United States Patent 8,999,380 (MODIFIED POLYNUCLEOTIDES FOR THE PRODUCTION OF BIOLOGICS AND PROTEINS ASSOCIATED WITH HUMAN DISEASE) - sequence listing, part 10

SEQ ID NO: 16372 - DNA, 2580 bp, Artificial Sequence
  Description of Artificial Sequence: Synthetic coding sequence
atgggcccttggggctggaagctgcgctggacagttgcacttctgttggcagctgccggcacagctgtgggggaccgctgcgagcgtaacgagttccagtgtcaggacggaaaatgtatcagctacaaatgggtgtgcgatggaagtgcagaatgccaagacgggtcggacgaatcacaggagacctgtctttctgtgacgtgcaaatctggtgatttttcatgcggcggccgcgttaatcgctgtattcctcaattttggagatgcgatggacaagtagattgcgacaatggcagcgatgaacaagggtgccctccaaagacatgctctcaggatgagtttagatgtcacgatggtaaatgcattagtcggcaatttgtgtgcgacagtgatagggattgcctcgatgggagcgacgaagcaagttgtcccgtcctgacctgcggaccagctagtttccagtgtaatagcagcacctgcatcccgcagctctgggcttgtgataacgacccggactgcgaggacggatcagatgaatggccccagaggtgtcggggactttacgtattccagggagactcttcaccatgcagcgcctttgagttccattgtctgtccggggaatgcatccacagttcttggaggtgtgatggcggcccagattgtaaagataaaagcgatgaggaaaactgcgcggtcgccacctgtaggccagatgagttccagtgctcagacgggaactgcatacacggtagcagacagtgtgaccgagagtatgattgcaaggacatgtctgacgaagtgggctgcgtgaacgtcactctttgtgaaggacccaacaaattcaaatgccactctggcgaatgcatcacactcgataaggtgtgtaacatggccagagattgcagagactggagcgatgagccaatcaaggaatgtggcacaaacgaatgcctggacaacaatggcgggtgcagtcacgtatgtaacgatctgaagataggggccgagtgcctgtgtcccgatggattccagctcgtcgcgcaacgaaggtgtgaagatatcgacgaatgccaagatccagatacctgcagccagctttgtgttaatctcgaggggggatacaagtgccaatgtgaggaaggctttcagctcgatcctcacaccaaagcgtgcaaggccgtcggaagtattgcgtacctcttctttactaacaggcacgaagtacgcaagatgactctggaccggagcgagtataccagtctgattcctaacctaaggaacgtggttgcgctggacacagaggttgcatccaacagaatatactggagcgatctgtcgcaacggatgatctgttcaacccagcttgacagggcccacggcgtgtcaagttacgacacagtgatctcccgcgacattcaggctccggacgggctcgcagttgattggatccacagtaacatatattggaccgatagtgtactgggcaccgtgtctgtcgctgataccaagggcgtaaaacgcaaaactttgtttagagagaacggaagcaaaccaagagcaatcgtggttgacccagtacacggcttcatgtattggaccgactggggaactcctgccaagataaaaaaggggggactgaatggtgtggacatctacagcctcgtcacagagaacatccagtggcctaacggtattactctggatctgctgagcggcaggctttactgggtggatagtaagttgcactccatttcgtcaatcgacgtgaatgggggcaacaggaaaacaatcttggaagatgagaagcgactggcccaccccttcagcctcgccgtctttgaggataaggtcttctggacggacatcataaacgaagctatctttagtgccaataggctgacagggtcagatgtgaatttacttgcagagaatctgctgtcccctgaggatatggtgctgtttcataacctgacacagccgcgaggggtcaactggtgtgagagaaccactttgtccaatggcggctgccagtacctgtgcctgccagctcctcagattaatcctcactcacctaagttcacttgcgcctgccctgatggcatgttgttggccagggacatgcgctcctgcctgaccgaagccgaagctgcggtggctacccaggagacgtcaaccgtgcgtctgaaggtttcgtctaccgccgtgcgcacacaacatactacaacacgtcccgtccctgacacctcccggctccctggcgcaacccctggcctgacaacagttgaaatcgttaccatgagccaccaggctttgggcgacgtggctgggagaggaaatgagaagaaacccagttctgtgagggcgctcagcattgtgctacccatcgtattgcttgtgttcctttgcctgggagtgtttctcctctggaagaactggaggctgaaaaacatcaacagcattaattttgacaaccctgtctaccagaaaaccaccgaagacgaggtccacatttgtcataatcaagacggatacagctacccatctaggcaaatggtgagcctggaagacgacgtcgct

SEQ ID NO: 16373 - DNA, 2580 bp, Artificial Sequence
  Description of Artificial Sequence: Synthetic coding sequence
atgggtccgtggggttggaaattacgttggacggtagcgctattactagcggcggcgggtacggcggttggtgatcgatgtgaacgtaatgaatttcaatgtcaagatggtaaatgtatatcgtataaatgggtatgtgatggttcggcggaatgtcaagatggttcggatgaatcgcaagaaacgtgtctatcggtaacgtgtaaatcgggtgatttttcgtgtggtggtcgagtaaatcgttgtataccgcaattttggcgatgtgatggtcaagtagattgtgataatggttcggatgaacaaggttgtccgccgaaaacgtgttcgcaagatgaatttcgttgtcatgatggtaaatgtatatcgcgtcaatttgtatgtgattcggatcgtgattgtctagatggttcggatgaagcgtcgtgtccggtattaacgtgtggtccggcgtcgtttcaatgtaattcgtcgacgtgtataccgcaattatgggcgtgtgataatgatccggattgtgaagatggttcggatgaatggccgcaacgatgtcgtggtttatatgtatttcaaggtgattcgtcgccgtgttcggcgtttgaatttcattgtctatcgggtgaatgtatacattcgtcgtggcgttgtgatggtggtccggattgtaaagataaatcggatgaagaaaattgtgcggtagcgacgtgtcgtccggatgaatttcaatgttcggatggtaattgtatacatggttcgcgtcaatgtgatcgagaatatgattgtaaagatatgtcggatgaagttggttgtgtaaatgtaacgttatgtgaaggtccgaataaatttaaatgtcattcgggtgaatgtataacgttagataaagtttgtaatatggcgcgagattgtcgtgattggtcggatgaaccgataaaagaatgtggtacgaatgaatgtttagataataatggtggttgttcgcatgtttgtaatgatctaaaaataggtgcggaatgtttatgtccggatggttttcaattagtagcgcaacgtcgttgtgaagatatagatgaatgtcaagatccggatacgtgttcgcaactatgtgtaaatctagaaggtggttataaatgtcaatgtgaagaaggttttcaattagatccgcatacgaaagcgtgtaaagcggtaggttcgatagcgtatctattttttacgaatcgtcatgaagtacgtaaaatgacgctagatcgttcggaatatacgtcgctaataccgaatttacgtaatgtagtagcgttagatacggaagttgcgtcgaatcgtatatattggtcggatttatcgcaacgtatgatatgttcgacgcaattagatcgtgcgcatggtgtatcgtcgtatgatacggtaatatcgcgtgatatacaagcgccggatggtttagcggtagattggatacattcgaatatatattggacggattcggttttaggtacggtatcggttgcggatacgaaaggtgttaaacgaaaaacgttatttcgtgaaaatggttcgaaaccgcgtgcgatagtagtagatccggtacatggttttatgtattggacggattggggtacgccggcgaaaataaaaaaaggtggtttaaatggtgttgatatatattcgttagtaacggaaaatatacaatggccgaatggtataacgctagatttactatcgggtcgactatattgggtagattcgaaattacattcgatatcgtcgatagatgtaaatggtggtaatcgtaaaacgatactagaagatgaaaaacgtctagcgcatccgttttcgttagcggtttttgaagataaagtattttggacggatataataaatgaagcgatattttcggcgaatcgattaacgggttcggatgtaaatttattagcggaaaatttattatcgccggaagatatggtattatttcataatctaacgcaaccgcgtggtgtaaattggtgtgaacgaacgacgttatcgaatggtggttgtcaatatttatgtttaccggcgccgcaaataaatccgcattcgccgaaatttacgtgtgcgtgtccggatggtatgctattagcgcgagatatgcgatcgtgtttaacggaagcggaagcggcggttgcgacgcaagaaacgtcgacggttcgtctaaaagtttcgtcgacggcggttcgtacgcaacatacgacgacgcgtccggttccggatacgtcgcgtttaccgggtgcgacgccgggtttaacgacggtagaaatagtaacgatgtcgcatcaagcgttaggtgatgttgcgggtcgtggtaatgaaaaaaaaccgtcgtcggttcgtgcgttatcgatagtattaccgatagttctattagtatttttatgtttaggtgtatttttattatggaaaaattggcgattaaaaaatataaattcgataaattttgataatccggtttatcaaaaaacgacggaagatgaagtacatatatgtcataatcaagatggttattcgtatccgtcgcgacaaatggtatcgttagaagatgatgtagcg

SEQ ID NO: 16374 - DNA, 2580 bp, Artificial Sequence
  Description of Artificial Sequence: Synthetic coding sequence
atgggaccatggggatggaagttgcgctggaccgtggccttgctcctggcagccgccgggaccgcggtcggagatagatgcgaaagaaatgaatttcagtgtcaggacggaaagtgcatctcgtacaagtgggtgtgtgatggctcagccgagtgccaggatggatcggatgagtctcaagaaacctgtctgtcagtcacctgcaaatccggagacttctcgtgcggtggacgggtgaaccgctgcatcccccagttctggcgctgcgatggtcaggtggattgcgataacggtagcgatgagcaaggatgccctccgaaaacttgctcgcaagacgagttcaggtgccacgacggaaagtgtatatccagacagttcgtttgcgactcagaccgggactgcctggatggctcggacgaagctagctgcccagtcctgacctgcggcccagccagctttcaatgcaattcatccacttgcattccgcagctgtgggcctgcgacaatgacccggactgcgaagatggatcggacgaatggccgcaaagatgtcgcggactgtacgtgttccaaggagattcgtcgccgtgctcggcgttcgaattccattgcctgtcgggcgaatgcatccacagttcatggcggtgcgacggtggacctgactgcaaggataagtcagatgaagaaaactgcgcagtggctacctgcaggccggacgagttccagtgctcagacggaaactgtatccacgggtcaagacagtgcgatagggagtacgactgtaaggatatgagcgatgaggttggatgcgtgaacgtcaccctgtgcgaaggaccgaacaagtttaagtgccattccggagagtgtatcaccctcgataaagtgtgcaacatggcaagggattgccgcgactggtcagacgaaccaatcaaggagtgcggtacgaatgagtgccttgacaataacggcggatgctcccatgtgtgcaacgatctgaagataggagccgaatgcctgtgtccagatggtttccagctggtggcccaacgccgctgcgaggatatcgatgaatgccaagatccggatacttgctcgcagctctgcgtgaacctggaaggaggatacaagtgccagtgcgaggaaggatttcagctggacccacacactaaagcgtgcaaggctgtcggctccattgcttacctgttcttcactaatagacatgaggtgcgtaaaatgaccctcgaccggtcagaatacacttccctcatcccgaacttgcgcaacgtcgtggccctcgacactgaggtcgcatcgaatcgcatctattggtccgacctctctcagagaatgatctgctcgacccagctcgaccgcgcgcacggagtgagctcatacgacactgtgattagcagagacatccaggcacctgacggactcgccgtggattggatccacagcaacatttactggaccgatagcgtgctggggaccgtgagcgtggcagacaccaaaggggtcaaaagaaaaactctgtttcgagagaacggatcgaagccgcgggcgatcgtcgtggatcccgttcacgggtttatgtactggaccgactggggaaccccggcaaaaatcaaaaagggaggtcttaacggagtggacatttactcgctcgtcaccgaaaacattcaatggccgaacgggatcaccctggacctgttgtctggacggctgtactgggtggattcaaagctgcactccatctcctccatcgatgtcaatggaggaaatcgcaagaccatcctggaggacgagaagcggctggcccacccattttccctggctgtctttgaagataaggtgttctggaccgacatcataaacgaagcgatcttctcagccaaccggctgacgggctcagacgtgaacttgctggcagagaatttgctgtcgccggaggacatggtactcttccacaacctgactcagccgagaggagtgaactggtgcgaaaggactaccctgtccaacggcgggtgccagtacctgtgcttgccggcaccacaaatcaatccgcattcgccaaagttcacctgcgcctgcccagacggaatgctgctcgctagggatatgcgttcgtgcctcaccgaggccgaggccgcggtggcaactcaggagacgtcgaccgtgagactcaaggtgtcatcgaccgccgtgcgcacgcagcatacgactacccgccctgtgccagatacctcgaggcttccaggggccacgcctggccttacgactgtggaaattgtgaccatgagccaccaggctctgggagacgtcgcaggccgcgggaacgaaaagaaaccatccagcgtgcgcgccctcagcatcgtgcttcccatcgtgctgttggtgttcctctgccttggagttttcttgctgtggaagaactggcggctcaagaacatcaactccatcaacttcgataatccggtctaccaaaaaactaccgaagatgaagtgcacatctgtcataaccaggacggatactcatacccttcacgccagatggtgtctctggaagatgacgtggcg

SEQ ID NO: 16375 - DNA, 2580 bp, Artificial Sequence
  Description of Artificial Sequence: Synthetic coding sequence
atgggtccttgggggtggaaactgcggtggacagtggccctgcttcttgctgccgcgggcacagcggtgggagataggtgtgaacgaaacgagttccagtgccaggacgggaaatgcatctcttataagtgggtatgcgacggcagtgctgaatgccaggacggctcagacgagtcccaagagacatgtttatccgtgacgtgtaagagcggcgacttttcatgtggaggaagagtgaatcgctgcatccctcagttttggcgctgtgacggccaggtggattgcgacaacgggtccgacgagcaaggctgtccaccgaaaacctgctcccaagacgagtttagatgccacgacggaaagtgcatctctaggcagtttgtatgcgattccgatagagattgcctcgacggttcggacgaagcttcctgccccgtgctgacctgcggaccagcctccttccagtgtaatagttcgacctgcatcccccagctgtgggcatgtgacaatgatccagattgtgaggacggttctgatgagtggccacagaggtgccggggcctctatgtttttcagggtgacagctctccatgtagcgcctttgagttccactgcctgagtggcgagtgcatccactcatcctggaggtgcgatgggggcccagactgtaaggacaagtccgacgaggaaaactgcgccgtggcaacatgtcggccagacgagtttcagtgctctgacggaaactgtatccatggatctcgccagtgtgatcgggagtatgattgtaaggacatgagtgatgaggtgggatgtgtgaacgtgactctttgcgaaggtcctaacaagttcaagtgccattcaggggagtgtattacgttagataaagtctgcaatatggctcgcgactgccgggattggtcagatgaacctatcaaagaatgtggcacaaacgaatgtcttgataacaatgggggttgttcacatgtgtgtaacgacctcaagatcggggccgagtgcctatgtccagacggctttcagctcgtcgcacagaggcgctgcgaagacattgatgaatgtcaggatcccgacacttgtagccagctctgtgttaaccttgagggtgggtacaaatgccaatgtgaggaagggtttcagttggacccccacaccaaggcgtgtaaagcggtgggttctatcgcttatctgtttttcactaatcggcacgaggttaggaagatgactctggacaggtcagaatacactagtctgattccaaacctgcgcaacgtagtggccctcgataccgaggtggcctcaaaccgtatctattggtccgacctgagccagcgtatgatctgttctacccagcttgaccgggcacacggcgtctcttcttatgataccgtcatctccagagacatccaggcgcctgatggactagcagtcgactggatccactccaacatatactggaccgacagcgtgctgggaactgtttccgtggctgataccaagggcgtgaagagaaaaactttattccgggagaacggctctaagccaagagcgatcgtcgtagatccagttcacggattcatgtattggacagattggggtaccccagcgaaaataaagaaaggtggattgaatggagtagatatctacagtttggtcaccgagaacatccagtggccgaacggtatcactcttgatctgttgagtggacgattatattgggtggactcgaagctgcacagcatctcatcgatcgatgtgaacggtggaaaccggaaaacgatacttgaggatgagaaacggttagcgcacccttttagtttggccgtgttcgaagacaaggtcttttggaccgacattatcaacgaggccatcttctctgccaaccggctaactggaagcgacgttaacctactggcggagaacctgttgtccccagaagacatggtcctgttccacaatttgacacagcctaggggggttaactggtgcgagcgaacaacgctgagcaacgggggatgtcagtatctctgcctgccggccccccaaattaatccccactccccgaagttcacgtgcgcttgccccgacggtatgctactcgctagagatatgcggtcatgtcttacagaagccgaggctgccgtggctacgcaggagacttcaactgtgcgactgaaggtgtccagtaccgccgttaggacccagcacactactacgagaccagtcccagatacttcacgcctgcccggggccacacctggcctgacaacagtcgagatagtgaccatgagccaccaggcgctgggagatgttgctggaaggggcaacgaaaagaagccgagttcagtgcgggccctatccattgttttgcccatcgtcctgctggtatttctctgtttgggggtttttctgctctggaaaaactggcggctcaagaacattaactccattaattttgacaacccggtctaccagaagacaactgaggacgaggttcacatctgtcacaaccaggacggctacagctacccatctcgtcagatggtgagcctggaagatgatgtcgcc

SEQ ID NO: 16376 - DNA, 2580 bp, Artificial Sequence
  Description of Artificial Sequence: Synthetic coding sequence
atggggccgtggggttggaaactgaggtggaccgtggccctcctgctcgcagccgctgggaccgcggtgggagatcgttgcgagcggaacgagtttcagtgtcaggacgggaagtgcatctcttacaagtgggtgtgcgacggatccgcagaatgccaagacgggtccgatgaatcccaggaaacctgcctgtccgtgacgtgtaaatcaggggatttttcctgcggcggacgcgtgaaccgttgcatccctcaattttggaggtgtgacggacaggtcgactgcgataatggcagcgacgaacaaggctgccctccaaagacttgcagccaggatgagttccggtgtcacgacggcaagtgcatctcgaggcagttcgtctgcgactcggacagagactgcctggatggtagcgacgaggcctcctgtccggtgctgacttgcggcccggcctccttccagtgcaactcatccacttgcataccgcagctgtgggcgtgcgacaacgatccggactgcgaggacggttccgacgaatggccgcagcgctgtcgcggactctatgtctttcaaggagactcgagcccttgctcggcgttcgaattccactgcctgtccggagaatgcatccatagctcatggaggtgcgatggtggcccggattgcaaggacaaatctgacgaggaaaactgtgcagttgcgacttgcaggccagatgaattccagtgctccgacggaaactgtatccacggatctcggcagtgtgatcgcgagtacgactgcaaagacatgtcagatgaagtgggctgcgttaatgtgaccctctgcgaaggaccgaataagttcaagtgccactccggagagtgcatcactctggataaggtgtgcaacatggcccgggattgccgcgactggtcggacgaacctatcaaggagtgtggaactaacgaatgcctggataacaacgggggctgctctcacgtgtgcaacgatctcaaaatcggagccgaatgcttgtgccctgatggcttccagctcgtggcgcaaagacgctgcgaagatatcgatgaatgtcaagaccccgacacctgtagccagctctgtgtgaacctcgagggagggtataagtgccaatgcgaagaaggattccagcttgacccccacaccaaggcatgtaaagccgtgggctccattgcgtacctcttcttcaccaacagacatgaggtcagaaaaatgactctggatcgctcagaatacacttccctcatcccgaatctgagaaatgtcgtggcactggacactgaagtggcctcgaaccggatctactggagcgacctctcccagcgcatgatctgtagcacccaactggaccgcgcgcatggggtgtcaagctacgatactgtgatttcacgggatattcaagcgccggacggactggccgtagactggatccattcaaacatctactggaccgatagcgtgctgggcactgtgagcgtcgcagatactaagggagtcaagagaaagacgctcttccgggaaaacgggtcgaagccaagagcaatcgtggtcgaccctgtacacgggttcatgtactggacggactggggaaccccggccaaaatcaagaagggagggctcaatggggtcgacatttactccctggtgaccgagaatatccagtggcctaacgggatcaccctcgatctgctttcgggtcgcctgtactgggtggatagcaagctgcatagcatatcatcgatcgacgtgaacggagggaatcgaaagaccatcctggaggacgaaaagcgcctggcccacccgtttagcctggccgtgttcgaggacaaggttttctggaccgacatcatcaatgaggcgatcttttccgcgaatcggctgaccggctcagatgtgaacctgctcgcggaaaatctcctgtcgccggaggatatggtcctcttccataaccttacccaaccccgcggcgtgaattggtgtgagcggactaccctgagcaacggcggatgccagtacctctgcctgccagcaccacagattaatccgcacagccctaagtttacctgcgcttgccctgatggaatgttgctcgcacgggacatgcggagctgcctcaccgaggctgaggctgcggtcgctactcaagagacttcgaccgtccggctgaaggtgtcatctacggcagtgcgcacccaacatactactacccggccagttccagatactagccgcctgccaggtgcaactccaggtctgactactgtggaaatcgtgaccatgagccaccaggccctcggtgacgtcgccggacgcggcaatgaaaagaagccaagctccgtgcgggcactctcgatcgtcctccccatcgtgttgctggtgtttctgtgcctcggagttttcctgctgtggaagaattggcgcttgaaaaacataaactcgatcaacttcgacaatccagtgtaccagaaaacgaccgaggacgaggtgcacatctgccacaatcaagacggatacagctacccgagccgccaaatggtgagcctggaggatgatgtggct

SEQ ID NO: 16377 - DNA, 2580 bp, Artificial Sequence
  Description of Artificial Sequence: Synthetic coding sequence
atgggaccttggggatggaaacttcgctggaccgtggcgctgctcctcgccgcggccggaaccgccgtcggcgatcggtgtgagcgcaacgaattccaatgccaagatggcaaatgtatctcatataagtgggtctgcgacggctccgctgaatgtcaggacggatctgatgagtcacaggaaacttgcctgtcagtcacttgtaagtcgggcgatttctcctgcggaggccgggtcaacaggtgcattccacaattctggcggtgcgacggtcaggtggattgcgacaatggatcagatgaacagggatgcccgcctaagacttgttcgcaggatgaattcagatgccacgacggaaagtgcatttcacgccagtttgtctgcgattctgaccgcgattgccttgacggctccgacgaggcgtcctgcccagtgctgacctgtgggcctgcgtcctttcaatgcaactcctcgacgtgtatcccgcagctgtgggcttgcgacaacgacccagattgcgaagatggctcagatgagtggccccaacgctgtaggggactgtacgtgtttcaaggagactcttcaccatgctcggcatttgaattccactgcttgagcggagaatgcatccacagctcgtggcgctgcgatggcgggccagactgcaaggacaagtccgatgaagaaaactgcgctgtggcgacctgcagaccagatgaatttcagtgctcggatggcaactgcatccatggctcacgccagtgtgaccgggagtacgactgcaaagatatgtcggacgaagtgggttgcgtcaacgtgactctgtgtgaaggaccaaacaagttcaagtgtcactcgggagaatgcattactctggacaaagtctgcaatatggctagagactgcagggattggtcggacgaaccaatcaaggaatgtggaaccaacgagtgcctggacaataacggaggatgctcccacgtctgcaatgatctgaagatcggggccgagtgcctctgccccgacggctttcagctggttgcgcagaggcgctgtgaagatatcgacgaatgccaagatccagacacctgctcgcagctgtgtgtgaatctcgagggcggatacaagtgtcaatgtgaggaggggttccagctggatccccacaccaaggcatgcaaggcagtcggctcgatcgcctacctgttcttcactaatcgccacgaggtgcggaagatgactctggaccggtcagagtatacgtcgctgatacccaatctccggaatgtggtggccctggacactgaagtggcttcgaacagaatctactggagcgatctctcgcagagaatgatctgtagcacccaactggaccgggcccatggagtgtcaagctacgacactgttatttcacgtgatattcaggcgccggacggtttggctgtggactggatccactccaatatctactggacggacagcgtcctgggcaccgttagcgtggcggatactaaaggcgtgaagaggaaaaccctctttagggaaaatggatccaaaccgcgagcaatcgtggtggatccggtccacggattcatgtattggaccgattggggaaccccggctaagattaagaaaggaggactcaacggagttgacatttactctctcgtgaccgagaacatccagtggccaaacggaatcactctggatctgctgtcaggcagactgtactgggtcgactcgaaactccactcaatctccagcatcgatgtgaacggcgggaatcgcaaaactatcctcgaagatgaaaagaggctggcacacccgttctccctggccgtgttcgaggacaaggtgttctggaccgacatcatcaacgaagccatcttctcagcgaatcggctgactgggagcgacgtgaacctgctcgccgaaaatctcctgtcaccggaggacatggtgttgttccataacttgactcagccaagaggcgtgaactggtgcgaaagaactaccctgtccaacggtggatgccagtacctgtgcctcccggctcctcagattaatcctcactcgccgaagttcacttgtgcgtgtccggatggtatgctgttggcccgtgatatgcgctcctgtctgactgaggcagaagcagcggtcgccactcaggaaacctccaccgtgcggctcaaggtgtccagcaccgcagtgcggactcaacatacgactactcggccagtgccagatacctcacggctgccgggggcgactccgggtctgaccaccgtggagatcgtcacgatgtcccaccaggcactgggagacgtggccggaagaggcaacgagaagaaaccctcatcggtgagagcactgtcaattgtgctgcccatcgtcctgctggtgtttctgtgcctgggcgtattcctcctgtggaaaaactggcgcctgaagaacatcaactcgattaacttcgacaatcccgtgtaccagaaaaccaccgaggacgaagtgcacatctgtcacaaccaagacggatacagctacccttcgagacagatggtgagcttggaagatgacgtggcg

SEQ ID NO: 16378 - DNA, 2580 bp, Artificial Sequence
  Description of Artificial Sequence: Synthetic coding sequence
atgggcccgtggggatggaaacttcgatggactgtcgcactgctcttggccgccgccggtacagcagtcggcgatcggtgtgagaggaacgaattccagtgccaagacgggaaatgcatcagttacaaatgggtctgtgacggctccgccgaatgccaggatggtagcgacgaatctcaagagacttgcctcagcgtgacctgcaagagtggggatttcagctgcggcggtcgggtcaatagatgtattcctcagttctggcgatgtgacggtcaggtagattgcgacaatggctccgatgagcaagggtgccctcctaaaacatgttctcaggatgagtttcgatgtcacgacgggaaatgtatatctaggcaattcgtttgcgactctgatagggactgtttggacggatccgacgaagctagttgtcctgtgcttacttgtggacctgcgtcatttcagtgtaatagttcgacgtgcatacctcagctctgggcctgtgataatgaccctgattgcgaagatggatcagatgagtggccacagcgatgccgtggcctgtatgtctttcagggcgatagttctccctgcagcgccttcgaattccactgcctgtctggcgaatgtattcacagctcatggcgatgcgacggtggaccagattgtaaagacaagtcggatgaggagaactgtgcagtggcgacctgtaggcctgatgagttccaatgttcagatggcaactgtattcatggaagtcgacagtgcgatagggagtatgattgcaaagacatgtcagatgaagttggctgcgtaaacgtcactctgtgtgaggggcccaacaagttcaaatgccattccggtgaatgcatcacgctggataaagtgtgtaacatggctagggactgcagggattggtctgacgagccaatcaaggaatgcggaactaatgagtgcctagacaacaatggaggatgtagccacgtgtgcaatgatctgaaaattggtgcagagtgcctgtgccctgacgggtttcagctcgtagctcagcgaaggtgcgaggacattgatgaatgccaggatccagacacgtgttcacagctatgtgtcaacctggagggtggatataagtgccagtgcgaagaaggttttcagctcgacccccacacaaaggcttgtaaagccgtgggttccattgcttacctgttcttcaccaatcgacacgaagtgaggaagatgacccttgacagaagcgaatacacctcgttaatccctaatctccgaaacgttgtagctctggacaccgaggtggcctccaaccgaatctattggagtgacctcagccagcgaatgatctgttccacccagcttgacagggcgcatggtgtatcgtcttatgacaccgtgatctcacgagatatccaggcccctgacggactggccgtcgattggatccactccaatatttactggactgattctgttctggggactgtctccgtggccgatacaaaaggtgtgaaacgaaagaccctctttagagagaacgggagcaagccgagagctatcgtggtggaccctgtgcacgggtttatgtattggaccgattgggggacccccgccaagattaaaaagggcggcctgaacggagtagatatttacagccttgtgaccgaaaatattcagtggccaaatggcatcaccctggatcttctcagcggccgactgtattgggtagatagtaaactacacagcatatcaagtattgacgttaacggaggtaacaggaaaactatcctagaagacgaaaaacgcctggctcacccattctctctggccgtctttgaggacaaggtgttttggacggatattatcaacgaagcaatcttcagtgctaatcgattgacaggcagtgacgtgaacctgctggcagaaaatctcctgtcgcccgaagatatggttctgttccacaatttgactcagccgagaggagtaaactggtgtgagcgtacaacgttgtcgaatggggggtgtcagtatctgtgcttgcccgcaccccagattaatcctcactctcctaagttcacctgtgcatgcccggacggaatgttgttggccagagacatgcgaagctgcctaaccgaggcggaggccgcagtggcgacacaggaaacctcaaccgtcaggcttaaggtgagttccaccgcagttagaacacagcacacaaccactcgacctgtgcccgacacctcacgacttccaggggcaaccccaggactgacgacagtcgagatcgtgacgatgtcccatcaggccctcggagatgtggcaggccgaggtaacgagaaaaagccttcatcagttcgggcattgagcatagtcctgccaatcgtgctgctggtgttcctgtgtctgggtgtgtttctgctgtggaagaactggaggttaaagaacatcaactcaattaactttgacaatcccgtttatcagaaaaccacagaggatgaagtgcatatctgccacaatcaagacgggtatagctatccttctaggcagatggtgtcactggaggatgacgtcgct

SEQ ID NO: 16379 - DNA, 2580 bp, Artificial Sequence
  Description of Artificial Sequence: Synthetic coding sequence
atggggccatggggatggaaattgcgatggacagtcgccttactgttagccgcagctgggacagcagtgggggatagatgtgaaagaaacgaattccagtgccaagatggaaaatgtatctcttataaatgggtctgcgatggaagtgcggaatgccaggatgggtcagacgaatcccaagaaacttgtctctcagtcacatgcaaaagtggggatttttcctgtgggggaagggtcaaccgatgcatcccccagttttggcgctgcgatgggcaggtagattgtgataacggatcagatgaacaggggtgccctcccaagacatgctcgcaggatgaatttaggtgccatgatgggaaatgtatctctagacagttcgtgtgtgattcagatcgagactgtctcgatggatccgatgaagcctcgtgtcccgtgcttacatgtgggccagcatcctttcagtgcaactccagtacttgtatcccacagctctgggcttgtgataacgatcctgactgcgaggacgggtccgatgaatggccgcagcgctgtagggggctttatgtctttcagggggattcctcgccttgctccgcttttgaatttcactgcctctcaggggagtgcatacattcatcttggcgatgtgatgggggacccgactgtaaagataagtctgatgaagaaaattgcgctgttgccacgtgccgtcccgatgaattccagtgttctgatggaaactgtattcacggatcccgacagtgcgacagagaatatgattgcaaagatatgtccgatgaggtggggtgtgttaacgtaacactctgtgaaggacccaacaaatttaaatgccactcaggggaatgtattactcttgataaggtgtgtaatatggcacgggattgccgggattggtccgatgaacccatcaaagaatgtgggacaaacgaatgcctggataataatggaggatgttctcatgtttgtaacgatttaaaaataggagccgaatgcctctgtcctgatggatttcagttggtcgcccagcggcgatgtgaagatatagacgaatgccaggatcccgatacttgctcacagctctgtgtcaacttggaagggggatataaatgtcagtgtgaagaaggatttcagttagatccacacactaaagcttgtaaagccgtgggatccatcgcctatctctttttcacaaaccggcacgaggtgagaaaaatgactctcgacaggtctgaatatactagtctgataccaaatctcaggaatgttgtggctctggatacagaagttgcttcaaatagaatctactggtcagatctctcacagcgcatgatttgttccacacagctcgatagggctcacggggtctcatcatatgatactgttatatctcgtgatatacaggctcccgatgggctcgccgtcgattggatccactctaatatatattggactgattccgtcctcggaacagtctccgtcgctgacacaaaaggggtgaaaaggaaaactctctttagagagaatggaagtaagccacgagccatagtggtggatcctgtacatgggtttatgtattggactgattggggaacacccgccaaaatcaaaaaagggggacttaatggggttgatatctattcattggtaacagaaaatatccagtggcccaacgggatcactttagatcttctatccggacggctgtactgggtcgactcaaaactccattcaatctcttccatagatgtgaacggagggaatcggaaaacaatcttagaggatgaaaaacgcttagcccaccccttctctctcgcagtatttgaagataaagtcttctggactgatatcatcaacgaagcaatattctcagctaaccgattaactggatcagatgtcaacctcctcgctgaaaatctgctgtcacctgaagatatggtcttattccacaaccttactcagcctcggggggtcaattggtgtgaaaggactacactctctaatggggggtgtcagtacttatgtttgcccgcacctcagatcaatccacactctccaaaattcacatgcgcttgtcctgatggaatgttgcttgcacgcgatatgaggtcgtgtctcacagaagctgaagcagctgtggcaactcaggaaacttctacagtgaggctcaaagtttcctctactgcagttcgcacacagcacacgacgacacgcccagtgcccgatacttccagactacctggagccactcctggattgactactgtggagatagtaactatgagtcatcaggcactaggggatgttgcggggagaggaaacgaaaaaaaaccatcctcagtacgggccctttctattgttctgcccattgttctcctggttttcctttgcctgggagtttttctcctctggaagaattggaggctcaaaaatattaattctatcaactttgacaacccagtctatcagaaaacaacagaagatgaggtgcatatatgtcacaaccaggatgggtattcatatccttcgaggcagatggtctctcttgaagatgacgtagct

SEQ ID NO: 16380 - DNA, 2580 bp, Artificial Sequence
  Description of Artificial Sequence: Synthetic coding sequence
atgggaccttgggggtggaagctgcgttggacggtagctctcctgctagccgccgccggaactgccgtgggtgacagatgcgaacgtaacgagttccagtgccaggacggaaaatgcatctcttacaagtgggtctgcgatgggagtgccgagtgccaggatggctctgacgagagccaggaaacatgcctgtctgtgacatgcaaatcaggagatttctcctgcgggggccgcgtgaataggtgcatcccgcaattctggagatgcgatggccaagtggactgtgacaatggcagtgacgagcaagggtgccccccaaagacatgctcacaagacgagttccggtgccatgacggaaaatgcatctctagacaatttgtgtgcgattctgatcgcgattgccttgacgggagtgacgaagcctcatgtccagtcttgacttgtggaccagctagtttccagtgtaattcgtcgacttgcatcccccagctgtgggcctgtgacaatgacccagactgcgaggacggatcagacgagtggcctcagagatgcagggggctgtatgttttccagggggattcctccccttgttctgccttcgagtttcattgtctgtccggggagtgcattcattccagttggcgatgtgacggtgggcctgactgtaaggacaagtcggacgaggagaattgcgccgtagcaacctgccggccagacgagtttcaatgctctgatgggaactgcatccatgggagccggcagtgtgacagggagtacgattgcaaagacatgtccgatgaagtgggttgcgtgaacgtgaccctgtgtgaaggtcctaacaaattcaaatgtcatagcggagaatgcataaccttggataaggtatgcaacatggcccgggattgccgagactggtcagacgagccaattaaggaatgcgggaccaatgagtgcttggacaacaatggcggctgttctcacgtgtgcaacgacttaaaaataggagcagagtgcctttgccccgacggatttcaactggtagctcagcgccggtgcgaagacatagacgaatgccaggaccccgatacatgttcccagctgtgtgtgaacctagagggcggatacaagtgtcagtgtgaggagggctttcaactggatccccacaccaaggcctgtaaagctgtcggctctatcgcctacctgttcttcactaaccgccacgaggtaagaaagatgactctcgaccggagtgagtacacatccctgatcccaaaccttcgcaatgtcgtggctctggacacggaggtagcttcaaatagaatttactggtccgatttatctcagcggatgatttgctccacacagctggaccgggcccacggggtctcgtcatacgataccgtcatatctcgcgatattcaggcaccagatggattagcagtcgactggatccactccaatatttattggaccgatagcgtcctgggaacagtttccgtggcagataccaaaggcgtcaaacggaaaacattattcagggagaatggatcaaaacctcgagcgattgttgtcgacccagtgcatgggttcatgtattggacagattggggcaccccagcgaagatcaaaaagggggggctaaacggcgtggatatatacagcctcgtcacagagaatatccagtggcccaatgggattacactcgatttgctgagcgggcgcttgtattgggtggactcgaaactccattctatcagttctatcgatgtgaatggcggaaatcgtaagacgatccttgaggacgagaagaggctcgctcatccattctcactggccgtgtttgaagacaaggtgttctggactgacatcatcaatgaagccatattctccgcaaaccggctgactggcagcgacgtgaacctgctggctgaaaatctcctcagtccggaggatatggtcttgtttcataacttgacccaaccccgaggagtcaactggtgtgaaaggacaactctcagtaacggcgggtgccagtacctgtgcctgccagccccgcaaattaatccccacagccctaagtttacttgcgcttgcccagacgggatgctgttggcccgggatatgcgtagctgtcttactgaagctgaagcggccgtggcaacccaggagactagtacggttcgtcttaaagtgagcagcaccgccgtgagaacccagcataccactacacggcccgtgcctgacaccagtagactgcccggggcaacacccggccttaccacagtcgaaatagtcaccatgtcacatcaagctctcggcgacgttgcagggagaggcaatgagaaaaagccaagttccgtgcgggccctgtctatcgtacttcccatagtcctgttggtgttcctctgcctcggtgtctttctcctgtggaaaaactggcgcctgaaaaacatcaacagcataaattttgacaatccggtctaccaaaagaccaccgaggacgaagtgcatatctgccataatcaggatgggtactcttatccatccaggcagatggtgtcactggaagatgacgtggcc

SEQ ID NO: 16381 - DNA, 2580 bp, Artificial Sequence
  Description of Artificial Sequence: Synthetic coding sequence
atgggaccctggggatggaagctgcggtggactgtggcgcttctcctagcagctgccggaactgccgtgggagatcgctgcgagcggaatgaattccagtgccaggatggaaaatgcatatcctacaaatgggtgtgcgatgggtccgctgaatgccaagacggatctgatgaaagtcaggaaacttgccttagtgtcacatgcaaatccggagatttttcttgcggggggcgggtaaatagatgcattccacagttctggaggtgtgatgggcaggttgattgcgataatggatccgacgaacaggggtgtcctcctaagacgtgctctcaggatgaattccggtgccacgacggaaaatgtattagtagacagttcgtttgtgacagtgatagggattgcctagatgggtctgacgaagcatcctgccccgtcctcacttgtggacccgcttccttccagtgcaattcctctacatgcatccctcagctgtgggcctgcgataacgatcccgattgtgaagacgggtccgatgaatggccccagaggtgtcgggggctctacgtgttccagggagattcttccccttgctccgcttttgaatttcattgtttatccggagaatgtatccattcctcatggcggtgcgatggagggcctgattgcaaagataaatctgatgaagaaaattgtgccgtagctacatgccggcctgatgaattccaatgttctgatggaaattgcatccatggaagtaggcagtgtgatcgcgaatatgattgtaaagatatgtccgatgaagtcgggtgtgttaatgtgacactgtgtgagggacctaacaaattcaagtgccactctggagagtgtattactctcgataaagtctgtaacatggcacgtgactgcagggattggtccgatgaacccatcaaagaatgtggaacaaatgaatgtcttgataacaatggaggatgcagtcatgtgtgcaatgacctgaaaatcggagctgaatgcctctgtccagatggattccagctggtggcacagcgccggtgcgaagatattgatgaatgtcaggatccagatacttgctcccagttatgcgtgaacctggaggggggatataaatgccagtgcgaagaaggattccagctcgatccacacacaaaagcctgtaaagctgtggggagtatcgcctatctctttttcacaaacaggcatgaagtacgcaaaatgactttagatcggtcagaatatactagtttaataccaaatcttaggaacgtggtagctctcgacacagaagtagcgtctaaccggatctattggtcagatctaagtcagcgcatgatctgtagtactcaactcgatcgggcacatggagtatcctcttatgatacagttatatcacgcgatattcaggcacctgatggactcgcggtggattggattcacagtaatatctactggactgattcagtcctgggaactgtcagtgtagcagatactaaaggggtgaaacgaaaaactctttttcgggaaaatgggtccaaaccacgcgccatcgtggtggatcccgttcatggatttatgtactggactgattgggggactcccgccaaaatcaaaaaaggagggcttaacggagtggacatatattcccttgtgacagaaaatatacagtggcccaatgggataacactcgacctgctgtccggaaggctatactgggtagattccaagctgcactcgatatcttccatcgatgtcaacggaggaaaccggaagactatccttgaagatgaaaaaaggctggcccaccccttctctctcgccgtgttcgaagacaaggtcttttggactgatatcataaatgaagctattttttccgctaaccgactaactgggagtgatgtgaatctcctagctgaaaacctcctttcacctgaagacatggtgctctttcataatttaacacagccaaggggagtaaattggtgtgaacggacaactctatcaaatggagggtgccagtacctttgcctccccgcccctcaaatcaatccacatagtcccaaatttacatgtgcctgtcccgatgggatgctactggctcgggatatgcgatcttgtctcacagaagccgaggcagccgtggccacacaggagacttctacagtccggctaaaagtgtcgagtacagctgttaggacacagcatactacaactcgccccgtacccgatacaagtcggctcccaggggccacacctggattaacaacagtggaaatcgtaacaatgtctcaccaggccttgggggatgtcgcggggcgcgggaacgaaaaaaaaccctcctctgtgagggcattaagtattgttctgcctatcgtcctccttgtcttcctatgcctcggagtattcctgctttggaaaaactggcgactgaaaaatatcaatagtatcaatttcgataatcccgtttaccaaaaaacaactgaagatgaagtgcatatatgccataaccaggatgggtactcttatccaagtcggcagatggtgtctctggaagatgatgtggct

SEQ ID NO: 16382 - DNA, 2580 bp, Artificial Sequence
  Description of Artificial Sequence: Synthetic coding sequence
atgggtccttggggatggaaacttcggtggactgtcgcgctgctgttggctgccgcgggcacggcggtaggtgatcgctgcgaacgaaacgagttccaatgccaagacggcaagtgtattagctacaaatgggtctgtgacggctctgcggaatgccaagatggctctgatgagagccaggaaacgtgtctgagcgttacttgtaagagtggggacttcagctgcggtggacgagttaaccgctgcatacctcagttttggcgatgcgatggccaggttgattgtgataacggttcagatgaacaaggttgtcctccgaaaacctgcagccaagatgaattcaggtgccacgatgggaagtgtatctcccgccagttcgtttgtgattctgaccgggactgcttggacggatctgacgaagccagctgcccggtcctgacttgtggccctgcctcgtttcagtgcaactctagcacttgcattccacagctgtgggcgtgcgataacgaccctgactgcgaggacggcagcgatgagtggccccagcgttgtcgaggtctgtacgtgttccaaggcgacagctccccttgttctgcctttgagtttcattgcttgagcggcgaatgcatacactcttcttggcgctgtgatgggggcccggattgtaaggacaagagtgacgaagaaaattgcgccgtggcgacctgccgtcctgatgagtttcagtgctctgatggtaactgtattcacggcagccgccaatgtgatcgcgaatacgactgtaaagatatgagcgatgaggtgggctgtgttaacgtcaccctgtgtgagggtcctaataagttcaagtgtcatagcggagaatgtattactttggacaaagtttgtaacatggcacgcgattgccgcgactggagtgatgagccgattaaggagtgcggcactaacgagtgcctggacaataacggtgggtgctctcacgtttgcaatgacctgaaaatcggggccgagtgcctctgtccagacggctttcaactggttgcacagcgacgttgtgaagacatcgacgagtgtcaggacccggatacctgtagccaactttgtgtgaatttggagggtgggtacaaatgtcagtgtgaagaagggttccagctggatccacacacgaaagcctgtaaagctgttggttcgatcgcatatctgttctttacgaaccgtcacgaggtccgtaagatgactctggaccgatccgagtatacctcgctgatcccgaacctgaggaatgttgtcgccttggatactgaagtggcaagcaatcggatttattggtccgatctgagccaaaggatgatctgttccacccaactggaccgggctcatggtgttagcagctatgacacggtaataagccgggacattcaagcaccagacggcctcgccgtggattggattcatagcaatatttactggaccgatagcgtgctcggcaccgtgtccgttgcggacaccaaaggtgtcaaaaggaaaacgctcttccgcgagaatggaagtaaaccacgcgctatcgttgtagacccggtccacggttttatgtactggactgactggggtacgccagccaaaatcaagaagggcggattgaacggggtagacatctacagcttggtgaccgagaatattcaatggccgaacggtattaccctggacctcctgagcggacggttgtactgggtggattctaagctgcattccatttccagcatcgatgttaacggtggtaacaggaagaccatcctcgaagatgaaaagcgtctggcccacccatttagcctggccgtattcgaggataaggtgttttggaccgacattataaatgaggcgattttctctgcaaatcgcctgacgggtagcgacgttaacctgctggcggagaatctactctcccctgaagacatggtcctgttccacaatctgactcaaccacgaggagtcaactggtgtgaacggaccaccctgtctaacggcggctgccaatatctgtgcttgccagccccgcagattaatcctcattctccgaagttcacctgtgcctgtccagatgggatgctgctggcgcgggacatgcgcagctgtctgacggaagcagaagcggcagtagcaacccaggagaccagcaccgttagactgaaagtaagcagtacggcagtccgtactcaacacaccacgacgcgcccggtccctgatacctcccgcctgccgggtgccacccccggcctgacgaccgtggaaatcgtcaccatgagccaccaggccctgggtgacgtggcgggtcggggtaatgagaagaaaccgagcagcgtgcgcgctctgagcatcgttctgccaatcgttttgctggtttttctgtgtcttggtgtctttttgctgtggaagaactggagactcaaaaatattaatagcattaacttcgataacccagtgtatcaaaagaccacggaggacgaagtgcacatttgccacaaccaggatggctattcttatccttcacgccagatggtgtctctggaggacgacgttgcg

SEQ ID NO: 16383 - DNA, 2580 bp, Artificial Sequence
  Description of Artificial Sequence: Synthetic coding sequence
atgggcccatggggctggaagctccggtggacagtggctctgttgcttgccgctgcggggacggctgttggggatcgatgtgagcgcaatgagttccagtgccaggacgggaagtgtatatcatataaatgggtctgtgatgggtccgcagaatgtcaggacggctccgacgagtctcaggaaacctgcctttccgtaacgtgtaagtcaggcgacttttcctgcggtggtagggtgaatagatgtattccccagttttggaggtgcgatggccaggtggactgcgataatggaagtgacgaacagggttgtcccccgaagacatgctcccaagacgagtttcggtgccacgacggcaagtgtattagcaggcagtttgtgtgtgactccgacagggattgtcttgatggttctgacgaggctagctgccctgtcctcacatgtggcccggcctcattccagtgcaactccagtacctgcatccctcaactgtgggcgtgtgataatgaccctgattgcgaagatggaagtgacgagtggcctcagagatgtcgagggctgtacgtgttccagggcgattcctccccgtgttctgctttcgagtttcactgtctttcaggggaatgcattcattcaagctggcgatgcgatggaggaccagattgcaaggacaagtctgatgaagaaaattgtgcagtcgctacatgtcggcccgacgagtttcagtgctccgatgggaattgtattcacggctccagacaatgcgatcgggaatatgactgtaaagacatgtctgatgaggtaggatgcgttaacgtgaccctgtgcgaggggcctaacaagtttaaatgtcactccggtgagtgtatcacactggacaaggtgtgtaacatggcccgggactgccgggactggtctgacgagccgattaaagagtgtgggactaatgagtgcctggacaacaatggaggctgctctcatgtttgtaacgatctgaaaattggtgcagagtgtctgtgtcctgatgggtttcaactggttgctcagcgccgctgcgaggacatcgatgaatgtcaggaccctgacacttgctcccagctttgtgttaacctggagggcggctataagtgtcagtgtgaagagggcttccagttggacccgcatacaaaggcctgcaaggctgtaggctccattgcctacctcttcttcacaaatcgacatgaagtgcgcaagatgacattggacagatcagagtacacctctttgatccctaatttgcggaatgtggtcgccctcgataccgaggtggcgtcaaacaggatctattggtctgatctgtctcagcggatgatttgttctactcagctcgaccgggctcacggggtctcctcatatgataccgtgatctcaagggacattcaggcccctgacggccttgccgttgattggatacattccaatatatattggaccgatagcgtgctcggtaccgtcagtgtggccgacacgaagggagtgaagcgcaaaactctcttcagggaaaacgggagtaagccaagggctatcgtggtcgatcccgtgcacgggttcatgtactggacagactgggggacaccagccaagataaaaaaaggaggcctgaatggcgtggatatttatagcttggtgaccgagaacatacagtggcccaatggtattactctcgatctgctgtcaggtaggctgtactgggtggactctaaattgcatagcatatctagcatcgacgtgaacggcggtaatcggaagacaatcctggaggacgagaagcggcttgcccaccctttttctctggccgtttttgaggacaaagtattttggacggatatcattaacgaagctatcttcagcgctaacagactgaccggctcagacgtgaatctcctcgctgagaatctgctctccccagaggacatggtgcttttccataacctgacccagcccaggggggtgaattggtgtgagaggacgactctttccaatggaggttgccagtacctgtgtctgcccgcgccgcagattaatcctcactctcccaagttcacatgtgcgtgtccggatggtatgctgctggcccgggatatgagatcctgtctcacagaagctgaggctgcagttgctactcaggagactagcacagtaaggctgaaggtgagttcaactgcagtgcgaactcagcacacaactacaaggccagttcctgacacttccaggctgcccggcgcaaccccgggtctcaccacagtcgaaatcgttacaatgtcccaccaagcccttggggatgtggccgggcgcgggaatgagaagaagccttcatcagtgcgggccctgtccattgttttgcccatcgtcctgctcgtgtttctctgcctgggcgtcttcctcctctggaagaactggaggctgaaaaacatcaactctatcaactttgacaatcctgtgtaccagaagactaccgaggacgaggtccacatatgtcataatcaggatggatactcctacccctcccgccaaatggtgagtctggaggacgacgtggcc

SEQ ID NO: 16384 - DNA, 2580 bp, Artificial Sequence
  Description of Artificial Sequence: Synthetic coding sequence
atgggtccttggggttggaagctgagatggactgtcgcacttctgctcgctgcagcaggtaccgcagtcggagatcggtgtgaacgaaacgaatttcagtgccaagatgggaagtgtatctcgtacaagtgggtttgcgacggttcagcagaatgccaagatggttccgatgaaagccaagagacttgtctctcggtcacctgcaagagcggtgatttttcctgtggtggccgcgtcaatcggtgtattcctcaattttggagatgtgacggacaggtggattgcgataatggatcagatgaacaaggctgcccaccaaaaacttgttcccaagacgagtttcgttgtcatgatggcaagtgtatctcccgtcaattcgtgtgtgattcagatcgcgattgccttgatgggtcagatgaagcatcttgccccgtgctcacttgcggaccagcgagcttccaatgtaactcgagcacctgtataccacaactgtgggcgtgcgataacgacccggactgtgaagatggaagcgatgaatggcctcagcgatgcaggggcctttacgtgttccaaggtgactcctcgccgtgctcagcgttcgaatttcattgtctttccggagaatgcattcattccagctggcggtgtgatgggggtcctgactgtaaagacaaatcggatgaggagaattgtgcagtcgctacctgtagacctgatgaatttcaatgttcagacggaaactgcatccatgggtcgcggcaatgtgaccgcgaatacgattgtaaggacatgtcagacgaagtgggatgcgtgaatgtcactttgtgcgaaggacctaataagttcaagtgtcacagcggagaatgtatcacccttgacaaagtgtgtaatatggcccgcgattgcagagattggtcagatgagccgattaaggaatgtggcaccaacgaatgccttgataacaacgggggatgttcccacgtgtgcaatgacctcaaaatcggagccgagtgtctgtgcccagacggttttcagctcgtcgcgcaacgtagatgtgaggacattgatgagtgccaagacccagatacgtgttcacaactgtgtgtcaacctggagggagggtacaagtgtcagtgtgaggagggcttccaactggatcctcataccaaggcatgtaaggcagtcggaagtatagcatacctcttcttcactaacaggcatgaggtgcgcaagatgaccctcgatcggtcggagtacacctctcttattcctaaccttcgtaatgtggtcgcgcttgataccgaagtcgcttcaaaccgtatttactggtcagacctttcgcaaagaatgatatgtagcacccagctggatagagcgcacggtgtgtcctcttacgacactgtgatttcccgagatattcaagcaccggatggacttgcagtcgactggattcactcaaacatctattggaccgactcggtccttggtactgtgtccgtggcggatacgaaaggagtgaaacggaaaactctgtttcgcgaaaacggttcaaagccaagagcgattgtggtggaccctgtgcatggattcatgtattggacggattggggtacccctgcaaagatcaagaaaggggggctgaacggcgtcgatatctactcgctggtcaccgagaatattcagtggccaaacggaattactcttgatttgctctcgggtagactgtactgggtggattcgaagctccattcgatttcgtcaatcgatgtcaacggtggcaaccgaaagacgatcctcgaagatgagaaaagactcgcacatccgttttccctcgcagtgtttgaagataaggtgttttggaccgatatcataaacgaagccattttctccgcaaaccggctgactggttccgatgttaaccttttggccgaaaatctgctctcgccagaggatatggttcttttccataacctgactcaaccgcgtggagtgaattggtgcgaacgaaccactcttagcaatgggggttgccagtacctctgtctcccagctccacagataaaccctcactcacctaagttcacttgtgcgtgccccgacggaatgctgctggctcgtgacatgcggagctgtttgactgaagcagaagcagctgtggcgactcaagaaacctcaaccgtaagactcaaggtgagctcgactgcggtgaggactcagcacacgaccaccaggccagtgcctgatacgtcccgcctgcctggagcaactcccggtttgaccaccgtcgagattgtgactatgagccatcaggcattgggtgatgtggcagggcggggtaatgagaagaaaccctcgtctgtgagggcactgtcgattgtgttgcctattgtactgcttgtgtttctctgccttggagttttcctgctttggaagaattggcgtctgaagaatatcaactcgatcaacttcgataacccggtctaccagaaaaccactgaggatgaagtgcacatctgccataaccaagacggttactcatacccttcccgccagatggtatctcttgaagatgatgtcgca

SEQ ID NO: 16385 - DNA, 2580 bp, Artificial Sequence
  Description of Artificial Sequence: Synthetic coding sequence
atgggcccctggggttggaagctgcggtggaccgtggccctcttgctggctgcagccggaactgccgtcggcgaccgatgtgagcgtaacgagtttcaatgccaggatgggaagtgtatcagctacaagtgggtgtgcgatggaagcgccgagtgtcaggatggcagtgacgaatcccaggagacgtgtttaagcgtgacatgtaaatctggtgacttcagctgcggaggtcgagtcaaccggtgtattccgcaattttggaggtgcgacggtcaggtcgactgtgataacggatccgatgaacagggctgtccccccaaaacgtgctcacaggatgaatttaggtgccatgatggtaagtgcataagcaggcagtttgtgtgtgacagtgatagggattgcctggatggatcagacgaggcatcctgcccagtgctgacgtgtgggcctgcgtcctttcagtgtaactcctcaacctgtataccacaattgtgggcctgtgacaacgaccctgattgcgaggatggcagcgacgaatggccccagcgctgccgaggactttatgtgttccagggcgactccagcccctgtagtgctttcgagttccactgcttgtccggtgagtgtattcatagctcctggcgatgcgacgggggccccgattgtaaagataagagcgacgaagaaaactgtgctgtggctacctgccgtccagacgaatttcaatgttccgacggcaattgtatacacgggtcacgacagtgcgaccgtgaatacgactgtaaggacatgtcagatgaggtgggatgcgtgaacgtgacgctctgcgagggacctaacaaattcaagtgtcacagtggcgagtgtatcacactagacaaagtttgtaacatggctagagactgcagggactggagcgatgagcccattaaagaatgtggtactaacgagtgcctggataacaacggcggctgcagtcacgtgtgcaatgacttgaaaatcggcgcagaatgcttgtgtccagacggcttccaactagtcgcccagaggcgatgcgaagatatcgacgaatgccaagaccccgacacctgctcccaactttgcgtcaacctcgagggcggatacaagtgtcagtgtgaagagggctttcagctggacccccatacaaaagcttgtaaagcagtgggcagcatcgcttacctcttttttacaaacaggcatgaggtccgaaaaatgaccctggacagaagtgaatataccagcctgatacccaacctgcgaaatgtggtcgctcttgacactgaggtggctagtaaccgaatttactggtctgatctctcacagaggatgatatgcagtacacagttagatagagcacacggcgtctcttcgtacgatactgtaatcagccgggatatccaggcaccagacgggctcgcagtggactggatacactccaacatatattggaccgactcagttctcgggacagtaagcgtcgcggacaccaagggcgtaaagcgtaaaacattgtttagggaaaacggctctaaacccagggcaatcgtggttgatccagtccacggcttcatgtattggacagattggggcacaccggccaagatcaagaaggggggtctgaacggagtggatatctacagcctggtcaccgaaaacattcagtggccaaacggaattacattggatctcctctcaggtagactctactgggtcgattccaaacttcatagtatcagcagcatcgacgtcaacggtggtaaccgcaaaacgatactcgaggatgaaaagagattggcacatcctttttccctggccgtgttcgaggacaaggtgttctggaccgacatcataaacgaagccattttcagcgctaatagattgacgggttctgatgttaatctccttgcggagaatctcctgtccccagaggacatggtgctgtttcataaccttacacagccacgaggcgtcaactggtgcgaacgcaccaccctctctaacggcgggtgccagtacctgtgcctcccggcgccccagattaacccccattcaccaaagttcacatgtgcatgccccgacgggatgctgctggcccgagatatgaggtcctgtctcacagaagctgaggcagccgtcgctacacaagaaaccagcacggtaaggctcaaagtttccagcaccgccgttcgtacccagcatacaaccactcgcccggtgcccgatacaagcagactgccgggcgccactcccggcctgaccactgtcgaaatcgtgacaatgtctcatcaggccttgggtgacgtggctggccggggcaacgagaagaaaccatctagcgttcgagcactctccatcgtactaccaatagtgctgctcgtcttcctgtgcctgggagtttttctgctctggaaaaactggaggttaaagaacataaacagtattaattttgacaaccctgtctatcaaaaaacgacagaagacgaggtgcacatatgtcacaaccaggacggctattcttaccctagccgacagatggtctcccttgaagatgatgtggcg

SEQ ID NO: 16386 - DNA, 2580 bp, Artificial Sequence
  Description of Artificial Sequence: Synthetic coding sequence
atgggtccttggggatggaagctgagatggactgtggctctgcttctcgctgctgcgggaacagctgtaggggaccggtgtgagaggaacgagttccagtgtcaggacggcaaatgtatctcttacaaatgggtttgcgatggctccgcagaatgccaggatggtagcgacgaaagtcaggagacctgtctgtctgttacctgtaagtccggcgacttcagctgtggcggtagagtcaaccgctgcatccctcagttctggcggtgcgatggtcaggttgactgcgacaacgggtctgacgagcaggggtgtcctcccaagacatgttctcaagacgagtttcgatgtcacgatgggaaatgtatttccagacagttcgtgtgtgactcagatcgtgattgtttggatggttccgacgaagcctcttgtcctgtgctcacttgtgggccggcctccttccagtgcaattcatctacttgcatcccacagctatgggcctgtgataatgacccagactgcgaagacggatctgatgaatggccccaaaggtgtagaggcctgtacgtatttcagggagatagctcaccctgtagtgccttcgagtttcactgcctctcaggcgaatgcatacattcctcgtggcgctgcgacgggggccccgattgtaaagataagtccgatgaggaaaattgtgcagtggcaacctgtcgaccagacgagtttcagtgctctgacgggaattgtattcacgggtcccggcaatgcgaccgggagtatgattgtaaggacatgagcgacgaagtgggttgcgtaaacgttacattgtgcgaaggtcctaacaaattcaagtgccatagtggcgaatgtatcaccctcgataaagtttgtaacatggctcgcgactgtcgagattggtctgacgaaccaataaaagagtgcggaaccaacgagtgtctggacaacaacggaggatgtagccacgtttgtaacgatcttaagataggggccgaatgcctgtgcccagacggctttcagcttgtggcacagcgccgctgcgaggatattgacgaatgccaggaccctgacacatgcagccagttgtgcgtgaacttggagggtggctacaagtgtcaatgtgaggaggggtttcaactcgaccctcacacgaaggcatgcaaagcggttggttccatcgcttacctcttcttcactaaccggcacgaagtccgtaaaatgactctagatcggagcgagtacacttccctgattcctaatttgcggaacgttgtggctttagataccgaagtagcctccaacaggatctattggagtgacctgagccagcgcatgatctgctccacccagctggacagagctcacggggtgtcttcatatgataccgtgataagtagagatatccaggcacctgatgggttggcagttgattggatccacagtaacatctattggacagacagcgttctggggaccgtaagtgtggccgataccaagggcgtgaagcgcaaaactttgtttcgggagaacggatcaaagccacgagcgattgtagtggacccagtacacgggtttatgtactggaccgattggggcacacctgctaaaatcaagaaaggtggcctgaatggcgtggacatttactctctggtgactgaaaatatccagtggcccaatgggatcacactggacctactatccggacgcctgtattgggtggactcgaagctgcatagcataagcagtatcgacgtgaacggcgggaacagaaaaacaatcttggaggatgaaaaacggctggcacaccctttttctttggcagtcttcgaggataaggtgttctggaccgacatcattaacgaggcaatcttttccgccaatcgcctgaccggctctgatgttaacctgctagcagagaatctcctgagtcctgaggacatggtactgttccataacctgactcaaccccgcggcgtgaattggtgtgagcgcactaccctttctaatggcggatgccagtatctgtgcctgcccgcgccacagatcaacccccacagcccaaaatttacgtgcgcttgccccgacggaatgctcctggctcgcgatatgcgcagctgtctgactgaggcagaagccgctgtggcaacacaagaaaccagtacggtcagactgaaagtttcttcgacagctgtccggactcagcatacaaccaccaggcccgtacccgacacctcacgtctccccggcgcaacacccggactgacaaccgtcgagattgtcactatgtcccaccaagcgctgggcgacgtcgcaggacggggcaacgaaaagaagccaagttcggtaagggccctgagtatagtcctacccatcgtgttattggtgttcctgtgtcttggtgtgttcctgctgtggaagaactggagactgaagaacattaacagcataaactttgataatccagtgtaccagaaaactactgaggacgaggtccatatctgccacaatcaggatggatacagctatccttctaggcagatggtttccctggaggatgatgtcgct

SEQ ID NO: 16387 - DNA, 2580 bp, Artificial Sequence
  Description of Artificial Sequence: Synthetic coding sequence
atgggaccctggggatggaaactgcgctggaccgtggcactgctgctcgcagcagccggaacggcagtgggagataggtgtgagagaaacgagttccaatgtcaagacggtaaatgtatttcgtacaaatgggtgtgtgatggctccgccgagtgccaagatggatccgatgagtcgcaggagacttgtctctccgttacttgtaagtccggggatttcagctgtggcgggcgggtgaacaggtgtattccacaattttggagatgtgatgggcaagtggattgtgacaacgggtcggatgaacaggggtgtccaccaaaaacttgctcgcaagatgaatttcggtgccacgacggcaagtgtatcagccgccaatttgtgtgtgattcggatcgcgactgtctggacggatcggatgaagcatcctgtccagtgcttacctgtggccccgcctccttccagtgtaattcgtcgacctgtataccccaattgtgggcatgtgataacgacccagattgcgaagatggcagcgatgagtggcctcagcgctgtagggggctttacgtgtttcagggtgactcctcgccctgttccgcatttgagtttcattgtctctcgggagaatgtattcattcgtcgtggcgatgcgatggaggaccagactgcaaagacaaatcagatgaggagaattgtgcagtggcaacctgtagaccggatgagtttcaatgcagtgatggtaactgcattcatggatcccggcaatgcgatagagagtacgattgtaaggatatgagcgacgaggtgggatgcgttaacgtgaccctgtgtgaaggacccaataagtttaagtgccattccggcgaatgtataacccttgataaggtgtgtaacatggctcgtgattgccgggattggtcggacgaacctataaaggaatgcggcaccaacgaatgtctcgataacaacggaggttgttcgcatgtgtgcaacgatcttaagataggcgcagagtgtctttgtcctgatggttttcagcttgtggctcaaagaaggtgtgaagatatagatgaatgtcaagaccctgacacctgctctcaactgtgcgtgaatctggaaggtggatacaagtgtcagtgtgaagaaggattccagcttgaccctcatactaaggcctgtaaggcagtcggttctatcgcgtacctgtttttcacgaaccggcacgaagtgcggaagatgactcttgatcgtagcgagtacacctcccttattccaaatctgcgcaatgtggtcgcactggatactgaagtcgccagcaacagaatctactggtcggatctgtcccaacggatgatctgctcgacccaactggatcgtgcccatggagtcagctcctacgacaccgtgatctctcgcgacatccaggcaccagatggtctggcagtcgactggatacattccaacatttactggacggattcagtgctcggtactgtgtccgtggcggacaccaagggagtgaagagaaagactttgtttcgggagaatgggtctaagccaagagcaattgtggtggaccccgtgcatggtttcatgtactggactgattggggaactccagctaagatcaaaaagggaggtctgaacggagtggatatctacagccttgtgactgaaaacattcagtggcccaacggaattaccctggacctcctgtcgggacggctgtattgggtggattcaaagctgcacagcatttcaagcattgatgtgaacggaggaaatcggaaaaccattcttgaggacgaaaagcggctggcacatccttttagcctcgcagtgtttgaagataaggtcttttggaccgacatcattaacgaggcgattttctcagcaaataggctgactggaagcgatgttaacctgcttgcagaaaatctgcttagccccgaggacatggtgctctttcataaccttacccaaccaagaggagtgaattggtgcgagagaaccaccttgtcaaatggcggttgtcagtacttgtgcctcccggccccacagatcaacccccactcccctaagttcacgtgcgcgtgccccgatggcatgctcctcgcacgggacatgaggtcgtgtctcactgaagcagaagctgcagtagcgacccaagagactagcactgtcagacttaaagtgtcctcgaccgcagtgagaacccaacatactaccacccgtccagtccccgatacgagcagactccctggtgcaactcctggcctcactactgtcgaaatcgtgactatgtcgcatcaagcactcggtgacgtggccggacggggaaacgagaaaaagccaagctcagtgcgtgcgctttcaatcgtccttcctatcgtgctgcttgtgttcctttgcctcggagtgtttttgctgtggaaaaactggagacttaagaatatcaattccatcaactttgataaccctgtgtaccaaaagaccaccgaagatgaggtgcacatctgtcataaccaagacggctacagctacccctcgcgccaaatggtgtcattggaagatgatgtcgcc

SEQ ID NO: 16388 - DNA, 2580 bp, Artificial Sequence
  Description of Artificial Sequence: Synthetic coding sequence
atggggccctggggatggaagctgcggtggaccgtggctcttctgctggcggccgcgggtactgctgtgggggaccggtgcgaacggaacgaattccagtgccaggacggtaaatgcatctcatacaagtgggtctgtgacggatctgcggagtgccaggatgggtcggacgaaagccaagagacttgcttgtcagtgacttgcaagagcggcgatttcagctgcggaggccgcgtcaacagatgtattccgcaattctggagatgcgatggacaggtggattgcgataacggttcggacgaacagggatgtccgcctaagacttgctcccaagacgaatttagatgtcatgatggaaagtgtatcagccgacagttcgtgtgtgattcggaccgtgactgcctcgacggaagcgacgaggcttcctgcccggtgctcacctgcggtccggcctccttccagtgcaattcctccacctgcatcccccagctgtgggcttgtgacaacgaccctgactgcgaagatggatcagacgaatggccgcagcggtgcagaggtctgtacgtctttcaaggcgactcgtccccttgctccgcattcgaattccactgcctgtcgggagagtgtatccactcctcgtggcggtgcgatggcggacccgattgtaaggacaagtctgacgaggagaactgcgccgtggcaacttgtcgcccagacgagttccagtgctccgacggaaactgcatccatggcagccggcaatgcgacagagaatacgattgcaaggacatgtccgacgaggtgggatgcgtgaatgtcaccctgtgtgagggacctaacaagtttaagtgccactcaggagaatgcatcactctggataaggtgtgcaatatggccagggactgccgggactggtccgacgaacctatcaaggagtgcgggaccaacgaatgcctggacaataacggtggatgctcccacgtgtgcaacgacttgaagatcggagctgaatgcctctgcccggatgggttccaacttgtggctcagcgccgatgcgaagatatcgacgaatgtcaggacccagacacctgctcccagctctgtgtgaacctcgagggtggatacaagtgccagtgcgaggagggcttccagctcgaccctcacaccaaggcctgcaaggcagtgggctcaatcgcatacctcttctttactaaccgccatgaagtcagaaaaatgactctcgatcgctcagaatacaccagcttgatcccgaacctgcgcaacgtggtggctctcgacacggaagtggccagcaaccggatttactggtcagacctgtcgcagcgcatgatctgctcgacccagctcgaccgggcgcatggagtgtcgtcatatgacaccgtcatctcgcgcgatattcaagcaccggacgggctcgcggtggattggatccattccaatatctactggactgacagcgtcctgggcaccgtgtccgtggccgacacgaaaggagtgaaacgcaagacgctctttagagaaaacgggtcaaagccacgggctatcgtggtggacccagtgcacggctttatgtattggaccgactggggaacgcccgcaaaaatcaagaagggtggactcaatggagtggacatctacagtcttgtgactgagaacatccagtggccgaacggcatcaccttggatcttctgtcagggcgcctctactgggtggactctaaacttcatagcatctcaagcatcgacgttaatggaggaaacagaaagactatcctggaggacgaaaagcggctggcacacccgttctccctcgcggtgttcgaagataaagtgttctggactgacatcattaatgaggctatcttttccgcgaatcgcttgactggatcagatgtgaacctccttgccgaaaacttgctgagcccggaggacatggtgctgttccacaacctcacccaaccgcggggagtgaattggtgcgagagaaccaccctgtcaaatggcggatgtcagtacctgtgtctgccagcgccgcagatcaatccgcattcgcccaagtttacctgtgcatgcccggacggaatgcttctcgcacgggatatgcggtcctgcctcactgaagcggaggccgccgtggccacccaagagacgtcaaccgtcagacttaaagtgtcatcaactgcagtccggacccagcataccacgaccagaccagtcccagatacctcgcgcctcccgggcgcaactccaggactgaccaccgttgagatcgtcactatgtcacaccaggccctgggagatgtggctggccgcggaaacgaaaagaagccatcgtcggtgcgagcactctccatcgttctgccgatcgtgctccttgttttcttgtgcctgggcgtctttctgctgtggaaaaactggcgccttaagaacatcaactcaattaacttcgacaatccagtgtaccagaaaactacggaagatgaagtccatatctgccataaccaggatggatactcgtacccatcccggcagatggtatcgctcgaggatgacgtggcc

SEQ ID NO: 16389 - DNA, 2580 bp, Artificial Sequence
  Description of Artificial Sequence: Synthetic coding sequence
atgggcccttggggctggaaactgagatggaccgtggcactcctgctggcagcagccggaaccgccgtaggagatcggtgcgaaagaaatgaattccaatgtcaagacggtaagtgtatatcatacaagtgggtgtgtgatggctccgcagagtgtcaggatggatcggatgaatcacaggaaacctgtctgtccgtgacttgtaagtccggggacttttcgtgtgggggacgtgtgaacaggtgtattcctcagttctggcgctgcgacggtcaagtggactgtgataacggcagcgatgagcaaggatgtccccctaaaacgtgctctcaagatgaattcagatgccatgacggaaagtgtatctccagacagtttgtgtgtgacagcgaccgggattgtctggatggttcggatgaggcatcatgccctgtcctcacctgtggccctgctagtttccaatgtaattcgtcaacctgcatcccgcaactgtgggcatgtgataatgaccctgactgcgaagatggatcagatgaatggccccaaagatgtagaggactgtacgtgtttcagggagattcgtcgccgtgcagcgccttcgagttccattgtctgtctggtgaatgtattcattcctcgtggcgatgtgatgggggtccagattgtaaagacaagtcagatgaggagaattgcgcggtggccacttgtcggccagatgaatttcagtgttccgatggcaactgtattcatggatccagacaatgtgatagggaatacgattgtaaggatatgtctgacgaagtgggttgtgtgaacgttaccctgtgtgagggtcccaacaaattcaagtgccatagtggtgagtgcatcacccttgataaagtgtgtaacatggcaagagattgccgtgattggtcggacgaaccaatcaaggaatgtggtactaacgagtgtctcgataacaatgggggctgttcccatgtgtgcaatgacttgaaaatcggagcggaatgtctgtgccccgatggcttccagctcgtggctcagagacggtgtgaagatatagacgaatgccaagaccctgatacttgcagccagctgtgcgtgaaccttgagggtgggtacaagtgtcagtgtgaagaaggcttccaacttgatcctcacactaaggcgtgtaaggcagtgggatcgatcgcctacctgttctttacgaacagacacgaagtcagaaaaatgaccctggatagaagcgaatacacttccctcattcccaatctgcgcaacgtcgtcgcactcgacaccgaagtggcttcgaatcgcatttactggagcgacctgtcccaaagaatgatttgttcaacccaactggacagagcgcatggagtgagcagctatgataccgtgatctctagggatattcaagcacctgatggactggcagtggactggatacacagtaacatttactggactgactcggtgctgggcaccgtcagcgtggctgatactaaaggtgtgaagagaaagactctgtttcgagagaacggctcgaaaccacgagcaattgtcgtcgatccggtgcacggatttatgtactggaccgactgggggactccagcaaagatcaaaaagggtggtctgaatggtgtggacatctattctttggtgactgagaatatacagtggcctaacgggattaccctggatttgctctctggaaggctttactgggtggactctaagttgcactcgatttcgagcattgatgtcaacggcgggaaccgtaagacgattcttgaggacgaaaagcgccttgcacatccatttagccttgccgtctttgaagataaggtattctggactgacataatcaacgaggcaattttctccgcaaaccgcttgacgggatcagacgttaatctgcttgcagagaacctgctttcgcccgaggacatggtgctttttcataacttgactcagcctagaggagtgaactggtgtgaacgcaccacgctttctaatggagggtgtcagtacttgtgcctgcctgcacctcagatcaatccacactcacctaagtttacgtgtgcgtgtccagatggaatgcttctggctcgggacatgagatcgtgtctcaccgaggccgaagcagccgttgcaactcaggaaacctcaactgtgcggcttaaagtctccagcaccgctgtgcggactcagcacacgaccaccagaccagtgccagatacctccagactgcccggagctactcccgggctgactaccgtggagattgtgaccatgtcacatcaagcacttggcgacgtggcaggacgagggaatgaaaagaaaccgtcctcagtccgcgcacttagcatcgtgctcccaattgtgcttctggtctttctgtgtctcggtgtgtttctcctttggaaaaactggcgcctcaagaacataaactcgattaacttcgacaaccctgtgtaccaaaagaccacggaagatgaggtccatatttgccataatcaagatggctactcgtacccatcgagacaaatggtgtccttggaagatgacgtcgca

SEQ ID NO: 16390 - DNA, 2580 bp, Artificial Sequence
  Description of Artificial Sequence: Synthetic coding sequence
atgggcccttgggggtggaaattgagatggacggtggctctattattagccgcagctgggaccgcagtgggtgatagatgcgagcggaatgaattccaatgtcaagatggaaaatgtatttcgtataaatgggtctgcgacggatctgcggaatgtcaggatgggtccgatgaatcgcaagaaacttgccttagtgtcacctgtaaaagtggtgacttttcctgtggcggccgggttaatcgctgcatcccgcagttttggcgatgtgatggacaagttgattgtgacaatggtagtgatgaacagggctgccctccgaaaacctgtagtcaggacgagtttagatgtcatgacggaaagtgcatttcgcggcagtttgtttgcgatagcgatcgggattgtcttgatggctcagatgaggcttcttgccctgtcttgacatgtgggccggcctcttttcaatgtaatagctctacgtgtattccgcagctctgggcctgtgataatgaccctgattgcgaagacggctctgatgagtggccacagagatgtagaggtctatatgtatttcaaggtgattcatctccatgcagtgcctttgagtttcactgtctcagcggagaatgtattcacagcagctggcgatgcgatgggggcccggactgtaaagataaatcagacgaagagaactgcgctgtcgctacatgtcgtccggatgaatttcaatgcagcgatggtaactgcattcatggttctagacaatgtgacagggaatatgattgcaaggatatgtccgacgaagtcggatgcgtaaatgtgacgctttgcgaaggccctaacaaatttaaatgtcactcaggcgaatgcatcacacttgacaaggtttgcaatatggcacgtgactgtcgtgactggtctgacgaaccaatcaaagaatgtggtacaaatgagtgtttggacaacaatggcggatgctctcatgtatgtaacgatcttaaaattggggccgaatgtctttgtccggacggatttcagcttgttgcacaaaggcgctgcgaggatattgatgaatgtcaggacccggatacttgcagccagttatgtgtcaatctagaaggcggatataaatgtcagtgcgaagaggggtttcaattagatccgcacacgaaggcttgcaaagcggtgggttcaattgcctatctgttcttcacgaataggcatgaagtgcggaaaatgacattagatagatcagaatatacaagtttgatcccgaatttgagaaacgtggtagctttagatactgaagtcgcatccaatcgtatttactggagcgacttgagccaaagaatgatctgtagtacgcaactagatcgtgcccatggagtgagcagctacgatacagtgattagcagggatattcaagcgccggacgggttagcggttgattggatccattctaacatttattggaccgatagtgtccttggaacagttagcgtggcggacaccaaaggggtcaaacggaaaacactgtttagagagaatggatcaaagcctagggcgatcgttgtggatccagtacacggttttatgtactggacggattggggaacgcccgcgaaaatcaagaaaggaggccttaatggagtcgatatctactctctcgtgacagagaatattcaatggccgaatggtatcacccttgaccttttgtccggaagactgtattgggtcgacagtaagctgcactcaatttcgagcattgatgtcaatggaggaaacagaaagacgatacttgaggacgaaaagcggttagctcatccttttagcctcgccgtgtttgaggacaaagtattctggacagatatcattaacgaagccattttcagcgcgaatcggctcactggctcggacgtaaacctgttagctgagaatttactgagtcctgaagatatggtcttgtttcacaacttaacgcagccgcgcggtgtcaactggtgtgagcgcacaacacttagtaacggaggatgccaatatctgtgtcttccagctccacagattaaccctcattctccaaaatttacgtgtgcttgtccggatggaatgttgctggcaagagatatgcgcagctgcttgactgaggctgaagcagccgttgcaacccaggaaactagtactgtgagacttaaagtatcttccacagccgtccggacacaacatacaacaactcgaccggtgccggatacaagcagactgccaggcgcaactccaggcttaacgacagttgaaattgtaacgatgtcacatcaggcgttgggggatgtggcgggacgtggcaatgagaaaaaaccaagctccgtacgcgcgcttagcattgtactcccaattgtccttttggtctttctgtgcctgggcgtgttcttactgtggaaaaactggcgcctgaagaacataaactcaattaattttgacaacccggtatatcagaaaacgacggaggacgaagtacatatttgccataatcaggatggttacagttatcccagcagacaaatggtaagtcttgaggacgatgtcgct

SEQ ID NO: 16391 - DNA, 2580 bp, Artificial Sequence
  Description of Artificial Sequence: Synthetic coding sequence
atgggcccgtgggggtggaagctcagatggaccgttgcccttttgctggctgctgctggcacagctgtgggagacagatgtgagagaaacgaattccagtgtcaggacgggaaatgcatttcttataagtgggtgtgtgatgggtccgccgagtgccaggacggatcagatgagtcccaggaaacctgtctatctgtcacttgcaagagcggcgatttttcgtgtggcggaagggttaacagatgtatcccacagttttggagatgcgacgggcaggtcgactgcgacaatgggtcggacgagcagggctgtcctccgaagacttgttctcaggatgagtttaggtgccatgacggtaaatgcatttcccgccagttcgtgtgcgattcagatcgtgattgcctcgatggctcagacgaagccagctgccccgttctgacctgcggtccagcttccttccagtgcaattcatccacctgtatcccccagttgtgggcttgtgacaatgatcccgattgcgaggacggaagcgacgagtggccccagcgatgccgtggcctatatgtgtttcagggcgactcctctccctgtagtgcttttgagttccattgtctgtcaggggaatgtatccactcaagctggaggtgcgatggcggacctgattgcaaggacaagtctgacgaagaaaattgtgcggtagctacctgcaggcccgacgagtttcagtgctcagatgggaactgtatccatggatcccggcaatgcgatagggagtacgactgcaaggatatgagcgatgaggtgggctgcgtaaacgtgacattgtgcgaagggcccaataagtttaagtgccacagtggggagtgcatcacgcttgacaaagtgtgtaacatggcacgcgactgtcgcgactggagcgatgagcctataaaagaatgcggtacaaacgagtgcctggacaacaatggaggctgctcccatgtgtgtaacgatctgaaaatcggagcagagtgcctgtgccccgacgggtttcagctggtggcacagcgtcggtgtgaggacatagatgagtgccaggaccccgatacctgtagtcaactgtgtgtgaatctggaaggcggctacaagtgtcaatgcgaagaaggatttcagttggatccccacaccaaagcgtgtaaagcagttggctcaattgcctacctgttcttcacaaatcggcacgaggtccgtaagatgacactggatagatctgaatacacatctctgatccctaatctcagaaacgtggtggccctcgacaccgaggttgcaagcaaccgaatttattggagcgacctgtctcagcggatgatttgctcaacacagttggatcgcgctcatggcgtgtccagctacgacaccgtgatttcccgagacatccaggcccccgatggccttgccgtcgattggatccacagtaacatctactggaccgacagtgtgctgggcactgtgtccgtagctgacacaaaaggagtgaaacgcaagactctttttagagagaatgggtcgaagccgagagcaatcgtggttgaccctgtacacgggtttatgtattggactgactggggaacaccggctaagatcaaaaaggggggtttaaatggtgtcgacatatatagcctcgtcactgaaaatatccagtggcccaacgggattacacttgatctgttgagcggaagactctactgggtcgacagtaagctccactccattagttctatcgatgtaaacgggggcaatcggaaaacaatcctggaagacgaaaaacgtcttgcccatcctttctcattggctgtatttgaggacaaggtgttctggaccgatataatcaacgaggcgatcttcagcgcaaacaggctcaccggaagtgacgtgaacctcttagcagagaatctgttaagtcctgaggacatggtgctattccataatctaacacaaccccgcggtgtcaactggtgtgagcggaccacactgagtaacggcggctgccaatatctgtgcctgcccgcaccccagatcaatcctcattctcctaaattcacatgcgcttgtcctgacgggatgttgctcgcgagggacatgagatcgtgcttaacagaggcagaggccgccgtggctacccaggagaccagtactgtaagactgaaagtgtcttcgacggcggtgcgtacccaacataccacgacacggcctgtgccggatacaagcagacttcctggggcgacgccgggattaaccaccgtggaaatcgtgaccatgtcccaccaagcactaggtgacgtggctggcagaggaaatgagaagaagccatccagcgtacgggcgctaagtatcgtcctgcccatcgtgctcctagtattcctttgtctgggtgttttcttgctttggaaaaactggaggctcaagaacataaattctattaattttgacaatccagtatatcagaagaccaccgaggacgaggtgcacatctgccacaatcaagacggctactcctacccaagccgccagatggtgtcactcgaagatgacgtggct

SEQ ID NO: 16392 - DNA, 2580 bp, Artificial Sequence
  Description of Artificial Sequence: Synthetic coding sequence
atgggcccctgggggtggaagctccggtggacagtcgctctccttctcgcggcagccggaacggcggttggagatcgatgtgagagaaatgaattccaatgccaggacggcaagtgtatttcgtacaaatgggtgtgtgatggctctgccgaatgccaagatggctctgacgagtcacaagagacctgtctctccgtcacatgcaagagcggcgacttctcctgcgggggaagagttaataggtgtatcccacaattctggcggtgcgacggccaggtcgattgcgataacgggtccgacgagcagggctgcccccccaaaacgtgcagccaggatgaattccggtgccacgatggcaagtgtatctctcgccagttcgtgtgtgatagtgatagggattgcctggacggctctgatgaagcatcctgtcctgttctgacatgcgggcctgcctcatttcagtgtaacagttcgacatgtataccccagctctgggcgtgcgataatgaccctgactgcgaggatggaagcgacgaatggccccagagatgtagaggactgtatgtcttccagggagactctagtccctgttctgcctttgaattccactgcctgtctggtgagtgtatccattcttcttggaggtgtgatggcggccccgactgcaaggataaatccgacgaagagaactgtgcggttgcgacgtgcagaccagacgagttccagtgcagcgacggaaactgcatccacggttcacggcaatgcgacagggagtacgattgtaaggatatgagcgacgaggttgggtgtgtgaatgtgactctgtgtgagggacccaataagtttaagtgccattccggagagtgtatcactcttgataaggtgtgtaacatggcccgcgattgcagagattggagcgatgagccaataaaggagtgtggtactgcagcatgtctggataataatggaggttgcagtcacgtgtgtaacgcattgaaaatcggcgcagaatgtctctgtcctgatggatttcaactggtcgcccagcggcggtgcgaggacatagacgagtgtcaagacccagacacatgctctcagctttgtgtgaatttggagggtgggtacaagtgccagtgcgaagaaggttttcagctggatccccacactaaagcctgcaaagctgtcggctccattgcctacctgtttttcactaaccggcacgaggtccggaagatgacgttggacagaagcgaatacaccagtttaatcccaaacttgcgtaatgtagttgcacttgacacagaggtcgcttccaaccggatatattggtcagacctgagtcagagaatgatctgttcaactcagttggaccgagcacatggtgtcagctcttacgacacagtcatctccagggacattcaggccccggatggcctagccgtggactggatccatagcaatatttattggacggactccgtcctggggaccgtgagtgtcgccgacaccaagggggttaagcggaaaacactgttccgcgagaacggctcaaaaccccgcgcaattgtcgtagaccctgtgcacggcttcatgtattggacagactggggcactccagctaaaattaagaagggaggcctgaacggagtggatatctactcgctcgtgaccgagaacatccagtggccgaatggcatcaccctggatttgttgtcaggccgcctctattgggttgatagcaaactgcatagtataagttccatagacgtgaatggcggaaataggaaaactatcctcgaagatgagaagaggcttgcccacccatttagtttggctgtgttcgaagacaaggtgttttggacggatataatcaacgaggcaatctttagcgccaaccggttgacaggttcagacgttaacttgttggccgaaaacctacttagtcccgaggacatggtactgtttcacaatctaactcagccacggggggttaactggtgcgagcgaacgaccttatcaaacggtggctgccagtatttgtgtctgcctgccccacagataaacccacactcaccaaaatttacctgtgcgtgtccagacggaatgcttctggctcgagatatgaggagttgtctcactgaagccgaagccgctgttgccacgcaggagacctcaactgtccggctcaaagtctcatcaacagcggtgcgcacacagcatacaacaacccggcctgtgcctgacaccagcagactccccggggcgacaccagggctcaccaccgttgagatagtgacaatgagtcatcaggctctgggcgacgtggcgggaagaggcaatgagaaaaagcctagctctgtgagagctctctctattgtcctgccgattgtgctactggtctttctctgtttgggtgtcttcctgttgtggaaaaactggcggctcaaaaatattaactctattaactttgacaacccagtctatcaaaagacaactgaggacgaggtgcacatctgtcacaaccaggacgggtactcctacccctctaggcaaatggtgtctttagaagatgacgtggct

SEQ ID NO: 16393 - DNA, 2580 bp, Artificial Sequence
  Description of Artificial Sequence: Synthetic coding sequence
atggggccatggggctggaaacttcggtggaccgtggcactgctgcttgcagcagcaggaactgcagtgggcgatcgctgcgagcggaatgagtttcagtgccaggatggcaagtgcatttcatacaagtgggtctgtgacggctctgccgaatgccaggacggatccgatgagtcccaggaaacgtgccttagcgttacctgtaagagtggggatttctcctgcggagggcgcgtcaaccgatgcataccccaattctggaggtgtgatggtcaggttgattgtgataacggatcagacgagcagggctgtcccccaaagacttgttctcaagatgaattccgctgtcacgacggcaaatgtattagccgacagtttgtgtgcgacagcgaccgggattgcctcgatggaagtgatgaagcttcatgccccgtacttacctgcgggccagcctccttccaatgtaactctagcacttgcatcccacaactgtgggcctgcgacaacgatccagattgtgaggatggaagtgatgagtggccacagaggtgccgcggcctctatgtctttcagggggacagctctccctgctcagcgtttgagtttcactgtctgtctggtgagtgtattcattcctcctggaggtgcgatggcggccccgactgcaaagacaaaagcgatgaagaaaattgcgcagtcgccacttgccggcctgacgaattccaatgtagtgacggtaactgcatccacgggagccggcaatgtgatcgcgagtacgattgtaaggacatgtcagatgaggtgggatgcgttaatgtcacactgtgtgaaggcccaaacaagttcaaatgccattcaggtgagtgcattacgctggataaggtgtgcaacatggcccgcgactgtagagactggtcagacgaacccatcaaggaatgtggaacagccgcctgccttgataataatggaggatgctctcatgtgtgtaatgctctgaaaatcggagcagagtgtttgtgtcctgatggatttcagctggtggcccagagacggtgcgaggatatcgatgagtgtcaggatccggacacttgctcccagctctgcgtgaacttggagggcggctacaaatgccagtgcgaggaggggtttcagctggatcctcatactaaggcctgtaaggccgtggggtccattgcctacctgttcttcacaaatcggcacgaagtgcggaagatgacactggatcgctccgagtacacctcccttattccaaacctgaggaacgtggtggctctggatactgaggttgccagtaacagaatctactggagtgacctcagtcagaggatgatctgtagcactcaactcgatcgggcccatggcgtgtcatcatacgatactgtgatctctcgagatattcaggctcctgatggattggcggtggactggattcattctaacatttattggaccgattccgtactcggcactgtctccgtcgcagatacaaagggggtaaaacggaagacactgttccgcgaaaacggttccaagccccgagcaatcgtagtcgatcctgtacatgggttcatgtactggaccgactggggcactcccgcaaaaattaaaaaaggcggcctgaatggcgtggacatatacagcctggtcacagagaatattcagtggcccaacggcatcacactggatctgctgtctggccgactctactgggtcgacagtaagttgcactccatcagcagcatcgacgtgaacggtgggaatagaaagactatcctggaggacgaaaagagactggcccacccattcagtctggctgtcttcgaggacaaggtgttctggactgacatcatcaacgaagctattttcagcgctaacagattgactggatcagacgtaaatctgttggctgaaaatttgctctcacctgaggatatggtgctttttcacaacttgactcagccacgaggagttaactggtgcgagcgcactactctgagtaatgggggctgccagtacctttgtctccccgcacctcagattaacccccattcccccaaattcacatgtgcctgccccgacggcatgcttctggccagggatatgaggagctgtcttaccgaggcagaagccgcggtagccacccaggaaacctctacagtacgcctcaaggtctcatctaccgccgtgcggacccagcatacaacaaccaggcccgttcccgacaccagcaggctgccaggcgctacaccaggccttacaaccgtggagatagtcacaatgtctcatcaggccctgggggatgtggccggcaggggcaacgagaaaaagcccagcagcgttagggccttgtccattgtgctgcctattgtcctgctggtgttcctttgcctgggcgtatttttgctgtggaaaaattggcgactgaaaaacatcaactcaatcaatttcgataatcccgtgtaccagaaaacgaccgaagacgaggtgcacatttgccacaaccaagacggctatagctaccccagtagacagatggttagtcttgaagacgacgtagct

SEQ ID NO: 16394 - DNA, 2580 bp, Artificial Sequence
  Description of Artificial Sequence: Synthetic coding sequence
atggggccatgggggtggaagctcaggtggactgtggccctcctgctagccgcggccggaacggccgttggagataggtgcgagcggaatgagtttcagtgccaggatggcaaatgcatctcctacaaatgggtctgcgatggctccgcggagtgtcaggatggctccgacgaatctcaagagacttgcctaagcgttacgtgtaagtctggagacttttcctgcggtggtcgcgtcaatcggtgtataccccagttctggcggtgcgacggtcaggttgattgcgataatggatccgacgagcaggggtgtccacctaaaacctgcagccaggacgaatttcgttgtcatgacggtaaatgtatctcccgacagttcgtgtgcgattcagatcgggattgccttgatggcagcgacgaagcttcctgcccagtcctgacctgtggaccggccagcttccagtgcaactctagtacttgcatccctcagctctgggcgtgcgataacgatcctgattgcgaggatggttcagatgaatggcctcaaaggtgtcgaggcctctatgtattccaaggtgacagttccccctgcagcgcctttgagtttcattgcctttctggagaatgtattcactcaagttggaggtgcgatgggggcccagactgtaaagacaaatccgacgaagagaattgcgcggtcgccacgtgtcgccctgacgagtttcagtgctctgatggcaactgcatccatggttcccggcagtgcgatcgcgagtatgactgcaaagatatgtccgacgaggtaggctgcgttaatgttactctatgtgaaggtcccaacaagtttaaatgtcattcgggtgaatgtatcactctggacaaggtttgtaatatggctagggactgcagagactggtctgacgagccaatcaaagaatgtggcacagcggcctgcctcgacaataatggtggctgtagccatgtctgcaacgctcttaaaattggcgctgagtgcctttgccccgatggctttcaactcgtggcacaaagacgctgcgaggatattgacgagtgccaggatcccgatacctgcagtcagctctgtgtgaatctggagggcggctacaagtgccagtgcgaggaggggtttcagctggatccacacacaaaagcctgcaaggcggtgggaagcattgcttatttgtttttcaccaacagacacgaagtcaggaagatgaccctggatcggagcgagtatacgtctctgatcccgaacctgaggaacgtggtcgcactggacaccgaggtggcttcaaaccggatttactggagcgatctgagccaacgcatgatatgctcgacccagcttgatagggcacacggagtctctagttacgatacggtcatcagtcgagacattcaggcccctgacggtctggccgttgattggatacattccaacatttactggactgacagcgtcctcgggactgtttcagttgctgatacaaaaggcgtgaagcgtaaaaccctttttcgcgagaacggatcaaagccccgcgccattgtggtagatcctgtgcacggattcatgtactggacagattggggtacccctgcaaagatcaaaaagggagggcttaacggagtcgatatctacagccttgtcacggaaaatattcagtggccaaatgggattaccctagacctgttgagtgggcgcctgtattgggtcgactctaaactccacagcatctcgtccatcgacgtcaatggcggaaatagaaagacaatactagaggatgaaaaacgactggcccatcccttttcgttagccgttttcgaggataaggtgttctggaccgacattatcaatgaggccatctttagcgccaatcggctcaccgggagcgatgttaatttactcgccgagaacctgctgtcacctgaggacatggttctcttccacaaccttacacagccccgcggggttaactggtgcgagcgaacaacactgtccaatggagggtgccaatacctttgtcttccagctccacagatcaatccacattctcctaaatttacatgtgcatgcccggatggcatgcttttggctcgcgacatgcgaagctgcctgacagaggcagaagccgccgtggccacacaagaaacctccaccgtgcgcctaaaggttagttccacagctgtacgcacacagcatacaacgactcgccccgtgccggatacatcccgcctgcctggcgctacacccggattgaccacagtcgaaatcgtcacaatgtctcaccaggcccttggagacgtagcgggccgcggcaacgaaaagaaaccgtcctcagtgcgagccctgtcaattgtgctgcccattgtactgcttgtcttcctgtgcctcggtgttttcttgctgtggaaaaactggcggttgaagaacattaattcaattaattttgacaatccagtttaccagaaaaccaccgaggacgaggtgcacatttgccataaccaggacggctactcctatccatctcgacagatggtcagcctggaagacgacgttgca

SEQ ID NO: 16395 - DNA, 2580 bp, Artificial Sequence
  Description of Artificial Sequence: Synthetic coding sequence
atggggccgtggggatggaagctccggtggaccgtggccctgctgcttgccgctgcaggtacagccgtgggggaccgctgcgagagaaatgagttccagtgtcaggacggcaagtgcatttcttacaaatgggtgtgcgacggatcagccgagtgccaggacggctcagatgagtcccaggagacttgtctgtctgtaacttgtaagagtggcgactttagttgtggagggcgggtgaatcggtgcatcccgcaattctggagatgtgatggccaggtagattgcgataacggatcagacgagcaagggtgccctcccaagacttgctctcaggacgagtttcggtgtcatgacgggaagtgcatttcccgccagttcgtttgtgactctgatagggattgccttgacgggtcagacgaggctagctgtcccgtgctgacatgcgggcccgcttccttccagtgcaattcttcaacctgcattccccagttgtgggcctgcgacaatgatccagactgcgaagatgggtctgacgagtggccgcagagatgccgcggactctatgtatttcagggtgactcaagcccctgcagcgccttcgaattccactgcctgtctggagaatgtattcacagttcctggaggtgcgacgggggcccagactgtaaggataagagcgatgaggagaattgtgcagtcgcaacctgcaggcccgatgaattccagtgcagtgacgggaattgtattcatgggtccaggcagtgtgatcgggagtacgactgtaaagacatgtctgacgaagtcgggtgcgtgaacgtaaccttatgtgagggccccaataagttcaaatgccatagcggggagtgtatcaccctggataaggtgtgtaatatggcccgggattgtcgagattggtccgacgagcctattaaggagtgcgggaccgcagcttgtttagacaacaatgggggatgtagtcatgtgtgcaacgccctgaagatcggggcagagtgcttatgtcctgatggatttcagttggtggcacagaggcgttgtgaggatattgatgagtgccaggatcctgacacctgttcgcaactgtgtgtgaacctggaagggggctacaagtgccagtgtgaagagggctttcagctcgacccacacacaaaggcctgtaaggctgtcggctctattgcctacctgttcttcactaaccgccatgaagtgaggaagatgacccttgacaggtccgaatatacatcacttattccaaaccttcgaaatgtcgtggcccttgacaccgaagttgcatcaaatagaatttattggtccgacctcagtcaacgaatgatatgtagtacacaacttgatcgggcacacggcgtctcttcttacgatactgtgatttccagggatatccaagcacctgacggactagctgtggactggattcattccaatatatactggactgactcggtccttgggaccgtctccgtggccgacaccaaaggtgtcaagaggaaaacacttttcagagagaacggatccaagcctagagccattgtggtagaccccgtgcatggcttcatgtattggacagactggggtactcccgcaaaaatcaagaagggtggcttgaacggcgtggacatctacagcctcgtcacggaaaatatccagtggcctaacggcattactctcgacttgcttagtgggcgcctgtactgggtcgactccaaactccatagcatctctagcatagatgtgaacggcgggaatagaaaaactattctcgaggacgaaaaaaggctggctcatcctttcagtttggcggtgttcgaagacaaggtgttctggacagatattatcaacgaggctattttttccgccaaccgactcacaggttctgacgtcaatcttctggctgaaaatttgctatctccagaggacatggtactttttcacaatctgactcagcctagaggcgtgaattggtgcgagaggactaccctatcaaatggcggctgtcagtatttatgtctccccgcccctcagatcaatccccacagccccaagttcacctgcgcatgtcccgacgggatgctgctggcacgggacatgcgcagttgcctgaccgaggctgaggctgctgtagccacccaagagactagcacagtgcggctaaaagtgtcctcgaccgctgtgcggacgcagcacaccacaacgcgccccgtacctgacactagtagattgccaggagccaccccaggcctgacaaccgtcgagatcgttacaatgtcacatcaggccttgggagatgtcgcaggaaggggcaacgaaaaaaagccctcaagcgtgcgcgcgctctcaatcgtccttccaatcgtgctgctggtcttcctgtgcctaggcgtgttcttgctgtggaaaaattggcggctgaaaaacatcaattctatcaacttcgacaaccccgtataccagaagaccactgaagatgaagtgcatatatgccacaaccaggacggctattcatatccctcaaggcagatggtcagtctggaggacgatgttgcc

SEQ ID NO: 16396 - DNA, 2580 bp, Artificial Sequence
  Description of Artificial Sequence: Synthetic coding sequence
atgggcccctggggatggaagctgcggtggaccgtcgcactgctactagccgccgctggaaccgccgtgggagacaggtgtgagagaaatgaattccagtgtcaggacggcaaatgcatcagttataagtgggtgtgcgatggctccgccgagtgccaggacggctcagacgagtctcaggaaacatgcttgtcggttacttgcaagtccggcgatttctcgtgtggaggccgagtgaacaggtgcataccccagttctggaggtgtgacggacaggtcgactgcgacaatggcagcgacgaacaggggtgcccaccaaagacttgctctcaggatgagttccggtgtcacgacggcaagtgcatttcccggcaattcgtgtgcgatagcgaccgggactgtttagacggctccgacgaggcttcctgtccagttcttacatgcgggccagccagctttcagtgcaatagctcaacctgtattccccaactgtgggcatgtgataacgatccggattgtgaagacggcagcgatgagtggccccaaaggtgtcggggcctttatgttttccagggggacagttcaccttgcagcgcgtttgagttccactgcttgtcaggagaatgtattcacagcagctggcgctgcgatggaggccctgattgcaaagataaatcggacgaagaaaattgtgcagttgctacgtgtagaccggacgaattccaatgctccgacgggaattgcattcatggcagtagacagtgtgatagggagtacgactgcaaggacatgtccgatgaggttggctgcgttaatgttacactgtgcgaaggtccaaataaattcaagtgtcactcgggggaatgcatcaccttggacaaggtgtgtaacatggccagggactgtcgggactggagtgacgagccgattaaggagtgcgggacagctgcgtgcttggataataatgggggatgctcccatgtctgcaacgctctaaagatcggcgctgagtgcctatgccctgacgggtttcagctagttgcacaaaggcggtgtgaggacatcgatgagtgccaagatcccgatacatgctcccaattatgcgtgaacctggagggaggatacaagtgtcaatgtgaggaaggatttcagctcgacccccatacaaaggcctgtaaggccgtcggcagtatcgcatatttattttttacaaacagacacgaagtgagaaagatgaccttggatagatctgagtacaccagcctgattcctaacctgaggaatgttgtcgcccttgacaccgaagtggcctccaaccgaatctactggagcgacttgagtcagcgtatgatttgtagcacacagctggaccgggcacatggcgtgtcgtcatatgacaccgttatttcacgtgacatccaggcacccgacggcctcgctgtggactggatccactctaacatttactggacggatagcgttcttggtacggtgagcgtagccgacaccaagggcgtgaagcggaaaacattgtttagggagaatggcagtaaaccaagggctattgtggtggacccagtccacggtttcatgtactggaccgattgggggactcctgccaagatcaaaaagggcgggctcaacggcgtggacatctactctttagtgactgaaaacatccagtggccgaatgggatcacactggacctcctctcagggcgcctgtactgggttgatagcaagctgcactctatcagttccatcgatgtaaacggcggtaataggaaaaccatccttgaagatgagaagcgcctggcacatcccttttctctggccgtgtttgaagataaggtattctggacagacatcatcaacgaagccattttttcagctaaccgattgactggaagcgacgtcaatcttttggccgagaatcttctgagccctgaggacatggtgctgtttcacaacctgactcagccccgcggagttaattggtgcgagagaacaacactgagtaacgggggttgtcagtatctctgtctgcccgccccacagataaatccgcactcacccaaatttacctgtgcctgccccgatggcatgttactggctagggacatgagatcttgtctgaccgaggctgaagctgccgtggctacacaagaaacgtcgacggtacgcctgaaggtgagttcaactgccgtccgcacccagcacacgacaacgcggcctgtccccgacacctcccgcctccctggagcaacccccggattgactacggtagaaattgtgaccatgtctcaccaggcactaggagacgtggccggaaggggaaacgaaaagaagccgtcttccgtgcgcgcgctatctatcgtcctgccaatcgtcttgctagtatttttgtgccttggagtattcttactctggaagaattggagactcaaaaacatcaactccataaactttgataatcccgtgtatcaaaaaaccactgaggatgaagtgcacatttgccataatcaggatggatactcctatccctcgcgccagatggtcagcctggaggacgatgtggct

SEQ ID NO: 16397 - DNA, 2580 bp, Artificial Sequence
  Description of Artificial Sequence: Synthetic coding sequence
atgggtccctggggatggaaactgcgctggaccgtcgccctcctcctggccgctgctggcactgccgtcggggatcgctgcgaacggaacgagttccaatgccaagacggtaagtgtataagctataaatgggtgtgcgatggttccgcagaatgccaagacggatctgacgagtcgcaagaaacttgtttgtccgtgacatgtaagtcaggagattttagttgtggtgggagagtgaaccgatgtataccacaattctggaggtgcgatggccaggtcgattgcgataacggatcggatgagcaaggttgccctcccaaaacttgcagccaggacgagtttcggtgtcatgatgggaagtgcattagccgtcagtttgtgtgtgactccgaccgtgattgtctggatgggagcgacgaagcttcctgccctgtgttgacttgtggaccagcaagttttcagtgtaacagctccacctgcattccacagctgtgggcctgcgataatgatcctgattgtgaagacgggtctgatgagtggccacagagatgccgggggctctacgtatttcagggcgattccagcccgtgctcagcatttgagttccactgcttgagtggcgagtgtatccactcatcctggaggtgcgacggtggccccgactgcaaggacaaatcagacgaagagaactgcgcagtagccacgtgtcggcctgatgaattccagtgtagcgatggaaattgcattcacggtagtagacaatgcgatcgtgagtacgactgtaaggatatgtctgacgaggtgggatgtgtcaatgtgaccctgtgcgagggcccgaataagtttaaatgtcactccggcgaatgcatcactctcgacaaggtgtgtaacatggcccgcgattgccgagattggtccgacgaaccaatcaaagagtgtgggacagccgcctgtctcgacaataacggtggctgtagccacgtgtgcaatgccctgaaaataggcgccgagtgtctttgccctgacgggttccagctggtagcacagcgaaggtgcgaggatatcgatgagtgccaggatcccgatacctgtagccagctctgtgtcaatttggaaggcggatataaatgccaatgcgaagagggttttcagctggatccgcatacgaaggcgtgtaaggcggttggatccattgcctaccttttctttaccaatcgtcatgaggtgcgcaaaatgacacttgatagatcggagtacacatcattaattcccaaccttcgaaatgttgtggcacttgacactgaggtggcttcgaaccgcatttactggtccgatctgtctcagcggatgatttgttcaactcagcttgatagagctcacggggtttcatcttacgacactgtgatttcaagagatatccaggcccccgacggcctggccgtggattggatacacagcaatatctactggaccgactccgtccttggaaccgtctcagtcgccgacaccaagggtgtgaaacggaaaaccctgttcagggagaatggcagtaagcctcgggccatcgtagttgatccagtacatggctttatgtattggaccgactggggcacacctgcaaagattaagaaaggcgggctgaacggggtcgacatctattcgctggtgacagagaatatccagtggcccaatggcattactttggacttgttgagcgggcggctgtactgggtggacagcaagctgcatagcataagtagcattgatgtgaatggggggaaccgcaaaacaatcctcgaagatgaaaaacgtctagcacaccccttcagtttggcagtattcgaggacaaagtgttttggacggatattatcaacgaggccatcttttccgcgaatcggctgaccggcagtgacgtgaatttgctagccgagaacctgctgagtcctgaggacatggttttgttccataacttaacccagccaagaggcgtcaattggtgcgagagaacaactttatcgaacggaggatgccaatacctgtgcttacccgcaccccagattaacccccattccccgaaatttacctgcgcctgtcctgatggcatgctactcgctcgagacatgaggtcttgtcttactgaggctgaggccgccgtcgccactcaggaaacctcaacagtgaggctcaaagttagcagtaccgcagtaaggacacagcacaccacgactcgcccagtgccagacacttcacgtctgccaggcgccaccccggggctgaccaccgttgagattgtgactatgtctcaccaagcattaggtgacgtcgccggaagagggaacgaaaagaagccatccagtgttagggcacttagcattgtcttaccgatagtgctgttagtgttcctttgccttggggtcttcttactgtggaagaactggagactgaagaacatcaatagcatcaactttgacaacccagtgtatcagaagactactgaagatgaagtccacatctgtcacaaccaggatggttactcatacccctctcgacaaatggtgtcactggaagatgacgtcgca

SEQ ID NO: 16398 - DNA, 2580 bp, Artificial Sequence
  Description of Artificial Sequence: Synthetic coding sequence
atgggaccgtggggatggaaactgaggtggactgtggccctcctcctggcggcagctggcacggccgtgggcgatagatgtgagcggaatgagttccaatgtcaggacggtaagtgcatctcctacaagtgggtctgtgacggatcggcagaatgccaagacggatcagatgagagccaagagacttgcctgagcgtgacttgcaaatcgggagatttctcctgtggaggacgcgtgaaccggtgcatccctcagttctggcgctgcgacggccaggtggattgtgacaatggatcggacgagcagggctgcccgccaaagacctgctctcaggatgaatttaggtgccacgacggaaagtgtatctcgcgccagttcgtgtgcgacagcgacagagactgcttggatggctccgatgaggcgtcgtgcccagtgctgacttgcggaccggcatcattccaatgcaatagctcgacttgcatcccacaactctgggcgtgcgacaacgatcccgactgtgaagatggatctgatgaatggcctcagaggtgccgcggactctatgtctttcagggcgactcgtccccatgctcagccttcgaattccactgcctcagcggagaatgtattcattccagctggcgttgcgacggaggcccggattgcaaggacaagtcggacgaggaaaactgcgccgtggccacttgccggcctgacgagttccagtgcagcgacggaaactgtatccacggcagcaggcagtgcgaccgggagtacgattgcaaagacatgtccgatgaagtgggttgtgtgaacgtcaccctctgtgaaggaccgaacaagttcaagtgccactcaggagaatgcattactctcgataaggtgtgcaatatggcccgagactgccgcgattggtcggatgaacccatcaaagaatgtggaactgccgcctgcctggacaacaatggagggtgctcgcacgtctgcaacgccctgaaaattggagctgagtgcctgtgcccggacgggttccagcttgttgcccagagacgttgcgaggacattgatgagtgtcaggaccccgatacttgcagccagctctgcgtcaatttggagggaggctacaagtgtcaatgcgaggagggattccagctggacccacataccaaggcctgcaaggctgtgggatccatcgcgtatttgtttttcacgaatcgccacgaggtgcgcaaaatgacgcttgatcggtcggagtacacttctctgatacctaatcttagaaatgtggtggccctcgacacggaagtggctagcaaccggatctattggtccgacctcagccagaggatgatctgttcgacccagttggaccgggcccacggcgtgagcagctatgataccgtgatctccagagatatccaggccccagacggactcgcggtggactggatccattccaacatctactggaccgattccgtgcttggtaccgtctcggtcgcagatactaagggagtgaagaggaaaaccctgttccgcgaaaatggatccaaaccgcgggctatcgtggtggaccccgtccatggattcatgtactggaccgactggggaaccccggcaaagatcaagaagggaggacttaacggcgtcgacatctactcactcgtgaccgagaacatccagtggcctaacggaatcaccctggatctgctcagcggtcggctgtactgggtggatagcaaattgcattcgatctcctcaatcgacgtcaacggcgggaaccgcaaaaccatcctggaggacgaaaagcgccttgcccacccgttttcacttgccgtgtttgaagataaggtgttctggaccgatatcattaacgaagccatcttctcagctaatcggttgactggatcggacgtgaacctgctggccgaaaatctcctgagcccggaggatatggtgctgttccacaacctgacccaaccgcggggagtgaattggtgcgagcgcaccacgctctcgaatggaggctgtcagtacctgtgcttgcctgctcctcagatcaatccgcactcgccaaagttcacgtgtgcctgcccggacggaatgctgctcgccagagacatgcgctcctgcctgaccgaggccgaagcggcggtggcaacccaggagacgtctaccgtgcgcctgaaagtctcgtcaaccgcagtccggactcagcataccaccaccagaccggtgccggatacttcacgcctgccgggagccaccccgggactcactactgtggagatcgtgactatgagccaccaagctctgggagacgtcgctggacggggtaacgaaaagaagccgtcatcagtgcgcgcgctgagcatcgtgctgccgatcgtgctcctggtctttctgtgcctgggagtgttcctgctctggaaaaactggaggcttaagaacatcaactcgatcaatttcgacaacccggtctaccaaaagactaccgaggatgaggtccacatctgccataatcaagacggttacagctacccctcacggcagatggtgagcctggaagatgatgtggca

SEQ ID NO: 16399 - DNA, 2580 bp, Artificial Sequence
  Description of Artificial Sequence: Synthetic coding sequence
atggggccatgggggtggaagttgcggtggactgtggctctgctgctggcggcggcgggcactgcagtcggagacagatgcgaacggaacgaattccagtgccaagacgggaaatgcatcagctacaagtgggtgtgcgatggaagcgcggagtgccaggatggaagcgacgaatcccaagagacttgcctctcagtgacctgtaagtctggtgactttagctgtggcggtagggtcaacagatgcattccacaattctggaggtgcgatggtcaagtcgattgcgacaacgggtcagacgaacaggggtgtccgccaaagacttgctctcaggatgagtttagatgccacgacggcaagtgcatttcaagacaattcgtgtgtgactccgaccgcgactgcctggacggctccgatgaggcttcgtgcccggtgctgacctgcggccccgcgtcgtttcaatgcaacagttcgacctgtattccccagctctgggcatgcgataacgacccggactgcgaagatggtagcgacgaatggccccagcggtgccgcggcctctacgttttccaaggagattcctccccttgctcggcctttgagttccattgcctctcgggggaatgcatacatagctcgtggcgctgcgatggaggacctgactgcaaggataaatcagatgaggagaactgcgccgtggctacctgccgaccagacgagttccagtgctccgacggaaactgtatccacggcagccgccagtgcgatcgcgaatacgattgcaaggacatgtcagatgaagtggggtgcgtgaacgtcactctgtgcgagggacccaataagttcaaatgccattcgggcgagtgtatcacccttgataaggtgtgcaacatggcacgggactgccgcgactggtcagacgagcctatcaaagagtgcggcaccgcagcctgcctggacaacaatggaggttgctcccatgtttgcaatgctctcaaaatcggcgccgaatgtctgtgcccggacggatttcagctggtggcccagagacgctgcgaagatatcgacgaatgccaggatcctgacacctgcagccagctgtgtgttaatctcgagggaggatacaagtgccagtgcgaggagggatttcagctcgacccacacaccaaggcctgtaaggcagtgggaagcatcgcttacttgttcttcactaaccggcatgaagtgaggaagatgaccttggaccgcagcgaatatacttccctgattccaaacttgcggaacgtggtcgcgctggacaccgaagtcgcttccaaccgcatctactggtcagacctgagccaacgcatgatctgctccacccagctggaccgcgcccacggggtgtccagctacgatactgtcatctcccgggatattcaggcaccggacgggctcgcggtggattggattcattccaacatctattggacggacagcgtcctcggcaccgtgtcagtggccgacaccaagggagtgaagagaaaaaccttgtttagagaaaacggttcgaagccgcgggcgatcgtcgtggaccccgtgcatggattcatgtactggaccgactggggcaccccggccaaaatcaaaaaaggcggcctgaatggagtggatatctactcactggtcaccgagaatatccagtggccaaacggaatcactctggaccttttgtcagggaggctctactgggtggattccaagctccactcgatttcctcgatcgacgtaaacggaggaaaccgaaaaactatcctggaagatgagaagcgcctcgcgcacccgttctcgctggccgtctttgaggataaagtgttctggacggacatcatcaacgaagcgatcttcagcgcgaatcgcctgactggttcagacgtcaacctcctggccgagaatctcttgtcgccagaggacatggtgttgttccacaatttgactcagccgcgaggagtgaattggtgcgagcgtaccaccctctcgaatggaggatgccaatacctgtgcctgccagctccacaaatcaacccgcactccccgaaattcacttgcgcctgccctgatggtatgctgttggcccgcgacatgagatcgtgccttaccgaagccgaggcggcagtggcgacccaggagacttccacggtcagactgaaggtgtcctcgactgccgttaggactcaacataccactactcggccagtgccggacaccagccgtctccccggagcgaccccgggcctcacgactgtcgagatcgtgactatgtcgcaccaggcgctcggcgacgtggcgggacggggaaacgagaagaaaccaagctccgtgcgagcgcttagcattgtcctgccgatcgtccttctcgtgttcctctgcctcggagtgtttctcttgtggaagaattggcggcttaagaacattaactctatcaacttcgacaatccagtgtatcaaaagaccactgaggatgaggtccacatctgtcacaatcaggatggatacagctacccgagccgccagatggtgtcgttggaggatgacgtagcg

SEQ ID NO: 16400 - DNA, 2580 bp, Artificial Sequence
  Description of Artificial Sequence: Synthetic coding sequence
atgggcccctgggggtggaaacttcgctggacggtggcactgctccttgcggccgcggggaccgcagtgggcgatagatgcgaacgtaatgagtttcaatgtcaagacggaaaatgtatatcgtacaagtgggtgtgtgatgggtcagcggagtgccaagacggatcagatgaatcgcaagaaacctgtctgtcggtgacctgcaaatccggagacttctcctgtggtggtcgcgtgaatcggtgtattccacagttctggcgttgtgatggccaagtcgattgtgacaacggctccgacgagcaagggtgtcctcctaagacttgttcgcaagacgaattccggtgtcacgatggaaagtgcatctcacgacagtttgtctgtgattccgaccgcgattgtcttgacggttcggacgaagcctcgtgtcctgtgcttacgtgtgggccagccagcttccaatgtaattcctcgacgtgtatacctcaactttgggcgtgtgataatgatcctgattgtgaagatgggtcggacgagtggccccaaagatgccgtggtctgtacgtgtttcaaggcgattcatcaccatgttcagccttcgagtttcattgtctgtctggcgaatgtattcattcgtcctggagatgtgatggcggacctgattgcaaggataagtccgatgaggagaattgcgctgtggcaacttgcaggcctgatgagttccaatgttcggatggaaactgtatccatggaagcagacagtgtgatcgggaatacgactgtaaggatatgtcggatgaggtcggctgtgtgaacgtgaccttgtgtgagggtccgaacaagtttaagtgtcacagcggtgagtgtattaccctggataaagtctgtaacatggcccgtgattgccgagactggtccgatgaaccgattaaggagtgtgggactgcagcgtgcctggacaataacgggggatgtagccacgtctgcaacgcgctgaagatcggcgcggaatgtctctgtcccgacggttttcaacttgtggcacaaagacggtgtgaagatattgatgaatgccaggatcctgatacctgttcccaactgtgcgtgaacttggaaggtggttacaagtgtcaatgcgaagaaggcttccaactggacccgcataccaaggcatgtaaggcggtgggttcaatcgcatatctcttctttaccaatagacacgaggtccgcaagatgactctcgatcgctcagaatacacctcgctgatacctaatctgcgcaacgtggtggcactggataccgaagtggcaagcaatcgaatttactggagcgacttgagccagcgaatgatatgctcaacccagctggaccgggctcatggggtcagctcgtacgataccgtgatttccagggatattcaagcacctgacggtctggcagtggattggatccatagcaacatatactggactgacagcgttctcgggaccgtgtcagtggcggatactaagggtgtgaaacgaaagactctgtttagagaaaacggatcgaagccaagagccattgtcgtggatccagtgcatggatttatgtactggacggattggggcaccccggcaaaaatcaagaaggggggacttaatggggtggatatctactcgcttgtcactgagaatatccaatggcctaacggaataactctcgatcttctgagcggtcggctctactgggtcgactcgaaacttcattcaatttcatcgattgatgtgaatgggggaaaccgaaaaactattttggaagatgaaaagaggctggcacatcctttttcgctcgctgtgttcgaagataaagtgttttggactgacattatcaatgaagcgattttctctgcaaatcgacttaccggttcggatgtgaatcttcttgccgaaaacctgctttccccagaagatatggtgctctttcataaccttactcaacctaggggcgtcaattggtgcgaaagaaccacccttagcaacggtggatgtcaatacctctgccttccagctcctcagattaacccacactcacccaagtttacttgtgcctgtcccgatggaatgctccttgcccgcgacatgagatcctgcctgaccgaagcggaagccgcagtggctacccaagaaacttcaaccgtccgactgaaagtctcctctaccgcagtccgcacgcaacatactaccaccagaccagttccagataccagccgtctgccgggagcaacccctggtctgaccactgtcgaaattgtgaccatgagccatcaagctcttggtgacgtcgcaggaagaggtaacgagaagaaaccgtcctcagtgcgggcgctgtcaattgtgctgccaatagtgctcctcgtgtttctgtgtctgggagtctttctgctttggaaaaactggcggcttaagaacattaactcaattaactttgataacccagtctaccaaaagaccactgaagatgaagtccacatctgtcataaccaagacggctactcctatccctcgcgacagatggtgagcctggaggatgacgtggct

SEQ ID NO: 16401 - DNA, 2580 bp, Artificial Sequence
  Description of Artificial Sequence: Synthetic coding sequence
atgggcccatggggatggaaactcaggtggacagtcgccttgctgctggctgccgctggtactgctgtgggcgaccgttgtgagaggaatgagttccaatgccaggatggcaaatgcatctcttataaatgggtatgtgacggctcagcagaatgtcaggacggctcggacgaaagtcaggagacttgtctttcagtcacgtgtaaaagtggtgatttctcatgtggaggtcgcgtgaatcggtgcatcccccagttttggcgctgtgatggccaggttgattgcgacaacggatctgatgaacagggttgtcctccgaagacatgcagtcaggacgagtttcgctgccacgatggcaaatgcatttccagacagttcgtttgcgactcagatcgagattgtttagacgggagtgatgaggcctcatgcccggtgctcacttgcgggccagcaagctttcagtgtaactcctccacctgcatccctcagttgtgggcctgcgacaatgacccagactgcgaggatgggtctgatgagtggccccagagatgccgggggctgtacgtgttccaaggagattctagtccgtgttcagcatttgagtttcattgtctctccggcgagtgcatccattcttcctggcgctgtgatggaggcccagattgcaaggacaagtctgatgaggagaattgcgcagtcgccacctgcaggcctgacgagttccagtgcagtgacggaaattgtatccacggctctaggcagtgtgatcgcgagtacgactgcaaagacatgagtgatgaagtaggctgcgtgaacgtgaccttgtgcgaagggcccaacaagtttaagtgtcattcgggggagtgcattactttagataaggtgtgcaatatggctcgggactgccgcgattggagcgatgaacccatcaaagaatgtggcacagcagcctgtctagacaataacggaggatgttcccacgtctgtaacgcactcaagattggggctgagtgtctgtgccccgacggattccaattggttgctcaacggcggtgcgaggatattgacgagtgccaggatccagacacgtgttcgcagttgtgtgttaatcttgaaggaggttataagtgccagtgtgaggagggcttccagctcgacccccacaccaaggcgtgcaaggccgttgggtctattgcatacttgttttttactaatcggcatgaagtgaggaagatgactctggatcggagcgagtacacatctctaatacccaacctgcggaacgtggtggccctcgataccgaagtagcatccaatagaatatactggagtgatttaagccagcgcatgatctgctccactcaacttgatagggctcatggggtctcgtcctatgacactgtgatcagtagggatatccaagcccccgacgggcttgccgtggactggattcattcaaacatttattggaccgactcggtgctggggactgttagcgtggcagacaccaagggcgtaaaacgcaaaacactgtttagagaaaacggtagtaaacctagggccatcgtagtcgatccagtgcacggcttcatgtattggaccgactggggcacccccgctaaaattaagaaaggggggttgaatggcgtggacatctattcgctggtgactgaaaacatacagtggcctaatggaattactctggatctgctcagcggaaggctgtattgggtggatagtaagctgcattctatttcgagcattgacgtaaacgggggaaatagaaagacaattctagaggatgagaagagactggcccatccattttctttagccgtttttgaagacaaagtgttttggacagatattatcaacgaggccatttttagcgcgaaccgactcaccggaagtgacgtgaacctgcttgctgagaacttgttaagtccagaggatatggtgctgttccataacttgacacagccacggggtgtcaattggtgcgagcgaaccacattgagtaacggagggtgccagtatttgtgtctccccgctccccagataaacccccattcaccaaagttcacatgtgcctgcccagacggaatgctactggcacgggacatgcgttcatgcctgactgaggctgaggccgcggtggccacccaggagacatccaccgttcgcttaaaagtgagttctactgcagtgcggactcaacatacaacgactcgacccgtgcctgacacttcccgtcttcctggggctacaccaggactcaccactgttgaaatcgtaacaatgagtcatcaggccctgggggatgtggctggccgggggaacgaaaaaaaaccttccagcgtgcgcgccttatctatcgtgctccctatcgtgttgctggtgtttttgtgcctgggtgtgttccttctctggaaaaattggcgcctgaagaacattaactctatcaattttgataaccctgtctatcagaaaactacagaagatgaagtgcacatctgtcacaatcaggatggctatagttatcctagccgccagatggtgtccctggaagatgacgtagcc

SEQ ID NO: 16402 - DNA, 2580 bp, Artificial Sequence
  Description of Artificial Sequence: Synthetic coding sequence
atggggccatgggggtggaagctccgctggaccgtcgcattgctgctggccgccgccggtaccgccgtgggagatcgctgcgaaagaaacgaatttcaatgtcaagacggaaaatgcatatcctacaaatgggtgtgtgacggatcggctgaatgtcaggatggatcggacgagtcgcaagaaacctgtctgagcgtcacctgtaagtcgggagatttcagctgcggaggaagagtgaaccgctgcattccgcaattttggcgctgtgacgggcaagtggactgcgacaacggttccgacgaacagggatgcccaccaaagacttgttcacaagatgaattcaggtgtcatgacggaaagtgcatttctcgccagttcgtctgcgattcggaccgcgattgcctcgatggatctgacgaggcctcctgcccagtgctgacctgcggccctgctagcttccaatgcaactcctcgacttgcatcccgcagctgtgggcttgcgataatgatcctgactgcgaggacgggtcagatgagtggccgcaaaggtgtcggggactctacgtgtttcagggagattcttcgccgtgctcagcgttcgaattccactgcctgtcgggggaatgcatccacagctcttggagatgcgacggggggcctgattgcaaagacaaatctgatgaggagaactgcgcagtggcaacttgccgccctgacgagttccaatgttcggatggaaactgcatccacggcagccggcagtgtgacagagaatacgactgcaaagacatgtccgatgaggtgggatgtgtgaatgtgaccctgtgcgaggggccgaacaagttcaaatgtcacagcggcgaatgcatcaccctggacaaggtctgtaatatggccagagattgccgcgattggtcggacgaacctatcaaggagtgcggcaccgcggcctgccttgataacaatggaggctgttcgcacgtgtgcaacgcactgaaaatcggagctgaatgcctctgcccggacggattccagctcgtggcgcagagacgctgcgaagatatcgacgagtgtcaagacccagatacttgctcccagctctgcgtgaacctggaggggggatacaagtgtcagtgcgaagaaggtttccaacttgacccccataccaaggcgtgtaaggcggtgggttcgattgcatacctgtttttcactaatagacacgaagtgaggaagatgaccctggatcgcagcgaatacacctcgctgatccccaatctccgaaacgtcgtcgcccttgataccgaggtcgcatcgaaccggatctactggtcggacctgagccagagaatgatatgctcgacccagcttgaccgcgctcatggggtgtcgtcctacgataccgtcatctcacgtgatatccaggcaccggacggactggcagtcgactggatccattcgaacatctactggactgattcagtgctcggaactgtttcagtggctgacactaaaggagtcaagcggaaaactctgttccgcgaaaacggatcgaaaccgcgggcgatcgtggtggacccggtccatggtttcatgtactggaccgactggggcactccagcgaagattaagaaaggtggattgaacggagtggatatctactccttggtgacggagaatatccagtggccgaatggaatcactcttgatctgctgtcaggacggctctactgggtcgattcgaagttgcacagcatctcatccatcgacgtgaatggaggaaaccgcaagactatcctcgaagatgaaaagagattggcccacccgttcagcctggccgtgttcgaggacaaggtgttctggaccgatatcatcaacgaagctatcttctccgctaaccgtctgactggctccgacgtgaacctgctggcggagaacctgctgtcgccagaggatatggtcctcttccacaacctgacccagcctcggggcgtgaactggtgcgagagaaccactctttccaatggtgggtgtcaatacctgtgccttcctgccccgcagatcaatccccattcgcctaagttcacctgcgcctgtccggatggaatgctgttggcgcgggatatgcggtcgtgcctgaccgaagccgaggcggcagtcgccactcaagaaacgtccaccgtgagactgaaagtgtcctcgactgctgtgaggacccagcacaccactaccaggccggtcccagatacttcccggcttccgggagctactccgggactgactaccgtcgagatcgtgaccatgtcgcaccaggcactgggagacgtggcgggacggggcaacgagaagaaaccttcatcagtccgcgcactgtcgatcgtgctgccgattgtgctgctggtctttctttgcctgggagtctttctgctgtggaagaactggcggctcaaaaacatcaactccatcaattttgacaatccggtgtaccaaaagaccaccgaggacgaggttcacatctgccataaccaggacggatactcctatccgtcacggcaaatggtgtcattggaggacgacgtggcc

SEQ ID NO: 16403 - DNA, 2580 bp, Artificial Sequence
  Description of Artificial Sequence: Synthetic coding sequence
atgggtccgtggggttggaaactacgttggacggttgcgttattattagcggcggcgggtacggcggtaggtgatcgatgtgaacgtaatgaatttcaatgtcaagatggtaaatgtatatcgtataaatgggtttgtgatggttcggcggaatgtcaagatggttcggatgaatcgcaagaaacgtgtttatcggtaacgtgtaaatcgggtgatttttcgtgtggtggtcgtgtaaatcgatgtataccgcaattttggcgatgtgatggtcaagtagattgtgataatggttcggatgaacaaggttgtccgccgaaaacgtgttcgcaagatgaatttcgatgtcatgatggtaaatgtatatcgcgtcaatttgtttgtgattcggatcgagattgtttagatggttcggatgaagcgtcgtgtccggtattaacgtgtggtccggcgtcgtttcaatgtaattcgtcgacgtgtataccgcaactatgggcgtgtgataatgatccggattgtgaagatggttcggatgaatggccgcaacgttgtcgtggtctatatgtatttcaaggtgattcgtcgccgtgttcggcgtttgaatttcattgtctatcgggtgaatgtatacattcgtcgtggcgatgtgatggtggtccggattgtaaagataaatcggatgaagaaaattgtgcggttgcgacgtgtcgaccggatgaatttcaatgttcggatggtaattgtatacatggttcgcgtcaatgtgatcgtgaatatgattgtaaagatatgtcggatgaagttggttgtgtaaatgtaacgttatgtgaaggtccgaataaatttaaatgtcattcgggtgaatgtataacgttagataaagtatgtaatatggcgcgagattgtcgagattggtcggatgaaccgataaaagaatgtggtacggcggcgtgtttagataataatggtggttgttcgcatgtttgtaatgcgctaaaaataggtgcggaatgtttatgtccggatggttttcaattagttgcgcaacgacgttgtgaagatatagatgaatgtcaagatccggatacgtgttcgcaactatgtgttaatctagaaggtggttataaatgtcaatgtgaagaaggttttcaactagatccgcatacgaaagcgtgtaaagcggtaggttcgatagcgtatttattttttacgaatcgacatgaagttcgtaaaatgacgttagatcgatcggaatatacgtcgttaataccgaatctacgaaatgttgttgcgctagatacggaagttgcgtcgaatcgtatatattggtcggatctatcgcaacgaatgatatgttcgacgcaattagatcgagcgcatggtgtttcgtcgtatgatacggtaatatcgcgagatatacaagcgccggatggtctagcggttgattggatacattcgaatatatattggacggattcggttctaggtacggtttcggtagcggatacgaaaggtgtaaaacgtaaaacgttatttcgagaaaatggttcgaaaccgcgagcgatagtagtagatccggtacatggttttatgtattggacggattggggtacgccggcgaaaataaaaaaaggtggtttaaatggtgtagatatatattcgttagtaacggaaaatatacaatggccgaatggtataacgctagatttattatcgggtcgtctatattgggttgattcgaaactacattcgatatcgtcgatagatgttaatggtggtaatcgaaaaacgatactagaagatgaaaaacgtctagcgcatccgttttcgttagcggtatttgaagataaagtattttggacggatataataaatgaagcgatattttcggcgaatcgattaacgggttcggatgtaaatttattagcggaaaatctactatcgccggaagatatggtactatttcataatttaacgcaaccgcgtggtgtaaattggtgtgaacgtacgacgttatcgaatggtggttgtcaatatttatgtctaccggcgccgcaaataaatccgcattcgccgaaatttacgtgtgcgtgtccggatggtatgttactagcgcgagatatgcgatcgtgtctaacggaagcggaagcggcggtagcgacgcaagaaacgtcgacggtacgtttaaaagtttcgtcgacggcggttcgtacgcaacatacgacgacgcgaccggtaccggatacgtcgcgactaccgggtgcgacgccgggtctaacgacggtagaaatagtaacgatgtcgcatcaagcgttaggtgatgtagcgggtcgtggtaatgaaaaaaaaccgtcgtcggtacgagcgctatcgatagtactaccgatagttttattagtttttttatgtctaggtgtttttctattatggaaaaattggcgattaaaaaatataaattcgataaattttgataatccggtatatcaaaaaacgacggaagatgaagtacatatatgtcataatcaagatggttattcgtatccgtcgcgtcaaatggtatcgctagaagatgatgttgcg

SEQ ID NO: 16404 - DNA, 2580 bp, Artificial Sequence
  Description of Artificial Sequence: Synthetic coding sequence
atgggaccctggggatggaagctcagatggactgtcgccctgctcctggccgcagccggcaccgctgtcggtgatcggtgcgaacggaacgaattccaatgtcaagacggaaagtgtataagctacaaatgggtctgcgatggttcagccgaatgtcaagatgggtcggacgaatcacaggagacgtgtttgtcagtgacctgtaagagcggagattttagctgtggcgggcgagtgaaccgctgtatcccacaattttggaggtgtgatgggcaagtggattgtgacaacggttccgatgaacaaggttgccccccaaaaacctgctctcaagatgagttcaggtgtcatgatggcaagtgtattagcagacaatttgtctgtgattcagacagggattgcctcgacggtagtgacgaagcatcgtgccctgtgcttacgtgtggtcccgcatcatttcaatgcaactcttctacttgtatccctcaactgtgggcgtgcgacaacgatccagattgtgaggacgggtcggacgagtggccacaaaggtgtcgtgggctttacgtttttcagggggactctagcccctgctcggccttcgaattccactgtctgtcgggcgagtgcatacattcctcctggcggtgtgatggtggacctgactgtaaggataagtccgatgaggaaaattgtgccgtcgcgacttgtaggcctgatgagtttcaatgctcagacggaaactgcattcacgggagcagacagtgtgaccgggaatacgattgcaaggacatgagcgatgaagtgggatgtgtcaacgtgaccctttgcgaaggaccgaacaagtttaagtgtcattcaggagaatgcattacccttgacaaggtgtgtaacatggcgcgggactgcagagactggtccgacgaacctatcaaggagtgtggaacggcggcctgtttggataacaacggaggctgctcacatgtgtgcaacgcattgaaaataggggcagaatgtctgtgtcccgatggtttccaacttgtggcacaaagacgctgtgaagatattgatgaatgtcaggatccagacacctgttcgcaactgtgtgtcaaccttgaggggggttacaaatgtcaatgtgaagaaggatttcagctggatccgcatacgaaggcgtgtaaggcagtcggttcgatagcatacctgttctttactaaccgccacgaagtgcgaaaaatgactctggaccgttcggaatacacttcccttattcccaatcttcggaatgtggtcgcgctggatactgaggtggcatcaaaccgcatttactggtcggatctctcccaaagaatgatttgttccacccagctggaccgggcacatggcgtgtcaagctatgatactgtcatttcaagagacatacaagccccagatggacttgctgtggactggatccattcaaacatttactggactgatagcgtgctcggtaccgtgtccgtggcagacactaagggagtcaagaggaaaaccctctttagggagaacggatccaaaccccgcgctatcgtggttgatccagtccatgggttcatgtactggactgactggggcactcctgcaaagattaagaaaggtggtcttaatggggtggacatttactcgctggtcaccgaaaacatccaatggcctaatggaattaccctcgatttgctttcggggcggctgtactgggtcgattccaaacttcattccattagttctatcgatgttaacggaggcaatcgcaaaactatactggaggacgagaagcgactcgcccatccgtttagcctggcagtctttgaggacaaggttttttggaccgacattatcaacgaagcaatcttctcagcaaatcggcttaccggatccgatgtgaatctcctggcagagaacctgctgtcacctgaagatatggtgttgttccataacctcactcaacctaggggtgtcaattggtgtgaacgcactacgctgtcaaacgggggctgtcaatacctttgcctgcctgcaccacaaatcaatcctcactccccaaagttcacctgcgcctgtcctgacgggatgctcctggcgcgcgatatgaggagctgcctgactgaagcagaagctgcagtggcaactcaggaaaccagcactgtccgtctgaaggtcagctcaaccgctgttcgtacccaacacaccaccactcgaccagttccggacacctcgcgcctccccggagccacccccggcctcaccaccgtggaaattgtgaccatgagccatcaggcattgggagatgtcgcaggaaggggaaatgagaagaagccttccagcgtgagggcgctctcaattgttcttccaatcgtcctgcttgtgtttctgtgtctgggtgtgtttctgctgtggaagaattggcggcttaagaacattaactcaatcaattttgataatccagtgtaccaaaagactactgaagatgaagtgcatatctgccataatcaagatgggtactcctacccttcaagacaaatggtgtcacttgaagatgatgtggcg

SEQ ID NO: 16405 - DNA, 2580 bp, Artificial Sequence
  Description of Artificial Sequence: Synthetic coding sequence
atggggccgtgggggtggaaacttcggtggaccgttgctttattgctggccgctgcaggtaccgccgttggcgaccgctgcgagagaaatgagttccaatgtcaggatgggaaatgtatctcatacaagtgggtctgtgatggaagtgccgaatgtcaggacggttccgacgagagtcaggaaacctgtctgagtgttacttgtaaatccggggatttcagctgtgggggaagggttaacaggtgcattccacagttttggcggtgtgatgggcaagtggactgtgacaatgggagtgatgagcagggctgccccccgaagacctgtagtcaggacgagttccgctgccacgacggtaaatgcatttcaagacaatttgtctgtgattctgaccgcgactgcctggacggatcagacgaggcttcttgtcctgtcttgacgtgtggaccagccagtttccagtgcaatagtagcacttgcatcccacagctttgggcttgtgataacgaccccgactgtgaagacggatctgacgagtggccccagcgctgtaggggactgtacgtgtttcagggcgactcttctccttgctctgccttcgaattccactgtttaagtggagagtgtatccacagctcgtggcgctgcgacggaggcccagattgtaaggacaagtctgacgaagagaactgtgcagttgctacctgtcggcctgacgagtttcaatgctccgacggaaattgtatccatggtagcagacagtgtgatagagagtatgactgcaaggacatgtccgacgaagtgggctgtgtcaacgtgactctgtgcgagggtcctaacaaatttaaatgccatagtggtgagtgcatcactctcgataaggtgtgcaacatggcccgggattgtagagattggtctgatgagcctatcaaggagtgtggcacagccgcatgtctggataataatggaggttgctcccatgtctgtaatgcgttgaagataggagcggagtgcctctgccccgacgggttccagttggtagcccagcgacgctgtgaggacatagatgaatgccaggatccggacacatgcagtcagctttgtgtgaacctcgagggaggatacaagtgccagtgcgaggagggctttcagctggatccacacacgaaagcatgcaaggcggtaggctctattgcctatttattctttacgaaccggcatgaagtgagaaagatgaccctagatcgcagcgagtacacttccctgatccccaacctgcggaacgtggtggctctcgataccgaggtggcgagtaataggatttactggagcgacttgtcccaacggatgatatgcagcactcagctcgacagggcacacggcgtgtcatcctatgacactgtgataagccgggacatacaggcaccagacgggctcgccgtcgactggatccactcaaacatctactggacagactccgtcctggggaccgtttccgtcgcggacactaagggggttaaacgcaagacactgtttagagagaacggctcgaagccaagagcaattgtggtggaccccgtgcatggatttatgtactggactgattggggaacccctgcgaagatcaagaaaggcggtttgaacggggtggacatttacagcttggtgaccgagaatatccagtggccaaacggaataactttggatctcctttcaggaaggctctactgggtggattcaaagcttcactccatcagctctatcgacgtcaatggcgggaaccgtaaaaccatcctcgaggacgaaaaacgactggcccacccattcagccttgccgtgttcgaggataaggtgttctggacagatatcataaatgaagcaatttttagcgctaacagactaactggctcggatgttaacctcctggcggagaatctgttgtctccagaggacatggtgttgttccacaacttgacccagccgagaggggtgaattggtgcgaaagaactaccttgtctaatggagggtgccaatatctgtgcttgccggcacctcagataaatccgcattccccaaagtttacctgcgcctgtcctgatggtatgctcttggcgagggacatgaggtcttgtctgaccgaggccgaggcggcggtagctacacaggaaacctccactgtgaggctaaaggtctcttcaacagccgtcaggacacagcacaccacaacaagacccgtgcccgatacctcgcgtcttcccggagccacgcccggcttgaccacagtggagatagtcactatgagtcatcaggcactcggtgacgtggctggcaggggtaacgaaaagaagcccagctccgtacgcgcactttcaatcgtcctgcctatcgttctcctggtgttcctatgcttgggcgtgttccttctgtggaagaactggcgactgaagaacattaactccattaacttcgacaaccctgtgtatcaaaaaactaccgaggatgaagttcatatctgtcataatcaggatggatattcataccccagcagacaaatggtgtctctggaagatgatgtggcc

SEQ ID NO: 16406 - DNA, 2580 bp, Artificial Sequence
  Description of Artificial Sequence: Synthetic coding sequence
atgggtccctgggggtggaagctgcgatggacggtcgctttgctattggcggccgcgggtacagcagtgggtgataggtgcgagcgcaatgagttccaatgccaggacggcaaatgtatatcatataagtgggtgtgcgatggttcggcggagtgtcaggacggaagcgacgagagtcaggagacgtgcctgtccgtgacctgcaaatccggggacttctcgtgtggtggccgcgtgaataggtgtattccacaattctggcggtgcgacggccaggttgactgtgacaatggaagcgacgagcagggctgtccgccaaagacgtgcagccaggacgagtttaggtgccacgatggaaagtgtatcagtcgtcagtttgtctgtgatagcgaccgggattgcctagacggatcagatgaggcaagttgtccagtgctgacttgcggccccgccagttttcagtgcaattcttcgacttgtatcccacagctttgggcttgcgacaatgatcccgattgcgaggatggatccgatgagtggccgcaacgctgccgaggtctatacgtgtttcagggtgacagttcgccttgtagcgccttcgaatttcattgcctgagcggcgaatgcatccacagtagctggcgctgtgacggtggaccagattgcaaagataagagcgatgaggaaaactgcgctgtggcaacttgtagacccgacgagtttcagtgcagcgatggaaattgcattcacggctcccgccagtgcgatcgtgaatacgactgcaaggatatgagtgatgaagtcggctgtgtgaatgttacgttatgtgaaggtccgaacaagttcaagtgccattcgggagaatgtataaccctggataaggtgtgcaacatggctcgggactgccgcgactggagcgatgaacccattaaggagtgcggaacagcggcttgtctagacaataatggtggttgcagccacgtttgtaacgcgctgaagatcggcgcagagtgtttatgcccagatggattccagctggtggcacagcgcagatgtgaggacatagacgaatgccaggaccccgatacatgctcccaactctgcgtgaacctggagggcggctacaaatgtcagtgcgaagaggggtttcaattggatcctcacacaaaagcttgcaaagccgtgggttcgatcgcctatctcttctttaccaatcgtcacgaggtgagaaagatgaccttggatcgttccgaatatacgagcctgattcccaacctgcgaaatgtggtggccctggatacagaggtggcctcgaaccgcatttactggagtgacttgagtcaacggatgatttgcagcacccagctggaccgcgctcacggcgtgtcgagctacgatactgtcatctcgcgggatatacaggcccccgatggtctagccgtcgattggattcattcgaacatatattggaccgattcagtgctgggaacggtgtcggtcgctgacactaaaggcgtgaagcgcaagacactcttccgggaaaatggcagcaagccccgcgctatcgtggtggatcccgtgcacggctttatgtactggactgattggggcactccagccaagatcaagaagggtggactgaatggtgtggacatctattccctggtgactgaaaatatacagtggccaaacgggataactctggacctgctgtcaggccgactttactgggtggacagtaagttgcactcgatctcatccattgatgtcaacggtggcaaccgcaagactatcctggaggatgaaaaacgtttggcccaccccttttcgctggcagtcttcgaggataaggtgttctggacagatattatcaacgaagccatattctccgccaatcggctaaccggtagcgacgtgaatctgttagccgagaacctgctgtcgccagaggatatggtattatttcacaatctgactcagccccgaggagttaactggtgcgagcgtacgaccttgtccaacgggggctgccagtacctgtgccttccagccccccagataaatccgcattcgcctaaattcacctgcgcttgccccgacggcatgctcctggcacgcgatatgcgctcgtgtctgactgaggcagaagctgcggtagcaacccaggagacaagcactgtgcgcctgaaagtgtctagcaccgcagttcgtacccagcatacaaccacccgtccagtacccgatacgagtcggctgcccggtgcgacccccggattgaccaccgtagaaatcgtgaccatgagccatcaagctctcggagacgtggcggggagaggtaacgagaagaagccatcgagtgtgcgggctctttcaatcgtactgccaatagtgctcctggtgtttctatgtctgggtgtcttcctgctgtggaagaattggcgtctgaaaaatatcaattccatcaattttgacaatcccgtgtatcagaaaacgacggaggacgaggtgcacatctgtcataatcaggacggttactcatatccgtctagacagatggtctctctggaggatgacgtcgcg

SEQ ID NO: 16407 - DNA, 2580 bp, Artificial Sequence
  Description of Artificial Sequence: Synthetic coding sequence
atgggcccctggggctggaaactccgatggaccgtggcccttttgcttgccgctgctgggaccgcagtgggcgataggtgtgaacgcaacgagtttcaatgtcaagacggaaaatgtatcagttataagtgggtctgtgatggcagcgccgagtgtcaggatggaagtgatgaaagccaagagacttgcctgtctgtcacatgcaagtccggcgacttcagttgcggcggacgggttaacaggtgcataccgcagttctggaggtgtgatggacaggttgattgcgacaatggctcagacgagcagggatgccctccaaagacttgttcccaggacgaattcagatgtcacgacggtaaatgtatttcacgccagtttgtatgtgactctgacagggattgcctggacgggtctgacgaggcaagttgcccagtcctcacctgtggcccagcctcgtttcagtgtaactcatcaacttgtatcccacagttgtgggcctgtgacaatgatcccgactgcgaagacggctctgacgagtggccccaacggtgccggggcttatacgtgtttcagggcgatagctctccctgctcagcctttgagtttcactgccttagcggtgaatgtatccacagttcttggcgatgtgatgggggaccagactgtaaagacaaatctgacgaggagaactgcgcggtggcaacatgtcggcccgacgagtttcagtgctccgatggaaactgcattcatgggagccggcagtgcgaccgggagtacgattgcaaagacatgagtgacgaggtggggtgcgtcaacgtgaccctgtgtgaaggaccgaataagtttaagtgtcactccggagagtgtatcacactggataaggtctgtaatatggcaagggactgtagggactggagcgacgagccaatcaaagagtgcgggacagctgcttgtctggataataatggggggtgtagccacgtgtgtaatgctttgaaaatcggagccgagtgcctgtgcccggacggcttccagctcgtagctcagcggagatgcgaggatatcgatgaatgtcaagatcccgatacatgcagtcaactgtgtgtaaatcttgaaggcggctacaaatgccaatgtgaggaagggtttcagctcgacccccacacgaaggcatgtaaggctgttggaagtattgcttatctttttttcaccaacaggcatgaggtgaggaaaatgactcttgaccgaagtgagtacacctcactcatccccaacctgcgaaacgttgttgccctggacactgaagttgcttcgaatcgaatctactggtccgacctcagccagagaatgatatgctcgactcagctggacagggcccatggagtgagtagctacgatacagtaatctccagggacattcaagcccctgacggcctcgccgtcgactggattcatagtaacatctactggactgattctgtgctcggtacagtgtctgtggccgatactaaaggggtcaaacgaaagacactcttccgcgagaacggttccaaacctagggctatagttgtagatccggtgcacggattcatgtattggaccgactgggggacacctgcgaagatcaagaagggagggctgaacggagtggacatctactccctagtcaccgagaacatacagtggcctaatggaatcacgctggatctgttgtccggccggctctactgggtggactccaagctgcactccatatcttccatcgatgtcaatggtggcaacaggaagaccatcctggaagatgagaagcgcctcgcccacccattcagcttggccgtgttcgaggacaaggtgttttggactgacattataaacgaagccatcttctctgctaaccggcttacggggagcgacgtcaatctgctcgcagagaatctgctttcccctgaggacatggtactctttcacaacttaacacaacctcgcggcgtcaactggtgcgagcgaacaactctgagcaacggaggctgccagtatctatgcctgccagccccacagataaacccgcattcccccaagtttacctgcgcttgcccagacgggatgcttctggcaagagatatgagaagttgcctgacagaagcggaggctgccgttgctacccaggagacctccaccgtgcgattgaaggtttcatccacagccgtgaggacgcagcacacaactacacgtcctgtccccgatacaagcaggctccccggcgcaacaccggggttgacaaccgtggaaatcgtgaccatgagccaccaggcactgggggatgttgcaggtagaggaaacgagaagaagccttctagcgttcgtgcgttgtcaattgtgcttccaatagtgctgttggtctttctgtgcctcggggttttcctgctctggaagaattggagattgaagaacattaactctataaatttcgataatcctgtgtatcagaaaacaacagaggacgaggtgcacatttgtcataatcaagacggttattcctatccaagtaggcagatggtaagcctggaggatgatgtggcc

SEQ ID NO: 16408 - DNA, 2580 bp, Artificial Sequence
  Description of Artificial Sequence: Synthetic coding sequence
atgggaccttggggctggaagctcagatggactgtggccctcctgctggctgccgcgggtaccgccgtgggtgatcgctgtgagagaaacgaattccaatgtcaggatgggaaatgtatttcgtacaagtgggtgtgtgacgggagcgcggaatgccaagacggttcagatgagtcccaagaaacttgtctgtccgtgacctgtaagtctggagatttctcctgtggtggtagggtgaaccggtgtattccgcaattctggaggtgtgatggtcaagttgattgtgacaacggatcggacgagcagggatgtccacctaaaacgtgctcccaggatgaattccgctgtcacgatggtaagtgcatttcacggcagtttgtctgtgattcggacagagactgtctggatgggtcagatgaggctagctgcccagtgctcacctgcggtcctgcatcatttcaatgtaattcctccacctgcatcccacaactgtgggcgtgtgataacgatccggactgcgaagatggcagcgatgagtggccgcagagatgtcgtggcctttacgtgtttcaaggtgattcctcgccctgttcggcattcgagtttcactgcctgagcggcgaatgtattcactcatcctggcggtgcgatggaggacctgactgcaaagacaaatcagatgaggaaaattgtgcagtagcgacctgtaggcccgatgagtttcagtgctcggacggtaactgtattcatggttccagacaatgcgatagggaatacgactgcaaagatatgtcagatgaagtgggctgtgttaacgtcactctttgtgaaggaccaaacaagttcaagtgtcattcgggtgagtgtataacccttgataaggtttgtaatatggcccgggattgtcgtgattggtcggatgagcctatcaaagaatgtggcaccgcggcatgtctggataacaacggaggctgcagccatgtgtgtaatgcacttaagattggggcagaatgtttgtgcccagatggtttccagctcgtggcacaacggagatgcgaagatatagacgaatgtcaagatccagatacttgctcgcaactttgtgtcaacctggaaggaggatacaagtgtcagtgtgaggaagggtttcagcttgacccccatactaaggcctgtaaggcagtggggtcgatagcatacctcttctttaccaacaggcacgaggtcaggaagatgacccttgatcgatccgaatacaccagcctgatccctaatctgcggaatgtggtcgcacttgacaccgaagtggcatcgaatagaatttactggtcggaccttagccaacggatgatttgttccacccaactcgaccgggcacacggggtgtcctcgtacgacactgtgatctccagagacatccaagccccagatggactcgcagtggattggattcattctaacatttactggactgattcggtgctgggaactgtgtcggtcgctgataccaagggagtgaagcggaaaactctgtttcgtgaaaacggttccaagccacgagcaattgtggtcgatcccgtgcacggtttcatgtactggaccgattggggaactccggcaaagattaagaaagggggtcttaacggtgtggacatttactctctggtgaccgagaacattcagtggcccaacggtataactctggatctcctgtccggcagactctactgggtggattcgaagctccattcgatttcatccatcgacgtgaacggagggaatagaaagactatactggaagatgaaaagagacttgcacacccatttagccttgcagtgttcgaggacaaggtgttttggactgacataatcaacgaagctatattctcggccaaccgtctgaccggaagcgatgtcaaccttctggccgaaaatcttttgagccctgaggacatggtgctgtttcataacctgacccagcctcgcggagtgaactggtgtgaacgcactactctttccaatggtggttgccagtacctttgcctgcctgctcctcagattaacccccattccccaaagttcacttgtgcatgtcctgacggaatgttgctggcccgtgatatgcgttcatgcctcactgaggcagaggccgcggtggcgactcaggaaacttcgaccgtgcggctgaaggtcagctccaccgcggtcagaactcagcatacgacgactagaccagtgcccgatacctcgcgacttccaggtgcaacccccggtctgaccactgtggaaattgtgactatgtctcatcaagctctgggggacgtggcaggtagaggcaacgaaaagaagccatcgagcgtcagagcactgtcgatagtcttgcctatagtgctccttgtgttcctgtgtcttggcgtgttcctgctgtggaagaactggaggctcaaaaacataaactccatcaattttgacaaccctgtttaccaaaagaccactgaggatgaagtgcacatttgtcacaaccaagatggttactcgtacccttcccggcagatggtgagcctggaagatgacgtggca

SEQ ID NO: 16409 - DNA, 2580 bp, Artificial Sequence
  Description of Artificial Sequence: Synthetic coding sequence
atgggcccttgggggtggaagctgcggtggactgtcgccctgctgctggctgctgccggcactgcggtaggcgaccgttgtgagcgtaacgaatttcagtgtcaggacggcaagtgtattagttataaatgggtctgtgatgggtccgctgaatgccaagatggatcggatgagagccaggagacatgtctgagcgtgacctgtaagtcaggggacttcagctgcggcggccgggtgaaccgttgcataccccagttctggcgctgtgatggccaggtggattgtgataatgggagcgatgaacagggatgtccaccaaaaacgtgctctcaggacgagtttaggtgtcacgacggaaaatgtatctccaggcagttcgtgtgtgattccgatcgtgactgcctggatggttctgacgaggccagctgccctgtgcttacttgtggacccgcctcttttcaatgcaacagttctacttgtattcctcagctgtgggcttgcgacaacgaccccgactgtgaggacggtagtgacgagtggccccagcgctgcaggggtctttatgtttttcagggagacagctccccttgctctgccttcgaatttcactgtctcagtggcgagtgcattcactccagttggcgctgtgacggaggcccggactgtaaagacaaaagtgatgaagagaactgcgccgtggcaacatgccgcccagatgaatttcagtgcagtgatggcaactgtatccatggctctcgccagtgcgacagagagtacgattgtaaggatatgtccgacgaggtcggttgtgtcaacgtgactctatgcgaggggcctaacaaatttaagtgccactctggtgagtgcatcactctagataaagtatgcaacatggcaagagattgccgcgactggagcgatgaacccatcaaggagtgcggcacggccgcttgtctggacaataatgggggatgctcacatgtttgtaacgctttgaagattggggcagaatgtctgtgtcccgatggctttcagctcgtggcccagaggcgctgcgaagatattgacgaatgtcaggacccagacacctgttcacaactgtgcgtcaacctagagggcggatacaaatgccagtgtgaagagggtttccagttggatccccacaccaaggcgtgtaaagcagttgggagcatcgcatacctcttcttcacaaatcggcacgaagtcagaaagatgacgctggaccggagtgaatacacctctctgattccgaaccttaggaatgtcgtggctcttgatacagaggtcgctagcaacaggatttactggtcagatctgtcccaacggatgatttgctccacgcaactcgatcgggcccatggggtgtcctcctatgacactgtgatctccagggacatccaagccccagatggcctcgcagtagactggattcactcgaacatttactggacggattctgtcctgggaaccgtgtcagtagccgatactaagggagtaaaaagaaagactttgttcagagagaacggaagcaagccgcgcgcaattgtggtggacccagtgcacggattcatgtactggactgactgggggacacccgctaagatcaaaaaggggggactcaacggggtagatatttatagccttgtgactgaaaacattcagtggcccaacggaatcacccttgatttgctttcaggcaggctgtactgggtggacagcaaactccacagcatctcctccatcgacgtgaacgggggaaatagaaaaactattttggaggacgagaaacgtctggcccatcctttttctctggccgtgtttgaggataaggtgttctggactgacataataaacgaagctatcttttccgcgaatcggctcaccggatcagatgtgaacctattggccgagaacctcctgtcccctgaggacatggtcctattccataaccttacacagcctaggggagttaactggtgtgagcggacgactctctccaatgggggttgtcagtacctgtgtctgcctgctccccagatcaatccccactctcctaagtttacctgtgcgtgtccagatggcatgctgttggcgagggacatgcggtcatgtctcacggaggctgaggctgccgtggcaactcaggaaactagcacggtccgcctaaaggtgtcctctactgcagtgagaacacaacacactactactcgccctgtgcccgacacttctagacttccaggtgctacccctggacttacaacggtggagatcgtgaccatgtcccatcaggctctaggggacgtggcaggcagggggaacgaaaaaaagcctagttctgtccgcgcattgtccatagtgctgccaattgttctcctggtgtttctgtgcctcggggttttcctcctatggaagaactggagattaaagaatattaacagtatcaactttgataatccagtgtaccagaagactacagaagatgaggttcacatctgccataaccaagacggctacagctatccctcccgccagatggtcagcctggaagacgatgttgca

SEQ ID NO: 16410 - DNA, 2580 bp, Artificial Sequence
  Description of Artificial Sequence: Synthetic coding sequence
atgggaccatgggggtggaagctccgctggaccgtggcgttgctccttgcagccgccgggactgctgtgggagatcggtgcgaaaggaacgagttccagtgccaggacggcaaatgcatcagttacaagtgggtctgtgatggatcggcagagtgtcaagacggaagcgatgaatcgcaagaaacctgtctgtcggtgacctgtaagtctggggatttctcgtgcgggggcagagtgaaccgctgcattccacagttttggagatgcgatggacaggtcgattgtgacaatgggtctgatgaacaaggatgtcctcctaagacgtgcagccaagatgaattccgctgccatgacggtaaatgtataagccgacaatttgtgtgtgactcggatcgggattgcctggatggaagcgacgaagcgtcatgccccgtgctcacgtgcggtccagcatcgtttcagtgcaactcgtccacctgtatcccccagttgtgggcgtgtgataatgatccagactgtgaggacggatcagatgaatggcctcagaggtgccgaggactctacgttttccaaggggattcatcgccatgttccgcatttgaattccactgtcttagcggagaatgtattcactcaagctggcgttgcgatggtggccctgattgtaaggataagagcgatgaagaaaactgtgccgtggcaacttgtagacccgatgaatttcagtgctcggatggcaactgtattcatgggtcaaggcagtgtgacagagaatacgattgtaaggacatgtccgacgaggtcggatgtgtgaatgtgaccctgtgtgagggacccaataagttcaagtgtcattccggagagtgtattactcttgataaggtttgtaatatggctagagattgtagagattggagcgacgaaccaattaaggaatgtggtactgcggcatgtctggacaacaacggcggctgctcacatgtgtgtaatgctctcaagatcggcgcagaatgtttgtgtcctgatggatttcaactcgtcgcacaacggagatgcgaggatatcgatgaatgccaagatcccgatacttgtagccaactttgtgtgaacctggaaggtggatacaagtgtcagtgtgaagagggattccaactggatcctcacaccaaagcctgcaaggcggtgggatccatcgcctacttgttctttaccaacagacacgaagtgcgaaagatgacccttgacagatcggagtacacgtcgcttatacctaatctgcgaaacgtggtggcgctggataccgaggtggcgtccaaccgaatctactggagcgatctttcgcaacgcatgatatgctcgacgcaattggaccgagcacatggtgtgtcgtcctacgacactgtgatctcgcgggatattcaagctccggatggcctggcagtggattggattcactcgaacatttactggactgactcagtgcttggcaccgtgtcagtggcagatactaaaggggtgaagagaaagactctctttcgagaaaatggcagcaagccgcgagcaattgtcgtggatccagtccacggctttatgtactggactgattggggaactccagccaagatcaagaaaggcggacttaacggcgtggatatctactcccttgtcacggagaacattcagtggcctaatggaattaccctggatctcctgtccggtagactgtactgggtcgactcaaagctccattcaatatccagcattgatgtcaacggaggaaaccgtaagactatacttgaggacgaaaaaaggcttgctcaccctttttcccttgcggtgtttgaagataaggtgttttggaccgacattatcaacgaggcaattttctctgcaaataggttgaccggctcagacgtcaaccttctcgccgaaaatcttctttctcctgaagatatggtcctgttccacaaccttactcagcccagaggcgtgaactggtgcgagcggactactctgagtaatggaggttgtcagtacctgtgccttcctgcaccacaaatcaatccacattctcccaaattcacgtgtgcctgccccgatggtatgcttctcgcacgagacatgcggagctgcctcactgaagccgaggctgcagtggccacccaggaaacctcgaccgtccgtctgaaagtcagctcgaccgccgtccgcacccaacataccaccacgcgacctgtgcccgatacctccagactgccgggagcaactcctgggcttaccaccgtcgaaatagttaccatgtcacaccaggcgcttggagacgtcgccggcagagggaatgagaagaagccatcctcagtgcgagcgctcagcatcgtgttgccaatcgtgcttctcgttttcctctgccttggcgtgtttctgctgtggaaaaactggcgtctcaagaacatcaactccatcaacttcgataaccctgtgtaccaaaaaaccactgaggacgaagtccatatttgccacaatcaggatgggtactcctacccatcgcgccaaatggttagcttggaggacgatgtggca

SEQ ID NO: 16411 - DNA, 2580 bp, Artificial Sequence
  Description of Artificial Sequence: Synthetic coding sequence
atgggaccatggggatggaagttgaggtggaccgtggcactcttgcttgcggctgccggcactgccgtcggcgataggtgtgaaaggaacgaattccagtgccaagacggaaagtgcatctcctacaagtgggtttgtgatgggtcagcggagtgtcaggatggcagtgacgagtcacaggaaacctgtctgtctgtgacctgtaagagtggggactttagctgtggcggcagagtaaacaggtgtatcccccagttttggcgctgcgacggacaggtggactgtgacaacggctcagacgagcaggggtgcccgcctaagacatgttcacaagatgaattcagatgtcatgacggaaagtgcattagtagacaattcgtgtgtgatagtgatcgcgattgccttgatggcagcgatgaagctagctgtccagtgctaacctgcggtcctgctagttttcagtgcaactcctccacatgcatacctcagctttgggcgtgtgataacgaccctgactgtgaagatggatctgatgagtggcctcagagatgcagggggctgtatgtgttccaaggagacagttctccctgctctgcatttgagttccattgtctatctggggaatgcatccactcgtcttggcgctgtgatggaggtccagattgtaaggacaagtccgacgaggagaattgcgcggtggcgacttgcaggccggacgagtttcaatgttccgacggaaactgtattcatggctcacgacagtgcgatagagaatatgattgcaaagacatgagtgacgaagtgggctgcgtgaatgtgaccttgtgtgagggtcccaataagttcaagtgccactcaggagagtgcatcaccttagataaggtctgtaacatggcccgagactgtcgagactggtctgatgaacccatcaaagagtgcggcaccgctgcctgcctagacaacaatggcggctgcagccatgtctgcaatgctttgaaaatcggggccgaatgcttatgtcctgatgggtttcagctggtcgcccagagaaggtgtgaagacatcgatgagtgccaggatcctgatacctgttcccagctgtgtgtcaacctggagggaggatataaatgccagtgcgaggagggattccagctcgaccctcataccaaagcctgcaaggcagtgggctctatcgcctacttgtttttcaccaatagacacgaagtgcgcaagatgacgctggacagatcggagtatacatcccttatccccaatttaagaaatgtggtggccctcgacactgaagtggcaagtaaccgaatttactggtcagatctgagtcagaggatgatctgtagtacccaattggatagggcacatggcgtgagctcttatgatacagttatcagcagagatatccaggcaccagacggattggccgtagactggattcactccaatatctattggacagacagtgtactcgggacagtgtctgtagcagacaccaagggtgttaagaggaagacgctcttcagagaaaacggatctaagcctagggcaatagtagttgaccctgtgcacggcttcatgtattggacggactggggaaccccggccaagatcaagaagggcggattaaatggagtggatatctactccttagtgactgaaaatatccaatggccgaatgggataacgctggatctcctgtctggaagactgtattgggtggatagcaagttgcactctattagcagcattgatgttaacggcggaaatcgaaagactattttagaggatgaaaagagactggctcaccctttttccctcgctgtgtttgaggataaggtgttttggaccgacattataaacgaggcaatcttttccgctaatagactgacgggcagtgacgtcaacctgcttgccgagaacctcctgtcgccggaggacatggttctcttccacaacctgacccaaccaagaggagtaaattggtgtgagaggactacactcagcaatggggggtgtcagtacctctgcctgccagcacctcagataaatcctcattccccaaaatttacatgtgcatgtccagatgggatgcttctggcaagagatatgaggagctgtctgaccgaggctgaggctgccgtggctacccaagagacaagcactgtgcgactcaaggttagcagtaccgcagtgcgaacccagcatactacaactcggcccgtgcctgacaccagtagattgccgggggcgactccaggcctgaccaccgtggaaattgtgacaatgtctcaccaggccttgggtgacgttgcggggcggggtaatgagaagaaaccttccagcgtgagagccttgagcatcgttttaccaatcgtgctgctggtctttctctgtctgggcgtattccttctgtggaaaaattggaggttgaagaatatcaactcaataaattttgataaccctgtgtatcaaaagaccaccgaggacgaggtccacatatgtcacaaccaggacggttactcgtatccaagcagacagatggtgtccctcgaggacgacgtcgcc

SEQ ID NO: 16412 - DNA, 2580 bp, Artificial Sequence
  Description of Artificial Sequence: Synthetic coding sequence
atgggtccgtggggttggaaacttcgctggactgtggcgcttttattagctgcggccggcaccgcggtcggggacagatgcgaaaggaatgaatttcagtgtcaagatggcaagtgtatttcatacaaatgggtgtgtgatggctcagcagagtgtcaagacggctcggatgaatctcaagagacttgcctgtcagttacctgcaaaagcggtgacttttcttgcggcggcagagtcaaccggtgtatcccgcaattttggcgttgcgatgggcaagtcgattgcgacaatggaagtgatgaacaggggtgtccgcctaaaacttgttcacaagatgagttcagatgtcatgatggaaaatgcatttctaggcaatttgtgtgcgactcagatagagattgcctagacggatctgatgaggcgtcctgtccggtgttgacatgcggtccggccagctttcaatgcaactcaagcacgtgtataccgcagctttgggcctgcgataatgaccctgattgtgaagacgggtcagatgagtggccgcagagatgtcggggcctttatgtgtttcaaggcgactcatccccttgttcagcttttgaattccactgtctcagcggggaatgtatacattctagctggagatgcgacggcgggccggattgcaaagataaatccgacgaagaaaattgtgcagtagcgacatgtcgtccggacgaatttcagtgctccgacggaaactgcattcatggatcacgtcaatgtgatagagaatacgattgcaaagatatgagtgatgaagtcggctgtgttaatgtgacgttgtgcgaaggacctaataaatttaaatgccatagcggagagtgcatcacattggataaggtatgcaacatggcgagagattgccgcgactggtcagatgaaccaatcaaggaatgcggcactgcggcgtgcttagataataacggggggtgttctcacgtgtgtaacgctttaaaaatcggggctgaatgtttatgccccgatggctttcaactggttgctcaaagaagatgtgaagacattgatgaatgtcaggacccggatacctgttcgcaactttgtgtgaatcttgagggaggatataagtgccaatgtgaagaagggtttcagctggatccgcatacaaaagcgtgtaaagcagtgggcagcattgcttatttattcttcacaaacagacatgaggtcagaaaaatgacactggaccgttctgaatacacaagccttatcccgaatcttcgcaatgtggtggcgcttgacactgaggttgcatcaaaccgcatttattggtcagatttatctcagcgtatgatttgttccacacagcttgatcgagcacatggagtgtccagctatgatactgttatcagtcgagatattcaggcgccggacggtttagccgttgattggatccatagcaacatctattggacagattcagtattgggcacggtgtcagttgctgatacaaagggggtgaagcgtaagacattattccgggaaaacggctcaaagccaagggctatcgttgttgatccggttcatgggtttatgtactggacggattgggggacgcccgcaaaaataaaaaagggagggttaaacggtgtcgatatttattcattagtgacagagaacattcaatggcctaacggaatcacgctcgatttacttagtggcagattgtactgggttgatagcaaacttcactcaattagcagtattgacgtcaacgggggtaacaggaaaacaatactggaagacgagaagcgcttagcccatccattcagtttagctgtctttgaagacaaagtgttctggactgatattattaacgaagccattttctcagcgaatcgccttacgggatcagatgttaatctgctggcagaaaatcttctcagtccggaagatatggttctgtttcataacctgacacaacctcgcggcgtcaattggtgcgaacgaactacactgtcaaacggaggatgtcagtatctttgtcttcctgcgccgcaaatcaaccctcattctcctaaatttacatgtgcgtgcccagatggaatgcttcttgcgcgtgatatgagaagctgtttaactgaggcggaagcggctgtcgctacgcaggaaacaagtacggtaaggttgaaggtttcatccactgctgttagaacgcagcatactaccacaagacctgtaccggatacctcccgcctgcccggagctacgccaggtttaactactgtggaaattgtcaccatgtcccatcaggctttaggagacgtcgccggacgcggcaatgaaaaaaaaccgtcttctgtcagggccttgtcaattgttctgcctatcgtgttgttagtttttctttgtctcggagtctttctgctgtggaaaaattggcgccttaaaaacattaattctataaattttgataatccggtgtatcaaaaaacgacggaagatgaagtccatatttgccacaatcaggacggatactcttatccgtctagacaaatggtgtccctggaagacgatgtagct

SEQ ID NO: 16413 - DNA, 2580 bp, Artificial Sequence
  Description of Artificial Sequence: Synthetic coding sequence
atgggaccatggggttggaagctgcggtggactgtcgcccttctcttggcagctgctggtactgcagtgggggatagatgtgagagaaacgaatttcagtgccaagacggcaaatgtatatcctacaaatgggtgtgcgacggctctgcggaatgccaggatggttcggatgaatcgcaagaaacttgtctctcggtgacgtgtaaaagcggggacttttcctgtggcggacgggtgaatagatgcataccccaattctggcgctgcgatggtcaggtcgactgcgataacggatcagacgaacaggggtgtcctcctaagacttgctcccaagacgaattccgctgtcacgatggaaaatgcatttcgaggcagtttgtgtgcgactccgaccgggactgcctcgacggctccgatgaggcatcctgtcctgtccttacctgcggacctgcatcgtttcaatgcaactcgtccacctgtatcccgcaactgtgggcatgtgacaacgatcccgattgtgaagatggatccgatgaatggcctcagagatgtcggggtctttacgtgtttcagggagacagttcgccatgctccgcattcgaatttcactgtctctccggagaatgtatacactcttcctggcgatgcgatggtggtccagattgcaaggacaagtcagatgaagagaactgtgcagtggccacttgtcgacctgacgagtttcagtgttcggatggtaactgcattcacggcagccgacaatgcgatcgtgaatacgactgtaaagacatgtctgacgaagtgggttgtgtgaatgttacgctgtgtgaaggcccgaataagtttaagtgtcattcaggagaatgtatcacgcttgataaggtgtgtaatatggctcgggactgccgagattggtcggatgaacccattaaggagtgtggtactgcggcatgtctcgacaataacggaggatgttcacatgtctgtaacgcgctcaaaattggagcagaatgtttgtgtcccgatggatttcagctggtggcccaacgccggtgcgaagatatcgacgagtgtcaggatccggacacctgttcacaactgtgtgtcaaccttgaaggaggctacaagtgccaatgtgaggaaggattccaacttgacccgcacacgaaggcatgtaaggcagtgggctcgatagcatacctgttctttactaatagacacgaagtgagaaagatgactctggatcgttcagaatacacctcgcttattcccaatctgaggaacgtcgtggctttggataccgaagtggccagcaatcgaatttactggagcgatctttcgcaaaggatgatttgttccacgcagcttgacagggcacatggtgtgtcatcgtacgataccgtaatctcccgcgatattcaagcacctgatggactcgccgtcgattggatccatagtaacatttactggacggacagcgtgcttggtacggtgtcagtggccgataccaaaggggtgaagagaaagaccctttttagagagaacggatccaagccccgggccatagtcgtggatcccgtgcatggttttatgtactggaccgattggggtactcccgccaagattaagaaggggggcctgaacggtgtggacatttactcccttgtcaccgagaacattcaatggccaaacggcatcactctcgacttgctgtcaggaaggctttactgggttgactcgaaacttcattccattagctcaatcgatgtgaacgggggaaataggaaaaccatcttggaagatgaaaagcgtctggcgcatcctttttcgcttgcagtgtttgaggataaggtgttttggacggatatcattaatgaagccatcttttcagcaaacagactcactggttccgatgtcaatcttctggcagaaaacttgctttcgcctgaagatatggtgctcttccacaacctgactcaaccacggggcgtgaactggtgtgaaagaactactctcagcaacggaggttgtcagtatctgtgtctgccagcaccccaaatcaacccccactcgcctaaattcacttgtgcctgtccggatgggatgctgctggcccgagatatgagatcatgcctgactgaggcagaagccgcggtggcgactcaagagacttccactgtcagacttaaggtcagctccactgctgtcagaacccagcataccactactagaccggtcccggacacctccagacttcccggagcaacccctggtcttactactgtcgagatcgtcactatgtcccatcaggcacttggcgacgtggcaggtcgagggaacgaaaagaagccgtccagcgtgcgagcactctctattgtgctgcctattgtgcttctcgtgtttctgtgtctgggagtgtttcttctttggaagaactggagattgaagaacatcaattcgatcaattttgacaaccctgtgtaccagaaaaccaccgaggatgaagtacatatctgccataaccaagacggctactcgtatccttcgcgacaaatggtgtcgctggaagatgatgtggct

SEQ ID NO: 16414 - DNA, 2580 bp, Artificial Sequence
  Description of Artificial Sequence: Synthetic coding sequence
atgggaccttggggttggaagttacgctggactgtggccctgttactggcagcagcgggaactgctgtcggcgacagatgcgagcggaatgaatttcagtgccaagatggcaagtgtatttcgtacaaatgggtctgtgacggttctgctgagtgtcaagacgggtctgacgaatctcaggaaacatgcctctctgtcacgtgtaagtccggagatttcagctgcggcgggagggtgaacaggtgcatcccacaattttggaggtgtgacgggcaagttgattgtgacaacggctctgacgaacagggttgcccgccgaaaacctgttcacaggacgaattccgatgtcatgacgggaaatgcatctctcgacaattcgtttgcgacagtgaccgggattgcttggatggctcagacgaggcctcctgtcccgtactaacctgtggacctgcttcttttcagtgtaactcatcaacctgcataccacagttgtgggcctgtgataacgatccggactgtgaggatggctctgatgagtggcctcaaagatgtagagggctgtatgtcttccagggggactcctctccctgttcagcattcgagtttcactgtctgagcggggagtgtattcatagtagctggcggtgtgatggtggacccgattgcaaagataagtctgacgaagaaaattgtgccgtagccacttgtagaccggacgaattccagtgttcggacggaaactgcattcacggcagtaggcagtgcgacagagagtatgactgtaaggatatgtctgacgaggtgggatgcgtgaacgttactctgtgcgaaggcccaaacaaatttaagtgtcattcaggagagtgcattactctggacaaagtgtgcaacatggctcgagactgccgggattggagcgatgagccaatcaaagaatgcggaacagccgcttgcctcgacaacaatggcggatgttcgcacgtgtgcaacgcgcttaagatcggggccgagtgcttgtgccctgatgggtttcagctcgtggctcaaagacgatgtgaggatattgatgaatgccaggatccagacacctgcagccagctgtgcgtcaacctggaagggggctataagtgccagtgtgaggaagggttccagctcgacccgcacactaaagcttgcaaggcagtcggcagcatcgcatacctgttttttacaaatcggcacgaagtgagaaaaatgacgctcgacagatctgaatatactagtcttatcccaaatctcagaaacgtggttgccctggacacagaggtcgcttctaaccgaatctactggagcgacctgtcccagcgtatgatttgttcgacccagctcgacagagctcacggagtgagttcatatgataccgtgataagcagggatatccaggcccctgacggactggctgtggattggatccactccaacatatattggactgatagtgtgctgggaacagtctcagtcgccgataccaagggcgtgaagcgtaagacgctcttcagagagaatggttcaaagcccagagcgatcgtggtagatcccgttcatggtttcatgtattggacagattggggtacccccgcaaaaattaaaaagggggggctgaatggcgtcgacatctattccttggttactgagaatatccagtggccaaatggtattacgttggatctgctgtcaggtcgcctctattgggttgacagtaaactacattctatcagcagcattgacgtcaacgggggcaaccgaaaaacgattctcgaggatgagaaacggctggctcatcctttttccttggccgtgttcgaggacaaggtcttttggaccgacatcatcaacgaagccattttctcggccaataggttgacgggctctgatgtgaaccttctggccgagaatttgctctctcccgaagacatggtgttgttccacaatcttacccagcctcgcggagttaattggtgcgagaggactaccctgtcaaatggtggatgtcagtacctctgcctccctgcaccccagatcaacccccactcgcctaagtttacttgtgcctgccccgacggaatgctcctggcacgggatatgcgaagttgcttaaccgaggcggaagccgccgtggctacacaagagacatccacagtgagactaaaggtgtccagcaccgccgtaaggacccagcatacgacaactcgccccgtgcctgataccagccggctgcccggcgccacacccggcttgacgaccgtggagatcgtcaccatgagccaccaggcactgggcgatgtggcaggcagagggaatgaaaaaaagccttccagcgtgcgggccctgagtatcgtgctgcctattgtcctactggttttcctgtgtttgggagtcttcctcttgtggaaaaactggaggctgaagaacattaattccattaactttgacaatccagtgtatcagaaaaccacagaagacgaagtgcatatttgtcacaatcaggacggttactcttacccctcccgccagatggtgtctttggaagacgatgtggct

SEQ ID NO: 16415 - DNA, 2580 bp, Artificial Sequence
  Description of Artificial Sequence: Synthetic coding sequence
atgggtccttggggatggaagctgagatggacagttgcactgcttctggctgcagccggtacagctgttggcgataggtgtgaacgtaacgaattccagtgccaagatggtaagtgtatatcttataaatgggtgtgtgacggaagcgctgagtgccaggatggttccgatgaatcacaagaaacatgtctgtctgttacatgcaagagtggcgacttttcctgtggtggcagagtcaacaggtgcataccccagttctggaggtgcgatggccaggtggattgcgacaacggtagcgacgaacagggttgccctcctaagacatgctctcaggatgagttcaggtgtcatgatggtaagtgcatcagtaggcagttcgtgtgcgacagcgaccgcgactgcttggacggatctgatgaagcttcctgcccagtcctgacatgtggacctgcatcttttcaatgcaactctagtacttgtattcctcagttgtgggcttgtgacaacgaccctgattgcgaggacggatcagacgagtggcctcagagatgcaggggcctctatgtttttcagggagattcttctccctgttccgcctttgagtttcattgtctttctggagagtgtattcatagcagctggagatgtgacggcggtccagactgcaaggacaagtccgacgaagagaactgtgcagttgccacttgccgtcccgacgaattccagtgctccgacggcaactgtatccatggttccaggcaatgcgacagggagtacgactgtaaggatatgtccgacgaggtaggctgtgttaacgtgactctttgtgagggaccaaacaaattcaagtgccacagcggtgagtgtattacactcgacaaggtctgcaacatggcccgtgactgtagggattggagcgacgagcctattaaggagtgtggaaccgcagcttgtctggataacaatggaggttgctctcacgtgtgtaacgccttgaagatcggtgccgagtgcctgtgccccgatggtttccagttggttgctcaaaggagatgcgaggacatcgacgagtgtcaggacccagacacctgctcacaactgtgtgtcaaccttgaaggcggctacaaatgccaatgtgaggagggttttcaactggaccctcacactaaggcttgcaaggccgtcggatccatagcctacctgttttttacaaaccgtcatgaggttaggaagatgactttggatcgctccgaatatacttccctgattcctaatttgcgcaatgtagttgctttggatacagaagtggcttctaaccgtatttattggagcgatctctctcaaaggatgatttgttcaacccagctcgacagggcccacggtgtctctagctacgacaccgtaatatccagggacatccaagccccagacggactcgccgttgactggatccactcaaatatctattggactgactcagtacttggaaccgtctccgtcgctgacacaaagggtgtaaagaggaagactcttttcagggagaatggtagcaaaccaagagcaattgttgttgatccagttcatggtttcatgtactggacagactggggaacccccgctaagattaagaagggtggactgaacggcgtggatatctattcactggtgaccgaaaacatccaatggcccaatggaataaccctcgatctcttgtctggaagactgtattgggtggattctaaactccacagtatttcaagcattgacgtaaatggaggaaataggaagaccattctggaggacgagaagaggttggctcatccattctcactcgccgtctttgaagacaaggtgttctggaccgacatcatcaatgaggccatcttctcagcaaacagactgactggatctgatgtcaacctgttggcagaaaatttgctttctcccgaggatatggtcctgtttcacaatcttactcagccacgtggagtgaactggtgcgaacgtacaactctgagtaatggaggatgccagtacctgtgtctgcctgccccacagattaacccccattcccctaagtttacctgcgcttgtcctgatggtatgctgctggctcgcgatatgcgttcctgcctgaccgaggccgaggccgctgtggcaactcaggaaacctctacagtcagattgaaagtcagttcaaccgccgtaagaacccagcatactactacacgccccgtgcccgacacatctcgcctgcccggtgctacaccaggactcacaactgttgaaatcgtaacaatgagtcaccaagcccttggtgatgttgcaggcagaggcaatgagaagaagccatcctctgtcagagcattgtctattgtcttgccaattgtgctcctggtgtttctttgcctgggagtgtttctcctctggaagaactggagactgaagaacattaactctatcaacttcgacaaccctgtttaccagaaaacaaccgaggacgaagtccacatatgtcacaaccaggatggctatagctacccttcccgccagatggtctctctcgaagacgatgtagcc

SEQ ID NO: 16416 - DNA, 2580 bp, Artificial Sequence; identical to SEQ ID NO: 16396
  Description of Artificial Sequence: Synthetic coding sequence

SEQ ID NO: 16417 - DNA, 2580 bp, Artificial Sequence
  Description of Artificial Sequence: Synthetic coding sequence
atgggaccttggggatggaaacttcgctggactgtcgccctgctgctggcagctgccggcaccgccgtcggagatcgctgcgagcggaacgagttccaatgccaggatgggaaatgcatcagctacaagtgggtgtgcgacggatcggcagagtgccaggacggttctgacgaaagccaagaaacctgtctgtcggtgacctgcaaatcgggggacttttcctgcggcggacgcgtgaatcggtgtattccacagttttggcgctgcgatggacaggttgattgcgataacggttcagacgaacagggatgccctcccaagacttgcagccaggacgaattcagatgccacgacggaaaatgcatctcacgccagttcgtgtgtgactccgaccgggactgcttggacggatcagacgaagcctcatgtccggtgctgacttgcggaccggccagctttcagtgtaatagctcaacctgtatcccacagctctgggcctgcgacaacgacccggactgcgaggacggatcggacgagtggccgcagcgctgcagaggactctacgtgttccaaggagattcctccccctgctccgcgtttgaattccattgtctctcgggtgaatgtatccacagtagctggaggtgcgacggaggtccagactgcaaggacaaatcagatgaggagaactgcgcagtggcgacctgtcggccagacgaattccagtgtagtgacggcaactgcatccatggctcgcgtcaatgcgacagagaatacgactgcaaggatatgtcggatgaggtcggatgcgtgaatgtcaccttgtgcgaaggccctaacaaattcaagtgccattcaggcgagtgcatcactctggacaaggtctgtaacatggcacgggactgccgggactggtcagatgaaccaatcaaggaatgcggaactgccgcttgtctggataacaatggtggttgttcccacgtgtgtaacgccttgaaaataggtgcggagtgcctgtgcccggacggtttccaattggtggcccaacgccggtgcgaagatatcgacgagtgtcaggatccggatacctgctcgcagttgtgcgtgaatctggaaggcgggtacaagtgccaatgcgaagaaggattccagctggacccgcacaccaaagcctgcaaagccgtggggtccatcgcctacctgttcttcaccaatcggcacgaggtgcgcaaaatgactttggacaggtcggaatacacttcattgatccccaatctccggaatgtggtggcacttgacactgaagtcgctagcaatcggatttactggtcagacctgtcgcagcggatgatctgctcgactcagcttgaccgcgcacatggggttagctcctacgacaccgtgatcagccgggatattcaggcccccgacggtctggccgtggactggatccactctaacatctactggacggacagcgtgctcggtactgtgagcgtcgctgacaccaagggagtgaagcgcaagaccctgtttcgcgaaaacggatccaagccgcgggcaatcgtggtggaccctgtgcacggattcatgtactggaccgattggggaaccccagccaagatcaaaaagggcggcctgaacggcgtggacatatactccctggtgaccgagaacatccaatggcccaacggaatcactttggacctgctcagcggacgcctctactgggtcgactcaaaactccactcgatttcatccattgatgttaatggtggaaacaggaaaactatcctcgaagatgagaagcggctggcccacccgttctcgctcgctgtgttcgaggacaaggtattttggaccgacatcattaacgaagcgattttctccgccaaccggctgaccggaagcgatgtgaaccttctggcggaaaacctgctcagcccggaagatatggtgctcttccataacttgactcagccgaggggggtgaactggtgtgaaagaaccactttgtccaacggaggctgccagtatctgtgcctgccggccccccagatcaacccgcactccccgaagttcacgtgcgcctgccctgatggcatgctcctcgcccgcgacatgcgctcgtgtcttactgaggccgaagccgccgtggcgacccaggagactagcactgtgaggctgaaagtgtccagcactgcggtccggactcaacataccaccacccgccctgtccccgataccagccgcctgcccggagccacgcccggactgaccactgttgagatcgtcactatgtcgcaccaggctctcggagacgtggcgggacgcggcaacgaaaagaagcctagctccgtgcgcgctctgagcattgtgctgccaattgtgctgctggttttcctgtgccttggagtctttctgctctggaagaattggcggctgaagaacatcaattcgatcaatttcgacaaccccgtgtaccagaaaaccacggaagatgaggtccatatctgtcataatcaggacggctactcctacccgtcccggcagatggtcagcctggaagatgatgtcgcc

SEQ ID NO: 16418 - DNA, 2580 bp, Artificial Sequence
  Description of Artificial Sequence: Synthetic coding sequence
atgggtccttggggttggaagctccggtggactgtggcactgctgctcgccgccgcgggcactgccgtgggtgacaggtgtgaacgcaacgagttccaatgtcaggatggtaaatgcatttcctacaagtgggtctgcgatgggagcgctgagtgtcaagacggatccgacgagtctcaagagacttgtctttctgtgacttgtaagtccggtgatttttcgtgtggcggccgtgtgaatcgctgtatccctcaattctggcgatgtgacggacaggtcgactgtgataatggatcggatgaacaaggatgcccccctaagacctgttcgcaggacgagtttcgatgccatgatggtaagtgcatctcccgccagtttgtgtgtgacagcgaccgggattgtcttgacggttccgatgaggcatcctgcccagtgctcacctgcggccctgcctcgtttcagtgtaactcaagcacctgtatcccacagctctgggcatgcgataacgaccccgattgtgaggacggaagcgatgagtggccgcagaggtgtagaggtctttacgtgttccaaggagattccagcccgtgttcggcatttgaattccactgtctctcgggggaatgtattcattcgtcctggaggtgcgatggcggtcctgattgcaaagataagtcagatgaagagaactgcgcagtggcaacttgtcggccagatgaattccaatgttccgatggaaattgtatccatggctcccggcagtgtgaccgtgaatacgattgtaaggatatgtccgacgaagttggatgcgtcaacgtgactctttgtgaaggtccgaacaagtttaagtgtcatagcggggagtgcattaccctcgataaggtctgtaatatggcacgcgattgtagagattggtcggatgaacctattaaggagtgcggaaccgctgcttgcctcgataacaatggtggttgtagccatgtctgcaacgcccttaagatcggagccgaatgcctgtgcccagacggattccagctggtggcccagcggcgctgcgaagatatcgatgaatgtcaagatccagatacttgttcgcagctgtgtgtcaaccttgagggagggtacaagtgtcagtgtgaggaaggctttcaactggatccgcacaccaaagcctgcaaagccgtgggctcaatagcatacctgtttttcactaaccgccacgaggtgcggaaaatgaccctggatcggagcgagtacacttcgctgatccctaacctgcggaatgtcgtcgcccttgatactgaggtcgcaagcaacaggatttactggtctgatctctctcagcgtatgatatgttccactcaactcgatcgagcacatggagtgtcctcctacgatactgtcataagccgcgatatccaagcacccgatgggctggcagtagactggatccattcgaacatatactggaccgacagcgtgcttgggaccgtctcagttgccgatactaagggcgtcaagcggaaaactctttttagagaaaatggctcaaagccacgcgcaatcgtggtggatcctgtgcatgggttcatgtactggacggactggggcactccagctaagattaagaaaggcgggctcaacggagttgacatctatagccttgtcactgaaaacattcagtggccaaacgggattacgctcgacctgctcagcggtcggctgtactgggtggatagcaaactccactcgatttcctcgattgatgtgaacggtggcaaccgcaagacgattctggaggacgaaaagcggctggcccaccctttttccctcgcagtgtttgaggacaaggtgttctggaccgatatcataaacgaagcgatattctcggcgaacagattgactggctccgacgtgaatctcttggccgagaatctcctttcaccagaggacatggtgctgtttcataaccttacccaaccaaggggagtgaattggtgtgaacgaactactctttccaacggtggttgccagtatttgtgccttccagcccctcagataaatcctcattcgccaaagtttacttgcgcatgccctgacggaatgctgctggcaagagatatgcggagctgtcttaccgaagccgaagctgcagtggcaacccaagaaacctcaaccgtgcgcctgaaagtctcaagcaccgcggtcaggacgcaacataccaccactcgacctgtcccagataccagcagactgccgggcgcaactcctggcctcaccaccgtcgagattgttaccatgtctcatcaagccctcggcgatgtcgcaggtcggggcaacgagaagaaaccatcctcggtccgcgccctttccattgtcctgcccatcgtgctgctggtgtttttgtgtttgggtgtgtttctgctttggaagaattggcgtctgaagaacattaactcgatcaattttgataaccccgtgtaccaaaagaccacggaagatgaagttcacatctgccataaccaagacggttactcgtacccgagccgtcaaatggtcagcttggaagatgatgtggca

SEQ ID NO: 16419 - DNA, 2580 bp, Artificial Sequence
  Description of Artificial Sequence: Synthetic coding sequence
atgggcccgtggggttggaagctacggtggaccgtagcgctgctcctggcagcggctggaacagctgtgggggatagatgcgagcgaaatgaatttcagtgtcaagacgggaagtgcattagctacaagtgggtgtgcgacggctcagcggagtgccaggacgggtcggatgaaagtcaggagacatgcctatccgttacatgtaaaagcggtgatttctcatgcggcgggcgcgtgaatagatgtatccctcagttttggcgctgtgacggccaggttgactgtgacaatggatccgacgagcaggggtgtcccccaaaaacgtgcagtcaggatgaatttcggtgccatgacggcaaatgcattagtcgccagtttgtttgtgactcagatagagactgtcttgacggctcagacgaggcatcttgccctgtactgacttgtggcccagcgagtttccagtgtaattcctcaacttgtatcccgcagctgtgggcctgtgataatgatccagactgcgaggacggatccgatgagtggccacagagatgtcgtgggctgtacgtttttcaaggagacagttcaccttgcagcgcctttgagttccactgcctgtcaggcgaatgcattcactcctcctggagatgcgacgggggtccggactgcaaagataagagcgacgaggaaaattgcgctgtggccacttgccggcccgacgagtttcagtgctcagatggaaattgcatccacgggtcccgccagtgtgatagagaatatgattgcaaggacatgtccgacgaggtaggatgtgttaacgttaccctgtgcgaaggcccaaacaaatttaagtgccacagtggggagtgtattactctggacaaagtgtgcaatatggcgcgggactgccgagattggtccgatgagccaattaaggagtgtggaaccgcggcttgcctggataataatgggggatgctcccatgtctgtaatgctctgaaaatcggagctgaatgcttgtgcccagacggctttcagcttgtggcccagcggaggtgtgaggatatcgatgaatgtcaggaccctgatacctgttctcaactctgcgttaacttagaagggggctataagtgccagtgtgaagagggcttccagttagatccacacactaaagcctgcaaggccgtgggctccatcgcttatttgttcttcacaaacagacacgaagtgcgcaaaatgacattagatcggtctgaatacacttctctgattcccaatctgagaaatgtcgtggctctcgatacagaggtggcctctaatcggatatactggagcgatcttagccagagaatgatatgttccacacagctcgatagagcccacggcgtgagcagctatgatactgtaatctctcgcgatatccaagctcccgacggacttgctgttgactggatccactctaatatatactggactgatagcgtcctgggaaccgtaagcgtggccgatactaagggcgtcaagcgtaagacactctttcgcgaaaatggctctaaaccacgggcaatcgtggtagatcctgtacacggcttcatgtactggactgactgggggaccccagcaaagatcaagaagggggggctgaacggtgtagacatctatagtcttgtgacagaaaatattcagtggccgaacggcatcacattggacttgctgtctggtcgcctgtattgggtggatagcaagctgcactctatctcctcgattgacgtcaacggaggtaatcgcaagacgatcctggaggatgaaaagaggttagcgcatcccttctccctggcagtcttcgaagacaaggtcttttggacagacatcatcaacgaagcgattttctctgctaacagacttaccggctcagacgtgaacctgctggccgagaacctgctgtcacccgaggatatggtgctatttcacaatctgacgcagccaagaggcgttaactggtgcgaacgaaccacgttgtctaatggcggctgccagtacttatgcctccctgccccacagattaatcctcatagcccaaaatttacatgcgcctgccccgatggcatgctgctcgctcgggacatgaggtcatgcctaacagaagccgaagctgcggtcgccactcaagagacttctaccgttaggcttaaggtctcctcaacggcagtacgaacacagcacactactactcgccctgtccctgacaccagtaggttgcccggcgccacgccgggactgactacggtggaaatcgttaccatgtcacaccaggccctgggcgacgtggccgggaggggaaatgagaaaaagccatcctccgtgcgtgcactgtcaatagtgttgccaattgtgctcctggtgtttctttgcctgggcgtatttctgctctggaaaaattggagactcaagaacatcaactcaattaactttgacaacccggtctaccagaagaccaccgaagatgaggtccatatctgtcacaatcaggacgggtactcctatccttcaagacagatggtgtcactcgaggacgatgtagcc

SEQ ID NO: 16420 - DNA, 2580 bp, Artificial Sequence
  Description of Artificial Sequence: Synthetic coding sequence
atgggaccttggggatggaaacttagatggacagtcgcactacttttggctgcagctggaacagcagttggagacaggtgcgagagaaacgagttccagtgtcaggacggaaaatgtatcagctacaaatgggtatgcgacggatccgctgaatgccaagacggatccgacgaatcccaagagacatgtctaagtgtaacatgcaaatccggagatttttcatgtggaggacgtgtaaatagatgtatccctcaattctggagatgtgatgggcaagtggattgtgataatggctccgatgaacagggttgtccacccaaaacctgttctcaagatgaattcaggtgtcacgacggcaagtgtatttcaaggcagttcgtttgcgactcagatagggattgcttggatggctctgatgaggcttcttgtcctgttttgacttgcggtcctgcctcatttcaatgtaactcttcgacctgcatcccacagctttgggcgtgcgacaacgacccagattgcgaggacggctctgatgaatggcctcaaagatgcaggggcttgtacgtttttcaaggggatagttctccttgcagcgctttcgagtttcattgccttagtggggaatgcatacattcctcctggagatgcgatggagggccggactgtaaagacaagtcagatgaagaaaactgcgccgttgccacttgccgacctgatgagttccagtgttcggacggaaactgcattcatggttcacgccagtgcgatagagagtacgattgcaaggatatgtccgacgaggtgggatgcgtcaacgttaccttgtgtgaggggccaaataaattcaagtgtcactctggcgagtgtataaccctcgataaggtgtgcaatatggcgcgtgattgtagggattggtcggatgaacccatcaaggaatgtggaacagctgcatgtcttgacaacaacggagggtgctcccatgtgtgtaacgcactaaagattggagcagaatgcttgtgccctgatggtttccaattggtggcacagagacgatgcgaagacatcgatgaatgtcaggatcctgacacatgctcccaactctgcgtgaatttggaaggaggttacaagtgtcaatgcgaagaaggtttccaactagatcctcatactaaggcatgtaaggctgtaggctcgatcgcatatttgtttttcactaacaggcatgaagtgcggaaaatgacattggataggtctgagtataccagtctgattcctaacttaagaaatgttgttgctcttgacacggaggttgctagtaatagaatttattggtcagatctttcacaaaggatgatatgttctacacaattggatagagcacatggtgtctcctcctatgacactgtgattagtagggacatccaagcgccagatggattagctgttgactggatccattccaatatatattggacagacagcgtattgggtacagtttcggttgcagacaccaagggtgtcaaacgtaaaactctcttcagagagaatggctccaaaccaagagcgatcgtggtagatcctgtccatgggtttatgtattggacggattggggaacacctgcgaaaattaaaaagggaggtctaaatggagttgatatctatagtctcgtcactgagaacattcaatggccgaacggaattactttggacttgttgtccggcagattatattgggtcgattctaagttgcatagcatttcatctatcgatgtgaacggaggaaaccgaaagaccatattggaagatgagaagagactggctcaccctttttctttggcagtcttcgaggacaaggtcttttggactgatataatcaatgaagcaattttctcagcaaatcgtttaacaggaagcgacgttaatctccttgcagagaaccttctctctcctgaagacatggttcttttccataatttgacgcagcctcgtggtgttaattggtgtgagcgaactactttgtcaaacggagggtgtcaatatttgtgtctacccgctcctcaaattaaccctcactctcccaagttcacctgtgcctgtcccgatggcatgttgcttgctagagatatgaggtcatgcttgactgaagctgaagctgctgtcgctactcaggaaacttcaacggtgcgcttgaaggtgagttcgacagccgttaggacgcaacatactactaccagaccggtgcctgatacctcgagattgccgggagctacaccaggactgaccactgttgaaatcgttacaatgagtcatcaagcactcggtgatgttgcaggtaggggtaacgagaagaaaccatcctcagtgcgcgctttgagtatcgtgctaccgattgttttgctggtgtttctctgcctaggagttttccttctctggaaaaattggaggcttaagaacataaattctataaatttcgataatcctgtctaccaaaaaactaccgaggatgaggtgcatatctgccacaaccaagacggttacagctatccgtcccgacagatggtttctttggaggacgacgtggct

SEQ ID NO: 16421 - DNA, 2580 bp, Artificial Sequence
  Description of Artificial Sequence: Synthetic coding sequence
atggggccttggggctggaagctgcgatggactgtggctctcctcctcgccgctgctggcacggctgtgggagataggtgtgaacgaaatgagtttcaatgtcaagacggaaagtgtatctcctacaagtgggtttgcgacggctcagccgaatgccaagacggctccgacgagagccaggaaacctgcctgtcagtgacgtgcaaaagtggcgatttttcctgtggtgggcgggtgaataggtgtatccctcagttttggcgctgtgacggccaggtggattgcgacaacggtagcgacgaacagggatgcccccccaagacatgtagtcaagacgaatttcgatgtcacgacggaaaatgtatctcaagacagtttgtttgtgattcagaccgcgactgtttggatggatctgacgaggccagttgtcccgttctgacctgcgggcctgcgagttttcagtgtaatagctctacttgtatccctcagctttgggcttgcgacaacgatcctgattgtgaagacggaagtgacgagtggccgcaaagatgtcggggcctctatgtgttccaaggagatagcagtccctgttccgcctttgaattccattgcctgtccggcgagtgcatccatagctcatggcggtgtgatggtggccctgactgcaaagacaaaagcgacgaggagaattgcgctgtggccacctgcagaccagacgagttccaatgctctgatggcaactgcatccatgggtctagacagtgtgatagagaatacgattgcaaggatatgtcagacgaggtggggtgtgtgaatgtaacactgtgtgaaggaccaaataagtttaaatgtcactctggtgaatgtattaccctggacaaagtgtgtaacatggctagggactgccgtgactggagtgatgaacccataaaggagtgtgggacggcagcttgtcttgacaacaacgggggctgctctcacgtctgcaacgcgctcaaaatcggagccgaatgtctgtgccctgatggcttccagctggtggcgcaacggcgttgtgaagacatcgatgagtgtcaggatcccgatacttgttcacagctttgtgtgaacctcgaggggggctacaagtgccagtgtgaagaaggtttccagctggacccccatactaaggcttgcaaggccgtgggctccatcgcatacctctttttcaccaatcgccacgaggtgaggaagatgaccctggaccgaagcgagtacacttcactcataccgaacctgaggaacgtagtggcgctggatacggaggttgctagtaaccgcatttactggagcgaccttagccagaggatgatatgttccacgcaactggacagagcacacggggtgtcctcctacgataccgtgataagccgagacatccaagctcctgacggtctggccgtcgactggatccattctaatatttattggaccgattcagttctggggacagtctcagtggcagatacaaagggtgttaagcggaagaccctatttcgcgaaaatggatctaagccccgggcgatagttgttgacccggtgcatgggtttatgtattggacggattgggggaccccagcaaagatcaagaaaggcgggctgaatggtgtggacatttactccctggttacagagaacattcagtggcccaacggaataaccctagacttactgtccgggcggctgtattgggtggattctaagctacacagcatcagtagcatcgacgttaatggaggcaacaggaagactatactggaagatgaaaagcgactcgcgcaccctttctccctcgccgtctttgaggacaaagtgttttggaccgatattatcaacgaagctatcttcagtgcaaatcgtctgacgggatctgacgtgaatctgttagctgagaacctactgtctcccgaggacatggtgctgttccacaatctcacacaacctagaggagtgaactggtgtgagcgcactactctttcgaatggcggttgtcagtacctgtgcctgccggctccccagattaaccctcattcgccgaagtttacgtgtgcctgcccagatggaatgttgttagcgagggatatgcggagctgcttgacagaagctgaggctgccgtggctacccaggaaacatccacagtacggctgaaagtaagctcaacggccgtgaggactcaacacaccaccactcggcctgttcctgacacatccaggcttccgggcgccactcctgggttgaccacagtggagatagtcactatgagccatcaggccctgggcgatgtggcaggaagaggtaacgagaaaaagccatccagcgtcagagctcttagcatcgttctcccaatagtgctcctagtgttcctctgcttgggcgtgttccttctgtggaaaaactggaggctcaagaatattaacagcattaattttgacaatccagtgtaccagaagacaacagaggatgaggtccatatctgccacaatcaggacggctacagttatccttccaggcagatggtctctttagaggatgatgtcgcg

SEQ ID NO: 16422 - DNA, 2580 bp, Artificial Sequence
  Description of Artificial Sequence: Synthetic coding sequence
atgggaccttgggggtggaaactcaggtggaccgtggcactcctactggcagcggctggtacggctgtcggggacaggtgtgagcgcaacgagttccagtgccaggatgggaagtgtatttcatacaagtgggtctgcgacggtagcgcagaatgccaagacggctctgacgagtctcaggagacctgtcttagtgtcacttgcaagtcaggcgatttttcctgcggaggaagagtgaacaggtgcattccacaattctggagatgtgacggccaagtagactgcgacaatggcagcgacgaacagggctgccccccaaagacctgttcgcaggatgagttccgctgccacgacggaaagtgtatctcccggcagttcgtgtgcgattccgatagggattgtttggatggtagcgacgaggctagctgccccgtgttgacctgcggacccgcctcatttcaatgtaactcatccacttgcattccgcagttgtgggcctgtgacaacgacccagactgcgaggacggttcagacgagtggcctcaaaggtgcagagggctgtatgtgttccagggcgatagcagtccttgttccgcattcgaattccattgcctcagcggcgaatgtatccattcgagctggcggtgtgacgggggtccggattgcaaggataaatctgacgaagagaactgtgcggtggctacttgtcgtcctgatgaatttcaatgcagtgatgggaactgtatccacgggtctcgccagtgtgaccgagaatacgactgcaaggacatgtccgacgaggtgggatgcgtaaatgtgacactctgtgagggccctaacaagtttaagtgccacagcggagagtgtatcaccttagacaaggtatgtaacatggccagagattgcagagattggtccgacgaacctattaaggagtgcggtacggctgcctgcctcgacaacaacggcgggtgttcccatgtctgcaacgccctcaagataggagccgagtgcctgtgccccgacggatttcagttagtggcccagcgtcgatgtgaggacatcgatgagtgccaggaccctgatacctgttcccagctctgtgttaacctggagggtggctataaatgccagtgtgaagagggcttccagctggatccacatacgaaggcctgcaaggccgtgggatcaatcgcgtacctgttctttaccaaccgacacgaggtccgtaagatgactctcgatagaagtgaatacacttctctgattcctaacctgaggaatgtggtggcactcgataccgaggtcgcatctaacagaatctactggagcgacctgtctcagcgtatgatttgttcaacccagttggaccgagcccatggcgttagtagttacgacactgtgatctccagagacatccaggcccctgacgggctcgccgtagattggattcattctaatatttattggaccgactctgtgctggggactgtgagcgtagctgataccaagggggtgaagagaaaaaccctgtttcgagagaatggctccaaaccccgggccattgtagtggacccagtgcacggctttatgtactggactgactggggaacaccagccaaaatcaaaaaaggtggattgaacggagttgatatctattccctcgtcacggagaacatccagtggccgaacggcatcacactcgatctgctgagcggtcggctctactgggtggacagtaagctgcatagcatcagtagtattgatgtgaacggtgggaacaggaagactattttagaggacgagaagaggttggcacatcccttctcccttgcagtgttcgaagataaagtcttttggacagacatcatcaacgaggccattttctccgccaaccggttgaccgggtccgatgtgaacctcctcgccgaaaatctactcagtcccgaggacatggtactgttccacaatctgacccagcctagaggggtgaactggtgcgagaggactacgctgtccaatgggggctgccagtacctgtgcctgcccgctccccagattaatcctcattccccaaagttcacctgtgcgtgcccagatggcatgctactcgccagagacatgagatcttgtttgactgaagcagaagccgccgtggccacgcaggaaaccagcacagtgcgcctgaaagtctcaagtactgccgtgaggactcagcataccacgacccggccggtgccagatacaagtcgtttgcctggtgccacccctgggctcacgaccgtcgaaatcgttaccatgagtcaccaggcactgggagatgtcgcaggaagagggaacgagaagaagcccagtagtgtccgggctttgtcgatcgtgcttccgatcgtattattggttttcctgtgtcttggagtcttcctcctgtggaagaactggcggttaaagaacatcaactccatcaattttgataaccctgtgtatcagaaaactactgaagatgaggtgcacatatgccataaccaagacggatatagctatccctctcggcaaatggtctcccttgaagatgatgtcgcc

SEQ ID NO: 16423 - DNA, 2580 bp, Artificial Sequence
  Description of Artificial Sequence: Synthetic coding sequence
atgggcccttggggctggaaactgcgctggactgttgccctgctgctcgccgcggctggtaccgccgttggcgatagatgtgaaaggaacgaatttcaatgccaggatggcaaatgtatttcttacaagtgggtgtgcgatggatcagcggagtgtcaggacggctcagatgagtctcaggagacgtgtctgtcagtgacctgcaagtccggagatttcagttgcggaggaagagtcaatagatgtatcccgcaattttggaggtgtgatggtcaggtagattgcgataacggctctgacgagcaaggatgtccccctaagacgtgtagccaggacgagtttagatgccatgacggaaagtgcattagcagacaatttgtgtgcgattccgatagggactgtctcgacggatcagatgaagcgtcttgccccgtcctgacgtgtggtccggctagcttccaatgcaacagtagtacatgcatcccccaactctgggcttgcgataacgatcctgactgcgaagacggctccgacgaatggccacagaggtgcagaggactgtatgtattccagggagactcaagcccgtgcagcgcatttgagtttcactgcctgtccggtgagtgcatccacagtagctggcgctgtgatggaggtcctgactgtaaggacaagagcgatgaagagaactgcgcggtcgccacctgtagacctgatgaattccaatgctctgacggcaactgtatccatggttctcgccagtgcgatcgcgaatatgactgtaaagatatgagcgatgaagttggctgcgtaaacgtcactctctgtgaaggtcctaacaagttcaaatgccacagcggtgagtgcattactctcgataaggtatgtaatatggcaagggattgcagagactggtcagatgagcccataaaggaatgtggaaccgcagcttgtcttgataacaacggcggatgctcacatgtttgcaacgctctgaagatcggcgctgagtgcctttgccccgatggattccagctcgtagcacagaggagatgcgaagacatagacgagtgtcaagaccctgatacctgtagtcaactgtgtgtaaacctcgaaggtggttacaaatgccaatgcgaggagggcttccaactggacccacacaccaaagcgtgtaaagctgtcggatctatcgcttacctgttcttcaccaatagacatgaagtaaggaaaatgacactggacagaagtgagtacacctcccttataccaaatctccgcaacgtcgtagcccttgacaccgaagtggcgtctaatagaatctattggtccgacctgagccaacgcatgatctgctccacccaactggatcgcgcccacggagtttcctcctacgatactgtgatctctagggacatacaggctcctgacggccttgcagtcgactggatccactccaacatctattggactgactctgtattgggcacagtgtctgtggcggatacgaagggagtcaagagaaaaaccttgttccgcgagaacggatccaagccccgcgctattgtggtggatcccgtgcacggtttcatgtattggactgattggggcacacccgccaaaataaaaaaaggaggccttaatggtgtggacatctatagcttggtgacggaaaacatccaatggcctaacggaataactctggatctcctgagcggcagactgtattgggtggattctaaactgcactcaatatcttccatcgatgtgaacggaggcaaccgcaagactatcttggaggacgaaaaaagactggcacatccttttagcttggccgtgttcgaagacaaagttttctggaccgatatcatcaacgaggcaatcttctctgcaaacaggttgaccggatccgatgtgaatctcttggctgagaaccttcttagtccagaagacatggtattgtttcacaatctcacccagcccagaggtgtcaactggtgtgagaggacgacactctctaatggtggttgccagtacctgtgtcttcccgcgccacagattaacccccattcccccaagttcacgtgtgcttgccccgatggtatgctccttgctagggatatgcgctcctgcttgacagaggccgaggctgccgtggctacccaggaaacatccacggttcgcctcaaggtgtcctctacagctgtgaggacccaacacaccaccacgcgccctgtacccgacacatcaagattgccaggtgcgactcccggactcaccaccgtggagatagtgaccatgtcacaccaggcccttggagacgttgccggtaggggaaacgagaagaaaccatcctctgttagggccctctcaatagtgctgcccatagttcttcttgtcttcctgtgtctcggcgtgttcctgctgtggaagaactggaggcttaagaacattaactccatcaattttgacaaccccgtgtaccaaaagaccaccgaagacgaagtgcacatctgccataaccaggacggatattcttatccctccaggcaaatggtttctctggaggatgacgtggcg

SEQ ID NO: 16424 - DNA, 2580 bp, Artificial Sequence
  Description of Artificial Sequence: Synthetic coding sequence
atgggtccatggggctggaagctgagatggaccgtggcccttctcctcgccgccgctggtacagctgtcggagaccggtgtgagcgaaatgagttccagtgccaagacggcaagtgtattagttacaagtgggtgtgtgacggatcagcagagtgtcaagatgggtctgatgagtcacaggagacctgtctgtccgtcacatgtaaatccggggacttctcatgcggagggcgcgttaatcggtgtatcccacagttctggaggtgtgacggccaggtcgactgtgataacgggagtgatgagcaggggtgtccccccaagacatgctctcaggacgagtttcggtgtcacgacggtaagtgtatctccaggcagttcgtgtgtgattccgatcgggactgcctggacggttctgatgaggcatcttgcccagttctcacctgtggcccagcttcctttcaatgtaattctagtacttgcatcccgcagctgtgggcatgcgataatgaccctgattgtgaagacggttctgatgagtggccccagaggtgccgcggactgtacgttttccaaggcgatagctcaccttgcagtgcattcgaatttcactgtctcagcggggaatgcatccactcctcctggcgctgcgacggcgggcccgactgcaaggacaaaagcgatgaagagaactgtgcggtggcaacctgtcggcctgatgagttccagtgcagcgatggtaattgcattcacggcagccgccagtgcgatcgcgaatatgattgtaaggatatgagcgacgaggtcgggtgtgtgaacgttacactgtgtgaggggcctaacaaattcaaatgtcacagcggagaatgcattacactggacaaagtgtgtaacatggcacgggattgtcgggactggtccgacgaacctatcaaggagtgcgggaccgccgcctgtttggacaataacggcggctgcagccatgtttgtaacgccctcaagattggggcggaatgtctttgtcccgacggctttcagttggtggcccaaagacggtgtgaagacatcgatgaatgccaagaccccgacacttgttctcagttgtgtgtgaacctggagggcggctataagtgtcagtgcgaggaaggattccagttggacccacacaccaaggcctgcaaagcagtcgggtctatcgcctacctgttctttaccaacaggcacgaggtcaggaaaatgacccttgaccggtctgagtacacgtctctgatccctaacttgaggaatgtggtggcgctggatacggaagtggcttccaatcggatttactggtccgacctgtcccagaggatgatctgcagtactcaacttgaccgcgcccacggggtcagttcatatgacaccgtaatctctcgggacattcaggctcctgatggacttgccgtagactggatccattctaatatttattggacagactccgtactgggcaccgtcagcgtggctgacaccaagggcgtgaaacggaaaaccctgttccgggaaaatggttcaaagcccagagcaatcgtagttgaccctgtacatgggtttatgtactggaccgactggggaactccggctaagatcaagaaaggaggtctgaatggagtggacatatatagtctggtcacggagaacattcagtggccgaatgggatcacactggaccttctgagcggaaggctgtactgggtcgattcaaagctgcattcaattagctctatcgacgtcaacggcggaaaccggaaaaccatcttggaagacgagaaaaggctggcccacccctttagcctggccgtctttgaggataaggtgttttggactgatatcatcaatgaggctatttttagcgccaaccgcctgacaggcagcgatgtgaaccttcttgcagagaacctgctgtccccagaagacatggtcctcttccataacctgactcagccgcgcggcgtgaactggtgtgaacgaacaaccctgtccaacggcggttgtcaatacctgtgcctgcctgctccacagatcaacccgcacagccctaagtttacctgtgcctgtcctgacggcatgttgctggctcgggatatgcggagctgcttgacagaagcagaagcagccgtggccacccaggagacctctactgttcggttgaaggtgtctagtactgccgtaaggacccaacacacgaccacccgcccagtgcccgatacaagtcggctccctggggccacaccaggactcactacagtcgagattgttaccatgtcccaccaggccctcggcgacgtggcggggaggggtaatgaaaagaaacctagttccgtgagagcactgagcatagtgctccctatcgttctgttggtattcctgtgcctcggtgtgtttcttctctggaagaactggcggctcaagaacatcaacagtatcaatttcgacaaccctgtgtaccagaagacaactgaggacgaggtgcacatctgccacaatcaggacgggtacagttatccaagtcgccagatggtctcactcgaagacgacgtagcc

SEQ ID NO: 16425 - DNA, 2580 bp, Artificial Sequence
  Description of Artificial Sequence: Synthetic coding sequence
atggggccgtggggttggaagttgaggtggaccgtcgcgcttctgctggctgcggcaggaaccgcagtgggcgacagatgcgagcgcaacgaattccagtgccaggatggaaaatgcatttcatacaaatgggtgtgtgacggctcggcagaatgccaagacggttcagacgagtcacaagaaacctgtctgagcgtcacgtgtaagtccggggatttctcatgcggagggagagtgaaccgctgcattccgcagttctggcgctgcgacggccaggttgattgcgacaatggatcggacgagcaaggatgtccgccaaaaacctgctcacaggatgagttccggtgccatgacggaaagtgcatcagcagacagttcgtctgcgattccgacagagattgcctcgatggttcggatgaagcctcctgcccagtgcttacctgtggacccgcgtccttccagtgcaattcgtccacttgcatccctcagttgtgggcctgtgacaatgatccagactgtgaagatgggtccgacgaatggccgcaacggtgcaggggactgtacgtctttcagggcgattctagcccgtgtagcgcctttgaatttcactgcctgtccggagagtgcatccattcatcatggaggtgtgatgggggtccggactgtaaggataagagcgacgaagagaactgcgccgtggccacttgtcggccggatgagttccaatgttctgatggaaattgcatccatggttctcgccaatgcgatcgggaatacgactgcaaagacatgagcgatgaagtggggtgcgtgaacgtgaccctgtgcgagggcccgaataagtttaagtgccacagtggtgaatgtataactttggataaggtctgcaacatggccagggactgcagagattggtcggatgagccgattaaggagtgcggcactgcagcctgtttggataacaatggcggatgctcacacgtgtgcaacgcgcttaagatcggagccgagtgcctgtgcccagatgggttccagctcgtggcccagcgcaggtgcgaggatattgatgagtgccaggacccggatacttgctcccagctgtgcgtcaacctggaaggcggttacaagtgtcagtgtgaagagggatttcagctggaccctcacactaaagcctgcaaggccgtcggttcaatagcttacctgttcttcaccaaccggcatgaagtgagaaagatgaccctggatagatcagaatataccagcctgatccccaacctgcgaaacgttgtggccctcgacactgaggtggcgagcaaccggatctactggtcagacctgtcgcagagaatgatttgtagcacccaacttgacagagcgcacggagtgtcctcctacgacacggtgatctcgcgggacatccaggcgcccgacggacttgctgtcgactggatccactccaatatctactggactgattccgtgctcggaacggtgtccgtggcagacactaagggcgtgaaacggaaaaccctgttccgggaaaacggaagtaagcctcgggctatcgtggtggacccggtgcacggatttatgtactggactgactggggaactccggccaagatcaagaagggaggccttaacggcgtggacatttactcactggtcactgagaacatccagtggcccaacgggatcactctggacctcctgtccggccggttgtattgggtggattcgaaactgcattcgatctcctcgattgatgtgaacgggggtaatcggaaaaccatcctggaggacgagaaacgccttgcccatcccttctccttggcagtgttcgaggacaaagttttctggaccgatatcatcaacgaggccatcttctccgcaaacagactgaccggttcggacgtgaacttgctcgccgagaatctcctgtccccggaggacatggtgctgtttcataacctgactcagccccgcggagttaattggtgcgaacgcaccaccttgagcaacggaggctgtcagtacctgtgcctgcctgcaccacaaatcaacccgcattcccccaagttcacttgcgcctgcccagatggcatgctgctggctcgcgacatgcgctcgtgcctgacggaggctgaggcggctgttgcaacccaggaaactagcactgtgagattgaaggttagctctacggccgtgcgcacccagcatactactacccgcccagtgccagacacttcccgcctgcctggagcaaccccaggactcactaccgtggaaattgtgactatgtcacaccaagcccttggggacgtggccggcaggggaaacgaaaagaaacccagctccgtcagggcgctgtcgatcgtattgccgatcgtgctgctcgtgttcctctgtcttggtgtgttcctgctctggaagaattggcgcctgaagaatatcaactccattaacttcgacaatccagtgtaccagaaaaccactgaagatgaagttcacatttgtcataaccaagatggatactcgtacccgtcccggcagatggtgtctttggaggacgatgtggct

SEQ ID NO: 16426 - DNA, 2580 bp, Artificial Sequence
  Description of Artificial Sequence: Synthetic coding sequence
atgggaccttggggatggaagctgcggtggaccgtggctctcctgctcgcggcggccggaaccgcagtgggcgaccggtgcgaacggaacgaattccagtgccaggatggaaagtgtatctcctacaaatgggtttgcgatggatccgccgaatgccaggacggcagcgatgaatcccaggaaacttgcctcagcgtcacttgcaagtcgggcgacttttcctgtggtggacgcgtgaaccggtgtattccacagttctggagatgtgatggacaggtggactgtgacaacggatccgacgaacagggatgcccgcctaagacgtgctcccaagacgagttcagatgccacgatgggaagtgtatctctcggcaattcgtttgtgacagcgaccgcgactgcctggatggaagcgatgaggcctcttgccctgtgctcacgtgcggcccggcgtcgttccagtgcaattcttcaacctgtatcccgcaactctgggcatgtgacaacgaccccgactgcgaggacggctcggatgagtggcctcagaggtgccggggactgtacgtttttcaaggtgactcgtccccatgctcagctttcgagttccactgcctctcgggagagtgcatccattcgtcctggcgctgtgatggaggaccggactgcaaagataagtcagatgaggaaaattgcgcagtggctacgtgtagaccggacgagttccaatgcagcgacgggaactgcattcatggctcgcggcagtgcgaccgtgaatacgactgcaaggacatgagcgacgaagtgggatgcgtcaatgttaccctctgcgaaggcccgaacaagttcaagtgtcactctggagaatgcatcaccttggacaaggtgtgcaacatggcacgcgattgcagggactggtccgatgaaccaatcaaagaatgtggtaccgcagcatgtctcgacaataacggaggatgctctcatgtctgcaacgcccttaagatcggagctgagtgcctgtgccccgacggctttcaactggtcgcgcagcggcgctgcgaagatatcgacgagtgccaggatccagacacttgctcccaactgtgcgtgaatctggaaggcggctacaagtgtcagtgtgaggaaggtttccaactggatccgcacaccaaggcatgcaaagcggtgggctctattgcgtacttgttcttcaccaatcggcacgaggtcagaaaaatgaccctggatcggagcgagtacacctccctcatcccgaatctgcggaatgtcgtcgccctggatacggaagtggcgtccaaccgcatctattggtccgacctgtcgcaaaggatgatttgttctactcagctggaccgcgctcatggcgtcagctcctacgacacggtgatcagccgcgatatccaggctcctgacggtttggccgtcgattggatacactcaaacatctactggactgactcagttctgggcactgtgtccgtggccgacactaagggggtgaaaagaaaaactctgtttcgggaaaacggatcgaagccgagggccatcgtggtggacccggtgcacgggttcatgtactggacggattggggtactcctgctaagatcaaaaagggaggtctgaatggagtggatatctactcgctcgtgactgaaaacatccagtggccgaacggaatcaccctcgatcttctcagcggacgcctgtactgggtggactccaaactccattcgatcagctcgattgatgtgaacggagggaaccgcaaaactatactggaggatgaaaagcgcttggcccacccattctcgctggctgtgttcgaggataaggtgttctggaccgacatcatcaacgaggccatattctcagccaaccgcctgaccggctcggacgtcaatctgctggccgaaaatctcctgtccccggaggacatggtgttgtttcacaacctgacccaaccccgtggagtgaattggtgcgagcggactactctgagcaatggtggttgccagtatctgtgcttgcccgcgccccagatcaatcctcattcacccaagttcacttgcgcgtgcccggacggcatgcttcttgccagagacatgcgatcatgtcttactgaggccgaagccgcagtggcaacccaggaaacgtcgactgtgcgccttaaagtctcgagcactgcagtcaggacccaacatactaccactcgaccggtcccggacacctcccgactccccggggccacgccggggctcaccaccgtggagattgtgacgatgtcgcatcaagcccttggggacgtcgccgggcgcgggaacgaaaagaagccatcttcggtccgcgcattgtcaattgtcctcccaatcgtgctgttggtttttctgtgtctgggagtctttctgctgtggaagaactggcgcttgaagaatatcaactcaatcaactttgataaccctgtgtaccaaaagaccactgaagatgaagtccacatttgccacaaccaggacggatacagctacccatccagacagatggtgtcccttgaggatgacgtcgca

SEQ ID NO: 16427 - DNA, 2580 bp, Artificial Sequence
  Description of Artificial Sequence: Synthetic coding sequence
atgggtccgtggggatggaaacttagatggactgtggccttgctgctggccgcagccggcactgcagtgggagacagatgcgaacgcaacgagtttcagtgccaagacggaaagtgcatcagctacaagtgggtgtgtgatgggagcgcagagtgccaggatggctccgacgagtcccaggagacttgtttgtccgttacgtgtaagtccggagacttctcatgcggaggccgggtcaacaggtgtatcccacaattctggcgctgcgatggtcaagtggactgcgataatggatcggatgaacagggatgcccacctaaaacttgcagccaagatgaattccggtgccacgacggcaagtgcatctcgcggcagttcgtgtgtgattcggatagagactgcctggacgggtccgacgaggccagctgtccggtgcttacctgtggccctgcatcatttcagtgcaattcgtctacttgcatcccgcagctctgggcgtgcgataacgatccagactgtgaggacgggtctgacgaatggccccagcgctgccgcggactgtacgtgttccaaggggactcgagcccatgctccgcgttcgagtttcactgcctctccggcgaatgcattcacagctcgtggcgatgcgatggtggacccgactgcaaagacaagtcagacgaggaaaattgtgcagtggccacttgtcgcccagatgaattccagtgctccgacggtaattgcatacatggatcaaggcagtgcgacagggaatacgactgcaaggatatgagcgacgaggtgggatgcgtcaatgtgactctgtgcgaaggaccaaacaagttcaagtgccatagcggcgagtgcattaccctggacaaggtctgcaatatggcccgcgactgtagggactggtcggatgagcctatcaaagaatgcggaaccgccgcttgccttgataacaacggaggctgctcacacgtgtgtaacgcactcaaaatcggagccgaatgcctgtgtccggacggcttccaactcgtggcccagaggcggtgcgaggatatcgacgaatgccaagatccagacacttgttcccagctgtgcgtcaatctcgaaggaggatacaaatgtcagtgcgaagaaggattccagcttgaccctcacactaaggcgtgtaaggccgtcggatcaatagcatacttgttcttcaccaaccggcatgaagtgagaaagatgactctggatagatcagagtacacgtccctgatcccaaatctccgcaacgttgtggcgcttgatactgaagttgcgtcgaaccgcatctactggtccgacttgagccagagaatgatttgtagcacgcaactcgatcgggcccacggtgtgagctcgtacgacactgtgatcagccgcgacatccaggcccctgatggcctggcagtggactggatccatagcaacatttactggacggattccgtgttgggaacggtttcggtggccgatactaagggagttaagagaaagaccctgttcagagagaacgggtccaaaccgcgggcaatcgtggtcgaccctgtgcacggctttatgtactggactgactggggaactccagctaagatcaagaagggtggactcaacggcgtggatatctactcgctggtgaccgaaaacatccaatggcccaatggcatcaccctggatcttctgtccggtcgcctgtattgggtcgatagcaaactccactcaatctcgtccatcgacgtgaacggcggcaaccgtaaaaccattctggaggatgaaaagaggctcgcgcatcctttctccttggccgtgttcgaggacaaggtgttctggaccgacatcatcaatgaggctatcttttcggctaatcgcctgaccggtagcgacgtgaatttgctggccgaaaacctcctctcgcccgaggacatggtgctctttcacaacctgacccagccgcggggagtcaactggtgcgaacggaccaccctgtcgaacggaggatgccagtacctgtgcctgcctgccccacaaatcaatcctcattcgccaaaattcacctgtgcatgcccggatggaatgctgttggcacgcgatatgcgctcctgcctgaccgaagctgaggcggctgtggcaacccaggaaaccagcacggtgagattgaaggtgagcagcactgctgtcagaactcagcatactaccacccgccccgtcccagacacgagccggttgccgggcgcgaccccgggcctgacgactgtggaaattgtgactatgtcgcaccaagccctcggagacgtggcgggaagaggcaatgagaagaagccgtcatcggtcagagcactcagcattgtcctcccaatcgtgctgttggtgtttctctgcctcggagtgttcctgctgtggaaaaactggcggctgaagaatatcaactcaatcaattttgacaacccggtgtatcaaaagacgacggaggacgaagtgcacatctgtcacaatcaggacggatactcatacccctcgcgccagatggtgtcgctggaagatgacgtcgcc

SEQ ID NO: 16428 - DNA, 2580 bp, Artificial Sequence
  Description of Artificial Sequence: Synthetic coding sequence
atgggtccctggggctggaagctccgctggaccgtggcacttttgctagcagcagctggcaccgccgtcggagatcgatgtgaacgcaatgagtttcaatgccaggacgggaaatgtatctcttacaaatgggtctgcgatggtagtgccgagtgccaggatggctccgatgagagtcaggagacatgccttagtgtgacctgcaagtccggtgacttttcatgtggggggcgtgtgaataggtgtatcccacagttttggaggtgtgatggtcaggtggattgtgataatggatcagatgagcagggctgcccacctaaaacatgtagccaagacgaatttagatgtcatgacggaaagtgcatatcccggcagtttgtgtgcgatagtgatcgagactgtctcgatggcagtgacgaagctagctgtccagtgttaacatgtggacctgcctccttccaatgcaactcttctacttgtatccctcagttatgggcttgcgacaacgaccccgattgtgaggatgggtctgatgaatggcctcagaggtgtcgtgggctctacgtgttccagggagactcctcaccatgctcagcattcgaatttcactgcttgagcggagagtgcatacactccagctggcgctgtgatggcggacctgattgtaaagataaatccgatgaggagaactgtgccgtggccacatgcagaccagacgagtttcagtgtagcgacggcaactgcatccacggtagccgacaatgtgatcgtgagtacgactgcaaggatatgtctgacgaggttgggtgtgtgaacgtcacactgtgtgagggaccaaacaaattcaagtgtcatagtggggagtgcatcacgcttgataaggtgtgcaatatggccagagactgccgggactggtctgatgagccaatcaaagagtgcgggacggccgcttgtctcgacaacaacggtgggtgttctcacgtttgcaacgccctgaagattggggcagagtgtttgtgtcctgatgggtttcagctggtagcacagcgtagatgtgaagacatagacgaatgtcaggacccagatacatgttcgcagttgtgcgtgaacctggaaggggggtataaatgtcagtgcgaggaggggtttcaactggatccccataccaaggcgtgcaaggcggtggggtccatcgcttacctcttttttaccaacaggcacgaggtgagaaagatgactctggatcgtagtgaatataccagtttaatacccaatctccggaatgtggtggcactggatacagaagtggcgtcaaatcggatttactggagcgatcttagccagcggatgatctgctccacgcaactggatagggcccacggcgtgtcaagctatgatacagttatttctcgggatatccaggctcccgacggcctagcagtcgattggattcacagcaatatctactggacggactcagtgttgggcacggtaagcgtcgcagataccaaaggagtgaaaagaaaaacactgttccgagagaatggaagtaaacctcgcgcaattgtagtagaccctgtgcatggattcatgtattggaccgactgggggactcccgcgaaaatcaagaaagggggcctgaatggggtggatatttattccttagtcactgaaaatatccagtggcccaatggcattactctggatttgctgtctgggcgcctttactgggtggattccaagctgcactccatctctagcatcgatgtgaacggcgggaacaggaaaacaatcttagaggatgagaagcggcttgcccacccattcagcctggccgtgttcgaagataaggtgttttggaccgacattataaacgaggccatattttcggcgaaccgtctgaccggctcagacgttaacctcttggcagagaatttgctatcgcccgaggacatggtgctgttccataatctcacacagccacgtggggtcaactggtgtgagcggactacattgtcaaacgggggctgccaatacctgtgtctgccagcgccccagatcaatccccattcccctaaatttacgtgcgcctgccccgacggcatgctgctggcaagagacatgaggtcctgcctgactgaggctgaagcagccgtggccacacaagagactagcaccgtgcgcctgaaagtatcttccactgccgtccggactcagcacaccaccacaagacccgtccctgatacttctcgactgccgggggccacgccggggctgacaaccgtggagattgtcaccatgagccaccaagctctcggggatgtggccggcagagggaatgaaaagaagccgtcatcagtgcgggctctgtctattgtgctcccgatcgtgctgctagtgtttctgtgcttaggggttttcctcctctggaagaactggagactcaagaacatcaacagcataaacttcgacaaccccgtatatcagaaaactactgaagatgaggtacatatttgtcataatcaggatggatactcgtacccttcaagacaaatggtgtctctggaagatgacgtcgcc

SEQ ID NO: 16429 - DNA, 2580 bp, Artificial Sequence
  Description of Artificial Sequence: Synthetic coding sequence
atgggcccatggggatggaagctgcgctggactgtggcgctgctgctggcggcggccgggaccgcggtgggtgaccgctgtgaaagaaacgagtttcagtgtcaagacggaaagtgcatctcctacaaatgggtgtgcgatggctccgcggagtgccaagacggctcagatgaaagccaagagacttgcctgtcggtgacttgcaaaagcggagattttagctgcggaggtagagtgaacaggtgcatacctcagttttggaggtgtgatgggcaggtcgattgtgataacgggtcggacgaacagggatgccctcctaaaacttgctcgcaggacgagttccggtgccacgacgggaagtgcatctctcggcagtttgtgtgcgactccgatcgggactgtctcgatggatcagacgaagcctcctgtccagtgctgacttgcgggccggcttcattccagtgtaacagctcgacttgtatcccgcagctctgggcatgcgacaatgaccccgactgtgaagatggctcagatgagtggccgcaacgctgtagaggactgtacgtgttccagggcgattcaagcccatgctcggctttcgagtttcattgtttgagtggagagtgcatccactcctcgtggaggtgcgacgggggaccggattgcaaggataaatcggacgaagagaattgcgcagtggcgacctgtcgccctgatgaattccagtgttccgacggaaattgcatccatggatcccggcaatgtgaccgcgagtacgactgtaaggacatgtccgatgaagttggatgcgtgaatgtcacgctctgcgaaggaccaaacaagttcaaatgtcactcgggcgagtgcatcactctcgacaaggtttgtaacatggcacgggactgcagagactggtcggacgagcccattaaggagtgcggaaccgccgcatgccttgacaacaacggtggctgctcgcacgtctgtaacgctctgaaaatcggcgcggaatgcctctgccccgacggctttcaactggtcgctcagaggcgctgcgaagacatcgacgagtgtcaggacccggatacctgcagccagctctgcgtgaacctggaagggggttacaagtgtcaatgcgaggagggatttcaactggatccgcatactaaggcatgtaaggccgtgggttcgattgcgtacctgttctttaccaatagacacgaagtgaggaagatgactctggaccgctcggaatacacttcgctgatcccgaatctgcgcaacgtggtggccctggacaccgaagtcgcttcgaatcgcatctactggtccgatcttagccagagaatgatctgttcaacccagctcgacagagctcacggtgtctcctcctacgacaccgtgatctcgcgggacatccaggcgccggacggactggcggtggattggatccactctaacatctactggaccgattcggtgcttggaaccgtgagcgtggcagacactaaaggcgttaagcgcaaaaccctcttccgcgaaaacggctcaaagccgcgggcgatcgtcgtggatccggtgcacggcttcatgtattggactgattgggggaccccggccaagatcaaaaagggcggactgaacggagttgacatctacagcctcgtcaccgagaatatccagtggccgaacggaattactctcgatctgctctcgggacgcctttactgggtcgatagcaagctgcattcgatctcttccatcgacgtgaacgggggcaatcgcaagacgatcttggaagacgaaaaacggctcgcccacccgttctcattggccgtcttcgaagataaggtgttctggactgacatcatcaacgaagctattttctcagcaaatagactcactggatcggacgtgaatctcctcgcagaaaatctgttgtcgccggaggacatggtgctgttccacaacctgactcagccacggggagtgaactggtgtgagcgcactaccttgtcgaacggggggtgccaatacctgtgcctgccggccccacagatcaatccacactcacctaagttcacctgcgcctgccctgatggcatgctgctggctagggacatgagaagctgtctgactgaagccgaagcggctgtggcgactcaggaaacgtcgactgtgagacttaaggtgtctagcactgctgtgcgcacccagcacactactactcgaccggttccggacactagcagacttccgggtgcaaccccaggcctcactaccgtggaaattgtgaccatgagccatcaggccttgggcgacgtggcgggtcgcggaaatgaaaagaagccgtcctcagttagagcgctgtcgatcgtgctcccaatcgtgctcctggtgtttttgtgcctgggagtgttcctgctgtggaaaaattggcgcctcaaaaacatcaattcgatcaacttcgataatccggtctaccagaagaccaccgaagatgaagtgcatatctgtcacaatcaggatgggtacagctacccgtcccgccaaatggtgtcactggaggatgacgtggcg

SEQ ID NO: 16430 - DNA, 2580 bp, Artificial Sequence
  Description of Artificial Sequence: Synthetic coding sequence
atgggaccttgggggtggaaactgaggtggactgtcgcccttctcctcgccgccgctgggactgctgtcggggatagatgcgaacgaaatgagtttcagtgccaggacgggaagtgcatctcatacaaatgggtctgcgatgggagtgccgagtgccaggacggttccgatgagagtcaggagacgtgtctgtccgtgacctgcaagtccggtgatttttcctgtggcgggcgggtgaaccgatgcatacctcaattttggcgttgtgatgggcaggtggactgcgacaatggatccgatgaacaggggtgcccccccaagacttgctcacaagatgagtttcgttgccatgacggtaagtgtatatcacgacaattcgtatgcgattctgacagggattgtctggatggaagcgatgaggcatcttgcccagtgctgacgtgcggacccgcaagcttccagtgtaactctagcacctgcattccacaattgtgggcctgcgacaatgaccccgactgtgaggacgggagtgatgagtggcctcagcgctgccgtggtttgtatgtatttcagggagacagttctccatgtagtgcctttgaatttcactgtctgagcggtgagtgtatccactcatcttggagatgtgacggaggacccgactgtaaagacaagtcggacgaggaaaattgtgccgtcgccacctgtcgaccggatgaatttcagtgcagtgacggcaactgtatccacggatcgagacagtgcgacagggagtacgactgtaaagatatgtcagatgaggtggggtgcgttaatgtgacactttgtgagggccccaataagtttaaatgtcatagcggtgagtgcattaccttagataaggtttgtaacatggcgagggactgccgtgactggagtgatgaaccaatcaaagagtgcggcacggccgcgtgcttggataacaacggtggatgttcccacgtttgcaacgccctcaaaatcggcgctgaatgcttatgtcccgatgggtttcagttggtggcccagcggcgctgtgaggacatcgacgaatgccaggatcccgatacctgtagccagctgtgtgtcaatctggagggagggtacaagtgtcagtgtgaggaaggcttccaattagacccccacacaaaggcttgcaaagcggtcggttcaatcgcctacctcttcttcacaaaccgccatgaagttaggaagatgacattggatagatccgaatacactagtctaattcctaacctacggaatgtggtggcattagacacagaagttgcaagtaatcgcatctactggtccgacctgtcacagcgcatgatttgtagcacacaactcgatcgtgcccatggtgtgagtagttacgacacagtgatctctagggatattcaggcacctgatggcttggccgtggattggatacacagtaacatttactggactgacagtgttcttggaactgtttctgtggccgacacgaagggcgtcaaacggaagacgctgtttcgggagaatggcagcaaacctcgcgccattgtggttgatcccgtgcacggattcatgtactggactgactggggcaccccggcaaaaattaagaaaggggggttgaatggagttgacatctactctttggttacggagaatatccaatggcccaatggtattactctagatctgttaagtggacgactgtactgggtggactccaagttgcactctatttcctccatcgacgtgaatggtggcaacaggaagactatactagaggatgagaagagactcgcccatcctttctccctcgccgtattcgaggataaggtcttttggacggacattatcaatgaggctattttctctgctaaccgtctcacaggctccgatgtgaacctgctagctgaaaacctgctgtctccagaggatatggtgcttttccataacctgacgcagcctcgaggggttaactggtgtgaaagaactaccctctcgaacgggggttgtcagtatctctgtctccctgccccgcaaattaatcctcattctcccaagtttacctgcgcttgccctgacggtatgctactcgcccgcgacatgcgttcttgccttactgaggcagaagccgctgttgccacccaggagacctccacagtgcggttgaaggtaagtagcacagcggtgcgaactcagcacaccacaacacggccagtcccagatacatctcgcttacccggcgctacccctggacttaccacagtggagatcgtgactatgagccaccaggccttgggggacgtcgccggcagagggaatgaaaagaagccttcgtctgtccgagccctgtctatagtgctgcccattgtgctgttggtgtttctctgtctgggagtgttcctgttgtggaaaaactggcggctaaaaaacattaattccatcaactttgacaatccagtataccagaagaccaccgaggatgaagtccacatctgccacaatcaggatgggtactcttacccctcccgccagatggtgtctctcgaagacgacgtcgca

SEQ ID NO: 16431 - DNA, 2580 bp, Artificial Sequence
  Description of Artificial Sequence: Synthetic coding sequence
atgggcccctggggctggaaactgcggtggacagtcgccctcttactcgccgctgctggtacagctgtgggtgatagatgtgaacgaaatgagttccagtgtcaggacgggaaatgtatctcctacaagtgggtctgtgacggctctgcagagtgtcaggatggaagcgacgagtcccaagaaacttgcctgagcgtcacatgcaagtccggcgactttagttgcggaggtcgcgttaatcggtgcattcctcagttttggagatgcgacggacaggtggattgcgacaatggctcggatgagcagggctgtcctcccaaaacctgttcccaagacgaattccgctgccacgatggtaagtgcatcagcaggcagtttgtttgcgatagtgaccgcgattgcctcgacggatcagacgaagctagctgtcctgtcctgacatgtggacctgcatcattccagtgtaacagttctacttgcattccccagctctgggcgtgtgataatgacccggactgcgaggatggcagcgatgaatggccacagcgttgccgtggtctttatgtttttcaaggggacagctcgccttgttcagccttcgaattccattgtttatccggagaatgtattcactccagttggcggtgtgacggaggccctgattgtaaagataaaagtgacgaggagaactgcgccgtggccacttgccgccctgacgaattccagtgctctgatgggaattgtatccatggaagtagacagtgcgaccgagagtacgactgtaaagatatgtcagacgaggtggggtgcgtgaatgtgaccttgtgcgaggggcctaataaatttaagtgtcactcaggtgaatgcatcacactggacaaggtctgtaatatggcccgggactgtcgtgactggtccgatgaaccaattaaggaatgcggcaccgccgcctgtttggacaataacggaggatgctcgcatgtctgtaacgcccttaaaataggggccgaatgcctctgtccagatggtttccaactagttgctcagagacgatgtgaagacatagatgagtgtcaggaccccgatacttgttcgcaattgtgtgtcaacttggaaggaggctacaaatgccagtgtgaagaggggtttcagttagatcctcataccaaggcctgtaaagcagtaggatctattgcctatctcttctttacaaatcggcacgaggttcgtaaaatgaccctggataggtcagagtataccagcttaatccctaatctcaggaatgtcgtcgctctggacaccgaagttgcaagcaatcgaatctactggagtgacctgtcgcaaagaatgatctgcagcacccagttggaccgcgcacacggggtttcctcctatgacacggttattagtcgcgacatccaggcaccggacggactggccgtggactggattcattcaaatatctactggacagattcagtgttgggcaccgtgagcgttgccgatacgaagggcgtcaaaaggaaaacgctgttcagagagaacggaagtaaacctcgagctatagtcgttgaccctgtacacggctttatgtactggacagattgggggacccctgctaagatcaagaaggggggacttaatggagtcgacatttactccctggttacagagaacatccagtggcctaatgggatcactttagacctccttagcggtaggctgtattgggtggattctaagctgcattctatctctagcatcgatgtgaacggaggcaacaggaaaaccatcttagaagatgaaaagcgcctggcccaccctttttcactcgcagttttcgaagataaagtgttttggaccgacattataaatgaggctattttttccgctaatcggctgaccggtagtgatgtcaatctcctggccgagaatttactcagccccgaagacatggtcctgttccacaacctcacccagccccggggtgtgaactggtgcgaacggactaccttatcgaacggcggttgccagtacctatgcctgcctgccccccagattaatccccactccccgaagttcacctgcgcctgtccggatgggatgctactggcacgagacatgcggtcgtgtcttactgaggctgaggccgccgtagctactcaggagaccagcaccgtaagacttaaagtctcatcaactgcagttagaacccagcacacaacaactcggccagtaccggacacctcgcgactgccgggcgcaacaccggggctgacaaccgtggaaatagtcacaatgtcccatcaggctctgggagatgttgctgggaggggaaatgagaagaagcccagctctgtaagggctctctccatagtactccctatagtgctgttggtcttcctgtgcctgggcgtctttctgctatggaaaaattggcggttgaagaacatcaactctatcaattttgacaatcccgtttaccagaaaacaacggaggacgaggttcatatatgccacaaccaggacggatacagctacccttctagacagatggttagtctggaggacgatgtggcc

SEQ ID NO: 16432 - DNA, 2580 bp, Artificial Sequence
  Description of Artificial Sequence: Synthetic coding sequence
atggggccgtggggatggaaacttagatggaccgttgcattgttgttggcggcggcaggcacagcagtaggggacaggtgtgagcgcaacgagttccagtgtcaggatggaaagtgtatttcatacaaatgggtgtgcgatggaagcgctgagtgccaggacggaagcgacgaaagccaagagacatgcttgagtgtaacatgtaagtccggcgattttagctgcggggggcgcgttaacaggtgcatcccgcaattctggaggtgtgacggccaggtggactgtgataacggtagcgatgagcagggctgcccgcctaagacatgtagccaagacgagtttcggtgtcacgacggaaagtgtatttcaagacaattcgtctgcgattccgacagggattgtctcgacggatctgatgaagccagttgtcctgtcctgacctgcggcccggctagcttccagtgtaatagttctacttgcattccgcagctgtgggcatgcgataatgatccagactgtgaggacggatctgacgaatggcctcaacggtgtagaggcctctacgtatttcaaggtgattcttcaccgtgtagtgcattcgagtttcactgtctgagcggagaatgtatccactcaagctggcgctgcgacggaggtcccgattgtaaggacaaaagtgatgaagaaaactgcgctgtggcgacttgcaggcccgatgagtttcagtgtagcgacgggaactgcatacacggtagccggcaatgcgacagggaatacgattgtaaggatatgtctgatgaagttgggtgtgttaatgtgaccctttgcgagggccccaacaagtttaaatgtcacagcggtgagtgcataaccctggataaagtgtgtaacatggctcgtgattgcagggattggagcgacgagccaattaaagaatgtggcacagcagcatgccttgacaacaacggggggtgcagccacgtgtgcaacgctctgaagattggggcagagtgcctttgtcctgacggcttccaactggttgctcagagaagatgcgaggacattgatgaatgtcaggatcccgacacttgcagtcaactctgcgtcaacctcgagggtggatacaaatgtcaatgcgaggaaggctttcagcttgacccacataccaaggcgtgcaaagctgtgggcagcattgcttacctgtttttcactaaccgccatgaggtgagaaaaatgactctcgatagaagtgagtatacttccttaattcccaatctgcgcaatgtagtagctcttgacactgaagttgctagcaaccgaatctattggtctgatcttagccagaggatgatatgctctactcagctcgaccgggcacatggcgtgagtagttacgataccgttattagtcgagacatccaagctccggacgggctcgctgtggactggattcactcaaacatttattggacagactctgtgctgggcaccgttagtgtagctgataccaaaggagtgaaacgaaaaaccctcttcagggagaacgggtcaaagccacgggctatcgtcgtggatccagttcacggtttcatgtattggaccgattggggaacaccagctaaaattaagaagggaggtctcaatggggtggacatctacagcctcgtcactgagaacattcagtggcccaatggaatcacattggatcttctgagcggtagactctactgggtcgattctaaactgcattccatcagttctatcgatgtgaacggcgggaacagaaaaaccatcttggaggacgaaaaaagacttgcacacccgtttagtcttgccgtttttgaagataaagttttttggaccgacatcataaacgaggcaatcttcagcgcaaataggctaactggatctgacgttaacctgctcgctgaaaaccttctgagcccagaagacatggtgctgttccataacctgacccagccaagaggagtgaattggtgtgaacgtactacactttccaacggcggctgtcagtacttgtgcctgccagcgccccagatcaacccccactcacctaagtttacatgcgcttgtccagacggcatgcttctcgctagagacatgcgcagctgtcttaccgaagccgaggctgccgtggcaacacaagagacctctaccgtaaggctcaaagtctcaagcaccgctgttaggacacagcataccaccacaagacctgttcctgatacttcaaggttgcctggcgccacccctggcctcacaaccgtagaaatcgttaccatgtcccatcaggccctgggcgacgtggccggccggggcaacgagaagaagccctcaagcgtaagggcactgtctatcgtgctgcccatcgtccttctggttttcttgtgtttgggggtcttcctgctttggaaaaactggaggctcaaaaatattaactctattaactttgacaatcccgtgtaccagaagaccacagaagatgaagtgcacatctgtcacaatcaagacggatactcttacccctcaagacaaatggtttctcttgaagacgatgtcgca

SEQ ID NO: 16433 - DNA, 2580 bp, Artificial Sequence
  Description of Artificial Sequence: Synthetic coding sequence
atgggtccctggggctggaaactgcgatggactgtggccctgttgctcgccgctgctgggaccgcagtcggggatcgctgcgagcgaaacgaattccagtgtcaggatggcaaatgtatcagctacaagtgggtgtgtgacggaagcgctgaatgccaggatggatccgacgaaagccaggaaacatgcctttccgtgacttgcaagtcgggtgatttttcttgcgggggcagagttaatcgctgtattccgcaattctggcgatgcgatggccaagtagactgtgataacggcagtgacgagcaggggtgcccccccaaaacctgttcgcaggatgagtttcgatgccatgacgggaagtgtatctcccgccagtttgtgtgtgactccgacagagactgtttggatgggtccgatgaggcctcttgccctgtgcttacgtgcggacccgcgagctttcagtgcaattcgtcaacatgcatcccacagctgtgggcgtgtgataacgaccctgactgcgaagatggctccgacgagtggccacagcggtgtagggggctttacgtgttccaaggcgattcgtccccttgctccgcatttgaattccactgtctgtccggcgaatgtatccactcttcatggaggtgtgacgggggaccagattgcaaggacaaatccgatgaggagaattgtgcggtcgccacctgtcggccagacgagttccagtgttccgacggcaactgcatacacggatctcgccagtgtgatcgcgaatatgattgcaaagatatgtccgacgaggtcggctgcgtaaatgttaccttatgtgaaggtcctaataagttcaagtgtcattctggcgagtgtataaccctggacaaggtctgtaatatggcgagagactgtcgcgattggagcgatgagccaattaaggaatgcggcacagcagcttgtctggacaataatggcggatgtagtcacgtctgcaacgctcttaagataggcgctgagtgtctgtgtcctgacggctttcagttggtggctcagaggcgctgcgaagacatcgatgaatgccaggatcctgacacttgctctcaactgtgcgtgaatctggaggggggttacaagtgtcagtgtgaagagggattccagctggatcctcatacaaaagcttgcaaggctgtgggcagtatcgcctacctcttcttcacaaacagacacgaagtcaggaagatgacactggacaggtctgagtacaccagcctgattcctaaccttcgcaacgtagttgctcttgatacagaggtggctagtaaccgtatctactggtcggatttgtctcagcggatgatctgtagtacccagctcgacagggctcacggagtatccagttacgacacggtgattagtagggacatccaggcacccgacggactcgcagtagactggatacactccaatatttattggaccgactctgtcttggggacagtttcagtggcagacacaaagggggtcaaacggaaaacacttttccgggaaaacggctcaaagccgcgggctattgttgtcgatcccgtccacggctttatgtactggaccgactggggcacccctgctaaaataaagaagggaggcttaaatggagtagatatatacagccttgtgaccgaaaatatacaatggcccaacggtatcaccctggatttgctgagcggtaggctctactgggtcgactcgaaactccatagtatctctagtattgacgtgaatggcgggaacaggaaaactatcctggaagacgagaagcgcctcgcccatcctttctccctagctgtgttcgaagacaaagtattctggacagacattataaatgaggcaatcttctcggccaatcgccttactggctctgacgtgaaccttctggccgagaacctactgagccctgaagacatggtcctgtttcacaacctcactcagccacggggcgtgaactggtgcgaacgtactaccctgtctaacggaggatgtcagtatctgtgtttgcctgcacctcagattaatccacacagcccaaaattcacatgcgcttgcccagatggcatgcttctggcacgggacatgcgttcttgtcttactgaggctgaagctgccgttgccactcaagagacttctactgtgaggctaaaagtttcctccaccgccgtccggacccaacacacaaccactcgtccagtacctgacactagtcgactcccaggggctacgccaggcctgacaaccgtagaaattgtgacaatgtctcatcaagctcttggcgatgtagctggtcgtggcaacgaaaaaaaaccctcctccgtgcgagctttgtccatcgtactccctattgtcctcctggtgtttctttgtctaggggtctttctgctgtggaagaattggcgtctgaagaacatcaattcaataaactttgacaaccccgtgtatcagaagaccacggaagacgaggtccacatctgtcacaaccaggacggctatagctatccttcccgacagatggtgtcacttgaggacgacgttgct

SEQ ID NO: 16434 - DNA, 2580 bp, Artificial Sequence
  Description of Artificial Sequence: Synthetic coding sequence
atggggccctggggatggaaacttcggtggacagtggctcttctactcgctgccgctgggacagcagtgggagatcgatgtgaacgaaacgaatttcagtgtcaggatgggaagtgtatttcctataaatgggtgtgtgatggatctgccgaatgtcaggacgggtccgacgaatcccaggaaacatgtcttagtgtgacttgtaaaagtggggatttttcctgtggggggagggtgaacaggtgtatccctcagttctggcggtgtgatggacaggttgattgtgataatggatcagacgagcaggggtgtccacccaagacatgcagtcaggatgaatttaggtgtcatgatgggaaatgcatatcccggcagttcgtatgcgactcagatcgggattgtttggacgggtcagatgaggcttcctgcccagtgctgacttgtggacccgcatcatttcagtgtaattcctctacttgtatccctcagctctgggcctgcgataacgaccccgactgcgaagacgggtctgatgaatggcctcagagatgtagggggctctatgtgttccagggggatagttcaccttgtagtgctttcgagttccattgtcttagtggggaatgtatccactccagttggcggtgtgatgggggacctgattgtaaagataaaagtgatgaagaaaattgcgccgttgccacttgccgcccggatgagttccagtgtagtgatggaaattgtattcatggatccaggcaatgcgatcgcgagtatgattgtaaagatatgtccgatgaagtgggatgcgttaacgtcacactgtgtgaagggcccaataagtttaaatgccatagtggggaatgcataactttagacaaagtatgtaacatggcacgggattgccgggactggtccgatgagccaattaaagaatgcggaacagccgcctgtctcgataacaatggggggtgctcccacgtgtgcaatgccctgaaaataggagcagaatgcctctgcccagatggatttcagctagtcgcacagcgaaggtgtgaagatatagatgaatgtcaagaccctgatacttgttctcagctctgcgttaatttggaagggggatataaatgccagtgcgaagaaggatttcaactagatccccacactaaagcatgcaaagctgtggggtctatcgcttacctcttttttacaaaccgacacgaagtgcgcaagatgactctagatagatccgaatatacaagtctcatcccaaatctccgaaacgtggtggccctggatactgaagtggcatcaaatcggatctattggtctgatctctctcagagaatgatttgttctacacaactagatcgagcacatggagtgtcatcttacgatacagtgatctctcgagatattcaggcacccgatgggctagccgtggattggatacatagtaacatatattggactgattcagtgcttgggactgtatctgttgcagatactaaaggagtgaaaaggaagactctgtttagggaaaacggaagtaagcctagagccatcgtagtggaccccgttcacggatttatgtattggacagactgggggactcctgctaaaatcaaaaagggagggctgaacggggtcgacatatacagtttagtaacagaaaatatccagtggccaaatggaataactctagatctactgagtgggcggctttattgggtcgattctaaattgcactccattagttctattgatgtcaatggagggaatcgaaagactatcctggaggacgagaaacgacttgcccatccattttctctggccgtatttgaagataaagtgttctggacagatatcattaacgaggctattttttctgctaacagattaactggatccgatgtcaatctcctggccgagaacctcctgtcccccgaagatatggtgttgtttcacaacctcacacaaccaagaggagtgaattggtgtgaacgaacaacactttccaatggggggtgtcagtatctgtgtttgcctgctccacaaatcaacccccactctccgaagttcacttgcgcctgccccgatgggatgctcttagcacgcgacatgagatcttgtctcactgaagcagaggcagccgtggcaactcaggaaactagtacagtacggttaaaagtgtcttcaacagccgttagaacacagcacactactacacgccctgtgccagatacttccagactgcctggggccactccaggactgactacagtggaaattgtgactatgtcccaccaggctcttggagatgtcgccggacgcgggaacgagaaaaaaccctcgtctgtaagggccctatccatagttctccctatcgtgctgctggtatttttatgcctaggggtttttctcctttggaaaaactggcggcttaaaaacataaactccatcaactttgacaatcctgtgtatcagaaaacaacggaagatgaggtgcacatatgtcataaccaggatgggtactcctatccctcgcggcagatggtgagtctggaagatgatgtcgct

SEQ ID NO: 16435 - DNA, 2580 bp, Artificial Sequence
  Description of Artificial Sequence: Synthetic coding sequence
atgggaccatggggctggaaactgaggtggactgtggcgctcctgctggccgctgcgggaactgcggtcggagacagatgcgaacgcaatgaattccagtgccaggacggaaagtgcattagctacaaatgggtgtgcgacggatcagccgaatgccaggacggcagcgacgagtcacaggaaacctgcctctccgtgacgtgtaaatccggggatttctcgtgcggcggccgcgtgaatagatgcatcccgcagttctggaggtgcgatggacaggtcgattgcgacaatggatcggatgagcaaggttgtccgccgaaaacctgctcgcaggacgagttccggtgtcatgatgggaagtgcatcagcaggcagtttgtctgcgatagcgaccgcgattgtctggatggaagcgacgaggcgtcatgtcctgtgctcacgtgtggcccggcctcgttccagtgtaactcctcgacctgcataccgcaactgtgggcgtgcgataacgacccggactgcgaagatggatcggacgaatggccccaacggtgccggggactctacgtctttcagggagactcgtcaccatgttcggctttcgaatttcattgcctgagcggtgaatgcatccactcttcgtggcggtgcgatggagggcctgattgtaaggacaagagcgacgaggagaactgtgccgtggctacctgtcggccggacgagtttcagtgctcggatggcaattgcattcacggaagccgccagtgcgatcgggagtacgattgcaaggatatgtcggacgaagtgggatgcgtgaacgtgactttgtgcgaaggccccaataagtttaagtgccatagtggtgagtgtatcacgctggacaaagtgtgtaatatggcaagggactgtcgtgattggagcgacgagccaatcaaggagtgcggaactgccgcgtgtctggataacaacggtgggtgcagtcacgtgtgcaatgctctcaagattggcgccgaatgcctgtgcccagatgggttccagctggtcgctcaacggagatgcgaagatattgatgagtgtcaagatcctgacacttgctcgcagctctgcgtgaaccttgagggagggtacaaatgccaatgcgaggagggatttcagctggatccgcacaccaaagcgtgcaaagctgtgggatcgatcgcatacttgtttttcactaataggcatgaagtccgcaagatgaccctcgaccgctccgaatacactagcctgatcccgaacctgcgcaacgtggtcgcgctcgacactgaggttgcctctaacagaatctattggagcgacctttcacagcgcatgatctgttccactcagttggaccgggcccacggagtcagctcttacgatactgtcatctcgcgggatatccaggccccggacggactcgcggtggattggatccactcgaacatctattggacggattcggtgctggggaccgtctcggtggccgacaccaagggagtgaagagaaagaccttgtttcgcgagaatggctcgaagcctcgcgccatcgttgtggacccggtgcacggatttatgtactggacggactggggaactccggcgaagatcaaaaagggcggactgaatggtgtggatatctacagcctggtgactgaaaacatccagtggccgaacggtatcactctggatctcttgtcgggacggctttactgggtcgattccaagttgcattcgatttcgtccatcgacgtcaacggaggtaaccggaaaaccatactcgaggacgaaaaaagacttgcccacccgttctcactggccgtgtttgaggataaggtgttctggaccgacatcatcaacgaagccatcttctccgccaatcgcctgactgggagcgacgtgaacctgctggcggagaacctcttgagtccggaagatatggtgctgttccataacctgacgcaaccgcgcggagtcaactggtgtgagcgcaccactctctccaatggaggctgccagtacctgtgcctcccagcaccgcaaatcaatcctcattcgccgaaattcacctgtgcatgcccggacggtatgctgctggcccgggacatgcgctcgtgcctcactgaggcagaggcagctgttgctacccaggagacttccaccgtccgactcaaggtgtcatccactgcagtgaggacccagcacaccaccacccggcctgtcccggacacgtcgaggctgcccggagcgaccccgggtctgaccaccgtggaaatcgtgactatgtcccaccaggcgctgggagatgtggcaggtcgcggcaacgaaaagaagccttcctcggtgcgtgccctgagcattgtgctgcccatcgtgctcctcgtgtttttgtgcttgggagtgttccttctgtggaagaattggcgcctgaagaacatcaattcgatcaattttgacaacccagtgtaccaaaagacgacggaagatgaagtgcacatctgccacaaccaggacggatacagctacccttcccggcagatggtgtcgctggaggacgatgtcgca

SEQ ID NO: 16436 - DNA, 2580 bp, Artificial Sequence
  Description of Artificial Sequence: Synthetic coding sequence
atgggcccgtggggctggaagctgagatggaccgtggctctgctcctggcagccgcgggtactgcggtgggggaccgctgcgagagaaatgaatttcaatgccaagatggcaagtgtatctcgtacaagtgggtgtgcgatggatcggcggaatgtcaggacgggtcggatgaatcacaggaaacctgcctgtctgtgacctgcaaatccggagatttttcatgcgggggacgcgtgaaccgctgcatcccgcaattctggagatgtgacgggcaggtggactgcgacaacggaagcgatgagcagggttgcccgccaaagacctgctcgcaggatgaattccggtgccatgacgggaaatgtatctcacgccagttcgtgtgcgacagcgatagagattgcctcgacggcagcgatgaggcaagctgtcctgtgctgacttgcggaccggcctcattccagtgcaacagctccacctgcatccctcaattgtgggcctgcgacaatgacccagactgtgaagatggatcagacgaatggccgcaacgctgtagagggctgtacgtgtttcaaggagacagctccccatgctcggcgttcgaattccattgcctgtcgggagaatgcattcactcgtcgtggcggtgcgacggaggaccggactgcaaagacaaatcagacgaggaaaattgcgccgtcgcaacttgtcgcccagacgaattccaatgcagcgatggcaactgcattcatggctctcggcagtgcgaccgcgaatatgactgcaaggacatgagcgatgaagtgggctgcgtcaacgtgactctctgcgaaggaccgaataagtttaagtgccatagcggcgagtgtataactttggacaaggtctgcaacatggcccgcgactgccgagactggtctgacgagccgatcaaggagtgcggaactgcggcttgcttggacaacaatggcggatgcagtcacgtctgcaatgcgctgaaaataggcgcggagtgcctgtgtccggacggctttcagctcgtggcacagcgccgctgcgaagatatcgacgaatgtcaggatccggacacctgcagccagctttgcgtcaatctggaaggaggatacaagtgccagtgcgaggagggcttccagctggacccgcacactaaggcttgcaaagcagtaggatccattgcatacctcttctttaccaataggcatgaagtgcgaaagatgactctggatcggagcgaatacacctcccttatcccaaatctgcggaatgtggtggccctggacaccgaagtggcgagcaacagaatctattggagcgacctgtcgcagaggatgatctgcagcacccaattggatcgcgcccatggagtgtcctcgtacgataccgtgatcagccgcgatatccaggctccagatggattggctgtggactggatccactcgaacatttactggaccgactctgtgcttggcactgtgagtgtcgcggacaccaagggggtcaagcgcaagacgctgtttcgggagaatggaagcaagcctcgtgcgatcgtcgtggacccggtccacggttttatgtactggacggactggggaactccggccaagatcaaaaagggcgggctcaacggagtcgacatttactctctggtcactgagaatatccaatggccaaatggaatcactctcgatctgctgtcaggacggttgtactgggtcgattccaagctgcactcgatctcgtcaatcgatgtgaacggaggaaacagaaaaaccatcttggaggacgaaaaacgactggcccacccattcagcttggccgtctttgaggataaagtcttttggaccgatatcatcaacgaggccattttcagcgcgaaccgactcactggtagcgacgtgaacctccttgcggagaatctcctctcgcctgaggatatggtcctgtttcataatctgactcagccgcggggcgtgaattggtgtgagagaaccaccctttccaacggaggatgccagtacctgtgtctgcctgctccgcaaatcaatccacactcgcccaagtttacctgcgcctgtccggatggaatgttgcttgcgagggatatgcgctcatgcctgaccgaagcagaagccgcagtcgctacccaggaaacctccacggtccggttgaaggtgtcctcaactgccgtgaggacccagcacaccaccacgaggcctgtgccagacacctcccgccttccgggagctactcccggactgactaccgtggagattgtcaccatgtcccaccaggccctcggggatgtggctggtcggggaaacgagaaaaaaccttcctcagtgagagccctgtcgattgtcctccctattgtgctgctggtgttcctctgcctgggcgtgttcctgttgtggaaaaactggcgcctgaagaacatcaactccattaacttcgataaccccgtgtaccagaaaacgactgaggacgaagtgcatatttgccataaccaggatggctactcatacccgtcaagacaaatggtgagcctcgaggacgacgtggcc

SEQ ID NO: 16437 - DNA, 2580 bp, Artificial Sequence
  Description of Artificial Sequence: Synthetic coding sequence
atgggcccttggggatggaagctcagatggacagttgccttacttctggccgctgccggaactgccgtcggagacagatgcgaacggaacgaatttcagtgccaagatggcaaatgtatttcttacaagtgggtgtgtgatgggagcgcggaatgccaagatggctctgatgagtctcaggaaacctgcctgtcagttacctgcaaaagtggtgatttcagctgtggcgggagagttaataggtgtattccccaattttggaggtgcgatgggcaggttgattgcgacaacgggtctgacgagcaaggttgccctccgaagacctgtagtcaagacgaatttagatgccatgatgggaaatgcatatcccgacaatttgtttgcgatagcgaccgagactgcctggatggtagtgatgaagcttcttgccccgtcctcacctgcgggccagcatcctttcagtgtaatagtagtacctgtatccctcaactgtgggcatgcgataacgacccggactgcgaggacggtagtgacgagtggccccagagatgcagaggactctatgtgtttcagggagattcatccccctgcagtgcatttgaatttcactgcctgtcaggtgaatgcatccacagctcatggcggtgcgatggcggcccagattgtaaggacaagtccgacgaagaaaactgtgctgttgccacctgcagaccagacgaattccagtgctcggatgggaattgtatacacgggtccaggcaatgcgacagggagtatgactgcaaggatatgtctgacgaggtcggttgtgtgaatgtgacactgtgtgaggggccaaacaaattcaagtgccatagtggggagtgcatcacgttggacaaggtttgcaacatggccagggactgtagagactggtccgacgaaccaattaaagaatgtggaacggccgcttgtttggataacaatggagggtgctcacatgtgtgcaatgcacttaaaattggggccgagtgtctgtgccccgacgggttccaactagttgctcagcgcagatgcgaggacatagatgaatgccaggaccccgacacctgttcacagctgtgtgtaaacctggaaggaggctataagtgccagtgcgaggagggctttcagctggatccccacacgaaagcctgtaaggcagttggcagcatcgcttatctgttttttactaacagacacgaggtgagaaagatgactctcgacaggagcgaatacacttcattgatcccaaatttgcggaacgtagtggcactggatacggaggtagccagtaaccgaatctattggagcgacctctcccagcgaatgatttgtagtacccagcttgatagggctcacggcgtgtctagctacgataccgttattagcagagatattcaggcccccgatggcctagcagtagattggatccactccaatatttactggacagacagcgtcttgggaactgtatccgtggccgacacaaaaggagttaagcgaaaaacgttgtttagagagaacggatccaaacccagagccatcgtcgtggatcctgttcatggcttcatgtactggaccgactggggcacacccgccaagataaaaaagggaggtctgaatggcgtggacatttattctttagtcaccgagaacatccagtggcctaacggtatcactctggatttgctgtctggacgactctattgggtggattcaaagctgcatagtatctccagtatagatgtcaatggaggaaacagaaagacaatacttgaagatgagaagaggctggcgcacccattttccctggcagtcttcgaggacaaggtcttctggacagacattattaatgaggcgatattctcagcgaaccgactgacgggtagcgacgtgaaccttctcgcggagaacctcctgagcccggaagatatggtgctgttccataatttaacacaaccaaggggagtgaattggtgcgaacgtacaacactcagcaacggcggatgtcagtacctgtgtttacccgccccacagataaaccctcactcccccaaatttacgtgtgcctgccctgatggcatgctgctcgcccgtgacatgcgtagctgtctaaccgaagccgaggctgcagtggcgacccaagagaccagtaccgtcagactcaaagtctcctcgactgctgtccgaacacagcacacaactacccgaccagtgcctgatactagcagacttcccggcgccaccccaggcctcactacagttgaaatagtgacaatgagccatcaggcattgggggacgtagcaggacggggcaacgagaaaaaaccttcatcggtcagagctctatctattgtcttaccgatagtgcttctggtgttcctgtgccttggcgtatttctgctttggaaaaattggagactgaagaatataaactctatcaacttcgacaatccagtctatcagaaaaccaccgaagatgaggtgcacatttgccacaatcaggatggatacagttacccctccaggcaaatggtgtctcttgaggacgatgtcgcc

SEQ ID NO: 16438 - DNA, 2580 bp, Artificial Sequence
  Description of Artificial Sequence: Synthetic coding sequence
atggggccttggggatggaagctgcgatggaccgtcgccttgctgcttgccgccgccggcactgctgtaggagataggtgtgagcgaaatgaatttcaatgtcaggacggcaagtgcattagttataagtgggtctgcgatggaagcgcagagtgtcaagacgggtccgatgagtcccaggaaacttgtctctcagttacctgtaaatctggggactttagctgtggaggcagagtaaaccgctgtattcctcagttctggcgctgtgacggccaggttgattgcgataacggatccgacgagcaggggtgcccaccaaaaacctgctctcaggatgagttccgctgtcacgacggtaagtgcatatctaggcagtttgtatgtgattctgatagggactgtctggatggatcagatgaggcaagttgcccagttctcacctgcggaccagcttctttccagtgcaactcctcgacctgtataccccagttgtgggcctgcgacaatgatccagactgcgaggacggtagtgatgaatggccgcagcgatgtcgcggtctctacgtgttccaaggggactctagcccttgtagcgccttcgagttccattgccttagtggagaatgcatccactccagttggaggtgcgacggcgggccagattgcaaggataaatctgatgaagaaaattgtgccgtggccacctgcagacctgacgagtttcaatgctctgatggaaattgtatccatggcagcaggcagtgcgaccgtgaatatgattgcaaggacatgagtgatgaagtggggtgtgtgaacgtgaccttgtgtgaaggacccaacaagtttaaatgccattcaggagagtgtatcacgcttgataaggtgtgcaacatggcgcgggactgcagagactggtccgatgaaccaatcaaggagtgtgggacagcggcctgcctggacaataacggcgggtgctcacacgtgtgtaacgccttaaagataggtgctgaatgcctgtgtccggatggtttccaactggtggcccagcggaggtgcgaggatattgacgagtgccaggatcccgacacctgcagtcagttgtgcgtcaacctggaaggcggctataagtgccagtgcgaggaggggttccagttggacccacacacaaaagcttgcaaagctgttgggagtattgcctatctctttttcaccaatcgccatgaggtacggaagatgacactggacaggagcgaatacacgagtctgatcccaaatctgaggaatgtggtggcattggataccgaggtggccagcaatcggatctactggtctgatctgagccagcgcatgatttgttcgacacaactagatcgagcccacggtgtgagctcctacgacacagtgatcagcagggacatccaggcacccgatggacttgccgttgattggatccattctaatatttattggaccgattccgtgctaggcaccgtgagcgtcgcggacaccaaaggcgtgaaaaggaaaaccctgtttcgcgagaatggaagcaaaccacgggccatagtcgtggatcccgtacacggctttatgtattggactgactggggtacccccgccaaaatcaaaaagggaggcctgaatggtgtggacatttactctttggtgaccgagaatatccagtggccaaacggtattacactggatctgctgagcgggaggctgtattgggtagacagtaagctgcacagtatcagcagtattgatgtgaatggggggaacagaaagaccattctggaagacgaaaagaggcttgctcatccgtttagtctggctgtgtttgaagacaaggtgttttggactgatatcatcaacgaagccatcttttcagccaacagacttaccggcagcgacgtgaacctcttggccgagaacttactgagccctgaggatatggtgctattccataacctgacccaaccacgtggggtgaattggtgtgaacggacaactctgagcaatggagggtgccagtacctgtgcctccccgctccccaaattaatccccatagtcctaagttcacttgtgcctgccctgatggaatgcttctggctagagatatgcgctcctgtttgacggaagctgaggcagccgtagctacccaggaaacctctacagtgagacttaaggtgtcatccactgcagtgcgtacccagcacacaactactcgtcccgtgccagatactagcagactgcccggcgccacacctggtctcacaactgtagagattgtgactatgtcccatcaagccctcggtgacgtggcaggccgcggaaatgagaagaaaccctcttctgtgcgggcactctccattgttctgcccatcgtgctcctggtcttcctgtgcttgggcgtgttcctgttatggaagaactggcggctcaaaaacatcaactccataaattttgacaatcctgtgtatcaaaagactaccgaagatgaagttcacatctgccacaaccaggatggatactcatacccaagcagacaaatggtatctcttgaagatgatgtggcg

SEQ ID NO: 16439 - DNA, 2580 bp, Artificial Sequence
  Description of Artificial Sequence: Synthetic coding sequence
atgggtccctggggttggaagctgcggtggacggtggcccttctgcttgccgcagcaggaactgcagtgggtgataggtgtgagaggaatgagttccaatgccaggacggaaagtgtatctcgtacaagtgggtgtgcgacggttctgcagagtgtcaggatggctcggatgaatcgcaagagacttgtttgtccgtgacctgtaagtccggagatttcagctgtggtggtcgtgtgaaccgatgtattccacaattttggcgatgcgacggacaggtcgattgtgacaatggaagtgatgaacagggatgtccaccaaaaacctgctctcaagacgagttcagatgtcacgatgggaaatgcatatcaagacaatttgtgtgtgattcggatcgtgactgtctcgatggatcagacgaggcttcctgtcctgtcctcacttgtgggccagcctcgtttcaatgtaactcctcgacctgtattccacagctctgggcctgcgataacgaccccgattgcgaggacggcagcgacgagtggcctcaacggtgtaggggtctttacgtgtttcaaggtgactcctcaccatgctccgcctttgagtttcattgcctttcaggagaatgcattcactcaagctggcgctgtgacggaggacccgattgcaaggacaaatccgacgaagaaaactgtgccgtggcaacttgtcgccccgacgagtttcagtgtagcgacggtaattgtattcatggttcgcggcagtgtgatcgtgaatatgactgcaaggatatgtctgatgaagtgggatgtgtcaatgtgactctgtgcgaagggccaaacaagttcaaatgtcattccggggaatgtataactctggataaggtgtgcaacatggctcgggactgccgggattggtcggatgaacctatcaaggagtgcggtactgcggcatgtctcgacaacaacggaggctgtagtcacgtctgtaatgctcttaagataggagccgaatgcctttgtcctgatggattccaactggtcgcccaacgtaggtgtgaagatatcgatgagtgccaggaccccgatacttgttcccaactttgcgttaaccttgaaggaggatacaagtgtcagtgtgaagagggatttcaattggatcctcacaccaaggcttgtaaagcggtgggttccattgcgtaccttttctttaccaaccgccatgaggtgcgcaagatgacccttgaccgttccgaatacacttccctcatccctaacttgaggaatgtagtggccctggacacggaggtggcgtccaatcgcatttactggagcgatctttcacagagaatgatttgctccacccaactcgacagagcacatggagtctcctcgtacgatactgtgatttcgagagacattcaggcacctgacggcctggccgtggactggattcattccaacatctactggacggactctgtcctggggactgtctccgtggccgatacgaagggagtgaagcggaaaaccctctttcgtgaaaatggctcaaagccacgcgccattgttgtcgaccctgtccacggctttatgtactggaccgactggggtaccccggcaaagataaagaaaggcgggctgaatggcgtggatatctactcgctggtcactgaaaacatccagtggcctaacggaattaccttggatctgcttagcggacggctttactgggtggatagcaagctccattccattagtagcatcgatgtgaacgggggcaatcgtaagaccattttggaagatgagaagcgtcttgcgcatcctttcagccttgcagtgttcgaagataaagtgttttggaccgatatcataaatgaggcgatcttttcagcaaatagattgactggatcggatgtgaacctgctcgcagagaacctgctctcgccagaagatatggtgctgttccacaaccttacccagccgaggggcgtcaactggtgtgagcgtactaccctgtcgaacggaggctgccagtacttgtgtctgccagcaccccagattaaccctcattcaccaaaattcacttgtgcgtgccccgatggtatgctcttggctagagatatgaggtcatgtcttaccgaagcagaagcagcggtggccacccaagaaacctcaaccgtcagactgaaagtgtcctccaccgccgtgcgcacccagcatactactactagacctgtccccgatacctcacgccttcccggtgcgaccccaggattgaccactgtggaaatcgtgaccatgtcgcaccaagcgctgggtgatgtggcaggacggggaaatgaaaagaagccgtcctccgtgcgcgccttgagcatagtgcttccaattgtgctcctggtgtttctgtgccttggagtgtttctgctgtggaagaactggcgccttaagaatatcaatagcataaacttcgataacccagtctaccagaaaactacggaggacgaggttcacatctgtcataaccaggacggatactcatatccttcgcgacaaatggtgtccctggaggacgatgtcgct

SEQ ID NO: 16440 - DNA, 2580 bp, Artificial Sequence
  Description of Artificial Sequence: Synthetic coding sequence
atgggaccttggggttggaagctgaggtggactgttgctctcctgttggccgctgccggaaccgcggtgggcgaccgctgcgaaaggaacgagttccagtgccaggacggaaagtgtatcagctacaagtgggtctgcgacggatccgctgaatgccaggatggcagcgatgaatcgcaggagacttgtctctccgttacttgcaagtcgggagatttctcatgcggaggtcgggtgaatcggtgcataccgcaattttggcgctgcgacggacaggtggattgcgacaacggatctgatgaacaggggtgcccgccgaaaacttgcagccaggacgaattcagatgccatgacgggaagtgtatatcccgccaatttgtttgcgactcggaccgagactgcctcgatggctccgacgaggcctcctgtcccgtgttgacttgcggcccggcctcgttccagtgcaatagcagcacttgcattccacaactgtgggcgtgcgacaacgatcccgattgcgaggatggctcagatgaatggccgcaacggtgccgcggactctacgtttttcaaggggattccagcccttgctcagccttcgaattccactgcctgtccggggaatgcatccactcatcctggcggtgtgatgggggacctgactgcaaagataagtccgacgaggaaaattgtgcggtggcgacttgccggccggatgaattccagtgctcagacggtaactgcatccatggttcgcggcagtgcgaccgcgaatatgattgcaaggacatgtcagacgaggtcggttgtgtgaacgtgactctctgtgagggccctaacaaattcaagtgtcactcaggagagtgcattactcttgataaagtgtgcaacatggcacgcgattgtagagactggtccgacgagccgatcaaagagtgcggaaccgctgcttgccttgacaacaacggcggatgttcacatgtgtgtaatgctctgaaaattggggccgagtgcctctgtccagacggattccaattggtggctcagcggcgctgcgaagatatcgacgaatgccaggaccctgacacgtgctcgcaactgtgcgtgaacctggagggaggttacaaatgccagtgcgaagagggattccagctggatccgcatactaaagcctgcaaggccgtcggctcgatcgcctacctgttcttcaccaaccggcatgaggtccggaagatgactctggatcgctcagaatacacctctctcatcccgaatctgcgcaatgtcgttgcactcgacactgaggtggcaagcaatcgcatctactggtcagatttgtcacagcgcatgatctgctcaactcagctcgaccgggcgcacggagtgtccagctacgatacggtcatcagcagggatattcaggcacctgacggactcgccgtggactggatccactcaaatatctactggacggactcggtgctggggactgtgtcagtggcggataccaaaggcgtcaagcgcaagaccttgttccgcgaaaacggatccaagccgcgggctatcgtggtggacccggtgcacggctttatgtactggactgactgggggactccagcgaagatcaaaaagggcggactgaatggcgtggacatctactcgctggtgaccgagaacatccaatggcctaacggaataacgcttgatttgttgtcaggtcgcttgtactgggtcgactcgaagctccattccatctccagcatcgacgtcaatgggggcaatcggaaaaccattctcgaagatgaaaaacgcctggcccacccgttctcgctcgccgtgttcgaggacaaggtgttctggaccgatatcataaacgaggcaattttctccgccaacagactgaccggatctgatgtcaatctcctggcggaaaacctgttgtctccggaagatatggtcctcttccacaacctgacccaaccgcggggggtgaactggtgtgagcggacgactctgagcaacggtggctgccaatacctgtgccttccagccccacagatcaacccccattccccgaagtttacctgtgcctgcccagacggcatgctgctcgcgcgtgatatgcggagctgtctcactgaagccgaggcggcagtcgccactcaagagacttccactgtgcgcttgaaggtgtcgtccactgcggtgagaacgcagcacaccacgacccggcctgtccccgatacctcacgcctgccgggtgccactccaggcctgaccaccgtggaaatcgtcactatgtcccatcaggcactgggggacgtggcgggtcgaggaaacgagaaaaagccatcttcagtgcgcgctctgagtatcgtcctgccgatcgtgctgctggtctttttgtgcctgggagtgttcctgctgtggaagaactggcggctgaaaaacatcaattccatcaatttcgacaatccagtgtatcaaaagaccaccgaggacgaagtgcatatctgtcataaccaggacggatactcgtacccctcgcggcagatggtgtcactcgaagatgacgtggca

SEQ ID NO: 16441 - DNA, 2580 bp, Artificial Sequence
  Description of Artificial Sequence: Synthetic coding sequence
atgggtccttggggttggaaacttcgctggactgttgcactgctcttggcagcagccggcaccgccgtcggggatcggtgtgagagaaacgaattccagtgccaggacggcaagtgcatctcttacaaatgggtctgtgatggatcagccgaatgtcaagacggctccgatgagtcccaagagacttgcctttcggtcacttgtaaatccggtgatttttcatgcgggggtagagtgaatcgttgtataccgcaattttggcgctgtgatggacaggtggattgcgataacggatcggatgaacaagggtgtcctcctaagacctgtagtcaagatgaatttagatgtcatgacggcaagtgtatttcaaggcaatttgtgtgcgattccgaccgagattgtctggacggaagtgatgaagcctcatgtcccgtgctgacgtgcggcccggcatctttccaatgcaattcgtcgacttgcatcccccaattgtgggcatgtgataacgaccctgattgcgaggatggtagcgacgaatggcctcaacggtgtagaggcctgtatgtctttcagggcgactcatcgccctgttcggcctttgaatttcattgtctctcaggagagtgtatccactcctcatggcggtgcgatgggggacctgattgtaaggacaagtccgatgaggagaactgtgcagtggcaacctgtagacctgatgaatttcaatgctcggacgggaattgtatccacggctcaagacaatgtgacagagagtacgactgtaaggatatgtctgatgaagtgggatgcgtcaatgtcactctttgtgaaggaccaaacaagttcaaatgtcactccggagagtgtattaccctggataaggtctgtaacatggcaagggattgtcgagactggtccgatgaaccaataaaggaatgtgggactgccgcgtgtctggataacaacggcggttgttcacacgtgtgtaacgctctgaaaataggtgccgaatgtctctgtcctgatggttttcagcttgtggcccagagaagatgtgaggatatagatgaatgccaagatccggacacctgtagccagctttgtgtgaacctggaaggaggctacaagtgtcaatgtgaggaaggatttcagctcgatccacataccaaggcatgtaaggccgtgggaagcatcgcatacctgtttttcacgaatcgacacgaagtccgaaaaatgactcttgaccgctccgaatacaccagccttattcctaacctgagaaacgtggtggcactggacactgaggtggcatccaaccggatttactggtccgatctgagccagcggatgatctgttcaacccaacttgacagagcacatggtgtgtcatcgtacgatacggtgatttcgagggatatacaggcacctgacggattggccgtcgactggattcatagcaacatttactggactgattctgtgttgggaacggtgtcggtggcggataccaaaggcgtgaagagaaagaccttgtttagagagaatggtagcaagccacgagccatagtcgtcgaccccgtgcatggttttatgtactggaccgattggggcactcccgccaagattaagaagggcggccttaacggggtggatatctatagcctggtgactgaaaacattcaatggccaaacggcatcacccttgatctgctgtcaggacgcctgtactgggtcgatagcaaactgcacagcatttccagcattgacgtcaacggaggtaacagaaaaactatcctggaggacgagaagcgtttggcccatccattctcgctggccgtgtttgaagataaggtgttttggactgatatcatcaatgaggcaatcttctcggctaatagactgacgggaagcgatgtgaacctgcttgcggagaatcttttgtcaccagaagatatggtcctgtttcacaacctcactcaacctagaggagtcaattggtgtgaacgaaccaccctgtccaacggtggttgtcaatacctttgtctcccagctccacagattaacccacattcccccaagtttacttgtgcatgccccgatgggatgctgctggcgcgcgacatgcggtcatgccttactgaagcagaagcagctgtcgcaacccaggaaacttcgaccgtcaggcttaaggtgagctcaactgccgtgagaacccaacataccaccactcggcctgtgcccgatacgtcccggctgcccggtgcaacccctggactgactaccgtggaaatagtcactatgtcgcaccaagcactcggtgacgtcgcaggaaggggtaatgaaaagaagccttccagcgtgagagcactgagcatagtcttgccaatagtgctgctggtgtttctttgtctgggagtctttctcctctggaagaattggaggcttaagaacattaactcgattaacttcgacaatcctgtgtaccaaaaaaccaccgaggatgaggtccacatctgccacaaccaagacggctactcgtacccctcgagacagatggtgtccctggaagatgacgtggca

SEQ ID NO: 16442 - DNA, 2580 bp, Artificial Sequence
  Description of Artificial Sequence: Synthetic coding sequence
atggggccatgggggtggaagctcaggtggaccgtcgccctgctgctagctgcagctgggaccgccgtgggtgatagatgcgaaaggaatgagtttcagtgccaggatggcaaatgcatctcctacaagtgggtgtgtgacggctctgctgagtgccaagacggaagcgacgaatctcaggaaacctgcctatccgttacttgcaagtctggtgatttctcctgcggcgggcgcgttaaccgctgtatcccacaattctggcggtgtgatggccaggttgattgtgataacggcagcgacgaacaggggtgccctcctaagacctgctcccaggatgagttcagatgtcacgatggcaagtgtataagcaggcaattcgtgtgtgactctgatcgtgactgtttggatggatctgatgaggcctcttgcccagtgctaacctgtggacccgcttctttccagtgcaattcctctacctgcatcccccagctgtgggcttgcgataatgatccagattgcgaggacgggagcgacgaatggcctcagcgatgtaggggcctgtacgtgttccagggagattcctccccttgctctgctttcgagtttcattgtctgtctggggagtgcatacatagttcctggcgctgcgatggcggaccagattgcaaggacaagtccgacgaggagaattgcgctgttgctacctgccggcctgatgaattccaatgtagcgatggcaattgtatccatggaagtcgccagtgtgacagggagtacgactgcaaggatatgtctgatgaggtggggtgcgtgaacgtgacactgtgcgaaggccccaataagttcaaatgccattcaggcgagtgcattaccctggacaaagtgtgcaatatggcaagggactgccgtgactggagtgacgaacccatcaaggagtgcggcaccgctgcctgtctggacaacaacggcggatgtagtcacgtctgcaatgccctgaaaatcggcgccgagtgtctatgccccgatggatttcagttggtcgcacaaagacgatgcgaagacattgatgagtgtcaagatcctgatacctgcagccagctctgcgttaatctggaaggcggatacaagtgtcagtgcgaagagggcttccagctggatccccatacaaaggcctgcaaagccgtgggctccatcgcctacctgttctttacaaatcgacatgaagtgcgtaaaatgaccctggatcgcagtgagtatacctctttgatacctaacttacgtaatgtagtggctctggataccgaggtggccagtaatcgcatctactggagcgatctcagccaacggatgatttgttcaacccaactggatagagctcacggcgtctcatcttacgatactgtgatatcccgggacatccaggcacccgacggcctcgcagttgactggatccacagtaatatatactggaccgactcagtactgggtaccgtgtctgtggccgacacaaagggtgtgaaaaggaagactttattcagagaaaacggttctaaaccacgcgctattgtggtagatccagtgcatggcttcatgtactggaccgattggggcacccccgccaagatcaagaaaggcggcttaaatggcgtggacatttatagtctcgtgaccgagaacatacagtggcctaatgggattaccctagatttactaagcgggaggctgtactgggtggacagtaaactgcattccatctcttctattgacgtcaatggtgggaatcggaaaacaatacttgaagatgaaaagcggctggctcacccctttagcctggcagtttttgaagacaaggtcttttggaccgatatcatcaacgaagctatcttttctgcaaatcggctgaccggctctgacgtgaatttactggccgagaatctgttgtcccccgaagacatggtgctgtttcacaatcttactcagccccgtggtgttaactggtgtgagaggaccaccctcagcaatggcgggtgtcagtacctctgcctgcccgcacctcaaatcaaccctcattcaccaaagtttacctgcgcatgtcccgacggaatgctactggcaagagatatgcggagttgcctgactgaagccgaggctgctgtggccacccaggaaacctcaaccgtgcgcctgaaggtctcctccactgctgtgagaacacagcacactaccacccgtcccgtgccagataccagccgtctgcctggagccacccctgggttgactaccgtagaaatcgtgaccatgtcccatcaggccctgggcgacgttgccggccgcggcaatgagaagaaaccaagcagtgtgagagcactgtccattgttttacccattgtgctactagtgtttctgtgccttggcgtgtttttactttggaagaactggcgccttaagaacataaactctatcaatttcgataacccagtataccaaaaaaccaccgaagacgaggttcatatttgtcacaatcaggacgggtactcctaccccagccgacaaatggtttcactggaggacgatgtggct

SEQ ID NO: 16443 - DNA, 2580 bp, Artificial Sequence
  Description of Artificial Sequence: Synthetic coding sequence
atgggaccatggggatggaagctgaggtggaccgtggcattgctgctggccgccgccgggacggccgtgggtgacagatgcgagagaaacgaattccaatgccaggacggcaagtgcatcagctacaagtgggtgtgcgacggatccgcggaatgccaagatggatcggacgaatcccaagaaacttgtctgtccgtcacctgcaaatcgggagatttttcgtgcggcgggagggttaacagatgcatccctcagttttggcgttgcgacggacaggtcgattgcgacaatgggagcgacgaacaaggctgcccaccgaaaacctgcagtcaggacgagttcagatgccacgacggaaagtgcatctcgcgccagttcgtgtgtgacagcgaccgcgactgcctcgacgggtccgatgaggcgagctgtccagtccttacctgcggaccggcctcgttccagtgcaactccagtacgtgcattccccagctttgggcgtgtgacaacgaccctgactgtgaggacggctcggatgagtggccccagaggtgccggggcctctatgtctttcagggagattcgtcaccgtgttcggccttcgaattccattgtctgtcgggcgagtgcatccactcgtcgtggcggtgtgatggaggaccagactgcaaggataaatccgatgaagaaaactgcgccgtggcaacgtgtagacctgatgaatttcaatgtagcgatggaaactgtatccacggtagccgccaatgcgacagggagtacgattgtaaggacatgagcgatgaagtggggtgcgtgaatgtaaccctctgcgagggcccgaataagttcaagtgccatagcggggagtgtatcacgcttgacaaggtgtgcaacatggctcgcgactgccgtgactggtccgacgaaccaatcaaggaatgcggcaccgcagcatgcttggacaataacggaggttgcagccatgtgtgtaacgctctgaaaattggcgccgaatgcctttgtccggatggattccaactcgtcgcacagaggaggtgcgaagatatcgacgagtgccaagatcccgatacttgcagccagctctgcgtgaacctcgagggagggtataagtgccagtgtgaggagggttttcaactcgacccgcacactaaagcctgcaaggcagtgggatcgattgcgtacctgttcttcaccaatcgccatgaagtgagaaagatgactctggaccgctcagaatacacctcgctcattccgaatctgagaaatgtggtcgcgttggatacggaagtggccagcaataggatctactggtcagatttgtcgcaacgcatgatctgctccacccagctcgaccgggctcacggagtctcgtcatacgacaccgtgatcagccgcgatatccaggccccggatggcctcgccgtggactggatacactcgaatatctactggactgatagcgttctggggactgtctccgtggccgacactaaaggcgtgaagagaaagaccctgttccgcgagaatggctcgaagccacgcgccatcgtggtcgaccccgttcatggcttcatgtactggactgactgggggactcccgcgaagatcaagaaaggaggtctgaacggggtggacatttactctctggtgacggagaatatccaatggccgaacggcatcaccctcgatttgctgtcgggacggctgtactgggtcgactcgaaacttcactccatcagctcaatcgacgtgaacggaggcaacaggaaaacgatcctggaggacgaaaagcgcttggcacatcctttctcgctggccgtgtttgaagataaggtgttttggaccgacatcattaacgaggccatcttttccgcaaaccgcctgactggatcggacgtgaatctgctggccgaaaatctgctctccccggaagatatggtgctgttccacaatctgacgcaaccccgtggagtgaactggtgtgagcggactaccctgtcaaatggcggatgccagtacctgtgccttccagccccgcagatcaatcctcactcgccgaaattcacctgcgcttgtcctgacggaatgctgctggctcgcgacatgcggtcctgcctcaccgaagcagaagccgctgtggccacccaggagacttccaccgttcgactcaaggtatcgagcaccgcggtccgcacccaacacactactacgcggccagtgccggatactagcagactccctggggcgacgccaggattgactacggtggagattgtcaccatgtcccatcaagcactcggggacgtggctgggaggggtaacgaaaagaaaccatcaagcgtacgggcgctctcgatcgtgttgccgattgtgctcctggttttcctgtgccttggcgtctttctcctttggaaaaactggcggctcaagaacatcaactcaattaacttcgataacccggtgtaccagaaaaccactgaagatgaagttcatatctgccacaaccaggacggatactcttacccctcacggcaaatggtttcgttggaagatgacgtcgcg

SEQ ID NO: 16444 - DNA, 2580 bp, Artificial Sequence
  Description of Artificial Sequence: Synthetic coding sequence
atgggaccttggggttggaagctgaggtggaccgtcgccctgttgctggcagcagcaggcaccgcagtgggcgaccgatgtgaacggaacgagtttcaatgtcaagatgggaagtgcatttcctataagtgggtttgcgatggatcagcggagtgtcaggatggctccgacgaaagccaggaaacctgtctctccgtgacgtgtaaatccggtgactttagttgtggcggaagagtgaacaggtgtataccgcagttctggagatgcgatggacaggtggattgtgataacggaagtgatgaacagggatgcccacctaaaacctgttcccaagatgagtttagatgtcacgacgggaagtgtatttcccgtcagttcgtgtgtgactccgacagagattgtctcgatggaagcgacgaggcatcctgccctgttctcacttgcggcccggccagctttcagtgtaattcaagcacctgcattccccaactgtgggcgtgcgacaacgacccggattgtgaagatggaagcgatgaatggccgcaaagatgtcggggactctacgtctttcaaggcgattcaagcccatgctccgcatttgaattccactgtctgagcggcgaatgtattcattcctcatggcgctgcgacgggggacctgattgcaaggataagtcggacgaagaaaactgtgcagtcgcaacgtgtagaccagatgagtttcaatgctccgacggtaactgtatccatggttcccgtcaatgtgatcgcgaatacgattgtaaggacatgagcgatgaagtagggtgcgtgaatgtgaccctgtgtgaaggtccaaacaagtttaagtgccattcgggtgaatgtattacccttgataaagtgtgcaacatggctcgtgactgccgcgattggtcagatgaacctattaaggaatgtggaaccgcggcttgcctcgacaacaatggcggatgtagccacgtctgcaatgcgctgaaaatcggagcagaatgtctctgtcccgatggcttccagcttgtggcccaacgacggtgcgaggacatagatgagtgtcaagaccccgacacttgttcacagctgtgcgtgaacctcgaaggggggtacaagtgccagtgtgaagaagggtttcaactcgatcctcacaccaaggcgtgtaaggccgtcggttcaatcgcctacttgttctttactaaccgccatgaggtcagaaaaatgacccttgatagatccgaatacacttcacttatacccaaccttcgcaacgtggttgcactggatactgaagtggcatcgaaccggatctactggtccgacctgagtcaacgcatgatttgttcgacgcaactcgatcgagcacatggcgtttctagctacgacaccgtcattagccgcgatattcaggctcctgacggcctggcagtggattggattcattcgaacatttactggactgactcggtgcttggaactgtgtcggtggcagatactaagggtgtcaagcgaaagactttgtttcgggaaaacggatcaaagccgagggcaattgtcgttgacccagtccacggatttatgtactggacggattggggaactccagcaaagattaagaaaggtgggcttaatggagtggatatctactcactggtgaccgagaacatccagtggccgaacggtatcactcttgacctgctgtcgggccgtttgtattgggtggactccaaacttcactccatatcgtcaatcgacgtgaatggaggaaaccgtaaaactattttggaggatgagaagaggctggcacatccattttccctcgcagtatttgaagataaggtgttttggacggacatcattaacgaagctattttctctgcaaatcgacttaccggttccgatgtgaatctcttggccgaaaatcttctttcgccagaggatatggtgctgtttcataaccttacccagccccgcggggtcaattggtgtgagcgaaccaccctgtcaaacggcggctgccagtacctgtgccttcctgctcctcagatcaatccgcactctcctaaattcacctgtgcctgtcctgacggaatgttgctcgcccgagacatgagaagttgtctgaccgaggcggaggcagccgttgccactcaagagacttcaacggtccggctgaaagtctcgtcgactgcagtcagaacccaacatactactactcggcccgtgccagacactagccgcctccccggagcgacccctggacttactactgtggaaatcgtgactatgtcgcatcaggcgcttggagacgtggcggggagaggtaacgagaagaagccatcgtcagtccgcgcactcagcatcgtccttccaattgtgcttctggtgtttctttgtctcggcgtgtttctcctgtggaagaattggcgactgaagaatatcaactcgattaacttcgataacccagtgtaccagaaaaccaccgaagatgaagtccatatctgccataatcaagatggttacagctacccttcgagacaaatggtatctctcgaggatgacgtagcc

SEQ ID NO: 16445 - DNA, 2580 bp, Artificial Sequence
  Description of Artificial Sequence: Synthetic coding sequence
atgggaccgtggggatggaaacttagatggactgtggcactgctgcttgcagcggccggaaccgcagtgggtgaccgctgcgaaagaaacgagtttcaatgtcaagacgggaaatgtatttcgtacaaatgggtgtgcgacggctcggcagaatgtcaagatggtagcgacgagagccaagaaacctgtctttcagtgacttgtaagtccggtgacttttcgtgcggcggtagagtgaataggtgtatccctcagttttggcgttgtgatggacaagtcgattgtgataacggtagcgatgaacaaggctgccctccgaaaacttgtagccaggatgaatttcggtgtcatgatggcaaatgcatctcgaggcagttcgtctgtgattccgatcgagattgtcttgacggcagcgacgaggcctcctgtcccgtgcttacttgtgggccagcatcctttcagtgtaactcatccacttgcattccgcagctctgggcttgcgataacgacccagattgcgaggatggatccgatgaatggccacaaagatgtcgcggactttacgtgtttcagggggatagctcgccatgttccgcgtttgagttccattgtctgtcaggggaatgcatacactcgtcttggcggtgcgacggagggccagattgcaaggataagtctgatgaggaaaactgtgccgtcgcaacttgtcgtccagacgaattccagtgctccgacggaaattgtatccacggaagccgccaatgcgacagagagtacgactgtaaggatatgagcgacgaagtgggatgtgtcaatgtgaccctttgtgagggtccaaacaaattcaaatgtcactccggtgaatgtatcactctcgataaggtctgcaacatggcgagggattgccgggattggagcgacgaacccattaaggagtgcggtaccgcggcctgtcttgacaataatggtgggtgctcccatgtgtgcaacgctcttaagatcggtgctgaatgcttgtgtcctgatggcttccagcttgtcgcacaaagaaggtgtgaagatatcgatgaatgtcaggacccggacacctgtagccagctttgtgtgaaccttgagggcgggtacaagtgccaatgtgaagaaggattccagctcgacccgcacaccaaggcatgcaaggcagtgggttcaatcgcgtacctgttctttactaacagacacgaggtccggaagatgaccctcgaccgctcagagtacacctcactgatacctaacctgcgcaacgtggttgcactggatactgaagttgcatcgaaccggatctactggtcggatctgtcgcaacgcatgatttgctcgacccagctcgatcgcgcccacggtgtgagcagctacgataccgtgatttccagagacattcaggcacctgatggactcgccgtggattggatacattccaatatctactggaccgattcagtgcttggcactgtgagcgttgccgataccaagggtgtcaaaagaaagactctgtttcgggagaacggcagcaagcctagggcaattgtggtcgatccagtgcatggattcatgtactggactgattggggcactccagcgaagattaagaaaggagggctgaacggtgtcgatatctatagcctggtgactgagaacattcaatggcctaacggaattacccttgacttgctgtcaggtcgcctgtactgggtggattcgaagctgcattcaatttcgtccattgatgtcaatgggggcaacagaaagaccattctggaggatgaaaagcggcttgcccatccattctcgctggcagtgtttgaagataaggtgttctggactgacattatcaacgaagccatctttagcgccaaccgccttactggctcagatgtgaatttgcttgccgaaaacctcctgtccccagaagatatggtgctgtttcataacctgacccaacctcggggagtgaattggtgtgaaagaactacgctctcaaacggaggctgccaatacctttgtctccctgcgccacagattaatccacattcgcctaaattcacctgtgcctgtcctgacggaatgctcctcgcacgagatatgcggtcctgtcttacggaagcggaagcagcagtggcaacccaagaaacttcgactgtgcggcttaaggtgtcaagcaccgcagtccgaacccaacacactactacccgccccgtgccagacacctctaggctcccgggggctacccctgggcttaccaccgtcgaaatcgtcaccatgagccatcaggcccttggcgatgtcgcgggacgaggtaatgagaagaagccgtcctcggtgagagcgctttccattgtgcttcccatagtcctgttggtctttctttgtctgggcgtgtttctcttgtggaaaaactggcgcctcaaaaacattaactccattaactttgataatccagtgtaccaaaagactacggaagatgaagtgcatatttgccataatcaggacggttacagctacccgtcccggcagatggtcagccttgaggatgacgtcgcg

SEQ ID NO: 16446 - DNA, 2580 bp, Artificial Sequence
  Description of Artificial Sequence: Synthetic coding sequence
atgggtccctggggatggaaacttagatggaccgtggcacttctgctcgcagcagcgggtactgccgtgggagatcgctgtgaacgaaacgaattccagtgtcaagatggtaaatgtatttcttacaagtgggtgtgtgatggctccgccgaatgccaagacggatctgacgagtcgcaagaaacttgtctctccgtcacctgcaagagcggggactttagctgcggaggccgggtgaatcgatgcattcctcaattttggcggtgtgatggacaggtcgactgtgataatggttcggacgaacagggttgcccgcctaaaacgtgtagccaagatgagttcagatgtcatgatgggaaatgtatctcaagacaatttgtgtgtgactcagaccgggactgcctggacggatcggacgaggcatcgtgtcctgtgcttacgtgtggcccagcatccttccaatgtaattcctcgacctgtattccacaactgtgggcatgcgataacgatcctgactgtgaagatggaagcgatgaatggccgcagcggtgccgcggcctttacgtgttccaaggggattcatccccatgtagcgccttcgaatttcattgtctttcaggcgagtgtattcattcaagctggcggtgtgacggaggtcctgactgcaaggacaagtcggatgaggagaactgtgcggtggcaacctgccgaccagacgaattccaatgttccgacggaaactgtatccacggttcccgccagtgtgatagggaatacgattgtaaagatatgagcgacgaagttggatgcgttaacgtgactctttgtgaaggccctaataagtttaagtgccatagcggagaatgtattactctggataaggtgtgtaatatggccagagattgtcgcgactggagcgatgaacctataaaggaatgcggtacggcggcctgtctggacaacaatggtgggtgttctcatgtgtgtaacgccctcaagatcggagcagagtgtctctgccctgatggttttcagctggtggcacaaagacggtgcgaggatatcgacgaatgtcaagaccctgatacctgttcacaactttgcgtgaaccttgaggggggatacaaatgtcaatgtgaagaagggttccagcttgatccccatactaaagcatgtaaggcagtgggttcaatcgcatacctgtttttcaccaataggcatgaggtgcggaagatgacccttgaccgcagcgagtatacttcccttatccctaaccttcggaatgtggtggctctcgatacggaagtggcatctaaccggatttactggtcagatctgtcgcagcggatgatttgttcgactcaactggatagggcacacggggtgagctcctacgatactgttatttcccgcgatatccaggcccctgatggtcttgccgtcgattggattcatagcaatatctactggactgattccgtgcttggtaccgtctccgtggccgatactaagggggtgaagcggaaaaccctttttcgggaaaacggctcgaaaccacgcgctatcgtggtggatccagtccacggttttatgtactggactgactgggggaccccagccaagattaagaaaggaggattgaacggggtcgatatctactcgctggtcaccgaaaacattcaatggccaaatggaattaccttggatcttctgtccggacggctctactgggtggattctaaactgcattcgatatcatcgatagatgtgaatggcggtaatcgaaagactatcctggaagatgaaaagcgactggcacatcccttttcgctcgctgtgttcgaagataaggtgttttggactgatatcattaacgaggccattttcagcgccaacaggctcactggttcagacgttaaccttcttgccgagaatctcttgtcgcctgaggatatggtgctgtttcacaaccttacccagccacgcggtgtcaactggtgcgaaagaaccaccctgtcaaatggaggctgccagtatctttgcctgcctgcccctcagataaaccctcattcccctaagtttacgtgtgcctgcccagatgggatgttgctggcaagagatatgagatcgtgtctgactgaagcagaagctgcggtcgcgacccaggagacttcaactgtgcgactcaaggtgtccagcaccgcggtaaggactcaacataccaccacgcgacccgtcccggatacttcacgactgcccggcgcaactcctgggctgactaccgtggaaattgtgactatgtcccatcaggcgctgggggatgtcgcaggacggggcaacgaaaagaagccttcttcggtgagggcattgtccattgtgcttcctattgtccttcttgtctttctttgtctgggcgtgtttcttctttggaagaactggaggctgaaaaacattaactcgatcaatttcgataaccccgtgtaccaaaagaccactgaggatgaagtgcatatctgccataaccaggatggttactcgtacccaagccgacagatggtcagcctggaggatgacgtggcc

SEQ ID NO: 16447 - DNA, 2580 bp, Artificial Sequence
  Description of Artificial Sequence: Synthetic coding sequence
atgggaccttggggatggaaattaagatggacagttgctttattattagctgcagcaggtactgccgttggtgatagatgtgaacgtaacgaatttcagtgccaagatggtaaatgtatttcatataagtgggtttgtgatggatcagcagaatgtcaagatggatcagatgagtcacaagaaacttgtcttagtgtaacatgtaaatcaggagatttttcttgtggaggtcgtgttaatagatgtattccacaattttggagatgtgatggacaagttgattgtgataatggatctgatgaacaaggttgtccaccaaaaacatgtagccaagacgaattcagatgtcatgatggtaaatgtattagtagacaatttgtttgtgattctgatagagattgtcttgatggaagtgatgaagcaagttgtcctgttcttacttgtggacctgcaagttttcaatgtaattcttcaacatgtattccacaactttgggcatgtgacaatgatcctgattgtgaagacggatcagatgaatggccacaaagatgtagagggttatacgtctttcagggtgatagttcaccatgctcagcttttgaattccattgcttatcaggtgaatgtattcattcttcatggcgatgtgatggaggtccagattgtaaagataaatcagatgaagaaaactgtgctgtagctacatgtcgtccagatgaattccaatgtagtgatggaaattgtatccatggatcaagacaatgtgatagagaatatgattgtaaagacatgtcagatgaagtaggatgtgttaatgttacactttgtgaaggaccaaacaaatttaagtgtcatagtggagaatgtattactcttgataaagtatgtaatatggctagagattgtcgtgattggtccgatgaaccaattaaggaatgtgggacagcagcatgtttagataacaatggtgggtgttcacatgtctgtaatgctcttaaaattggtgccgaatgtctttgtccagatggattccaacttgtagctcagagaagatgtgaagatattgatgaatgtcaagatccagatacttgtagtcaactttgtgttaatcttgaaggaggatataaatgtcaatgtgaagaaggattccaattggatccacatactaaagcttgtaaggcagttggaagtattgcttatcttttttttactaatagacatgaagtaagaaaaatgacattagatcgttcagaatatacaagtttaattccaaatttaagaaatgtagtagcattagatactgaagttgcatcaaatagaatttattggtcagatctttcacaaagaatgatttgttcgacacaattagacagagcacatggagtttctagttatgatactgtaattagtagagatatacaagctccagatggattagcagttgattggattcattctaatatttattggactgactctgtattaggtactgtgagtgttgcagatactaaaggtgttaagagaaaaacattatttagagaaaatggaagtaaaccaagagcaattgtagtagatccagttcatggatttatgtattggacagattggggaactccagctaaaattaaaaaaggaggacttaatggagttgatatttattctttagttactgaaaatatacaatggccaaatggaattactttagatttactttcaggacgtttgtattgggttgattcaaagttgcattctattagttcaatagacgttaatggaggaaaccgtaaaacaattttagaggatgaaaaaagattagcacatccattttctttagcagtatttgaagataaagttttttggacagatattattaatgaagctattttctctgctaatcgattaactggatcagatgttaatcttttagcagaaaatcttttaagcccagaagatatggttttattccacaatcttacacaaccacgtggtgttaattggtgtgaacgaacaacattaagtaatggtggatgtcaatatttatgtttacctgcaccacaaattaacccacatagtcctaaatttacatgtgcatgtcctgatggtatgttacttgctagagatatgagatcatgtttgactgaagcagaagctgcagttgctactcaagaaacatccacagtcagacttaaagtctcaagtacagcagtgagaacacaacatacgactaccagaccagtaccagatacatcaagattgccaggtgcaacaccaggacttacaacagtagaaattgtaacaatgagtcatcaagctcttggagatgttgcagggagaggaaacgagaaaaagccttcaagtgtaagagcattaagcattgttcttcctatagttttacttgtttttctatgtttaggagtatttcttttatggaaaaattggagattaaagaatattaattcaattaattttgataacccagtatatcaaaaaactactgaagatgaagtccacatctgtcacaaccaagatggttattcatatccaagtagacaaatggtttcattagaagatgacgttgca

SEQ ID NO: 16448 - DNA, 2580 bp, Artificial Sequence
  Description of Artificial Sequence: Synthetic coding sequence
atggggccttggggatggaagctgcgctggacagtcgctctgctacttgctgctgctgggacagcagtcggagaccgatgtgaaaggaatgaatttcaatgccaggatggcaagtgcatatcgtataaatgggtgtgtgacggaagcgccgaatgtcaagacggcagtgatgagtcccaagagacctgcctgtcggtgacatgtaagagcggagattttagttgtggcggtcgtgtgaaccgctgcatcccccaattttggcgctgcgacggccaggtcgactgcgataacggatctgatgagcagggttgtccaccaaagacctgctcccaggatgaatttcgctgccacgatgggaagtgcatttcccggcagttcgtttgcgactctgatagagactgtctcgacggctcggacgaggcaagctgtcccgtgttaacatgcggaccagcctcctttcagtgtaactcaagcacatgtattccacaactctgggcctgcgacaatgatcccgactgcgaggatgggtccgatgaatggccacagcggtgccgaggactttatgtgttccagggagactctagcccctgcagcgctttcgagttccattgtctcagtggcgaatgcatacatagtagctggaggtgcgacgggggtcccgattgcaaagataagagcgatgaagagaattgtgccgttgccacttgtcgtcccgacgaatttcaatgctctgatgggaactgtatccacggtagccggcagtgtgacagagagtacgattgtaaggacatgagcgatgaggtcggttgcgtaaacgtgactctatgcgaaggacctaataaattcaaatgccattcaggggaatgtatcacactggataaagtgtgtaacatggcacgtgattgtagagattggtccgatgagcccattaaggagtgcgggaccgcagcctgcttggataataatggggggtgttctcacgtctgtaatgccctaaaaattggtgccgaatgcctctgccctgatggctttcagctggttgctcagcggaggtgtgaagatatcgacgagtgtcaggaccccgatacttgcagtcagttgtgcgtgaaccttgagggagggtacaaatgccagtgcgaggagggatttcagctcgacccccataccaaggcatgtaaggcagtgggcagcattgcttatctctttttcaccaacagacatgaagttcgcaagatgacactcgatcggtcggaatacacatctctgatccctaacctaaggaatgtcgtcgccttagacacagaggtggcaagtaaccggatttattggtcagacctttcgcaaagaatgatttgtagcacccagctggatcgggcccacggagtctcatcatacgacactgtcatctcacgagatattcaagcccccgatgggctggccgtggattggattcactccaatatttactggacagactccgttctgggtaccgtatccgtggcagacaccaaaggggtgaaacgcaagacgctgtttcgcgaaaacggatcaaagccgcgcgcaatagtggtagaccccgtgcacggatttatgtactggaccgactggggtaccccagcaaaaattaagaaaggcggactgaacggtgttgacatctatagtctcgtgaccgaaaacattcagtggcccaacgggattactctcgacctgcttagcggtcgcctctattgggtggacagtaaactgcactccatctcaagcatcgatgttaacggcgggaaccggaagactattctcgaggacgagaagcgtctggcccatcctttttccctggctgtgttcgaggataaggtgttctggacagatatcataaatgaagccatcttctctgccaatcggttgacaggatccgacgttaatctgttagccgaaaatttgctgtcacccgaggacatggtgctattccataatctcacgcagcctcgaggtgtaaactggtgtgagcggactacactgtcgaacgggggctgccaatatttgtgtctgccagctccacaaataaatcctcacagtcctaaattcacttgtgcatgtcccgacggaatgctcctcgcacgcgatatgaggtcgtgcttgacagaggccgaggctgctgtggccacacaggaaacttctacagtgcgcctcaaggtctcttccacggctgtgaggacgcaacacacgaccactcggccggtcccagatacctccaggctgcccggtgctacacctggcctgactaccgttgagattgttacgatgtcccaccaagccttgggcgacgtcgccggccggggaaatgagaagaagccctcttccgtccgcgcactgtctatcgtactccccatcgtgctcctggtgtttttgtgtcttggggtgtttctcctatggaaaaactggcgactcaagaatatcaattcgattaatttcgacaatccagtgtaccagaagacaacggaggacgaagttcatatatgtcacaatcaagatggatactcgtatccaagtcgccagatggtttctctggaggatgatgtggca

SEQ ID NO: 16449 - DNA, 2580 bp, Artificial Sequence
  Description of Artificial Sequence: Synthetic coding sequence
atgggcccatgggggtggaagctaaggtggacagttgcgctgttgctcgccgctgcaggaaccgctgtaggtgacaggtgtgaacgcaacgaattccagtgtcaggacggcaagtgcataagttataaatgggtgtgcgacggttctgccgagtgccaggacggctctgatgagtcccaagaaacatgcctgtccgtcacttgtaagagtggtgacttctcatgcggcggtagagtcaatcggtgtatcccccagttctggcgttgcgacgggcaggtggactgtgacaacgggagcgacgaacagggctgcccacctaagacctgttcccaggacgaatttagatgtcatgatggaaagtgtatctcccgccagtttgtttgcgatagtgaccgcgattgtcttgatggctctgacgaagcatcttgtccagtgctgacctgcggtccagcctccttccaatgcaattcatcaacatgcataccacaactgtgggcctgtgataacgacccagattgcgaagacggatccgatgaatggccccagcgctgtagaggtctgtatgttttccaaggagacagcagtccatgctccgcattcgagtttcattgcctttctggagaatgtattcacagcagttggaggtgcgacggcggacccgactgtaaggataagtctgacgaggagaattgtgcagtggccacctgccggcccgacgagtttcaatgttctgatggtaattgcattcacggctctaggcaatgtgaccgagaatatgactgtaaggacatgagtgacgaggtgggctgcgtgaatgtaacattatgtgagggacccaacaagttcaaatgccactccggtgaatgcattactttagacaaggtctgtaatatggcacgagattgcagagactggtccgatgaacctatcaaggagtgtggaaccgctgcatgccttgacaacaatggcggctgttcgcacgtgtgcaacgcactcaagatcggcgcagaatgtttgtgccccgatgggttccagctggttgcccagcgccggtgcgaggacatcgatgagtgccaggacccagacacatgcagccaactgtgcgtgaacctggaggggggatacaagtgtcaatgcgaggaaggtttccaactggacccgcacacaaaggcttgtaaagccgtgggatccattgcctacttgttctttacaaaccgtcatgaagtccggaaaatgacactcgatcgcagcgaatatacttctctaattcccaatttacgtaatgtcgtggcgctggacactgaggtcgccagcaatagaatatattggtctgatcttagtcagcggatgatctgcagcacccagttggaccgtgcccacggagtgtccagctatgatacagtcatctcacgcgacatccaggcacctgatggactggcagtagactggatacattccaacatttactggaccgacagcgtactgggcaccgtgtccgtggcagacacaaagggagtgaaaagaaagacactcttccgagaaaatgggagtaagcctcgggcgatcgtggtcgatccagttcacggattcatgtactggaccgactggggaacacccgctaaaataaagaaaggagggctgaacggtgttgacatatactctcttgtgaccgaaaacattcagtggcccaacgggattacactcgatctcctgagcgggcgactttactgggtggactccaaactgcatagcatttcttccattgatgtaaacggcggcaatagaaagacaatcctagaggatgagaaaaggcttgcccatccgttctctcttgcggtgtttgaggataaggtcttctggaccgacatcatcaatgaggccattttttcagcaaatcgcctgactggctcagacgtgaacctattagccgagaatctgctatcacctgaggatatggtgctcttccataatctgacgcaaccgcgcggagtgaattggtgtgaacgaaccactctgagcaatgggggttgtcaatacctgtgcctgcctgctcctcagattaaccctcattcccccaaattcacttgcgcctgtccagacggtatgctgctggcgagggatatgaggtcatgcttgacggaagctgaggcagcggtggcaactcaggagacgtccaccgtcaggctgaaggtgtctagcaccgcggtgagaactcagcatactactactagaccggtgcccgatacatcccgtctcccaggggctacgcctgggctaactacagtggagattgtcacaatgagccaccaggctctgggggacgttgccggcagggggaatgaaaagaaaccctcaagcgttagagcactttcaatcgtcttgcccatcgtattactggtctttctctgcctcggggtctttcttttgtggaaaaactggcggctgaagaatatcaactctataaacttcgacaatccagtatatcaaaaaactactgaggacgaggtacacatctgccacaaccaggacgggtattcctatccatccaggcagatggtgtctctcgaggacgatgtggcc

SEQ ID NO: 16450 - DNA, 2580 bp, Artificial Sequence
  Description of Artificial Sequence: Synthetic coding sequence
atggggccatggggatggaagctcagatggacagtagcgctcctgttggctgctgccggcacagccgtcggagatagatgcgagcggaatgagttccagtgccaggacggaaaatgcatttcctacaagtgggtctgtgacggttccgctgagtgtcaggacggaagtgacgagtcccaggagacttgccttagtgttacgtgcaaatctggggatttttcatgtggagggcgcgtgaaccgctgtatcccacaattctggagatgcgacgggcaagtggactgcgataacggttcagacgagcaggggtgccccccaaaaacctgttcccaggacgagttccggtgccacgacggtaagtgcatctccaggcagtttgtgtgtgatagcgatcgtgactgcctagacggatccgacgaagccagctgccccgtgctcacttgcggcccggcttctttccagtgcaatagcagcacctgcatcccccagttatgggcctgtgataacgatccagattgtgaggatggtagcgatgagtggcctcaacggtgtcgagggctttacgtttttcagggggacagtagcccttgctctgctttcgagtttcactgcttatcgggtgagtgcatccactccagttggagatgtgacgggggccctgactgcaaggataaaagcgacgaagagaattgcgccgtggctacctgtagaccagacgaatttcaatgtagcgatgggaattgcattcacgggagcaggcaatgtgatcgggaatacgactgcaaagatatgtccgatgaagttggctgcgtcaatgttacactgtgcgaggggccaaacaaattcaagtgtcattcaggagagtgcatcaccttggataaggtttgtaacatggcgagagattgtcgagattggagcgacgagcccattaaagaatgtggaaccgctgcctgcctggacaacaacggtgggtgctcgcatgtgtgcaacgctctgaaaataggcgctgaatgcctgtgcccagatggatttcagctggtggcccagcgcagatgcgaagacattgacgagtgccaagacccagatacatgttcccagctgtgtgtgaacttggaaggtggatacaagtgccagtgcgaggagggcttccagctggacccccatactaaagcctgcaaggccgtagggagtatcgcatatctcttcttcaccaacagacatgaggtaagaaagatgacactggacaggtcagagtacacctccctcataccaaatctgagaaacgtagtcgctctggataccgaggttgcctctaaccggatttattggagcgatctgtcccaaaggatgatctgcagtactcaattggaccgagcccacggagtttcttcttacgatacggtgatcagcagggacatccaagcccctgatggtctcgctgtggattggattcacagcaacatctactggacagattcagttttggggactgtgtctgtcgcagatactaagggggttaagcgcaaaacactgttccgcgagaacggatccaaaccacgcgctatagtggtggatcctgtccacggcttcatgtactggactgactggggaacacctgcgaagatcaagaagggaggccttaacggggtagacatttattctctggtgaccgagaatattcagtggcctaacggaattacattagacctcctgtcaggaagactgtactgggttgatagtaagctacacagcatctccagcattgatgtcaacggcggcaaccgtaagacaatcttggaagatgagaagaggctggcgcatcccttcagcctcgccgtgttcgaggacaaagtgttctggactgatattattaatgaggccatcttctccgccaatcggcttaccgggtcagacgtgaacttattggccgaaaacctgttgagccccgaagatatggttttgttccacaatctgactcaaccacgcggcgtcaactggtgcgagaggacgacactttccaatggcggatgccaatacctgtgcctgccggctccccagattaatccacatagcccaaagttcacttgcgcttgcccagacggcatgctattagcccgggacatgagaagttgcctgaccgaggccgaggccgccgtggccacacaggaaacatctaccgtacggctgaaagtatccagcacagccgtaaggactcagcatactactacacgacccgtccccgataccagcagactgccgggggctactcccggactgacgaccgtcgagatcgtgacgatgtcacaccaggctttgggtgacgtcgctggaagggggaacgagaagaaaccaagttctgtacgggctctttcaattgtactgcccatagtgctcctggtgttcctctgtttgggcgttttccttctgtggaagaattggcggctcaaaaacatcaacagcataaactttgacaatcctgtgtaccaaaagaccacagaggacgaggtgcacatctgccataaccaggacggctatagttatccctcgagacagatggtaagcttagaagatgacgtggcc

SEQ ID NO: 16451 - DNA, 2580 bp, Artificial Sequence
  Description of Artificial Sequence: Synthetic coding sequence
atgggcccttggggctggaagttacgttggaccgtggcactcctactcgccgcggccggcacagcagtgggagacaggtgcgaaaggaacgagttccagtgccaagatggaaaatgtataagctataaatgggtctgcgacgggtccgctgagtgccaggacggtagcgatgagagtcaggaaacttgtctgagcgtcacctgtaaatcgggtgacttttcatgcgggggccgagttaaccggtgcatacctcagttctggcggtgtgacgggcaggtcgactgtgataacggaagcgatgagcaaggatgccctcccaaaacctgctcacaggacgaatttcgttgccacgatggtaaatgcatatcacggcagttcgtctgcgactcggacagggactgtcttgacggcagcgacgaggcctcctgtccagtgctaacatgtgggccggcaagcttccagtgcaatagtagtacatgtattccccaactctgggcctgcgataatgaccctgactgtgaagatggatccgatgagtggccacagcggtgccggggactgtacgttttccagggagacagctctccatgttctgcttttgagtttcactgcctatcgggagaatgcattcatagctcctggcgatgtgacgggggaccagattgcaaagacaagtctgatgaagaaaactgtgccgtggctacgtgcagaccagatgagtttcaatgctccgatggcaactgcattcatgggagccggcagtgcgaccgcgaatacgattgcaaggatatgtctgacgaagtaggttgcgtgaacgttactttgtgtgaaggcccaaataaatttaaatgtcatagtggagaatgtataacactcgataaggtgtgcaacatggccagggactgcagagactggtccgacgagcccattaaagaatgtggaacagctgcctgcctagataataacggcggatgtagccatgtgtgcaacgctttgaaaataggcgccgaatgtctgtgcccggacggcttccagcttgtggcacagcggcgatgcgaggatattgatgagtgtcaggatcccgacacgtgttcacagctttgtgtcaacctggaaggaggttataagtgccagtgcgaggagggctttcaactcgaccctcacacaaaagcctgtaaggccgttgggtccatagcatatctgttcttcaccaaccgccacgaggtaagaaagatgacactggaccgcagtgaatacacttcgcttatcccaaatctgaggaatgtcgtggccctggacaccgaggtggcttctaaccgcatttactggtctgatttgagccagagaatgatctgcagtacccagcttgaccgggcgcacggagtgagcagctacgacaccgtaatttctcgagatatccaagcccctgatggccttgcggtggactggatccatagtaacatctattggacggattcggttttgggtacggtgtccgtggcggacaccaaaggcgtaaagcggaagaccttattcagggagaacgggagcaagcccagggctatcgtcgttgatccagtgcacgggttcatgtattggactgattggggaactcctgcaaaaatcaaaaaaggcggcctgaatggagtggacatctatagtctggtgacagagaatatccagtggcccaatggaattacgctcgacctgctgtctggacggctctactgggtggattccaagctgcactccatcagcagcattgacgtgaacggagggaatagaaagactatcttagaagatgaaaagcgcctcgctcaccccttctctcttgcggtcttcgaagataaggtattttggaccgacatcataaacgaggccattttctcagccaacagattaacgggcagcgatgtgaatctgctggccgagaacctcttaagccccgaggacatggtgctctttcataacctaacacagccccgcggggtcaactggtgcgaacgtactaccttaagcaacggcggatgtcagtacctatgcctgccggccccccaaatcaacccccattctcccaaattcacatgcgcatgcccagatggaatgctgctggccagggacatgcgttcatgcctgacagaagccgaggctgccgtggccacacaggagacttctacagtccgtttgaaggtttcctctaccgccgtgcgaactcaacatacaaccacacgacctgtgcctgacacctctcgcctgcctggggctaccccagggctgactactgtggagatcgtgaccatgtcacaccaggcattaggggatgtcgccggacgggggaacgaaaaaaagccaagctccgtgcgtgcactttcaatagtcctcccaatcgtcctgcttgttttcctttgtcttggcgtttttctgctttggaaaaactggcgtctgaaaaatatcaatagcataaatttcgataaccctgtgtaccagaagactacagaggatgaagttcacatctgtcacaaccaggacgggtatagctatcccagcaggcagatggtttctctcgaggatgatgtagcg

SEQ ID NO: 16452 - DNA, 2580 bp, Artificial Sequence
  Description of Artificial Sequence: Synthetic coding sequence
atgggaccatggggatggaagctgaggtggaccgtggcgcttctgctcgcggctgccggaactgcggtcggagatcgctgcgagcgcaatgaatttcagtgccaagacggtaagtgcatcagctataagtgggtttgtgacggaagtgctgaatgccaggatggttctgacgaatcgcaggaaacgtgcctttcagtcacctgcaagtccggtgacttcagctgcggtggccgagtgaatagatgtataccgcagttttggcgctgcgatggacaggtcgactgtgacaatggatccgacgaacaggggtgcccgccaaagacctgctcccaagacgaattccggtgccatgacggcaagtgtatctctcgacagttcgtgtgtgactcagatcgcgactgcctggatgggagtgatgaggcgtcctgcccggtcctcacctgcggaccagcctcattccaatgcaattcttccacctgcattccacaactgtgggcctgtgacaatgacccagattgcgaggacggaagcgacgagtggccgcaacgctgcaggggcctgtacgtctttcagggagacagcagcccgtgctcggctttcgaattccactgcctgtccggcgaatgcatccactcctcctggcggtgcgacggcggccccgactgcaaggacaagagcgatgaggagaattgcgctgttgccacttgtcgcccggacgagttccagtgctcggatgggaattgtatccacggttcgcgccaatgcgatcgcgaatacgattgcaaggatatgtcagacgaggtcggttgcgtcaacgtcaccctttgcgagggcccgaacaagttcaagtgccactcaggagaatgtataaccctggacaaggtctgtaacatggcccgtgattgtcgggactggtcggacgaacctatcaaggagtgtgggactgcagcgtgcttggacaacaacggagggtgctcccacgtgtgcaacgcattgaaaatcggcgctgaatgcctctgcccagacggattccaactggtggcccaacggcgctgcgaagatatcgatgaatgccaagacccggatacctgctcacagctctgtgtgaacctggaagggggctacaaatgccagtgtgaggagggctttcaactggacccccatactaaagcctgcaaagcagtgggatccatcgcgtacctcttctttaccaatcgccatgaagtcagaaagatgaccctcgacagatccgaatacacttctcttatcccgaacctcaggaacgtcgtggcccttgataccgaagtcgcttccaacagaatctactggtctgacctgtcacagcgcatgatctgtagcactcagctcgatcgcgcacatggtgtgagctcatacgacaccgtgatcagccgcgatattcaggccccggacgggttggcggtggattggatccattcgaatatctattggacggacagcgtgctgggaaccgtctcggtcgccgatacgaaaggtgtgaagcgcaagaccctcttcagagagaatggatcgaaaccgagagccatcgtcgtagatcccgtccatggatttatgtactggacggattggggaactcccgcaaagatcaaaaagggcggactgaacggagtggacatctactcccttgtcacggagaacatccagtggcctaacggaatcaccttggacctgctgagcggacgcctgtactgggtcgattcaaagctgcactcaatttcgtccatcgatgtcaacggagggaataggaaaaccatcctggaggacgagaagaggctggcgcacccattctcacttgccgtgttcgaggacaaggtgttctggactgacatcatcaacgaagccatcttctccgccaaccggttgacgggatcggatgtgaatctgctggccgagaacctgctgtcgcccgaggatatggtgttgttccataacctgacccagcctcggggcgtgaattggtgcgagcgcactaccctgtcaaacgggggatgccaatacctgtgcctccctgccccacagatcaatccacactcgccgaagtttacctgtgcgtgtccggatggcatgctgctggcccgggacatgagatcgtgcctgaccgaagcagaggccgcggttgccacccaggagacttcaactgtccgcttgaaggtgagctcgactgccgtgcggacgcagcacaccactactaggccggtgccggatacttcgcgcctgccaggggccacgcccgggctgaccaccgtggagattgtgactatgtcccatcaggcactcggagacgtggccggtagagggaatgagaaaaagcccagctccgttcgcgccctgtcgatcgtcctccctatcgtgcttcttgtctttctgtgccttggagttttcctcttgtggaagaactggagactcaaaaacataaactcgatcaactttgataacccggtttaccagaaaacgactgaggatgaggtgcacatctgccacaaccaggacgggtacagctacccatcgaggcaaatggtgagcttggaagatgacgtcgcc

SEQ ID NO: 16453 - DNA, 2580 bp, Artificial Sequence
  Description of Artificial Sequence: Synthetic coding sequence
atgggcccatgggggtggaagctccgatggacggtcgctctcctgcttgccgcagccggtacggcagtgggagatcggtgtgaacggaacgagtttcagtgtcaggatggaaaatgcatttcatataaatgggtttgcgacggtagcgccgagtgtcaggacggatcagatgagtcgcaggaaacatgcctttcggtaacatgcaagagcggagatttcagttgcggcggaagggtgaataggtgcataccgcagttctggaggtgtgatggccaggtggattgcgataacggcagtgatgagcaagggtgccctccgaagacatgctcccaggacgaatttcgatgtcacgatgggaaatgcatcagccggcagtttgtgtgcgacagtgacagggactgcctggacgggtctgacgaagccagctgccccgtattgacctgtggccccgcaagcttccaatgtaactcatccacatgcatcccacagttgtgggcctgcgacaatgatcctgactgtgaggacgggagcgacgaatggcctcagaggtgcaggggattatacgtctttcagggggattcatctccctgtagcgcctttgagtttcactgtctgagcggagagtgcatccattccagttggaggtgcgacgggggtcctgattgtaaagacaagagtgacgaggagaactgtgccgttgctacctgcaggcccgacgaatttcagtgctcagatggtaattgcatacacggttcaaggcaatgtgacagggaatacgactgcaaggatatgtccgatgaagtaggctgcgttaacgtgaccttatgtgagggacctaataaatttaagtgtcacagcggcgaatgtattaccctagataaggtctgtaatatggctcgagattgtcgggactggagcgatgagcccattaaagaatgcggcactgccgcgtgcctcgataataatggagggtgtagtcatgtatgtaacgcgctcaagatcggtgcagaatgtctctgccctgacggattccagcttgtggctcaacgtcggtgtgaggacatcgacgagtgtcaggatccggacacgtgtagccaactctgtgtgaacctcgaaggcggttataagtgtcagtgtgaagagggttttcagcttgacccccacactaaggcctgtaaagccgtcggtagcatcgcctacctgttctttacaaaccgccacgaggtgagaaaaatgacattggataggagcgagtacacttcactgatccccaacctgagaaacgttgtggcgctcgacactgaggtggccagcaaccgcatttattggagcgatctgtctcagcgtatgatatgctccactcagctggaccgagcacatggcgttagtagctatgacacggtgatatccagggatattcaggcccccgacggcctggccgtggattggattcactctaatatttattggactgattccgtcttggggaccgtctccgtggcagataccaaaggagtaaagaggaaaacgctgtttcgcgagaacggatcgaaaccgcgggctatcgtggtcgatcctgtgcatgggttcatgtactggacagactggggaacacccgcaaaaattaagaaaggcggtctgaacggtgtcgacatctacagcctagtgaccgagaacatccagtggccaaacggaataacattagatttgttgagtggccgattgtactgggtggactccaaattgcactccatctcatccatagacgttaatgggggcaacaggaaaacaatattagaggatgaaaagaggctcgcacaccccttcagcttagccgttttcgaagacaaggtattttggaccgatataataaacgaagccatctttagtgctaatcgccttaccggctccgatgttaacctcttggcagaaaacctgctgagccctgaggacatggtactgttccataacctgactcagcccagaggagtaaactggtgtgagcggacaaccttgtccaacggagggtgccagtatctgtgcttgccagctccccagattaatccacatagtcctaagttcacctgtgcctgtcctgatggcatgctcttggccagagatatgcggagctgtctcacagaagcagaggcagcggtcgccactcaggagacctccaccgtgcgcctgaaggtctccagcaccgcagtcaggactcagcacactacaactaggcctgttcctgatacttcccggctgccaggtgcgacgcctggccttacaaccgtcgagattgttacaatgtctcatcaggccttgggcgacgtggctggtagaggcaacgagaagaagcctagttcagtccgtgccctatcaatcgtgctacctatagtgctgctggtgttcctgtgcctaggtgttttccttctctggaagaactggcggctcaagaatatcaactctatcaattttgacaacccagtgtaccagaaaaccactgaggatgaagtgcacatttgccacaatcaggatgggtacagttatcccagtagacaaatggtgtcactcgaggatgatgtggca

SEQ ID NO: 16454 - DNA, 2580 bp, Artificial Sequence
  Description of Artificial Sequence: Synthetic coding sequence
atgggcccttgggggtggaagctgcgatggaccgtagccctgctactggcggcggccggcaccgccgttggcgaccggtgtgagcggaacgaattccagtgtcaggatggtaaatgcatttcatacaagtgggtgtgcgatggttccgctgaatgtcaagacggcagtgatgagagccaggagacctgcctctctgtgacttgcaaatctggcgacttcagctgcggcggaagagtgaatcgctgcatcccccagttttggagatgtgatgggcaggtggactgtgacaacggaagcgatgagcagggttgcccgccaaaaacttgttcccaagatgaattccgatgtcatgacggcaaatgcatttcacgacagtttgtctgcgacagtgacagagattgtctcgatggttctgacgaggctagttgtccagtcctcacctgcgggcctgcatctttccagtgtaattctagcacctgcatcccccaactgtgggcctgcgataatgaccccgactgcgaggatgggtcggacgagtggccgcagcggtgcagagggctgtatgtgttccagggggacagtagtccttgttccgctttcgagttccactgtctgtctggcgagtgcatccacagttcttggagatgcgacggagggcctgattgtaaggataagagtgatgaggagaactgtgccgtcgcaacgtgtcggcccgacgaattccagtgtagcgatggtaattgtattcacggaagtcgccagtgtgatcgcgagtacgattgtaaggatatgtccgatgaggtcggctgcgtgaacgtcactctttgtgaaggtccgaataagtttaagtgtcactcgggagagtgcatcacccttgacaaagtttgtaacatggccagagactgtagagactggtcagacgagccgataaaggaatgtggcactgccgcctgtctcgataacaacggcggatgctcgcacgtgtgcaatgcactgaagattggagccgagtgtctgtgtccagacggcttccagctggtggcacagaggaggtgtgaggacatcgatgagtgccaggatcctgacacgtgttcacagctttgcgtgaacctggagggagggtataagtgtcagtgcgaagagggctttcagctagatccacatacaaaggcatgtaaagctgtcggtagtatcgcgtaccttttttttacaaataggcacgaggtgaggaaaatgactttggacaggtccgaatatacatcacttatccccaatctgcgcaacgtggtggccctggacacagaggtggcatctaacagaatctattggtcagacctatcacaacggatgatttgttctacccagttggatcgagcccatggagtttcatcatatgataccgtgatttcccgggatatacaggctcccgatggcctggccgtggattggatacactcaaatatctactggacagatagcgtccttgggacagttagtgtagccgatacaaaaggcgtgaaacgaaagacactttttagagaaaacggatctaaacctcgcgccattgtcgtggaccctgtgcacggctttatgtattggacggattggggcacccccgcaaagattaaaaaaggaggtctgaatggcgtcgacatttacagtctggtgacggaaaacattcagtggcccaacgggatcactctggacctgttgagcggccggttatactgggtagatagcaagctccactcaatttcatctatcgacgttaatggtgggaataggaagaccattttggaggatgagaaacgattggcacaccccttcagccttgctgtgttcgaggataaagtcttctggacagatataattaacgaggccatcttcagtgctaataggttaaccggcagcgatgttaacttgctagcggagaaccttttgagcccagaggatatggttctcttccataacctcacccagccacgtggggttaactggtgcgagcgcacaacgctgagcaatggaggctgccagtacctgtgcttgccggccccacagatcaacccccactcccccaaatttacctgtgcgtgccccgatggcatgttgctggcaagagacatgcgctcctgtctaacagaggctgaggccgctgtggctacacaggaaaccagcactgtacggctgaaagtgtcgagcacagctgttcgtacccaacataccacaaccagacctgttcccgacacctcacggctgcctggggctacacctgggctcactactgtggagattgtgacaatgtcacatcaggccctgggcgatgttgctggacgtggcaatgagaagaagccgtcatcagtcagagctctctccattgtactccccatcgtactactcgtgttcttgtgcctgggcgtttttttgctttggaagaactggcgcctcaaaaacatcaactctatcaactttgataatcctgtttaccagaagacaaccgaggacgaagtgcacatttgccataaccaggatggttattcctaccctagtcgtcagatggtgtcactggaggatgacgtggct

SEQ ID NO: 16455 - DNA, 2580 bp, Artificial Sequence
  Description of Artificial Sequence: Synthetic coding sequence
atgggcccgtggggatggaaattgcgctggaccgtggcgcttctcctcgcagccgctggaactgccgtgggcgatcgctgcgaacgcaatgaatttcagtgtcaagacggaaagtgcatctcctacaaatgggtctgcgatggtagcgcggagtgccaggatggatctgacgagagccaagaaacctgcctcagcgttacttgtaagtcaggagacttcagttgcgggggacgggtgaaccgctgcatcccgcagttctggcgctgcgacggacaagtggactgcgacaatggaagcgatgagcagggatgccccccaaagacctgttcgcaggacgaattcagatgtcacgatggtaaatgtatctcccggcagttcgtgtgcgattcggaccgggactgcctggatggctcggacgaagcatcctgcccggtgcttacctgcggcccagcctcgttccagtgtaactcgtccacctgtattcctcaactgtgggcatgcgacaacgaccctgattgcgaggacggctcagacgaatggccgcagcgttgtaggggactgtacgtgttccagggcgacagctccccatgttccgccttcgaattccattgcctgtcgggtgaatgcatccactctagctggcggtgtgacggtggacctgattgcaaggacaagtccgatgaagagaactgcgcggtcgccacgtgcaggccggacgagtttcaatgctccgacgggaactgcattcacggatccaggcaatgcgaccgggagtacgactgcaaggatatgtcggatgaagtgggatgtgtgaacgtcaccttgtgcgaaggaccaaataagttcaagtgccactccggggaatgcatcactctcgacaaggtttgtaacatggcccgggattgccgggactggtcagatgaaccgataaaagagtgcggcacggctgcctgcctcgataacaacggtggttgctcgcatgtgtgcaatgccctgaagattggagccgaatgcttgtgcccggacggattccagctcgtggctcagagaagatgcgaggacatcgatgaatgtcaggacccagatacttgctcccaactgtgtgtgaacctggagggcggatacaagtgccaatgcgaggagggattccaactcgatcctcatactaaagcctgcaaggcggtcgggtccatcgcgtacctcttctttaccaatcggcacgaagtgaggaagatgacgctggatcgcagcgagtacacttcactcatccccaacctgagaaatgtggtggccttggataccgaagtcgcatcgaaccgcatctactggtccgatctgtcccagcgcatgatctgctcgacccaactggaccgggcacacggcgtgagctcgtacgacacggtgatctcccgtgatatccaagcccctgacggactggcagtcgattggattcactctaatatctattggacggactcagtgctgggaaccgtctccgtcgccgacactaaaggcgtgaagcgcaagaccctgttcagagaaaacggctcgaaaccgagggccattgtggtcgacccggtccacgggttcatgtattggaccgattggggtactccagcaaagatcaaaaagggaggacttaatggggtggacatctactcgctggtcactgaaaacatccagtggcctaacggaatcactttggacctcctctcagggcggctgtactgggtggattcaaagctccattcgatctcaagcatcgacgttaacggagggaatagaaaaacgatcctggaggatgagaaacggttggcccatccatttagcctggccgtgtttgaagataaggtgttctggaccgacatcatcaatgaggctatcttcagcgcaaacagactcaccggtagcgacgtgaacctgttggcggagaacctgctgtcacctgaagatatggtgctgttccacaacctgactcagccccgcggagtgaattggtgcgaacggactaccctcagtaatggcggatgccaatacctttgcctgccggctccacaaatcaacccccactcgccaaagttcacctgtgcttgtccggatggcatgcttttggctcgcgacatgcgatcctgtctgactgaagccgaggctgcggtggcgacccaggaaacttcaactgtccgcctgaaggtgtcaagcaccgcagtgagaactcagcataccactacccggccggtgccagacacctcgcgcctgcccggggcgacccctggcctgactactgtcgagatcgtcaccatgtcccatcaggccctgggagatgtcgctggccgaggaaacgaaaagaagccgtcgtcagtgcgcgcgctttcgatcgtgctcccgatcgtcctgctcgtgtttctgtgtctcggtgtatttcttctgtggaagaattggcgcctcaagaacattaattcgatcaacttcgacaacccggtgtaccagaaaactaccgaggacgaagtgcatatttgccacaatcaggacggatactcatacccgagcagacagatggtttccctggaggacgacgtcgcg

SEQ ID NO: 16456 - DNA, 2580 bp, Artificial Sequence
  Description of Artificial Sequence: Synthetic coding sequence
atgggcccgtggggctggaagctgcgctggaccgtcgctctgctgctggccgctgccggcaccgctgtgggtgatcgctgcgagcgcaacgagttccagtgccaagacggtaagtgtatctcctataagtgggtctgcgacggttccgcggaatgccaggacggtagtgacgagtctcaggagacctgtttgtccgtcacgtgtaagagcggcgacttcagttgcgggggtcgcgtcaaccggtgcatcccccagttctggaggtgcgacggtcaggtcgattgtgataatggatccgatgagcagggttgtccacccaaaacctgctcgcaggacgagttccgctgccacgacggcaagtgtatctctcgtcagttcgtctgcgacagcgaccgcgactgtctggacggctccgacgaggctagctgcccagtcctaacatgcggtccggcgtccttccagtgcaattcctcgacttgcatcccccagctttgggcatgtgataatgatcctgactgcgaagatggatcggacgaatggccgcaacggtgcagaggtctgtacgttttccagggtgacagttccccctgttccgccttcgaattccattgtttgagcggggagtgtatccatagctcttggcgttgcgacggaggccctgactgcaaggataagtctgacgaggaaaactgtgctgtggccacgtgcaggcccgacgagttccagtgctcagatggtaactgtatccacggttcccgtcagtgcgatcgtgagtacgattgcaaggatatgtctgatgaggtcggttgtgttaacgtgacattgtgcgaggggcctaacaagttcaaatgtcatagtggcgagtgtatcaccctggacaaggtctgcaacatggcccgagactgtagagattggtccgacgagccgattaaggagtgcggcaccgcggcctgcttggacaacaacggcggttgttcgcacgtgtgtaacgccctgaagatcggtgctgagtgcctctgcccggacggtttccagttggtcgcccagcggcggtgcgaagatatcgacgagtgtcaagatcccgacacttgctcgcaactctgtgtcaatttagagggcggctacaagtgccagtgcgaggagggcttccagctggaccctcacactaaggcctgtaaagcggtcggttccatcgcctatctgttttttaccaaccggcatgaggtccgcaagatgactttggaccgctcggagtacaccagcctcattcccaacttgcgcaacgtcgtggccctggacacggaggttgcctcgaataggatctattggtcggatctttcacagcgaatgatctgttcaacccagttagacagggcccacggtgtatcgtcctatgatacggtcatcagccgggatatccaggcgcctgatggcttggctgtggattggatccattctaacatctattggacggactcggttttgggcactgtttccgtcgcggatactaagggcgttaagcgcaagacgctcttccgggagaatggaagtaagcctagggctatcgttgtcgacccggtgcacggctttatgtactggacagattgggggacccccgccaagataaaaaagggaggcttgaatggagttgatatatactccctcgttaccgaaaatatccagtggcctaatggaataacccttgatcttctgtcagggcgcctgtactgggtcgactcgaagctgcacagcattagctcaatcgacgtcaacggcggaaaccgtaagaccatcctcgaggatgagaagcgtctcgcccatcccttctccttggccgtgttcgaggacaaagtcttttggaccgatattattaacgaggctatcttctccgccaaccgtttgaccggcagtgacgtgaatctgttggccgagaatttgctctcccccgaggacatggttcttttccacaacctgacgcaacctcgtggagtcaattggtgcgagcggaccactctttccaacgggggctgccagtacctgtgcctgccggcgcctcagatcaacccgcactcccctaaattcacttgcgcttgccccgacggcatgttgctggcccgcgatatgcgttcttgtttgacggaagccgaagccgctgttgccacacaggagacctccaccgtccgccttaaggtctcgagcactgctgtccgcacccagcacactaccacgcgacctgtccctgacacgagtcgcctcccgggtgctacaccgggcttaactacggtcgagatcgtgaccatgagccatcaggctctgggagacgtggctggacgcggtaatgagaagaagccatcttcagtccgcgctctctctatcgttctgcccattgtcctgctggtctttctgtgccttggcgtcttcctattgtggaagaattggaggctcaagaacatcaacagtatcaacttcgacaaccccgtctatcagaagactaccgaagatgaggtccatatttgccacaaccaggatggttactcgtatccgtcccgccagatggtctctctggaggatgatgtggcc

SEQ ID NO: 16457 - DNA, 2580 bp, Artificial Sequence
  Description of Artificial Sequence: Synthetic coding sequence
atgggaccttggggatggaaactcagatggactgtcgcactcctgcttgcagcagctggcaccgcggtgggagatagatgtgaacgcaacgaatttcagtgtcaggacggtaagtgtatttcgtataagtgggtctgtgatggatcggcagagtgccaggatggtagtgacgaatcgcaagaaacttgcctgtctgtcacctgtaagtccggagatttttcgtgtggtgggcgggtgaatagatgcataccacaattttggagatgcgatggtcaagttgattgtgataacggttccgatgaacagggatgcccaccaaaaacttgttcacaagacgagtttagatgtcatgatgggaagtgcatcagtagacaatttgtgtgtgactccgatcgagattgcctcgatggatccgacgaggcctcctgcccagtgttgacttgtgggccagcgagctttcaatgtaattcttccacttgcattccgcagctttgggcttgcgacaatgacccggattgtgaagatgggtctgatgaatggccccaacgatgtaggggtctgtacgtttttcagggagattcatcaccgtgttcggcctttgagttccactgtctttcaggcgaatgtatccacagcagctggcgctgtgatggcgggccagattgcaaagacaagtcagacgaagagaattgtgccgtggcgacctgtcggcccgatgaattccaatgttccgatggaaattgtatccatggtagcagacaatgtgacagagagtacgattgtaaggatatgagtgatgaagtcgggtgtgtcaacgtcaccctctgtgagggcccaaataagtttaagtgtcattcaggcgagtgtataactctcgataaggtctgcaatatggcccgggattgccgcgactggtcggacgagcctatcaaggaatgtggaactgcagcctgcctggacaataacggaggttgtagccacgtgtgtaacgcgcttaagattggtgccgaatgcctttgtccggacggcttccaactggtcgcacagagacgatgtgaggacattgacgaatgtcaagatcctgatacctgttcccagctgtgcgtaaatcttgaaggtggatacaagtgtcagtgtgaagagggatttcagctcgaccctcatacgaaggcatgcaaggcggtcgggtcgattgcatacctgtttttcaccaaccgccatgaggttcgaaagatgactctggacagatcggaatacacttctctgatcccaaaccttcgaaacgtggtggcacttgatactgaagtggcttccaatcgaatatactggtcggacctgagccaaaggatgatttgctcaacccagctggatagggctcatggggtgagctcatacgataccgtgatctcccgggacatccaagcacccgacggacttgccgtggattggattcattcgaacatatactggacggattccgttcttggtaccgtgtccgtggcagataccaagggtgtgaaaagaaaaactctgtttcgggagaatggctcgaagcctcgcgctatagtggtcgatccagtgcatggatttatgtactggaccgactggggaactccagcaaagattaagaagggcggcctgaacggtgtggatatctattcccttgttactgagaacattcagtggcctaacgggattactctcgatctcttgagcggacgtctgtactgggtggatagcaaactgcattccatttcgtcgattgacgttaacggcggaaacagaaaaactatcctggaggatgagaaacgtttggcccaccctttttcgctggcagtgttcgaggataaagtgttctggaccgatatcatcaatgaagcgattttctctgcaaacaggctcaccggcagtgatgtgaaccttttggcagaaaacctgctctcccctgaagatatggtcctttttcataacttgacccagcctcgaggtgtgaactggtgcgaacggactactctttcaaacggtggatgccaatacctgtgtttgcccgcaccacagattaacccacactcgcccaagttcacctgtgcatgcccagacggaatgcttcttgcacgcgacatgcgttcgtgcctgactgaagccgaagccgcagtggccacccaagaaaccagcacggtgagacttaaggtttcgagcactgcagtccgcacccaacataccaccacgaggccggtccctgatacctcgagactgcctggagcaacccccggactgacgaccgtggagatcgtcacgatgagccaccaggccctcggtgacgtggcaggacggggaaatgaaaagaaaccctcgagcgtgcgggcattgagcatcgtgcttcctattgtcctcttggtgttcctctgtctgggagtgttcttgctttggaaaaactggaggcttaagaatatcaacagtattaactttgacaatcctgtttaccaaaaaacgaccgaagatgaagtacacatttgccataatcaagacgggtacagctaccctagcaggcagatggtgtctctcgaagatgacgtggcg

SEQ ID NO: 16458 - DNA, 2580 bp, Artificial Sequence
  Description of Artificial Sequence: Synthetic coding sequence
atgggtccctgggggtggaaactgcgctggaccgtggcattgcttttggccgctgccggaaccgcagttggcgacagatgcgaaagaaacgagtttcagtgccaggatggtaagtgtataagttacaagtgggtttgcgatggatccgcagagtgccaggacgggtcagacgagtctcaagaaacctgcctgtccgtcacgtgtaaatccggtgacttttcttgcggtggacgagtgaatagatgtataccccagttctggagatgtgacggtcaggtggattgtgataacggcagtgatgagcaaggctgccccccgaagacatgttcccaagacgaattccgctgtcatgacgggaagtgcatatctaggcaatttgtttgtgacagcgacagagattgcttggacggaagtgacgaggcctcatgccctgtgctgacatgcggtcccgcaagcttccagtgtaacagtagcacatgcatccctcagctgtgggcctgtgataatgaccccgattgtgaagacggctccgatgagtggcctcaacgatgtcgcgggctgtatgtgtttcagggcgactcctccccttgcagcgcgtttgagttccattgtctctcaggggagtgcatacacagttcttggagatgcgatggcggccccgactgtaaagacaaaagcgacgaggagaactgcgccgttgcaacttgcaggcctgatgaattccaatgtagtgacggcaattgtatacatggatccaggcagtgcgaccgggagtacgattgcaaagatatgtcagacgaagtgggctgcgtgaatgtgaccctgtgcgagggacccaataagtttaagtgccattccggagaatgcatcacactggacaaagtttgcaatatggcaagagactgtagagattggagcgacgagcccataaaggaatgcgggaccgccgcttgtcttgataacaatggtgggtgttcacatgtgtgcaacgctctgaagatcggggctgaatgcctttgccccgacggattccagttggtcgcacagcgacgctgcgaggacatcgatgaatgccaagatcccgatacttgctcacagctctgcgtgaatcttgagggcggctataaatgtcagtgcgaggagggattccagctggaccctcatacaaaagcatgcaaggctgtaggttctatcgcctacctctttttcacgaatcgccacgaggtgcgcaaaatgaccctggatcgctccgagtataccagccttattcctaatcttcgcaacgttgttgctctggatactgaagtggcctcaaacaggatttactggtccgaccttagtcagcggatgatctgcagcacccagctggatagggcacatggcgttagctcatatgacaccgtaatttccagggatattcaggctcccgacggcctggcagtggattggattcatagtaacatctattggactgattcagtgctcggcacggtgtccgtagcggatactaagggtgtcaaaaggaaaactctcttcagagagaatggcagtaagcctcgggcaatcgtggtggaccctgtgcatgggtttatgtactggacagattggggcacacccgcaaagatcaagaaaggcgggctcaatggcgtggatatctattccctggtgacagaaaatattcaatggccaaacggcatcactctcgacctcctgtctggacggctgtactgggtcgactctaagctgcactcaatcagttccatcgacgtcaacggcgggaatcggaagaccatcctggaagatgagaagaggcttgcccaccccttttctctggccgtctttgaggacaaagtcttctggacggacattatcaatgaggctatcttctccgcgaaccgcctcactggatctgacgtcaaccttctcgccgaaaacctcctgtctcctgaagatatggtgctgttccataacctcacacagcctcgaggggttaactggtgtgaaaggacaaccctgagtaatggagggtgtcaatacctctgcctccccgctccccaaatcaacccacattctcccaagttcacgtgtgcatgccccgacgggatgctcctggccagagacatgcgatcctgcctgactgaggctgaggccgctgttgcaactcaagagactagcaccgtgcgacttaaagtgagttccaccgccgtccgaacccaacacactaccactaggcccgtgcctgatacctcccgattgccaggcgctacccctgggctcacaacggtggaaatcgtgacaatgtcacaccaggcgcttggggacgtggcaggcagaggtaatgaaaaaaaaccatcaagcgtacgggcactgagtatcgtgctgcctattgttctcctcgtgttcctgtgtttgggtgtattcctgctctggaaaaactggcggctgaagaatatcaacagcattaatttcgataaccccgtgtatcaaaaaaccacggaggacgaagttcacatttgccacaatcaggacggatattcctatcctagccgccagatggtttctctggaagacgatgtcgct

SEQ ID NO: 16459 - DNA, 2580 bp, Artificial Sequence
  Description of Artificial Sequence: Synthetic coding sequence
atgggcccgtggggatggaagttgagatggaccgtcgccctgctcctggcagcagcgggtaccgccgtgggggaccggtgtgagagaaacgaatttcaatgccaagacggaaaatgcattagctacaagtgggtttgcgatggatcagcggagtgccaggacggttcggacgagtcccaagaaacctgtctcagcgttacttgtaagtcgggtgatttttcgtgcgggggacgggtgaacagatgcattccccagttttggcgctgcgatggtcaggtggactgtgacaatgggtcggacgagcagggatgcccgccaaagacttgctcgcaagacgaattccgctgtcatgatggaaaatgtatcagccggcaatttgtgtgcgactctgatagagactgcttggacgggtcggatgaggcgtcctgccctgtcctcacctgtggacctgcatcgttccagtgcaattccagcacctgtatcccacagttgtgggcatgtgataacgaccctgactgcgaagatggcagcgatgaatggcctcaacggtgcagaggactgtacgtgttccagggcgactcgtcgccgtgttcggctttcgagttccactgccttagcggagagtgcattcattccagctggcggtgtgacggaggacccgattgtaaggataagtcggacgaagagaattgcgccgtggcaacctgccggccggacgaattccagtgctccgatggaaactgcatccatggatcgagacaatgtgatagggagtatgactgcaaggacatgagcgacgaagtcgggtgcgtgaatgtgaccctgtgcgagggaccgaacaagttcaaatgccactcaggagaatgtatcaccttggataaggtgtgtaatatggcccgtgattgccgcgactggtccgacgaacctatcaaagagtgtggaaccgctgcgtgccttgacaataacggtgggtgtagccatgtctgcaacgccctgaagatcggggcggagtgtctgtgcccagatggatttcagctggtggcgcaacgccggtgcgaagatatcgacgagtgtcaggaccctgacacttgctcgcagctctgtgtgaacctggaaggcggttacaagtgccagtgcgaagaaggattccagttggatccacacaccaaggcttgcaaagcggtgggctcaatcgcctacctgttcttcaccaaccgccatgaggtgcggaagatgaccctggaccgcagcgaatacacttccctgatcccgaatcttaggaacgtggttgccctcgatactgaggtggcaagcaacagaatctactggagcgatctgagccagcggatgatttgcagcactcaactggatcgcgcgcatggagtcagctcctacgatacggtcatttcgagagacatccaggcgccggatggactggcggtggactggatacactcgaacatctactggaccgacagcgtgctcggaactgtgtctgtcgccgacactaagggagtgaagcgcaagacccttttccgcgagaacggctccaagccacgcgccatcgtcgtggatccagtccatggatttatgtactggactgactggggaactcctgcgaagatcaagaagggaggattgaacggagtggacatctacagcttggtgactgagaatatccagtggccaaacggtattactctcgatctgctctcgggacgcctgtactgggtggattccaagctccattctatctcatccatcgatgtcaatgggggcaaccgcaaaacgatccttgaggatgagaaacggcttgctcatcccttctctctggccgtgttcgaggacaaggtcttttggaccgacatcattaacgaggccatcttttcggccaaccggctgacgggaagcgacgtgaatctgctggcagaaaatctgctgagcccagaagatatggtgctgttccacaatctcactcaaccgcgcggagtgaactggtgtgagcgcactactctgtccaacgggggatgtcaatacctctgtctgcctgcccctcagatcaatccgcattcgccgaagttcacttgcgcgtgccctgacgggatgttgctggcccgggacatgaggtcctgtctgaccgaagccgaagcggccgtggcgacgcaagaaacctccacggtgcgcctgaaagtgtcgtcgaccgccgtgagaacccaacacactactactcggccagtcccggatacctcacgcctgccgggggccacgcctgggctgactactgtggagatcgtgaccatgtcgcatcaggcactgggagacgtcgccggccgaggtaacgagaaaaaaccgagctcagtccgggccctgtccatcgtgctgccgatcgtgctgctcgtgtttctctgcctcggcgtgttcctgctgtggaagaattggcgtctcaaaaacatcaattcaatcaacttcgataaccccgtgtaccaaaagactacggaagatgaagtgcatatctgccataaccaggacggctactcttacccgtcgagacagatggtgtcgctggaggatgatgttgcc

SEQ ID NO: 16460 - DNA, 2580 bp, Artificial Sequence
  Description of Artificial Sequence: Synthetic coding sequence
atgggtccgtggggctggaaactccgatggacggtggccttgttgctagcagctgcggggacagcggtcggagacaggtgcgagagaaatgaattccagtgccaggacggtaagtgcatttcttacaagtgggtatgtgatggtagcgccgagtgccaagatggctctgatgagagccaggagacctgcctgtctgtcacgtgcaaaagcggggacttcagctgcggcggccgcgtgaatcgatgtatccctcaattttggcgctgtgatggccaagtggactgtgacaacggctccgacgagcagggctgccctcctaagacctgcagccaggacgagttccgctgccacgacggtaagtgtattagccgccagtttgtgtgtgacagcgatagagactgtctggacggaagcgacgaagccagctgtcctgttctgacctgcggcccagcgtcgttccaatgcaatagtagcacctgcataccacagttgtgggcatgtgacaatgatcctgattgtgaggacggcagcgacgagtggccacagagatgtagaggactctacgtgttccaaggcgactcatctccatgcagtgccttcgaattccactgtctgagcggggaatgcatccactcatcttggcgctgcgacggtggcccggattgtaaggacaaatctgacgaggaaaattgcgcggttgcgacctgccgcccagatgaatttcaatgttctgatggtaattgcatccacggtagccgccaatgcgaccgtgagtatgactgcaaagatatgtcagacgaggtcgggtgcgttaacgtgaccctgtgcgaaggccctaacaaatttaagtgccacagcggcgaatgtataacactggacaaagtgtgtaacatggccagggactgcagggactggagcgacgagccgatcaaagaatgtggcactgcggcttgtctggataacaacggaggctgcagccatgtctgtaacgcgctcaagatcggcgccgaatgcctgtgtccagatggctttcaattagtggcacaacgcagatgtgaagatattgatgagtgccaggaccctgatacctgcagccaactgtgtgtgaacttggagggcgggtacaaatgccaatgcgaagaaggctttcagctggacccgcacacgaaagcgtgcaaggccgttggaagcattgcctacctattctttaccaaccggcacgaagtgcgcaagatgacgctcgatcggtctgaatacacctccctgattccgaatctgcggaacgtggtggccctcgataccgaggtcgcgtctaatcgcatctactggagcgatctcagccaacggatgatttgctcaacgcagctggatagggcgcatggcgtcagctcctacgataccgtgatatccagggacattcaagctcctgatggcttggctgtggactggatccactcaaatatttactggacggacagtgtactggggacggtctccgtcgcagataccaaaggtgtgaagcggaaaaccctgtttcgagaaaatggaagcaaaccgcgagccatcgtggtggatccggttcatggcttcatgtactggacggactggggtaccccggcgaaaattaagaaaggtggcctgaatggtgtggacatctatagccttgtgaccgagaacattcagtggcctaacggaattaccttggatctgctgtctggaaggttgtactgggtcgactctaagctgcatagcatttcctcaatagacgtgaatggcggtaatagaaaaactatcctggaggatgaaaaacgcctggctcaccctttctcactggcagtgttcgaagataaagtcttctggacggacattatcaacgaggcaatcttttctgcaaacagattgacgggatctgacgtcaacctgttggcggaaaacttgctgtctccggaggacatggtgctgtttcataacttaacgcagcctaggggagtcaactggtgtgagcgcaccaccctgagcaacggtggctgccagtacctgtgtctaccggcgcctcagattaatcctcactccccgaagttcacatgtgcatgccctgatggcatgctgttggcacgtgatatgagaagctgcctgaccgaggctgaagccgctgtcgcgacacaggagacctccacggttcgtctgaaggtgagcagcacggcagtacgcacacagcacactaccacgaggccggtgcctgacacctctcgcctgccgggtgcaaccccgggcctgacaacggtggaaattgtaaccatgtcacatcaggcactcggtgatgtggcgggtcgcggtaatgagaaaaaaccatcttctgtacgcgccctgagcattgtcctgcctatcgtcttgctggtgtttctctgcttgggggtgttcttgctgtggaaaaattggcgcctaaagaacatcaacagcatcaattttgacaacccagtctaccagaaaacgacggaggatgaagtgcatatctgtcacaatcaagatggttacagctacccttctcgtcagatggtgagtctggaagatgatgtggca

SEQ ID NO: 16461 - DNA, 2580 bp, Artificial Sequence
  Description of Artificial Sequence: Synthetic coding sequence
atggggccttgggggtggaaactacgctggacagtggccctactcttagccgctgccggaactgccgtcggggatagatgcgaacgtaatgaattccaatgccaggatgggaaatgtatttcctataagtgggtctgcgatggatctgctgaatgccaggatgggtcagatgagtcgcaggaaacatgcttgtcggtgacatgcaaatctggggattttagttgcggaggaagagtgaatagatgtatcccccagttttggcgttgcgatgggcaggtcgattgcgataatgggtctgatgagcagggatgtcctcccaaaacatgttcacaagatgaatttcggtgccacgacgggaagtgtatcagtcgccagttcgtgtgcgattccgatagggattgtctagacgggtccgacgaggcctcatgtcccgtccttacatgtgggcccgctagtttccagtgcaattcttctacatgtataccccagctatgggcttgcgataacgatcctgattgcgaagacggatctgatgagtggccgcagaggtgtcgaggactgtatgtgttccagggggattcctctccctgttctgcgttcgagttccattgtctctcaggggagtgtatccatagtagttggaggtgcgacggagggccagattgtaaagataaatcagatgaagaaaactgcgccgtagccacatgtcggccagatgaattccagtgttccgatgggaattgcatacatgggtcccgacagtgtgatcgggagtacgattgtaaagatatgtcagatgaagtggggtgcgtgaatgtaacactgtgtgaaggaccaaataaatttaaatgtcactcaggagaatgtataactcttgataaagtatgcaatatggctagggactgcagagactggagtgatgagcccataaaagaatgcggaactgcggcttgtctggataacaatggaggatgctcccacgtatgcaacgccttaaaaataggagccgaatgtctttgtcccgatggattccaattggtcgctcagcgacgctgcgaagatatcgatgagtgtcaagatcccgatacttgctctcagctctgtgtcaacctggaaggagggtataaatgtcagtgcgaagagggatttcagctagatccacacacaaaagcatgtaaggctgtgggatctatagcttatctgttttttactaaccgacatgaggttcgaaaaatgacattagatagatcagaatatacaagtctaatacccaatctaagaaacgtcgtagctcttgatactgaagttgcgtccaatcggatatattggtccgatctgtcccagagaatgatctgctccactcagttggatcgggcccacggggtctcctcttatgatacagtgatatcccgagatatccaggctcctgatgggctagctgttgattggattcattctaacatctattggacagattctgtactgggaactgtctctgttgctgatacaaaaggagtcaaacgcaaaactttatttagagaaaatggatcaaaaccgcgtgcaatcgtggtggatcctgttcacgggtttatgtattggacagattggggaacacccgccaaaatcaaaaagggggggctgaatggagtggatatatattccctagtgactgaaaatattcagtggcctaatggaattacactagatcttctgtctgggcggctgtattgggtggatagtaaactgcattctataagttctatagatgttaacggagggaataggaaaacgatcctcgaagatgaaaaacgacttgcacacccattttcattggcagtattcgaagacaaagtgttctggacagatatcataaacgaagcgatattttccgctaatcggctgacggggtctgatgtgaacctcctggcagaaaatttgctctctcccgaggatatggtgctctttcataacttaacacagcccagaggggtgaactggtgtgaacggactacactctctaacggggggtgccagtacctatgcctccccgcaccacagatcaatcctcattctcccaagtttacatgtgcatgcccagatgggatgctccttgcaagagacatgcggtcatgtctgactgaagctgaggcagccgtcgccacacaggaaacatctactgtaaggttaaaagtgtcttccacagcagtgcgcacacagcatacaactacacgcccggtgcccgatacaagtaggctacccggggccactcccggactcacaacagtcgaaatagtcactatgtcacatcaggctttgggagatgtggctggaagagggaacgaaaaaaaaccatcctccgtgagagctctctcgatagtactgcccattgtgctcctggtatttctatgcctgggggtcttccttctgtggaaaaactggcgcctcaagaatatcaattccatcaactttgataatcccgtctaccagaaaacaacagaagatgaagtccatatctgccataatcaggatgggtattcctacccctcccggcagatggtctcgttagaagatgatgtggcc

SEQ ID NO: 16462 - DNA, 2580 bp, Artificial Sequence
  Description of Artificial Sequence: Synthetic coding sequence
atgggtccttggggatggaaacttcgctggactgtggcactgcttctggctgcagcaggtaccgctgtgggcgatagatgcgagagaaacgagtttcaatgtcaagacggaaagtgtatttcatacaagtgggtctgtgacggcagcgcagagtgtcaggacggcagcgatgagagccaagaaacctgcctgagcgtgacttgtaagagcggggatttttcatgcggtggaagagtgaatcgctgtatccctcagttctggagatgcgatggacaggtggactgtgataatggttcggacgagcaggggtgcccacccaagacctgttcccaggatgaattccgatgtcacgacggtaagtgcatctcacgccagtttgtctgtgattccgatagggactgtcttgatggcagtgacgaggcatcgtgccctgtgttgacctgtggccccgcctcctttcaatgtaactcttcaacctgtattcctcaactgtgggcctgtgacaatgacccagactgcgaagatgggtcggacgaatggccacaacgatgtcgtgggctgtacgtttttcaaggtgactcgagcccatgcagcgcgttcgaattccattgtttgtctggcgaatgtattcacagctcctggcgctgcgatggaggccccgattgcaaagataagtcggacgaagaaaactgtgccgtcgccacctgtaggcccgatgaatttcaatgctctgatgggaattgtattcacggttcccgacagtgcgaccgagaatatgattgtaaagacatgtccgatgaagtgggatgtgtgaatgtgaccctttgcgagggacctaacaagttcaagtgccattcgggagagtgtatcacgcttgataaagtgtgcaacatggcacgcgattgtagagattggagcgatgaaccaatcaaagaatgcgggactgcagcgtgccttgacaacaacggcggatgctcacatgtgtgtaatgccctcaagattggagctgaatgcctgtgtccagacggtttccaacttgtagcgcagcgccgctgtgaagatatcgatgagtgccaggacccagatacgtgctcccagctctgtgttaacctggaaggaggttacaagtgtcagtgtgaagaaggtttccaactggatccacacactaaagcctgtaaggccgtgggcagcattgcatacttgttcttcaccaacaggcacgaggtgcggaagatgaccctggatcggtctgagtatacgtccctcattccaaaccttagaaacgtggtggccctggataccgaagtcgcaagcaatcgaatatactggtccgatttgtcgcaaagaatgatttgttcgacccaactcgacagagcacatggggtgtccagctacgacaccgtcatctcaagggatattcaggcacccgatggtctggcggttgactggatacattcgaatatctactggactgattcggtgctgggaactgtctccgttgctgacactaaaggggtgaagaggaaaactctttttcgagaaaacggatcaaagcctagagcaattgtggtcgatcctgtccatggattcatgtactggaccgattggggtactcccgcaaagattaagaagggtgggctgaacggagtggacatctactccctggtgactgaaaacattcagtggccgaacgggattacgctggatctcctgtctggaaggctttactgggtcgattcgaagctgcactccattagctccattgatgtcaatggcggtaaccgcaagacgatccttgaagatgagaagcggcttgcgcatccgtttagtctcgcagtctttgaagataaggtattttggaccgatatcattaacgaagcgatattcagcgcaaatcggctgactggatccgacgtcaatttgcttgcagagaatctgctctcgcctgaggatatggtgctgtttcataaccttacccagcctagaggcgtaaattggtgtgaacggaccaccctgagtaatggggggtgtcaatacctctgtctgcctgccccacagataaatcctcatagccctaagtttacctgtgcgtgtcccgatggtatgctcctggcacgcgacatgagatcatgtctgaccgaagccgaggcagcagtcgctactcaagagacgagcaccgtgagactgaaggtttcgtcgactgcagtgcggacccaacacactacgaccaggcccgtgccggatacgtcgcgtctccccggagcaacccctggacttaccactgtggaaatagtgactatgtcccatcaggcccttggagatgtggccggtcgtggcaacgagaagaaaccatcgtcggtgagagccctgtcgatcgtgcttcctatcgtgctgctggtgtttctctgcttgggcgtttttctgctctggaaaaactggcggctcaagaacattaactcaattaactttgataatccggtgtaccaaaaaacgactgaagatgaagtgcatatatgccataaccaagatgggtactcctaccctagccggcaaatggtatctcttgaggacgatgtggca

SEQ ID NO: 16463 - DNA, 2580 bp, Artificial Sequence
  Description of Artificial Sequence: Synthetic coding sequence
atgggaccttgggggtggaagttgagatggactgtcgcactgctgctcgccgcggcaggcactgccgtcggagatcggtgcgaacgaaatgagtttcagtgtcaggatgggaaatgtatctcatacaagtgggtttgtgatggcagcgcagaatgtcaagatggttccgatgaatcccaagaaacctgcttgtccgtcacgtgcaaatccggtgacttcagctgtggggggcgagtcaatcggtgcattccacagttttggcgttgtgatgggcaagtcgactgcgataacggttcggatgaacaggggtgtccacccaagacctgttcgcaagatgagtttcgctgtcatgatggaaagtgcatatcgaggcagtttgtctgtgattcggatcgggattgcttggatggatcggacgaagcaagctgtccagtgctcacctgcggtccagcatcctttcaatgtaactcatcgacttgtattccccagctctgggcctgtgataatgaccccgattgtgaggacggatccgatgaatggcctcagagatgtcgcggcctctacgtgtttcaaggtgacagctcaccttgctcagcctttgaattccattgcctgtcgggggagtgtatacatagctcgtggcgctgtgatgggggaccggattgtaaagataagtcagatgaagaaaattgtgcggttgcaacgtgtaggccagatgagttccaatgtagcgatgggaactgtattcatggatcaagacagtgcgatagagagtacgactgtaaagatatgagcgatgaagtgggctgtgtgaatgtgactctctgtgaaggcccaaacaagttcaaatgtcattcgggagagtgcattacccttgacaaagtctgcaatatggcaagagattgtcgagactggtccgatgaaccgattaaagaatgtggcactgcagcatgtttggacaacaacggtggatgcagccatgtgtgtaacgcacttaagattggggcagaatgcctctgccccgacggatttcagcttgtcgcgcaacgtcgctgtgaggacatcgacgaatgtcaagacccagacacctgttctcagctctgcgtgaatctggagggcggatacaagtgtcagtgcgaagagggttttcaacttgatccgcacactaaggcttgtaaggcagtcggttccatcgcctacctcttctttaccaacagacacgaagtgcggaagatgacgctggaccgctcagagtacactagcctcattccaaacctgcgcaacgtcgtggcgctggacactgaagtggcatcaaatagaatttactggagcgatctgtcccagaggatgatctgctccactcaattggatagggcacacggagtctccagctacgacacggttattagccgcgacatccaagcacctgatggacttgccgtggattggatacattctaatatctactggaccgattcagtgcttggcactgtgtccgtggccgacactaagggtgtgaagcgcaagaccctgttccgggaaaacggctcgaaaccccgggctattgttgtggaccccgttcatggattcatgtactggactgattgggggaccccagcaaagattaagaagggaggactcaatggagtggacatttactcgctggtcaccgagaatatccaatggccgaacggtatcaccctggatctcctgtcgggtaggctctattgggtggattctaagctccactccatttcaagcattgatgtcaacggcggaaacagaaagaccatattggaagatgagaaaaggcttgcccaccctttttccctggcagtgtttgaagataaggtgttctggactgacatcattaacgaggcaattttcagcgcaaacaggttgactggatccgacgtgaacctgctggccgagaacctgctttcccccgaggatatggttctgtttcataatctgacccaaccacgaggagtcaactggtgcgaaaggactaccctgtcgaatgggggatgccaatatctttgtttgcccgcaccccaaatcaatccgcacagccccaagtttacctgtgcttgtcctgacggcatgcttcttgctcgtgacatgcgctcctgtcttaccgaagcagaggcggccgtcgccacccaggagacttcaaccgtgcggctgaaagtgagctcgaccgcggtcagaacccagcacaccaccacgaggcctgtgcccgatacttcacgtctccccggagcgactccggggctgaccaccgtggaaattgtgaccatgagccatcaggcgctcggagacgtggccggacgaggtaacgaaaagaagccctcatcggtgcgggcgctttccattgtgcttccaatagtgcttctggtctttctttgtctcggagtgtttttgctctggaaaaactggagactgaagaacatcaattcgataaactttgataacccagtgtaccaaaaaaccactgaggatgaggtccatatctgccataaccaagacggatactcgtacccctcgcggcagatggtgtcccttgaagatgacgttgct

SEQ ID NO: 16464 - DNA, 2580 bp, Artificial Sequence
  Description of Artificial Sequence: Synthetic coding sequence
atgggcccctggggctggaagctgcgttggactgttgcgttgctcctcgccgctgctgggaccgccgttggggaccgatgcgaaagaaacgagttccaatgccaagacggtaagtgcatctcttataagtgggtctgtgatggctctgccgagtgtcaagacggctcagatgagagccaagagacatgcctttcggtgacgtgtaagtcgggcgatttcagttgtggcggtagagttaatcggtgcatcccccagttttggcgctgtgacggccaggtcgattgtgacaacggctccgacgaacagggctgccctcctaaaacgtgttctcaagatgagtttcgttgccatgatgggaaatgcatctcccgacaatttgtgtgcgattccgaccgagactgtttggacgggagcgacgaagcgagctgccctgtgctaacttgtggaccagcatcttttcagtgtaattcctcgacttgcatccctcagctgtgggcctgtgataatgaccccgactgcgaagacgggtctgatgaatggccgcaacggtgccgaggtttatatgttttccagggagattctagtccgtgttccgcattcgaattccattgtctctctggtgagtgcattcattcatcgtggcgttgtgacggagggcccgactgcaaggataagtctgacgaggaaaactgtgccgtggcgacctgcaggcccgacgagttccaatgttcggacggcaattgtatccatgggtctcgacaatgcgatagggaatacgattgtaaagacatgagtgatgaggtcggatgtgtcaacgtcaccttgtgcgaggggccgaataagtttaagtgtcacagtggcgaatgtataacacttgacaaagtttgcaacatggcgcgtgactgtagagattggtctgacgagccaatcaaggaatgcggcacagcggcatgcttggacaacaatggagggtgctcccatgtttgtaatgcccttaagattggcgctgaatgcctgtgtcctgacggattccaactcgtagcgcaacggagatgtgaagatatcgacgagtgtcaagatccggacacttgtagccaattatgtgtgaatttggaggggggttacaagtgtcaatgcgaggagggtttccaactcgacccacacactaaagcttgtaaagctgttggaagtatagcctacttgtttttcaccaatcgacatgaagtgaggaagatgactcttgaccgcagtgagtacacgtcactaattccgaatcttcgaaacgttgtcgcactcgacaccgaagtggcgtctaaccgtatctactggagtgacctctcccaacgcatgatctgtagcacgcagttagaccgggctcacggcgtatcaagctatgatacagtgattagcagagatatccaagcgcccgatggcctcgctgtcgactggattcattcaaatatctattggacagacagcgtgctgggtaccgttagtgtagccgataccaagggcgtgaaacgcaagactctcttcagagagaatggcagcaaaccacgcgcaattgtggtggatcccgtccacggcttcatgtattggacagactgggggactccggccaaaatcaagaagggaggactgaacggtgttgacatctactcgttggtaacggaaaatattcaatggccaaacggtataacgctcgatctcctgagcggtcgtctttattgggtcgacagtaaactgcattctatttcctctatcgacgtgaatggcggtaacaggaaaaccattctcgaagacgagaagcgccttgcccatccatttagtctggcagtctttgaagataaggttttttggacggatatcattaatgaagcgattttttctgcgaaccgcttaactggatccgatgtcaacctgctggcggaaaaccttctcagtcccgaggatatggtcttatttcacaatctgacacaaccccgtggagtcaactggtgtgagcggacgaccctctctaatggcggttgtcagtatctttgtctgcctgccccacagataaatccacactcaccgaaattcacctgcgcttgccctgatgggatgttgttggcacgtgatatgcgcagctgcctgaccgaggcggaagcagcggtggctacccaggagacctcgactgtccggctcaaggttagttcaactgcggtgcgaactcagcacacgaccaccaggcctgtgcccgatacatcacggcttccaggagcgacgccaggactcactacagttgagatcgtgacaatgtcacaccaggcgttaggggatgttgccggacgtggcaatgaaaagaagccctcgtcagttcgagcactgtctatcgtcctccccattgttctccttgtgttcctgtgtttgggggttttcctgttatggaagaattggcgtctcaagaacatcaatagtattaacttcgataaccccgtttatcagaagactacagaagatgaagtgcatatctgtcacaatcaggacggttattcatatcccagccgtcaaatggttagtctagaggacgatgttgcc

SEQ ID NO: 16465 - DNA, 2580 bp, Artificial Sequence
  Description of Artificial Sequence: Synthetic coding sequence
atgggcccttggggttggaaactccgctggacagtggctctgctcctcgctgcagctggcacagcggtgggggaccgatgtgagcggaacgagtttcagtgccaggacggaaagtgcatatcctataaatgggtttgtgacggatcagctgaatgtcaggacggatctgacgagtctcaggaaacttgccttagtgtaacgtgtaagtccggggacttcagttgtggcggccgagtgaataggtgtataccccagttttggcgatgtgatggccaggtagattgcgataatggctctgatgagcaaggctgcccgcctaaaacctgcagccaggatgagttccggtgccacgacggaaagtgcatttctcgacaattcgtgtgcgacagtgatagagattgtttagatggttccgatgaggcttcgtgccctgtgctgacatgcgggccagcctcatttcaatgtaactcaagtacctgtatccctcagctgtgggcatgcgacaatgacccagactgtgaggatggatctgacgagtggccccagcgatgtaggggactgtatgtgttccaaggggactcctcgccatgttccgccttcgagttccactgtctctctggcgaatgcatccattccagctggcgctgcgatggcgggcctgactgcaaagacaagagtgacgaggagaactgcgcagtcgctacctgtcgtccagatgagttccagtgcagtgatggcaattgtatccacgggtctcggcagtgtgatagagagtacgactgtaaggatatgagcgatgaggtcggctgcgtgaatgtgaccctgtgcgagggtccaaacaagtttaagtgccactcaggcgaatgcataacgttggacaaggtgtgcaatatggcaagggactgtagagattggtctgacgaacctattaaggagtgtggtacagctgcatgccttgataacaacgggggatgctcacacgtttgcaacgccctgaaaattggcgcggagtgtctttgtcccgatgggttccagttagttgcgcaaaggagatgcgaggacattgacgaatgccaggatccagacacctgtagtcagctgtgcgtgaacctcgaaggcggatataaatgccagtgcgaggagggcttccaactggacccccacacaaaggcttgtaaggcagtgggtagtattgcctatctattttttactaacaggcatgaagttcggaaaatgaccctggaccggtctgagtacacgagcctcatacccaatcttaggaatgtcgtggcacttgatacagaggtggcaagcaatcgcatctattggagtgatttgagccagagaatgatctgttccactcagctcgatagagcccatggcgttagtagttacgataccgtgattagccgcgacatacaggcacctgatgggttggcggttgattggattcattcaaatatctattggaccgactccgttctgggaacagtctccgtggccgatacaaagggagtcaaaagaaaaaccctttttcgagagaacggatccaaaccaagagcaatcgtggtggaccccgtgcacggcttcatgtactggacagactggggcacccccgcaaagattaagaaggggggcctgaatggagtggacatctattccctggtgacggagaatatacagtggcccaatggcattactctggaccttctgtccggaagactatactgggtggatagcaaattacattccataagttcaatcgatgtcaacggtggcaacagaaagaccattctggaagatgagaaaagactcgcacaccccttttcactggcggtttttgaagataaggtgttttggactgacataatcaacgaagccatattttcagctaacagactgactggatctgacgtcaacttattagcggagaacttactttctccagaggacatggttttattccacaatctgacccagcctaggggcgtcaattggtgtgaacgaactactctgtctaacggcggctgccaatacctctgcctgcctgcacctcagataaatccgcacagccctaaattcacatgtgcctgccccgatggaatgctgctggcccgggacatgcgatcctgcctcaccgaggcagaggccgccgtggcaacccaggagacctcaacggttcgcctcaaagtaagctctaccgctgtgaggacccaacacactacaaccagaccagtccccgacacctctagactaccaggcgccacccctggtctgaccaccgttgagatagtgactatgtctcaccaggcactgggcgatgtggcgggacgtgggaacgagaagaaaccctcttccgtgagagcactttcgatcgtgctccccatcgtccttttggtgttcctgtgtctcggggtgtttttgctgtggaagaactggcgattaaagaatatcaacagtatcaacttcgataatcctgtgtaccagaagaccactgaagacgaggtgcatatctgccacaaccaggatggttatagttatccttcccgacaaatggtgtcactcgaggacgatgtggct

SEQ ID NO: 16466 - DNA, 2580 bp, Artificial Sequence
  Description of Artificial Sequence: Synthetic coding sequence
atgggaccttggggatggaagttgcggtggacggtggcacttctcctcgcagcagcagggactgcagtgggtgatcgatgcgaacggaacgagtttcaatgtcaagatgggaaatgtatctcttacaagtgggtgtgtgatggtagcgcagagtgtcaagacggctctgatgaatcgcaagaaacctgtctgtccgtgacctgtaaatccggggatttttcatgtggggggcgggtgaacaggtgcattccccagttttggagatgcgacggtcaggtggattgcgataacggcagtgacgagcaaggatgccctccaaagacgtgctcgcaagacgaatttcggtgtcatgacggtaaatgtatttcgagacaatttgtgtgcgatagcgaccgcgattgtctggatggttcggacgaagcgtcctgtcctgtgctgacttgcggacctgcgagcttccaatgtaattcgtcaacttgcattccacaactgtgggcttgtgataacgaccctgattgcgaagatggctcagacgaatggccgcagagatgtcgcggactttacgtgttccagggtgattcgtccccttgcagcgcattcgaattccattgtctgagcggagagtgcatccattcctcctggcgatgcgatggaggtccagattgtaaggataaatccgacgaagaaaactgtgccgtcgcaacttgtcgacctgatgagtttcaatgctcagacggaaattgtattcacggttcccgccaatgtgatcgcgaatacgattgcaaagatatgtcggatgaagtcggctgtgtgaacgtcaccctgtgtgaaggaccgaacaaattcaaatgccattcgggggaatgcattaccctggataaggtctgcaacatggcaagagactgccgcgattggtcggacgaacccattaaagagtgcgggaccgcagcctgtttggataacaacggtgggtgcagccacgtctgtaacgccctgaaaatcggggcggaatgcctgtgtccagacggattccaactggtcgcacaaagacgttgcgaggacatcgatgaatgtcaagatcccgatacctgctcccagctgtgtgtgaacctggagggtggatacaagtgtcagtgtgaagaaggattccaacttgatccacacactaaggcatgtaaggcagtgggttccattgcctaccttttctttacgaacagacatgaagtccgcaaaatgactctggacagatcggaatacacttcattgattcctaaccttcgaaatgtcgtggcactggatactgaggtcgcatcgaaccgtatttactggtcggatctctcgcaacgaatgatatgttccactcaactggaccgcgcgcatggagtgtcgtcctacgatacggtcatttcgagagacatccaggcgccagacggactcgcagtggattggattcactcgaacatttactggaccgacagcgtccttggtaccgtgtcggtggcagacaccaaaggtgtgaagaggaaaactctttttcgggaaaatggatcgaaaccacgagcaatcgtggtggatccggtgcacggctttatgtactggaccgattggggaacgcctgctaaaatcaagaaaggaggcctgaatggtgtcgacatttactcccttgttaccgagaatatacaatggccaaacggtataacccttgaccttctgagcggacgcctgtactgggtcgactcaaagctgcattcaatttcgtcaatcgacgtaaacgggggcaatcggaaaactattcttgaagatgaaaagaggctggcgcatcccttctccctggcagtgtttgaggacaaggtgttctggactgacataatcaacgaagccattttctcagcaaaccggctgacgggtagcgatgtcaaccttctcgccgaaaacctgctctcacctgaggacatggtcctgttccataatctcacccaacctagaggcgtgaattggtgtgagagaactactctctccaatggggggtgtcagtacctttgcctgccggctccacagataaacccccattcccctaagttcacttgcgcctgccctgacggtatgctcctggcaagagacatgcgctcgtgtctgactgaagcagaagcagccgtggcaacccaggagactagcactgtccggcttaaagtctcgtccaccgctgtgaggacccaacataccactaccagaccggtgcccgacacttcccgcctgcctggagcaactccaggactgaccacggtggagatagttaccatgagccatcaagcactcggtgatgtggcagggagagggaatgaaaagaagccatcatcagtccgcgccctgtccatcgtgctcccaattgtgctgcttgtgtttctctgtctcggcgtttttctcctttggaagaactggagacttaagaacatcaattcaatcaattttgacaacccggtgtaccaaaagactactgaggacgaagtgcatatttgtcacaaccaggatggctactcctacccttcacggcagatggtgtccctcgaggatgacgtcgca

SEQ ID NO: 16467 - DNA, 2580 bp, Artificial Sequence
  Description of Artificial Sequence: Synthetic coding sequence
atggggccgtggggatggaaattgcgttggaccgtagccctgttgttagcagcggcgggtactgcagtcggggatagatgtgaaagaaatgagtttcagtgtcaagatggaaaatgtatttcctataagtgggtatgtgatggctctgccgaatgccaggacggatcagatgaaagtcaggagacatgtcttagtgtaacatgcaaatcaggagactttagttgcggaggacgcgttaatagatgtataccacaattttggcgttgcgatggacaggtagattgtgataatggctcagatgagcaagggtgcccacctaaaacatgttctcaagatgaattccgatgccatgatgggaaatgcattagtcgtcaattcgtatgcgattcggacagagattgtttggatggcagtgatgaagcatcatgcccagttcttacttgcggacccgctagttttcagtgtaatagtagtacctgcataccgcaattgtgggcctgcgataacgatccagattgtgaggacggatctgatgaatggccacaacggtgtagaggactatatgtttttcaaggggactcatcaccgtgctctgctttcgagttccactgtttgtccggggaatgcatacatagtagttggagatgtgatggaggtccagactgcaaagataaatcagacgaagagaattgcgcagttgcaacatgccgaccagatgaatttcaatgctcagacgggaattgcatccacggatcacgacagtgcgaccgagaatacgattgcaaggatatgtctgatgaagtgggttgcgtgaatgttactttgtgtgaaggaccaaacaaatttaaatgccactctggagaatgcatcacactagataaagtttgtaatatggctcgggattgtcgtgattggtcagacgaaccgataaaagagtgcggcacagctgcatgcctggataacaatggaggttgttctcacgtgtgcaatgcattgaagatcggagctgaatgtctttgccccgatggattccaactggttgcccaaagacgatgtgaggatattgatgaatgccaagatcccgatacttgctctcaactatgtgttaatttggaaggaggctataaatgccaatgtgaggagggatttcagttggatccacatacaaaggcatgcaaggcagtcggatccattgcttacctgttttttacgaacagacatgaagtcagaaaaatgacacttgatcgctcggaatatacaagtttgatcccaaacctccgaaacgttgttgctcttgatacagaagttgctagcaaccgaatctactggtcggatcttagtcagcggatgatctgctctacacagctggaccgtgcacacggagtatcgtcgtatgatacagttatttctcgagacattcaagctcctgatggattagccgtcgattggatacactctaacatttattggactgattccgttttggggactgtgtctgtagctgatacaaagggagttaaaagaaagaccttgtttagagagaatggttctaaaccccgagcaatagtcgtcgatcctgtgcacggttttatgtattggacggattggggaaccccagcaaaaatcaagaagggaggtctcaatggcgtagatatttactctttggttacggaaaatattcaatggccaaatggaatcacacttgatcttttatcgggaagattgtactgggtggatagtaaacttcacagtatctcgtcaattgatgtcaacggcggaaacagaaagacgatcttggaagatgagaaacgattggcgcacccattttctctggcggtgttcgaggacaaggtattttggactgatatcattaatgaagctatcttctcagcgaatcgacttacgggtagcgatgtcaatttgttggcagagaacctcctttcacctgaagatatggttttatttcacaatcttacgcaaccgcggggagttaattggtgcgaacgaacgactttatcaaatgggggttgtcaatatctttgcctccctgcgccgcagattaatccacattctcctaaattcacctgcgcttgtccagacggaatgctccttgcgcgcgatatgcgatcctgcctcacagaagccgaggctgcagttgcaacacaagaaacttctacagttagactcaaggtatcatcgaccgcagtacgaactcagcacacaacaacacgtccagtgccagacacaagcagactacccggggccaccccaggacttaccacagtagaaattgttactatgagtcatcaagccctgggagacgtggctggccgaggaaatgaaaaaaagccttcttcggttcgagctttgtccatcgttctgccaattgtccttttggtcttcttgtgccttggcgtgtttctgttgtggaagaactggaggttgaagaatattaatagcattaatttcgataatccagtttatcaaaaaacaacggaggacgaagtgcatatctgtcataatcaggatggatattcgtatccttccagacagatggtgagtctcgaagacgatgtggct

SEQ ID NO: 16468 - DNA, 2580 bp, Artificial Sequence
  Description of Artificial Sequence: Synthetic coding sequence
atgggaccatggggctggaaacttcgttggactgtggcactgctgctggcagcagcgggcactgcagtcggcgaccggtgtgaacgtaacgaattccagtgtcaagatgggaagtgtatttcgtacaagtgggtctgtgacggttcggcagagtgccaagatggttccgacgaatcacaagaaacttgtctgagcgtgacctgtaagagcggcgacttcagctgcggagggagggtgaatcggtgtattccccagttttggagatgcgatgggcaggtcgattgtgataatggttcagacgaacagggatgtccaccaaagacttgtagccaggacgaattcagatgtcatgatggtaagtgcatttcccggcagtttgtgtgtgatagcgatagagactgtttggacggaagcgacgaagcctcgtgtccagtgcttacttgcggtcctgcctcatttcagtgcaattctagcacctgcatcccacaactgtgggcctgtgataacgatcccgactgtgaggacggatcggatgaatggccacagcggtgcagaggtctgtacgtgtttcagggagattcgagcccttgttccgcgtttgagtttcactgtctctcgggagaatgcatccactcctcgtggcgctgcgatggtggacccgattgcaaggacaagtcggatgaggaaaattgtgcagtggctacctgcagaccagacgaatttcaatgtagcgatggaaactgtatccacggttcaagacagtgcgaccgcgagtatgactgcaaggatatgtccgatgaggtcgggtgcgtgaacgtgactctttgcgagggtcctaacaaattcaagtgccattcaggtgaatgcatcacgctggacaaagtgtgtaacatggcgcgcgactgtagggactggagcgatgaaccgattaaagaatgtggaactgcagcatgtctggacaataacgggggatgttcgcatgtgtgcaacgcactcaagataggtgcagagtgtctgtgtccagacggatttcagttggtcgcacagcgccgatgcgaagatattgacgaatgccaagaccctgacacctgttcccagctttgcgtcaatttggaaggggggtataagtgccaatgcgaagagggattccaacttgatcctcataccaaggcctgtaaggcagtcggatccatcgcatacctgttctttaccaacagacacgaagtgaggaagatgaccctggatcgttccgagtacacgagcctgatccctaacctgcgcaacgtcgtggcccttgatactgaagtggcatcgaatagaatttactggtcagatctgtcgcagcggatgatttgtagcacccaacttgatagggcacatggagtgtcgtcgtacgatactgtgatatctcgcgatatccaagcaccagatggattggccgtcgattggatacattcaaacatttactggactgactcggttctggggaccgtttcggtggctgacaccaagggagttaagcggaaaaccctgttcagggaaaacggatccaaacccagagcaatagtggtggaccccgtgcacggatttatgtactggaccgattgggggaccccagccaagataaagaagggaggactcaacggagtggacatatactcgctcgtgactgagaatattcagtggccaaacggaattactctggacctcctctcgggacgtctctactgggtggattcgaaacttcattccatttcgtcgatcgatgtcaatggcgggaataggaaaactattctcgaagatgaaaagcggctggcacatccatttagcttggccgtctttgaagataaggtgttctggactgacattatcaatgaagcaattttctcggcaaacagactgaccggctccgatgtgaatctgcttgctgaaaatctgttgtcccccgaagatatggtcctttttcataacctgactcagcctaggggcgtgaactggtgtgaaagaactaccctctcgaacggaggatgtcagtacctttgtttgcctgcgccccaaatcaatccccactcaccgaagtttacttgtgcttgtcccgatggcatgttgctcgcacgtgatatgcgcagctgccttactgaggcggaagcagccgtggcaacccaagagacttccactgtcagactgaaagtgtcctcaaccgctgtgcgtactcagcacactaccactcggcccgtgcccgacacctcaaggctgcctggcgccaccccgggtctgactactgtggaaatcgtgaccatgtcgcaccaagccctgggtgatgtggccggacggggaaacgagaagaagccctcatccgtgcgtgcacttagcatcgttcttcctatagtcttgcttgtgtttctgtgtcttggagttttccttttgtggaagaactggcgcttgaagaatatcaactcgatcaatttcgataacccagtctaccaaaagaccaccgaggatgaggtgcatatatgtcataatcaagatggatacagctatccttcacggcagatggtgtcccttgaggatgatgtggca

SEQ ID NO: 16469 - DNA, 2580 bp, Artificial Sequence
  Description of Artificial Sequence: Synthetic coding sequence
atgggaccatggggttggaagctgcgatggactgttgccctgctgctggccgctgctgggacagcagtaggcgataggtgtgaaaggaatgagtttcagtgccaagacggaaaatgtatttcatacaaatgggtgtgcgatggcagtgccgaatgtcaggatgggagcgatgaatctcaagagacatgcctgtctgtgacttgcaagagtggtgacttctcatgtggtggccgcgtaaaccgctgcataccacagttttggcggtgcgatggccaggtggactgtgacaatgggtcagatgaacagggctgtcctcccaaaacgtgtagtcaggacgagtttagatgtcacgatggcaagtgcattagccggcagtttgtatgtgactcagatcgcgattgcctcgacggttctgacgaggcctcttgccctgtgctgacatgtggaccagcctcattccaatgcaacagcagtacgtgcatcccacagctgtgggcttgtgacaatgacccagactgtgaagatggttcagatgagtggccacaacggtgcaggggtttatatgtcttccagggagattcgtccccctgctcggcctttgagtttcactgcctgagtggggagtgcatccacagtagctggagatgtgacggcgggcctgattgcaaagacaagagtgatgaagagaactgtgctgtagctacatgtaggcctgatgagtttcagtgcagcgatggaaattgcatacacgggtcccgacagtgcgacagggagtatgactgcaaagacatgtccgacgaagtggggtgtgtgaatgttacgctctgtgagggccctaataaattcaaatgtcatagtggcgagtgcatcacactagacaaagtttgtaatatggcacgagactgcagagactggtcagacgagcctataaaggagtgcgggactgcggcttgcctggataataacggcggttgctcccatgtttgcaacgcactgaagataggcgcggaatgtctttgccctgatgggtttcagctggtcgcccaacgtagatgcgaggatatcgacgaatgtcaagatcccgacacatgtagccagctgtgtgtgaacctggagggaggatataaatgccagtgtgaagagggcttccagctggatccccacactaaagcctgcaaggccgtggggtccatcgcctacctgtttttcacgaatagacacgaggtgaggaagatgaccctggatagaagcgagtatacaagcctaattcctaatcttcggaatgtggtcgccctagatactgaagtggcctctaaccggatctattggagcgacctaagtcaacgcatgatctgtagcactcaactggacagggcccacggcgtgtcatcatatgacacagtgatttcacgagacattcaggcccccgacggactagccgtggattggatacactcaaacatttattggacagactccgtcctagggacagtttcagtggctgataccaaaggcgttaagaggaaaacacttttccgcgagaatgggtcgaagcctagggcaatcgtcgtagaccctgtccatgggttcatgtactggaccgattggggaacccccgctaaaatcaagaaggggggactcaatggcgtggatatttatagcctcgttacagaaaatattcagtggccaaacggtatcaccctcgatctgctgtctgggcggctctattgggtcgactccaagctgcactctatctcatcaatcgatgtcaacggcggaaaccgcaagaccattttggaggacgagaaaaggcttgctcatcctttcagcctggctgtgtttgaggacaaggtcttctggaccgatatcattaacgaagcaatcttcagcgctaaccggctgaccggttctgatgtaaaccttctggctgaaaatttactcagtcccgaggacatggtgctctttcataacctgacacagcctcggggcgtcaactggtgtgagcggacaacgctctcgaatgggggttgtcagtatctgtgtctgccagccccacagattaaccctcactctccaaaattcacctgtgcatgcccagacggaatgctcttggctcgcgatatgagaagttgcctgactgaggcggaggcagccgtggctactcaggaaacatctacagtgcggttgaaggtgtctagtacggctgtgcggacccagcacacaactactagacccgtgcctgatacgagccgcctgccaggagctacccccggactcacgaccgtcgagatagttactatgtcccatcaggccctgggcgacgtggcaggccggggaaatgagaaaaaaccctcctccgtccgcgctctgtcgattgttctgccaatcgtgcttttagtgttcctgtgtctgggcgtcttcctcctgtggaagaactggcggttaaagaatattaacagcattaacttcgacaatcccgtctatcagaagaccacagaggacgaagtgcatatttgccacaaccaggacggttacagttacccctctagacagatggtatccttggaagatgacgtcgcc

SEQ ID NO: 16470 - DNA, 2580 bp, Artificial Sequence
  Description of Artificial Sequence: Synthetic coding sequence
atgggaccgtggggatggaagctgcgctggaccgtggccttgctgctggcagccgcgggtacggcagtgggggaccgctgtgaaagaaatgaattccagtgtcaggacggaaaatgcatttcctacaagtgggtgtgcgacggcagcgccgaatgtcaagatggctccgatgaatcgcaagagacttgccttagcgtcacctgtaagtcaggagatttctcttgcggggggcgcgtgaaccggtgcatcccacaattctggcggtgcgatggacaggtggattgcgataacggatccgatgaacagggatgtccgccgaaaacctgctcgcaggacgaattcagatgccacgacggcaagtgcatctcacgccagttcgtgtgcgactcagaccgcgactgcctggatggctcggatgaggcttcatgcccagtgctgacttgcggacctgcttcattccagtgcaactccagcacctgcatcccccaactctgggcctgtgacaatgaccctgactgcgaagatggatccgacgagtggccacaacggtgccgggggctgtacgtttttcagggagattcgtcgccgtgctcggccttcgagtttcactgcctctccggagaatgcatccacagcagctggaggtgcgatggtggcccggactgcaaggacaaatcggacgaagagaattgcgcggttgcaacttgccggccggatgagttccaatgcagcgatggaaactgcatccatggatccagacagtgcgaccgggagtacgattgcaaagatatgtcggacgaagtgggatgcgtgaatgtgaccctctgtgaaggacctaacaagtttaagtgtcactcgggagagtgcatcaccctcgataaagtctgcaacatggctcgggactgcagagactggtcggatgaaccgatcaaagaatgcggcaccgccgcctgcttggacaataacggaggatgcagccacgtgtgcaacgcactgaagattggcgcagaatgtctgtgtcccgacggattccagctggtggcgcagcgcaggtgcgaggacatcgatgagtgccaagatccggatacttgcagccaactgtgcgtgaacctggagggtggatacaaatgccagtgtgaggaggggttccaactggatccgcacaccaaagcatgcaaggcggtgggatcgatcgcttacctgttcttcactaaccggcacgaagtgcgcaagatgaccctcgataggagcgaatacacctccctgatcccaaacctccgcaatgtggtggcgttggatactgaagttgcttcaaatagaatctactggtcggatctctcgcagcgcatgatctgctccacgcagctggacagagcccacggagtttcctcatacgataccgtgatctccagagacatccaagctccggacggacttgcggtggactggattcactccaacatctactggactgattcagtgctggggactgtgagcgtggctgatactaaaggcgtgaaacggaaaacgctcttcagagagaatggatcaaagccccgcgctattgtggtcgacccggtgcatggattcatgtactggaccgattggggaacgccggcaaaaatcaagaaaggtgggttgaacggcgtggacatctactccttggtcaccgaaaacatccagtggccgaatggaatcactctggatctgctctccggtcggctgtactgggttgactcaaagctgcattcaatctcctctatcgatgtgaacggaggaaatagaaagacgatcttggaggacgagaagagactcgcacatccattctcgttggctgtgttcgaagataaggttttctggactgatatcatcaacgaggccatctttagcgccaataggcttactggctcggatgtgaacctcctggcagagaacctgctgagcccggaggacatggtgctgttccacaacctcacccaaccacgcggagttaactggtgcgaacgcaccaccctctcgaacggcggatgccagtacctctgccttccagccccgcagattaatccccattcgccgaagtttacctgcgcctgccctgacgggatgttgctggcacgggatatgcgatcgtgtttgaccgaggctgaggcggccgtcgcgactcaggagacttcgaccgtccggctcaaggtgagctcaaccgcagtgcgcacgcaacatactaccacgcgccctgtcccggacacctcgcgtctcccgggcgctaccccgggattgaccaccgtcgaaattgtgacgatgagccatcaagccctgggtgatgtggccggacgcggaaacgaaaagaagccttcgtcagtccgagcactttccatcgtgcttcctattgtgctgctggtattcctctgcctgggtgttttcctgctctggaaaaactggcgcttgaaaaacatcaattccatcaactttgacaacccagtctaccaaaagaccactgaggatgaggtgcatatctgtcataaccaggacgggtacagctacccatcgcgccagatggtgtccctggaggatgatgtggca

SEQ ID NO: 16471 - DNA, 2580 bp, Artificial Sequence
  Description of Artificial Sequence: Synthetic coding sequence
atggggccgtggggttggaagttgcggtggaccgtcgccctgctgctggcagcggctggtaccgccgtgggcgaccgctgcgagcggaatgagtttcaatgtcaggatggaaaatgcatcagctacaaatgggtgtgtgatggatcagctgaatgccaagacggaagtgacgagtcgcaggagacttgcctgtcagtgacctgcaaatccggagatttctcgtgcgggggccgggtgaatcgctgcatcccgcagttctggcggtgtgatggtcaagtggattgcgacaacggctcggacgaacagggatgtccaccgaaaacttgttcacaggacgaattccgctgccatgatggaaagtgtatctcacggcagttcgtctgcgattccgacagggactgccttgacggaagcgacgaagcctcctgtccggtgcttacttgcggcccggcctcgtttcagtgcaactcgagcacgtgtatcccacaactttgggcctgcgacaatgacccggattgcgaggacggctcagacgaatggccccagcggtgtagagggttgtacgtgttccagggcgactcatccccctgctcggcatttgaattccattgtctctccggcgagtgcattcattcatcctggaggtgcgacggaggtccggactgcaaggacaagagcgacgaagagaattgcgccgtggccacttgcagaccagatgaattccaatgttcagacggcaattgtatccacggatcacgccagtgcgacagggaatacgactgtaaagacatgtcggatgaagtcggatgcgtgaacgtgaccctctgcgagggaccgaacaagttcaagtgtcactccggagagtgtataacgctggacaaggtgtgcaacatggcccgggattgccgcgattggtcggatgaaccgatcaaggagtgtggaaccgcggcctgcctggacaacaacggaggatgctcacatgtgtgtaatgccctcaaaatcggagcggagtgcctgtgcccggatgggttccagttggtggcccagcggcgctgtgaagatatcgacgagtgccaagacccggacacctgctctcagctctgcgtcaatttggagggcggatacaagtgccagtgcgaagagggattccagctggacccgcacactaaggcttgcaaagccgtcggatcaatcgcatacctcttcttcaccaaccgccacgaagtgcggaagatgactcttgaccgatcggaatacacttcgctgatcccaaacctgcggaacgtggtggcccttgacactgaagtcgcctctaatcggatctactggtccgatctgagccaaaggatgatctgctctacccaactggaccgggctcatggagtttcgtcgtacgacactgtgatcagccgcgacatccaggcgccggacggactcgccgtggattggatccattcgaacatctattggaccgattccgtcctggggactgtcagcgttgctgacactaagggcgttaagagaaaaaccttgtttagagaaaatggctccaagcctcgggccatcgtggtcgatccggtgcacggattcatgtattggaccgactggggtactccggcgaaaatcaagaaaggcggactcaacggagtggacatctacagcttggtgaccgaaaacatccagtggcccaacggaatcacgcttgacctgctgagcgggcgcttgtattgggtcgacagcaagctgcatagcatctcatccatcgacgttaacggaggcaatcgaaagactatcctcgaggacgagaagagattggcgcatccattcagcctggccgttttcgaagataaggtgttctggactgatatcatcaacgaagcaatcttttcggcgaaccggctgaccggctcagatgtgaaccttctcgccgaaaatctcctctcgcctgaagatatggtgctgttccacaacctgactcaaccgcgcggcgtcaactggtgcgaacggaccaccctctcaaacggcggctgccaatacctgtgcctgccggcaccgcagatcaatccgcactccccgaagtttacgtgtgcctgtcccgacgggatgctcctggcacgcgatatgcgctcctgccttaccgaagccgaggccgcggtggcgacccaagaaacctccactgtccggctgaaggtgagctccaccgccgtgcggacccagcacactaccacccgcccggtgcccgatacttcaagactgccgggcgccaccccggggctgaccactgtcgaaatcgtcacgatgtcccatcaagcgctgggagatgtcgctggacggggaaatgagaagaagccgtcgtcggtcagagccctgtcgatcgtgctgccgatcgtgctcctcgtctttctttgcctcggagtctttcttctctggaagaactggcgccttaagaacatcaattccatcaacttcgataacccggtgtaccaaaagaccactgaagatgaagtgcacatctgccacaatcaggacggatacagctacccttcccgtcaaatggtttccttggaggacgacgtggca

SEQ ID NO: 16472 - DNA, 2580 bp, Artificial Sequence
  Description of Artificial Sequence: Synthetic coding sequence
atgggaccttggggatggaagctgaggtggacggtggcgctgttgctggcggcagcaggtaccgcagtgggagataggtgcgagcgaaacgagtttcaatgccaggacggtaagtgcatttcctacaagtgggtgtgtgatggatcagccgaatgtcaagacggatcggacgagtctcaagaaacctgcctgagtgttacttgtaaatccggagacttcagctgtggtggtcgcgtgaaccgctgcattcctcagttttggcgctgtgatgggcaggtggattgtgataatgggtcggacgaacaaggttgcccacctaagacttgctcgcaagatgaatttagatgccatgacggtaagtgtatttccagacagttcgtgtgcgacagcgatcgagactgccttgacggctcggatgaagcctcgtgcccagtgctgacttgtggtcctgcctccttccagtgtaactcatcgacctgtatccctcaactgtgggcatgtgataacgatccagattgtgaagatggatctgatgaatggccacagcggtgtagaggactgtacgtttttcaaggtgattcgagcccctgttcagcatttgagttccattgtcttagcggtgagtgtattcattcgagctggcgttgcgatggaggcccagattgcaaagataagtccgacgaagagaattgcgcagtcgcaacttgtcgcccggacgaattccaatgttcagacggtaactgtattcacggctcaagacaatgtgatagagagtacgattgcaaggatatgtcggatgaggtgggctgtgtgaacgtgactctgtgcgaaggcccgaacaagttcaaatgtcacagcggcgaatgcattacgctggataaggtgtgcaacatggcacgggattgtcgcgattggtccgatgaacccatcaaggaatgcgggacggcagcttgtcttgataacaacggaggctgcagccacgtgtgtaatgcgctgaaaattggagcagaatgtctgtgtccagatggatttcagctggtcgctcaacgacgctgtgaagatatcgatgaatgtcaagatccagacacctgtagtcaactgtgtgttaatctggagggcggctacaagtgtcagtgcgaagaaggatttcagctcgaccctcatactaaggcatgcaaggcggtgggttccatcgcatacctcttctttactaaccggcatgaagtgcgcaagatgactctggacagaagcgaatacacctccctgattccaaatctgaggaacgtcgtggcactggatactgaagtggcatccaatcggatttactggtctgatctgtctcaacgaatgatctgctccacgcagctcgacagagcacatggggtttcttcctatgatacggtgatttcgagggatatccaagctcctgatgggctggctgtcgattggatacattcaaacatctactggaccgatagcgttctcgggactgtgagcgtggcagataccaagggtgtgaaacgcaaaacgctcttcagggagaatggctcgaaaccaagagccattgtcgtcgatcctgtgcatggattcatgtactggacggactggggtactcccgctaaaatcaaaaagggcggactgaatggagtggacatctactcgcttgtcaccgagaatatccagtggccaaatgggattacccttgaccttctttccggtcgcctctactgggtggatagcaagctgcattcaatctcgtccatagatgtgaacggtggcaaccgtaagacgattcttgaggacgagaagcggctggcgcaccctttctcacttgcagtgttcgaggataaagtgttttggaccgacataatcaacgaggccatcttttccgcgaatcggttgactggtagcgacgtgaatctcctcgccgaaaacctgctttcgccggaggacatggtcttgtttcataacctgactcaacctcggggagtgaattggtgtgaacgcactactctttccaacgggggatgccaatacctctgtttgccagccccacagataaacccgcattcgccgaagtttacttgcgcttgtcccgatggtatgctgctggcgagagatatgaggtcgtgtctcacggaagcagaagcagcagtcgcaacccaggaaacctcaaccgtgaggctgaaggtgagcagcacggcagtgagaacccagcataccacgactaggcctgtgcctgacacgtcgaggctgccaggtgccaccccaggtttgaccactgttgaaatagttacgatgtcccaccaagccttgggggatgttgccggccgcggtaacgagaagaagccctcatccgtgcgggcactttccatagtactccctattgtgctgttggtctttctgtgtctcggtgtttttcttctctggaaaaactggcgtcttaagaacattaactcgatcaacttcgataatcctgtgtatcaaaagaccaccgaagatgaagtgcacatttgtcacaatcaggatggctacagctacccttcgcggcaaatggtcagcctcgaggacgatgtcgca

SEQ ID NO: 16473 - DNA, 2580 bp, Artificial Sequence
  Description of Artificial Sequence: Synthetic coding sequence
atgggaccctggggatggaaattgcgttggacagtggcactcctcctcgcagctgctggtacagccgtgggggaccgttgcgagcgtaacgaatttcagtgccaagatggaaagtgcatttcctataaatgggtgtgcgatggcagcgccgagtgtcaggacggctcagatgagagccaggagacctgcctgagtgttacctgcaagagcggagattttagttgcggaggacgcgttaataggtgcattccgcaattctggcggtgcgacggacaggtcgactgtgacaacggatctgatgagcagggatgcccacccaaaacctgtagccaggacgaatttcgctgtcacgatggaaagtgtatctctcgacagtttgtttgtgattcagatagggactgcctggatggtagcgatgaagccagttgtccggtgctcacttgcgggcccgcaagcttccagtgcaatagctcaacctgtattccacagttgtgggcttgtgacaatgacccagattgtgaagacggctccgatgagtggcctcagaggtgccgtgggctgtacgtcttccagggagatagcagcccatgtagtgcattcgagtttcattgcctttccggcgagtgcatccattcctcttggaggtgcgatgggggcccagactgcaaagataagtcagatgaagagaactgcgctgtcgccacttgcaggccagatgaatttcagtgttcagacggcaattgcatccatggatctcggcaatgcgacagggagtatgattgtaaagatatgtcagacgaagtgggatgcgtaaatgtcactctatgtgaaggacctaataaattcaagtgtcacagcggggaatgtataaccctagacaaagtgtgcaacatggcaagggactgccgggattggtctgacgagcctataaaggaatgcggcaccgcagcatgtctcgacaacaatggcggatgttcacatgtgtgcaatgcgttgaagatcggggcggagtgcctgtgcccagacggattccagttagtggcccagcgccgctgcgaggacatcgatgagtgtcaggatcctgacacctgctcccagctgtgcgtcaatctcgaaggaggctataagtgccagtgtgaggagggattccagctggatccccatacaaaggcttgcaaagcagtgggatccatcgcgtacttgttcttcactaatcgccatgaagttcgcaagatgactcttgaccggtcagagtatacgagtctcatccctaatctcaggaacgttgtcgcactggatacagaggtggcttctaacagaatatattggtcggacctgtctcagaggatgatctgcagtacgcagttagacagggcccacggagtgtcaagctacgataccgttatcagcagagacatccaggctcctgatggcctggcagttgactggattcacagcaacatctattggactgatagtgtcctgggaaccgtcagcgtggccgacaccaagggcgtgaaaaggaagactctgtttagagagaatggctcaaagccccgcgcaatcgttgtggacccagtgcatggcttcatgtactggactgattggggaactcctgcaaaaatcaaaaaaggaggactgaatggcgttgatatttacagcctcgtcaccgaaaatatccagtggcctaatggcatcactctagacctactgagtggccgcctttactgggttgacagcaaattgcactccatcagcagcatcgacgtgaatggtggaaacagaaagaccatcctagaagacgaaaagcgtctggcccatccctttagcctggctgtatttgaagataaggtgttttggacagacatcatcaacgaagccattttctcagcgaatcgcctcacgggctcggatgttaacctgctcgcagagaatttactgtcccccgaagacatggtgttatttcacaacctaacacagcctaggggtgttaattggtgcgaacgtacaaccttgagtaacggtggatgccaatacctgtgtcttccagcacctcaaatcaaccctcatagcccaaaatttacctgcgcctgccccgacggaatgctccttgcccgtgacatgcgctcatgcttgactgaggccgaagccgctgttgccacccaagagactagcacagttaggctgaaggtgtcttccactgccgtcagaactcagcatacaaccactcggcccgttccagacaccagtaggcttcctggagctactccaggcctcactaccgtggaaatagtaactatgagccatcaagccctgggcgatgtggctggaaggggtaacgaaaagaaaccatctagtgttcgagccctcagcattgttttgccgatagtacttctggtgtttctctgcctgggcgtttttctgctttggaaaaattggagattgaaaaacatcaacagtatcaacttcgacaatccggtttaccaaaagaccaccgaagatgaagtgcatatttgccacaatcaagatggttattcttatccaagcagacagatggttagcctggaggatgacgttgca

SEQ ID NO: 16474 - DNA, 2580 bp, Artificial Sequence
  Description of Artificial Sequence: Synthetic coding sequence
atgggaccgtggggttggaagctgaggtggactgtggctctcctcctggccgcagctggaaccgcggtgggagacagatgcgagaggaacgagttccagtgccaggacgggaagtgcatctcttacaagtgggtgtgcgatgggtccgcagaatgccaagatggctccgatgagagccaagaaacctgcctgtcggtgacctgcaaatccggcgacttctcatgcggcggacgggtgaaccgctgtatcccacagttctggcggtgcgacggtcaagtggactgcgataatggctcggatgaacaaggatgtccgccaaagacttgcagccaggacgagttcagatgtcacgacgggaagtgtatctcccgccaattcgtgtgcgattcagacagagactgcctggacgggagcgacgaagcctcgtgtccggtgctcacctgtggaccggcctcattccagtgcaactcctcgacctgtatcccgcagctgtgggcttgcgataacgacccagattgtgaggatggttcggatgagtggccgcaacggtgccggggcctgtacgtctttcagggagactcatcaccatgctcagcattcgagttccactgcctgtccggtgaatgtattcactcatcatggaggtgcgacggaggcccggactgcaaggacaagtcggatgaagagaactgcgccgtcgcaacgtgccggcctgacgaattccaatgctcagatggaaattgcatccatggaagccgtcagtgcgacagggaatatgactgcaaggatatgtcggatgaggtcggatgcgtgaacgtgactctgtgtgaggggccaaataagttcaagtgccactccggggagtgtatcactcttgacaaagtctgtaacatggcccgggactgccgggattggagcgacgaaccgatcaaagaatgtggaactgctgcctgtctggacaacaatggcgggtgctcgcacgtctgcaatgcacttaagattggggcggaatgcctctgcccggacggattccagctggtggctcagcgccggtgtgaggacatcgacgaatgccaggatccggacacctgctcccagctgtgcgtcaatctggagggaggatacaagtgccagtgtgaagagggtttccaactggacccgcatactaaggcgtgcaaggccgtcggttccatcgcttacctcttcttcaccaatcgccacgaagtgagaaagatgactctcgaccggagcgaatacacttcgctcatcccgaacctccggaacgtggtcgccctggacactgaagtggcgtcaaaccgaatctactggtctgatctgtcccaacggatgatctgctcgactcaactggaccgcgcgcacggcgtcagcagctacgatactgttataagccgcgatatccaggccccggatggcctggctgtcgactggatccactccaacatctactggacggattcagtgctgggaactgtgtcggtggctgacactaagggcgtgaagcggaaaacgctctttcgcgagaatggcagcaagccgcgcgcaatcgtggttgacccagttcatggcttcatgtactggactgactggggaactccggctaagatcaagaagggaggcctcaacggggtcgacatctatagcctggtgacggaaaacatccagtggccaaacggaatcactctggacctcctgtcgggcagattgtattgggtggactcgaaacttcattcaatctccagcatcgatgtcaacggtggaaatagaaagactatcctggaagatgagaagcgcctggcgcatccattctcattggccgtgttcgaggataaggtcttttggaccgacattatcaatgaagcgatcttctcagccaaccgcctgaccggatcagatgtcaatttgctcgccgagaacctcctgtcgccggaggacatggtgctgttccataatctcactcaacctcgcggcgtgaactggtgcgaacggacgactctgagcaacggaggatgccagtacttgtgtctccctgcccctcagattaatccgcacagcccgaagttcacctgcgcatgtccggatggaatgctcctggctcgggatatgcgctcctgtctgaccgaagccgaagctgccgtggccacccaggagacttctacggtgagactcaaggtgtcgtcgaccgccgtccgcactcagcataccacgaccaggcccgtgcccgacactagccgcctgccaggagctacccctggtctgactactgtggagatcgttactatgtctcaccaggcgttgggagacgtcgcgggacggggcaacgaaaagaagccttcctcagtgcgagcactttcaatcgtgttgcctatcgtgctgctggttttcctgtgcctgggggtgttcctgctgtggaagaattggcggttgaagaacataaactctatcaacttcgacaaccccgtgtaccagaaaaccaccgaagatgaggtgcatatctgccataatcaggatggctactcgtacccctcccgccagatggtgtcgctggaagatgacgttgct

SEQ ID NO: 16475 - DNA, 2580 bp, Artificial Sequence
  Description of Artificial Sequence: Synthetic coding sequence
atgggaccatggggctggaaactgcggtggactgtcgcacttcttctggccgcagcaggaaccgccgttggagatcgttgcgaacgcaatgagttccagtgtcaagacggcaaatgtatatcatacaagtgggtgtgtgatggttcagcagagtgccaggacgggagcgatgagtcacaggaaacatgcttgtctgttacgtgcaaaagtggggatttttcctgcggcgggagagtcaaccgctgcatccctcagttttggcgctgtgatgggcaagtagattgcgacaacgggagtgatgaacaggggtgcccacctaagacctgttctcaggacgagtttcggtgtcacgacggcaaatgtatatctcgccagtttgtttgtgacagcgaccgggattgcctggacgggtcggacgaggcctcatgtcccgtgctgacctgcggtcccgcctccttccagtgtaacagcagtacatgcattcctcaactctgggcgtgtgacaacgaccctgattgtgaagatggaagtgatgagtggcctcagcggtgtagaggcctctatgtgtttcagggggatagcagcccctgtagcgctttcgaatttcactgcctttctggcgagtgtattcacagtagctggcggtgtgacggggggcctgattgcaaggacaagtctgacgaagagaattgcgctgttgccacgtgccgcccagacgaatttcagtgtagtgacggaaattgcattcacggttcaaggcagtgcgatcgtgagtatgactgtaaagatatgtccgatgaggtggggtgcgtaaatgtcacactgtgcgaaggcccaaacaaattcaaatgccatagcggcgaatgcatcacattggacaaagtctgcaatatggccagggattgtagagactggtcggatgagccaatcaaggaatgcggaaccgctgcgtgcctggataacaatgggggctgttcgcacgtttgcaacgcattgaaaatcggagcggaatgtctgtgcccagatgggttccagctagtggcacagcgtaggtgtgaggacatcgacgagtgtcaggaccccgacacctgtagccagttgtgtgtgaacctcgagggtggatacaaatgccaatgcgaggagggcttccaactggatccccacacaaaggcttgtaaagctgtgggcagcatcgcctacctgtttttcacaaatcggcatgaggtgaggaagatgacccttgatagatctgagtacactagcttgattccaaatctaaggaacgtcgtagcattggacacagaggtagcgagcaaccgcatttactggtctgacctgagccagcgcatgatttgctcgacgcagctggatagggcgcatggggtctcctcatacgatacagtgatttctagagacatccaagctcctgatggcctggccgtggattggattcattctaacatttactggacagactctgtgctgggcacggtgtcagtggccgatactaagggtgtcaagcggaagactctcttccgcgagaacggaagtaagccgagggccatcgtggtcgaccctgtccacggttttatgtactggacagactggggaactccagctaagatcaagaagggcgggctcaacggggtcgacatctattcactggtgacagagaatattcagtggcccaatgggatcactctggatctgctaagtggccgattgtactgggtcgactctaagctgcatagtatcagcagcattgatgtgaacggtggaaacagaaagacaattctggaagatgagaaaagactcgcacatccattctctctggccgtgtttgaagacaaggtgttctggacggatattatcaacgaagccattttttccgcgaaccgactgacaggctcggatgtaaatctactagccgagaatctgctgtcccccgaagacatggttttgtttcacaatctgactcagcccagaggtgtaaactggtgtgagaggaccacgctgagcaatgggggttgccaatatctgtgccttcccgctccgcagattaatccccactccccaaagtttacctgcgcctgcccagacggcatgctactggcccgtgacatgaggagctgccttacagaagcagaggccgctgtggcgacccaggagacctccaccgtccgcctgaaggtcagttctaccgccgtccgcacgcagcatacaaccacgagacccgtgcctgacacatctaggctcccaggggccacccccggtctaactaccgtcgaaattgtaaccatgtcccatcaagccctgggcgacgtggccggtagggggaacgaaaaaaagccatcatccgtgagagccctgtctatcgttttgccgatcgtcttactggtctttctgtgtttgggagtcttcctcctgtggaagaactggcgactaaagaacatcaactcaattaatttcgataatcccgtttaccaaaagaccactgaggatgaagtgcacatctgtcacaaccaggacgggtactcatatcccagtaggcagatggtctcactggaagatgatgtcgcg

SEQ ID NO: 16476 - DNA, 2580 bp, Artificial Sequence
  Description of Artificial Sequence: Synthetic coding sequence
atgggaccatggggttggaagctgcgctggaccgtggcgctcctgctcgcggctgccggaacggcagtgggagacagatgcgaacgaaatgagttccagtgccaagacggaaaatgtatttcttacaaatgggtgtgcgatggatcggccgagtgccaggatggaagcgacgagtcacaagagacttgcctttcggtgacgtgtaagtccggtgacttttcatgtggtggacgggtgaacagatgtatcccacaattttggagatgtgatggacaggtcgactgtgacaacggatcagacgagcagggatgcccacccaagacttgttcgcaggacgaattcagatgccacgacggcaaatgcatctcacgccagtttgtttgcgactccgaccgggactgtctcgacggaagtgacgaggcctcctgcccggtcctgacctgcggtcccgcgagcttccaatgcaacagctccacttgcatcccacagctctgggcctgcgacaatgacccggattgcgaggatgggtcggacgagtggccgcagcgctgtcggggactgtacgtctttcagggtgactccagcccgtgctcagcattcgaattccactgcttgtcgggagaatgcatccactcatcctggcggtgcgacggcggccctgattgcaaggacaaatccgatgaagaaaactgcgctgtcgcgacgtgccgccctgacgaattccagtgctcggacggtaattgcatccatggaagtcgacagtgtgacagggaatacgactgtaaggatatgtcagacgaggtgggttgcgtcaacgtgactctttgcgaaggaccgaataagttcaagtgccattccggcgaatgtatcacccttgataaggtgtgcaacatggcgagagactgtagggattggtcagacgaaccgattaaagagtgcggcactgctgcctgtctcgacaacaacggcggatgttcacacgtgtgcaacgcgctgaagattggagccgaatgcctgtgccctgacggttttcaacttgtggcccagagacggtgtgaggatatcgatgagtgtcaggacccggatacctgttctcaactctgcgtgaacctggaaggaggctacaagtgccaatgcgaagagggcttccaactggatccacacactaaggcctgcaaagcagtaggctcgatcgcctacctcttcttcaccaaccgccacgaggtccgaaagatgactctggaccggtcggaatatacgtcactgatcccgaatctgcggaacgtggttgccctggacaccgaggtcgcctccaatcgcatctactggtcggatctttcccaacgcatgatttgctcaactcagctcgaccgcgcccatggcgtgtcgtcctatgatactgtgatttcgagggatatccaggctcccgacgggctcgcagtggactggatccactctaatatctactggaccgactccgtgctgggaactgtcagtgtcgccgacaccaaaggagtgaagaggaaaactctgttccgggagaatgggtcgaagccgcgcgccattgtggttgacccagtgcacggcttcatgtactggactgactgggggactccggcgaagatcaagaagggaggccttaacggagttgacatttactccctcgtgaccgaaaacatacagtggcctaacggaatcaccctcgatctgttgtcggggagactgtactgggttgactcgaaactgcattcgatctcatccatcgacgtgaatggcggcaaccgcaagaccatcctggaagatgagaaacggctggcgcatccattttcgctggcagtgtttgaggataaggtcttttggaccgacatcattaatgaagccatcttctcggccaatcggctgaccggatccgacgtcaacctgctggccgaaaacctgctgagcccagaagatatggtgctcttccacaatctgactcaaccacgcggtgtcaattggtgcgagagaactactctcagcaacggtggctgccaatacctttgcctgccagctccgcagatcaacccgcattcgccaaagtttacgtgcgcttgcccggatgggatgctgctggctcgcgacatgaggtcctgcctgaccgaagcggaggccgccgtggccacccaggaaacttccaccgtgagactgaaggttagttctacggccgtgcggacccagcacaccactacccgccccgttccggatacgtccaggctgccgggtgcaactcctggactcacgaccgtcgaaatcgtcaccatgtcgcatcaagcactcggagacgtggcaggaagagggaatgagaagaagccatcctcagtgcgcgccctgtcaatcgtgctgccgatcgtgctcctcgtgtttctttgtctcggtgttttcttgctgtggaaaaactggcgactgaaaaacatcaactccattaacttcgacaatccggtgtaccaaaagaccaccgaagatgaggtccacatctgccacaaccaggatgggtactcatacccgtcgcgccaaatggtgtcgcttgaggacgacgtggcc

SEQ ID NO: 16477 - DNA, 2580 bp, Artificial Sequence
  Description of Artificial Sequence: Synthetic coding sequence
atgggcccctggggatggaaattgcgctggaccgtggccctattgctggctgccgccggaacagctgtaggggacaggtgcgagaggaatgaatttcaatgccaggatggtaaatgtatcagttacaagtgggtttgcgacggttctgccgaatgccaagacggcagtgacgaatcacaggagacttgtttgtccgtcacgtgtaagagcggtgacttttcctgcggcggccgagtgaacaggtgtatcccccagttttggcggtgcgatgggcaggtggattgtgacaacggaagtgatgagcagggatgcccgccaaaaacctgttcccaggatgagtttcgctgccatgatgggaagtgcatttccaggcagtttgtgtgcgattccgaccgtgattgcttagatggcagcgatgaggctagctgcccggtgctgacatgcggacctgcgtcttttcagtgtaatagctctacatgcatcccccagctctgggcgtgcgataacgaccctgactgcgaggacggatctgacgaatggcctcagagatgtcggggattgtatgtgttccagggtgacagctcaccctgtagtgcctttgagtttcattgcctgtctggagaatgtatacactcatcatggaggtgtgatgggggccccgactgtaaggataaatccgacgaggaaaactgcgctgtcgccacttgtaggcctgatgagttccagtgttcagacgggaactgtattcacggatcacgccagtgcgatcgggaatatgactgcaaagacatgagcgatgaggtggggtgtgtgaacgtcacgctgtgcgagggccctaacaagtttaagtgccactccggcgagtgtattacattggacaaagtgtgtaatatggcccgcgactgccgggactggtctgacgagcccatcaaagaatgcggtactgctgcgtgcttggacaacaacggcgggtgttcccacgtttgcaatgccctgaaaattggcgccgaatgcctctgtcccgacggctttcagctcgttgcgcagcggaggtgtgaggatatagacgagtgccaggaccctgacacctgttcacagctgtgtgtgaatttggaggggggctacaaatgtcagtgtgaggaaggatttcaattagaccctcacacaaaagcatgcaaagctgtgggaagcatcgcatatttattctttacaaatcgccatgaagtgcgcaaaatgactttggaccgtagcgagtacacatccctgattccgaatctgcgaaacgtggtggccctagataccgaggtagcaagcaaccgaatctattggagcgatctatctcagagaatgatctgttctactcagctcgatcgggcacatggcgtctcgtcatatgacacagtcatctccagagacatacaggccccagatggcttggcagtggattggatacattcgaacatctactggactgatagcgtgttggggacagtgtccgtcgctgataccaaaggggtcaagcggaagaccctgtttcgtgagaacggtagcaaaccgagggctatcgtcgtggacccagtgcatggctttatgtattggaccgactggggaacccctgcaaagattaaaaagggaggcctgaatggtgtcgatatttattcactggttacagaaaatatacagtggccaaacggcataacattggatcttctgtcagggcgactgtactgggtggacagtaagctccatagtatctccagtatagatgtgaatggtgggaaccgaaagactatccttgaggacgagaaacggctggcccatcctttttccctggctgtcttcgaagacaaagtattctggaccgacattataaacgaggccatctttagcgccaatcgacttaccggctccgacgttaatctgttggcggagaacctgctcagccctgaggatatggtgttatttcataatttgacgcagccccgtggcgtgaactggtgtgagcgcacaaccctgtcaaatggcggctgtcagtacctctgccttcctgcacctcaaataaacccacattctcccaaatttacttgcgcttgcccagacgggatgttgttggctcgggacatgcgatcttgtctgacagaggcagaagccgcggtagctactcaggagaccagtacagttaggctgaaagtatcctctactgcggtccgcactcagcatacgacaacccggcctgtacccgacacgagccgcctgccgggagctacgcccggactgactacggtagaaatcgtgactatgagtcatcaggcgttgggcgatgtcgccggacgagggaacgaaaaaaagccatcttcagtgcgggcactaagtatagtgttaccgatcgtgctgctcgtttttctttgtctgggagtttttcttctgtggaaaaattggcgtctgaaaaacatcaactctataaatttcgacaaccctgtgtatcagaagactacagaggatgaagtgcatatctgtcacaaccaagatggctactcctatccgagccgtcagatggtcagccttgaggatgacgtcgca

SEQ ID NO: 16478 - DNA, 2580 bp, Artificial Sequence
  Description of Artificial Sequence: Synthetic coding sequence
atgggaccctgggggtggaagcttcgttggacagtcgccctgctgctggcagctgctgggacagctgtcggcgacagatgcgaacggaacgagtttcagtgccaagacggcaagtgcatatcctataaatgggtctgtgatggcagtgccgagtgccaggacggatccgatgagagtcaggaaacgtgcctgtccgtcacctgcaaaagcggggattttagctgtgggggaagagtgaataggtgcatcccccaattctggaggtgcgacggacaggttgattgcgacaacgggagcgatgaacagggatgcccgccgaagacttgcagccaggatgaattccggtgccatgacggtaagtgtatctcaaggcagtttgtctgtgattcagatagggactgtctcgatggttcagacgaagcatcctgcccagtcctgacatgcgggcctgccagtttccagtgcaattccagcacttgcatcccccagctttgggcctgtgacaatgatccagattgcgaggatgggagtgatgagtggccccaaagatgtaggggcctgtacgtctttcaaggcgattcaagtccttgttctgcattcgagtttcattgtttgagtggagagtgcattcactcctcttggcggtgtgacggaggccccgattgtaaagacaaaagcgacgaggaaaactgtgctgtcgccacatgcaggcccgacgagtttcagtgtagcgatggaaactgtatccatgggagccgccagtgcgacagggagtatgactgtaaggacatgagcgatgaggttgggtgcgtgaacgtgaccctttgcgagggcccgaataagttcaaatgtcactccggtgaatgcatcaccttagataaagtgtgcaacatggctcgcgactgtcgggattggtctgacgagcctattaaggagtgcggcacggccgcttgcctggataacaatggcggatgttcacatgtatgtaatgctttaaaaatcggtgcggaatgtttgtgtcccgatggattccagcttgtagcccagcgaaggtgcgaagacatagacgagtgccaggatcccgatacttgctcacagttgtgcgttaacctcgagggcggctataagtgtcagtgtgaggaaggcttccaacttgacccccacaccaaggcatgtaaggccgtcggtagcatcgcttacttgttctttaccaatcgccacgaggtcagaaagatgacgctcgaccggtcagaatacacatccctgattcccaaccttcggaacgtggtggccctggacactgaagtggcatccaatcggatctactggtctgatctcagtcagcgcatgatctgtagtacacagcttgatcgggcccatggagtcagttcttacgatacagtaatatccagggacattcaggcccctgacgggttggccgtggattggatccactccaatatctattggacagactcagttttaggaacagtgagcgtggcggacacaaagggcgtcaagcgtaagacgctttttcgcgagaacggttctaaacctagggccatcgtcgtcgatcctgtgcatggcttcatgtattggacagattggggaactcccgccaaaattaaaaagggcgggctgaatggcgtagacatctatagtctggttacggagaacatccagtggcctaatgggattacgctcgatttgctatccggcagactgtattgggttgatagtaagttacatagcatatctagtatagatgtgaacggaggaaatcgaaagactatcctggaggatgaaaagaggttggctcacccattcagcctggccgtttttgaagataaggtcttttggaccgacattatcaacgaagctattttttccgccaataggctgacaggtagcgacgtcaacctgctcgccgaaaatttgctgtcacctgaggacatggtcttgttccacaacctcacacagccccgtggcgttaattggtgtgagcgcaccacactctccaatgggggctgtcaatacctctgtctgcccgcccctcagatcaatccccactcacccaagtttacctgcgcctgccctgacgggatgttactggccagagatatgcgatcatgcctgaccgaggcggaagcagccgttgccacccaagaaacttccaccgtgcggctcaaggtaagttcaacagctgtgcgcacccaacacacaaccactcgaccagtacccgacacctcgaggttaccaggtgctactccggggctcaccaccgtagagattgtgactatgagccaccaggcgctcggggacgtggccgggcgggggaatgaaaaaaaaccaagtagcgtacgtgctctttcaatcgtcttgccgattgtcctgctggtctttttgtgtttgggagtgttccttctgtggaagaactggcgcctgaaaaatatcaattccattaactttgataatccagtctaccagaagacaacagaagatgaggtccatatttgtcacaaccaggatgggtactcctacccgagcagacagatggtcagtcttgaggacgacgtggcc

SEQ ID NO: 16479 - DNA, 3033 bp, Artificial Sequence
  Description of Artificial Sequence: Synthetic coding sequence
atgggtgcttatgctcgagccagtggggtgtgtgcgagagggtgcctggacagcgcaggcccctggacgatgtcccgcgctctgagaccccccctgccaccactttgtttcttcttgctgctgctcgctgctgctggggccagagccggtggctacgaaacctgtcccactgtgcagccaaatatgctgaacgtgcatttgttgccccatacacacgacgatgtggggtggctcaagacagtcgatcagtatttttatggtattaaaaacgacatccagcacgccggggtgcaatatattttggatagtgtgatctctgcgcttttggccgatccaacgcgccggttcatttacgtggaaatcgccttctttagtaggtggtggcaccagcagacaaacgccacccaggaagtcgtgcgggacctggtcagacagggacgattggaattcgctaatggcggctgggtgatgaatgacgaagctgcaacacattatggagccatagtggatcagatgactctgggcctgcgcttcttggaggacacctttggcaatgatggaaggccccgcgtagcctggcatattgacccctttgggcactcacgagagcaggctagtctctttgcccagatggggtttgatggcttcttctttggtcgccttgattaccaagacaagtgggtccgcatgcagaaactcgagatggagcaggtatggcgcgcttctacgagcttgaagccgccaactgctgacctgttcaccggtgtactgccaaatggctacaaccctccgagaaatttgtgctgggacgtgctgtgtgtggaccagccactggtcgaagatcctaggagccctgaatacaacgctaaggagctcgtagactatttcctgaatgttgcaacagcgcagggccggtactacaggactaatcatacagtgatgaccatgggcagtgactttcaatacgaaaatgctaatatgtggttcaaaaatctggacaagcttataagactcgtgaatgctcaacaggccaaaggctcctcagtccacgtcctgtactccactcccgcctgctacctgtgggaattgaataaggccaatcttacctggagtgtaaaacatgatgatttctttccctacgccgatggccctcatcagttttggacagggtactttagctcaaggcctgccctcaagcggtatgagagattgtcatacaatttccttcaagtgtgtaatcaactcgaggccctggtcggacttgccgctaacgtcggtccctatggatctggcgactccgcacccctgaatgaggctatggcggtacttcagcaccacgatgccgtgagcgggacaagccgccaacacgtggccaatgattacgccagacagctggctgcgggatggggaccgtgtgaggtgctgctttctaatgctcttgcaaggctgaggggcttcaaggaccactttaccttctgtcagcagctgaacatttctatctgtccactgtcacagactgcggctaggttccaagtcattgtttataatcctcttggacggaaggtgaactggatggtgcgcctgccagtctcagaaggggtattcgtcgtgaaagaccccaatggtaggacagtcccttccgatgttgtgatattccccagctctgactctcaggcccatccacccgagctcctgtttagtgcctctctgcctgccctcgggtttagcacctatagtgtggcccaagtgccaaggtggaagccgcaggctcgggccccccagccaattcccaggagatcttggagtcccgctctgaccatcgagaacgaacacattcgagctacttttgaccctgacaccggactccttatggaaatcatgaatatgaatcagcagctgttgctgcctgtgcggcagaccttcttttggtacaacgcaagcatcggggacaacgagagtgaccaggctagcggcgcttacatttttcgacctaatcagcagaaaccactgcctgtgtcccggtgggctcagatccacctcgtcaagacgcctctggtgcaggaagtacaccagaactttagtgcatggtgtagccaggtggtgagactctacccaggtcagaggcatctcgaactggagtggtccgtaggccccatacccgttggtgacacgtgggggaaggaggtaatatctaggttcgatacccctctggagacaaagggcagattttatacggatagtaacggcagggagatcctcgagcggcggcgggattataggccaacctggaagctgaaccagacagagcccgtagccggaaactactaccctgtgaataccaggatttacatcactgacggcaacatgcagctgactgtgctgacagatcgaagtcagggtggttcttctcttagagatggctccttggagttgatggtacaccggcggctgctgaaagatgacggccgaggcgtgtctgaacctttgatggagaacggatctggggcctgggtccgcggcaggcacctggtgctgttggataccgcccaggccgccgcagcggggcacaggctgctggctgaacaggaggtcttggcacctcaggtggtactggcccccggaggaggtgcggcgtataacctgggcgctcctccccgcacgcagttctctggactgcgacgagacttgccgccttcagtgcacctgctcaccttggcctcctggggcccggaaatggtgctgctgcgactggagcatcaattcgctgtgggagaggactcagggaggaatttgtctgctccggtgactctgaatctgcgcgacctgtttagtacgtttactatcacccggttgcaggaaacgacgcttgtggcaaatcagttgcgggaggctgcctctcgactcaaatggaccacaaataccggacccacgcctcatcagaccccctatcaacttgaccctgctaacataacactggagcctatggaaatacgcaccttccttgctagcgtgcagtggaaggaggtggatggc

SEQ ID NO: 16480 - DNA, 3033 bp, Artificial Sequence
  Description of Artificial Sequence: Synthetic coding sequence
atgggcgcctacgctcgcgcatcgggggtgtgtgctagaggctgtctggactctgcaggcccttggactatgtcgcgcgccctcagacctccgctgcccccgctgtgctttttcctcctgctgctggcggctgcgggtgccagagccggcgggtacgaaacctgccccaccgtacagcccaatatgctgaatgtgcacttgcttccccacacccacgacgatgttggctggctcaagaccgttgatcaatatttctacgggatcaagaatgatattcagcacgccggagtgcagtacatcttggattcggtgatcagtgccctgctcgctgatccgactagacggtttatttatgtagagatagcctttttctctcggtggtggcaccagcagacaaacgcaacccaggaagttgtgagagatctggttcgccaggggagactggaattcgcaaatgggggatgggtcatgaatgatgaggccgctacacactatggcgctatagtagatcagatgactctaggactacgctttttagaagacacattcggcaacgacgggagacctcgggtcgcctggcacattgacccatttggccactcccgggagcaggcaagccttttcgcccagatgggcttcgatggattttttttcggtagattggattatcaggataagtgggtgagaatgcagaaacttgaaatggagcaggtgtggcgagccagcacaagtctcaagcccccaaccgccgacctttttaccggagttttgcctaatggctacaatccaccaaggaacttatgctgggatgtgctttgcgtagaccaacctttggtggaggaccctagatcacctgagtacaacgcgaaagaactagttgactatttcttgaacgttgcaacagcccagggtaggtactaccgtaccaaccacacagtgatgaccatggggtccgacttccagtatgagaatgctaatatgtggtttaagaatctagacaagcttatcaggctggtcaatgcgcagcaggccaaggggtcgtccgtgcacgtcctttattcaacaccggcctgttacctttgggaactgaataaggcgaatctgacatggtccgtgaagcatgatgattttttcccatatgcggacggaccacaccagttctggacagggtatttctcgagtagacccgcccttaaaaggtatgaacgtctgagctataacttccttcaggtttgcaatcagctcgaggccctcgtgggcctagctgccaacgtcgggccatacggttcgggtgattcagcacccttgaacgaagctatggccgtgctccagcaccacgatgcagtgtcaggtacatctcggcagcacgtcgcaaacgattatgcccgacagttggccgcaggatggggaccatgcgaagtgctgctgagtaatgcactcgcccggctccgggggttcaaggaccacttcaccttctgtcaacagctgaatatctccatttgtcctctaagccagactgctgcccgctttcaggtgatagtgtacaacccgctaggcaggaaggtgaattggatggtccggctgcccgtgagcgagggggtgttcgtagtgaaagaccccaatggcagaacagtcccaagcgacgtcgttatctttccgtcttcagattcccaggctcatccccccgagctgctattttccgcatctttgcccgccctcggcttttctacatactcggtcgcacaggtgccacggtggaagcctcaggctagggcacctcagccaataccacggcgatcttggagcccagcactgacaatagagaatgagcatatcagggcaacattcgacccagatactggcctcctgatggagatcatgaatatgaatcagcagctgttgctgccagtcagacagacatttttttggtacaacgctagtataggggataacgaatctgaccaggcgagcggggcgtatatcttccggcctaaccaacagaaacctctgcccgtttcaagatgggcccagatccacttggtgaagacccctctggtgcaggaggtgcaccagaatttttctgcgtggtgctcccaggttgtaaggctgtatccagggcagcgccatcttgagctcgagtggagcgtgggaccaataccagtgggagatacctggggcaaggaggttataagtcgattcgatactccacttgagacaaagggacgcttttatactgattcaaacggaagagagattctggaacgacgacgggattaccggcccacttggaagctcaaccagaccgaacctgttgctggcaactattatcccgtaaacacaagaatctacatcactgatggcaacatgcagctgacagtgctgactgatcgctctcaaggggggtcaagtctcagagacggctctctcgagttgatggtgcacaggcggcttctgaaggatgatggcagaggtgtgagcgaaccgctgatggagaatgggtccggtgcctgggtacggggacgccacttagtgctcctggataccgcccaagccgctgcagcaggccatcgcctgctggccgaacaagaagtccttgccccgcaggtggttcttgctccaggcgggggggccgcatataacctcggggctccaccccgcacccagttttccggcttgaggagagatctgcctccaagcgtgcacctcctgactctcgccagctggggtccggagatggtgctgttgaggctggaacaccagtttgcggtgggcgaagacagcggtcggaatctgagcgcacctgtcacactaaacctgcgggatctgtttagcactttcaccataactcgcctgcaggagacaacgctggtcgctaaccaacttagagaggcggcaagccgactgaagtggaccaccaacacagggcccaccccgcaccaaacgccctaccagttggaccctgcgaacatcactcttgaacccatggagatcaggacgttcctcgcctccgtccaatggaaagaagttgacggc

SEQ ID NO: 16481 - DNA, 3033 bp, Artificial Sequence
  Description of Artificial Sequence: Synthetic coding sequence
atgggagcatacgcacgggcaagcggtgtgtgtgcacgcggctgcctcgattccgcaggcccctggacgatgtccagagctttgcggccgcccctgccgccactgtgttttttcctgctgctccttgcagcagcgggtgcacgcgcgggaggctacgaaacctgccctactgtccagcccaatatgcttaatgtgcatctgttgccccacactcatgatgatgtgggatggcttaaaactgtggatcagtacttctatggtatcaaaaacgatatacaacatgctggagtgcagtacattctggactcagttatctcggctcttctggccgatccaactaggcgattcatatacgtcgaaattgctttctttagcagatggtggcatcaacagactaacgccacccaagaggtggtgcgcgacctggtccgtcaggggagactcgaatttgcaaatggcggatgggtcatgaacgatgaagcggctacccactatggagctattgtggatcaaatgaccctgggacttagattcctggaagatacttttgggaatgacggtcggcctagagtcgcatggcacatcgacccctttgggcattcgagagagcaggcaagcctgtttgcgcaaatggggttcgacgggttctttttcgggcggctggattaccaggataaatgggtgcgcatgcaaaagttggagatggagcaggtctggcgcgcaagcacctcacttaagccacctaccgccgatctgttcaccggagtgctgcccaacgggtacaacccaccaaggaatctgtgttgggacgtcctttgcgtggatcagccactggtggaggatcctcgatctccagagtacaatgcaaaggaactcgtcgactatttcctcaatgtggcgaccgcacaagggcggtactacagaaccaatcataccgtcatgaccatgggatcggattttcaatacgaaaatgcgaatatgtggttcaagaatcttgataagctcatccgacttgtcaacgcgcaacaggccaagggctcgtccgtgcacgtgttgtactccactcctgcatgttacctttgggaactgaacaaggcaaatcttacctggtcagtcaagcatgatgacttttttccttacgccgatggaccgcatcaattttggactggctacttttcttcacgaccagcccttaaacgctacgagagactgagctacaactttcttcaagtgtgcaaccagcttgaggcactcgtgggcctggctgcaaacgtgggaccatacggctcaggagatagcgccccacttaacgaggcaatggctgtcctgcagcatcatgacgccgtctctggaacttccaggcaacatgtggccaatgactacgcccgccagctggctgccgggtggggaccttgcgaagttttgttgtcgaacgcgcttgccagacttcgtgggtttaaggaccattttactttttgccaacagctgaatatcagcatctgtcccctctcgcagactgcagcaagattccaggtcatcgtgtacaacccacttggacgcaaggtgaattggatggtgcgactcccagtgtcggaaggtgtctttgtggtcaaagaccctaatggtcggaccgtgccctccgatgtggtcatttttccttcctcagattcacaagcccatcctcccgagctgctgttcagcgcatccctgccagcccttggcttttcaacgtattcagtggcccaggtccctaggtggaagccccaggcacgcgcaccacaaccaatacccagaagatcgtggtcgcctgcactgactattgaaaatgaacatattcgggcaactttcgaccctgataccggattgcttatggaaatcatgaacatgaatcaacaactgctcctccctgtgagacaaacttttttctggtacaatgcgtcgataggcgataatgaatcggaccaagcctccggagcatacattttcaggccaaaccaacagaagcctctccccgtgtcgcgatgggcacaaattcacctggtgaaaactccactggtacaggaagtgcaccagaacttctcggcatggtgctcccaagtggtcagattgtacccgggacagagacacctggaactggaatggtcagttggtcccattccggtgggagatacttggggaaaggaggtcatttcgcgctttgatactcctctcgaaacgaagggacgattttacaccgatagcaacggacgcgaaattctcgaaaggagaagagattacagacctacctggaagctcaatcaaaccgaaccagtggccggaaactactaccccgtgaatacccgcatttacatcactgatggaaacatgcagctgactgtcctgaccgatagatcccaaggagggtcatcccttagagatggatcgctggaactgatggtgcatagacgcctgctgaaggatgatggacgaggcgtgagcgaaccacttatggaaaacggaagcggggcttgggtcagaggtcggcacttggtgcttctggacacggcacaagcagcggcggcagggcaccgccttctggcagaacaagaagtccttgcaccacaagttgtgctggctccaggaggaggcgccgcgtacaacctcggagctcctccaagaactcagtttagcggccttcgacgcgacctgccgccctccgtgcacctgctgacccttgcatcgtggggccctgaaatggtgcttttgcgtttggagcatcaatttgctgtgggtgaggactccgggaggaacctctccgcacctgtcactctcaaccttagggacctgtttagcacttttactattacccggcttcaggaaaccacccttgtcgcaaaccagcttcgtgaggcagcttcccgtttgaaatggaccaccaataccggacctactccccatcaaaccccttaccaactggatcccgcaaacataactcttgaaccaatggagatcagaacgtttctggcgtcagtccaatggaaggaggtcgatggt

SEQ ID NO: 16482 - DNA, 3033 bp, Artificial Sequence
  Description of Artificial Sequence: Synthetic coding sequence
atgggagcttacgcccgggccagcggagtctgcgcgcgcggatgtttggattccgcggggccgtggaccatgagccgcgcactgcgccctccactgccgccattgtgtttcttcttgctgttgctggccgcggcgggagcccgagctggagggtacgagacttgcccaaccgtccagccaaacatgctcaacgtgcacctgttgcctcatactcatgacgacgtgggatggcttaagaccgtcgaccagtacttttacggcatcaaaaacgacatccaacatgcaggagtccagtacatcctggactcggtcatcagcgcgctgttggccgatccgacgcggcgctttatctacgtggaaatagcgttctttagccggtggtggcaccagcagaccaacgctacccaggaggtcgtcagagatcttgtgaggcagggacggttggagttcgccaacggtggttgggtgatgaacgacgaggccgctacccattacggcgcgatcgtggatcaaatgaccttgggactgagattcctggaggataccttcgggaacgatggacgaccccgggtggcatggcacatcgacccattcggccattcccgcgagcaagcatccctgttcgcccagatggggtttgatggattcttcttcggacggctggattaccaagataagtgggtccgcatgcaaaaactggagatggaacaggtctggcgggcgagcacctcgctgaagccccctaccgccgatctgttcaccggtgtcttgcccaatggctacaatccaccgagaaatctgtgttgggatgtgttgtgtgttgatcaacccttggtcgaggacccaagatccccggagtataacgccaaagagctggtggattacttcttgaacgtggcgaccgcacagggacggtactatcggactaatcacaccgtgatgaccatgggatccgatttccaatacgaaaacgctaatatgtggttcaagaatctggacaagctcatcaggctcgtcaatgcccaacaggcaaagggttcaagcgtgcatgtcctttatagcacccccgcctgctacctctgggagctgaacaaggctaacttgacttggtccgtgaagcacgatgacttctttccttacgcagatggaccgcatcagttttggactggatacttctcgtctcgtcctgctctcaagcgctacgaaaggctgagctataacttcctccaggtttgtaatcaattggaagccctggtgggactggcggccaatgtggggccatacggatcgggtgacagtgcccccttgaacgaagccatggccgtgctccaacaccacgatgctgtctcggggacttcaagacagcacgtggccaacgattacgcgagacaactggcggccggctggggaccgtgcgaagtgctgctgagcaacgccctggcccgcctgcgcggtttcaaagatcattttactttctgccagcagctgaacatcagcatatgcccgctcagtcagaccgcggctcgctttcaagtgatcgtgtacaacccgcttggccgaaaagtgaactggatggtgcggctgccggtgtccgaaggggtgttcgtggtcaaggacccaaatggccggactgtgccatcggatgttgtgatcttcccatcaagcgactcgcaggcccacccacccgaactgctgttttcagcgtccctgcctgcgcttggtttttcgacgtactcagtggcacaggttccgagatggaagccacaggccagagccccgcagccaatccctcggcggtcgtggtcgccggccctcactatcgaaaacgagcatatccgcgccaccttcgacccagacaccggactgctcatggagattatgaatatgaatcagcaactcctgctgcctgtgcgacagaccttcttctggtacaatgctagcatcggggacaacgaaagcgaccaggcttccggagcttatatctttcgtccaaatcaacaaaagcctctgccggtgtcacgctgggctcagatccatctggtgaaaacccccctggtccaggaagtgcatcagaatttctctgcttggtgcagccaagtggtgagactgtacccggggcaaagacacctcgagctggaatggtcagtgggccctatcccagtcggagatacttggggaaaggaagtgatctcaaggtttgacaccccgctggaaaccaaaggccgcttctacaccgattcgaacggcagggagatccttgagcgccgccgcgactacaggcctacctggaaactgaatcaaactgaaccggtcgccggcaactactatcctgtgaacaccagaatctacatcactgatggaaatatgcagctcaccgtgctcaccgatcgctcacagggcggatcgtccctgcgggacggatcactcgagctcatggtgcaccgccgcctcctgaaagacgacggtcgcggagtgtcagaaccgttgatggagaacggaagcggcgcgtgggtccgaggccgccacctcgtgctgctcgacaccgcccaagccgcggcggcgggtcatagactcctggctgaacaggaggtcttggcgcctcaggtggtcctggcgccgggaggaggcgcggcttacaatctgggggcgccgccgcggacccagttctcagggctgcgccgcgacctgcccccgagcgtgcacctcctcacccttgcttcgtggggcccagaaatggtcctcctcagactggaacatcagtttgcagtgggagaagattcaggaagaaacttgtcggccccggtcacccttaacctgcgcgacctgttctccactttcaccatcaccaggctgcaagaaaccactctcgtcgcaaaccagctgcgggaagccgcttcaaggctgaagtggaccactaacactggcccgactccacaccagactccttaccagcttgacccggcaaacattaccctcgagccgatggaaatccggactttcttggcgtcagttcaatggaaggaggtggacgga

SEQ ID NO: 16483 - DNA, 3033 bp, Artificial Sequence
  Description of Artificial Sequence: Synthetic coding sequence
atgggcgcatacgcgagggcttcaggagtgtgtgcccgcggttgccttgattccgcaggaccatggactatgtccagggcacttagacctcctcttcctcctctgtgtttcttccttctcctgcttgcagccgcaggggcacgcgctggtggttacgaaacttgtcctactgtgcagccaaatatgctgaacgtgcatcttcttcctcacacccacgatgatgtgggatggctgaaaactgtggaccagtacttttatggcattaagaatgacattcagcatgcgggagtgcaatacatcctggactcggtgataagcgccctgctggcagatccgacccgccgctttatctacgtcgagattgcgttcttttcgagatggtggcaccaacaaacgaacgccactcaggaagtcgtgagagatctcgtgcgccagggtaggttggaattcgccaacgggggatgggtcatgaacgatgaagcagcaacccactacggtgccatcgtcgatcaaatgacccttgggctgcgttttctcgaagatacctttggtaatgatggtagaccacgcgtggcatggcatattgatcctttcggtcactcccgcgaacaagcatcgctctttgcacagatgggctttgacggctttttcttcggtcgtctcgattaccaggataagtgggtccgcatgcaaaaacttgagatggaacaagtctggagagcgtccacctcactcaaaccaccaacggcagatctgtttacgggagtcctcccgaatggctacaacccacctagaaacttgtgttgggacgtgctttgcgtcgatcaacctctggtggaagatcctagatcgcctgaatacaacgctaaagagcttgtcgactacttcctgaacgtggcaaccgcacaagggcgctactaccgcaccaatcacactgtgatgaccatggggagcgacttccaatacgaaaacgcaaatatgtggttcaagaacctggacaagttgatccggctcgtgaacgcccagcaagcgaagggttcgagcgtacatgtgctgtactcaactccagcatgttacttgtgggagctgaataaggcaaatctgacttggtcggtgaagcatgacgactttttcccttacgcggatgggccacaccaattctggactggttacttctcctcccgacccgcactgaaacgctacgagagactgtcctacaactttctgcaggtgtgcaaccaattggaggcgctggtgggactggccgccaatgtgggtccgtacggatccggggattctgccccgctcaatgaagctatggcagtccttcagcatcatgacgcggtgtcaggcactagccgtcaacatgtcgcaaacgattatgcacgccagcttgcagccggatggggaccatgtgaagtccttctgtcaaatgcgcttgcacgactccgaggatttaaggaccattttactttttgtcaacaactgaacatttccatttgtcctcttagccaaaccgcagcacggttccaggtgattgtgtacaatccactgggccggaaggtcaattggatggtgcgcctcccggtgagcgagggcgtctttgttgtgaaagacccaaacgggaggactgtgcctagcgatgtcgtcatttttccatcatcagactcccaggcgcaccccccagaacttctcttctcagcctctctgccggcactcggcttcagcacctactccgtcgcacaggtgcctagatggaaaccacaagccagagcacctcaacctatcccgagaaggtcgtggtcgcctgcccttaccatcgaaaatgaacatattcgggccacgtttgatcctgatactggacttcttatggagatcatgaacatgaaccagcagctgctcctgcctgtccggcagacctttttctggtacaatgcttccatcggtgataatgaatcggatcaggcctccggagcatacatctttaggcctaaccaacaaaagcctctgcctgtgtcgaggtgggcgcaaattcatcttgtgaaaacgccacttgtccaggaagtgcatcaaaactttagcgcatggtgttcgcaagtcgtcagactgtacccaggtcaacgccatcttgaactggaatggtcggtcggacctatccccgtcggagatacgtggggaaaggaagtgatctcgcgattcgacacccccctggaaaccaagggtcgcttttacaccgactccaacggtcgcgaaatcctcgaacgccgccgtgattacagaccgacctggaaactcaaccagaccgagccagtggcaggaaactactaccctgtgaacactcggatttacattactgatggcaacatgcagctgacggtgcttaccgatcgttcccaggggggatccagcttgagagatggttcgctcgagcttatggtccatcgccgacttctgaaggacgacggaagaggagtgtcagaacctcttatggaaaacggttcgggtgcctgggtgagaggccgacatctggtcctgctggatacggctcaagcggcagcagccggccaccggcttctggcggaacaggaggtacttgcacctcaggttgtccttgcaccgggtggtggagccgcatacaaccttggagcaccacctcgcacccaattttccggactgagacgcgatctgccaccaagtgtgcatttgctcactcttgcatcttggggacccgaaatggtgctgctcaggctggaacatcaatttgccgtgggagaggattccgggcgaaatctcagcgcccccgtgaccctcaatttgagggatctcttcagcaccttcaccattaccagactgcaagaaaccactctcgtcgcaaaccaactgcgcgaagccgcatctcgacttaagtggaccactaacactggcccaaccccacatcagaccccgtaccaacttgatccagcgaatatcacccttgagcccatggagattagaacctttttggcctccgtgcagtggaaagaagtggatggt

SEQ ID NO: 16484 - DNA, 3033 bp, Artificial Sequence
  Description of Artificial Sequence: Synthetic coding sequence
atgggagcctacgctagggcctctggtgtgtgcgcccggggctgcctggactccgctggtccctggactatgtcgcgcgcgctgcgccctccgttgcccccgctgtgctttttcctgctcctcctggccgccgccggagccagggccggaggatacgagacttgcccgactgtgcagcctaacatgcttaacgtgcacctgctgccgcatacccatgacgacgtcggatggctcaagaccgtggatcagtacttctacggaatcaagaacgacattcagcacgcgggagtgcagtacatcctggattcggtgatctcggccctgctggctgacccgactagacgcttcatctacgtggagatagccttcttctcaaggtggtggcatcagcaaaccaatgccactcaagaggttgtgcgggacctggtgcgccaagggcggctggagttcgccaatggaggatgggtgatgaatgacgaggcggccacccactacggggctatcgtggaccagatgacgctgggtttgcgcttccttgaggacaccttcggcaatgacggcagaccacgggtcgcgtggcacatcgaccctttcgggcatagcagagagcaggccagcctgtttgcccagatgggttttgacggattcttcttcggtagactggactatcaagataagtgggtgcgcatgcaaaagctggaaatggagcaggtgtggcgcgcctcaaccagcctgaaaccgcctaccgcggacctctttaccggagtgttgccgaatggttacaatccgccgcgcaacctgtgctgggatgtcctgtgcgtcgatcaaccgcttgtcgaggacccacggtcacctgagtacaatgcaaaggaacttgtggactacttccttaacgtcgcgactgcgcagggacgatactacagaaccaatcacactgtcatgactatgggatccgacttccagtacgagaatgcaaacatgtggtttaagaatctggacaagttgattaggttggtgaatgcgcagcaagcaaagggatcgtcggtgcacgtgctctacagcaccccagcctgttacttgtgggaactgaataaagcaaacctgacgtggagcgtgaagcatgacgacttctttccatacgccgacggacctcatcagttctggactggttacttctcgagccggcccgcacttaagcggtacgaaagactgtcgtacaatttcctccaggtctgcaaccagctcgaggcactcgtgggcctcgcggcgaacgtcggtccctacggaagcggcgattcagcgccgttgaacgaagccatggccgtgcttcagcaccatgacgcggtcagtggaaccagccggcagcacgtggcgaacgattatgccagacaactggccgctgggtggggaccatgtgaagtgctcctctccaatgccctcgcccgattgcggggcttcaaggaccatttcaccttctgccagcaacttaacatctccatctgccctctgtcccaaaccgcggccaggtttcaagtgatcgtgtacaacccgttgggacggaaagtgaattggatggtgcggctgcccgtctcggagggggttttcgtggtgaaggatccgaatggacggaccgtcccgtcagatgtcgtgattttcccatcgtcggactcgcaggcccatcctccggagctcctgtttagcgcttcattgccagcactcggattctccacctacagcgtggcccaagtcccccggtggaagcctcaagcccgggctccacagcctatcccacgcagatcgtggtcacctgccctgactatcgaaaatgaacatatccgggctaccttcgacccagacaccggattgctcatggagatcatgaacatgaaccagcagctgctcctgccagtgagacagacctttttctggtacaacgctagcattggtgacaacgaatccgaccaggcgtcgggcgcctacatctttcgccccaatcaacagaagccactgcctgtgtccaggtgggcccaaattcacctggtgaaaacccccctggtgcaggaagtgcatcagaacttttcggcctggtgcagccaggtggtcagactttaccccgggcagcggcatctggaattggaatggtccgtcggcccaatcccggtaggagacacctggggtaaagaggtgatctcgcgcttcgataccccgctggagactaaaggccggttctacaccgactcgaacggacgggaaatcttggaacggagacgcgactaccgaccgacttggaaactgaatcaaaccgagccggttgctggaaactattacccggtgaacacccgcatctatatcacggacgggaacatgcagctgactgtgctgactgaccggtcccaaggaggctcttccttgcgcgacggctcgctggagcttatggtccaccgcaggctgctcaaagatgacgggaggggcgtgtcggagccgctcatggagaacggctcgggtgcctgggtgcgcggaaggcatctggtgctcttggacaccgcgcaggccgccgccgccggccaccgtctgctcgccgaacaagaggtcctggctccgcaagtggtgctggcaccgggcggtggagcagcctacaatctcggcgccccgcctcgcactcaattctcgggcctccggcgggacctgccgccttcggtccatttgctcactcttgcgtcatggggaccggagatggtcctcctgagactggaacaccagttcgcggtgggagaagattcaggaaggaatctgtcagcccccgtgactctgaacctccgtgatctgttctccactttcactattaccagactgcaggaaaccaccctcgtcgccaatcagctgcgcgaggcagcttccaggctgaagtggacgacgaacaccggacccaccccgcaccaaaccccttaccagctggatcctgccaacatcaccctggaaccaatggaaattcggacttttctggcatcagtgcaatggaaggaagtggatgga

SEQ ID NO: 16485 - DNA, 3033 bp, Artificial Sequence
  Description of Artificial Sequence: Synthetic coding sequence
atgggggcctacgcccgtgcctctggagtttgcgcccgcgggtgtctagattcggcgggcccgtggaccatgtcccgtgctctgcgccctcccctaccacccctgtgtttctttctgctgctgcttgcggccgctggggcccgcgcgggaggatatgaaacttgcccaacggtccaacctaatatgctcaacgttcatctccttcctcacacacatgacgatgttggctggttgaaaacagtcgaccagtacttttacgggattaaaaatgacatccagcacgccggggtgcaatacattttggattccgtgatttccgctttgcttgccgaccctacccgaagatttatctacgtggaaatagcttttttctcacggtggtggcatcagcaaaccaatgcgacgcaggaggtggttcgcgatttagttcgccagggcagattggaatttgccaacggcggctgggttatgaacgatgaggcagccacacattacggagccattgtggaccagatgactctcgggttaagatttctcgaggacacatttggaaatgacggcaggcctcgggttgcctggcatattgacccattcggccacagccgcgagcaggcatcactgtttgcccaaatgggttttgacgggttcttttttgggcgtttggactaccaagacaagtgggtaaggatgcagaaattggaaatggagcaggtatggagggcttcaacatccctgaagccacccacagccgatctgtttactggcgtgctgccaaatgggtataacccccctcgtaatctgtgttgggatgtgctttgcgttgatcagcccctggtggaggatcctagatcccccgaatacaatgccaaggagctcgtcgactatttcctgaacgtagctacggcgcaggggcggtattacaggacgaaccataccgtgatgaccatgggtagcgactttcagtacgagaatgccaatatgtggttcaaaaacttggacaaactgattcgccttgtgaacgcacaacaagccaaaggctccagcgtccacgtcttatactccacacctgcttgttacctctgggagctcaacaaagccaatctgacctggagtgtgaaacacgacgatttctttccgtacgccgacgggcctcatcagttttggaccggatatttcagctcccggcctgcactcaagcggtacgaaagattatcttataatttcttgcaagtttgcaatcagttagaagcgctggtcggattggctgccaatgtgggcccatacggcagcggtgattcagcgcctctgaatgaagctatggcagtgctacaacatcatgacgctgtctccgggactagtcggcagcatgtggcgaacgattatgcacgccagctggccgctggatggggcccatgcgaagtactgctttctaatgctctcgcacgtctccgggggtttaaagatcactttactttctgtcaacagttgaatatcagcatctgccctctaagccaaaccgctgctagattccaggtcattgtgtacaacccactgggtaggaaggtgaactggatggtgcgccttcccgtctccgagggggtgtttgtcgtgaaagaccccaacggtaggaccgttccgtcagatgtggtaatattcccgtcctctgattctcaggctcatccgcctgagctactgtttagcgctagtttaccagccctgggattcagtacttattccgtcgcccaagttcctcggtggaagccgcaagctagggcaccacaaccaattcccaggcgtagctggagccctgccctgaccatcgagaatgaacacatccgagctacattcgaccccgacacaggtctgctgatggagatcatgaatatgaaccagcaacttctgctccctgtcaggcagacatttttctggtacaatgcctccataggggacaatgagtcggatcaagcatcaggtgcttacattttccggcccaatcaacagaagcccctgcctgtctcacggtgggcccagattcatctggtgaaaactcctcttgttcaggaagtgcatcagaacttctccgcctggtgcagccaagttgtgcgcctgtatccgggccaaaggcacctcgagctcgagtggagcgtggggcccatacctgtaggtgatacctggggaaaggaggtaatatcccggttcgacaccccattagagacaaagggcaggttctacacagatagcaatggaagagagattctggagcggcggcgggattaccgccctacctggaaactaaaccaaacagagccggtggccggcaattattatcctgtcaacacccggatctatattacagacggaaacatgcaacttacagtgctcacagatcgttctcaggggggatcaagtctgcgagacgggtcactcgagctgatggtgcacaggagactcctcaaggatgatggcaggggggtgtccgaaccactcatggagaacggttctggggcctgggtgagaggaaggcacctagtgctgttggatacggctcaggcggccgccgccggtcataggctcctcgctgagcaggaggtgttagctccccaggtcgtcctggctccgggtggaggggccgcttataatttaggcgcaccccctaggacacagtttagcggtctacggcgagacctgccaccatcggtgcatctactgactctggcttcttggggaccagagatggtcctgctgaggttggagcatcagttcgccgtgggcgaggactccggtcgaaatctgtctgcgccagtgacgctaaatttgcgcgatctttttagcacattcacaattacccgcctgcaggagaccaccctcgtcgccaaccagctcagagaggcggcttctcgcttgaagtggaccacgaacactggccccaccccacaccaaactccttatcagctggaccctgccaacattaccctggagcccatggagattcggacgtttctggccagtgttcagtggaaagaagtggatgga

SEQ ID NO: 16486 - DNA, 3033 bp, Artificial Sequence
  Description of Artificial Sequence: Synthetic coding sequence
atgggagcttatgcccgagcctcaggcgtgtgcgcccgcggttgtctcgacagtgcggggccgtggactatgtctcgggctctgcggccccctttgcctccattgtgcttcttcctgctcttactggcagcagctggggctcgagcaggcgggtacgaaacctgccccacagtccagccaaatatgctgaatgtgcacctgctcccacacacccacgatgacgtggggtggctgaaaacagtcgatcagtacttctacgggatcaaaaacgacatccagcacgccggcgtccaatacatactggattcggtgattagcgccctgctcgccgaccctacacgaaggttcatctacgtagaaattgcgttcttctcccggtggtggcatcagcaaactaatgcaactcaggaggtcgtccgggacctggtgaggcaagggagactcgagttcgccaacggagggtgggtgatgaatgatgaagccgccacacactacggtgccattgttgatcaaatgacccttgggctaagattcctggaggatacatttgggaacgacgggcgcccccgggttgcatggcacatcgatcctttcggacactcacgagagcaggcgtctttgttcgcccaaatgggctttgatgggttctttttcggaaggctcgactatcaggataagtgggttaggatgcagaagctggagatggagcaggtttggagagccagcaccagccttaaaccacctactgccgatctctttaccggagtgctgcccaacgggtacaatcctccccggaacctatgttgggacgttctgtgcgtggatcagcccctagtggaagatccccgttctccagaatacaacgcaaaggagctggtggactacttcctgaatgtggctaccgctcagggaagatattatcggaccaatcacaccgtgatgacgatggggagcgattttcagtatgagaacgccaacatgtggttcaaaaatctcgacaaactgatccgcttggtgaacgcgcagcaggccaaaggttccagtgtgcatgtgctgtatagcacccccgcttgttatctgtgggagctgaacaaggctaacctgacatggtctgttaagcacgatgatttcttcccatatgcagatgggccacatcagttttggactggttatttcagttcacggccagcacttaagaggtacgagcggctctcctacaattttttgcaggtctgcaatcaattggaggctctggtcggactcgcagccaacgtgggaccctatggatctggcgattccgctcccctcaacgaggccatggcagtactacagcaccacgatgctgtttccggtacctctcgccagcatgttgctaacgactatgcccgccagctggccgccggatggggcccttgtgaagtccttctgtccaatgctcttgctaggctgcgagggtttaaagatcacttcaccttctgtcagcagctcaacatcagtatttgccccctgtctcaaactgcggctagattccaagtaatcgtgtataacccgcttggtcgcaaagtgaactggatggtgcgattgcctgtgtcagagggagtgttcgtcgtcaaagaccccaatggtaggacagtgccatcagatgttgtgatcttccctagctctgactcacaggcccaccccccggagctactgttcagcgcgtccctgcctgccttgggcttttcaacttactctgttgcccaggttccacgctggaaaccacaggctagagcaccccagccaatccctcgaagatcttggtcaccggctctgacaatcgaaaatgagcacatcagagccaccttcgatccagacaccggcctcctgatggagatcatgaatatgaaccagcaactcttgctccccgttagacaaacttttttttggtataacgcctccatcggtgacaatgagtctgatcaggccagtggcgcctacattttcaggccaaatcaacagaagcctctccctgtgagccgctgggcccagatccatctggtcaagaccccattagtgcaggaggtgcatcagaatttctccgcctggtgtagccaggtagtacgcttgtatcctgggcagcgccacctcgagctggagtggagcgtgggaccaatccctgttggggatacctgggggaaagaagtgatctcaagatttgacactccacttgaaacaaagggccgtttctatacggattcaaatgggcgggagatcctcgagaggagacgtgattaccgcccaacgtggaagctgaaccaaaccgagccagtcgcgggcaattattatccggtgaataccagaatttatataacagacggaaacatgcagctgaccgtgctcaccgacaggagccagggaggctcttcacttagggatggcagtctggagctaatggtgcatcgaagattgctgaaagatgatggaaggggcgtgtctgaaccccttatggagaatggctctggcgcctgggtgcgaggaagacacctggtcctgctcgacacggcccaggcagccgccgctggccacaggcttctcgcagaacaagaagttttagctcctcaagttgtgttagcccccggaggcggggctgcctataatttgggggccccgccaaggacccagttttcaggcttgaggcgggacctgccccctagcgttcatctgctaaccctggcctcctgggggcctgagatggtcctcctaaggctggaacatcagtttgccgtgggagaagatagcggaaggaatctgagcgcgcccgttacgctgaatctacgagaccttttctccactttcactatcacccgtttacaggaaacaacactggtggccaaccagttgagggaggctgctagtcgactgaagtggacgaccaacacagggcctacaccccatcagacgccatatcaattagaccccgccaatatcacattggagccgatggaaattcggacatttttagcttctgtgcaatggaaggaggtggatgga

SEQ ID NO: 16487 - DNA, 3033 bp, Artificial Sequence
  Description of Artificial Sequence: Synthetic coding sequence
atgggggcatacgctcgagcaagcggcgtgtgtgctagggggtgtctggacagtgctgggccgtggaccatgtctagagctctccggccgccacttcccccattatgcttcttcctgttgcttttggccgcagcaggagcgcgggccgggggttacgaaacctgccccacagtacagcctaacatgttaaatgttcacctgctccctcacacacacgacgacgtcggatggctgaagaccgtggatcagtatttctatggaatcaaaaacgatattcagcacgccggcgttcagtatatccttgacagcgtgatttcggccctgcttgccgatcctacgcggagattcatctatgtagagattgccttcttttcacgctggtggcaccaacagactaacgccacccaggaggtggtccgggatctggtgaggcaaggacgactagagttcgcaaatggcggttgggttatgaatgatgaggccgctacgcactacggggcaattgtggaccagatgaccctggggctgcggtttctcgaggacaccttcggaaacgatggccggccgagggtggcctggcacatcgacccctttggacacagtagagaacaagcttcattattcgcccaaatggggttcgacgggttttttttcgggcggctggattatcaagacaagtgggtgagaatgcagaagctggagatggaacaggtgtggcgtgccagtacatcgctcaagcctccgaccgcagacctgttcaccggagtgttgcctaacggttacaatccaccacgaaatctgtgctgggacgtcctttgcgtagaccagcccttagtcgaagacccaagatcccctgaatataacgccaaagagctggttgactattttttgaatgtagctacagctcaggggagatattacaggactaatcacacagtgatgacgatgggctcagacttccaatatgaaaatgctaatatgtggtttaagaatctggataagcttattagactggtgaacgctcagcaggccaagggctcttcggtgcacgttttatatagtacgcctgcctgttatctgtgggagctcaataaggccaatctgacgtggagcgtgaagcatgatgacttcttcccttacgccgatggaccgcatcagttctggaccggttactttagctctcgccctgctttgaaacgatatgaaaggctttcctacaactttctgcaggtgtgcaatcagctcgaggcgctggtgggacttgccgcgaatgttggcccatatggctcgggagattccgctccacttaacgaggccatggctgtcctccagcatcatgatgccgtctccgggacatccaggcaacacgttgccaacgactacgccagacagctggcagccggttggggtccatgcgaggtgctgctgagcaatgcgttggcacggctccggggctttaaagaccatttcactttctgtcagcagttgaatatttctatctgtccgttaagccagaccgctgctcgcttccaggtgattgtgtacaatcctctgggacgcaaggttaattggatggtacggctccccgtgagcgagggagtattcgtcgtaaaagatcctaatggaaggactgtgcccagtgatgtggttatctttccttcgtctgactcacaggctcatcccccggagctgctgtttagtgcctccctgcccgcgttgggcttctctacgtatagcgttgcccaggtgcctaggtggaaaccccaggcacgggcccctcagcccattccaagacgctcctggtcaccagcgctcacaattgagaatgaacacatccgagcaactttcgaccccgacaccggccttctgatggagatcatgaatatgaaccagcagctcctcctgcccgttaggcagactttcttttggtacaatgcgagcatcggtgacaacgagtcagaccaggcttccggtgcctacatttttaggcctaatcagcagaaacctctgcccgtctccagatgggcacagattcatctcgtgaagacccccttggtgcaggaggtgcaccagaacttctccgcttggtgttcacaggtagtcaggttatatccaggacagaggcacctggagttggaatggtcagtggggccaattccagtaggggacacatggggtaaggaggtgatctccagatttgataccccgctggagaccaaaggacgcttttatacagacagtaacgggagagaaatactagagcggagaagagactaccgtcccacatggaagctgaaccagacagagccagtggcaggcaactactatcctgttaacacacgcatatatatcaccgacggcaacatgcagctgacagtactgactgatagatctcagggcggttcttccctgcgggacggatctctggaattgatggtgcaccggcgcctgctcaaggatgacggaagaggcgtctctgagcctctgatggaaaatggcagcggcgcatgggtccgtggccgacatctagtccttttggacacggcccaggctgccgcagctggccaccgactgctggcggagcaggaggtgctggcaccacaagttgtcttggccccgggaggtggggctgcctacaatttgggggcaccacctaggactcagttcagtgggcttcgtcgcgacctcccacccagcgtgcacctgctcacactcgcctcttgggggccagagatggtactgttaagattggagcaccagttcgctgtaggagaagattcagggcgaaaccttagtgcgccggtgactctgaaccttagagacctgttctcgacgttcaccattacccgccttcaagaaaccacattggtggccaatcagctgcgggaggcggcgagtcggcttaagtggaccacaaacaccggtcccacacctcaccagaccccgtaccagttggatccggctaatatcacccttgaacctatggaaatcaggacatttctggcaagcgtccagtggaaggaggttgatgga

SEQ ID NO: 16488 - DNA, 3033 bp, Artificial Sequence
  Description of Artificial Sequence: Synthetic coding sequence
atgggtgcgtacgctcgtgcatctggggtctgtgcaaggggatgtctggattcagcggggccttggactatgagccgtgctttgcgccctccattgccaccactctgttttttccttcttctgctggcagcagcaggtgcacgcgccggaggctacgaaacctgccctactgtgcaaccaaatatgctgaatgtgcatctgctgccccatacccatgatgatgtgggttggttgaaaactgtggatcagtacttttatggcattaagaacgatattcaacatgcgggcgtgcagtacattctggacagcgtgatttccgcactcctggcagatcctactcggcgtttcatttatgttgaaattgccttcttttcccggtggtggcatcaacagaccaacgcaacccaagaggtcgtgagagatctggtccgccaaggacgactggaattcgcaaacggaggttgggtcatgaacgacgaggccgcaactcattacggggcaattgtggatcaaatgaccctggggctccggtttcttgaagatacttttggaaatgatggacggcctcgagttgcatggcacattgaccccttcggccattccagggaacaagcgtccctgtttgctcaaatgggattcgacggatttttcttcggaaggctcgattaccaagataagtgggtgagaatgcagaaactggaaatggaacaggtgtggcgcgcttcgacttccctgaagcctcccactgctgacctttttactggtgtgctgcctaacggctacaacccacctagaaacctgtgttgggacgtgctctgtgtggaccagcccctggtggaagatcctcggtcccctgagtacaacgcaaaggaacttgtcgactactttcttaatgtggcaactgcccagggaagatactaccgcactaaccatactgtcatgaccatgggatcggatttccaatacgagaatgcaaatatgtggttcaagaacttggacaagctcattcggctggtgaatgcacagcaagcaaaaggatcaagcgtgcatgtcctctactcgaccccagcatgctacctttgggaactgaataaggcgaatcttacttggagcgtgaagcatgacgatttcttcccttatgcagatggacctcaccaattttggaccggttacttttcctcacggcctgcacttaaacgctacgaacgcctgtcatataactttctccaggtgtgtaaccaacttgaagcacttgtgggccttgcagcaaacgtggggccatacggttcgggcgattctgcaccacttaatgaagcaatggcggtgctccaacatcatgatgcagtgtcgggaacctcgcgccagcatgtggcaaatgactatgcgagacaactcgcagcagggtggggtccttgtgaagtgctgctttccaacgctctggcgcgcctccggggatttaaggaccatttcaccttttgtcaacaactgaacatctccatctgtcctctgtcgcagactgcagccagatttcaggtcatcgtgtataacccccttggaaggaaagtgaactggatggtgagactgcctgtgtccgaaggagtctttgtggtgaaggaccctaatggccgaactgtcccatcagatgtggtcatatttccctcgtcggacagccaagcccatccgcctgaacttcttttctcggcaagcctgcccgcgctgggtttttcgacctacagcgtggcacaagtccctagatggaagccacaggcacgggccccacaacctattcctagacgctcgtggagccctgcgctgactattgaaaatgaacacatcagagccacctttgacccagataccggacttctcatggagatcatgaatatgaatcaacagcttctgctgcccgtgcgacagactttcttttggtacaatgcatcgatcggcgacaatgaatctgatcaagcctcgggtgcttacatcttcagacctaaccaacaaaagccattgccagtctcgcggtgggcgcaaatacatctggtgaaaactccgttggtgcaggaagtccaccaaaacttttcagcatggtgtagccaggtggtgcgtctgtaccctgggcaacggcatcttgagctggaatggtccgtgggtcctatccctgtcggagatacctggggtaaggaagtcatttcaagatttgacactccactcgaaaccaagggacgtttctacaccgattcaaatggaagagaaattcttgagagaaggcgggattaccgccccacttggaaactgaaccaaaccgaaccagtggccgggaattactaccctgtcaacaccagaatttacattaccgatggcaacatgcagcttaccgtgcttactgatagatcacaaggaggatcgtcgcttcgggacggatcgcttgaactgatggtgcaccgacgtctgctcaaggacgacggacgcggagtgagcgaaccgctcatggaaaacggttccggtgcatgggtgagaggccggcatctggtcctccttgacactgctcaagccgcggcagcaggacaccggctcctggccgaacaggaagtgctggcaccacaggtggttctcgcacctggaggtggcgcagcatacaatctgggagcgcctccacggactcagttttccggtctgcgcagggatctccccccatcagtgcatctcctgactttggcatcgtggggacctgaaatggtgctcctccggttggagcatcaatttgcggtgggagaagattccgggcggaatctgtcagcccccgtgacgcttaaccttcgcgacctcttttccaccttcactataactcgtctccaggaaacgaccctggtcgcgaaccaactgcgggaagcagcatcccgactcaagtggaccactaacaccggtcctaccccccaccagaccccataccaacttgatcctgccaatatcacgctcgaaccgatggagattaggacgtttctcgcgtccgtccaatggaaggaagtggatggt

SEQ ID NO: 16489 - DNA, 3033 bp, Artificial Sequence
  Description of Artificial Sequence: Synthetic coding sequence
atgggagcctatgcgcgcgcgtcaggggtgtgtgcgcgcggttgcctggactccgccggcccgtggactatgtcgagggcacttcggccgccgctgcctcccctctgcttctttcttctgttgttggccgccgccggggctcgggcgggtggatatgaaacctgcccgaccgtccagcctaacatgctcaacgtgcacctgctgccacatacgcacgatgatgtgggttggttgaaaactgttgatcaatacttctacggaatcaagaatgacatccagcacgcaggagttcaatacatcctggattccgtaatttccgcactgttggctgatccgactcgccgcttcatctacgtggaaatcgccttcttctcccgctggtggcatcagcagacgaatgccacccaagaagtggtgcgggacctggtccggcaggggagactggaattcgccaacggcggatgggtcatgaacgacgaagcggccactcactacggcgcaatagtcgaccaaatgaccctgggacttcgcttcctcgaggatactttcggaaatgacggacgccctcgagtcgcctggcacattgacccgtttggacactcccgggagcaggcctctctgtttgcacagatgggattcgacggctttttcttcggacgcctggattaccaagacaaatgggtccgcatgcagaagctggagatggaacaggtgtggagagcgtcgacctcgctgaagccaccaacggcagacctctttactggcgtgctgcctaacgggtacaacccgccgcgcaatctgtgttgggatgtgctgtgcgtcgatcagccgcttgtggaagatcctcgctccccggaatacaacgcgaaggagctcgtggattactttctgaacgtggctacggcccaggggcggtactaccgcaccaaccacactgtcatgaccatgggaagcgacttccagtacgagaatgcaaatatgtggtttaagaacctcgataagctcatcaggcttgtgaacgcccagcaagccaagggctcgagcgtgcatgtgctgtactccaccccggcatgctacctctgggagttgaacaaggcaaatctgacctggagcgtaaagcatgatgatttctttccctacgcggacggaccgcaccagttctggaccggatatttctcatcgcgacccgccctgaagcgctacgagaggctgagctacaatttcttgcaggtttgcaatcaactggaggcccttgtcggattggccgcaaacgtcggtccatacggaagtggcgactcggcacccctcaatgaggccatggcggtgctgcaacatcatgacgcagtgagcgggacctcccggcagcatgtggcgaacgattacgcgcggcagctggcggccggatgggggccgtgcgaggtgctgctctccaacgccctcgcacgcttgcgaggcttcaaagaccattttaccttttgtcagcaactcaacatatcgatttgccctctgagccaaactgctgccagatttcaggtgatcgtctacaatcctctgggaagaaaggtgaattggatggtgcgtctcccggtgtccgaaggcgtgttcgtcgtcaaggacccaaatggcaggactgtgccatctgatgtggtgatcttcccgtcgagcgactcacaggctcacccaccggaactcctgtttagtgcctccttgcccgctctgggtttctccacctattctgtggcccaggtgccgcggtggaagccacaggcccgcgccccacaaccgatccctcggcggagctggtcgccggccctgactatcgaaaacgagcacatcagggcgaccttcgatcctgacaccggccttctcatggaaatcatgaacatgaaccagcagctgctcctcccagtgagacagactttcttttggtacaacgcctcaattggagacaacgaatcggaccaggcttcgggtgcctacatcttcagacccaatcagcaaaaaccgctgccagtctccaggtgggcacagatccacttggtaaaaaccccgctggtccaggaggtacatcagaacttctcggcgtggtgcagccaagtggtgcgcctttaccccgggcagagacatcttgagttggaatggtcggtgggtccaatcccggttggagacacttggggaaaggaggtgatctcacgcttcgacaccccccttgaaaccaagggtagattctacactgactcgaacggccgagaaatcctcgaacggcgtcgcgactacagaccgacctggaaactgaaccaaactgaaccagtggctgggaactactaccctgtgaatactcggatctacattacggatggcaatatgcaactgaccgtgttgactgatagatcacagggcggaagctcgctcagggatggctccctcgagctgatggtgcaccgtcggctgttgaaggatgacggtcgaggggtgtcagaaccgctcatggaaaatggatcgggggcgtgggtgcggggcagacacctcgttctcctcgacaccgctcaggcggccgcagcaggacaccgcctcctggcggagcaagaggtcctggccccacaagtggtccttgctccgggaggtggagcggcttacaatctgggagcgccaccacggactcaattcagcggactccggagggacctgccgccttcagtgcatctgttgaccctggccagctggggaccagagatggtacttctgcggttggaacaccagttcgcggtgggagaggactcaggaaggaacctctccgctcctgtcactctcaacctgcgtgaccttttctccactttcactattacgagactgcaggaaacgacgctcgtcgctaaccaacttcgtgaggccgcttcgcgcctgaaatggaccactaatactggccctaccccccaccaaactccgtatcaactcgacccggccaacatcaccctcgagccaatggaaatcagaaccttccttgcatccgtgcagtggaaggaagttgatggg

SEQ ID NO: 16490 - DNA, 3033 bp, Artificial Sequence
  Description of Artificial Sequence: Synthetic coding sequence
atgggagcatacgccagagcatcaggtgtgtgcgcccggggatgccttgactcggcaggaccgtggaccatgtcgagggcgctcagacctccgttgcccccgctgtgtttcttcctgctgttgcttgcagcggccggggccagagcaggtggttacgaaacctgcccgactgtgcaaccaaacatgctgaatgtccatctcctcccacacacgcatgacgatgtgggatggctcaagactgtggaccagtacttttacggaatcaaaaatgacatccagcatgccggggtgcagtacatcctcgactcagtgatctccgcacttttggcagatccaacgcgacggttcatctacgtggaaatcgcttttttctcgcggtggtggcatcaacaaactaacgccacccaggaggtggtgagggacctcgttagacaaggccgcctggagttcgctaacggaggatgggtgatgaacgatgaggcggccacccactatggggctatcgtggatcagatgactctggggctccggttcctcgaggacactttcggcaatgacggccgcccgcgggtcgcctggcatatcgaccccttcggtcacagcagggagcaagcctcgctgttcgcccaaatgggattcgatggatttttcttcggacgcctggattaccaggacaagtgggtgcggatgcagaagttggagatggaacaggtgtggcgggcttccacttcccttaagccccctaccgcagatctgttcactggagtccttccaaatggctacaatccacctcgcaacctgtgctgggacgtgctctgcgttgatcaaccactggtggaggacccccgctcgccggagtacaacgcgaaggaattggtcgactacttcctgaacgtggccactgcccagggaaggtactaccggactaaccacactgtgatgacgatgggctcagatttccagtacgaaaacgcgaatatgtggttcaaaaacctggacaaactgatccggctggtgaacgcgcaacaggcgaagggatcgtcggtgcacgtgctttactccactcctgcttgctatctgtgggaacttaacaaggcgaatcttacctggtcagtgaagcacgatgacttttttccgtacgctgacggccctcaccaattctggaccgggtatttcagctcccggccggccctgaagcggtacgaaaggctctcgtacaactttctgcaagtttgcaaccagctggaggctttggttggactggctgccaacgtgggcccgtacggctcgggcgactccgctccgctcaacgaagcgatggccgtgctgcagcatcacgatgccgttagcggaacctcgagacaacacgtggccaacgattacgcccgccaactcgctgccggatggggaccgtgcgaggtgctgctgtctaacgctctcgcacgcctgcgcggtttcaaggaccatttcactttctgccaacagctgaacatcagcatatgcccactctcccagactgccgccagattccaggtgatcgtgtacaacccgctgggcagaaaggtgaattggatggtgcgcctgccggtgtccgaaggagtgttcgtggtgaaggacccaaacggccggaccgtgccatccgacgtcgtgattttcccgtcatcggatagccaggcgcatccgcctgagctgctcttttcggcatcgctgccagcgctcggatttagcacctactcagtggcccaagtgccgcggtggaagccgcaggcacgggcaccgcaaccgatccctagaagatcatggtcgccagccctgactattgagaacgaacatattagggccacctttgacccggataccggcctgttgatggaaatcatgaacatgaaccagcaactgctcttgcccgtgcgccagacgtttttctggtacaacgcgtccatcggcgacaacgaaagcgaccaagcgtccggagcgtatatctttagacctaatcaacaaaagccacttccagtgagcagatgggctcaaatccaccttgtcaagaccccgctggtccaggaagtgcaccaaaacttctcggcctggtgctcacaagtggtgcggctgtacccgggacaaaggcatctggaactggagtggagcgtcggaccaatcccggtgggcgatacctggggtaaggaagtgatcagccggttcgacacccctcttgaaactaagggacgcttttacactgatagcaatgggcgtgaaatcctggagcggcgccgcgactacagacccacttggaagctcaaccaaacggaacccgtcgccggcaattactaccctgtcaacacgcgcatttacatcaccgatggaaatatgcagctgacggttctgaccgaccgatcgcagggcggatcatcattgagagacggctcccttgagctgatggtccataggagactgctcaaggatgacggacgcggtgtgtccgaaccgctgatggaaaacggctcaggggcatgggtgcgcggacggcacctcgtcctcctggacaccgcacaggccgccgctgcaggccaccggctcctggccgaacaagaggtcctggcgcctcaggtggtgctcgcaccaggaggaggggcggcctacaacctcggggccccgccgcgcacccaattctcgggactgaggagggatctcccgccatccgtgcacctcctgactctggcatcctggggccccgaaatggtgctgttgagactggagcaccagttcgcggtcggggaggacagcggacgcaacctctccgcaccagtgactctgaatctgcgggacctcttctcgactttcaccatcactaggctgcaagaaaccacccttgtggccaaccaactgcgggaagcagcatccagactgaaatggaccacgaataccggcccaactccacaccaaaccccataccagttggatccggcgaacattaccctggagccgatggagatcaggacctttctggcctccgtgcagtggaaagaagttgacggg

SEQ ID NO: 16491 - DNA, 3033 bp, Artificial Sequence
  Description of Artificial Sequence: Synthetic coding sequence
atgggagcctatgctcgcgcttctggcgtctgtgccaggggatgccttgactcagctggcccttggacaatgtctagggctttgcgcccccccttgccccctctgtgtttttttctcctgttgctggctgccgctggcgctagggccggtggatacgaaacctgcccaactgtccaacccaacatgctgaacgtgcacctgctgcctcatacacacgacgatgtgggttggctcaagacagtggaccagtatttctacggtatcaagaacgatatacagcatgctggagtgcagtacatcctggactctgttatatccgctttgctggctgacccaaccaggagattcatatacgttgagatcgctttcttttccagatggtggcatcagcagactaacgccacccaggaggtcgtacgtgacctggtccgccaaggcagacttgagttcgctaatggtggctgggtcatgaacgacgaggctgctacacactacggcgcaattgttgaccagatgactctcggtcttcgtttcctcgaggatacctttggaaatgatggacgcccccgtgttgcatggcacatcgatcctttcggccattctagggaacaggctagcttgttcgcccagatgggattcgacggttttttcttcggccgtctggattaccaggacaaatgggtccgtatgcagaaactggaaatggaacaggtgtggcgcgccagcacaagcctcaaacctcccactgccgacctgtttactggcgtcctgcctaacggttacaaccctcccaggaacttgtgttgggatgtgctgtgcgtagatcaacctctcgtcgaggatcccagatctcccgaatacaatgctaaggagctggtggactattttctgaatgtggctaccgcccaaggtaggtactacagaacaaatcacactgttatgaccatgggatcagacttccaatacgaaaacgctaacatgtggtttaaaaaccttgacaagctcatcaggctggtaaacgctcaacaggctaagggctcatccgtccatgtgctctattccactccagcttgctacttgtgggaactcaataaggccaacttgacctggtctgttaaacatgatgacttcttcccatacgctgatggcccccaccagttctggaccggttacttctcctcacgccctgctctgaagcgttatgagagactgagctataacttcctgcaggtgtgtaatcagctggaagccttggttggtctcgccgctaacgttggaccttatggaagcggcgacagcgcacccctgaacgaggctatggcagtgctgcaacatcacgatgcagtttcaggcaccagcaggcagcacgtggccaacgattatgcacgtcaattggcagccggatggggtccatgtgaagtgctcctgtccaacgccttggcaaggctgcgtggattcaaggatcacttcaccttctgccagcaactgaatattagtatctgccctctctctcagacagcagcaagattccaagtcatcgtatacaatccactgggaaggaaagtgaactggatggtgaggctgccagtttcagagggcgtctttgtggtcaaggaccccaacggtcgtactgttccatccgacgtggtcattttccccagtagcgattctcaggctcacccccctgaactgctgttctcagcctctctgcccgcattgggctttagtacctattccgtggctcaagtcccccgttggaagccacaggcaagagctccccagcccatccccagaaggtcctggtcacccgcccttacaatcgagaatgaacacatcagagcaacctttgacccagacaccggtctcttgatggagattatgaatatgaaccagcaattgctcctccctgtgagacagaccttcttttggtacaacgcctccattggtgacaacgaaagtgatcaggccagtggtgcttacatcttcagacctaatcagcagaagcccttgcccgtctctaggtgggcacagatccatctcgtcaagacacctctggtacaagaggttcaccagaatttcagtgcctggtgctcacaggttgtaagactttacccaggccaacgccaccttgagctggaatggagcgtcggacccatcccagtgggcgacacctggggaaaggaagtgatctcccgttttgatacccccctggagaccaagggaaggttctatactgattcaaacggacgcgaaatcctggaaagaagacgtgactaccgccccacctggaagcttaaccagactgagccagtagctggaaactactacccagttaacacaaggatctacatcactgacggaaatatgcagttgactgtgctgactgaccgtagccagggtggtagctccctgcgcgacggaagcctggaactgatggtacatcgtagactgctgaaggacgacggcagaggcgtcagcgaaccattgatggaaaacggcagcggtgcttgggtgcgtggtagacatctggtgcttctcgacaccgcccaagcagctgctgcaggccatagattgctggctgagcaggaagttttggcacctcaggtcgtcctcgctccaggaggtggcgccgcttacaacctgggtgcacctccacgtactcaattctcaggcctgcgtagggacctgcctccttccgtgcacctgcttactctcgccagctggggtccagaaatggttttgcttaggttggagcatcagttcgccgtaggtgaagatagcggccgtaatctttccgctccagtcaccttgaatcttcgtgatttgtttagtactttcacaatcactcgcctgcaggaaactacacttgttgccaatcaactgagagaggctgcctcacgcctcaagtggaccactaacactggaccaaccccccaccaaaccccataccaattggaccctgcaaatattactctcgagccaatggaaattcgtacattcctcgcttctgtccaatggaaagaagtggatggc

SEQ ID NO: 16492 - DNA, 3033 bp, Artificial Sequence
  Description of Artificial Sequence: Synthetic coding sequence
atgggagcctacgccagagcgtcaggcgtctgtgctcgcggctgcctggactcagcggggccgtggaccatgagccgggcgctgcgcccgcctctcccgcctctgtgctttttcctgttgctcctcgcggccgctggggcccgcgccggaggctacgaaacctgcccgaccgtccaaccaaacatgctgaatgtgcacctcttgccgcatacccacgacgacgtgggatggcttaagactgtggaccaatacttctacgggattaagaacgacattcagcacgccggggtgcagtacatccttgactcggtcatctctgctttgctggcggacccgacccgcagattcatctacgtcgagatcgccttcttctcgcgctggtggcaccagcagaccaacgcgacccaggaagtcgtgcgagatctggtgcgccagggccggctggaatttgccaatggaggatgggtgatgaatgacgaggcagctactcattacggtgctattgtggaccagatgactctgggactccgcttccttgaggacacgttcggcaacgacggcagaccgagagtggcctggcatatcgacccatttggccactcgagggagcaggcatccctctttgctcagatgggattcgacgggtttttctttgggaggctcgactaccaagacaagtgggtgcgcatgcagaagctggaaatggagcaagtctggcgggcgtcgactagcctgaagccgccgaccgcggacttgttcactggcgtgctgcctaacggctacaacccgccgcggaacctgtgctgggatgtgctctgcgtggaccaacccctggtcgaggaccctcgctcaccagaatacaacgctaaagagctggtggactatttccttaacgtcgcaacggcacagggtcggtactacagaactaatcatactgttatgaccatgggatccgattttcaatacgaaaacgctaacatgtggttcaagaacctggacaagctgatccggctcgtgaatgcccagcaggccaagggttcatccgtccatgtgctctattccacgccagcctgttacctgtgggaactgaataaagcaaacttgacctggagcgtgaaacacgacgatttcttcccttacgcggacggtccgcatcagttttggacgggatacttctcgtcacggccggctttgaaacggtacgaaagactctcatacaatttcctgcaggtgtgcaatcaactcgaagctctcgtcggcctggcagccaacgttggtccgtacggatcaggagattcggcaccgctgaacgaggcaatggccgtgcttcaacaccacgacgccgtgtcaggcacctcgcgccagcatgtcgccaacgactacgcgcgccagctcgctgctgggtgggggccgtgcgaagtgctgctgtccaacgcactggcacggctgaggggattcaaagaccattttaccttttgccagcagctgaacatttccatctgcccgctgtcgcaaaccgctgcgcgattccaagtgatcgtgtacaaccccctcgggcgcaaagtgaattggatggtccgcctgccggtcagtgagggagtgttcgtggtgaaggaccccaacggaagaactgtgccgtcggatgtggtcatcttcccatcctcggattcgcaagcgcatcctccggaattgctgttctccgccagcctcccggcgctgggattttccacctactctgtggcccaagtcccgaggtggaagcctcaggcgcgcgccccgcagccaatccctcgccgcagctggagcccagcactgactatcgagaatgagcacatccgcgccactttcgacccagatactggcctgctgatggaaatcatgaacatgaatcaacagctgctgttgccggttcggcaaactttcttttggtacaacgcatcaattggggacaacgagtcggaccaagcgtcaggggcctacatctttcggccaaaccaacagaaaccgctcccggtatcaagatgggcccaaatccatctggttaagacccccctcgtccaagaagtgcaccagaacttcagcgcctggtgcagccaggttgtgcggctgtacccaggtcaacggcatctggagctcgagtggtcagtcggcccaatccctgtgggcgacacttggggaaaggaagtgatctcccgcttcgacaccccattggaaactaagggtagattctataccgactcaaatgggcgcgagatcctggaacggcgccgcgattacagaccgacgtggaagctgaaccagactgagccagtggcagggaactactacccggtgaatacgagaatctacatcaccgacggtaatatgcagcttactgtcctgaccgacaggtcccagggaggctcgtccctgcgggacgggagcctggaactgatggtccaccgaaggctgctgaaggacgacggtcggggagtctcggaaccactcatggagaacggctccggagcgtgggtccgcggccgccatctggtgcttctggatacggcacaggcggccgccgccggtcatcggctgttggcggagcaagaagtgctcgccccgcaggtggtgctggcccccggtggtggtgccgcgtataatctgggcgctccaccgcgcactcaattctccggactgagacgcgacctgcctccgagcgtgcatctcctgactttggcttcgtggggaccggaaatggtgctgctgcggctggaacaccaattcgcggtgggagaagattcgggacgcaatctctcggcgccggtgaccctgaatctccgagatctgttctctaccttcactatcactcgcctccaggagactaccctcgtggcaaatcagctcagagaggccgcctcacgcctgaaatggacgactaacaccggaccgaccccgcatcagaccccttaccaactggacccagctaacattactctggaaccgatggagatccggaccttcctggcctcagtgcagtggaaggaggtggacggt

SEQ ID NO: 16493 - DNA, 3033 bp, Artificial Sequence
  Description of Artificial Sequence: Synthetic coding sequence
atgggggcctacgcacgcgctagtggggtgtgcgctcgcggatgtctcgattctgctggaccctggactatgagtcgggctctgaggccacctctcccaccactctgttttttcctactcctgcttgcggctgcaggagctcgtgctggggggtatgagacatgtcccacagtgcagccaaacatgctaaacgtgcatctcttaccacacactcatgatgatgtcgggtggctgaaaacagttgatcagtatttctatggaataaaaaatgatatacaacacgctggagtgcagtacatacttgattctgtgatcagtgctctgctcgcagatcctacaagacggtttatctacgtagagatcgctttcttttctagatggtggcatcagcagacgaatgctactcaggaagtggttcgggatcttgtaagacagggaagactcgagtttgctaacggaggatgggtaatgaacgatgaagccgcgactcactatggagcaattgtcgatcagatgacacttggactcagattcttagaagatactttcgggaacgatggacggccccgagtggcttggcatatcgatcctttcgggcattctagggaacaggccagtcttttcgcacagatgggatttgatggattcttttttggacgcttagactaccaggacaagtgggttcgaatgcagaaattagaaatggaacaggtgtggcgggcctccacttctctaaaacctcctacagccgacctcttcactggagtgctacctaacgggtataatccccctcgaaacctgtgctgggatgttctgtgcgtggaccaacctctcgttgaagatccaagatcccctgaatacaatgccaaggaacttgtggactatttccttaatgtagctacggcccaggggaggtactatcgaactaatcatactgtaatgacaatgggatctgatttccagtatgaaaacgctaatatgtggttcaaaaatctagataaactcattagactagttaacgcccagcaggctaagggatcctcagtccacgtcctatatagtactcccgcctgttacctatgggaattaaacaaagcaaaccttacttggtccgtcaagcacgacgatttcttcccctatgccgatgggcctcatcagttttggactgggtattttagtagtcgccctgccctaaagaggtatgaaagactttcttataattttctccaggtctgcaatcagctcgaagcattagttgggctcgccgcaaatgtggggccttacgggtccggggattccgcccctctgaacgaggcaatggcagtcctccagcaccacgatgcggtgagtggaacaagtagacagcatgtagccaatgattatgctagacagctggctgccggatggggaccatgtgaagtcctcctgtctaatgcactggctcgcctccggggattcaaagatcactttacattctgccaacagcttaacatatccatctgcccattgagtcagactgctgcaagatttcaggtgattgtgtacaatcccctcggacggaaagtaaattggatggtacgactgcccgtctcggaaggggttttcgtagtgaaagatcctaatgggcgaactgtgccctccgatgtggtgatattcccctcaagtgattctcaggctcacccccctgaactcctcttctccgcttcactcccagctctcggattttctacatattcagttgcacaggttccacgatggaaaccccaggcccgcgcaccccagccaatacctagacgctcatggtcccccgcgttgactatcgaaaacgaacacatcagagccacattcgaccccgatactgggcttctaatggaaatcatgaatatgaaccagcagttactgctccccgtgaggcagacatttttttggtataacgcctctatcggagataatgaatccgaccaggcaagtggagcttatatcttccgccctaaccagcagaaaccccttcctgtgtcccgctgggcccagatccaccttgttaaaactccactcgtccaagaggttcaccagaacttcagtgcatggtgttcccaggttgtgcgactctatccaggacagagacatttagaattagaatggtccgtgggaccaattcctgtgggagacacatgggggaaggaagtgatctcccggttcgatacaccacttgaaacaaaagggaggttctatactgattcaaatggacgagaaatccttgaacggcgtcgggattatcgacctacatggaaacttaatcagacagaaccagtagcggggaattattacccagtgaatacacggatatatataactgatgggaatatgcagcttacagtactcacagataggtcgcagggggggtcatccctgagagatggatctctcgaactcatggtgcatagaaggctactgaaggatgatgggcggggagtttcggaacctctaatggaaaatggaagtggagcctgggtacggggaagacacctcgtccttctcgatactgctcaggccgccgccgctgggcacaggctcctggccgaacaggaagttttggcaccacaagtcgtcctcgctccaggaggaggagccgcctataatctaggggccccaccaaggacacagttttccgggttacgaagggacctcccaccctccgtgcacctgttaacattagcttcctggggacccgaaatggtgttgctcaggctggaacaccagtttgctgtcggagaagattctgggaggaatctttcagcccccgtgacacttaatctcagagatcttttctccacgtttacaattactcgcctacaggagactacactcgtagccaaccaactcagggaagcagccagtaggctcaaatggactacaaacactgggcccactccacaccagacaccctatcagctagaccctgctaacatcactctggagcccatggaaattagaacatttttagcctctgtacagtggaaagaagtcgatgga

SEQ ID NO: 16494 - DNA, 3033 bp, Artificial Sequence
  Description of Artificial Sequence: Synthetic coding sequence
atgggcgcttacgcaagagctagtggtgtgtgtgcaaggggatgcctcgatagtgcgggcccgtggacaatgtctcgggcgctgaggccccccttgccaccgctctgcttctttcttctcctgctggcagccgcaggcgctcgggccggagggtacgagacttgccctaccgtgcagcctaacatgctgaatgtgcatctgctaccacacacccatgatgatgtcggttggctgaagaccgttgatcagtatttctatgggattaagaacgatatccaacacgccggagtccagtatatccttgattctgttatatccgccctcctggcggatcccacaagacgtttcatctacgtggagattgcttttttttctcggtggtggcatcagcagacaaacgcgactcaggaggtcgtgagagatttagtgcgccagggcagactggagttcgcaaacgggggatgggtgatgaatgacgaggctgccacacattacggagcaattgtcgatcagatgacattgggactacgctttttggaggacacgtttggaaacgatggccgaccacgcgtcgcctggcatattgacccatttggccacagccgagagcaggctagtctgtttgcccagatgggatttgacgggttcttctttggcagactggactaccaggataagtgggtgcgcatgcagaagctggaaatggaacaggtctggagagcctctacatccctgaagcccccaacggccgacctgttcacaggcgtgctgcccaacggctacaaccccccacggaatttgtgttgggacgttctctgtgtggatcagcctctggtggaggacccgagaagccctgaatacaacgcgaaggaacttgtcgactacttcctgaacgttgccactgcgcaggggaggtactaccggaccaatcacaccgttatgaccatgggaagcgatttccagtatgaaaatgctaacatgtggttcaagaatcttgacaagctcattaggctcgtgaacgctcaacaggcgaaaggatctagcgtccatgtgttatattcgactccagcctgttacttatgggaactcaacaaagcgaatctgacctggagcgttaaacacgatgacttcttcccgtacgccgatggcccgcatcagttttggaccggctatttcagctctcgaccagcactgaaaagatacgagaggttgagttacaactttttgcaagtctgcaaccagctcgaggccttggttggcttagccgccaacgttggtccctacgggagcggtgatagcgcgccgttaaacgaagccatggccgtactccagcaccacgatgccgtgagcggaacgagcaggcagcatgtggcaaatgactacgcccggcaactagccgccggttggggaccatgcgaggtgttattgagtaatgccctcgcgcgactgcgaggctttaaggaccactttacattttgccagcagctgaacattagtatatgtcccctgtctcagactgcagcacggttccaagtgatcgtctacaatcccctgggtcggaaggtgaattggatggtgcggctgccagtgagcgagggcgtgtttgtagtgaaagaccctaatggtcgtacggtacccagcgatgttgttatcttcccttcatcagactctcaggcccacccccctgagcttcttttctcagcttcattgcccgccctgggcttcagtacctactcggtagcacaggtcccaaggtggaagccacaagccagggcccctcagcctattcctagacggtcctggagccccgcactgaccatcgaaaatgaacacattcgggctacgttcgatcctgacacaggcctgctcatggaaatcatgaatatgaatcagcagctgttactgcccgtgcgccagacgttcttctggtacaatgcttcaatcggggacaacgagtcagaccaggcctccggagcttacatttttagaccgaaccagcaaaagccccttccggtatcacgctgggcacagatccacctcgtcaagacgcccttggtgcaggaagtgcatcaaaacttttctgcgtggtgttctcaggttgtgcgcctttacccagggcagcgccacctggaattagagtggtcagtgggacccatcccagttggagatacatggggtaaagaggtgatttcaagattcgacactccacttgagaccaagggtcggttctacacagacagcaatggcagagagatacttgagcggagaagggattaccggcccacatggaagctgaatcagaccgagccggtggccggcaactattacccagtcaacaccaggatctacatcacagacggtaatatgcagcttaccgtgttgactgaccgaagccaaggcggatctagtttgagagatggatcactagaactgatggttcacaggcgactgttgaaggacgacggtaggggtgtctcggagcctttgatggaaaacggctctggggcttgggtcagaggccgccacttggtcctactggacaccgcacaggctgccgccgcaggtcacaggctgctggctgagcaggaggtgctggccccccaggtggtgctggcgcccggggggggggccgcatataacctcggtgcaccaccccggacgcagtttagcggcctgagaagggacctcccccctagcgtgcacctgctgaccctggcttcttgggggccagagatggtgttgctgaggctggagcatcaatttgccgtcggcgaagactccggtaggaatctcagcgctcctgtaaccctgaaccttagggatctgttctctacattcacaataactagactgcaggagacaaccctcgtggcgaatcaactgagagaagccgcatccaggctcaaatggactaccaataccggccccaccccccaccagacgccctaccagctcgaccccgcgaacatcacgttggagccaatggagatccgtaccttcttggcgtctgtgcagtggaaagaagttgatgga

SEQ ID NO: 16495 - DNA, 3033 bp, Artificial Sequence
  Description of Artificial Sequence: Synthetic coding sequence
atgggagcatacgcccgcgcctcgggggtgtgcgcgcgcggatgtctcgatagcgctggaccttggactatgagccgcgctctgcggccgccgctcccaccgctgtgtttcttcctgctgctgctcgcggccgcgggagctagagccggaggatacgagacttgcccgactgtgcagccgaacatgttgaacgtccatctgttgccgcacacccatgatgacgtgggctggctcaagaccgtcgatcagtatttctatggaatcaagaatgatatccaacatgccggtgttcaatacatcctggactccgtcatctccgctctgttggccgatccaaccagaaggttcatctacgtggagatcgccttcttttcccggtggtggcatcagcaaactaatgcgactcaggaagtcgtccgggacctcgtccggcagggccgcctcgagtttgcaaacggaggatgggtcatgaatgatgaggctgctacgcattacggagctatcgtggaccagatgacgctgggacttcggtttctggaagatactttcggcaatgatgggcgccccagagtggcatggcatatcgacccatttggacactcacgggagcaggcctcgctgttcgcccagatgggtttcgacggattcttcttcggacggctcgactatcaagataagtgggtgcgcatgcagaagctggaaatggaacaagtgtggagagcgtcgacctcgctcaagccgcctaccgccgacctgttcaccggggtgctgcccaacggatacaatccgccacgcaacctgtgctgggacgtgctgtgcgtcgaccaaccactcgtcgaagatccgagatcacccgagtacaatgctaaggagttggtagattactttctgaacgtcgctaccgcgcaaggcagatactacagaaccaaccacaccgtgatgaccatgggatcggactttcaatacgaaaatgcgaacatgtggttcaagaatcttgataagctgatcagactggtgaatgcacagcaggcgaaaggatcctccgtgcatgtgctgtacagtacccctgcctgttacctgtgggagctgaacaaggcaaatctgacttggagcgtcaaacatgacgacttcttcccctacgccgacggcccgcaccagttttggactggttacttctcctcgcgccccgccctgaagaggtacgagcgcctctcatacaacttcctccaggtgtgcaaccagctggaagcgctcgtcggactggccgccaacgtcggaccgtacggatcgggagattccgcgccgctgaacgaggcgatggctgtgctgcaacaccatgacgccgtgtcgggtacttcgagacaacatgtggccaatgactacgcacgccaacttgcagccggatggggcccatgcgaagtcctcctgtcaaatgccctggcacggcttcgcggattcaaggaccatttcaccttctgccaacagttgaacatctcaatctgcccgctgtcacagaccgccgccagattccaggtcatcgtgtacaacccgctgggacgcaaggtgaattggatggtgcgcctcccggtgagcgaaggagtgttcgtggtcaaggaccccaatggacgcacggtgcccagcgacgtcgtgattttcccctcctccgattcgcaggcgcacccgccggaactgctgttctcggcttccctcccggccctgggattctctacttactcggtggcccaagtgcctagatggaagccgcaggcacgggccccgcagcctatcccacgacgctcatggtccccagcactcaccatcgagaacgaacatataagagctaccttcgatccagacaccggactcttgatggaaatcatgaatatgaaccaacagctgctcctgccagttagacagaccttcttctggtacaacgcctcgattggcgacaacgagtcggatcaagcctccggagcttacatcttccggccgaaccagcagaagccgctgcctgtgagtcgctgggcgcaaatccacctggtcaagactcctctggtccaggaggtgcaccaaaacttctcggcgtggtgctcgcaagtggtccgcctctaccctggccaaagacatcttgaactcgagtggtcagtgggtccgatcccagtgggggacacttggggaaaggaagtgatctcgcgctttgataccccgctggagactaagggaagattctacactgactcgaacggtcgggaaatcctcgagcgcagacgcgattatcgtcctacctggaagctgaatcagacggagccggtggcgggaaactactacccagtgaatacccgcatctacatcactgacgggaacatgcaactgaccgtgctgaccgaccgcagccaaggagggagcagcctgcgggacggatcgctggaactcatggtgcacaggcggcttctcaaggacgatgggcgcggtgtgagcgaaccgctgatggaaaatggatcaggagcgtgggtgcggggacgacacttggtcctgctggacaccgcccaggcagccgccgccggccaccgcttgctggcagaacaggaagttctggcgccccaggtcgtgctcgcccctggaggtggagccgcttacaaccttggcgcgccgccacgcacccagttcagcggcctcaggagggacctgccgccgtccgtgcacctcctcacgctcgccagctggggtccagaaatggttctgttgagactggagcatcagttcgctgtcggagaggactccggtcggaacctgtcggcccctgtgactctgaacctcagagatttgttttcaaccttcactatcactaggctgcaagaaactaccctggtcgccaaccaactccgcgaggcagcaagcagactgaagtggactactaacactgggcctactcctcaccagaccccctaccaattggatccggcgaacattaccctggagcctatggaaatcagaaccttcctcgccagtgtgcaatggaaggaggtggatggt

SEQ ID NO: 16496 - DNA, 3033 bp, Artificial Sequence
  Description of Artificial Sequence: Synthetic coding sequence
atgggggcttacgccagggcctccggtgtttgcgctagaggctgtctagacagtgccggaccttggacaatgtcgagagccctgcgccccccgctaccgcccctgtgtttcttcctgctactcctggctgcagccggcgccagggccggcgggtacgagacctgcccaaccgttcagccaaatatgctgaatgtacacctgctccctcatacccacgatgacgtgggatggctgaaaaccgtagatcagtacttctacgggattaaaaatgacatccaacacgctggcgtgcagtatatcctggactccgttattagtgctctactggccgaccccaccaggcggtttatttatgttgagatcgcattctttagcagatggtggcaccaacaaaccaacgccactcaggaggtcgtgcgtgatctcgtgcggcagggaaggctggaattcgccaatggcgggtgggtgatgaatgacgaggccgcaacgcactatggtgctattgtggaccaaatgaccctcggtctgcgctttctggaggacacatttgggaatgacggaaggccacgagtggcatggcacatcgatcccttcggacacagccgggagcaggcaagcctgttcgcccaaatgggatttgacggattcttcttcggtcggcttgattatcaggataagtgggtgcgcatgcagaagctcgaaatggaacaggtctggcgcgcaagcacttctctgaagccaccaacagcagatctatttaccggtgtccttcctaatggatataaccccccacggaatctgtgttgggatgtgctgtgtgtcgaccaaccacttgtcgaagaccccagaagccctgagtataatgctaaggagttagtggactactttctgaacgtcgccaccgcgcagggacgctattacagaacgaatcacacagtgatgacgatgggcagcgatttccagtacgaaaatgctaatatgtggttcaagaaccttgacaaattaatcaggctcgtgaacgcacagcaggcgaaggggtcgtctgtgcatgtgctgtacagtactcccgcctgctatttgtgggagctgaataaggctaatctgacgtggagtgtcaagcatgacgacttcttcccatatgctgacggacctcatcagttctggacaggctatttttcatcccgccctgctctgaagaggtatgagcgcctatcttacaacttcctgcaagtgtgtaaccagctagaagccctcgtcggcctggccgctaacgtgggaccctacggatccggcgacagtgcacccctgaacgaagcaatggctgttttgcagcaccatgacgcggtttcgggtacctcgcgtcagcatgttgcgaacgattatgcccgtcagctggctgctggttggggcccctgcgaggtgctgttatctaacgcactagcgcggttgcgcggattcaaggatcatttcacattttgccaacagctgaatatcagcatttgccctctcagccagactgcggcccggtttcaggtgattgtctacaaccccctgggccgcaaggtgaattggatggtgaggctaccagtgagcgaaggagtcttcgttgtcaaggatccaaatggccgcacggtgccatccgatgtagtaatttttccgagcagcgactcccaggcacacccaccggagttgttgttctccgcttccctgcctgctctgggattctccacgtactcagtcgcacaggtgccccggtggaagccacaagccagagcaccacagcctattccaagacgctcttggtcccccgccttgacaatcgaaaacgaacatatcagggccacatttgaccctgataccggactgcttatggaaattatgaacatgaaccagcagttgctgctccctgtacgtcagacattcttctggtataacgcgagcattggggacaacgaatcagaccaagctagcggcgcatatatcttcagaccaaaccaacagaagcccctgcccgtctcgcgttgggcccagatccacctggtgaaaaccccgcttgtgcaagaagttcaccaaaatttttctgcgtggtgctcacaagtcgttcgcttgtaccctgggcaacgtcatttggaacttgaatggagcgtcggccctatccccgtgggagatacctggggaaaggaagtgatttctcgcttcgataccccgcttgagacgaaaggccggttctacacagacagtaatggccgagagattcttgaaagaagaagagattatcgacccacatggaaactcaatcagaccgagcccgtcgccggcaactactaccctgtaaacactcggatttacatcaccgacggaaacatgcagctgaccgttttaaccgatcggtcccagggcggatcttcgcttcgagacggaagcctggaactgatggtgcaccggcgactgttaaaggatgacgggcggggcgtcagtgaacccttgatggaaaatgggtccggagcatgggtgcgcggccgccacctcgtcttactcgacaccgcgcaggccgctgcggctgggcatcgactgcttgccgagcaggaggttctggcccctcaagttgttctggcccccggcggcggggccgcatataatttaggagcaccaccccggacacaatttagcggactgagacgagacctgccaccgagtgtgcacctcctgaccttggccagttggggtcccgagatggtgctgctaaggctggaacaccaatttgccgtaggagaagatagtggccgcaatctcagcgcccctgtgacgttgaatctgcgcgatctgttttcgacctttaccattacccgtcttcaggaaactacgctcgtggctaaccagctgcgggaggcagcttccaggctgaaatggacaaccaacactgggcccaccccacatcagacaccataccagcttgacccagcgaacataacactggagcccatggaaattcggactttcctagcctcagtgcagtggaaggaagtagatggc

SEQ ID NO: 16497 - DNA, 3033 bp, Artificial Sequence
  Description of Artificial Sequence: Synthetic coding sequence
atgggcgcctacgcccgggctagcggtgtgtgcgctaggggatgtcttgatagtgccggcccgtggactatgtcaagggcattgaggccacctctgcctcctctctgcttcttcctgctgttacttgcagctgctggtgcccgagccgggggctatgagacctgcccaaccgtgcagcccaacatgctgaatgtccatctactgccccacactcatgatgacgtggggtggctcaaaaccgtcgatcaatacttttacggcattaagaatgacatccagcacgccggggttcagtacatcctcgactccgtgatcagtgccctcttggccgacccaacaaggcgcttcatctatgtggagatcgcatttttctcccgatggtggcatcaacagacaaatgctactcaggaggttgtgagggacctggtgcggcaaggaagactggagtttgccaatggagggtgggtgatgaacgatgaagcagcaacgcactatggtgcaattgtggaccaaatgaccctgggactacgatttctggaagacacgttcggcaacgacggtcgacctcgggtggcttggcacatcgatcccttcggacacagtcgcgaacaagcatccctatttgcacagatgggttttgacggatttttcttcggtcggctggactaccaggacaagtgggttagaatgcagaagttggaaatggagcaggtctggcgggcatccacctctctgaagcctcctactgccgacctgtttacaggagtcctgccgaacggctacaatcctcctcgcaatttatgctgggacgtactgtgtgtggatcagcctctggtggaagacccccgtagccctgagtacaacgcgaaagaactggtggattatttcttaaacgtagcaacagctcagggtcggtattatagaactaaccatacagtgatgactatgggctcagatttccagtatgagaatgctaacatgtggttcaaaaaccttgataagctgatcagactggtgaacgcacaacaagccaagggctcttctgtgcacgtcctgtattcaacacctgcctgctacctatgggagctcaataaagcgaacctcacttggtctgtaaagcatgacgattttttcccttacgcagatggccctcatcagttctggacgggatacttctcctctcgacccgccctcaagagatacgaacgtctgagctacaatttcttgcaggtgtgtaaccagttggaagcccttgttgggctggccgccaatgtggggccttatgggtcgggggacagcgccccactgaatgaagccatggccgtgctccagcatcatgatgcggtgtccggaacgtcaagacagcacgtcgccaatgactatgcaagacagttagcagcagggtggggcccttgtgaagtcctgctctctaacgcactggcccgactgcgcggcttcaaggaccatttcacattctgccaacagttgaacatctccatttgtccactttctcaaaccgcggccaggtttcaagtgattgtgtacaaccccctgggccgcaaggtgaattggatggtgcggctgcctgtgtctgaaggtgtgttcgtggttaaagacccaaatggacggaccgtcccatcagatgtcgtgatttttcctagctccgactcccaagcccaccccccggaactattgttcagcgcctctctgcccgctctgggcttttccacatattccgttgctcaggtccccagatggaaaccccaagcacgcgcccctcaacccatacctaggagatcttggtcccctgctttaacaatcgaaaatgagcacattcgagccaccttcgacccagatacaggtctcctcatggaaatcatgaatatgaaccaacagttgctgctgcccgtcagacagacgtttttttggtataatgcgagcatcggggataatgaaagcgaccaggccagcggagcctacattttcagaccaaaccagcaaaaacctctacccgtttcaagatgggcacaaattcatctggtgaagacacctctggtgcaagaagtccaccagaatttctcagcttggtgtagccaggttgtgcggctttaccctggacaacggcatctggaactcgagtggtccgtaggtcctatccccgtaggggacacatggggaaaggaggtaatttcaaggtttgacactcccctggagacgaaaggacgcttttacactgattcgaatggacgagagattctcgagcggcggcgggattacaggccaacttggaaactgaaccagaccgagccagtcgcaggaaattattatcccgtgaatacaagaatttatataacagacggcaatatgcagcttacagtcttaacagacaggtcccagggaggctctagcctgagagacgggtctttggagctgatggtccaccgccgactgctgaaggatgacgggcgtggggtaagcgaacccctaatggagaacggatctggagcctgggtgcggggacggcatttagtcttgttggacaccgcgcaggctgccgctgctggtcatcgcctgttggcagagcaggaagttctcgccccccaggtggttctcgcacctggcggaggggccgcctacaaccttggtgcccctcctcggacacagttctccgggctgaggagagatctccctccgagcgtacatttgctcaccctagccagttggggccccgagatggtgctgcttagattagaacaccagttcgccgtcggagaggattccggaagaaatctgtctgccccagttacgctgaacttgcgagacttgttttctacatttaccattacacggctgcaagagacaactttagtggccaaccagctgagggaagcggcttctcgactgaaatggacaaccaacacgggacccacccctcatcagactccctaccagttagatccagccaatatcacactggagcctatggagataagaacattcctggcgagtgtgcagtggaaagaagtggacgga

SEQ ID NO: 16498 - DNA, 3033 bp, Artificial Sequence
  Description of Artificial Sequence: Synthetic coding sequence
atgggcgcttatgcgagagcatcgggcgtgtgcgccagaggctgccttgattccgccggcccatggaccatgagccgggccctccgccctccgcttccgccgctctgttttttcttgctcctcctggccgcggcaggtgcccgcgcgggagggtacgaaacctgtccgactgtgcagcctaatatgctcaacgtgcacctgctgccccatactcacgatgacgtgggctggctgaaaaccgtggatcagtacttctacggaattaagaatgacatccagcatgcgggcgtgcagtacatccttgactcagtgatctcagcactcctggcagacccgacgcggcgcttcatttacgtcgagattgccttcttttccagatggtggcatcaacagaccaacgccactcaggaagtggtgcgcgatctggtgagacagggtagactggagttcgcgaatggagggtgggtgatgaacgatgaggcagccacccactatggagctatcgtcgaccagatgactctgggcctgagatttctggaagataccttcggcaatgacggaaggccgcgggtggcatggcacatcgatccgtttggacacagtcgcgaacaggcctccctgttcgctcagatggggttcgatggattcttctttggacggctggactaccaggacaagtgggtccgcatgcagaagttggaaatggagcaagtctggagagcgagcacttccctgaaaccgccgaccgcggatctgttcaccggtgtgctgccgaatggatacaacccgccacggaacctctgctgggatgtcctctgcgtggaccaacccctggtggaagatccgagatcccccgaatacaatgccaaggagctcgtcgactacttcctgaacgtcgcaacggcccagggacggtactaccggactaaccatactgtcatgactatgggtagcgacttccagtacgagaacgcaaacatgtggtttaagaaccttgataaactgatccgacttgtgaatgcacaacaagccaagggctcatcggtgcacgtcttgtactcgactccggcttgctacctgtgggagctgaataaggctaatctgacctggtcggttaagcacgatgatttcttcccctacgccgacggaccacatcaattctggactggatatttctcgtcgaggccagcactcaagcgctacgagcgcctttcttataacttcctgcaagtgtgcaaccaactggaagccctggtgggactcgccgccaatgtcggaccatacggatcgggagattcagcaccgcttaacgaagcgatggcagtgctgcaacaccacgacgcggtgtctggcacctcacggcagcacgtggcaaatgactacgctaggcagctcgccgcagggtggggcccctgcgaagtgcttctgtcgaacgccctggcacggctcagaggcttcaaggatcacttcaccttttgtcaacagctgaacatctccatctgcccgctgtcgcaaaccgctgcccggttccaagttattgtgtataacccgctcggacgcaaagtcaattggatggtgcggctccctgtctcggaaggggtgtttgttgtgaaagacccaaacggccgcactgttccgtccgatgtggtcatctttccttcgtcagactcccaggcgcaccctccggaactgctcttctccgcctcgctgccagccttgggattctcaacttactcggtcgcccaagtgccgcgctggaagccacaggcacgcgccccgcagcccatcccccggcggtcgtggtcaccagcactcaccatcgaaaacgaacatatccgggcgactttcgaccctgatactgggctcctgatggaaatcatgaacatgaaccaacagctcctgctgccagttcgccaaactttcttttggtacaacgcctccatcggagataacgaatccgaccaagccagcggcgcctacatctttcggccgaaccagcaaaagccgctccccgtgtcgaggtgggcccagatccacctcgtcaagactccgctcgtgcaggaggtgcaccagaacttctcagcgtggtgctcccaagtcgtgcggctctaccctggccagagacatttggaactggaatggtcggtgggaccgatcccagtcggggatacttggggaaaagaagtgatcagcagattcgacacgccgctggaaaccaagggtcgcttctacaccgatagcaatggcagagaaatcctggagcgccgtcgcgattaccggccaacctggaagttgaatcagacggaaccggtggccggtaactactaccctgtgaacacccgcatctacatcactgatggaaatatgcagctgactgttctgaccgaccgctcgcagggtggatcctcgctcagagatggctcactggagcttatggtgcaccgcagactcttgaaagacgacggacggggcgtgagcgaaccgctcatggagaacggaagcggcgcgtgggttcggggacgccacctggtacttctggacaccgcgcaggcggcggccgcggggcacagactccttgcggaacaggaagttctggcgccgcaggtggtgctggccccggggggcggagccgcctacaacctgggcgctccaccacgaacccagttctccggactccggcgcgacctgccaccgagcgtgcacttgctcactctcgcctcctggggcccggagatggtgctcctgagacttgagcaccagttcgcggtgggagaagattcaggaagaaacctgagcgcaccggtgactctgaacctgcgggacctgttttcgactttcactatcacgaggttgcaggaaaccactttggtcgccaaccagctgagagaggcggcctcgcggctgaagtggaccaccaacaccggacctactccgcaccagactccgtaccaacttgatccggccaacataaccctggaaccgatggaaatccggacgttccttgcatccgtgcaatggaaggaagtggatggc

SEQ ID NO: 16499 - DNA, 3033 bp, Artificial Sequence
  Description of Artificial Sequence: Synthetic coding sequence
atgggtgcatacgcacgggccagcggggtctgcgctagagggtgcctcgattcggccgggccttggactatgagcagggcgctccgtccccctctgccacctttatgcttctttctgctgctcctggccgccgctggagctagggcaggcggatatgagacttgtcccactgtgcagcccaatatgctcaacgtgcatctgctgcctcacacacatgacgatgtggggtggctcaagacagtggaccagtacttttatggcataaaaaacgatatccagcatgctggcgttcaatacatcttggattctgtgatctccgccctgctcgcagatcctacaaggagattcatctatgtcgagattgccttcttttcccgctggtggcaccagcagacgaatgccacacaagaggtggtcagggatctcgttaggcaggggcgcctggagttcgccaacggtggatgggtgatgaatgatgaagccgccacacactacggcgctatcgtagaccagatgaccctggggttgagatttctcgaagatacatttggaaatgatgggcgtccccgcgtcgcttggcacattgacccctttggacatagcagggaacaggctagtctgtttgcccagatggggttcgacggcttctttttcggccgtcttgactatcaagataagtgggtgcggatgcaaaaactagagatggaacaggtctggagggcctctacaagtctcaagccgcctaccgccgatctttttactggtgtgctgccgaacggctataatcccccacgaaacttgtgttgggatgtactgtgtgtcgaccagcctcttgttgaggacccaagatctcccgaatacaacgcgaaagagctggttgactactttctgaacgttgcaacagcccagggaagatactaccgcaccaatcatacagtcatgacaatggggtcggactttcagtacgaaaatgcgaacatgtggttcaagaacctggataagttaattcggctcgtgaatgcccagcaggcgaaaggatcatccgtccatgtgctgtattcaacacccgcatgctatttgtgggagctgaacaaggccaacctcacctggagcgttaagcacgacgatttcttcccctatgctgatgggccacaccagttctggacaggttacttttcttctagaccagcactaaagaggtatgagcggctttcgtacaatttcctccaggtgtgcaaccagctcgaagctctggtggggttggcagcgaatgtcgggccttacggatctggcgactccgcccctctaaacgaagcaatggcagtactgcagcaccatgacgctgtatccggcacatcccggcagcatgtggcgaatgactacgctaggcagcttgccgctggctggggcccctgcgaagttctgctctccaacgcccttgcacggctccgcggttttaaagatcacttcacattttgtcaacagctgaatatttccatttgcccgctctcacagactgccgcccgttttcaggttatagtctataacccactgggcagaaaagtgaactggatggttaggctgcctgttagtgagggagtcttcgtcgtcaaggatccgaacggccggacagtgcccagtgatgtggtgatcttccccagcagcgatagccaggcccaccctcctgaactgcttttcagcgcaagcttgcctgctcttggcttctctacctatagcgtggcacaggtgccaaggtggaaaccgcaggcaagagccccccaaccgatacctagaaggtcgtggtctcctgctcttaccattgagaatgagcatatacgggcaacgttcgatcccgacaccggccttctgatggagatcatgaacatgaaccagcaactactgttgcctgtcaggcaaactttcttctggtacaatgccagcatcggagataacgagagcgatcaggcgagtggggcgtatattttccggccgaatcaacaaaagcctctgcccgttagccgttgggcacagattcacctagtgaaaacccctcttgtgcaggaggtgcaccagaatttttctgcatggtgctcacaggtagtgaggctctaccccggacagcgccacctggaattggaatggtcggtggggcccattccagttggtgacacctggggaaaagaggttataagcagatttgacactcctttggaaactaaaggccgattttacaccgatagcaatggaagggagatcttagaacgacgtcgggactacaggcccacttggaaattgaaccagaccgaacccgtggctggaaattactaccctgtaaacaccagaatttatatcacagatggcaatatgcagcttaccgtcttgactgataggagccagggtggttctagcctgcgcgacgggtctttggagcttatggtacataggcgcctgctgaaggacgatggaaggggcgtaagtgagcccctgatggagaatggaagcggggcctgggtgcggggacgccacctggtacttctagatacagcacaggcagccgccgctggtcatcgcctgcttgcagaacaggaagtcctagcccctcaagtcgttttggcgccaggtggtggggctgcctacaatctcggtgcacctcccaggacccagttctccggactgcgcagggatctacccccttccgtgcaccttcttacactggcgtcgtggggcccggagatggtattgctgaggctagagcaccaatttgcagttggtgaagacagcggtagaaacctcagcgcaccagttactctgaatctcagagacctgtttagtaccttcacaatcacccggctgcaggagacgaccctggtggctaaccagttgcgggaagctgcatcacgcctgaaatggaccaccaacaccggaccgacaccacaccagactccatatcagctggatcccgcgaatatcacactagagcccatggagatacgtacatttctcgcatccgttcaatggaaggaagtggatggc

SEQ ID NO: 16500 - DNA, 3033 bp, Artificial Sequence
  Description of Artificial Sequence: Synthetic coding sequence
atgggtgcctatgccagagcctcaggagtctgtgccagggggtgcctcgatagtgccggaccttggaccatgtcccgggccctcaggcccccactgccaccattgtgtttcttcctcctgctgcttgcagcagctggcgcacgagctggcggatacgaaacctgcccaacggtacagcccaatatgctaaatgtgcatctgctccctcatacacacgatgatgttggctggctgaagactgtggaccaatacttttacgggatcaaaaatgatattcaacatgcgggagtgcagtatatcctcgacagtgtgatttcggcgttacttgcagatccaactcgacgctttatatatgtggagatagcgtttttctctaggtggtggcaccaacagacaaacgctactcaggaagtcgtacgcgatctggtcagacagggccgattggaatttgccaacgggggatgggtgatgaacgacgaagccgcaactcattacggggcgattgtggaccagatgaccctgggactgcggtttctggaggatacatttggaaatgatggacgtcctcgagtggcgtggcatatcgatcctttcggtcacagtcgtgagcaggcttcccttttcgcccagatgggatttgatggctttttttttggaaggttggactatcaagataaatgggtccggatgcagaagttagaaatggaacaagtctggcgagcttctacctccctaaagccccctacagcggacttatttacaggtgtgcttcctaatggctacaacccccctcgtaacctgtgctgggacgttctgtgcgtggaccagcctctcgtcgaggacccacgaagccccgaatataacgctaaggaactggtggattattttctgaacgtggccaccgcccaaggccgatattatagaaccaaccacaccgtaatgaccatgggaagcgactttcagtatgaaaatgcaaatatgtggttcaaaaatctggacaagttgattagactggtgaacgctcagcaagccaaaggcagtagtgtgcacgtgctctactcgacgccggcatgctacctctgggagctaaacaaagccaacctgacatggtcagtgaaacacgacgacttctttccatatgcggacggtcctcatcagttttggactggctattttagcagcaggccagccctcaaacgttacgaacggcttagctacaactttcttcaggtgtgcaaccagctggaagctctcgtgggcctggccgcaaatgtgggcccttatgggtccggggacagtgccccactgaacgaggccatggctgtacttcagcatcacgatgccgtctcagggacctcccgacagcatgttgcgaatgactatgccagacagctagcagcgggctggggcccctgcgaggttctgctatctaacgcgttggcccgattgagagggtttaaggaccacttcacattctgtcagcagctgaacatttctatctgcccactgtcacagaccgccgctagatttcaagtaattgtctataatcccctgggccggaaggtcaattggatggtccgactccccgtgtctgaaggggtcttcgtagtgaaggacccaaatggccgaactgtcccgagcgacgttgtgatattcccatcttcagattctcaggcgcatccgcctgaactgttgttttctgcaagcctgccagccttaggcttttccacatattctgtggcacaggtccccaggtggaagccacaggcccgagcacctcagcctattccccgaaggagctggagtccggcactcacgatcgaaaacgagcatatccgtgctacttttgacccagatactggtctgctgatggaaatcatgaacatgaaccagcagctcctactgcctgttcggcagacattcttttggtataacgcttcaatcggggacaacgagtcagaccaggcgtcgggggcttatattttccgaccaaatcaacagaagcctctccccgtttctaggtgggcccaaattcacctggttaagaccccactggtgcaggaagtgcatcagaatttttcagcctggtgttcacaagtagtgagactataccctggccagcgacacctggaactagagtggagcgtaggaccaattccggttggagatacctgggggaaagaagttatcagtcgattcgacacccctctcgaaacaaaaggaagattttacacagactctaacggtcgagaaatccttgagcgacgaagagattacaggcccacttggaaacttaatcagacggagcctgtcgcagggaattattatcccgtcaatactcgaatctacatcacggacggtaacatgcagctcaccgtgctcaccgacaggtcccagggaggtagctcgttaagagatggtagcttggaacttatggtccatagacgattgttgaaggacgacggacggggagtgagcgagcctctgatggaaaatggttccggagcctgggtccggggccgccatttagtgctgctagacacagcacaggccgccgctgccggacaccgcttgttagcagagcaggaggtcctcgctcctcaagtggtcctcgcccccggaggaggagctgcttacaacttgggagccccacccaggacccaattttctggtctgagaagggatttgccaccttccgtgcacctcttaacgctggccagttggggacccgaaatggtactcctccggctggaacaccaattcgccgtaggtgaagacagtggacgcaacctatccgcaccagtcacacttaacctgagagaccttttctccacattcaccatcaccaggctgcaggaaacaacccttgtagcgaaccagcttagggaagcagcgagcagacttaagtggacgacaaatacaggcccgactcctcatcaaacgccataccagctcgatcctgcaaatatcactcttgaacccatggaaattcgaacgttcctggcctccgtgcagtggaaagaagtcgatggg

SEQ ID NO: 16501 - DNA, 3033 bp, Artificial Sequence
  Description of Artificial Sequence: Synthetic coding sequence
atgggggcatacgctagggcatcaggagtgtgcgctagaggatgcctcgattctgctggaccctggacaatgagtagggccctcaggcccccgctgcccccgctgtgcttctttcttttgctgttggccgctgcgggcgctagggcagggggatacgaaacatgtccgactgtgcagcctaacatgctgaacgtccatctcctcccccacacacacgacgatgtcggatggctgaagacggtggaccaatatttttatgggatcaagaacgatattcagcacgctggggttcaatatatcctggacagtgttatcagtgccctgctagccgaccccacacgccgctttatttacgtggagatcgccttcttctctcgctggtggcatcaacaaaccaatgcaacacaagaagtggtgcgcgacctggttagacagggccggctcgagttcgccaatgggggatgggttatgaacgacgaggctgcaacccactacggggccattgtcgatcagatgacattaggcctgagattcctcgaggataccttcggaaacgacggccgaccacgcgtagcatggcacatcgacccattcgggcacagcagggaacaggcttccctctttgcacagatgggcttcgatgggtttttctttggcaggctggattatcaagataaatgggtgcgtatgcagaaattagaaatggaacaggtatggagagcaagtacatcccttaagccccctaccgcggacttgtttacgggagtgctaccaaacggctacaatccacccagaaacctctgctgggatgtcttatgcgtggaccagccgttggtggaagacccaaggtctcctgaatataatgcaaaagagcttgttgattactttttgaacgtagccaccgcccagggtaggtattatcggaccaatcacactgttatgactatgggatctgactttcagtacgaaaatgcaaacatgtggttcaagaaccttgataaattgataaggctcgtcaacgcgcagcaggctaaaggtagttctgtgcacgtgctttactcaacacccgcatgctatctgtgggagctaaataaggccaatttaacctggtctgtgaaacacgatgattttttcccctacgcggatggcccccaccagttttggacgggatatttttcctctaggcctgccctcaagcgatacgaacgactgtcttacaactttcttcaggtatgcaaccagttggaggctcttgtgggactcgctgctaacgttgggccctatggtagcggcgacagtgcacccctgaacgaagccatggccgttttgcagcaccatgatgccgtgagcggtacatcacgacagcacgttgcgaacgactacgcccgccagctggcagctggctggggaccatgtgaagtgctcctcagtaacgctctggcaaggctgcgcggatttaaagatcacttcaccttctgtcagcagctcaacatttcaatttgcccactgagtcagaccgcggcacggttccaagtgattgtttataaccctctcggcagaaaagtaaattggatggttcgactgcctgtctccgaaggcgtttttgtcgtgaaggatcccaatggcagaacggttccatccgacgtggttatttttcctagctctgattcacaggcacaccctccagaactgttgttctccgcctccctgcctgcgcttggattctctacatattcagttgcccaggtgccccgctggaaaccccaggcccgcgcgccccagcctataccccgccgaagctggtcacccgccttgacgattgagaatgagcatattagggctacctttgatccagacacagggctgttgatggaaattatgaatatgaaccagcagctccttctgccagttcgccaaacttttttctggtataacgcttctatcggcgataatgaatctgatcaagcatccggggcctatatcttccgccccaatcagcagaaacccctgccggtctccaggtgggcacaaattcatctggtgaagactcctctcgttcaggaagtgcatcagaatttctccgcctggtgtagccaagtagtgcgcctgtacccaggccagagacacttggaacttgaatggtcagttgggcccatccccgtgggcgatacctggggtaaagaggtaatatcccgatttgatacacctcttgagacaaagggcaggttctacaccgactccaatgggcgcgaaatactggagcggaggcgagattataggccaacttggaagcttaaccagaccgagcctgtagctgggaactactacccggtgaatactaggatctatattactgacggaaacatgcagctgacagtgctgaccgacagaagccagggaggttcctccctccgtgacgggagtctagaactgatggttcacagaagactgctcaaagatgacgggagaggggtctctgaacccctgatggagaatgggagcggcgcttgggtacgtggtcgccaccttgtcctcttagacactgctcaggctgccgcggcaggacatcgcttactcgcagaacaggaggtgctggcaccccaggtggtgctcgcgccaggcgggggtgccgcatataatctgggagcgcctcctaggacacaattctccggcctccggagagatttaccgccatctgtgcacctcctcacactcgccagctggggccccgaaatggtgcttttgagactcgagcatcagtttgcggtcggtgaagatagtggtaggaaccttagcgcccctgttacactaaatctccgggatctgttcagtactttcaccattaccagactccaagagaccacattggtagcaaaccagttgagggaggccgcatcccggctgaagtggacaacgaataccggccctacccctcaccaaacaccgtatcagctcgacccggccaacataactctggagccaatggaaatacgcactttccttgcgtcggttcagtggaaggaggtggatggt

SEQ ID NO: 16502 - DNA, 3033 bp, Artificial Sequence
  Description of Artificial Sequence: Synthetic coding sequence
atgggagcttatgcgcgggctagcggtgtgtgcgcacgggggtgcctcgactctgccggcccctggactatgagccgggctctgaggccaccgctcccccctctgtgctttttcctgcttctgctggcagcagccggcgcaagggctggcggctacgaaacgtgtcctactgtccaacccaacatgctcaatgtacatctcttacctcacacccacgatgacgtcggatggctcaaaacagttgaccagtacttctacggaattaaaaatgatatccaacatgcgggcgtccagtatatccttgactccgtcatcagtgctctgctggcagaccctacacgccgcttcatctacgtcgagattgccttcttttcaagatggtggcatcagcagaccaacgccactcaggaggtggtacgcgaccttgtgcgacagggaaggctcgaatttgcaaatggggggtgggtaatgaatgatgaagcagcgacacactacggtgccatcgtggaccagatgaccctcggcttgcggttccttgaggacacttttgggaacgatggcagaccccgtgtagcctggcatatcgatcctttcggccactctcgcgaacaggccagcctgtttgcgcaaatgggtttcgacggttttttcttcggaagattggattaccaagataagtgggtgaggatgcagaagctggaaatggagcaggtgtggagagccagcacaagcctgaagccgcctacagctgatctgttcactggcgtactgccgaatgggtataatccccccaggaatctgtgttgggatgtcctgtgcgtcgatcagcccctggtagaggaccccaggagtccagaatataacgcgaaggagttggtagattattttctgaacgtggccaccgctcagggacgttattaccgcacaaatcacaccgtcatgacgatgggcagcgatttccagtacgaaaacgccaatatgtggttcaagaacttggataaactaatccgcctggtgaacgcacagcaagcaaaaggttcctcggtgcacgtgttgtatagtacccccgcgtgctatctgtgggagctgaataaagcaaatttgacatggagtgtcaagcacgacgatttttttccttatgccgacggaccgcatcagttttggactggctacttcagcagtcggcccgctttgaagcggtatgagcgcctcagttataatttcctccaagtctgtaaccagctcgaggcattggtggggctcgccgctaacgtgggtccttacggttcaggcgacagcgctccacttaatgaagccatggccgtgctccagcaccacgatgcagtcagcggtacctcaagacagcatgtggccaatgactatgctcgtcagctggccgctgggtggggaccatgtgaggttcttctcagcaacgctttggcacgattgcgtgggttcaaggaccattttaccttttgccagcagctcaatatctcaatttgccctcttagtcagactgctgcccgcttccaggtcatcgtgtacaacccactcgggaggaaagtgaattggatggttcgcctgccagtgtctgaaggtgtgttcgtagtgaaggatcccaacggccgtacagtgccttccgacgttgtgattttccccagcagtgactctcaagcccaccctcctgaattgcttttctctgcctcactccccgcactgggcttttccacctacagtgtcgcgcaggtaccccgctggaaaccacaggcacgggcaccccagcccattccgaggcggtcttggagtcccgcacttaccattgagaacgagcatatccgcgccaccttcgacccagacaccggtcttctcatggaaatcatgaatatgaaccagcagctccttctgcctgtgcgtcaaacgtttttctggtacaacgccagcattggtgataatgaatcagatcaggcctcgggcgcctacatcttccggcctaatcagcaaaagccgctgccagtgtctaggtgggcccagattcatttggtgaagactcccttagtgcaggaagtgcatcaaaacttcagcgcttggtgtagtcaagttgtgcgcctgtaccccggacagagacatctcgaactggaatggagcgtcggaccaattccagttggcgatacatgggggaaggaggtgatttctcggttcgatacccccctggagaccaaagggcgcttctacacagacagtaatgggagagagattctggagaggcgacgcgattaccgccctacatggaaactgaatcagaccgaacctgtggctggaaactactatcccgtgaacaccagaatctacatcacagacggaaatatgcagctgaccgtgctgaccgacaggtcccaggggggatcatctctgcgagatggaagcctggagttaatggtgcatagacgcctcttaaaagatgatgggcggggcgtatctgagcctctgatggaaaacggtagcggagcctgggtaagaggcaggcatttggtgctcctggataccgctcaagctgccgccgctggacacaggttgttggccgaacaagaagtgcttgctccgcaagtggtcctggccccgggcgggggagctgcctataacctaggcgcacctccgagaacccaatttagtgggctgcggcgagatctgcccccaagtgtgcacctattaacattggcttcttggggccccgaaatggtgctacttcggctagagcatcagttcgctgtgggagaggatagtggccggaacttaagcgctcctgtcactttgaacctccgtgatctctttagcacattcaccatcacaaggcttcaagagacaacactcgttgcaaaccagttgagagaagccgcaagccgactcaaatggactacgaatacaggacccactcctcaccaaaccccttaccagcttgaccctgccaacatcacgctcgaaccaatggaaatccgtacattcctggctagtgtgcaatggaaggaggtggatggg

SEQ ID NO: 16503 - DNA, 3033 bp, Artificial Sequence
  Description of Artificial Sequence: Synthetic coding sequence
atgggggcatacgcgcgggcaagcggagtgtgtgcccgtggctgtctcgattcggcggggccgtggacgatgtcccgggctctcagaccgccactgccgcctctttgcttttttctgctcctccttgctgcggcaggggcccgcgccgggggttatgaaacctgccccaccgtgcaacctaatatgctgaacgtccatctgcttcctcatactcatgacgatgtcggatggctcaaaaccgtggatcaatacttctacggtattaagaacgatatccaacacgctggtgtgcagtacattttggattcagtgatttccgcgctgctggcggatccaactcgcaggtttatctacgtggaaatagcattcttttccaggtggtggcatcagcagaccaacgcaacccaggaggtggtccgtgatctggtcaggcagggtagactggagttcgccaacggaggttgggtcatgaatgacgaagccgcaacgcattacggagcaatcgtcgatcagatgacgctggggctgcggtttctggaggataccttcgggaatgatggtaggcctagagtggcctggcatattgaccccttcggacactcaagggaacaagctagcctgtttgcacagatgggttttgatggattcttttttggacggttggattaccaggataaatgggtgagaatgcagaaacttgagatggaacaggtctggcgagcgtccacttccctgaagccacctactgcagatctgtttacgggtgtcctgccgaacggttacaatccaccaaggaacctgtgttgggacgtgctttgtgtggatcagccactggtggaagatcccagatcccctgaatacaacgcaaaagagctggtcgactacttccttaacgtggcgaccgcacagggcaggtattacaggactaaccataccgtgatgactatgggttcggacttccagtacgagaatgcaaatatgtggttcaagaatctggataagctcattagactcgtgaacgcacaacaagcaaagggatcgagcgtgcatgtcctttatagcactcccgcgtgttacctgtgggagctcaacaaggccaacctgacctggtctgtcaagcacgacgatttcttcccatacgcagatggcccacatcagttctggaccggatactttagctcgcggccagcactgaagcggtacgaacgccttagctacaatttcctgcaggtgtgcaatcaattggaagctcttgtgggtttggctgcaaatgtgggtccctacggatctggagattcggcgcccctcaacgaagcgatggcggtgctgcaacatcatgatgccgtgtcgggaacctccagacagcatgttgcgaatgattacgcacggcaactggctgcgggttggggaccttgtgaagtgcttctttcgaacgccttggccagactgagaggttttaaggaccattttacgttttgccaacaacttaacatcagcatctgtccactttctcaaactgccgcacgattccaagtcattgtctacaatccacttggtagaaaggtcaactggatggtgcggctgcctgtgtcagagggtgtctttgtggtgaaggatccaaatggacggactgtgccatccgacgtggtcatttttccgagtagcgacagccaagcgcaccctccagagctgctgtttagtgcgtcgttgcctgcactcggattttccacgtacagcgtggcacaagtcccacggtggaaaccacaagcaagagccccccaacccatcccacgtcggtcatggtcgcccgcccttactattgaaaacgagcatattcgcgccactttcgatcccgacactgggctgctcatggagattatgaatatgaaccaacaactgttgctgcccgttagacagaccttcttctggtacaatgcgagcattggcgataacgaatccgatcaagcatcgggtgcatacatatttcgaccgaatcagcagaagcctctgcccgtctcacgttgggcacaaatccacctggtgaaaacgccacttgtgcaagaggtgcaccaaaacttttcggcctggtgtagccaagtggttcgtctctacccagggcaaagacatctggaactcgaatggtcggtgggccccattcctgtgggagatacttggggaaaagaggtgatttctcgatttgatacccctcttgagactaaaggtcgcttctacaccgactccaatggaagagagatcttggaacggaggcgtgattacaggcctacctggaagctcaatcaaactgaacctgtggcaggtaactactacccggtaaacacccgcatttacataaccgacggtaacatgcaacttacggtgctcaccgatcgcagccagggtggatcatccttgcgcgacgggagcttggaactgatggtccaccgccggttgctgaaggatgatggccgtggcgtctctgaacctctgatggaaaatggctcaggtgcctgggtgagaggtcggcatcttgtccttctcgataccgcacaggcagcagcggctggacatagacttttggcagaacaagaagtgctcgcacctcaggtcgtccttgcacccggcggcggtgcagcatacaacctgggagcacctccgagaactcaattttctgggctgagaagggatcttcctccttcggtgcacctgctcactctcgcatcgtgggggcctgaaatggtactcctgagactggagcatcagttcgcagtgggtgaggattcaggcagaaatctttccgccccagtgactcttaacctgagagatttgttttccacgtttactattacccggcttcaggaaaccaccctggtcgcaaatcaacttcgcgaggccgcatccaggcttaagtggactactaacaccggacctacgccacaccagacgccataccagcttgacccagcgaatatcaccctcgagccgatggagatccgcactttcctggcttccgtgcaatggaaggaggtggatgga

SEQ ID NO: 16504 - DNA, 3033 bp, Artificial Sequence
  Description of Artificial Sequence: Synthetic coding sequence
atgggcgcctacgccagagccagcggcgtgtgcgcccggggctgcctcgactcggccggcccctggacaatgagcagagcattaaggccaccgctgccaccactctgcttcttcctcctcctcctggccgccgctggcgcgcgagccggggggtatgaaacctgtccaaccgtccaacctaatatgctgaacgtgcatctgcttccacacacccatgacgatgttggctggctgaagacagtcgatcagtacttctatggcatcaaaaatgacatccagcatgcaggggtgcagtacattctggatagcgtgatatcagctctcttggcagatccaacacgccgatttatctatgttgaaattgcctttttctcacgctggtggcaccagcagacgaatgctacccaggaggtcgtccgggatttggtgcgtcaagggcggctggagtttgccaatggcggatgggtgatgaatgacgaagccgcaacgcactatggtgccatcgtcgaccagatgaccttggggttacggttcctggaagacacatttggtaacgacggaagaccacgagtggcttggcatatcgaccctttcggccattctcgagagcaggcctctctctttgctcagatgggtttcgacggattcttctttgggagactggattaccaagacaaatgggttagaatgcagaagcttgagatggagcaagtgtggcgcgcctcaacctcactaaaaccaccgaccgcagatctcttcaccggcgtacttcccaacggctataatcccccaagaaacctttgttgggatgtgttgtgcgttgatcagcccctagtagaggatccgcgctctcccgagtacaacgccaaggaacttgtggattacttcttgaacgtcgccaccgcacagggcaggtattaccgaacgaatcacaccgtgatgaccatgggctccgactttcaatatgagaatgctaacatgtggttcaaaaacctggataagctcatcaggctggtgaacgcacagcaggctaagggcagctcagtacacgtgctgtactctaccccggcctgttatctctgggagctgaacaaagccaacctgacatggagcgtgaaacatgatgactttttcccgtatgccgacggtccgcatcagttttggacagggtacttctcgtctcgacccgcccttaagcgatacgagcgactctcctacaatttcctacaagtgtgcaaccagttggaggccctagtgggccttgccgcaaacgtgggcccctacggctccggagactccgcgccattaaacgaggcgatggcagtactgcagcatcacgatgccgtaagtgggacatctagacagcacgtggctaatgattatgcccgacagttagctgcggggtgggggccgtgtgaagtgctcctcagcaatgccctggctcgcctgcgggggtttaaagaccatttcaccttttgccaacagctgaatatcagcatctgcccccttagccaaactgcggcccggtttcaggttatcgtttataacccacttggtcgcaaggtgaactggatggtgcgactgccagtgagcgaaggagtgttcgttgtgaaggatcctaatgggcgaaccgtgccatctgacgtcgttatcttcccatcatcggatagccaggcacatccacctgaactgttgttttccgcctccttgccggctcttggcttctccacctacagtgtggcccaggttcctcgctggaaacctcaggctagagcacctcagcccattcctcgaagatcttggagtcccgctctaactattgagaatgaacacattcgcgctacctttgacccggacactggtttgttgatggaaattatgaacatgaaccagcagctccttttaccagtgaggcagacattcttctggtacaacgcatcaatcggagacaacgagtccgatcaggcgagtggcgcttacatctttagacctaatcagcaaaaaccactgcctgtctcccggtgggcccagatccatctggtgaagacccccctggtccaagaggttcaccagaacttctccgcctggtgttcacaggttgtccggctttaccctggccagcgccatctagaattggagtggtcagtgggtcccatcccggtcggagatacctggggaaaagaagtgatttcaaggtttgatactcccctggaaaccaaggggagattttacacggactccaatgggagggagattctggagcggaggagggattatcggccaacgtggaaactcaaccagaccgagccggttgctggaaactactaccccgtcaatactcggatttacattaccgatggtaacatgcagctaactgtgctgacagatcggtcacaaggaggatcctcactgcgcgatgggagtctggagctgatggtccaccggcggctgttgaaggatgatggacggggcgtgtcagagcccctcatggaaaacggcagtggagcctgggtacgaggccgccacctagtcctgttggacactgctcaggcagccgcggccggccaccgcctccttgcagagcaggaggtgcttgcacctcaggtggttttggccccgggcggaggcgctgcgtataacctcggcgctccacccagaactcagttctccgggctgagacgcgaccttcctccgtcagttcatctactgacgcttgcgtcgtggggacctgaaatggtcctgctgcggctggagcaccaatttgccgtaggggaagactctggccggaatctgagcgcgcctgtgaccttgaacctgagggatttgttttccacgttcacgatcacacgattgcaggaaaccactctggttgctaaccaacttcgagaggctgcatcaaggttgaaatggactaccaatactggaccgaccccccaccagaccccttaccaactcgacccagcgaacattactttggagcccatggaaattaggaccttcctcgcaagcgtccagtggaaagaggtagatggt

SEQ ID NO: 16505 - DNA, 3033 bp, Artificial Sequence
  Description of Artificial Sequence: Synthetic coding sequence
atgggagcctacgcccgtgcgtctggagtgtgtgccaggggctgtctcgatagcgccggcccttggactatgtcccgcgccctgaggcctcccttgccacctctctgttttttcctgctcctgttggcagctgccggcgccagagcaggtggatacgaaacttgccctaccgtgcagcccaatatgctgaatgtgcaccttctcccccatacacacgatgacgtgggctggctaaagacagtggaccagtatttttatgggataaaaaatgacatccaacatgcaggtgtgcagtatatcttagactcagtcatatctgccctgctcgcagaccccacccggcggtttatctacgtcgagattgcctttttctcgaggtggtggcaccagcagacgaacgcaacccaagaagtggtgcgagacttggtaagacagggccgactcgagtttgctaatgggggatgggtgatgaatgacgaggcagctactcactatggagctatcgtggaccaaatgacgcttggcctgcgatttctggaggacaccttcggtaatgacgggcgaccgcgagtggcttggcacatcgaccccttcgggcatagtagggagcaggctagcttatttgcccagatgggttttgacggcttcttttttggcagactcgattaccaggataagtgggtgcgaatgcagaagctcgagatggaacaagtctggcgagctagcactagtctgaagcctccaactgctgatctttttactggggtccttcctaatggatataaccccccacggaacctctgttgggatgtactttgcgtggatcaacccctcgtcgaggatccacgcagccccgaatacaatgccaaagagcttgtggactacttcctcaatgtggccactgctcaaggccggtactacagaacaaaccatacggtcatgactatggggagcgattttcagtatgaaaatgcgaatatgtggttcaagaatctggataagctgatccgactcgttaatgcacaacaagcgaaaggctcatcagtgcatgtcctctattcgaccccagcctgctacttgtgggaactgaataaggcgaacctgacatggtctgtgaagcacgatgacttctttccatatgctgacgggcctcaccagttttggacagggtacttcagctctagacccgcactcaagcggtacgaacgcctgagttacaattttctgcaggtgtgcaatcaacttgaagccctcgttggtctggcagctaacgtggggccctacgggagcggagactccgctcccctaaacgaagccatggccgttctgcagcatcatgatgctgtaagcggaacctccagacagcacgttgccaatgattacgcacgacagctggcggcaggttgggggccatgcgaggtgctgctgtctaacgcacttgctcggctgcgaggattcaaagaccacttcacgttctgccagcagctgaatattagcatatgccccctatctcagactgcagcaaggtttcaggtcattgtatataatccgcttggtcgaaaagttaactggatggtccgactacctgttagcgagggtgtgttcgtcgtgaaggatcccaatggtagaaccgtcccctccgacgtggtgatttttcctagctctgactcccaggcccatcctccagagttgctgttctctgcttccctgccagccctagggtttagcacctactccgtggctcaggtccccaggtggaaacctcaggcaagagctccccagcctatcccacgaaggtcttggagccccgccttgaccatcgaaaacgagcacatccgagccacattcgaccctgacacaggacttttgatggagattatgaatatgaaccagcagctccttctcccagtgaggcagaccttcttttggtacaacgcgtccatcggggataatgaatcagatcaagcttcgggagcgtacatctttcgaccaaatcagcagaagccgttgcccgtttcccggtgggctcagatccacctagtgaaaacccctctggtccaggaggtccatcagaactttagcgcctggtgcagccaggtagtgcggctataccccggacagagacatttggaactggaatggtctgtcgggcccattcccgtaggcgatacatgggggaaggaagtgatttcgcggttcgatactccactggagacgaagggtagattctacaccgactctaatggcagagagatcctggagaggcgacgagattatcgacccacgtggaaattgaatcagacagaaccagtggcgggtaattactatcccgtgaataccaggatctatattactgatggtaatatgcagctaacagtgctgaccgaccgtagccaaggcgggtctagcctccgggatggctccctggaactgatggtgcacagacgcttactcaaagacgacggacgaggagtgagcgagccgcttatggaaaacggaagcggagcctgggtcagagggagacacctcgtgcttctggataccgctcaggcagcggctgcaggccatcgcctactagcggaacaggaggtgctggcaccacaggtggttttggctcctggggggggagctgcatacaacttgggcgctccccctaggactcagttcagtggcttgcggagggatctccccccaagcgtgcatcttcttaccttggcaagctggggaccggaaatggtgctgctacgactcgaacaccaattcgccgtgggggaggattctggccggaatctatccgcccctgtgacactaaatttaagggacttattttcaacctttacaatcacacgtcttcaggaaacaacactggtcgccaatcaacttcgagaggcggcgtctcgactgaagtggaccacaaacacaggccctaccccccatcagaccccctatcagctggacccagctaacatcacactagaaccaatggaaatcaggacattccttgcctctgttcaatggaaagaagtggacggg

SEQ ID NO: 16506 - DNA, 3033 bp, Artificial Sequence
  Description of Artificial Sequence: Synthetic coding sequence
atgggcgcctacgcccgtgccagtggggtgtgcgccagaggctgtttggactctgccggcccgtggaccatgtctagagccctgagacctccactccccccactctgttttttcctactcctgctcgccgcggctggcgcccgggctggtggatacgaaacatgcccaactgttcagcccaatatgctgaacgtgcatctgttgccacatactcacgacgacgtgggctggctcaaaactgtcgaccagtacttctacgggattaaaaacgatatccaacacgccggtgtgcaatacattttagacagtgtgatttccgcgctgttagccgacccaacgcgaagatttatttatgtggagatcgctttcttcagtcgttggtggcaccagcagactaatgcaactcaggaagtagtgagggatcttgtgcgccaaggaaggctggagtttgcaaacggtgggtgggtgatgaacgacgaagccgccactcactatggcgcaatcgtcgatcagatgactttgggcctgcgtttccttgaagatacatttggaaacgatggccgcccacgggtagcctggcacattgatcctttcggccactcacgggagcaggccagccttttcgctcagatgggattcgatggcttttttttcggcagactggactaccaggacaaatgggtgaggatgcaaaagctggagatggaacaagtttggcgcgcctctacaagcctgaagccccctaccgccgacctgtttactggcgttcttcctaatgggtacaatccaccccggaacttgtgctgggacgtcctgtgtgtcgaccagccgctggtagaagatccacgaagcccagagtataatgctaaggagcttgtcgactattttcttaacgtcgcgactgctcaggggagatattatagaaccaatcacacagtaatgaccatgggtagtgacttccaatatgagaatgctaacatgtggttcaagaacttagacaagttaatcagactggtgaacgctcagcaggcaaagggctctagtgttcatgtgctctatagtaccccagcctgttacttgtgggaattgaacaaggcaaacctgacatggagcgtaaagcatgatgacttcttcccctatgccgatggcccgcaccagttctggactggatattttagtagcaggccagctctcaaaagatatgagaggctcagctataactttctgcaggtgtgtaatcagctggaggcccttgtgggtctcgccgcaaatgtaggaccatacgggagtggtgactctgctccactgaacgaggccatggcagtgttgcagcaccacgacgctgtgtccgggactagccgccagcacgtggctaacgattacgctcgacagcttgccgccggatgggggccgtgtgaggtgttgctctccaacgcattggctcggttacgaggcttcaaagatcattttacattttgtcaacaattgaacatcagcatctgccccctcagtcagaccgcagcccgcttccaggttattgtttataacccccttgggcggaaggtcaattggatggtgcggctgcccgtgtcagagggggtctttgtggttaaggatcctaatggaaggaccgtgccttccgacgtggtgatctttcctagtagtgactcacaggcccacccccctgaacttctgttttccgcttcattaccagcgcttggtttctcaacatacagtgttgcacaggtcccaagatggaagcctcaagcccgcgccccccagccaatcccccgcagatcatggtcccctgcgctgaccatagaaaacgagcacatccgggcaacctttgatccggataccggcctgttaatggagatcatgaacatgaaccagcagctgctcctaccagtaaggcagacttttttctggtataatgcctccataggcgataacgagtctgatcaggccagcggcgcctacatattcaggccaaaccagcagaagcctctgccggtgagccggtgggcgcaaatacaccttgtgaaaaccccgcttgttcaagaggtgcaccagaatttctctgcttggtgttctcaagtggtacggctgtaccctggccaacgccatctggagctcgagtggagtgttggtccaatacccgtgggtgatacctggggcaaagaagtgattagccggttcgatacacccctggagactaaggggcgattctacacagactctaacggtcgggaaatcctggaacgtcggagggattaccggccaacctggaagctcaaccagacggaacccgtggcgggcaactattacccggttaacactcgaatctacatcactgatgggaatatgcagctcacggttcttactgatcgaagccaaggtggcagttccctgcgcgacggaagccttgaactcatggttcaccggaggcttctcaaggacgatggacgcggggtcagcgaacctctaatggagaacggctcaggcgcttgggtacgcggacgccacctagtgctgctcgacacagctcaggctgcggccgctggccacaggctactcgccgagcaggaggtgctggcgccgcaggtggtcctggccccaggcggtggggccgcctacaacctcggcgcaccaccacggactcagttctccgggctacggagggatctgccacccagcgtgcatctgctgacgctggcgtcatggggccccgagatggttttgctgcgcctggagcaccagtttgctgtgggggaagatagcgggcggaacctgtccgctcctgtgaccctgaacttgagggatctgtttagtacatttaccattactaggttgcaggaaaccacacttgtcgccaaccagctaagggaagccgctagcaggctcaagtggactactaataccggacctactccacaccagaccccatatcagttggatccagccaacattactctcgagccaatggagataaggacattccttgccagcgtccaatggaaagaagtggacggc

SEQ ID NO: 16507 - DNA, 3033 bp, Artificial Sequence
  Description of Artificial Sequence: Synthetic coding sequence
atgggagcctacgcgcgggcctcaggggtgtgtgcgcgcggatgcttggactcagcgggcccttggactatgagccgggcgctgcgcccaccgcttcccccactgtgcttcttcctgctgcttcttgctgcggcgggagcaagagcgggaggatacgaaacctgcccaaccgtgcaaccgaacatgctcaatgtgcatctgctcccgcatacccacgacgatgtcgggtggttgaaaactgtggatcagtacttttacggaatcaaaaatgacatccagcacgcgggcgtgcaatacattctcgattccgtgatcagcgccctccttgcggacccaaccagaagattcatctacgtcgaaatcgcattcttctcgagatggtggcatcaacaaaccaatgcgacccaagaagtggtgcgtgatctcgtgagacaaggccgcctcgagtttgccaacggaggatgggtcatgaacgacgaagccgccactcactacggagcgatcgtggaccagatgactcttggacttagatttctggaagatacctttggaaacgatggtcgcccacgggtcgcgtggcacatcgatccattcggacactcacgggagcaggcgtcgctgttcgcccagatggggttcgacggatttttctttggccggctggactaccaggataagtgggtgaggatgcagaaactggaaatggaacaagtctggcgcgcatcaacctcactgaagccaccgaccgccgacctcttcactggcgtgctccctaacggctacaatccgccacggaatctctgttgggacgtgctgtgcgtggaccagccgctggtggaggacccgcgcagcccagaatacaatgccaaagagctggtggactattttctgaacgtggccaccgcgcagggtcgctactacaggactaaccataccgtgatgaccatgggctcggacttccagtacgaaaatgccaatatgtggttcaagaatctcgataagctcattcgcctggtgaacgctcaacaggcaaagggatcctccgtccatgttctctacagcactccggcgtgttacctgtgggagctcaataaggcgaatctgacttggtcggttaagcatgacgacttcttcccgtacgcagacggcccgcaccaattctggaccggctacttctcgtccagaccggcgctgaaacggtacgaacggctgtcgtacaactttctgcaagtgtgcaaccagctggaggctctcgtgggactggctgccaatgtgggaccttacggaagcggtgactctgccccgctgaacgaagctatggctgtgctccaacatcatgacgctgtgtccggaacttctcgacaacacgtcgctaacgactacgcaaggcagctggcagccgggtggggaccctgcgaagtgctcctctccaatgcgttggcccgcctgaggggattcaaagaccatttcaccttttgccagcaactgaacatcagcatctgcccgctgtcgcagactgccgcccgcttccaggtgattgtctacaaccctctgggccgaaaggttaactggatggttcgactgcctgtctcagaaggagtctttgtggtgaaggacccaaacggccggacggtcccgtcggatgtcgtcattttcccgtcctccgattcacaggcacatccgcctgagttgctgttctcggcgtcattgcccgcgctgggattttcgacctactcggtggcgcaagtccctcggtggaagcctcaagctcgggcaccgcaaccgatcccacgcagatcctggtccccagcattgaccatcgaaaacgagcatatccgggcaactttcgaccctgatactggactgctcatggagataatgaacatgaaccaacaactgctgcttccagtgcgccagacgttcttttggtacaacgctagcatcggggacaatgaatcggaccaggcctccggagcttacatcttccggcctaaccaacagaagccccttccggtgtcgagatgggcgcaaatccacctcgtaaagaccccgctggtgcaagaagtccatcaaaacttcagcgcatggtgctcccaggtcgtgaggctctacccgggccagcgccacctcgaactggaatggagcgtgggaccgattccagttggcgatacctgggggaaggaagtgatctcgagattcgacacgccgctcgaaactaagggacgcttctacactgatagcaacggtcgcgagatcctcgaacgcagaagggactaccggccgacctggaagctgaaccagaccgaacccgtggccggtaactactatcccgtgaacacccggatctacatcaccgacggaaatatgcaactcacggtgcttacggacagaagccagggcgggtcctccctgagggacgggagcctggagctcatggtgcatcgccgacttctgaaggatgacggacggggcgtaagtgagcctcttatggagaacggatcgggagcatgggtcaggggacgtcaccttgtcttgctcgatactgcccaagcagcggcggcaggccatagactgctcgctgagcaagaggtgctggctccacaagtcgtgcttgcccctggagggggagccgcttacaatctcggcgccccgccacgcacccaattctcaggactgcggcgcgacctgccaccgtccgtgcatctgctgacgctcgcctcgtggggaccagaaatggtcctgttgcgcctggagcaccagtttgctgtgggagaggactccggacgcaatctctctgccccggtgactttgaatcttagagatctcttctcgacctttactatcactcgcctgcaggaaactaccctcgtggcgaaccaactgcgagaagcagcatcacggctgaaatggaccaccaacactggaccgactccgcaccagacgccataccagctcgacccggccaacatcactctcgaaccaatggagattcgcacgtttctcgcgtccgttcaatggaaggaggtggatggt

SEQ ID NO: 16508 - DNA, 3033 bp, Artificial Sequence
  Description of Artificial Sequence: Synthetic coding sequence
atgggtgcctacgccagggcctctggggtctgtgcccggggctgtctcgattctgctggcccctggacaatgagccgagcccttagacctccactgccccctttatgctttttcctgctgctgctcgccgcggctggggctcgggctggtggctacgaaacttgccctacggtgcaacctaatatgctcaatgtgcacttgctcccacatactcatgacgacgtagggtggttaaaaactgttgaccaatatttctacggtattaagaacgacatccagcacgcgggggtccagtacattctggactccgtaatctctgctctgttggcggatcctacccggagatttatatatgtagagatcgctttttttagtaggtggtggcaccaacagacgaatgctacgcaagaagttgtgagggacctcgtgcggcaggggcgcctggagttcgctaacggaggctgggtcatgaatgatgaagctgcaacccactacggggccattgtcgaccagatgacacttgggctgcgttttctagaggacacttttggtaatgacgggcggcctagggtggcctggcatattgacccattcggccattcccgcgaacaggcctcgctgttcgcgcagatgggctttgacggctttttttttggtaggcttgactaccaggataagtgggtgcgtatgcaaaaattagagatggagcaggtgtggagggccagcacctccttgaaacctccaactgcagatttattcaccggcgtgttacctaacggttacaaccccccacgaaatctgtgttgggacgttctgtgtgtggaccaaccgcttgtcgaggaccctcgcagcccagaatataatgctaaggagctagtcgactacttcctgaatgtggcgactgcacagggccgctattaccgaaccaatcatacggttatgaccatgggaagtgatttccagtatgaaaacgctaacatgtggtttaagaacctagacaagctgatccgattggtgaatgcccaacaggccaagggtagttccgtgcacgtgctatactcaacacctgcttgttacctctgggagcttaataaagctaacctaacctggtccgtgaagcatgatgattttttcccgtatgcagatgggccccaccagttttggacaggctacttcagcagtagaccagcgcttaagcggtacgagcggctgtcgtacaacttcctccaagtttgtaatcagctagaggcattggtgggacttgccgccaatgttggcccgtacggctccggggattcggcgcctctgaacgaggccatggccgtcctgcagcaccatgacgcagtgagcggcacgagtcgacagcacgtggccaatgattatgcccggcagctggctgcgggttgggggccatgcgaggtgttgctctccaatgcccttgcacgattacgaggcttcaaagaccacttcaccttctgccaacagttgaatatcagcatctgtcctctgtcacaaaccgcagcccgttttcaggttatagtgtataacccactgggaaggaaagtgaactggatggtacggctgcctgtctccgaaggtgtgttcgtggtcaaggatccaaacggccgaactgtgccgtcagacgtggttatctttccctcctctgatagtcaggcgcatcccccagaacttcttttcagcgcctctctgccagccctcggcttttccacatacagcgtcgcacaagtccctcgatggaaaccacaggcccgggctcctcaacctattcctcgaaggtcctggtcccccgcattgacaatcgagaacgaacacatcagggccacctttgatcctgatacggggctccttatggagattatgaacatgaatcagcagctgctccttcctgtgagacagacgttcttctggtacaacgcctccatcggggataatgaatctgaccaggcttccggggcgtacatcttccgacccaatcagcagaaacccctgccggtctcgcgatgggctcagattcacttagtcaagactcccctagtgcaggaagtacaccagaacttttccgcctggtgctcacaggtggtgaggctgtatcccggacagagacacttggagctggaatggtctgttgggccgatacctgtgggcgacacttggggcaaggaggttatatccagatttgacactcccctggagacaaagggcaggttttataccgattccaacggtagggaaatcctagaacgacgcagggactataggcccacttggaagctgaaccagaccgagccggtcgctggtaactattaccctgtaaacacccgcatttacattaccgacggtaacatgcaactcacagtgttgactgataggtcccagggcgggagcagcttgagggatggtagtctggagctgatggtgcacaggcggctgctcaaagatgatggccgaggggtgagtgaaccccttatggaaaacgggtccggagcatgggtgagggggcggcatcttgtgcttctcgatactgcccaagcagctgcagcgggacacaggttgttggcggagcaggaagttctagctccccaagtggttctggctcctggcgggggtgccgcctacaacctgggggctccccctcgcacacagttttcaggactgcgcagggatttgcctcctagcgtgcacctgctgactctagcgtcatgggggcccgaaatggtgctcctgaggctggaacatcagttcgcagtaggagaggatagcggacgtaatctgagcgccccagtcacactcaacctgagagacctattttccacgtttacaattacgaggctgcaggagaccaccctggtggcaaaccagctcagagaggctgcttctagacttaagtggaccaccaacaccggacctaccccccaccagacaccatatcagcttgaccccgcaaatattactctggagcccatggagatccgtacattcttggcgtctgtgcaatggaaggaagtggatgga

SEQ ID NO: 16509 - DNA, 3033 bp, Artificial Sequence
  Description of Artificial Sequence: Synthetic coding sequence
atgggcgcgtatgcacgcgccagcggcgtctgcgcacgcggatgcctggattctgccggtccctggaccatgtctcgcgcactcagaccccccctgccaccactgtgctttttcctcctcctgttggctgcagccggcgcccgcgccggaggatatgagacctgtcccacagttcagccaaacatgctgaatgtccacttgttgccccacactcatgatgacgtgggatggctgaagacagtagaccagtatttctatggtatcaagaacgatatccagcacgccggtgtccagtacattctggacagcgttatatccgcgttgctggctgatcctacaagaaggttcatctatgtcgagatcgcattcttctcccgctggtggcaccagcagaccaacgctacacaggaggtggtccgcgacctggttagacagggaaggctggaattcgcaaacggcggctgggtgatgaacgatgaagcagcgacccactacggtgctatcgtggaccagatgacactcggactgcgcttcctcgaagacacattcggcaatgacggaagacctagggtggcgtggcacattgatcctttcggtcacagccgcgaacaagcctctttgttcgcacagatgggcttcgatggctttttctttggccgcctcgactatcaggacaaatgggtaaggatgcagaagctcgagatggaacaggtgtggcgcgcctcaacatcactgaaaccccccacggcagacttgttcaccggtgttctgccaaacggctacaaccccccacgcaacctttgctgggatgtgctgtgcgtggaccagcccctggtagaggaccccaggtctccagaatacaacgcaaaggaactggtagactactttctcaacgtggctactgcccagggaaggtactacagaactaaccataccgtcatgaccatgggaagcgatttccaatatgagaacgctaacatgtggttcaagaacttggacaagctgattcgcctcgtgaacgcccagcaggccaaaggatcctcagtccatgtcctgtactcaactcccgcctgttacctgtgggaattgaacaaagcaaatctgacttggtcagttaaacatgatgacttctttccttatgctgatggtccgcatcagttctggaccggttacttctctagccgcccggctctgaaaagatacgaaaggttgtcttacaactttctgcaagtgtgtaaccaactcgaagctctggtgggtctggcagctaacgtgggaccttacggcagcggtgactcagcccccttgaacgaagctatggctgttctccaacatcacgatgccgtcagcggtaccagccgccaacacgttgccaatgactacgccagacagctggccgctggatggggaccttgcgaggtcctgctctccaatgccctcgctagactgagaggctttaaggaccatttcacgttctgccagcaattgaatatttccatatgtccactttcccagacagccgcaagattccaggtcatagtctataacccattgggaagaaaagtgaactggatggtgcgcctgcccgtctccgagggcgtctttgtggtcaaggatccgaatggcagaacagtgcctagcgacgttgttatttttccatctagcgattctcaggcccacccccctgagttgcttttctctgctagtctgcccgctttgggattctctacatactccgtggcccaggttccaaggtggaaaccacaagctcgcgcacctcagccaattcctaggcgctcatggagccctgctctcacaattgagaacgagcacatcagggcaaccttcgacccagatacgggattgctcatggagatcatgaatatgaatcaacagttgctcctgccggtccgccagactttcttttggtacaatgcctcaattggagacaatgagagcgatcaagcttcaggcgcatatatttttcgccccaaccagcaaaagcccttgcctgtgtctaggtgggcccagatacacctggtaaaaactcccttggtccaagaagtacaccagaatttttctgcttggtgttctcaggtagtgaggctctatccaggtcaaaggcacctggagctcgagtggtctgtgggccctatccctgtcggtgatacatggggcaaagaggttatctcccgctttgatactcctctggaaacgaaaggccgcttctacacagacagcaacggccgcgaaatcctggagagaagaagagactacaggcctacctggaagctcaaccagactgaacccgtcgccggcaattactatcctgtgaatactaggatctacatcacagacggcaacatgcagctgaccgtgcttactgacaggtctcagggcggctccagcctgcgcgacggcagcttggagttgatggtgcatcgcaggcttctgaaggacgacggacgcggagtgtcagagccgcttatggaaaacggttccggagcgtgggtgaggggccgccatctggtcctcttggacacggcgcaagccgcagctgccggccatagactcctcgccgagcaagaggtgctcgcccctcaggttgtcctggctccaggtggcggcgctgcctataacctgggtgctccccccaggactcagttctcaggactgcgcagggacctgcctccaagcgtgcatctgcttacacttgcttcatggggccccgagatggtgttgctcagactggaacaccagttcgccgtaggtgaagattctggcagaaacctctccgcccctgtaaccctgaacctcagggatttgttctctaccttcactattaccagacttcaggagaccaccctggtagccaatcagcttcgcgaggctgcctcaagattgaagtggaccaccaatactggtcccacaccccaccagacaccatatcagttggatccggctaatatcaccctggaacccatggagatcaggacgttcctggcttcagtccagtggaaggaagtggatgga

SEQ ID NO: 16510 - DNA, 3033 bp, Artificial Sequence
  Description of Artificial Sequence: Synthetic coding sequence
atgggggcatatgcacgcgcctctggcgtatgcgctcgtggatgtttggattcagccgggccatggacaatgtcgcgtgctttgcgcccgcccctgccacctctgtgctttttcttgttgctcttggctgccgctggcgcaagagcaggaggatacgagacatgtccgacagtccagcccaacatgctgaacgtgcacctgctcccccacacacatgacgatgtgggatggctgaaaacagtggaccagtacttttacgggataaaaaacgatattcagcacgcgggcgttcaatacattctggattccgtgattagtgctctgctcgctgatcccacccggagattcatttacgtggagattgcgttcttctcccgatggtggcaccaacagacaaatgcaacacaggaagtggtccgggatcttgtccggcagggcaggctggaattcgcaaatggcggttgggtcatgaacgacgaggccgccactcactacggggctatcgtagaccagatgacgctgggcctccggtttctggaggataccttcggcaatgatggtcgtcctcgtgtggcttggcatattgatccctttggacacagcagggagcaagcttcgctttttgcccaaatgggattcgatgggttctttttcggacggctcgactaccaagataagtgggtgagaatgcagaagctagaaatggagcaggtgtggagggccagcaccagcctgaagccaccaactgctgatttattcactggggttctacctaacgggtacaatccaccccgcaacctgtgctgggatgtgctgtgcgtcgatcagcctttagtggaagacccacgctcccccgagtacaatgccaaagagctggtcgactatttcctgaacgtcgcgacggcacaagggagatactatcgcaccaaccataccgtgatgaccatgggcagtgattttcagtatgagaatgccaatatgtggtttaagaatctggacaaactgataaggctggtaaacgctcagcaggccaaaggatcctccgttcacgtcctgtattctaccccagcttgttatctgtgggagctaaacaaggcgaatttgacatggtctgtgaagcacgacgacttcttcccatacgccgatgggccccatcagttctggacgggctatttcagcagccgtccggccctcaagaggtacgagcgcctttcgtataacttcctgcaggtgtgcaaccaattggaagctctggtgggactggcagccaatgtgggtccatacgggtctggcgactcagctcctctgaatgaggctatggccgtgctccaacatcacgatgcggtgagtgggacatcccgacagcacgtcgcgaatgattacgcccggcagctggccgctggctggggcccttgtgaggtgctgctgtctaatgccctggcccgcctgagagggtttaaggatcacttcacattttgccagcagctgaatatctctatttgccccctgtctcagacggcagctaggtttcaggtgatcgtgtacaatcctcttggacggaaagtcaattggatggttcgcttgccggtgtcagaaggcgtgtttgtggtgaaagacccaaacggcaggaccgttccatcggatgtggtgattttccccagctccgacagtcaagctcatccaccagagcttctattctctgctagcctgcctgcactcgggttcagcacctactccgtggcccaggtgccaaggtggaagcctcaggcccgcgccccccaacccatcccgagacggagttggagtcccgcgttgaccatagaaaatgaacatatccgcgccacctttgatcctgataccggactcctcatggaaattatgaacatgaatcagcagcttctcctccctgtgagacaaaccttcttctggtacaacgccagcattggggacaacgagtcagatcaggcgagtggtgcttatatattccgtccaaaccaacagaagccacttcctgtgtcacgctgggcccaaatccacctagtcaagacaccattggtccaagaggtgcaccagaatttctcggcctggtgcagtcaagtcgtgcggctctatcctgggcagaggcacctggaactggagtggagtgtcggacctatccctgtgggtgacacatggggtaaggaggtcattagccgtttcgatacccctctcgagaccaaaggccgattctacacggactctaatggaagagagatactcgaaaggagaagagattatagaccaacctggaagttgaaccaaactgagcctgtggctggaaactactaccccgtcaatacacgcatctacattacggacggcaatatgcagctcacggtgctaaccgaccgatcccagggcgggagctccctcagggatggatctttggagctcatggtgcacaggagactcctcaaagatgacgggcggggcgtgagtgagccccttatggaaaacgggtcgggcgcatgggtccgaggcaggcatttagtgctcctggatacagcccaggccgccgccgcaggtcataggttgctggctgaacaggaggtactggccccacaggtagtgctcgctcccggaggcggagccgcctacaacctgggggcacctccacggactcaattttccggcctcagaagggacctgccaccctcagtgcacttgcttaccctggcttcatggggtccagagatggtgctgctgcgtctcgaacatcagtttgccgtaggagaagattcgggcaggaatctgtctgcacctgtgacattgaacttacgggacttgttttccacttttactatcacacggctccaggagacaacactggtggctaatcagctgcgtgaagcagcctcacggctgaagtggacgactaatactggccctacccctcatcagacaccatatcagctcgatccagctaacatcaccctggagcctatggaaatcaggacgtttctggctagcgtgcagtggaaggaagtggatggg

SEQ ID NO: 16511 - DNA, 3033 bp, Artificial Sequence
  Description of Artificial Sequence: Synthetic coding sequence
atgggagcatacgcgagagccagcggagtgtgtgcaaggggatgtctcgacagcgcaggaccgtggacgatgtcgagagctctccggccacccctgccgcctctgtgcttcttcctgcttctccttgcagctgcaggcgctcgagcgggcgggtacgagacgtgtccaaccgtgcagccaaacatgttgaatgtgcatctgcttcctcatacccacgatgacgtgggatggctgaagactgtcgatcagtacttttacggaatcaagaatgatatccagcacgccggcgtccagtacatcctggactcggtgatctccgcactgctggcggatccgactagaaggttcatctacgtggaaatcgcgttcttctcaagatggtggcaccaacaaaccaatgctacgcaggaggtcgtgagggacctggtccgccagggtagactggaatttgcgaacggaggatgggtgatgaacgacgaagcagcgactcattacggtgcaatcgtcgaccaaatgaccctcggactgcgattcctcgaagatactttcgggaacgacggacgcccacgcgtggcctggcatattgacccgtttggccattccagagaacaggcctcactgttcgcccaaatgggattcgacggattcttttttggacgcctcgactaccaagacaaatgggtgaggatgcaaaaacttgagatggaacaagtgtggcgggccagcacctccctgaaacctccaaccgccgacctgttcaccggagtgctgccgaacggatacaaccctccacgcaatttgtgctgggacgtgctgtgtgtcgaccagccgctggtggaagacccgaggagcccggaatacaatgcgaaagagcttgtcgattacttcctgaacgtggccaccgctcagggccgctattaccgcaccaaccataccgtgatgactatggggtccgactttcagtacgagaatgcaaatatgtggttcaagaacctcgacaagctgatccgcctggttaacgcacagcaggccaagggttctagcgtccacgtgctgtactcaactcccgcctgttacctctgggaacttaacaaggctaacttgacttggtccgtcaagcacgatgatttctttccgtacgcggacggccctcatcaattctggacgggttacttttcatcacgaccagcgctcaaacgctacgaacgcctctcgtacaattttctgcaagtctgcaatcagttggaagccctcgtcggcctggctgcgaatgtgggaccatacggctcgggggacagcgcgccactgaacgaagcaatggccgtgctccagcaccacgacgcagtgtcaggcacttctcggcagcatgtggcaaacgactacgcgcgccagctggcagcgggatggggaccatgcgaggtgctcctgtcgaacgctcttgcgagactgaggggtttcaaagaccactttactttctgtcaacagctgaacatcagcatctgcccgctgtcgcaaaccgccgcgcggttccaggtgatcgtgtacaatcccctggggcgcaaggtgaactggatggtgaggctgccagtctccgagggggtgtttgtcgtgaaagatccaaatgggcgcaccgtgccatcagatgtcgtgatcttcccatcgtcagactcgcaggctcatccgcccgaactgctcttctcggcatccctcccggccctgggattctcaacctacagcgtggcgcaggtgccccgctggaagcctcaggccagagccccccaaccgattcctaggagatcgtggtccccggcgctgactatcgagaacgagcacatcagagccactttcgacccagacaccggacttctgatggagatcatgaacatgaatcagcaactccttctgcctgtgcggcagaccttcttttggtacaacgcctccattggagacaacgaatcggaccaggcatcgggcgcctacatctttcgccctaatcagcaaaaaccgctgccggtttcccgctgggcccaaatccatctggtgaaaaccccactggtccaagaagtgcaccagaatttctccgcgtggtgctcgcaagtggtgcggctgtacccggggcaacgccacctggagctggagtggtcagtcggaccaatcccggtgggagacacttggggcaaggaggtcatctcgcggttcgacactccactggaaaccaagggcaggttctacaccgatagcaatggccgggaaattctggaaaggagacgggactaccggcctacctggaaactgaatcagacggaaccagtggccggtaattactatccagtgaacactcgcatctacatcactgacggaaacatgcagttgactgtccttactgaccggtcgcagggaggatccagcttgcgcgatggctccctcgaactgatggtccatcggcgcctccttaaggacgatggccggggtgtgagcgaaccgctcatggaaaatggctcgggagcctgggtgcgcggacgccacctggtgctgctcgacaccgcgcaggccgccgccgccggccatcggctgctggcagaacaggaagtcctggcgcctcaggtggtgctcgcccccggaggaggagcggcgtacaatctgggcgccccgccgcgcacgcagttttccggactcaggcgcgaccttccgccttccgttcatcttttgaccctggcctcgtggggaccagagatggttctcctgcgcctggaacatcaatttgccgtcggcgaagattccggcagaaacctgagcgctcccgtcacgctcaatctgcgggacctctttagcaccttcaccatcaccagattgcaggagactacgctggtcgctaatcaactgcgggaggccgccagccgcctcaagtggaccactaatactggccctaccccacaccaaaccccgtatcaattggatcccgcgaacatcaccctcgaacctatggaaatccgcaccttcctggccagcgtgcagtggaaggaggtcgacgga

SEQ ID NO: 16512 - DNA, 3033 bp, Artificial Sequence
  Description of Artificial Sequence: Synthetic coding sequence
atgggtgcatacgcacgtgcctcgggggtgtgcgcaaggggctgtctcgattccgcaggcccctggactatgtctagggcacttagaccacctctgccaccactctgttttttcctgctgctgcttgcggcggccggagcacgcgcaggaggttacgaaacctgccctactgtccaaccgaacatgctcaacgtccatctgttgccacacacgcatgatgacgtcgggtggctgaaaactgttgatcaatacttttacggaattaagaacgacatacaacacgcaggcgtgcaatacattcttgatagtgtcatctcggcactgctggcagacccgactcgccggttcatctatgtcgaaattgctttcttcagcagatggtggcatcagcagaccaacgctactcaagaagtggtgcgggatttggtacgccaaggcagacttgagttcgcgaatggagggtgggtcatgaatgatgaagcagccacccattacggggcaattgtcgaccagatgactttgggattgcggttccttgaagatacttttggaaacgacggtagaccacgagtggcgtggcatattgatccgttcggccactctcgcgaacaagccagcttgtttgcccagatgggctttgacggttttttcttcggcagactcgattaccaggacaaatgggttagaatgcagaagctggaaatggaacaggtgtggcgggccagcacgtcgctcaagccccctaccgcagacctgttcacgggggtcctgccaaacggctacaacccgccgaggaatctttgctgggacgtcctctgtgtggaccaacctctggtcgaggatccgcgttcaccggaatacaacgcaaaggagctggtcgactactttttgaatgtcgcgactgcacaggggagatactacagaacgaatcacaccgtgatgaccatgggaagcgactttcagtacgagaatgcaaacatgtggtttaagaacctggataaactcatccgcttggtgaacgctcaacaggcgaagggatcatcagtgcacgtcctgtacagcacccccgcgtgttacctctgggaactgaataaggcaaaccttacctggtccgttaaacatgacgatttcttcccttacgcagatgggcctcatcagttttggactgggtacttttcctccaggccagctcttaaacgttacgagcgcttgagttacaactttctgcaagtgtgtaatcaattggaagctcttgtcggactggccgcaaatgtgggtccttacggctcgggcgattcagctcctctcaacgaagcaatggcagtgttgcagcatcacgatgccgtctcgggaacgtcccgccaacatgtagctaacgactatgcgcggcagcttgcagcaggctggggtccttgcgaggtgcttctgtcaaatgcactggcccgccttagaggattcaaggaccactttaccttttgtcaacagcttaacatttcaatttgtcccctgtcccaaaccgcagccagattccaagtgatcgtgtataacccactgggaagaaaggtgaactggatggtccgcctcccagtctcagagggagtgtttgtggtgaaagatcctaacggaagaaccgtgccatcagatgtggtgatctttccttccagcgattcccaagcacaccctccagaacttttgttttcggcctcccttccggcccttggattttccacttacagcgtagcacaggtgcctaggtggaagccccaagcccgtgcaccccaacctatacctagacggtcgtggtcccctgcacttactatcgagaatgaacacatcagagcaacctttgatccagatactggactgctcatggagattatgaatatgaaccagcaacttctgctgccagtgcgacagactttcttttggtataacgcatcgattggtgataatgagtcagatcaggccagcggagcctacattttccggccaaatcaacaaaagccacttcctgtgtcccgctgggctcagatccatctcgtcaagacgccgcttgtgcaagaagtccatcaaaacttctccgcatggtgttcgcaggtggtgaggctgtaccctggacagcgccacctggaactcgagtggtcggtgggtcccattcctgtgggagatacctggggtaaggaagtgatctcgcggtttgataccccactggaaactaaaggacgtttttacactgattctaacgggcgggaaatcctggagcgcaggagagactaccgcccaacttggaagttgaatcaaaccgagcctgtcgcaggcaactactaccccgtgaatacccgtatatacataacggatggtaacatgcaactgaccgtgctgacggaccggtcacagggtggaagcagccttagagacggatctcttgagctcatggtgcatcggagactgcttaaggatgatggccggggtgtctccgaacccctgatggagaacggctcgggtgcctgggttcgcgggagacatctggtgttgctcgatacggcccaggcagccgcagcagggcatagattgctggcggagcaagaagtgctcgcccctcaagttgtgcttgcccctggtgggggagccgcttacaatctgggcgcgccgcctcggactcagttttccggacttcgcagggacctgcccccatcggtgcatctgttgaccctggcgtcctggggacctgaaatggtgcttctgaggcttgaacaccagtttgcggtgggtgaggatagcggtcggaacttgtcagcaccggtcaccctcaacctccgcgacctcttctcgacctttactattacccgcctgcaggagactactcttgtggcaaatcaactcagggaagcggcctctcggctgaagtggacgaccaataccggccccaccccacatcagactccctaccagctcgaccctgcaaacattacccttgaacctatggagattaggacctttttggcatcagtgcaatggaaagaagtggatgga

SEQ ID NO: 16513 - DNA, 3033 bp, Artificial Sequence
  Description of Artificial Sequence: Synthetic coding sequence
atgggggcatacgcccgcgctagcggagtgtgtgcccgcggttgtctggatagcgcaggaccatggacgatgtcccgggccttgcgcccgccgcttccgccactgtgcttcttccttctgctgctggcggcggccggcgcgagagccggaggttacgaaacttgcccgactgtgcagccaaatatgttgaatgtgcatctgctcccacacacccacgatgacgtgggctggctgaaaaccgttgatcagtatttctacggcattaagaacgatatccagcatgccggagtgcaatacattctcgattcagtgatctccgcgctgctggcagacccgactcggagattcatctacgtcgagatcgcattcttctcacgctggtggcaccagcaaaccaacgcgacccaggaggttgtcagggacctcgttcggcaggggcgcctggagttcgccaatggcggatgggtgatgaacgacgaggccgcgacccactacggcgcaatcgtcgaccagatgactctcggtctgcggttcttggaagatactttcggcaatgatggacgcccgcgagtcgcgtggcacatcgacccattcggccattcgcgggaacaggcctccctgttcgcccagatgggcttcgatggatttttcttcggaaggcttgattaccaggacaagtgggtccggatgcagaagctggaaatggaacaagtctggagagccagcacttcactcaagccaccaacggccgatttgtttactggagtgctgccaaatggttacaatcctccgcgcaatctgtgctgggacgtgctgtgcgtggaccagcctctcgtggaagatccgcgctcccccgagtataatgcaaaggaactggtcgactacttcctcaatgtggccactgcccaaggacgctactaccggaccaaccatactgtgatgactatgggatcagatttccagtacgaaaacgcgaatatgtggttcaagaacttggacaaactcatccgcttggtgaacgcccagcaggccaagggttcgtccgtccacgtcctgtactcgactcccgcatgctacttgtgggagctcaacaaagcaaatcttacgtggtcagtgaagcatgatgacttttttccgtacgcagatggcccccaccaattctggaccggatacttctcctcaaggccggcgctgaagaggtacgaaagactgtcgtataacttccttcaggtgtgcaaccagttggaagcactcgtgggcctggcggccaatgtcggaccctacggaagcggagattcggcaccgttgaacgaagccatggcggtcctgcaacaccacgacgcagtgtccggcacctcacgccagcacgtcgctaacgattacgctaggcagctggccgcgggttgggggccctgtgaggtgctgctgagcaacgcgctggcccggctgcgcgggtttaaagatcactttaccttttgtcaacagctgaacatatccatctgccccctcagccagaccgcagccagatttcaggtgatcgtgtacaatcctcttggccgcaaggtgaattggatggtgcgcctgccagtgagtgaaggagtgttcgtggtgaaggacccgaatggaagaaccgtgccatcggatgtggtgattttcccgtcgagcgacagccaggcccatcctccggaactcctgttcagtgcatcactgcccgctctgggattctcaacttactccgtggcacaggtgcctcggtggaaacctcaggccagggctcctcaaccgatcccgcgacggagctggtccccagccctcaccatcgaaaacgagcacatccgggccactttcgatcctgatactggactcctcatggaaatcatgaacatgaaccagcagctcctcctgcccgttcggcagactttcttttggtacaacgcaagcattggggataacgaatccgatcaggcatccggagcttacatcttccgtccgaaccaacaaaagccactgcctgtgtcgcgctgggcccagatccatctggtgaaaaccccgcttgtccaagaggtgcaccagaacttcagcgcctggtgttcccaggtggtccggttgtatcctgggcaaagacacctggaactggaatggtcggtgggacctataccagtcggagatacttggggtaaggaggtaatctcccgctttgatactccgctggagactaagggccggttttacactgattcgaatgggagagaaattctcgagagacggcgggactaccgccctacttggaagctcaaccagaccgagccagtggcgggaaactactacccggtgaacacccggatctacatcactgatggaaatatgcagctgactgtcctgactgaccgatcacagggcggctcatcgctgcgggatggcagcttggaactgatggtccatcgccggctcttgaaggacgacggacggggtgtctccgaacccctgatggaaaacggctcaggggcgtgggtgcggggacggcacctcgtactcctggataccgcacaggctgctgccgcgggccatcgactgttggccgagcaggaggtcttggctcctcaggttgtccttgcaccaggagggggcgctgcatataacctcggcgctccgccgcgcacccaattctcgggactccgccgcgatctgccaccgtccgtgcatcttcttaccttggcgtcctgggggccggaaatggtgctcctccggctggaacatcagtttgctgtgggcgaggactcgggacgaaatctctcagctccagtgacgctgaatctgcgcgacctgttcagcaccttcaccatcaccaggttgcaagagacgaccctggtcgcaaaccagctgcgcgaggccgctagccggcttaagtggaccaccaacactggtccgaccccgcaccaaacgccctaccaactggatccagccaacataacgctcgaaccgatggaaatccgcaccttcctggcctcggtgcaatggaaagaagtcgacgga

SEQ ID NO: 16514 - DNA, 3033 bp, Artificial Sequence
  Description of Artificial Sequence: Synthetic coding sequence
atgggcgcatacgcaagggcgagcggggtgtgtgcaagaggctgtcttgatagcgccggaccctggactatgtcgcgcgctcttcgccctccactgccacctttgtgcttttttctcctgctgttggcagcagcaggggcgagagcaggtggatacgagacgtgccccaccgtgcagcccaacatgcttaatgtgcacctgctgcctcacacgcatgatgatgtgggatggctgaaaactgtggaccaatacttctacgggataaagaatgacattcaacatgcgggcgttcagtacatcctcgatagcgtcatatccgcgcttctggctgaccccacccgtagattcatatacgtggaaatcgcctttttctcgagatggtggcatcaacagactaatgcaacccaagaagtcgtgagggatctggttcggcagggacgcctcgaattcgcaaatggtggatgggtgatgaacgatgaagctgcaacccattacggagcaatcgttgatcagatgactctggggctgcgcttcctcgaagatacgtttggaaatgacggtagacctagggtcgcatggcatattgacccgttcggacatagccgcgaacaggcatcgctttttgcgcagatgggctttgatgggttctttttcggacgactcgactaccaagacaagtgggtccgcatgcaaaaactggagatggaacaggtttggcgcgcgtcaacgtcgcttaaaccgcctaccgcagatctttttaccggtgtcctcccgaatggatacaatccgccgagaaacctttgctgggatgtgctctgcgtggaccagcccctggtcgaagatcccagatcgccagaatacaatgcgaaggagttggtggactactttcttaatgtggcaaccgcacagggaagatactacaggaccaatcacaccgtgatgactatgggctccgactttcagtacgaaaacgctaacatgtggtttaagaaccttgacaaactgattagacttgtcaacgcacaacaggcgaagggatcctcagttcatgtcttgtattccactcctgcgtgctatctttgggaactgaataaggccaatctcacctggtccgtgaaacatgatgatttcttcccgtacgccgatggacctcatcagttttggactggatacttttcatccagaccagcactcaagcggtacgaacgcctcagctacaactttctgcaagtgtgcaatcagcttgaagccctggtggggttggctgccaacgtgggtccatacggcagcggtgattcagcgccacttaacgaggcaatggccgtgttgcagcaccatgatgcagtgtctggtactagccgccagcacgtggcaaacgattatgcacggcagctggcagcaggatggggaccatgtgaagtcctgctgtctaacgcgctggcaaggctccgcggatttaaggatcattttacgttctgtcaacagcttaacatctcgatttgccctctctcccaaactgccgcacggtttcaagtgattgtgtacaatcctctcggacgaaaggtcaactggatggtgagacttccggtgtccgaaggcgtgtttgtggtgaaagaccctaacggaagaacggtgccgtcggatgtcgtgatctttccatcatcggactcgcaagcccatccccccgagctgctcttcagcgcgagccttcccgctctgggattttccacttattccgtcgcacaagtgcctagatggaagccgcaagcaagggccccacaaccaatccctaggcggtcctggtcccctgcactgactatcgaaaacgagcatattcgtgcaacttttgatccggataccgggctgctgatggagattatgaacatgaatcaacagctgctcctgcctgtccgacaaaccttcttttggtacaacgcaagcatcggggacaatgagtcggaccaagcaagcggggcatacatctttagacccaaccagcaaaagcctcttcccgtgtccaggtgggcacagatccacctggtcaagacccccctggttcaagaagtgcatcagaactttagcgcctggtgttcacaagtcgttcgtctttaccctggtcagcgacatctcgagttggaatggtcggtgggccccattccagtgggggatacctggggcaaggaggtgattagccggtttgataccccccttgaaaccaagggacgcttttacactgacagcaacgggcgtgagattcttgaacggagacgggattacagacctacttggaagctgaaccaaaccgaaccagtcgccggtaattactaccctgttaataccagaatttacattaccgacggcaatatgcagctgaccgtgttgaccgaccgctcacaaggaggaagctccctgcgcgacggttccttggagctcatggtgcaccggagactgcttaaggacgatggacgaggcgtgtccgaaccactgatggagaacggatccggcgcctgggtgcggggaaggcaccttgtcctgctggataccgcccaagcagcagctgcaggtcataggctcttggcagaacaagaagtgcttgcaccacaggttgtgctggcccccgggggaggcgcggcttacaacttgggagcaccacctcggactcagttctcggggctcaggcgcgatcttcccccatcggtccacctgttgaccctggcctcatggggacctgagatggtcctgctgcgtctggaacatcagtttgcagtgggggaagatagcgggaggaacctctccgcacctgtgacccttaacctgcgcgaccttttttcaacctttactattaccagactccaggagactaccctcgtcgcgaaccagcttcgcgaggccgcatccagactcaagtggaccacgaatacgggtccaacgccacaccaaactccctaccagcttgatccggctaacattactcttgaaccaatggaaatcagaacttttctcgcaagcgtgcaatggaaagaggtcgatggt

SEQ ID NO: 16515 - DNA, 3033 bp, Artificial Sequence
  Description of Artificial Sequence: Synthetic coding sequence
atgggggcatacgccagagcgtcgggcgtgtgcgcccgcgggtgtctcgactcggcgggaccatggactatgtcacgggccctgcgacctccactgcccccgctctgcttctttcttctgcttctggccgccgccggcgccagagcgggaggttacgagacttgcccgactgtccagccgaacatgctgaacgttcacctcctcccgcatactcatgacgatgtcgggtggcttaagaccgtggatcaatacttttatggaatcaagaacgacatccagcacgcaggcgtgcagtacatcctggactcggtgatctccgccctcctggccgacccaacccggaggttcatctacgtggaaatcgcttttttctcgagatggtggcaccagcaaaccaacgccacccaggaagtggtgcgtgacctcgtccgccaggggagactggaattcgcaaacgggggatgggtcatgaacgacgaagcggccacccattacggagcgatcgtggatcaaatgactctgggccttcgtttcctggaagatacgttcggcaacgacggacggccgcgcgtggcctggcatatcgaccccttcggccactcgcgcgagcaggcgtcactgttcgctcagatgggtttcgacggtttcttttttggaaggctcgattaccaggacaaatgggtccggatgcagaaacttgagatggagcaagtctggcgggcttccacttccctcaaaccgccgaccgcggacctctttaccggggtgcttccaaacggatacaatccccccaggaatctctgctgggatgttctgtgcgtggaccaacctctggtcgaagatccgcgttcgccggagtacaacgccaaggaacttgtggactatttcctgaacgtggccaccgcgcaagggcgctattaccgcacgaaccacaccgtgatgactatgggaagcgacttccaatacgagaacgcaaatatgtggttcaaaaatctggacaagctgataagactggtcaacgcgcagcaggcgaagggctcctccgtgcatgtcctttacagcactcccgcttgctatctgtgggaactgaataaggcaaacctcacctggtccgtgaagcatgatgatttctttccttacgccgacggaccgcaccaattctggactggatacttctcgtcccggccggcgctgaaaagatacgagcgcctgtcatacaacttcctccaggtctgtaatcaactggaagccttggttggcttggccgccaacgtgggcccgtacggatcaggcgacagtgccccactgaatgaagccatggcggtgctgcaacatcatgacgcagtgtccggaacttcacgtcaacacgtcgcgaacgattacgcccgccaattggccgcgggctggggaccgtgtgaagtgctgctctccaatgctctggcccgcttgcgcggattcaaggatcatttcactttctgccaacagttgaatatctccatctgcccactgtcgcagaccgccgccagatttcaggtgattgtgtacaatcctctgggtaggaaggtgaactggatggtgagactgccagtgtcggaaggagtctttgtggtcaaggacccgaacggccgaaccgtgccgtcagatgtggtgattttcccatcctcggattcgcaagctcacccgccagagctgctgttctccgctagcctccctgccttggggttctcgacctactccgtggcccaggtaccacggtggaaaccccaggcgcgggccccacaaccgattccacgccgctcctggtcgccagccctcactattgagaacgaacatatccgcgcgactttcgatccggacaccgggctcctgatggagatcatgaacatgaatcaacagctgctcctgcccgtccgccagactttcttttggtacaacgcgtccatcggggacaacgagtccgaccaagcctcaggcgcctacatcttccggccaaatcaacaaaagcctctccctgtgtcgagatgggcgcaaatccatctggtgaaaacgccactggtgcaggaggtccaccaaaacttctcagcttggtgctcccaggttgtgcggctgtacccaggacagcgccacctggagcttgaatggtcggtgggcccgatcccggtgggcgacacctgggggaaagaagtcatctcaaggttcgacaccccgcttgaaaccaaaggacggttctacacggactccaacggccgcgagattctcgaaaggcgcagggactacagaccgacttggaagctcaaccaaacggaaccggtggctgggaattactacccggtgaacacccgcatctacatcacggatggaaacatgcagcttactgtgctcactgatcgctcgcagggcggatcgtccctccgggatggttcgctggagctgatggtgcaccgccgcctgctcaaggatgacggaaggggtgtgtcggagccgctgatggagaacgggtcaggggcctgggtgcgcggacggcacctggtgttgctcgacaccgcccaggccgcagctgccggacatcggctgctggccgaacaagaagttctcgctccgcaagtggtcctcgcgccgggcggtggagcagcgtacaacctgggcgcaccacctcggacccaattctctggactgaggcgcgacctccctccatcggtgcatctgctgacccttgccagctggggaccagaaatggtgctgctgcgactcgaacaccagttcgccgtcggtgaagattcgggaagaaacttgtccgcccctgtgactctgaacctgcgggatctgttctcgaccttcaccatcacgcggttgcaagagactacccttgtcgcaaaccaactccgggaagctgcatccaggttgaagtggacgaccaataccggcccgactccacatcagactccgtatcagctggacccagcaaatatcaccctcgaacctatggaaatccgcaccttcctggcttctgtgcaatggaaggaagtggatgga

SEQ ID NO: 16516 - DNA, 3033 bp, Artificial Sequence
  Description of Artificial Sequence: Synthetic coding sequence
atgggagcatatgcccgcgcatccggggtgtgtgccagaggatgccttgattccgcagggccctggacaatgtctcgagccttgcgacccccccttcctcccctttgttttttccttctcctcctagcagcagccggagctagagccggagggtacgaaacttgcccaactgtccagcccaatatgctcaatgtccacctcctcccccatacacatgacgatgtgggatggctcaaaactgtggatcagtatttttatggaatcaaaaatgatatacagcatgccggggtccagtacattttagattccgtgatctccgcccttctggctgacccaactaggagatttatttatgttgagatagcgttcttttcccggtggtggcaccagcagacaaatgctactcaggaagttgtgcgagatctagtaagacaggggagacttgagttcgccaacggagggtgggtgatgaatgatgaagcagcaacacattacggagcaattgtggaccagatgactcttgggctgagattcctcgaagatacttttggaaacgatggacgccccagagtcgcatggcatattgatcccttcgggcactctagggaacaggccagtttatttgcacagatggggttcgatggattcttttttggaaggctcgactatcaggataagtgggtgcggatgcagaaacttgaaatggaacaggtctggcgggcttctacgagtctgaaaccccctacagctgatctttttactggggtacttccaaacgggtataaccccccccgaaacctctgctgggatgtgctctgtgtggatcagcctcttgtagaagatcccagatcccccgaatataatgctaaagaactggttgattattttcttaatgttgcaacagcccaggggcggtattatagaacaaatcacactgtgatgacaatggggtctgatttccagtatgaaaacgctaatatgtggtttaaaaacctcgataagttgatccggctcgttaacgctcagcaggctaaagggtcttccgtgcatgtactctattccacacccgcatgctacctttgggaactaaacaaagccaatttaacatggagtgtgaaacatgatgatttctttccctatgcagatggaccccaccagttttggacaggatatttttcttcccggcccgccctcaaacggtatgaaaggctttcatacaattttctccaggtctgcaaccagctggaagctctggtagggttggctgccaatgtgggaccatatgggtctggggattccgcccctttgaacgaggctatggctgttctgcagcatcatgatgcagtcagtgggacatccagacagcatgtcgccaatgattatgcccggcagttggccgccgggtgggggccatgcgaagtacttctgtccaacgccttagctagacttcgtggatttaaggatcatttcactttttgtcagcagctcaacataagtatttgtccactctcacagactgcagcaaggtttcaggttatcgtttacaaccccttgggacggaaggtgaattggatggttcggctgcccgtttctgaaggagtttttgttgtaaaagatcccaacggacgtacagtaccctctgacgttgtcatatttccttcaagtgattcacaggcacatccccccgaactgctcttctcagcatcccttcctgcgctggggttctccacttattctgtggcccaggtgcccaggtggaaaccacaggcccgggctccccagccaatccctaggcgcagttggagtccggctcttacaatcgaaaatgaacatataagggccactttcgaccctgatactggactcctcatggaaatcatgaatatgaatcagcagctcctgctgcccgtgaggcagacatttttttggtataacgcatctattggggacaacgaatccgatcaggcctctggagcctatatattcaggccaaatcagcagaaacccctcccagtttctcggtgggctcagatccatttagtgaaaacaccactcgtgcaggaagtccaccagaacttttctgcatggtgttcgcaggtggtgaggctttaccctgggcagcggcatcttgaattagaatggagtgtgggacccattcctgtcggggatacgtgggggaaagaagtaatatcgaggtttgatacaccccttgagacaaaaggaagattctatactgattctaatggaagggagatccttgaaaggcgaagagattataggcctacttggaaactcaatcagacagaacccgtagccggaaattactaccccgtgaatacaaggatatatataacagatgggaatatgcagcttactgtactgacagatcggtctcagggagggtcctccttaagggatggatccttggaactcatggtgcaccggcggctgctcaaggatgacggacggggagtgtccgaaccactcatggaaaacgggtccggagcatgggttagggggcgacatctggtgctcctggacacagctcaggcggcagcggctgggcaccggctactcgcagaacaggaagtgctggctcctcaagttgtgcttgctcctggagggggggctgcatacaatcttggggctcctcctcgaactcagttttctggactacggcgagacctcccccctagtgtccatttgcttactctggcatcctggggaccagaaatggtactcttacggctggaacaccagttcgccgtgggagaagattctgggcgtaacctaagtgcgccggtgactcttaatcttagggaccttttttcaacttttacaattactcgcctccaggaaacaactctggtcgctaatcagctccgagaagccgcatccaggctgaaatggactactaatacaggacccactccacaccagacaccttatcagctcgatcccgccaacattacactggaacccatggagatccgaacttttctggcatcagtccagtggaaagaagtagatgga

SEQ ID NO: 16517 - DNA, 3033 bp, Artificial Sequence
  Description of Artificial Sequence: Synthetic coding sequence
atgggagcttatgctagggcatcgggtgtttgtgctcgaggatgcttagactccgctgggccatggactatgagtcgtgccctcagaccgcctctgcctccactttgtttcttccttctgcttttggccgctgctggtgccagagctggaggatatgaaacctgtcccactgttcaacccaacatgttaaacgtgcatcttttgcctcacactcacgacgatgttggatggttaaaaacagttgatcagtatttttatggaattaagaacgatatccaacacgctggtgtgcaatatattcttgactctgttatatcagcgttacttgcggatccgactagacgatttatttatgtggaaatcgcatttttctccagatggtggcatcaacagactaacgctacacaagaggttgtacgtgatctggttaggcaaggccgattagagttcgcaaatggtgggtgggtgatgaacgacgaagctgccacacactatggtgctattgttgatcagatgactttgggtttgagattcctcgaagatacatttggtaacgatggacgccctagggtagcctggcatattgatccatttggtcactcaagggaacaagccagtttatttgcgcaaatgggtttcgatggtttctttttcggcaggttggactatcaggataaatgggtcagaatgcagaaattagaaatggaacaggtttggcgcgcctccacttctcttaaacccccaacggctgatctatttactggagtcctccccaatgggtataatccccccagaaatctgtgttgggatgttctatgcgtcgatcagccattagtggaagatcccaggtccccagaatataacgcaaaggagctggtcgattatttccttaacgttgctactgctcagggtagatattaccgtacgaatcacacagtgatgaccatgggatcggacttccaatatgaaaacgctaatatgtggttcaaaaatctagataagcttatcaggcttgtcaacgctcaacaagctaaaggaagttcagttcatgtattgtatagcacacctgcttgctacctgtgggaacttaacaaagcaaacttgacctggtctgttaaacatgatgatttctttccttacgccgatggacctcatcaattctggacgggttacttctcatcgagacccgcacttaagaggtacgagagactttcttacaacttcttgcaggtctgcaaccaattagaagctcttgtaggtcttgctgctaacgtgggtccgtatggttctggagattcagcaccgttaaatgaagctatggcggtgctccaacaccatgatgctgtttccggcacatccaggcaacatgttgctaatgattatgcccgacagcttgctgctggctggggtccgtgtgaggtccttctctcaaatgctttggctaggcttcgtggtttcaaggatcatttcaccttttgccaacaattaaatatctctatctgccctctgtcacagacagctgcaaggtttcaagtgattgtttacaacccattgggaaggaaggttaattggatggttaggttgcctgtgtctgagggggtctttgtggtgaaggatccaaacggacgaacggttccgtcagatgttgtcatttttcctagcagtgattctcaggcacatccacccgaactgcttttttccgcctccctgccagcactgggttttagcacctacagtgttgcccaggtacctagatggaaacctcaggcccgagcccctcagcctattcctagacggagctggtctcctgctcttaccattgagaatgagcacatccgagctacatttgatcctgataccgggttactcatggaaattatgaatatgaaccagcagctacttttaccagtgcgtcaaacttttttttggtataacgcttccattggggataacgaatccgatcaagcatccggtgcatatatttttagaccaaatcaacaaaagccactgcccgtctctaggtgggcacaaatacatttggtcaaaacaccacttgtacaagaagttcaccagaacttttctgcctggtgcagccaagtggtaagactttatccaggccaaagacatttggagttggaatggtctgttgggccaataccagtaggcgatacatggggtaaggaggttatctcccggttcgacacaccattggaaaccaaggggcgtttctacactgattccaacggccgcgaaatattggagaggagacgggattatcgacctacttggaagcttaaccagacggagcctgtggctggtaattactatccagttaacacgcgaatttatataacagacgggaatatgcagctgactgtgcttacagatagaagccagggggggagctcgttgagggatgggtcccttgagttaatggttcatcgtcgactcctcaaagatgacggtaggggggtgtcggaaccattgatggagaatgggtctggcgcatgggtgaggggccgacatttggttcttttggacactgcccaggcagctgcagcaggtcaccgcttgttggctgagcaggaagttcttgcaccacaagtcgtgctggctccaggtggcggtgcagcttacaacctgggtgcacctcctaggacacagttttcaggactcaggagagatttacctccttctgtacatcttcttacactggctagctggggtcccgagatggtattgctgcggcttgaacaccaatttgctgttggagaggatagtggtaggaatttatctgcacctgtgacacttaatctcagagatttgttctccacctttactatcacaaggctacaagagacaacgctcgtagctaaccagctcagagaggcggctagtcgtcttaagtggacaacaaatacaggtcctacccctcatcaaaccccttaccagcttgatcccgcgaacattaccttggagcctatggaaattaggacttttcttgcctctgtgcaatggaaggaggtcgacggg

SEQ ID NO: 16518 - DNA, 3033 bp, Artificial Sequence
  Description of Artificial Sequence: Synthetic coding sequence
atgggtgcatacgcacgtgcatccggcgtgtgtgcccgcggatgcctggattcggccggaccgtggactatgagccgagccttgaggccgccactgcccccactgtgctttttccttctcctgctggcagccgccggcgccagagctggaggatacgagacgtgcccaaccgtgcagcctaatatgctgaacgtgcacctcctgccgcatacccacgatgacgttgggtggctgaaaaccgtggaccaatacttttacggaatcaagaacgatatccagcatgccggcgtccagtacatccttgactcagtgatctcagccctcctggccgacccgacccggcgcttcatctacgtggagatcgcctttttctcccgctggtggcaccaacagactaacgctacccaagaggtggtccgggacctggtccgccagggacggctcgagttcgccaatggaggatgggtcatgaacgacgaagcagccactcactacggagccatcgtcgatcagatgactctgggcctgcggttcctggaagataccttcgggaacgatggacgaccacgcgtcgcctggcacatcgaccctttcggacattcgagagagcaggcatcattgttcgctcagatgggttttgatgggttcttcttcggacgcctcgattaccaagacaaatgggtgcgcatgcagaagctcgaaatggagcaggtgtggcgggcatccaccagcctgaagccgccgaccgccgacctcttcaccggagtcctgcccaacgggtacaatcccccgcgcaacctctgctgggacgtgctgtgtgtcgaccaacctctggtcgaggaccctcgctccccggaatacaatgccaaggagctcgtcgactacttcctcaacgtggctactgcgcagggaagatactatcggactaatcacactgtgatgacgatggggtccgacttccaatacgaaaatgcgaacatgtggttcaagaatctggataaactcatccggctcgtgaacgcgcagcaagccaaaggttcatccgtgcacgtgctttactcgactcccgcttgctacctctgggagctgaataaggccaatttgacctggtcggtcaagcatgatgacttcttcccatacgctgacggaccgcaccagttctggaccggttacttctcaagcagaccggccctgaagaggtacgaaagactctcgtacaacttcctccaggtgtgcaaccagctcgaagcgctggtcggactcgccgctaatgtgggaccatatggatcaggtgactcggcgcctctgaatgaggctatggccgtgctgcaacaccatgacgcggtgagcgggacctcccggcaacacgtcgcgaatgactacgcacggcaactggctgccggatggggaccttgcgaagtgctcctgtctaatgcactggcacggctgagaggcttcaaagaccacttcactttctgccagcaactgaacatttcgatttgccctctgtcccagactgccgcgagatttcaagtgattgtgtataacccgctgggaaggaaggttaactggatggtgcggttgcccgtgagcgaaggagtgttcgtcgtcaaggatccgaacggcagaactgtgccctccgacgttgtgatctttccttcctccgactcacaggcacacccgccggagttgcttttctcagcatcactgccggcgttgggcttcagcacttacagcgtggcgcaagtgccgaggtggaagccacaggcacgcgcgccccagcctatcccacgcagaagctggtcgccggcccttaccatcgaaaacgagcatatacgagcaaccttcgacccagatacgggcctgctcatggaaatcatgaacatgaaccagcaactcttgctgcccgtccgacagactttcttttggtacaacgcttcgatcggggacaatgagtccgatcaggccagtggagcctacatcttcaggcctaaccagcagaagcccctcccggtttcgcgctgggctcagatccacctggtgaaaaccccgttggttcaggaagtgcaccaaaatttttccgcgtggtgtagccaggtggtacgcctgtacccaggacagcggcatctggaactcgaatggtcagtgggtcctattccggtcggcgacacttggggcaaggaagtgatctcccgctttgacaccccattggaaaccaagggacgcttttacacggactccaacggcagggaaatcctggaacggagaagggattacagaccgacctggaaacttaaccagactgaaccagtggccggaaactactatccagtgaacacgcgcatttacatcaccgatggcaacatgcaactgactgtgctcaccgataggagccagggcggctcgtcgcttagagacggatcgctggagctgatggtccatcggcggctcctgaaggatgatggacgcggtgtgagcgagccgctgatggaaaatggctcgggcgcgtgggtccggggtcggcacctcgtcctgcttgacactgcccaggcggcggccgcgggacatcgccttctggctgaacaggaggtcttggccccacaggtggtgttggcgccggggggaggggcggcttacaatcttggcgcacctccgcgcacgcaattctctggtctgagacgggatctgccgccatcagtccatctgttgactctggctagctggggcccggagatggttctcctccgtcttgaacatcagtttgcagtgggggaagattctggacgcaacctgtcggccccagtgaccctcaacctgcgcgacctgttctccacctttacgatcacccggctgcaagaaaccactctggtggctaatcaactccgggaggccgcaagccgcctcaagtggaccactaacactggaccgaccccgcaccaaactccttaccagctggatccggcgaacatcaccctggaaccaatggagatcagaactttccttgcctcggtgcaatggaaggaggtggacgga

SEQ ID NO: 16519 - DNA, 3033 bp, Artificial Sequence
  Description of Artificial Sequence: Synthetic coding sequence
atgggggcatacgcacgcgcatccggcgtgtgtgcacgaggatgcctggattctgcaggcccttggaccatgtcaagagcgctgcgacctccactgccccctctgtgcttctttcttcttttgcttgctgccgcaggcgccagggccggcgggtacgagacctgtccaaccgtgcagcctaatatgctaaacgtacatctgctgcctcacactcacgacgatgttggctggctgaagaccgtagatcagtatttttatggcatcaagaacgacattcagcatgctggtgtgcagtacatcctggacagtgtgatctccgcgctgctcgcagatcctactcgtaggttcatctatgtggagattgcctttttttcgcgttggtggcaccaacagaccaatgccacgcaggaggtggtccgagatctggtgaggcaaggcagacttgagtttgcaaatggcggttgggttatgaacgatgaggctgctacccactacggcgctatagtggatcaaatgactctgggccttcggttcctggaggataccttcggaaacgacggacgaccacgcgtagcttggcatatcgaccccttcggtcacagtagagagcaggcctccctttttgctcagatggggttcgatgggttcttcttcggtagacttgactaccaggataagtgggtgagaatgcagaagcttgagatggagcaggtgtggagagcatcaaccagtttgaaacctcccacagcagatctgtttaccggtgttttacctaacgggtacaatccacctcggaatctgtgttgggatgttctgtgcgtagaccagcccctggtcgaggaccctcgatctccagaatataacgcaaaagaattggttgattatttcctcaacgtagccaccgcccagggcaggtactaccgaactaatcacacagtgatgacaatgggatcagattttcagtacgagaacgcaaatatgtggtttaagaatcttgataaattgatacgtcttgtcaatgcccagcaggctaagggaagcagtgtccatgtcctatatagtacccccgcatgctacctatgggagctgaacaaagccaatttaacttggtctgtaaagcacgacgatttttttccatatgcggatggaccacaccagttctggacgggatacttctcttcaaggcccgcgcttaaacgctacgagagactctcatacaattttctgcaagtgtgcaatcagttggaggcgttagtggggctggccgctaatgtgggcccatatggaagtggtgacagcgccccactcaacgaggccatggcagtgctgcagcatcacgacgcagtctccggcaccagtcgtcaacacgttgccaacgattatgcacgtcagctggccgccggatggggtccatgtgaggtgcttctgtcgaatgctttagccaggctgcgggggttcaaggaccacttcactttctgccaacagttaaatataagcatatgtccactctctcaaacagccgctcgctttcaggtgatcgtgtataaccctctggggcgcaaagtgaactggatggtgcgcctgccagtgtcagagggggtcttcgtcgtaaaggatcctaacgggagaactgtcccttctgatgttgtgatcttccccagtagtgactctcaggcccatccacctgagttgcttttttcagccagtctgcccgccctgggcttttcaacctattcagtggcccaggtgcccagatggaagccacaagcccgggccccccaaccaattcctaggcgctcatggagtcctgcacttacaattgaaaacgagcatattcgggccacctttgatccggacactggcttgttgatggagatcatgaatatgaatcagcagctgctgttgcccgtgcggcaaacatttttctggtacaatgcatctatcggggataatgagtctgaccaagccagtggcgcatatatttttagacctaaccagcagaaaccgctgcctgtcagccggtgggctcaaatccatttggtgaaaacgcctctagtgcaagaggtccatcaaaattttagtgcttggtgcagccaggtggttagactgtaccccggccagagacatctggagctggaatggtcagtcggtccgatccctgtgggtgatacttggggaaaagaggtcatttcaaggttcgacacacctctggagacaaaaggcaggttctacactgactctaacgggcgcgagattctagagaggcgcagggactatcggccgacttggaaacttaatcagacggaacctgttgccggcaattattatcccgtcaatacacgtatctacattaccgacggcaatatgcagctcacagttttgactgaccggtcccagggcggcagctccttacgggacgggtccctcgagttgatggtgcaccggaggctcctgaaggatgacggccgcggcgtgtccgagcctttgatggagaacggatccggagcctgggtgagaggtcgccacttggtgctgcttgacactgcccaggcagctgctgccgggcaccggcttctggccgaacaagaggtgctggcgccacaggtagtattggcaccaggggggggtgctgcctacaatctgggtgcacccccacggactcagtttagcggcttacggcgggaccttccaccttctgtgcatctgctgacattggcctcatgggggcctgagatggtgcttctgaggttggagcaccagtttgccgtgggcgaagattcagggcgtaacttgtcggcgcctgtgaccctgaatctaagggaccttttttctacattcactataacacggctacaagagaccacactcgtggccaatcaactcagggaagccgcctctcggttgaagtggactaccaacaccggtccaacaccacatcagaccccttatcagctggatcccgccaatatcacactcgagcctatggaaattcgtacctttctcgctagtgtacaatggaaggaggtggacggg

SEQ ID NO: 16520 - DNA, 3033 bp, Artificial Sequence
  Description of Artificial Sequence: Synthetic coding sequence
atgggtgcatacgctagagcaagcggtgtctgtgcaagggggtgcctcgacagcgcagggccttggacaatgtcgagggcactccggcctccgttgccccccttgtgctttttccttttgttgctcgctgccgccggagcgcgcgcaggcgggtacgagacctgcccaacagtgcagcccaacatgcttaatgtgcacttgctgcctcatactcatgatgacgtcggttggctcaaaactgtggatcaatatttttacggtataaaaaacgatatacagcatgctggcgtccagtatatcttggacagtgttatttcagctctgctcgccgaccccactcgcaggtttatttatgttgaaattgcctttttctcgaggtggtggcaccaacagaccaacgcaacccaagaggttgtgcgtgatttggtgcgccagggcagattagaattcgcaaacgggggttgggtcatgaacgatgaagctgccactcattacggagccatagtggatcagatgacgcttggtctccgttttcttgaagacacttttggtaacgacggacggcctagggtggcttggcatatcgatcctttcggtcattctagagaacaggcctccctctttgcccaaatgggattcgatggtttcttcttcgggcgcctggattaccaggataagtgggtccggatgcaaaagctggagatggagcaggtatggagggcctcgacctctctgaaacccccaactgctgacctatttactggagtattgcctaacggctataatccgccaagaaacctttgttgggacgtcctgtgcgtcgatcaaccactggtggaggatcctcgcagtcctgaatacaacgccaaggagttggtggactactttctgaacgtcgcaaccgcacaaggaaggtattatagaaccaatcacaccgtgatgaccatgggaagcgatttccagtacgaaaatgctaacatgtggtttaaaaacctggacaagctgatcagactcgttaacgctcagcaggccaagggtagcagcgtccacgttctttattccacacccgcatgctacctttgggagctgaacaaggccaacctgacttggagcgtgaaacacgacgacttctttccttacgcggacgggccacaccagttttggacaggctatttcagctcccggcctgcactgaaaaggtacgagaggctgtcatataacttcctgcaagtgtgcaaccaactggaggccctcgtgggccttgctgctaacgtcggtccgtacggcagtggagacagcgctccactgaacgaggccatggcggtgctgcaacatcacgatgctgtatccggcaccagtcgccaacacgttgctaacgattacgcgaggcaactggccgccggctggggtccttgtgaagttctgttatccaacgctctagctaggcttcggggttttaaagaccacttcaccttctgccaacagcttaacatctcgatctgccctttaagccaaaccgcagcccgattccaggtgattgtgtacaacccactcggaagaaaggtcaattggatggttcgacttcctgtgtctgagggggtcttcgtggtcaaggatccaaacgggcggacggttccgagtgatgtcgtcatctttcctagctcagatagccaggcccacccccctgaactcctctttagcgcctctttacctgctcttgggtttagcacctactccgtcgcgcaagtgcctaggtggaagcctcaggcccgggcccctcagcccatccccaggaggagttggagtcctgcactcacaatcgagaacgagcatataagggctacattcgatccagataccggactgctgatggaaattatgaatatgaaccagcaattgctcctccctgtcagacagacattcttctggtataacgccagcattggagataacgagagcgaccaggctagcggcgcctacatcttccgtcccaatcaacagaagcccctcccagtcagcagatgggcgcaaatccatctggtgaaaaccccccttgtacaggaggttcaccagaacttcagcgcgtggtgttctcaggtggtgcgcctgtatcccggtcaacggcatctcgagctggaatggagcgttggacctatccccgtaggcgacacctggggcaaggaagtgatcagccgctttgatactcccttggaaaccaagggccgcttctatacagacagcaatggtagggagatcctggaacgtagacgggactacagaccgacttggaaactgaatcagaccgagccagtcgctggaaactactaccccgtgaacaccagaatttacatcactgacgggaatatgcaacttacggttctcactgatagaagccagggaggttctagtctcagagacggctcccttgagcttatggtgcataggcgcctcctgaaagacgatggtagaggagtttcagagccactgatggagaacggatcaggcgcttgggtgcggggccgccatttggtgcttctggatacggctcaagccgccgctgcaggtcaccgcctcttggctgaacaggaagttttggcaccacaggtggtcttagcacctggtggcggtgctgcatacaaccttggtgctcctccaaggactcagttctccgggcttcgccgggatttgccaccctctgtccacctgctgactcttgcttcatggggacccgaaatggttctcttaagactggagcatcaatttgctgtgggagaggatagcggaagaaacctcagtgccccagtgaccctaaacctgagagatctatttagcacctttaccatcactcgtctgcaagagaccaccctggtggcgaaccagctcagagaggcagctagcaggcttaaatggactactaacacaggacctaccccccaccagacaccttatcagctggacccggctaacatcactctggagcccatggaaataaggaccttcctggcctctgtgcagtggaaagaggtggacggc

SEQ ID NO: 16521 - DNA, 3033 bp, Artificial Sequence
  Description of Artificial Sequence: Synthetic coding sequence
atgggtgcctacgctcgggcttcgggtgtctgcgcgcggggatgccttgactctgcgggtccctggaccatgagtcgtgcgctccgcccgccgcttcctccgctatgcttctttctgctcctactggccgcggctggtgcacgcgcaggcggctacgagacatgccctaccgtccagccaaacatgctgaatgttcacctgctgccgcatacccatgatgacgtcggttggctgaaaacagttgaccagtacttctacggaatcaagaacgatattcagcatgcaggcgtgcagtacatcctggactccgtcatctccgcgctcctggccgatcctacgcgtcgatttatctacgtggaaatcgcttttttctcccgttggtggcatcagcagaccaacgcgacccaggaggtcgtgcgggacctcgtgcgtcagggccgtcttgagttcgcaaatggtggttgggtcatgaacgatgaggccgctactcactacggagctatcgttgaccagatgaccttgggtctcaggttcctcgaggacaccttcgggaacgatggcagaccccgcgtggcctggcatatcgatcccttcggccactcccgcgagcaggcctctttgttcgctcagatgggctttgacgggttcttctttggtcgcctggactaccaggacaagtgggttcgcatgcaaaagctggagatggaacaggtgtggagagcgagcacctcactgaagccccctaccgccgacctgtttaccggcgttctcccgaacgggtacaacccacctcgcaacctctgttgggacgtcctctgcgttgatcaaccgctcgtagaagacccgcggtcgccggaatacaacgccaaggagttggtcgattattttctgaatgtcgcaacagcacagggtcgttattaccgtaccaaccacacggtcatgaccatgggcagcgacttccagtatgagaacgctaacatgtggttcaagaatctggacaagcttattcgactggtcaacgctcagcaggcgaagggttcttccgttcacgtgttgtacagcacccccgcctgctacctatgggagctcaacaaggccaacctcacctggagtgtgaagcacgatgacttcttcccatatgcggacggcccccatcagttctggaccggctacttctcaagtaggcccgctctgaagcgttatgaaaggctctcctacaacttcctccaggtctgcaaccagcttgaggccctcgtcggcttagcggctaatgtcgggccctacggctccggagattccgctccccttaacgaggccatggctgtgctgcagcaccacgatgcggtctctggaacttcccgacagcatgtcgctaacgactacgcgcgtcaactcgctgctggctggggcccgtgtgaggtgctgctctctaacgctttggcgcggctgcgcggatttaaggaccacttcactttctgccaacaactgaacataagcatttgtcccctttcgcagaccgccgcccgtttccaggtcattgtctacaaccccctcggtcgtaaggttaactggatggtccggttgcccgttagcgagggcgtcttcgttgtgaaggatcccaacggccgcacggtgccgtcggacgtggttatcttcccgtcctccgactcccaagcccatcccccggagttgctgttttccgctagcctcccggccctgggtttctccacgtatagcgtcgctcaggtcccgagatggaagcctcaggcgcgcgctccccagccgatcccgcgacgtagttggtctcctgctctaaccatcgaaaacgaacacatccgggcaaccttcgacccagacactggcctccttatggaaataatgaatatgaatcaacagcttctgcttcctgtaaggcagactttcttctggtataacgcctccattggtgataacgagtccgatcaggcctcgggagcctatatcttcagacctaatcaacaaaagccgctcccggtcagcagatgggcacagatccacctggttaagaccccgctcgtccaggaagttcatcagaacttttccgcatggtgtagtcaggtcgtgcgcttataccccgggcagcgccacctagagctggaatggtcggtaggcccgattcctgttggtgatacgtggggcaaggaagtgatcagcagatttgacacccccctcgaaacaaaaggccggttttacacggattcgaacggacgtgaaattctggagcgtcgtagagattaccgtccaacctggaagctcaaccagacagaacctgttgccggtaactattaccccgtgaacactcgcatttacatcaccgatggaaacatgcagctcaccgtgctgaccgatcgcagccaagggggatcgtccctccgggatggctcgctggagcttatggtccacagacgcttactcaaggatgacggtcgtggtgtctctgaacctttgatggagaacggttccggcgcctgggtaagaggtcgtcaccttgttttgttagacaccgcccaggctgctgctgccggacacagattgttagctgagcaggaagtgctggccccccaggtcgtcttggcccctggcggtggcgctgcttacaaccttggtgcgcccccgcggacccagttcagcggactccgacgcgatctacccccgtctgtccacctgcttactctcgcttcgtggggtcccgagatggtcctgctccgccttgagcatcaattcgccgtcggcgaggactccggccgtaacctcagtgcgcccgtcaccctgaacctcagagacttgtttagtaccttcaccatcactcggctgcaagagactacactagttgccaaccaactgcgtgaggcagcctcccggcttaagtggacgactaatacaggacctactcctcatcagactccgtaccagcttgaccctgccaacatcaccctggagcccatggagatccgaaccttcttggccagtgtgcaatggaaggaggtggatggg

SEQ ID NO: 16522 - DNA, 3033 bp, Artificial Sequence
  Description of Artificial Sequence: Synthetic coding sequence
atgggagcgtacgccagagcgtctggtgtttgcgccagaggttgtcttgattcggccggaccatggacaatgagtcgtgccctacgtccgccgcttcctccgctttgctttttccttctccttctcgccgcagcgggagcaagagccggaggatatgagacttgtccaacagttcaaccaaatatgctaaatgtgcacttgttgccgcatactcatgatgacgtgggatggctgaaaactgttgatcaatatttttatggaatcaaaaatgatattcaacatgccggtgttcaatatattcttgatagtgtcatttccgctctcttagccgatccgactcgccgttttatatatgttgaaatcgcctttttttcacgatggtggcaccaacagacaaatgcaactcaggaggtagttagggacctggtaagacaaggcagacttgaatttgcgaacggaggttgggtcatgaatgacgaggcagcaacgcattatggagccattgttgatcagatgacactgggtttgcgctttttagaggacactttcggaaatgatggtcggccaagggtagcatggcatatagatccatttggacactctcgagaacaagcatcattatttgctcaaatggggtttgatggtttttttttcggacgcctcgattatcaggataaatgggtaagaatgcaaaaactggagatggaacaggtgtggagagcatctactagtctcaaaccaccaacagcagacctcttcacaggagtccttcctaacggatataatcctccacgtaacttgtgctgggacgttctatgtgtggatcagccgctcgtggaagatccacggtctccagagtacaacgctaaggaattggtggattacttccttaatgtggcgaccgcacaaggaagatactatcgaactaatcacacagttatgactatgggcagtgatttccaatatgagaacgctaatatgtggttcaaaaatctggataagttgattcgtttggttaacgcacagcaggccaagggctctagcgtgcatgttttgtactcgacccctgcttgctatctatgggaattgaataaagcaaatttaacttggtctgttaaacatgatgatttctttccttacgctgatggaccacaccagttctggaccggatatttttcgagtcgtccagctttgaaaagatatgaacgattaagttataattttttgcaagtatgcaaccaactcgaagcattggttggactggctgctaacgttggcccgtatggctcaggtgattctgccccactaaatgaagcaatggctgtcttgcaacaccatgatgccgtctctggtactagtcgtcagcatgttgccaatgattacgcacgccaactcgcagctggatggggaccatgcgaggtgttgttatctaacgctttggcacggctcaggggttttaaggatcactttacattctgtcaacaattgaatatttctatctgtccactgtcccagactgcagcacgtttccaagtcattgtctacaatcctttgggccgaaaagtcaattggatggtccgactcccggtgtccgagggagtttttgttgtaaaggacccaaatggacgtacggtcccatcggacgtagtcatttttccatcgtcggattcccaagcccatccccctgagctcctgtttagcgcatccctaccagctttgggattttcaacgtactctgtagcccaagtgccacgatggaaaccacaagctcgcgcgcctcaacctattcctcgccgatcgtggtcaccagctcttaccattgaaaacgaacatattcgtgcgacattcgacccggatactggtcttttgatggagattatgaacatgaaccagcaattgctactacccgttcgccagaccttcttctggtataatgcgagcattggagataacgaaagcgatcaagcaagtggtgcatatattttccgaccaaatcagcaaaagccactaccagtcagcagatgggcacagattcatttagtgaaaacacctttggtccaagaagttcatcaaaatttctcagcttggtgttcccaagtggttaggctgtatccgggacagcgtcatcttgaactcgagtggagtgtagggcctattccagtcggcgatacatggggaaaagaagtcatatcgaggtttgataccccattagaaacaaagggaagattctatactgatagcaatggccgtgagattctggaaagacgacgagattatcgacctacatggaaacttaaccagactgagccagtagcgggcaattattatcccgtcaacacaagaatttacattactgatggaaatatgcagttgacggtcttgactgatcgaagtcaaggaggctcgtctcttcgagatggaagtttggaacttatggtgcaccgtagattgctcaaagatgatggcagaggtgtttcagaacccctcatggaaaacggatccggagcttgggttcgtggacgtcacttagtactccttgatactgcacaagctgccgccgcaggtcatagactccttgcagaacaggaagtcttagcgcctcaggtggtgttggcaccaggaggaggagctgcctataaccttggtgctcctccaagaacacaattctcaggactccgacgagatctgccgccctcagttcatttgttaaccttggcttcctggggaccagaaatggtgctattgcggttagaacaccagttcgcagtgggagaagattcaggaagaaatttgtcggcacctgtcactttgaatttaagagatcttttctctacgttcaccattactcgattgcaggagaccacactcgttgcaaatcagctacgggaagcagcatcaagattgaagtggacaaccaataccgggccaactccacatcaaacaccctatcaacttgacccagcaaatataaccctagaaccgatggagattagaacgttcctagcaagtgtgcaatggaaagaagtggatgga

SEQ ID NO: 16523 - DNA, 3033 bp, Artificial Sequence
  Description of Artificial Sequence: Synthetic coding sequence
atgggcgcgtacgccagggcgtccggcgtgtgcgcacgggggtgtctcgactcggccggcccgtggacgatgtcaagagcacttagaccgcccctccccccgttgtgtttcttcctgcttttgctggccgccgcaggagctcgcgccggagggtacgaaacttgcccaactgtccagccgaacatgctgaacgttcatctgcttccgcatacccacgatgacgtcggatggcttaagaccgtggaccaatacttctatggcataaagaatgacatccagcacgccggggtgcagtacattctcgattcggtcatctccgccctgcttgccgacccgacccggcggttcatctacgtggaaatcgcgttctttagcaggtggtggcaccagcaaaccaatgcgacccaggaagtcgtccgcgacctggtgagacaaggacggctcgaattcgcgaacggaggttgggtcatgaatgacgaggcagcgacccactacggtgctatcgtcgaccaaatgacgctggggctgagattcttggaagatactttcggcaatgacggacgcccacgggtcgcctggcatatcgaccccttcggacactcgcgggaacaggccagcctgttcgcccaaatgggcttcgatgggtttttcttcgggcgcctggattaccaggacaaatgggtgcgcatgcagaaacttgaaatggagcaagtgtggcgcgcgtccacctcccttaaaccgccaactgctgatttgttcacgggtgttttgccgaacggatacaaccccccacggaacttgtgctgggacgtgctctgcgtggatcagccgctcgttgaggatcctcggagcccagagtacaacgcgaaggagcttgtggattacttcctcaatgtcgccactgcacagggcagatactacagaaccaatcacacggtgatgacgatgggcagcgactttcagtacgaaaatgccaatatgtggttcaagaatctggacaaactgatcaggctggtcaatgcccaacaggcaaagggctcgtcggtgcacgtgctgtattcgaccccggcctgctatctctgggagctgaacaaggccaacctgacctggtcagtgaagcacgatgatttctttccgtatgccgacggaccgcaccaattttggaccgggtatttcagctcgaggccggccctgaaacgctatgagcgattgtcctacaactttttgcaagtgtgcaaccaacttgaagcactggtcggcctggctgcaaatgtggggccctacggctccggtgattcagccccactgaatgaggcgatggccgtcttgcaacaccatgatgcagtctcgggcacttctaggcagcatgtggcgaacgattacgcgcggcagttggccgccggttggggaccgtgcgaagtgctgctgtcgaatgcgcttgctaggctgcgcggcttcaaggaccactttaccttttgccagcagctgaacatctccatttgtccgctctcgcaaacggccgccaggtttcaggtgatcgtctacaacccactcggacgcaaagtcaattggatggtgcggcttcctgtgtctgaaggagtgttcgtcgtcaaggacccgaacggacgaacggtgccgtcagacgtcgtgattttcccttcatcggatagccaagcgcacccacccgaattgctcttcagcgcgtccttgccggcactcggtttctcaacgtactccgtggcgcaggtcccgcggtggaagccgcaagccagagccccgcagccaatcccccggcgcagctggtcgcctgccctgactattgagaacgagcacatccgcgcgacgtttgacccagacaccggactgctgatggaaatcatgaacatgaaccaacagctcctgctccccgtgcggcagactttcttttggtacaacgcatcaatcggagacaacgaaagcgatcaggcctccggggcgtacatcttcagaccgaaccagcaaaagccactgccggtgtcgcggtgggcgcagatccatctcgtgaaaacgccactggtgcaggaagtgcaccagaacttcagcgcctggtgctcccaagtggtgcggctttacccgggccagcgccacctcgaacttgaatggagcgtcgggcctatcccggtgggagatacttggggcaaggaggtgatctcccgcttcgacacccctctcgaaaccaaggggcgcttttacaccgattcgaatggaagagaaatcctcgaacgcagacgggactaccggccgacttggaaactgaaccaaactgagcctgtcgctgggaattactacccagtcaacactagaatctacatcactgatggaaacatgcagctcaccgtgctcaccgaccggtcgcagggcggttcgtctctgcgggacggctcactggaactgatggtgcaccgccggctgctgaaagacgacgggcgaggcgtctccgagcctctcatggaaaacggatccggagcttgggttcggggacgtcatctcgtgctccttgatactgcccaggccgctgcagcaggacatcgtctgctcgccgaacaagaagtcctggcaccacaggtggttctggcccctggcggaggggccgcctacaacctgggcgcgcctccccgcacgcagttcagcggactccggcgggatctgcccccatcggtgcatctgcttactctggcaagctggggaccggagatggtgttgctgcggctggaacatcagttcgcggtgggagaggactccggtaggaatttgtccgcgccagtgactctgaatcttcgcgacctgttctccaccttcactatcactagactgcaggagacgaccctcgtggcgaatcagctgcgcgaggcagcatcaagactgaagtggactaccaacaccggaccaaccccgcatcaaaccccgtaccagttggacccggcgaacattaccctggagccaatggaaatcagaacgtttcttgcatcggtgcagtggaaagaggtggacgga

SEQ ID NO: 16524 - DNA, 3033 bp, Artificial Sequence
  Description of Artificial Sequence: Synthetic coding sequence
atgggagcgtacgctagagcgagtggagtgtgtgcgaggggatgcctcgacagcgccgggccctggactatgtcccgagcactgaggccaccacttcccccactttgctttttcctgctgttgctcgccgctgctggggcccgcgcaggaggctacgagacttgcccaacggtccagcccaatatgttgaacgtccacttactgcctcacacacacgatgatgtcggatggttgaagacagtggaccaatacttttatggaatcaaaaacgatatccagcacgccggggtgcagtacatccttgattccgtgatatccgcgttgttggccgacccaactaggcgttttatttacgtggagattgcatttttctccagatggtggcaccagcaaaccaacgccacacaggaagtggtaagggacttggtgaggcagggacgactcgagttcgcaaatgggggctgggtcatgaacgacgaagccgccacccattacggtgctatcgtcgatcagatgacactgggccttagatttttggaggatacatttggcaatgatggaaggcctcgggtcgcctggcacattgaccccttcggccacagcagggaacaagcgtcactatttgcccagatgggttttgatggtttcttcttcgggcgacttgactatcaggataagtgggtgaggatgcagaagctggagatggaacaggtttggcgagcctctacttctttgaaacctccgactgccgatctctttactggggtcctccctaacgggtataatcctccacgtaacttatgctgggacgtactgtgtgtggaccagcctttagttgaagaccccagatcaccggaatacaatgccaaagaacttgtagattattttctgaacgtggcaacggcccagggccgatactatagaaccaatcacacagttatgaccatgggatccgactttcagtacgagaatgcaaacatgtggtttaaaaacctggacaaacttatccgattggtgaacgctcagcaggcaaaagggtcttccgtccacgtgctgtactccacacctgcttgctatctgtgggaattaaataaggctaacttgacttggagcgtgaagcatgacgatttcttcccctatgccgacggcccacatcagttctggaccgggtacttctcaagccgcccagccttgaaaagatatgagcggctcagctataattttctccaagtttgcaaccagctagaggccctggtgggcctagctgccaacgtcggaccctacggatccggcgacagtgcaccgctgaatgaggcgatggctgtcctgcagcatcatgatgccgttagcggcacttcaaggcagcatgtggctaatgattacgcacggcagctggctgcagggtgggggccatgcgaggttttactgtcgaatgctctggcaagattacgaggatttaaggaccactttacattttgccagcagcttaatatctcaatctgtcctctctcccagacggcggcaagatttcaagtgatagtatataatcctctagggagaaaggtgaactggatggtgaggctcccagtatccgagggcgtgtttgtggtaaaggacccaaacgggcggaccgtacccagcgatgtggttatttttcccagttcagattcacaggcccacccacccgaactgctcttctctgcttccttaccggcacttggtttcagcacttactccgttgcccaggtccctcgctggaagccacaggcccgggcccctcaacctatccccaggagatcatggtctcccgccctaactattgagaatgagcacattagggctacttttgatccagacaccgggttattgatggaaataatgaacatgaaccagcagttgcttctgccggtgaggcaaaccttcttttggtacaacgccagcattggagataacgagtcggaccaggcttcaggcgcttatatcttccggcccaaccagcagaagcctctgcctgtgagcaggtgggctcagattcacctggtaaagacgccgctcgtgcaggaagtgcaccagaacttttctgcctggtgtagtcaggtagtgaggttgtatcctggacagagacaccttgaactcgagtggtccgtgggtcctattccagtgggagacacctggggtaaagaggtaatctccaggttcgacacgccccttgaaacgaaggggaggttttatacggactccaatggtcgagagatactggagcgacggagagactacaggcccacctggaaactaaaccaaacagagccagtggccggaaactattacccagtcaatacacgcatatacatcacagatgggaacatgcagcttacggtcctaactgaccgatctcaaggtggctctagcctgcgcgatggtagccttgagctaatggtgcaccgcagactgctgaaagatgatgggcgtggggtgagcgagcccctcatggaaaacggctctggagcgtgggtccggggacgacacctcgtcctgctagacacggcccaggccgcagccgccggccaccgactcttggcggaacaagaggtgcttgcacctcaggtggtgctagcacccggcggtggagctgcgtacaacttgggcgctccaccaaggacacaattttctggacttagaagggacctgcccccgtcagtgcatttgctgactttggctagttgggggcctgagatggttctgctgagattggaacatcagtttgctgtaggcgaagatagcggcagaaatctcagcgccccggtgacactcaatctgagagacctcttcagtaccttcaccattacgaggcttcaggagacgacactggtggcaaaccagctcagagaggccgcctctaggttgaagtggaccactaacaccggtccgacaccacaccagacaccatatcagctggatcctgctaacatcactctcgaacctatggagatcagaacttttctggccagcgtccagtggaaagaggtggacgga

SEQ ID NO: 16525 - DNA, 3033 bp, Artificial Sequence
  Description of Artificial Sequence: Synthetic coding sequence
atgggggcatatgccagggcgtctggtgtctgcgctcgtgggtgcctggatagtgcgggcccttggacaatgtctcgggcactcaggccgccactcccccctttgtgcttcttcctcctccttctggccgccgcgggtgcccgggccgggggctatgagacttgtccaacggtgcaacccaacatgctaaatgtccatctgcttccacacacccatgatgacgtaggctggctgaagaccgtcgatcagtatttctacgggattaagaatgatatccagcatgcaggggttcagtacatactcgatagcgtcatatcagctctcctggctgacccgaccaggcgattcatttacgtggagattgccttcttctccagatggtggcaccagcagacgaacgccacccaggaggtggtgagagacttggtgagacagggcagactggagtttgcaaacgggggatgggtgatgaatgacgaggccgccactcactacggggctattgttgatcagatgacgctaggactaaggtttctggaagacacatttggcaacgacggtcggcctcgggtggcatggcatatcgatcctttcggtcacagtagggaacaggcaagtcttttcgcccagatgggctttgatggctttttctttggacgtttggattatcaagacaagtgggtgaggatgcaaaagctcgaaatggagcaggtgtggcgcgcatctacgtcgcttaaaccacctactgctgacctattcaccggcgtgctgccaaatggctataaccctccccgcaatttatgctgggacgtactatgcgtggaccagccactggttgaggacccgagaagcccagagtacaacgctaaggagctcgttgattatttccttaacgtggcgacagcccagggccgatattatcggactaatcacactgtcatgactatggggtccgacttccagtacgagaacgcgaacatgtggttcaaaaatctcgataagttgataaggttggtcaatgctcagcaggcgaaggggagcagtgtccacgtgctgtatagcacaccagcctgttacctgtgggagctcaacaaagctaatctgacatggtccgtgaaacacgacgattttttcccatacgcggacgggcctcatcagttttggactggatatttctcaagcagacctgccttgaaaaggtacgaacgactcagttacaacttcctacaggtgtgtaaccagctggaggccctggttggcctcgccgctaatgtcgggccctatggttccggcgatagcgcccctctcaacgaggccatggccgttttgcagcaccacgacgcagtgagcggcacctcccgtcaacacgtggctaacgactatgccagacagttagctgcaggctgggggccctgtgaggtgttgttatctaacgcgctagctcgcctgaggggctttaaggaccactttaccttttgtcaacagttgaatataagtatttgtccactgagccaaacagcagcccggtttcaagtgatcgtgtacaatcctttgggccgaaaggtgaattggatggttaggttgcctgtgtcagaaggagtgtttgttgtcaaggaccccaacggacggacggttccttccgatgtcgtgattttccccagtagtgattcacaggcgcacccccccgagttactgttttcagcatccctgcccgccctgggattctctacttactcagtggcacaagtgcctaggtggaaaccacaggcgcgggcgccccagcccatcccgcgtaggtcatggagcccggccctaaccattgagaatgagcatattagggcgacgttcgaccctgacacaggtctcctcatggaaataatgaacatgaaccagcagcttctgcttccggttcgccagaccttcttttggtataatgcttcaatcggggataatgagtctgaccaggctagcggtgcttatattttccggccgaaccagcagaaacccctgcctgtgagtcgctgggcacagatccacctggtaaagacgccgttggtgcaagaggtgcatcagaatttcagcgcctggtgctcacaagtcgtgcggctgtatccgggacagcgtcatttggaacttgaatggagcgtaggacccatacctgtcggagatacgtgggggaaggaagtcatctcacgcttcgacacacctttggagactaaggggcggttttataccgatagcaacggccgggaaatcctggagcgcagacgggactacaggcctacctggaaactgaaccagactgagcccgttgctggtaattactacccagttaacacaaggatctacataaccgatgggaacatgcagcttaccgtgctgacagataggagtcagggcggatcctcattgagagatggctccctggagctcatggtccacagaaggttgcttaaggacgacggcaggggggtgagtgagcccctgatggagaatggctctggtgcatgggtccgggggagacaccttgttctactggacacagcgcaggctgcagctgctggacaccgcctgcttgcagagcaggaggttctcgctccacaggtcgttctggcccccggggggggggctgcctacaatttgggagctcctccacgcacccaatttagtggcctgagaagagatctccccccgagcgtgcatctgttgacacttgcaagttggggccctgaaatggttctgttaaggctggagcatcagtttgctgtcggagaagactccggtcgaaatctctccgctcccgtgacactgaacttgcgggatcttttctccacctttaccatcacccggcttcaggagacgaccctagtcgcgaaccagctccgtgaggccgccagcagactcaagtggactacaaacaccggccctaccccccaccagacaccatatcagctggacccagctaacattacgcttgaacctatggaaatccggactttcctggcctcagtgcagtggaaggaggttgatggg

SEQ ID NO: 16526 - DNA, 3033 bp, Artificial Sequence
  Description of Artificial Sequence: Synthetic coding sequence
atgggtgcctacgcacgagcttcgggggtgtgtgctcgaggatgcttggactcagcgggtccttggaccatgtcaagggccttgaggcctcctctgccgccactgtgcttttttctgctgttgctggcagcggcgggggcccgcgctgggggctacgaaacctgtccaacagtccagccgaacatgcttaacgtgcatttactccctcacactcacgacgacgtggggtggctcaagacagttgaccagtacttttacggcattaagaacgatatccagcatgcgggcgttcagtatatcctggatagtgtgatcagcgcattattagcagatccaacacgccgatttatctacgtggagatcgcattcttctctaggtggtggcatcagcagactaacgccacacaggaagtggttagagatctggttcggcaggggagactcgagtttgctaatggaggctgggtaatgaacgacgaggctgccacacattacggagccatcgtggatcagatgacgcttgggctgcgttttctcgaagatacctttggcaacgacgggaggccccgagtcgcctggcacatcgacccgttcggtcactccagagaacaagcctcacttttcgcccagatgggtttcgacgggttcttctttggccgcctggattaccaggataagtgggtacgtatgcagaaactggagatggagcaggtatggcgcgcatctaccagtctcaagccaccaacggctgacctcttcactggcgtcctgccaaacggatacaacccaccccgaaatttgtgctgggacgttctgtgtgtggatcaacctttggtagaggatccccggagccctgagtacaatgccaaggaactcgtcgattattttttaaacgtagcgacagcgcaaggccgctattataggaccaaccacactgtgatgactatgggctcagatttccaatacgagaacgccaacatgtggttcaaaaatttggataagctcataagactcgtcaatgctcagcaggctaaggggagctctgtgcacgtactgtattctactcccgcatgctatttatgggaacttaataaagcgaacttgacatggtccgtgaagcacgacgacttttttccatacgccgacgggccccaccagttctggacaggctacttctcatctaggcctgctctgaagagatacgagaggctctcttacaacttcctgcaggtgtgtaatcagttggaagccttggttggcctcgccgcaaacgtgggtccatatggatctggcgacagtgctcctcttaatgaggctatggccgtgctgcagcaccacgacgccgtgtccggaacgtccagacagcacgtggccaatgactacgcgagacagctggccgcagggtgggggccgtgtgaagtgttgctttccaacgccttggcccggctccgaggtttcaaggaccactttactttctgtcagcagttgaacatttccatatgcccactttcccagacggccgcgagattccaagtcatcgtctacaaccctctggggaggaaagtgaactggatggtgcggctgccagttagcgaaggagtgttcgtcgtgaaggatcctaacggacggacagtgccatcggacgtagtaattttcccgtcatccgattcacaggcacatccccccgaactactgttctcagcctcactgcctgccctgggattttcgacctattcagtagcgcaggtgccccggtggaagccacaggctcgggctcctcagcccatccctaggcgcagctggtcccctgcacttacaatagaaaatgagcatatccgggctacgttcgatcccgacactggactgctgatggaaatcatgaatatgaatcagcagcttcttctgccagtgcggcaaacatttttttggtacaatgcctccataggcgataacgagtccgaccaggcctccggcgcgtacatcttcaggccaaaccagcagaaacccctccccgtcagcaggtgggcgcaaatccacttggtgaaaaccccattggtgcaagaggtgcatcagaattttagcgcctggtgtagccaagttgtgcggttgtatccaggtcaacggcatctggagctggaatggtcggtgggcccaatacccgtcggcgatacctgggggaaggaagtcatctctcgattcgatacccccctggaaacaaaagggcgtttttatactgactcaaacgggagagagatactcgaacgacggcgtgattatcgtcctacatggaaacttaatcagaccgagccagtggcgggcaattattatcccgtgaataccaggatttacattacggacgggaacatgcagctgactgtacttaccgaccgatctcagggcggttcatcacttcgtgacggcagcctggaactcatggttcacagaaggctgctaaaggacgatggccggggggtgtcggagcctttgatggaaaacgggtcaggagcatgggtacgcgggaggcacctcgtgttgctggacacagcgcaggcagcagccgctggacaccgccttctggctgagcaggaggtgctcgccccgcaggtcgtgttggctcctggaggtggcgcagcatataacttgggcgcgccccctaggacccaattttcgggcctccgaagagatcttcccccgtctgttcacttgctgactctggcaagttggggacctgaaatggttctcttacgactggagcaccagttcgctgtgggcgaggactcaggtagaaacctgtccgctcccgtgactctcaacctaagggatctgtttagcacatttactattacgcgtttgcaggagactacactggtggccaaccagctgagagaagctgcaagccggctgaagtggactacaaatactggccccaccccacaccagactccctatcagctggatcctgccaatatcacgctggaacctatggagataagaacgtttcttgcatcagtccaatggaaagaggttgacgga

SEQ ID NO: 16527 - DNA, 3033 bp, Artificial Sequence
  Description of Artificial Sequence: Synthetic coding sequence
atgggagcatacgcgagagccagcggtgtgtgtgcacgtggatgcctcgattcggcgggaccctggaccatgtcgagggcactccgcccccctctgccaccactttgcttctttctgcttctccttgcagcagcaggagcaagagcaggcggttacgagacttgtccaactgtgcagccgaacatgcttaatgtgcatcttctgccccacactcatgatgacgtcggatggctgaaaactgtggatcagtacttttatggaattaagaatgatattcagcatgccggtgtgcagtatatccttgattcggtcatctcggcactgcttgcagatccgacccgacgcttcatttacgtggaaattgcctttttctctcgttggtggcatcagcaaactaatgcaactcaagaggtggtccgggaccttgtgaggcaagggcggctggaattcgcaaacgggggctgggtgatgaacgatgaagccgcaacccattacggtgccattgtcgatcaaatgaccctgggacttaggtttcttgaagatacttttggcaacgacggccgcccacgcgtggcgtggcatatcgatcctttcggacattccagggaacaagcaagcctttttgctcagatgggttttgacgggtttttctttggacgccttgactaccaggataagtgggtccgcatgcaaaagctggagatggaacaggtctggcgggcctccacctcccttaaacctcctaccgcagatctctttaccggggtccttccaaacggttacaaccccccacgaaatctttgttgggatgtgctgtgtgtggatcagcctcttgtcgaggacccccggtcgccagagtacaacgcaaaggaactggtggattacttcttgaacgttgccactgctcagggcaggtactacaggacgaaccacactgtgatgactatgggatccgatttccagtacgagaatgctaacatgtggtttaagaacttggataagctcattcggctggtgaacgcccaacaagccaaaggatcatcagtgcatgtcctctactcgaccccagcctgttacctctgggaacttaacaaggccaatcttacctggtccgtgaaacacgacgatttcttcccatacgccgatgggcctcaccaattttggactgggtacttctcgtcacggccagcacttaagaggtacgagcgcctgtcatacaacttcttgcaggtgtgtaaccaacttgaagcattggtgggccttgccgcaaacgtcggaccctacgggtcgggtgattcagcacctctgaacgaggcgatggccgtgctccagcaccatgacgcagtgagcggaacctcgcggcaacatgtggccaacgactacgcgcgacagctcgcagcaggctggggcccttgtgaagtgctgctgtcgaatgcactggcaaggctgcggggttttaaggatcactttaccttctgtcagcagctgaacatatccatctgccctctgtcccagacggcagcacggtttcaggtcattgtgtacaacccccttggccggaaagtgaactggatggtgcgcctcccagtgagcgaaggggtctttgtggtgaaggatcccaacggtagaactgttcccagcgatgtcgtgatctttcccagcagcgactcacaagcacatccccccgagctcctgtttagcgcatccctgcctgccctgggattttccacttactccgtggcacaagtgccacgatggaagccccaagcaagagcaccacaaccaattcccagacgttcatggagtcctgcacttactatagaaaacgagcatattagggcaacgtttgatcctgatactggccttcttatggaaatcatgaatatgaaccagcaacttcttcttcctgtgagacagaccttcttctggtacaatgcctccattggtgataatgaatcggatcaagcatccggagcgtacatcttccgccccaaccagcagaagccgttgcctgtgtccagatgggcacaaattcacctggtgaaaactccactcgtgcaagaagtccatcagaatttcagcgcatggtgttcacaagtggtcaggctgtacccaggtcagaggcatctggagttggagtggtcggtgggtccaattcctgtcggagatacctggggaaaggaagtgatctcgcgctttgatacccccctcgaaactaaggggcgattctacaccgactcgaacggcagagaaatcctggaacgcaggcgcgattacagaccaacttggaagttgaatcaaactgaacctgtggcaggtaactactacccggttaacacgaggatttacatcaccgatggtaacatgcagctgaccgtcctgaccgatcgatcgcagggtggtagctccctgcgtgatggttccctcgagctgatggtccatcgtcggctgctgaaggatgatgggcggggagtgtcggaaccgctgatggagaacggttcaggagcatgggtgagagggcgccacctggtgttgttggacaccgcacaggccgcagcagctgggcatagactcttggcagagcaggaggtcctcgcacctcaagtggtgctggcgcccgggggaggggcagcatacaaccttggggcgcctccacgcactcagttcagcggcctgcgtagagatctcccaccttcggtgcacctcttgaccctcgcttcatggggtccagaaatggtcctcctccggctggagcatcaatttgcggtgggggaggactcgggccggaacctttcggcacctgtgactctcaatctgagagatctgttttcgacctttactatcactaggcttcaagaaactactcttgtcgccaaccagctgcgggaggcagcttccagactcaaatggaccactaataccggtcccacgccgcatcagactccttaccaactggatcctgcaaatatcacccttgagccaatggaaattagaaccttcctcgcttcggtgcaatggaaagaggtagatggt

SEQ ID NO: 16528 - DNA, 3033 bp, Artificial Sequence
  Description of Artificial Sequence: Synthetic coding sequence
atgggagcctacgcccgcgccagcggagtgtgcgcgcggggctgcttggatagtgcaggcccctggactatgagtcgggcgctgcggccacccctaccaccactctgcttctttctcctcctactggcagctgcaggcgcaagggccggtggttatgagacatgtccaacagttcagcccaacatgcttaatgtgcacctgctgccccatacacatgacgacgttggctggctcaagaccgtggatcagtacttctacgggatcaagaatgatatacagcacgccggcgtgcagtacatactggactccgtgatctctgccttgcttgcggatcccacacgcagattcatctatgttgagattgcctttttctcccgatggtggcatcagcagacaaacgctactcaggaggttgtgcgagacctggtgcggcaaggacggctggagtttgcgaacggaggatgggtgatgaatgacgaagcagccacccactacggcgccatcgttgatcagatgactctcggcctgagattccttgaggacacatttggaaacgatggtcggcctcgggtcgcctggcacatcgatccattcggacactcccgggaacaggcaagcctgtttgcccaaatgggcttcgatggattttttttcgggaggttggattatcaggacaagtgggtacgaatgcagaagttggagatggagcaggtctggcgggcctcgacatcactgaaacctcctaccgcagacctcttcactggggtgctgccaaatggatataatcctccgcgcaatctgtgctgggatgtgctctgtgtggaccaacctctagtggaggatcctaggagccccgagtataatgccaaagaactggtggactattttctcaacgtggccactgcccagggtcgctactataggacaaaccatactgtcatgactatgggatctgactttcagtatgagaacgccaacatgtggttcaaaaatctggataaactgattcgcttggtgaacgcccaacaggctaaaggcagtagtgttcatgtcttgtactccacccctgcatgttatctgtgggagctcaataaagcaaacctaacttggtctgtgaagcatgatgacttttttccatacgccgacggcccgcatcagttctggacaggttatttcagctcaaggccggccctgaagcggtatgaacgtctgtcgtacaatttcctccaagtgtgcaaccagctcgaagctttggtgggattggccgctaacgtcgggccgtacggttccggtgattccgctcccctgaacgaggccatggctgttctccagcatcatgatgccgtgtctgggacatcacgacagcacgtggctaatgactatgcacgacagttagccgccggttggggcccctgcgaggtcctgctcagtaacgcactggccaggctcagaggttttaaggatcactttaccttctgtcagcagcttaacatatcaatctgccctctaagtcagacagctgcccgcttccaagtcattgtgtacaacccgcttggacgcaaggtgaactggatggtcagattgcccgtgtccgagggagtcttcgtagttaaggatccaaacggacggaccgtcccctctgacgtcgtgatctttccctccagcgacagtcaggcccaccctcccgaactattgttctcagctagtttgcccgctttagggtttagcacttactcggtcgcgcaggtgccccgctggaaaccgcaggctcgggcccctcagcccataccacgccgcagttggtccccggcgttaaccatcgaaaatgagcacatcagagctacattcgaccctgacactggccttcttatggaaattatgaatatgaatcagcaactgctacttcctgtgagacaaacgttcttttggtacaacgcgtctatcggggataatgaaagtgatcaagccagcggagcttatatttttcgacccaaccaacaaaagcctctgcccgtctcccgttgggcccagatccatctcgtgaagacgcccctggtgcaggaagttcaccaaaatttctcagcctggtgttcacaagtggttaggctgtaccccgggcagagacacctggaattagagtggagtgtgggccccatccctgtgggggacacctgggggaaagaggtgatcagcagatttgacactcctcttgagacgaaaggccgtttttacaccgactcaaacgggcgcgagatattagagaggaggcgggattatcggccgacctggaagttaaatcaaaccgaacccgtggcgggaaactattacccagtaaacactcggatatatataaccgacgggaacatgcaacttacagtcctgactgatagatctcaaggggggtcaagcctgagagatggatctcttgagctgatggtgcaccgccggctgctgaaagacgacggacgtggcgtcagtgagccactcatggaaaatggcagcggggcctgggttagaggaaggcaccttgtgcttctggacacagctcaggcggccgctgcaggccatagattgctggctgaacaggaagtgctggctcctcaggttgttctcgcccccggcggaggagccgcctacaacctcggcgcgccacctcgcacccagttcagcggcttgcggcgggacttaccacccagtgttcatttgctaacgttggcttcttggggaccagagatggtcctgctgaggttggaacatcagtttgccgtgggggaagatagcgggagaaatctaagcgcaccagtcacgctcaacttgcgggatctgttctctacatttaccatcactcgtctgcaagaaacgacattggtcgcaaatcagctgcgcgaagccgcctcgcgtctaaagtggaccactaacactggtccaacaccacaccagactccatatcagctcgaccctgccaacatcactctggaaccgatggaaatccgcacttttctggccagcgtccagtggaaagaagtcgatggc

SEQ ID NO: 16529 - DNA, 3033 bp, Artificial Sequence
  Description of Artificial Sequence: Synthetic coding sequence
atgggagcctatgctagagcctctggggtgtgtgctcggggctgccttgactccgccggtccttggaccatgtcccgcgcgcttcgacctccactccctcccctttgcttcttccttcttctcctcgcagccgccggtgccagggccggcggatacgagacgtgtccgaccgtacaaccaaacatgctgaatgtgcatctgcttccacatactcatgatgacgtgggctggctgaagacagtggatcagtacttctatggcatcaaaaacgatatccaacacgcgggcgtgcagtatattttggacagcgtaatcagtgctctgctagctgatccgacgagacggtttatctacgtcgaaatcgcttttttctccagatggtggcatcagcaaacaaacgctacgcaggaggtagtgcgtgacctcgtccgtcagggcaggcttgaattcgccaacggcgggtgggttatgaacgacgaggcagccacccactacggagccatcgttgatcagatgacactgggtcttcgcttcctcgaggatacgttcggtaatgacggcagaccccgagtcgcctggcacattgaccctttcggccacagccgtgagcaggcctccctgttcgctcagatggggttcgacgggttcttcttcggccgcctcgactaccaggacaaatgggtgcgaatgcaaaagctcgagatggaacaggtgtggcgggccagcacgagtttgaagccaccaacagcagacttgtttacaggggtgctccctaatggatacaatcccccgcgtaacctatgctgggatgtgctgtgtgtcgaccagcctctggtcgaagacccccggagcccggagtataacgcgaaggaactggtggactatttcctcaacgtggccaccgcccagggccgttactaccggacaaaccacactgtgatgacgatggggtcagatttccagtacgagaacgccaatatgtggtttaaaaatctggataagctcataaggttggtcaatgctcaacaggcaaaaggaagctccgtgcatgtcctatactctacccctgcctgctacctgtgggagctcaataaagcaaacctgacgtggtccgtgaagcacgacgacttcttcccctatgctgacgggccccatcagttctggacaggctatttttcttcccgtccggcactgaaaagatacgagcgactttcctacaatttcctacaggtttgtaaccagctggaagcactggtgggacttgccgctaatgtagggccctatgggtccggcgatagcgcaccactcaacgaagccatggctgtccttcagcaccatgatgcagtgtcagggacatcccggcagcatgtggcaaatgattacgccaggcagctggcagccggctggggtccttgtgaagtgctacttagtaatgccctagctaggctcagggggtttaaagaccacttcaccttttgccagcagctcaatatctccatttgtcctctgtcccagaccgcagcgaggttccaggttattgtctataatcctctgggccgcaaagtaaactggatggtccggctgccggtgagcgaaggagtgtttgtggtgaaggacccaaacggtcgcaccgtgccttcagatgtggtgatcttcccctcatcagattcacaggcacatcccccagaactcttgttctccgccagcctccctgctctcggattcagcacttactctgttgcacaagttccacgctggaagccacaagcccgagcaccccagccaatcccaaggcgaagctggtccccagcattaaccatcgaaaatgagcacatacgggctacgttcgaccccgatacgggactgctgatggagattatgaacatgaatcagcagctattgcttccagttcgtcaaaccttcttctggtacaacgccagcattggtgataacgagtccgatcaggcaagcggggcttatattttccgacctaatcagcagaaacctttaccagtttcccgttgggcccaaattcatctggtcaaaacgcccctggtgcaggaggtgcaccagaatttctctgcctggtgttctcaggtggtaagattgtaccctggacagaggcacttggaactggaatggtcagtgggtccaatccccgtaggcgatacatggggcaaagaagtgatctctcggttcgacacccctctggaaacaaaggggcgcttttatacagacagcaatggtcgggagatcctggaacgcaggagagactaccgaccaacttggaaactgaaccaaaccgagcccgtggcaggtaattactacccggtaaacactaggatctacataacagatggtaacatgcagctcacggtcttaacggatcgttctcagggaggctcaagcctgagggacgggagtcttgagctgatggttcaccgcaggctgctgaaggatgatgggcgtggcgtgagcgagcccctgatggagaacgggtcaggcgcctgggtgaggggccgacacctggtgttgctggacacggcccaggccgccgccgctggacatcggctgctcgctgagcaggaggttctggctccccaggtcgtattggcccctggtggtggagcagcttacaatttgggcgctccccccaggacacagttttccgggctgcggagggacttaccgccaagtgtacatcttctgacgttggcctcctggggtcccgagatggtcttactacgcctagaacatcagttcgctgtgggggaggactccggtaggaatctgtcagccccagtgaccctgaatctgcgcgacctgttttccactttcacaattacccggctgcaggagactaccctggtggccaaccagctcagagaagctgcttccaggctcaaatggaccactaatacgggacccaccccacaccagacaccctaccaactagatcctgctaatataaccctggaaccaatggaaataagaacattcttagcctctgtgcagtggaaggaggtagacggg

SEQ ID NO: 16530 - DNA, 3033 bp, Artificial Sequence
  Description of Artificial Sequence: Synthetic coding sequence
atgggcgcatacgctcgggcaagcggcgtgtgcgcaagaggctgcctcgactcggcagggccctggacgatgagccgcgccctgagaccacctctaccacccctatgtttttttctcttgttgctggcagctgcaggcgcccgtgcgggtggctacgagacctgtccaactgtgcaacctaatatgctgaacgtgcacctgctccctcacacgcacgatgatgttggatggctgaagacagtggaccaatacttttacggaatcaagaatgacatccagcatgccggcgtccagtacatcttggatagcgttatttccgcactgctggccgacccaactcgacggttcatttacgtcgagattgcctttttcagtagatggtggcaccagcaaaccaatgctactcaggaagtggtgcgcgacctggtccgccaaggcaggctggagtttgccaatggtggctgggtcatgaatgacgaggccgccactcactacggcgcaatcgtcgaccagatgactctcggcctgcgattcttggaggatacatttggcaatgatggccgcccaagagtcgcttggcacattgaccctttcggccactctcgggaacaggctagcctgttcgcccagatgggatttgacggattcttcttcggtcgtctggattaccaggataagtgggtgaggatgcaaaagttggagatggagcaggtgtggagagcctctacctcactgaaaccccctacagctgatctcttcactggcgtgctccctaacggttacaatcctcccagaaatttatgttgggacgtgctctgcgtagatcaacccctggtcgaggatccacgaagccctgaatataacgccaaggagctcgtggattactttctgaatgtggcgacagctcagggccgctactatcgcacaaatcacacggtgatgaccatgggatccgactttcagtacgaaaatgccaacatgtggttcaagaacctagataagctgatccggctggtgaacgcccagcaggccaagggctcctcagtacatgttctctatagcactccagcctgctacttatgggaacttaataaagccaacctgacttggtcggtgaagcacgatgatttcttcccatacgccgatggacctcaccagttctggacagggtattttagtagccgccccgccttgaaacgttacgagaggctgagctataatttcctgcaagtgtgcaatcagcttgaggctctggtcggcttggctgccaatgtcggaccctacggctctggagactccgccccgttaaacgaggccatggccgtcctgcagcaccacgacgcagtgtcgggcacgtcccgacaacatgtggctaatgattacgctaggcagctcgctgcagggtggggcccctgcgaggtgttactttctaacgctctagctcgtttacgaggcttcaaagaccacttcacgttttgccagcagttgaacattagcatctgcccccttagtcagacggccgcccggttccaagtaatagtttacaatcccctgggccgaaaggtaaattggatggtgcgactccccgtttcagaaggagtttttgtggtcaaggatccaaacggccgcactgtaccttcagacgtcgttatttttccgagctccgacagccaagctcatccaccagaactcctgttctctgccagcctgcctgccctaggattctccacatactctgtggcgcaggtgccaaggtggaagccacaggctcgcgctccacagcccatcccccgaagatcctggagccccgcgctcaccatcgaaaatgagcacattagagcaacttttgaccccgatacaggcttattgatggagatcatgaacatgaatcagcagttactgctcccagtgaggcagactttcttttggtacaacgcctccatcggggacaatgagtcagatcaggcctccggagcctatattttccggccaaaccagcaaaaacctctgccagtaagtcgctgggcccagatccatctcgtgaagacaccactagtgcaggaggtccaccagaacttctccgcatggtgtagccaagtggtccggctataccctgggcagcgccacttggaactggaatggtccgtagggcctatccctgttggtgatacttggggcaaagaggtgatctctaggttcgacaccccactagagacgaaaggcagattctacactgacagcaacggccgcgaaatccttgaacgcaggcgggactatcggccaacgtggaagctgaatcaaacagaaccagtagccggaaactactaccccgtaaatacaagaatatacattactgacggaaatatgcagttgaccgtcctgaccgatcgctcccaagggggctcatctctaagggacggctctctggaacttatggtccaccggagactgctaaaagacgatggtaggggggtgtccgagccattaatggagaacggcagcggagcctgggtgagggggcggcaccttgtattgctagacaccgcgcaggccgctgctgccggccaccggctgctggccgaacaggaagttttagctccacaggtagtcctggcccctggaggcggggcggcttacaatctgggagctccaccgagaacacagttttccggactgagacgagatctccctccaagtgtgcaccttctcacgctggcgtcgtggggaccggagatggtgctactcagactggagcaccagtttgccgtgggtgaagatagcggcagaaacctatccgcccccgtgacgctgaacctgagggacttattttccactttcactataacccgtctgcaggagactacgctagtggctaatcagctgagggaagcagcttcccgactgaaatggactaccaacacgggtcctactccacatcagaccccataccaattagatccagctaatattacgctcgagcccatggagattcgaaccttccttgcctcagtgcaatggaaggaagtggatggg

SEQ ID NO: 16531 - DNA, 3033 bp, Artificial Sequence
  Description of Artificial Sequence: Synthetic coding sequence
atgggagcctatgctcgggcaagcggggtctgtgcaagaggctgccttgattctgcaggaccatggacaatgtcccgggctctgcgccctccactccctcccctttgtttttttctcttgctgttggccgccgcaggggctcgggctggcggctatgaaacatgtccaactgtgcagccaaacatgcttaacgtccacctcttgccacacactcacgatgatgtgggatggctgaagaccgtggaccaatacttttatgggattaagaatgacatccagcacgcaggcgtccagtatatcttagactctgtgatctcagcactccttgcagaccctacaaggcgatttatttacgtggaaatagcatttttctctcgctggtggcatcaacaaaccaacgcaacacaagaagtggtgagagatctcgttcgccagggcagacttgaattcgcaaacggcggatgggtaatgaacgatgaggcagcaacccactacggagctattgtcgatcagatgaccctggggctgaggttccttgaagacacgtttggaaacgatggtagacccagggtcgcctggcatatcgacccctttggccattcacgcgaacaggcctctctgtttgcccaaatgggatttgacgggttttttttcggtaggctggactatcaagacaagtgggtccgtatgcagaaattggagatggaacaggtgtggagagcaagtacctcgttaaagcctcctaccgctgacctttttactggagtgctgcctaatggatataatcctccaaggaacctttgttgggatgtcctgtgcgtcgatcagcctttggtcgaagatcctagaagccccgagtacaacgcaaaggaattggtcgattacttcctcaacgttgcaacggcccaggggcgttactacagaaccaaccacaccgtcatgaccatgggctctgacttccagtacgaaaatgcaaacatgtggtttaagaatctcgataagctcatcaggctggtcaacgcacagcaggctaaaggctccagcgtccatgtcctatactcaacccccgcatgctatctgtgggaactcaacaaggcaaatctgacatggtctgtcaagcatgatgacttcttcccttacgctgacggccctcaccaattctggactggatactttagcagcagaccagctttgaagagatacgagagactgagctataacttcttacaggtatgtaatcagttggaggctctagttgggctcgctgccaatgtcgggccttacgggtcaggagatagtgccccccttaatgaagcgatggctgtccttcaacatcacgatgccgtcagtggtacctcccggcagcatgtggctaacgactacgctcgccaactggcagctggctggggcccttgcgaggtcctcctgagtaacgctcttgcaaggctgaggggatttaaagaccattttaccttctgccaacaattgaatattagcatttgcccattaagtcagactgccgcaagatttcaggtgatcgtgtacaatccactgggccgtaaagtgaactggatggttcggcttcccgtaagcgagggcgtctttgtcgtcaaggaccccaacggccgcactgttccctctgatgtagtgatttttcccagtagcgacagccaagctcacccccccgagctccttttctcagcttcactgccagcactgggcttcagcacttacagcgtagcccaagtcccccgctggaagcctcaagcaagggctccgcagccaataccgaggaggtcatggtctcctgcactcacaatcgaaaacgagcatattcgggcaacctttgatcccgacacagggctcctgatggagattatgaacatgaatcagcagctcctgctgcctgtgaggcagacctttttttggtacaacgctagcatcggagacaatgaatctgatcaggctagtggagcctacattttcagacctaaccaacagaaaccactccccgtgagcagatgggcccagatccatttggtgaagacgccactcgtccaagaggtgcaccagaacttttcagcttggtgtagccaggtagtgcgactatacccaggccagcgccacttggaattagaatggtctgtcggccctatcccagtcggcgatacttggggaaaggaggtaattagccggttcgatacccccttagagacaaaaggaagattttacaccgatagcaacggtagagaaatcctggagcgccggagggattacagacccacttggaaactgaatcaaactgaacctgtcgccggtaattactaccctgtgaacaccaggatctatattacagatggaaatatgcagttgactgtgctcacagatcgctcacagggcggaagctctttgcgggatggaagccttgaactgatggttcaccgacgtctgctcaaagacgatggccgcggcgtgagcgagccattgatggaaaatggctcaggggcatgggtgagaggccgccacttagtcctgctcgacaccgcgcaagctgccgcagctggtcatcgactgctggcggagcaggaggtcctggctccacaggtggtactggctccaggcgggggggctgcctataatctgggagcacccccgcggacacagttttctggactccgcagggatttgcccccatccgtccatttgcttacgcttgcgagctggggacccgaaatggtgctgctgcggctcgagcaccagtttgcagtgggggaggactctgggcgcaacttatctgccccagttactcttaacctgcgggacctgttttcgacattcacaatcacaaggttgcaggagactacccttgtggcaaaccagctgcgcgaggcagcctctaggttaaaatggaccactaatacaggcccaaccccccaccagacaccttaccagctcgatccggctaacattaccctagaacctatggagattagaacattcttggctagcgtgcagtggaaggaggtcgacggc

SEQ ID NO: 16532 - DNA, 3033 bp, Artificial Sequence
  Description of Artificial Sequence: Synthetic coding sequence
atgggagcgtacgcccgtgcctctggagtgtgcgctaggggatgtctcgacagcgcaggcccttggacaatgagtagggccctccggccaccgcttccaccgctatgtttctttcttctgcttctggctgccgctggcgcccgtgccggcggatatgagacttgtcccaccgtccagcctaacatgctgaatgtgcatctgctgccccatactcacgatgacgtaggctggctgaagaccgtggaccagtacttttatgggatcaagaatgacattcagcacgcgggagtgcagtatattttggattcagttatctctgcactgctggctgatcccactaggcgcttcatttatgtggaaatcgccttctttagccggtggtggcaccagcagacgaacgcaacgcaggaggtggtgcgcgatctggttcgccagggtagactggagttcgctaatggcgggtgggttatgaacgacgaagctgctacgcactacggagcaatagtcgaccagatgactctaggcctgcggttcctagaggatacatttggtaacgacgggagacctcgcgtggcctggcacatagatccattcggccactcccgagagcaggcctctctgtttgcccagatgggcttcgatgggtttttcttcggacgactggattaccaggacaaatgggtgaggatgcagaagctggaaatggaacaggtgtggagagcttcaacatcgttaaaaccccctactgctgacctgtttacgggagttctgcccaatggatataatccaccacggaacctttgttgggacgtcctttgtgtcgaccagcccttagtggaggatcctaggagtccggaatataatgctaaggagctggtggactacttcctgaatgttgccacagcccaggggcgctattaccggaccaatcatacagtaatgaccatgggcagcgatttccagtacgaaaacgcaaatatgtggtttaaaaacctggacaaattgattcgattggtgaatgctcaacaagccaaggggagttcagtgcacgtcctgtactctaccccggcctgttatctctgggaactgaacaaggctaacctgacatggtctgtcaaacacgacgattttttcccctatgctgatggcccccatcagttttggaccggttacttctcctcccggcccgctttaaaacggtatgaaagactgtcgtataatttcctccaggtctgcaatcagctggaggcgctggtgggcttggcagccaatgtgggtccttacggcagcggcgatagcgccccattgaacgaggcaatggccgtgttacagcatcacgatgccgtgagtggtaccagcaggcagcatgtagctaacgattatgcgcggcaacttgcggccggatggggtccgtgtgaagtgctgctgtccaacgccctggcacgcttgcgggggttcaaagaccactttacgttctgccagcagctgaatatcagcatatgccccctgagccagaccgccgctcggtttcaggttatcgtctataaccctctaggaaggaaagtaaattggatggtgaggctaccggtatccgagggagtgtttgtcgtgaaggatcctaatggcaggaccgtcccaagtgatgtcgtaatcttcccttcttccgactcgcaggcccatccacccgagctgttattttccgcgtcgctaccagctctcggtttctctacatacagcgtggcccaggttcctcggtggaagccacaggcaagagcgcctcagcctatacctcggagatcttggtcccccgcccttacaatcgagaatgagcacattcgggctactttcgacccagataccggccttctgatggagattatgaacatgaaccagcagttactgctgccagtgcgccagaccttcttttggtataatgccagcatcggtgacaacgagtctgaccaagccagcggcgcatacatcttccggccgaatcagcagaagcccttgcctgtctccagatgggctcaaatacacttggtgaagacccctttggtgcaagaggtccaccagaatttctccgcatggtgcagccaagtcgtccgactctacccagggcagcggcacctcgaacttgagtggagcgtgggtcccatccctgtgggagacacgtggggaaaggaggtcatctcccggttcgacacacctctggaaacgaagggccgtttttacaccgatagcaatggtcgggaaattctggagcggaggcgggactacagacctacctggaaacttaatcagacagagccagtggccggtaattactaccccgttaacacaaggatatacatcaccgacggtaacatgcagttgactgtgctcacggacaggagccaaggaggcagctccctgcgggacgggagccttgaactcatggtgcaccgtcggctgctgaaagacgatggtcgcggggtcagtgagccccttatggagaatgggagcggcgcttgggtccgcggcaggcatctcgtcttgctggataccgcccaagcagcggcggctggccaccggctgctggcagaacaggaggtcctcgcccctcaggttgtgctggctcccggcggtggagctgcctacaacctcggcgcccccccgcggacgcagttctcgggcctgaggcgcgacttgccacctagtgttcacttactgaccctcgcatcctggggcccggagatggtgctactgcggctagagcatcagttcgccgtgggagaagactcaggcaggaatctctctgcccccgtcacactcaatctcagggatttattctccacatttaccattactcggctgcaggaaaccacactggtcgcaaaccaattgcgggaagccgcgtccagattgaaatggaccaccaacaccggccccaccccgcatcagaccccctatcagcttgatcccgcaaacattacgcttgaaccaatggagattaggaccttcttggcatccgtgcagtggaaggaggtggacggc

SEQ ID NO: 16533 - DNA, 3033 bp, Artificial Sequence
  Description of Artificial Sequence: Synthetic coding sequence
atgggtgcctacgcacgtgcttcgggtgtgtgcgcgagaggctgtttggattccgccggaccatggaccatgagcagagctctccggccccctcttccgcctttgtgcttcttcctgctcctgctggcagccgctggagcccgggcgggaggctacgagacttgtccgacggtccagcccaatatgttgaacgtgcacctgctgcctcatactcatgacgatgtcggctggctgaaaaccgtggatcagtacttctacggaatcaagaatgacattcaacatgcaggcgtgcagtacatcctggactccgtgatatcggccctcctggcagaccccactcgcaggttcatctacgtcgaaattgcgtttttctcgaggtggtggcatcagcagacgaacgccacccaggaagtggtccgcgacctggtgcgacagggccgcctcgagttcgccaacgggggctgggtgatgaacgacgaggcggccacccactacggagctatcgtggatcagatgactctcggactccgcttcttggaagataccttcgggaacgatggacgcccgcgcgttgcctggcacatcgatccttttggtcattcacgcgaacaggcgagcctgttcgcgcaaatgggtttcgacggtttcttctttggcaggctcgactatcaagacaagtgggttagaatgcaaaaactcgagatggagcaggtctggagggcctcgacttccctgaagccgccaactgccgacctcttcactggcgtgttgcccaacggatacaacccacctagaaatctctgctgggacgtgctgtgcgtggatcagccgctggtcgaagatccaagatccccggaatacaatgcgaaggaattggtcgactacttcttgaacgttgctactgcacaaggacgttactacaggactaaccacactgtcatgaccatgggatccgacttccagtatgagaacgccaacatgtggttcaagaacttggacaaactgatccgcctcgttaacgcccagcaagccaagggctcaagcgtgcacgtcctgtactcaactccagcatgttacctgtgggaactgaacaaagctaacctcacctggagcgtgaaacacgacgacttcttcccatacgcagatgggccccatcagttctggaccggctacttctcgtcgcggcctgctctgaagcggtacgaacgcctgagctataactttctccaggtgtgcaaccagcttgaggctctcgtgggactggccgcaaatgtggggccttacggaagcggagactccgcaccgctgaacgaggccatggccgtcctgcagcaccatgacgcggtgagcggaactagtcgccaacacgtcgccaatgactacgctaggcagctggctgccggatggggcccttgcgaagtgcttctgtcaaatgcactggccagacttagagggtttaaagaccacttcaccttctgccagcagctgaacatctctatctgccctctgtcgcagaccgcggcgcggttccaagtcatcgtgtacaatccgctgggacggaaggtcaattggatggtgcggctgccggtgtcggaaggcgtctttgttgtcaaggatcctaacggcagaacggtgccaagcgatgtggtgattttcccgagtagtgactcgcaggctcaccctcccgagctcttgttctcggctagcctgccggcgctgggtttctcaacctactccgtggcccaggtgcctaggtggaaaccgcaggcccgcgccccgcaacctattccaaggcggtcctggtcccctgccctgactatcgaaaacgaacatatcagggcaacttttgacccagacaccggactgctgatggaaatcatgaatatgaaccagcaactcttgctgcctgtgcgccaaactttcttttggtacaacgccagcatcggagataatgaatcagaccaggccagcggagcttacatctttagaccgaatcagcagaagcctttgccggtgtcgcggtgggctcagatccatctggtaaagacgccgctggtgcaggaggtgcatcaaaacttttcagcgtggtgtagtcaagtcgtccgcctctaccctgggcaacgccacctcgaactcgaatggtccgtggggccaataccagtgggagatacctggggcaaggaggtcatctcacggtttgatactccgctggagacgaaggggagattctatactgattcgaacggacgcgaaatcctcgagcgtcgccgggactaccggcctacctggaaacttaatcagaccgaaccggtggcggggaactactatccggtcaatacccggatctacatcaccgatgggaacatgcagctcaccgttcttacggatcggtcccagggaggttcctctctgagagacggaagcctggagctgatggtgcaccgccgcttgctgaaagatgacggcagaggtgtcagcgaacctctgatggagaacggttccggagcatgggtccggggccgacacctggtgctcctggacaccgctcaggccgccgccgcgggacacagacttctggcggaacaagaagtccttgctcctcaagtggtgctggcgcctgggggcggagctgcgtacaatttgggagcacccccgcggactcaattttctggacttcgccgcgacctgccgccgtcggtgcatcttcttactttggcttcgtggggacctgagatggtgctccttagactggagcaccaattcgctgtgggcgaggactcagggaggaatctgtccgcgccggtcactctcaaccttcgcgacctgttctcgaccttcacgattactcggctgcaagaaaccactctcgtcgccaaccagctgagagaggcggcatcgcgtctgaagtggactacgaataccggaccgaccccgcaccagactccgtaccaactcgaccccgccaacatcaccctcgaaccaatggagatccggacctttctggcctccgtgcaatggaaagaggtcgatgga

SEQ ID NO: 16534 - DNA, 3033 bp, Artificial Sequence
  Description of Artificial Sequence: Synthetic coding sequence
atgggtgcttacgctcgagcgtcgggggtttgcgcgcgtggatgcctagatagcgcagggccatggactatgtcccgcgccttgcgtcccccgttaccccccctgtgcttcttcttgctcctgctggccgcagccggcgcacgggcaggtggttacgagacttgccccaccgtgcagcctaatatgctgaatgtgcacctcctgccccatacccacgacgacgtcggatggttaaagaccgttgaccagtatttttatggtataaaaaacgacattcagcatgccggggtccagtatattctggattctgttatctctgcactgctggccgatccgacacggcgctttatctacgtcgagattgctttcttctccagatggtggcaccagcaaactaatgctactcaagaagtggtacgcgaccttgtgcgacagggacgacttgaatttgccaacgggggttgggtgatgaacgatgaagctgctacacactatggcgcaatcgttgaccagatgaccctgggcctgaggttccttgaggacaccttcggcaacgacggacggccccgtgtcgcttggcacatagatccattcggccactctcgcgagcaggcttccctatttgcccagatgggctttgatggcttttttttcgggagactggactaccaggataagtgggtcagaatgcagaagctggagatggagcaagtgtggagagccagcacgtccctgaagccgcccacagccgatctgttcacgggggtgctcccgaacgggtacaacccccctcggaatctgtgctgggacgtgctgtgtgttgaccagcctttagttgaggacccaagatcccctgaatacaacgccaaggagctggttgactactttcttaacgtcgctaccgctcaagggcggtattatcgaactaatcatacggtcatgactatgggatctgactttcagtatgaaaacgcgaacatgtggtttaagaatttagacaagctcattaggctggtgaatgcccagcaggccaagggctcctcagtgcatgtcctgtactcaactcctgcctgttatctgtgggagctaaataaagccaatctgacctggtctgtaaaacacgacgatttttttccctatgccgacgggccacaccagttctggactggttatttcagttcacggcctgccctgaaaagatatgagagactcagctacaattttctacaggtttgcaaccaacttgaagccttggttggtctggcggcaaacgtcggaccctacggaagcggcgattccgctccactgaatgaggcgatggcagttctgcaacaccatgacgctgtgagtggtacgtctagacagcatgttgccaacgactatgccaggcagttagccgccggttggggaccctgcgaggtcctgctctctaatgcactggcaagacttcgcggatttaaggatcacttcaccttctgccaacaattgaatatctctatttgccccctgagccagaccgccgcacgcttccaagtcattgtctataacccactgggcaggaaagtgaactggatggtccggcttcccgtaagtgaaggcgtctttgtggtcaaggatccgaatggccggacggtgccttctgacgttgtcatttttccttcctccgattcacaggcgcacccaccagagcttttattctcagcgtcactgccagccctgggattctctacctactccgttgctcaggtccccaggtggaaaccccaggctagggccccgcagcctatcccgcgccggtcgtggagtcctgccctcaccatcgaaaacgaacatatccgagctacctttgaccctgacactgggctacttatggagatcatgaatatgaaccaacagcttctgctgcctgtgaggcaaacgttcttttggtacaacgcctctataggtgacaatgagagcgaccaggcgagtggtgcatatatcttcagacctaatcagcagaagccactccccgtgtcccgatgggctcaaatccatctggtgaagaccccgcttgtacaggaagtgcatcagaacttttctgcatggtgctcacaggtcgtcaggctttatcccggccaaagacatctggaactggagtggtccgtgggccccattccggttggcgatacatggggtaaggaagtcattagccgctttgacacgccattggagactaaaggtagattctacacggattccaatggtcgggagatcctagaacgtaggcgtgactatcggcctacatggaagcttaaccaaacagaaccagtggccgggaattattatcctgtgaacacccggatctacattactgatggaaacatgcaattgaccgtgctgacagatcgtagccagggcgggagcagtctgcgcgatggctccctggaactgatggtgcatagacgcctcctgaaagatgatggccgcggagtatcagagcccctaatggagaacggctccggtgcctgggttcgtgggcggcacctggtccttttagacaccgcgcaagccgccgccgccggacaccggctactcgctgaacaggaggttctggctccccaagtggtgctagccccagggggcggggccgcttataatttgggcgcgcctccaagaacccagttctccgggttgagaagggacctgcctccctcagtccatctgctgacccttgctagctgggggccagaaatggtactgctgagactcgagcaccagtttgcggtgggggaggactccgggaggaatctctcagcccccgtcaccctgaatctacgggacctgtttagcacctttacaattacccgcctccaggaaaccaccttggtagccaaccagcttcgtgaggcagcgtctcgactgaaatggactactaacactggtccaaccccccatcagacgccataccagctggaccccgcgaatataacactggaacccatggaaatccggactttcttggcatccgtgcagtggaaggaggtcgatggt

SEQ ID NO: 16535 - DNA, 3033 bp, Artificial Sequence
  Description of Artificial Sequence: Synthetic coding sequence
atgggggcatacgcaagagcgagcggtgtctgtgcccgcgggtgtcttgactccgctgggccttggaccatgagccgcgccctgaggccacctcttccacctttgtgcttctttctgctgctgctcgccgcagcaggtgcccgagcaggcggatacgaaacgtgtcccactgtgcaacctaacatgctgaacgtgcatctgctgcctcatacccacgatgatgtcggttggctgaaaactgtcgaccaatacttttacggaattaagaacgacattcagcatgcaggagttcaatacattctggacagcgtgatctcagcattgctcgcggatcctacccgtagattcatttacgtggaaatcgcgtttttctcacggtggtggcaccagcagaccaatgctactcaggaagtggtgagagatctggtccgccagggacggctggagtttgccaacggtggctgggtgatgaacgacgaagctgcaactcattatggtgccatcgtggatcaaatgactctgggccttagattcctggaggacacttttgggaatgatggaaggcctagagtcgcctggcatatcgatcctttcggccacagcagagaacaagcatcgcttttcgcacaaatgggtttcgacggattcttttttggacgattggattaccaagataagtgggtgcgtatgcagaagttggagatggagcaggtgtggcgtgcatcgacctcgcttaaaccgcccaccgcagatctttttactggggtgcttcccaatgggtacaatcctccacgtaatttgtgttgggatgtcctttgcgtggatcagcctctggtggaggatcctcgttctcctgagtataacgcaaaggaacttgtcgattactttctcaacgtggcgacggctcaggggagatactaccgaacgaaccataccgtgatgaccatgggaagcgattttcagtacgaaaacgcaaacatgtggttcaagaacctcgataagctcatccgtttggtgaacgcacaacaagcgaagggttcgtccgtgcatgtgttgtactccacgcccgcctgttacctttgggaattgaacaaggcaaatctgacttggtccgtgaagcatgatgacttttttccctacgcagacggacctcatcaattttggaccggatacttttcgagccgcccagctctcaaaagatacgaaagactgtcatacaattttcttcaagtatgtaaccagcttgaggcacttgtcggcctggcagccaacgtcggcccatacggatcgggtgattcggcgccccttaacgaagcaatggcagtacttcaacatcatgatgctgtgtcgggaacctcgcggcaacatgtggcaaacgattacgcacgacaactggcagcgggatggggtccatgcgaagtcttgctttctaatgcacttgcaaggctccgtggatttaaggatcactttaccttttgtcaacaactgaacattagcatctgtccattgtcccaaaccgcagcaagatttcaagtcatagtgtacaaccctctgggtcgcaaggtcaattggatggtgagactccctgtgtccgagggggtgtttgtcgtgaaggaccccaatggaagaactgtgcctagcgatgtcgtcatctttccttcgtcggatagccaggcccaccccccagaactcctgttctcggcaagcctgcctgccctcggattcagcacttattcagtcgcccaagtgcctagatggaaacctcaagcacgtgcccctcaacccattccacggcgcagctggtcgcctgcgctgactatagaaaatgagcatatcagagcaaccttcgatccagacactggcctgcttatggaaatcatgaacatgaaccagcaacttctgctccccgtgcgtcagaccttcttttggtataacgcgtccatcggggacaatgagtcggatcaggcatccggtgcatacatcttccgtcctaatcagcagaaaccactgcctgtgagccgctgggctcagattcaccttgttaaaactccactcgtgcaggaagtgcaccagaatttctccgcctggtgctcgcaggtcgtccgtctttacccaggacaaagacatttggagctggagtggtccgtgggaccaattccagtgggtgacacgtggggaaaggaggtgatctctcggttcgataccccacttgaaaccaaagggcggttctacaccgattccaatgggcgagaaatccttgagcgccgcagggattaccgacctacctggaagttgaatcagaccgaaccggtggcaggtaactactaccctgtgaatacccgtatctacataacggatggaaatatgcaacttactgtgctcactgataggtcacaaggcggttcgtcacttcgggatggttcacttgaacttatggtgcataggcgcctgttgaaagacgatggccggggtgtctccgaacctctgatggaaaacggtagcggggcatgggtgcgcggacgccatctcgtgctcctggatactgcacaagcagcagcagccggtcaccgactgctggcagagcaagaagtgcttgctccacaagtggtccttgcgcctggtggtggtgcagcgtacaacctgggagcgccgccgcggactcaattctccggcctgagaagagatctgccaccttcggtgcatctcctgactctggcgtcgtggggaccagaaatggtcttgcttcgactggaacatcaatttgccgtcggagaggattcgggaagaaacctgtcagcgccagtcacccttaaccttcgcgatctgttctccacctttaccatcactagattgcaagaaaccacgctcgtcgcaaaccaactgagagaagcggcgtcaagactgaagtggaccactaacactggacccaccccccaccaaaccccataccaacttgatccagcaaacattacgctggagcctatggaaatccgaacctttcttgcatccgtgcagtggaaggaggtggacgga

SEQ ID NO: 16536 - DNA, 3033 bp, Artificial Sequence
  Description of Artificial Sequence: Synthetic coding sequence
atgggggcctacgcacgggcctccggtgtgtgtgcccgcggatgcctggactctgccgggccatggaccatgtcacgtgcactgcgtcctccactgcccccactgtgtttctttctcctgctgctggccgccgctggagccagggcaggcggctacgagacctgcccaacagtgcaacctaatatgctgaatgtgcatctgctccctcacacccatgacgatgtggggtggctaaaaaccgtggatcagtacttttatggcattaaaaacgatatacaacatgctggagtgcagtatatcctggactctgtgatcagcgcacttttagcagatcctactcggcgtttcatttatgtggaaatcgccttcttttccaggtggtggcatcagcagaccaatgctacacaagaagtcgttagagatctagttcgacagggacggctagaattcgccaacggcggatgggtgatgaacgacgaggctgctacacactatggcgcaatcgttgatcagatgactctcggtctgcggtttctagaggacactttcggcaatgatgggcgtccacgtgtggcctggcacatagacccctttggccactctcgcgagcaggccagtttattcgcccagatgggctttgatggctttttcttcggtcggctggactaccaggacaagtgggtccggatgcagaagcttgaaatggaacaggtgtggagggcttctaccagtctaaaacccccaacagccgacctcttcactggggtgctgcccaacggctataaccctcctaggaatctatgttgggatgtcctatgtgtcgaccagcctctagtcgaggacccacgaagtccagaatacaacgccaaggaacttgtcgattactttctgaatgttgcaacagcccagggccggtactacagaaccaatcacacagtgatgaccatgggatccgactttcagtatgagaacgccaacatgtggttcaagaatctggataagctgattcgactggtgaacgctcagcaggctaaaggctcctccgtccatgtgctgtattcaacacctgcatgctatctgtgggaactcaataaggctaatctgacctggtccgttaagcatgacgactttttcccctacgccgacggcccccaccagttctggaccggctacttcagttcccgaccagctctgaagagatacgagcggctgtcctacaactttctacaagtttgtaaccagctggaggccctggtgggtctggccgcaaatgttgggccctacggaagcggagactctgctccccttaatgaagccatggccgtgctccagcaccatgacgccgtgagtggtacctctcgccagcacgttgctaacgactacgctcggcagctggcagccggctggggaccatgtgaggtgttactgtcaaatgctttagcacgcctgagaggctttaaggaccatttcaccttctgccagcagctaaacatctccatatgccctctgagccaaacagctgcccggttccaggtcatcgtgtataatcctctggggaggaaagtgaactggatggttagactacctgtgagcgagggtgtgtttgtggtcaaggatcccaatggaaggacagttcccagtgacgttgtcatcttcccatctagcgattcccaggcccatccccccgaactactgttttctgcatctctgcctgctttaggtttcagcacatatagtgttgcacaggtgccccgatggaagcctcaggctcgagcaccacagccaattccccgacggtcctggagtcccgccctaaccatcgagaacgagcacatcagagccacatttgaccccgatacaggactcctgatggagattatgaacatgaaccaacagctgctactaccagttagacagacctttttctggtacaacgcctctataggcgataacgagtccgaccaggcttccggcgcatatatctttcgccctaatcaacagaaaccactgccagtgtctagatgggcacaaatacacctggtcaagaccccactcgtgcaggaggtgcatcaaaattttagtgcttggtgctcccaagtcgtcaggctgtatcccggccagaggcatctcgagctggagtggtcagtgggtccaatcccagtgggggatacttggggcaaagaagtcattagtagattcgacacccctcttgaaacaaaagggagattctacaccgatagcaatgggcgtgaaatcctggaacgccggcgagattatcgtcctacttggaagctcaaccagacagagcccgtagccggcaactactatcctgtgaacacacggatctatataacagacgggaatatgcagctgaccgtcctgaccgaccgctcccaaggcgggtcctccttaagggacggctctctggagctgatggtccaccgacggctgctcaaggatgatggtcggggcgtgtccgagccgttaatggagaacggcagtggcgcttgggtccgcggaagacacttagtgctgttagatactgcccaggctgctgctgccggccaccggctcctggcagaacaagaagtgctggccccacaggtggtgctcgcacccggcgggggagctgcctataatcttggcgcccctccccggactcaattctccggcctgagacgcgacctgccacctagtgtgcacttgcttacactcgcctcatggggcccggaaatggtgctgctgagactcgaacatcaattcgccgtgggcgaagactctggccggaatctatctgctccagtcaccctgaacttaagggacctgttctctacatttacaatcaccagactgcaggaaaccaccctagttgccaatcagctgcgggaagccgcaagtcgattgaaatggaccactaataccgggcctacacctcaccagacaccctaccagttagaccccgctaacatcacattggagcctatggagatacgcacattcctggcttccgtgcagtggaaggaggtggacggg

SEQ ID NO: 16537 - DNA, 3033 bp, Artificial Sequence
  Description of Artificial Sequence: Synthetic coding sequence
atgggagcatacgctcgagcatccggagtgtgtgccagagggtgtttggattccgcaggaccgtggactatgtcacgagcgctgcggcctccacttcctccactgtgttttttcctgcttctcctggcggcagcgggagcacgtgcgggaggatacgaaacctgcccaacggtccagccgaatatgctgaacgtgcatcttcttccccatacccatgatgatgtgggatggctgaaaactgtggatcaatacttttacggaattaagaatgacattcaacacgcaggagtgcagtatatcctggattcagtgataagcgcactgctggcggatcccactagaagattcatttacgtggagattgcatttttctcccgctggtggcaccaacaaacgaacgcaacccaggaagtggtcagagatctggtgagacaaggacgcttggaatttgctaacgggggatgggtgatgaacgatgaggcagcaacccactatggtgcaatcgtggatcagatgaccctgggactccgctttctcgaagatacctttggaaatgatggcaggccacgggtcgcatggcatattgatccttttggacattcccgagagcaggcaagcctttttgctcagatgggctttgatggtttcttttttggacgcctggattaccaagacaaatgggtgaggatgcaaaagctggagatggaacaagtgtggcgcgcgtctacctcccttaaacctcctaccgcagacctgtttaccggagtgctcccaaacggttacaatccaccaagaaatctctgttgggacgtgctgtgtgtcgatcagcctctggtggaggatccacggtcgcccgagtacaatgcaaaggaacttgtcgattactttctgaacgtcgcgaccgcacaaggccgatactatcggactaaccatactgtcatgactatgggatcggattttcaatacgagaatgctaacatgtggtttaagaaccttgataaactgattagactggtgaatgcacaacaggcgaagggttcatcggtccatgtgctttactcaactcctgcatgttacctttgggaactgaacaaggcaaacctgacttggtccgtgaagcacgatgacttttttccttacgccgacggaccacaccaattctggacgggatacttctcctcacgtcctgcgctcaagagatacgagcgattgtcttacaactttctgcaagtgtgtaaccaactcgaggcacttgtcggcctggccgccaatgtgggcccctacgggagcggggactcggcgcccctgaacgaagccatggcagttctgcagcatcacgacgcggtgtcgggtacctccagacagcatgtggcaaacgattacgcaagacaactcgccgcgggttggggtccatgcgaagtcctcctgtccaacgccctcgcacggcttcgtggttttaaggatcacttcaccttttgtcaacagctgaacatttcaatttgccctttgtcgcagacggcagcaagatttcaagtgattgtgtacaaccctcttggtcggaaggtcaattggatggtgcggttgccagtgtccgaaggagtgtttgttgtgaaagatccgaacggaaggaccgtgccctcagacgtcgtcattttcccatcctccgattcccaggcccatcctcccgagcttctcttcagcgcatctctgcccgcgctgggatttagcacctactccgtggcccaggtgccaagatggaagccacaagcaagggcacctcagcctatccctagacgctcgtggtcgcccgctctcactatagaaaacgagcacattagagcaacttttgatcctgacactggcctccttatggagattatgaatatgaaccagcagcttctccttcctgtgcgtcaaaccttcttttggtacaatgcgtcaattggggataacgaatccgatcaggcatcaggtgcgtatatcttcaggcctaaccaacagaagccactgcctgtgtcaaggtgggcccaaatacacctggtcaagacccctctggtgcaggaagtgcatcaaaacttctcggcatggtgcagccaagtcgtgcgactttacccaggtcagaggcatcttgaactggaatggagcgtgggaccaatcccagtgggcgacacttggggaaaggaggtgattagcagatttgatacccctcttgaaactaagggaaggttttacaccgactcgaatggtagagaaattctggaaaggcgccgcgactaccgccctacctggaaactcaaccagacggagcccgtggcaggtaattactaccctgtcaacaccaggatttacattaccgatggaaatatgcagctgactgtcctgactgatagatcccagggcggctcctctcttcgcgatggcagcctcgaactcatggtgcataggcgactgctcaaggatgatgggcgtggcgtctcggaacccctgatggagaacggttcaggtgcttgggtgaggggtagacatcttgtcctcctggataccgcacaagcagcagcagccggtcatcgacttctcgctgaacaggaagtactcgcacctcaagtcgtgttggctcccggcggcggggccgcctacaatcttggagcaccacctagaactcagttctccggacttagaagagatctgcctccaagcgtgcatctgcttacgctggcatcatggggaccagaaatggtgcttctcaggctggaacaccagttcgcagtgggagaagattcaggcaggaatcttagcgcgcctgtgaccctgaacctgcgggacctcttttccaccttcactattacccgtctccaggaaactacgctggtggccaaccaactgcgggaggcggcctcgagacttaagtggactaccaacactggtccaacgccccatcagaccccgtaccagcttgatcccgccaacattaccctggagcctatggaaataagaaccttcctggcatccgtgcaatggaaggaagtcgatgga

SEQ ID NO: 16538 - DNA, 3033 bp, Artificial Sequence
  Description of Artificial Sequence: Synthetic coding sequence
atgggagcgtacgcgagagcgtctggagtctgcgcacgtggctgtctcgacagcgcaggcccttggaccatgtcgcgagctcttaggccacctctccctcccctttgcttttttcttctgctgttggctgcagcaggtgcgcgtgccggaggttacgaaacttgtccaacggtgcaacctaatatgctgaatgtgcatcttcttccacatactcatgacgatgtgggatggctgaaaactgtcgaccagtacttctacggtatcaaaaacgatattcagcatgccggggtgcagtacatacttgatagcgtgatctccgccctgctggcagaccccactaggcgctttatctacgtggaaatcgcattcttctcacggtggtggcaccaacaaaccaatgcaacccaggaggtggttagggacctggtgaggcaaggtaggctggagtttgcaaatgggggctgggtcatgaatgacgaagccgccactcattacggagcgattgtggatcaaatgaccctggggctccgcttcttggaagatactttcggaaacgacggacggccacgggtggcatggcatattgacccgtttgggcattcccgagagcaggcgtccctctttgcacagatgggattcgatggtttcttctttgggagactcgattaccaagataaatgggttcgcatgcaaaagctcgaaatggagcaagtgtggcgcgcttcgacttcgttgaagccccctactgcagacctgtttacgggtgtgcttccgaatgggtataatcccccaaggaatctttgttgggacgtgctgtgcgtggaccagccgctcgtcgaagatcctcgatcacccgaatacaacgcaaaggaacttgtggattactttcttaacgtcgccaccgcacaaggacggtattaccggactaaccataccgtgatgactatgggcagcgatttccaatacgaaaacgcaaacatgtggtttaagaatctggacaagctgatccggcttgtcaacgcacaacaggcaaagggatcgagtgtgcacgtgctctactcgactccagcatgttacctgtgggagctgaataaggcaaatcttacctggagcgtcaagcacgatgacttttttccatacgcagacggtccacatcagttttggacgggatacttttcgtcccgacccgcactgaagaggtacgagcggctgagctacaattttctgcaagtgtgcaatcaactggaagcgctggtgggactggcagcaaatgtgggcccctacggttcgggcgattccgcccccctcaatgaggcaatggccgtcctgcagcaccatgacgcagtgagcggaacctcgcgtcaacacgtggcaaacgattacgcccgtcagctggcggccggttggggcccttgtgaggtgctgctctccaatgcacttgctcgcctcagaggatttaaggaccattttaccttttgtcagcaactcaacatctcgatctgtcctctttcccaaactgcagcaagatttcaggtgatagtgtacaatcctcttggacgaaaggtgaactggatggtgcggctgccagtgtcagaaggcgtgttcgtggtgaaggatcctaacgggagaacggtcccgtcggatgtggtgatatttccatcctcggatagccaagcacatccacctgagctgctttttagcgccagcctgcctgcccttgggttttctacttacagcgtcgcccaagtgcctcggtggaaaccgcaggcgcgcgcccctcaaccaattccgagacggtcctggtccccagcgctcactattgaaaacgagcatatccgggccactttcgacccggacaccgggctgctgatggaaatcatgaatatgaaccagcaacttcttctcccagtccgccagacttttttctggtacaatgcatcaatcggcgataacgagtctgatcaggcctcaggggcgtacatttttcgccctaaccagcaaaaaccactccccgtgtcacgctgggctcagattcatttggttaagactcctttggtgcaggaagtgcaccaaaacttttcagcatggtgctcgcaagtcgtgcgactttaccctggacagaggcacctggagcttgaatggtctgtagggccaatacctgtcggtgatacttggggaaaagaagtcatttcacgttttgatactccacttgagactaaggggagattctataccgactcaaacggcagagaaatccttgaacgtcgtagggattacaggcctacgtggaagctgaatcagaccgaacccgtggcagggaactattacccagtcaatactcggatctatatcaccgatggtaacatgcaactgaccgtgctgaccgataggagccagggcgggagctcgctcagagatggatccctggaacttatggtacatcgccgccttctgaaggatgatggacggggggtatccgagcctctcatggaaaacggatcgggagcatgggtgagaggcagacacttggtccttctggatacggcccaagcggcagctgcaggccatagactgcttgcagaacaggaggtgcttgccccacaggttgtcctggcacccggcggtggggccgcgtacaaccttggggccccacccaggactcaattctccgggcttagaagagatctcccaccgagcgtgcatttgctgactctggcatcatggggtccagaaatggtgcttcttcgcctcgaacaccagttcgccgtcggagaggactcgggtcgtaacttgagcgcgcctgtcaccctcaacttgcgtgaccttttctccacctttactataaccagactgcaggagactaccttggtggcgaaccagctgcgggaggcagcttctcgtttgaagtggactacgaatactggtcctaccccacaccaaactccataccaattggatcctgcaaacattactctcgaaccgatggaaattcggactttcctggcatccgtgcagtggaaggaagtggatggt

SEQ ID NO: 16539 - DNA, 3033 bp, Artificial Sequence
  Description of Artificial Sequence: Synthetic coding sequence
atgggagcatacgcccgcgcctcgggtgtgtgcgcacggggctgtctggattcagcagggccctggaccatgtccagggctcttagaccgccacttccacctctgtgcttctttcttcttctgctggcagcggccggtgcacgtgccggagggtatgaaacttgcccaaccgttcaaccaaacatgttgaacgtgcatctgcttccacatacccatgacgatgtgggttggcttaagaccgtcgaccagtacttctacggaattaagaatgatatacaacatgctggcgtccaatacattttggactcagtgatatccgccttgcttgcagacccaaccagacgatttatctacgtggagattgcatttttctctcggtggtggcaccagcaaaccaatgctactcaggaggttgtcagagatctggtgaggcaaggccgactcgagttcgctaacggtggatgggtgatgaatgatgaagcagcaacccattacggagcaattgtggatcaaatgactctcggactccggtttcttgaggacaccttcggtaacgacggtagacccagagtcgcctggcatatcgatcccttcggccattcgagagagcaagcatccctgtttgcacaaatggggtttgacgggtttttcttcggacgcctcgactaccaggacaagtgggtgcgtatgcaaaaacttgaaatggaacaagtctggcgcgcatcaacttccctcaagccacccaccgcagatcttttcactggcgtcctccccaacgggtacaatccgccacggaatttgtgctgggatgtcctgtgcgtggatcaacccctcgtggaggatcccagatcccctgaatacaacgctaaagaactggtggactactttctgaacgtggccaccgcgcaaggtagatactaccggaccaaccataccgtgatgaccatgggctcagattttcaatacgaaaacgcaaacatgtggtttaagaatttggacaaacttattagactggtgaacgcacagcaggcgaagggttcgtcggtgcacgttctttactccactcccgcttgttacctttgggaacttaacaaggcaaacctgacttggtcagtgaagcatgatgactttttcccctacgcagacggacctcatcagttttggactggatacttttcctcccggccagcgctgaaaagatatgaacgcctcagctacaatttcctccaggtgtgcaaccaacttgaagcattggtgggccttgcagcaaatgtgggcccctacggatcaggcgactcggcacctctgaacgaggccatggcggtgctccagcatcacgatgcagtgagcggtactagccggcaacatgtcgcaaacgattacgccaggcagcttgcagcaggatggggtccctgcgaggtgctgctgtcaaacgccctggcacggctcagaggcttcaaggatcattttaccttttgtcagcagctgaatatctcgatctgtcctcttagccagaccgcggcgcggttccaggtgattgtctataatcctcttggaaggaaggtgaattggatggtgcggcttcctgtctcggaaggtgtattcgtggtgaaggatccaaatggcagaactgtgccgtcagacgtggtcatttttccctcaagtgattcgcaagcacatcctcctgaacttcttttttcggcatcgctccccgcactcggattctcaacgtacagcgtggcacaggtcccgagatggaagcctcaggcaagagcaccacaacctattccccggcgatcgtggtcgcccgccttgactatcgaaaatgaacacatccgtgcaaccttcgaccccgataccggcctcctgatggaaatcatgaacatgaatcaacaactgctgctgccagtgagacagacttttttctggtacaatgcttccattggagacaacgaatcagatcaagcctcaggtgcctacatatttcggcctaatcaacagaagcctcttccagtctcgcgttgggcacaaattcatctggttaagaccccactcgtgcaggaagtgcaccagaacttttctgcatggtgttcgcaggtggtccgactgtaccccggccaacgccatttggaacttgaatggtcagtggggcctattcccgtgggggacacttggggtaaggaagtgatttcccgatttgatactcccctggagactaagggtcgtttttacaccgattctaatggacgagagattcttgaacgccgtcgggattacagaccgacctggaagttgaaccagaccgaacctgtcgcaggaaattactaccctgtcaacaccagaatctacataaccgatggcaacatgcaactgaccgtgctgacggaccgatcccaggggggcagctccctcagagatggatcactggaattgatggtccaccggaggctcctgaaggacgatgggaggggagtcagcgagccacttatggagaatggatccggcgcatgggttcgtggccggcaccttgttctgcttgacactgcacaggccgcagcagcaggtcatcgtttgctggcagaacaagaggtccttgcaccacaagtggtgctcgcccctggtgggggagcagcatataacttgggcgcaccacctagaacccaattttccggactccggcgtgaccttccaccaagcgtgcatttgctgaccctggcctcatggggaccagagatggtgctcctgcgtcttgaacatcagtttgcagtgggagaggactcaggcaggaacctgtcggctccagtcaccctgaatcttagggatctgtttagcacgtttacgatcactcgccttcaagaaaccacccttgtcgcaaatcagctccgtgaagctgcaagccggctcaagtggactactaatacgggacctacgcctcatcaaactccttaccagcttgatcctgcaaatatcactctggagcctatggaaattaggacgtttctggcctccgtgcagtggaaggaagtcgatggt

SEQ ID NO: 16540 - DNA, 3033 bp, Artificial Sequence
  Description of Artificial Sequence: Synthetic coding sequence
atgggagcatacgcccgcgcttctggagtctgtgcgcggggatgcctcgattctgcagggccttggacaatgtctcgcgcactccgtccccctttgcccccgctctgcttctttctcctgctgctcgcagccgcaggcgcgagggccggtggctacgagacatgcccaacggtgcagcctaacatgttgaatgtgcacctgctcccccacacgcacgacgatgtcggatggcttaaaactgtcgatcagtacttctatggaatcaagaacgatatccagcatgcgggagtccagtacatcttggacagtgtgatctctgctcttctggccgatcccacccgtagattcatttacgttgaaattgctttcttcagccgctggtggcatcagcagaccaatgcaactcaagaagttgtgagggatctggtcagacagggcagattagagttcgcaaacggcggctgggtcatgaacgacgaggcggcaactcattacggtgcaatcgtcgaccagatgacgttaggactccgctttctcgaggatacctttggcaatgatggacgccccagggttgcctggcacatagacccgttcggccattctagagaacaggcctcgctcttcgcacaaatgggatttgatggcttcttcttcggtcgcctggactatcaagataagtgggtgaggatgcagaaactggagatggagcaagtgtggcgcgcctcgacatcccttaagccgccaaccgcagacctgttcactggagtccttcccaacggttataatccaccgcgcaatctctgctgggacgtactttgcgttgaccagccactggtcgaagatcctcgatcaccagagtacaacgcaaaagagctggttgactattttctgaatgtggctaccgcccagggccgttactatcggacaaaccacaccgtgatgacaatgggtagcgacttccagtacgagaacgcaaacatgtggttcaaaaatctagacaagctgatcaggttggtgaacgcccagcaggctaagggaagctcggtacatgtgctgtactccacccccgcttgttacctgtgggagctaaacaaggcaaacttgacctggtccgtcaagcacgacgacttcttcccctacgccgacggaccacatcaattttggaccggctatttttcctctcgccccgccctgaagaggtatgaacgactgagctacaatttcctgcaggtgtgcaatcaactagaggccctcgtgggtttggccgccaacgtggggccgtatggaagcggcgattcagccccccttaacgaagccatggcggttctccagcaccatgatgccgtcagcggaacctcaagacagcatgttgcgaatgattacgccaggcaactggcggccggatggggtccgtgcgaggtgctgctgtccaacgctttggcacgcctacgaggattcaaggatcacttcacgttctgtcaacaactgaatatatccatctgtccgcttagccaaaccgcggcacgtttccaggtgattgtttacaacccgttgggccgcaaggttaactggatggtgcgcctgcccgtctcagagggcgtattcgttgtaaaggaccctaacggtcgtacagtgccaagcgacgtggtgattttccccagctccgacagtcaggcgcacccccctgagttgctcttcagcgcctctctgccggccctgggattttccacctattcagtcgcccaagtaccgcgttggaaaccacaggccagggctccccaaccgatcccgcgccgcagttggagtcccgctctgaccattgagaacgagcacattcgtgcaaccttcgatccggacacaggattgctcatggaaataatgaacatgaatcaacagctgcttctcccggtgcgccaaacgttcttctggtacaatgccagcatcggtgacaacgagtctgatcaagcttcaggcgcatatatctttcgtcccaaccaacaaaagcccttaccagtgagccgctgggcgcagattcatctggtgaaaaccccgctggtgcaggaggtccaccagaatttctctgcctggtgctcgcaggtcgtgcgtttataccccggccagcgccacttggagttggagtggtccgtcggtccgatccctgttggtgacacctggggtaaggaagtgatttcacgtttcgatactccactagagaccaaggggagattctacacggattccaatggtcgggagatactggaaaggcgacgggattatcgtcctacgtggaaattgaaccagaccgaacctgtcgcgggcaattactacccggtgaatacccgcatttacatcaccgacggaaatatgcagctgaccgtgcttacagatcgcagccaaggtggatcgagccttagagatggcagccttgagctgatggtacaccgaagattgttaaaagatgatggccgtggagtttccgagccccttatggagaatggatccggcgcctgggtccgcggacgccatctggtgttgctcgataccgcgcaagctgcagcggccggtcatcgattgctggctgagcaggaggtcctagccccacaggtcgtgctggcgcctggtggtggggccgcgtacaacctcggggccccaccccgtacccagtttagcggtttgcgaagggatctacccccaagcgtccacctgctgaccttggccagctggggtcctgaaatggtgctgttgcgccttgagcatcaatttgccgtgggcgaagattctggccggaatctatccgcccccgttacgctgaatcttcgcgacctcttctccactttcacaatcacgcggctgcaggagacaacgcttgtggccaatcagcttcgagaggcggcgtctcgtctgaagtggaccacgaacaccggacccaccccacaccagacgccctaccagttggacccggccaacattaccctggagccgatggagattcgtacgttcttggcctctgtgcaatggaaggaggtggatgga

SEQ ID NO: 16541 - DNA, 3033 bp, Artificial Sequence
  Description of Artificial Sequence: Synthetic coding sequence
atgggagcttatgctcgggcgtcaggagtctgcgcaagagggtgcctcgacagcgcggggccgtggaccatgagcagagccttgcgccctccgctgcctcctctgtgtttcttcctgctgctgttggctgccgcgggcgcaagagccggcgggtacgaaacatgtcccacagtgcagcccaatatgctgaacgtgcatcttctgccccatacacacgacgacgtgggttggctgaagacagtggaccaatatttctacggcattaagaacgacatccagcacgcgggcgttcagtatatcttggattctgttattagcgcgctccttgctgacccgactcggcgattcatctatgtcgaaattgcgtttttctcccggtggtggcaccagcagacgaatgcaacacaggaagtggtgcgcgatctggtgcgtcagggacgcctggagtttgcgaacggagggtgggtgatgaatgatgaagctgctacccattatggggcgattgtggatcagatgacactgggcctacgcttcctggaggacacttttggaaacgatggcaggccacgtgttgcctggcacatagatccgttcggccatagtagagagcaagcctcactgtttgcgcagatggggtttgatggttttttctttggccgtctggactaccaggacaagtgggtgcgcatgcagaaattagaaatggaacaagtgtggcgagcttcaacatcattaaaaccacccaccgccgacctgttcaccggcgtccttcccaatggttataatcctccaagaaacttgtgttgggacgtattgtgcgtggatcagccattggtggaagatccccggtcacctgaatacaacgccaaggagctggtggattatttccttaacgtggctactgcacaggggagatactacagaaccaaccacaccgtcatgaccatgggcagtgacttccaatacgagaatgctaacatgtggtttaaaaatctggacaaactcatcaggctcgtaaatgctcagcaggccaagggctcttctgtccacgtcctatactccacccccgcttgctacttgtgggagctaaataaggcaaaccttacttggtctgtgaagcatgacgacttctttccttatgccgacggacctcaccagttttggacggggtatttctcctctcgacccgccctaaaacgctacgagaggctaagctataacttccttcaggtgtgcaaccagctagaggcactggtgggcttggcggccaatgtaggcccttatggttctggggattccgcacctctgaatgaagctatggccgtgcttcaacatcacgatgccgttagcgggacgtcgcgccagcacgttgctaacgactacgccaggcagttggccgcgggatgggggccctgtgaggttctcctctcgaatgcgctcgcccgcttacgcggattcaaggatcacttcacgttctgccagcaactcaatatttctatatgtccactgtcccaaaccgctgctaggttccaggtgattgtgtacaacccactgggacgaaaggtgaattggatggttagactccccgtgagtgagggggtgttcgtggtgaaggacccaaacggaaggactgtgccttccgatgttgtgattttcccaagctcagactctcaggcgcatcctcctgaacttctgttttctgctagcctaccggcccttggtttttcgacctactccgtggctcaggtcccacgttggaagccccaggccagggctcctcagcccatccctcgaagaagttggagcccagcactgaccatcgagaatgagcatataagagccactttcgaccctgatactgggctgttgatggagatcatgaacatgaaccagcagctccttcttccagttcgccaaacgtttttctggtataatgctagcataggagataacgaaagcgatcaagccagtggagcctatattttcaggcccaatcagcagaaacccctgccagtgagtaggtgggcacagatccatctcgtaaagacaccacttgttcaggaggtacaccagaacttcagcgcttggtgttcccaggttgttaggctgtaccctgggcagcggcacctggaattagagtggtctgtggggccaatccccgtgggcgacacgtggggcaaagaggttattagccgatttgacacacctctcgaaactaaggggaggttctataccgacagcaatggccgtgagatcctcgagcgcaggcgtgattaccgcccaacctggaagctgaatcagactgagcccgtagctggaaattactatcctgtgaacacacggatctatatcaccgacggcaacatgcagcttaccgttctgacggacagatcccagggtggctcctccttgagagacggctctttggagctcatggtgcaccgcagactgttaaaggacgacggccggggggtgtcagagcccctcatggagaatggcagcggagcctgggttcgaggccgccatctagttctgcttgacaccgcccaggctgctgccgcaggacatcgtctgttggccgaacaggaagtgctcgccccacaggtagtcctggcgcctggtggcggcgcggcttataatctcggagcccctcctagaacccaattctccggcctccgtcgcgacctgccgccgagtgtccatcttctgaccttggccagctggggtccagagatggttctgctaaggctggaacatcagtttgccgtgggggaagactctggaagaaacctgtccgcccccgttaccctgaacctgagagatctattcagtacattcaccattactcgtctccaggagaccaccctggtcgccaatcaactacgggaggccgcaagccggctgaaatggacaacaaatacaggccccactccacatcaaactccatatcagctcgatccagctaatattaccctggaacctatggaaattcggaccttcttggcgtcggtgcagtggaaggaggtggatggt

SEQ ID NO: 16542 - DNA, 3033 bp, Artificial Sequence
  Description of Artificial Sequence: Synthetic coding sequence
atgggggcttacgcaagggcctctggcgtctgtgcgagggggtgcttggattctgccggcccgtggacaatgtccagggccctgcggcctcctctccctcccctgtgcttcttcctgctgctgctggcagctgccggcgcacgggcaggcggctatgagacttgccctactgtccagcccaacatgttgaatgtacatttgctccctcacacccacgatgacgtcgggtggcttaagaccgttgaccaatacttctacggcataaaaaacgacattcagcacgccggcgtgcagtatatcctggatagcgtgatcagcgccctgctggcagatccaacacgacggtttatttacgtggagatcgccttctttagccggtggtggcatcagcagactaacgcgactcaggaggtggtgcgagacctggtcagacagggtcggctcgaatttgcaaatggcggctgggtcatgaacgacgaggcagccacgcattacggcgccatcgtggaccagatgaccttgggccttcgctttctcgaggatacctttggtaatgatggaagacccagagtggcctggcacatagatcctttcgggcactctagagaacaagcttccctctttgcacagatggggtttgacggctttttctttgggaggcttgactaccaggataagtgggtgagaatgcagaagctggaaatggaacaggtgtggagagcatcaaccagcctgaaaccaccgaccgcagatcttttcactggtgtcctgcccaacgggtacaatcccccaagaaatctgtgctgggacgtgctgtgtgtcgaccaaccgctggtcgaggacccaaggtccccggagtacaacgcgaaggagctggtggactattttttgaacgttgctactgcacagggcagatattaccgaaccaatcataccgttatgacgatgggtagcgacttccagtacgagaatgccaacatgtggttcaagaaccttgacaagctcatacggcttgtcaatgctcaacaggccaagggatcctccgtgcacgtcttgtatagcacgccagcgtgctatctttgggagctcaacaaagcgaacctgacctggtcagtcaagcatgatgatttcttcccatatgccgacggacctcaccagttttggacgggatacttcagttcaaggcctgctttgaaacgctatgagaggctttcatacaatttcctgcaggtgtgcaatcagttggaggccctggttggcctggccgcaaatgtcggcccatacggctcaggagattccgcgcccctgaacgaggcaatggccgtgctccaacaccatgatgccgtcagcggcactagccggcagcacgtcgccaacgactatgcaagacagcttgcagctggatgggggccatgcgaggtcctcctcagtaatgcactggcccggctcagaggttttaaggaccacttcaccttctgtcagcagctgaatatcagcatttgccccctgtctcagacagccgcacgattccaggtaatcgtttacaatccccttggtcggaaagtgaactggatggtgcgccttccagtgtccgagggtgtatttgtggtgaaagatccaaacgggagaacggtgcccagtgatgtcgttattttccccagctctgattcacaggcacacccgcctgagctcctcttttcagcatctctcccagctttggggttctcaacatacagcgtagcccaggtcccgagatggaagccacaggcccgggccccacagccgatcccgagaagatcttggtccccagcgttgactatcgagaatgaacacattcgggccacttttgatcccgatacaggtttgctgatggaaatcatgaatatgaatcagcaacttcttttgccggtgcgccagacattcttttggtataatgcatcaatcggcgacaacgagagtgatcaagccagcggtgcctacatttttagacctaatcagcagaaacccctccccgtgagcaggtgggcacagatacacctggtgaagaccccactggtgcaagaggtgcaccaaaacttttctgcgtggtgttcccaggtcgtgcgactgtatcctggccagaggcatctcgaactggaatggagcgtcgggccgattccggtgggagacacatgggggaaggaagttatcagtcgcttcgatacccccctggagaccaaggggaggttctatacagattccaacggcagggaaatcctggaacgccgccgggactacaggcccacgtggaagctgaaccagaccgaacccgtcgccggaaattactaccccgtcaataccaggatctacatcacagacgggaatatgcagctcacagtgctgacagataggtctcagggggggagcagcctccgggatgggagtttggaacttatggtgcatagacgcctcctcaaggacgacggtaggggcgtctctgagccactgatggagaatgggtccggcgcttgggtgcgcggaagacatctggtcttgctggatacagcccaggccgcagcagctggacacaggctcctggccgaacaagaagtccttgcgccccaggtcgtcctggcccctggcggcggtgcagcatacaatctgggtgccccgccacggactcagttctctggcctgcggcgggacctcccaccgtcagtgcatctgctgaccctggcctcttggggccccgaaatggttttgcttaggcttgagcatcaatttgccgttggtgaagactccggcaggaatctttccgcccctgtcaccctgaacctcagggatctgttctctaccttcaccatcactagactgcaggagacaactctggtcgctaaccaactgcgagaagctgctagtcgactgaaatggaccacaaatacaggtcctacacctcaccagaccccttaccagttggatccagcaaatatcactcttgaacccatggagatccgcaccttcttggctagcgtccagtggaaggaagtagatggc

SEQ ID NO: 16543 - DNA, 3033 bp, Artificial Sequence
  Description of Artificial Sequence: Synthetic coding sequence
atgggggcttatgcacgggcgagtggggtttgcgcacggggttgcctggacagtgcaggtccttggaccatgagtcgcgcattgaggcctccgctcccccccctttgtttctttctgttgctattggcggcggccggagcccgcgccgggggctacgagacatgcccgacagtccagccaaacatgctaaatgtgcatcttttgcctcacacccatgacgacgtcggatggctcaaaactgtggaccagtatttttacggcattaaaaatgacatacaacacgcaggtgtccagtatattctcgattccgtgatttctgctctcctagccgacccaacccgccggttcatatatgtagagatcgctttctttagccgttggtggcaccagcaaaccaatgcgactcaagaagtcgttcgagatttagtcaggcaggggaggctcgaatttgcgaatggcgggtgggtcatgaatgacgaggctgcaactcattatggtgccatagtggatcagatgactttggggcttcgctttctcgaagatacgtttgggaatgatggccggccacgtgtggcgtggcatatcgatcctttcggccattctcgggagcaagcgagcctcttcgctcagatgggcttcgatggcttcttctttggcaggctcgactatcaggataagtgggttcggatgcaaaaactggaaatggaacaggtctggcgggcctctacttccctcaagcctcctacggcagatctgttcactggagtactacctaacggctataaccctccgcgaaacttgtgctgggacgtactttgcgtcgaccagccactcgttgaggatcctagaagtccagaatataatgcgaaagagttagttgactatttcctaaatgtcgcaaccgcccagggccgttactacaggaccaatcatacggtgatgaccatgggatcggattttcagtacgagaacgctaatatgtggtttaagaatttagacaagctgatacgtctcgtaaatgcccagcaggccaagggatcatcagtgcatgttctctattcaacccctgcttgttatctttgggaactgaataaggctaatctgacgtggtccgtaaagcacgacgacttcttcccttatgctgatggcccccaccagttctggacgggctacttttcttcgcgaccggcgttgaagcgttacgaaaggctgagctacaacttcttacaagtttgcaatcagcttgaggctctagtgggcttggctgcgaatgtcggcccgtatggttcgggtgactccgccccattgaacgaggcaatggctgtattgcagcaccacgatgctgtgagtggcacatcgcgccaacacgtcgctaatgattacgccagacagttggctgctgggtggggtccatgcgaggtccttcttagcaatgcactcgctcgattgcgaggttttaaggaccattttaccttctgccaacaactgaatataagcatttgtcccctaagtcaaactgcagcgaggtttcaagttatcgtatacaaccccttgggaagaaaggttaactggatggtccggctccctgtatctgagggagtcttcgtggtgaaggatccgaacggtaggaccgttcccagcgacgttgttatttttccgagctcggacagtcaggctcacccccccgaattgctcttctccgcgtcactcccggccttgggcttcagtacgtattccgttgcacaggtccctcgttggaagccacaggcccgcgcaccacaaccgatcccaaggcgctcctggtcaccagctcttactattgagaatgaacacatacgcgcaaccttcgacccggatacaggccttctaatggagatcatgaatatgaaccagcaactcctcctgccagtacgccagaccttcttctggtacaatgcgtctatcggtgacaacgagagtgatcaggccagtggcgcctatatattccgacccaaccagcagaagccattgcccgtatcgcgttgggcacagatccatttggtgaagactccgctagtccaggaggttcaccagaactttagcgcctggtgttctcaggttgtacgcctttacccgggacagcgccacctcgagcttgaatggagtgtcggtcctattcccgtaggcgacacctggggcaaggaggtgatatcgaggtttgacactccgcttgagacgaaagggcgtttctataccgattcaaatggaagagaaatacttgagagacgcagagactatcgacctacgtggaaactgaatcagaccgagcccgtcgccggaaattactaccctgtcaatactcggatatacatcacagatggaaatatgcaactcaccgttttgactgatagatcgcaggggggttcaagcctccgcgacgggtcgctcgagctcatggtacatcgccgtctgcttaaggatgatggacgaggggtttctgaaccattgatggagaatggttccggcgcatgggtaagaggaaggcacttggttctcctcgacacggcgcaggccgccgccgcagggcatcggctacttgccgagcaggaggtgcttgccccccaagttgttttggcgcctggtggcggtgcagcgtataatctcggagctcctccaagaacccaattctccggattgcggcgtgatttgcctccatccgtacatctcctgactctcgccagctgggggcccgaaatggtactattgaggctcgaacaccaattcgcggttggtgaggatagtggacgaaatctctctgcgcccgtaacgctgaatttgcgagatctcttctccacatttaccatcacacgtctccaagagaccacactcgtggcaaaccaactacgcgaggccgcgtcgcgactgaagtggactacaaacacggggccaaccccacaccaaaccccctatcagctggatcctgccaatatcacattggaacccatggaaattcgcacattcctggcgagcgtgcagtggaaagaagtcgacggc

SEQ ID NO: 16544 - DNA, 3033 bp, Artificial Sequence
  Description of Artificial Sequence: Synthetic coding sequence
atgggtgcgtatgcccgggcgtcaggcgtctgcgcccgcggctgcctcgactccgctgggccctggactatgtctagggccctgcggccacccctcccgcccttgtgtttcttcctgctcctgcttgcggccgcgggagcgagggcaggaggctacgaaacctgcccgactgtgcagcccaatatgctcaacgtccatcttctcccccacactcatgacgatgtggggtggctcaagaccgtcgatcagtacttctacggaatcaagaatgacatccagcacgccggcgtccagtacatcctggattcagtgatttcggcactgctggccgatccaaccagacggttcatctacgtggaaatcgccttcttcagccggtggtggcatcaacaaaccaacgcaacgcaagaagtggtccgggatcttgtgcgccagggaaggctggagtttgcgaacggaggatgggtcatgaatgatgaggcagctactcactatggagccatcgtggatcaaatgactctcgggctccggtttctggaggatacttttggaaacgacggacgccctcgggtggcctggcacatcgacccgttcgggcatagccgggaacaggcttcactgttcgcgcagatgggattcgacgggttcttttttggacggctggactaccaggacaaatgggtgcgcatgcagaagttggaaatggaacaggtgtggcgggcgtcgacttcactgaaacctccgaccgccgacctcttcaccggtgtcttgccaaacggatacaacccgccgagaaacctctgttgggacgtgctctgcgtggaccagcctctcgtggaggatccgcggtcgccagagtacaacgcaaaggagctggtggattacttcctcaatgtggcaaccgcccagggacgctactacagaactaaccatactgtcatgactatgggcagcgacttccagtacgagaacgccaacatgtggttcaagaacctggacaagctgatcaggctggttaacgcacagcaggcaaagggtagctcggtgcatgtactgtactctaccccggcttgctacctctgggaactgaacaaggcaaatctgacctggagcgtgaagcacgatgactttttcccgtacgccgacggaccacaccagttctggaccggatatttctcgagcagaccagccctcaagcgttatgagcgcctgtcgtacaacttcctccaggtctgtaaccagttggaagctctggtgggcctggcggcgaacgtcggtccatacggttccggagactctgcccccctgaatgaggccatggccgtcctgcaacatcacgatgctgtgtcgggcacctctaggcagcacgtggccaacgattacgcccggcagctggccgccggctggggtccgtgcgaagtgctgctctcgaacgctctggcccgcctgcgcggattcaaggaccactttaccttctgccaacaactgaacatctcgatttgccctctgagccaaaccgccgcccggttccaagtgatcgtttacaacccgctgggacgcaaggtcaactggatggtgcggctgccggtcagcgaaggagtgttcgtggtgaaagaccctaatgggcggaccgtgccttccgacgtggtgatcttcccatctagtgactcgcaagcccacccgcccgaactgctcttctcggcctcgcttccggccctgggcttttcgacttactcggtcgcccaggtgccaagatggaagcctcaagccagagcaccgcagccgatcccgcgccgcagctggtcaccggcactgaccattgaaaacgaacatatccgcgccaccttcgaccccgatactggactcctgatggaaatcatgaacatgaatcaacagctgcttctgccagtgcgccaaaccttcttttggtacaatgcgtcgatcggagacaacgagtcggatcaggcctcgggagcgtatatcttccggccaaaccagcaaaaaccgctgccggtttcgcgctgggctcagatccacttggtcaagacccctctggtgcaggaggtgcatcagaatttctccgcctggtgctcccaggtggtccgcctgtacccgggacagcggcatctcgagctggaatggagcgtgggaccgatccccgtgggagacacttggggaaaggaagtgatctctcggttcgacactccacttgagactaaaggcaggttttacactgatagcaatggaagggaaatcttggagcggcggagggactacagaccgacctggaaactgaaccagaccgaaccggtggcaggcaactactaccctgtgaatacccggatttacatcaccgacggcaacatgcaactgactgtgctcaccgatcgctcacaaggcggttcctcacttagagacggaagccttgagctgatggttcaccggcgcctcctgaaggacgacggccggggagtcagcgaaccactgatggagaacggttcaggcgcatgggtacgaggacgccacctcgtcttgctggacactgcgcaggccgctgccgccggccacagactgctggcagaacaagaagtcctcgccccacaggtcgtgctggccccagggggaggggcggcttacaacctcggcgctccaccgcgcactcaattttccggactgcgacgggatctgccacccagcgtccacctcctgaccctggccagctggggcccagaaatggtcctgctccgcctggaacaccagtttgcggtgggcgaggactcgggtcgcaacctgtccgcgccagtcactctcaatctgcgcgatctcttcagcactttcaccatcaccagactccaagagactaccttggttgccaaccagctgcgggaagcggcctcgcggctgaaatggactacgaacactggaccaactcctcatcagaccccgtaccaactggacccggcaaacataaccttggaaccaatggaaatccggaccttcctggcgagcgtgcagtggaaggaagttgacggg

SEQ ID NO: 16545 - DNA, 3033 bp, Artificial Sequence
  Description of Artificial Sequence: Synthetic coding sequence
atgggcgcctatgcgcgcgcctctggtgtctgtgcccgaggatgcctggattcggctggcccatggaccatgagcagggccttgaggcccccactgccaccgctgtgtttcttcctgctgctgctggcggccgccggggcgagggcagggggttacgaaacctgcccaaccgtgcagccgaatatgcttaatgtccacctgctacctcatactcacgatgatgtcggttggctgaaaaccgtcgaccagtatttttacggcatcaaaaatgacattcagcacgctggcgtgcaatacattttggactctgtgatttctgcattacttgccgatccaacgcgacgcttcatatacgttgaaattgcattctttagcagatggtggcatcaacagacaaacgcaacccaggaagtggtgcgcgatctggttcgccaaggccgtctggagtttgcgaatggcggatgggttatgaatgacgaggcggcgacccactacggggccatcgttgaccaaatgaccctgggactgcgctttctagaagataccttcggcaatgatggtagaccacgcgttgcgtggcatatcgatccatttgggcactcccgcgagcaagcttctctgttcgcccagatgggtttcgacggtttcttttttggccgtcttgactatcaagacaaatgggtccgtatgcagaagctggagatggagcaagtttggcgcgccagcaccagcctgaaaccgccaaccgcagacctgttcacaggcgtcctgccgaatggctataacccacctaggaacctttgctgggacgtcttgtgtgtagaccaaccgcttgttgaggatcctcgtagcccagaatacaatgccaaggagcttgtggattattttttgaatgtggcaactgcgcagggacgctattaccgtacgaatcacactgtgatgacgatggggagtgacttccagtatgaaaacgccaatatgtggtttaaaaacttagataaactgatcagacttgtgaacgcacagcaggccaagggcagcagcgtccacgtgctgtatagcacgccggcctgttacctgtgggaactaaataaggcgaatctgacctggagcgtcaaacacgatgacttcttcccctacgccgatgggccgcatcaattctggacgggctatttctcctcacgccccgcgctaaagaggtacgaacgcctatcctacaacttccttcaggtctgcaaccagctggaggccctcgtcggcctggcggcgaacgttggaccttacggaagcggagactccgcgccgcttaatgaagctatggcggtcctgcaacatcatgacgccgttagcggtacgagcaggcaacatgtggcaaatgactacgcgcgccagctggcggcgggctgggggccgtgcgaggtactgttaagcaacgcactggcacgcctgcgcggcttcaaggaccattttacgttctgccagcaactgaacatcagtatctgccctctgagtcaaacagcggcccggtttcaagtgatcgtctacaatccactcggccgtaaggtcaattggatggttcgcctgccggttagcgagggcgtttttgttgttaaagaccctaatggtcgcacggtgccttccgatgttgttatttttccgagttctgatagtcaggcccaccctccggagctgctctttagcgctagcctgcccgccctgggttttagcacgtatagcgtggcccaggtcccccgttggaagccgcaggctcgcgcgccacagcctattccgcgccgtagttggagtcctgcgctgactattgaaaacgagcacatccgtgcaaccttcgacccggacactggcctgttgatggagatcatgaacatgaaccaacagctgctgctgccggttcgtcagaccttcttctggtacaacgcctccattggtgataatgagagcgatcaggcttccggtgcttacatattcaggccgaaccaacagaaaccattgccggtcagcagatgggcgcagatccaccttgtgaagaccccgctggtgcaggaggtgcatcaaaacttctctgcctggtgtagccaagtcgtgcgcctgtacccgggccaacgccatctagaactggagtggagcgtgggcccgattccagtaggtgacacctggggtaaggaggttatctctcggttcgacactccactggaaaccaaaggtcgattttacacggatagcaacggtcgcgagattctcgaacgccgacgagattacagaccgacatggaaactgaatcaaaccgagccagttgcaggtaactactacccagtaaatacgcgaatctacatcacggacggtaatatgcagctgacggtcctgactgatagaagccaaggcggtagcagtttgcgagacggtagcctggagctgatggttcaccgccgtctgctgaaagatgatggacggggcgtcagcgagcccttgatggaaaacggaagcggggcatgggtccggggtcgccacttagtcttgctggatactgcgcaagccgcggccgcaggccatcgcctcttggcagagcaggaagttctggcaccgcaggtggtgctggcgccaggtggtggagcagcgtataacctgggtgccccgccgcgcacccagttcagcggactgcgccgcgacctgcctcctagcgtccacctgttgaccctggcatcttggggtccagaaatggtcttactacgccttgaacaccagtttgctgtcggcgaagacagcgggcgtaatttaagcgcacctgtcaccctgaacctgagagaccttttcagcacctttaccataactcggcttcaagaaaccactctggttgctaatcagctgcgcgaggcagctagccggcttaaatggacgacaaataccgggccgaccccccaccaaacaccttaccagctggatccggcgaatattaccttggagccaatggaaattcgcaccttcttggcctccgttcagtggaaggaagttgatggc

SEQ ID NO: 16546 - DNA, 3033 bp, Artificial Sequence
  Description of Artificial Sequence: Synthetic coding sequence
atgggcgcctacgcaagagcatcaggggtgtgtgctagaggatgcctcgattctgcaggcccttggaccatgagcagagcactgaggcctccactgccaccactttgcttttttcttctgctgctggcagcggcaggggcgagagcaggaggatacgaaacctgccccactgtgcaacccaacatgctgaacgtgcacctgcttcctcacacccacgatgacgtcggatggctgaaaaccgtggatcaatacttttatggtatcaagaacgacatccaacatgccggagtgcaatacattctggattccgtgattagcgcactgctcgccgacccaacgcgacgttttatctacgtcgagattgcgtttttctcgcggtggtggcaccagcagaccaatgcgactcaagaggtcgtccgcgacttggtgaggcagggtagactcgaatttgccaacggaggttgggtgatgaacgatgaggctgcaacccattacggagcgatcgtcgatcagatgactttgggactgcgttttctcgaagatacctttggaaacgacggacgcccaagagtggcctggcacattgacccattcggccatagccgggagcaagctagccttttcgcccagatgggcttcgatggatttttcttcggacgcctggattaccaagataaatgggtgagaatgcaaaaacttgaaatggagcaggtctggcgcgcaagcacgagcctgaagcctcctaccgccgatttgttcaccggagtgctgcccaacggttacaatccaccccggaatctttgctgggatgtgttgtgtgtcgatcagcctcttgtggaagatcctagatcgcctgagtacaacgcaaaagagctcgtggactattttctcaacgtggccacggcccaaggtaggtactaccggactaaccacactgtcatgaccatggggtccgactttcagtatgagaacgcaaacatgtggttcaagaatcttgacaagctgattcggcttgtgaacgcacaacaagcaaagggctcatcagtgcatgttctttactcgacccccgcgtgctacctttgggaacttaacaaagccaacctcacttggagcgtcaagcatgacgatttcttcccttacgcagacggaccacatcagttttggactggatacttttcctcaaggcctgctcttaagcgatacgagcgcctctcttacaactttctgcaggtgtgcaaccaactggaagcgctcgtgggcctggcagcaaacgtgggaccgtacggatcgggtgattctgcacctcttaatgaagccatggccgtgctgcagcatcacgatgcagtgagcggaacctcgcggcagcatgtggcgaatgactacgcaagacaactcgcagcaggatggggtccttgtgaagtgcttctgtccaatgcccttgccaggctcagggggttcaaggatcattttaccttttgtcaacagcttaacatttcgatatgcccactgtcgcagaccgcagcacggtttcaagttattgtgtataaccctctcggcaggaaggtgaactggatggttagactccccgtttccgaaggagtgttcgttgtgaaggatccaaacggtagaactgtcccctcggacgtcgtgattttcccctcgtccgattcgcaggcccacccacctgagctcctttttagcgcctcgctccctgctctggggttttcgacctactccgtggcccaagtgcccagatggaagcctcaagcaagagctcctcaacctataccacgtcggtcgtggtcccccgcacttactatagagaatgagcatattcgcgcaacctttgatcccgatactggtctgcttatggagatcatgaatatgaatcaacaacttttgcttccagtccgacagaccttcttttggtacaacgcatcgatcggagataatgagtcggatcaagcatccggtgcttacatttttcggcctaatcagcagaaaccacttcccgtctcaagatgggcacaaatacatctggtcaagactccacttgtgcaagaagtgcaccagaacttttctgcatggtgctcgcaagtggttagactctaccctggtcagcgacatctcgaactggagtggtcggtgggacccatccctgtcggggacacttgggggaaagaagtcatctcgcgctttgatactccattggaaaccaaaggtagattttacactgactccaatggtagagaaattctggagaggaggagagattacagacctacctggaagctgaaccagactgaacctgtcgcaggcaattactacccagtcaatactagaatctacatcacggacggcaacatgcaacttacggtgctgactgaccgctcacaaggtggatcgagcctgagagatggttctcttgagctgatggtgcatagacggcttctgaaggatgatggcagaggagtttcagaacctttgatggagaatggaagtggcgcatgggtgcggggtcgtcatcttgtgctcctggacactgcacaagctgccgctgcagggcatcggcttcttgcagagcaagaagtgcttgcaccacaggtggtgctggcaccaggaggaggagcagcctacaatcttggagcaccaccaaggacccaattttcagggctgaggcgcgatctgccaccgtctgtgcatctcctcacccttgcgagctggggtccagaaatggtcctgctgagacttgaacatcaattcgcagtgggagaagattcggggagaaatcttagcgcacctgtcacccttaatctgcgagatcttttttctacctttacgattactcgtttgcaggagacgacccttgtggccaatcagctgagagaagccgcgtcgaggcttaagtggactaccaataccggcccaactcctcatcagaccccttaccagctcgatcccgccaacatcacccttgaaccgatggaaattcgcacttttctcgcaagcgtgcaatggaaagaggttgacggg

SEQ ID NO: 16547 - DNA, 3033 bp, Artificial Sequence
  Description of Artificial Sequence: Synthetic coding sequence
atgggcgcttatgcacgggcttccggagtgtgcgcaaggggctgccttgacagcgccggtccctggacgatgagccgtgcattacgaccccctctcccccctctgtgtttcttcctgttgcttcttgccgctgcaggcgcaagagccgggggatatgagacctgccccaccgtgcagccgaatatgttgaacgtgcaccttctcccacacactcatgatgatgttggctggctgaagaccgtggatcagtacttctacggcatcaagaatgacatccagcacgccggagtccagtacattttagattccgtaatttccgctctgctcgctgaccctacaagacgctttatttatgttgagatcgccttcttctcacggtggtggcaccagcagaccaacgcaactcaggaggtggtgagggacctggtgaggcaaggacggctggagttcgcgaatggcggctgggtaatgaatgatgaagccgcaactcactatggcgcgatagtggaccaaatgaccttagggctcaggttcttggaggatacattcggtaacgatggacgcccccgagtggcgtggcacatcgatccatttggccattcccgcgaacaggctagtttgttcgcacagatgggcttcgacgggttttttttcggtaggttggactaccaagacaaatgggtgaggatgcagaagctggagatggaacaggtgtggcgggccagtacttctctgaaacctccgaccgcagatctgtttaccggcgtgctgccaaatggctacaaccctcctcgcaatctgtgttgggatgtgctgtgcgtggatcagcccctcgtagaggatccgcgctcgcccgagtataatgctaaggaactcgtcgattactttctcaatgtagccaccgctcaaggaagatactataggaccaaccatacagtgatgacgatgggctccgactttcagtacgaaaacgccaacatgtggttcaagaacctcgataaactcatacggctggttaacgcgcagcaggctaagggttccagcgtccatgttctttatagcacccctgcctgctacctgtgggaattgaacaaggctaatctgacctggtccgtgaagcatgatgatttttttccatatgcggatggcccacaccagttttggacgggctacttttccagcaggcctgccttaaagagatatgaaagacttagctataactttctgcaggtctgtaaccagttagaggcacttgtgggactggccgctaacgtgggcccatacggatccggcgacagtgccccgctgaacgaggctatggctgtcctccagcaccacgatgctgtttccggcacgtctcgccaacatgtcgcgaatgattatgcgagacaattagctgccggatggggcccctgcgaagtcctcctctcaaacgcattagctcgacttcgggggtttaaggaccacttcaccttctgccagcaattgaacatcagcatatgtcccctctctcagactgcagcgcgcttccaggtgattgtgtacaacccactcggcagaaaagtgaactggatggtccggctgccagtctctgagggcgttttcgtggttaaggatcctaatggcagaacagtcccctccgacgtggtgatttttccgtcatctgactctcaagcacatccccctgaacttctttttagcgcttccctccctgctttgggcttcagcacttatagtgtggcccaggtgccccgctggaagcctcaggcgagggcgccacagcccataccacgtagaagttggtcacctgcactgaccatcgagaacgagcatattagagcaacattcgaccccgatacgggtctactcatggaaatcatgaacatgaaccaacagctcttgttaccagttagacagacattcttttggtacaatgcgagcattggcgataatgagagtgaccaagcttctggcgcctatattttccgtcccaaccaacagaagcccctgcccgtgagtcgatgggcccagatacacctggtcaaaactcccctggttcaggaggtgcatcaaaactttagcgcatggtgttctcaggtggtacgactctaccctggccagcggcatttggagctggagtggagcgtgggcccaattcccgtcggagatacatggggcaaggaggtgatcagtcggtttgatactcccctagaaactaaaggccggttttacaccgattccaacgggagggaaatccttgaacggagaagggattacagacctacctggaagctcaatcaaaccgagcctgtggctggcaactactacccagtcaatacccgtatctatattaccgacggaaacatgcaactgaccgtgcttaccgacagatcccaaggcggatcttcactccgcgatgggtccttagagctaatggtgcacagacgcctcttaaaggacgacggcaggggagtttcagagcctttgatggagaacgggagcggtgcttgggtacgcgggcgccatctcgtactcttggacactgcccaggcagccgctgcagggcacaggctgctcgccgagcaggaggtcctggctcctcaggtcgtgctagcgccgggcggaggggccgcctataacctcggagctcccccacgcacacagttctccggccttagacgagatttgccgccgagcgtgcacttattgactctggcctcgtggggtcctgaaatggtgctgctcagactagaacatcaatttgcagtcggcgaggatagcggacgcaacttgtctgctcccgttacactgaacctcagagatctgttttccactttcaccatcacccgactacaagaaacaactctagttgcgaatcaacttcgggaggctgccagccggctgaagtggaccactaatacaggtccgaccccgcatcaaacaccctaccagcttgatcccgctaatatcacactggagcctatggagatccggaccttcttagccagtgttcagtggaaggaggtggacgga

SEQ ID NO: 16548 - DNA, 3033 bp, Artificial Sequence
  Description of Artificial Sequence: Synthetic coding sequence
atgggggcgtacgctcgggcgtccggagtgtgtgcaagaggctgtctcgactccgccggaccatggaccatgtcgcgcgcacttaggcccccgttgcccccgctctgtttctttctgttgctgctggcggcggccggggcgcgcgcaggaggatatgagacttgtcccaccgtgcagcctaacatgctgaacgtgcacctgctgccacatactcacgacgatgtgggctggttgaaaaccgtggatcagtacttctacggaattaagaatgatatccaacatgctggagtgcaatacatcctggattccgtgatctctgcactgctcgccgaccctactcggcggttcatctacgtggaaattgcttttttcagcaggtggtggcaccagcaaactaatgccactcaagaggtggttcgtgaccttgtccgccagggaaggttggagttcgcgaacggaggctgggtgatgaacgacgaggcagccactcactacggggctatagtcgaccagatgactctgggcctccgcttcctcgaagatacctttggaaatgacggcagaccccgcgtggcatggcatatagatccgttcggccactcccgggagcaggcgtccttgttcgcacaaatgggattcgatggcttcttcttcggcagactggactaccaggacaagtgggtccggatgcagaagctcgagatggaacaggtatggcgagcctccacctccctgaaaccacctaccgccgatctgttcactggtgtgcttccgaatggatacaatccgccccggaacctgtgctgggacgtgctgtgtgtggaccaaccgctcgtcgaagatccacggtcgccggagtacaacgccaaagaacttgtggattactttctgaatgttgcaacggcgcagggccggtactaccggacgaaccacactgttatgaccatgggatccgactttcagtacgaaaacgcgaatatgtggttcaagaacctggacaaactgatccggttggtgaacgcccaacaggccaaggggtcatcggtgcacgtcctgtactcgacccccgcttgctatctctgggagctgaacaaagcaaacctgacctggtccgtgaaacatgatgatttcttcccgtacgccgacgggccacatcagttctggacgggctacttttcctcccggccagctttgaagcgctacgaacggctgtcgtacaatttccttcaggtctgcaaccagctggaagcactggtgggactcgccgccaatgtgggtccgtacggttcgggtgatagcgccccgctgaatgaggctatggcggtgctgcaacaccacgacgccgtctcggggacttctcggcaacacgtggccaacgattacgcgaggcaactcgcggccgggtggggtccatgtgaagtcctgttgtcaaatgcattggctaggctccgtgggtttaaggaccacttcacgttttgccagcagctgaatatcagcatctgcccgctctcccagaccgctgcgcgctttcaggtgatcgtgtacaaccctctgggccgcaaagtcaactggatggtgcgattgccagtgtctgagggagtgtttgtggtgaaagacccgaatggaagaactgtgccgtcagatgtggtcatcttcccttcgtcggattcacaggcccatccgcccgaacttctgttttcagccagcctgccggcactgggattctcaacttacagcgtggcgcaggtgccaaggtggaaacctcaggcgagggctccacagccgatcccgcgccgctcgtggagcccagctctcactattgaaaatgagcacatccgggccactttcgatccagataccggcctgttgatggagattatgaacatgaaccaacaactgctcctgcctgtgcgccaaaccttcttctggtacaacgcatcgatcggcgataatgagtcggaccaagcgtccggggcctacatctttagaccgaaccagcagaagccgctcccagtctcgcgctgggcgcagatacacttggtgaaaactcctctcgtccaagaagtgcatcaaaacttctcggcatggtgctcacaagttgtgcgactgtacccgggacagcgccatctggagctggaatggtcagtgggtccgatcccggtcggagacacctggggaaaggaggtgatcagccgctttgacactcccctcgaaaccaaaggccggttttacaccgactccaatgggagagagatcctggaacggagaagagactaccgccctacttggaaactcaatcagacggagccggtggcaggaaattactacccggtaaatacccgcatatacatcaccgacggaaacatgcaactgaccgtgctcacggatcggtcccaaggcggatcatccctgcgggacgggtcgctggaactcatggtgcacaggcgcttgctgaaggatgacggacggggagtcagcgagccactgatggaaaacggcagcggcgcctgggtgcgcggacgccatctggtcctcctggataccgcccaggctgcggcagcgggacacagattgctggcagaacaggaggtcttggcgccacaggtcgtgctcgctccgggaggtggcgccgcctacaacctcggtgccccaccaagaactcaattttccggactccggcgcgacctgcctccctcagtgcatctgctcactctggccagctggggacctgagatggtcctgctcagactggaacatcaattcgcagtgggcgaggactctggtcggaacctgagcgcccctgtcactctgaatcttcgcgatctcttctcaaccttcactatcacccgcctgcaggaaaccactctcgtcgctaaccaacttcgcgaggcagcatcgcgcctgaaatggactaccaacactggtcctacgccacaccaaaccccttaccagctggatccggcgaatatcaccctggaaccgatggagatccggacctttctggcctccgtgcagtggaaggaagtggacgga

SEQ ID NO: 16549 - DNA, 3033 bp, Artificial Sequence; identical to SEQ ID NO: 16524
  Description of Artificial Sequence: Synthetic coding sequence

SEQ ID NO: 16550 - DNA, 3033 bp, Artificial Sequence
  Description of Artificial Sequence: Synthetic coding sequence
atgggcgcctacgcgcgggcatccggagtgtgtgcccgcggatgcctggactcggcgggcccatggaccatgtcgcgggcactccggccgccactcccaccgttgtgcttctttctcttgctgcttgcggctgccggggcgcgggctggaggatacgaaacttgtccgactgtccagccgaacatgctgaacgtgcacttgctcccccacacccacgacgacgtgggctggttgaaaacggtggatcagtacttctacggaatcaagaacgacatccaacacgctggtgtgcagtacattctggacagcgtgatctcagctcttctcgccgaccctactcgcagattcatctacgttgagatcgccttcttctcgcggtggtggcaccaacagaccaacgcaacgcaggaggtggtgcgtgacctggtccggcagggacggttggaattcgctaatggtggatgggtcatgaatgacgaagcagccacccactacggagccatcgtggaccaaatgacgcttggactgcggttcctggaagatactttcggaaacgatggacgcccccgggtggcttggcatatcgacccgttcggacattccagggagcaggcgagcctgttcgcgcaaatgggcttcgatggattctttttcggacgactggattaccaggacaaatgggtcaggatgcaaaagctggaaatggaacaggtctggagagcgtccactagccttaagccaccaaccgcggatctcttcactggcgtgctgccgaacggatacaacccgccgcggaacctctgctgggatgttctgtgcgtggatcaaccactggtggaggaccctcggagcccagaatacaatgcgaaggaactggtggattacttccttaatgtggctaccgcccagggccggtactaccgcactaaccatactgtcatgaccatgggtagcgactttcagtatgaaaacgctaatatgtggttcaaaaatctcgataagttgatcagactggtcaacgcgcagcaagccaagggttcctccgtccatgtcctctactcaacgccggcctgctacctctgggaactgaacaaagccaacctcacctggagcgtgaaacatgacgactttttcccgtacgccgacggtcctcatcaattctggactggatacttctccagccgcccggctctcaaacggtacgagaggctctcgtataactttctgcaggtctgcaaccagctggaggcgctcgtgggactggccgccaacgtgggcccgtacgggtctggcgacagcgctccgctgaacgaggcaatggctgtgctccagcaccatgatgcggtgtccggcacttcgagacagcacgtggcaaatgactacgcgcgccagttggccgccggctgggggccttgcgaagtgctcctctcgaacgcactcgcacggctgcgcggcttcaaagaccatttcaccttttgccagcagctgaacatctccatttgcccgctgtcacagaccgccgccagattccaggtcatcgtgtacaacccgttgggacgcaaggtgaactggatggtgagactgcctgtgagcgagggtgtgtttgtggtgaaagatccgaatggtcggactgtgcccagcgacgtggtcatttttccaagctcagatagccaggcacacccgccagagttgctgttctcggcgtcactcccggctttgggcttttccacctactcagtggcccaggtgcctcgctggaagccgcaggcaagagcaccgcaacctatcccacgccggagctggtcccctgccctgacgatcgagaatgagcacatccgcgcgaccttcgacccggacactggactgctgatggaaatcatgaacatgaaccaacaactcttgttgcccgtccggcagaccttcttctggtacaatgcctccatcggggacaacgaatccgatcaagcgagcggggcctacatcttccgcccgaatcaacagaagccactgccagtgtcacgctgggctcaaattcacttggtgaaaacgccattggtccaggaggtgcatcaaaacttcagcgcatggtgcagccaggtggttcgtctctacccgggacaacgccatctggaattggagtggtccgtaggacctatcccagtgggggacacttgggggaaggaggtgatctcaagatttgatactccattggagactaaaggacggttctacaccgacagcaatggacgtgagatcctcgaacgccgcagagactatcggccgacttggaaattgaaccagaccgagccggtggcgggaaactactacccggtgaatactagaatttacatcaccgacgggaacatgcaactcactgtcctcaccgataggtcacagggcgggtcctcacttcgcgatggaagtcttgagctgatggtccatagacggctcctcaaggacgatggcagaggagtcagcgagcctctgatggaaaacggttcgggcgcatgggttcggggacgccatctggtgctcctggataccgcccaagctgccgccgcggggcaccggctgctggcggaacaggaagtgctggcaccgcaagtggtcctcgcccccggcggaggagccgcctacaatcttggggctccacccagaacccagtttagcggactccggcgcgatctccctccgagcgtccatctgctcactctggcctcgtggggaccggagatggtcctcttgagactcgaacaccaattcgcggtgggcgaggattcaggtcggaacctgtcagctcctgtgaccctcaacctgagagatctctttagcactttcaccatcacgcggctgcaggaaaccaccctggtcgccaatcaactcagagaggccgcttcccgccttaagtggaccaccaacaccggcccaaccccgcaccagaccccgtaccagctggacccagcaaacattacgctggaacctatggaaatccggacctttttggcatcagtgcagtggaaggaagtggatgga

SEQ ID NO: 16551 - DNA, 3033 bp, Artificial Sequence
  Description of Artificial Sequence: Synthetic coding sequence
atgggagcctacgccagagcctcaggggtctgtgccaggggatgtcttgacagcgcagggccatggacgatgtccagggcattgcggcctcccctgcccccactttgtttttttcttctcctgctggctgccgctggggcgcgagctgggggatatgaaacctgtcccaccgttcaacccaacatgctgaacgtacatttgctgccgcacactcatgacgatgtcgggtggctcaagactgtggaccagtacttctacggtattaagaatgatattcagcatgccggggtccagtatatcctagatagcgtgatttcagctctgttagcagacccaacgcggcggttcatttacgtggagatcgccttcttttccaggtggtggcatcaacaaacgaacgcgactcaggaagtcgtgcgggacctcgttaggcagggtaggttagagttcgcaaatgggggctgggtgatgaatgatgaagccgccactcactatggggcaatcgtggatcagatgactttagggctgagattccttgaagatacctttggcaatgatgggcgccctcgggtggcttggcacattgacccgtttggacactcaagagagcaagcctccctctttgcgcagatgggcttcgatggcttctttttcgggaggctggactaccaggataaatgggtaaggatgcaaaaacttgaaatggagcaggtgtggagggcatctacctcgctaaaacctccaaccgcagatctgttcacgggggtgctgcctaacggctacaacccccctagaaatttgtgctgggacgtcttgtgtgtagatcagccgctggttgaggacccaaggagtcccgagtacaacgctaaagaacttgtggactatttcttgaatgtggcgaccgcccagggccgatactatcggacaaatcatacagtcatgaccatgggctccgactttcagtacgagaatgcaaacatgtggttcaagaacttggacaaattgatccgcctagttaacgcccagcaagcaaagggatcatccgtccatgtgctgtactctacacccgcctgttatctgtgggagcttaacaaggccaacctgacctggtccgtcaagcacgacgacttctttccatatgcggatggcccgcaccagttttggacagggtatttcagctcgcggcccgccctgaagaggtacgaacgcctgagttacaacttcctccaggtctgtaaccagctggaagctctggttggcctagcggcaaatgttggcccttacgggtctggcgatagtgccccactgaacgaggctatggctgtccttcagcaccacgatgctgtatccgggacttcccggcagcacgtcgccaacgattacgctcgtcagctggctgcgggatgggggccctgcgaggtacttctaagcaatgcgctggctagactgaggggattcaaggatcatttcaccttctgtcagcagttaaatatttctatttgccccctctcacaaactgctgcgcggttccaggtgattgtgtacaatcctttaggccgaaaggtgaactggatggtgagactgcccgtcagcgaaggggtgttcgtggttaaagatcctaacggccgaacagtgccatccgacgtagtgatcttcccgagttccgacagccaggcacatccacctgaactgctgttttccgcgagtctcccagcgctgggcttttctacgtactctgtcgcacaggttcctaggtggaagccacaggccagggcacctcagccaattccgagaagatcctggtctccggcactgacgatagagaatgaacacatccgcgcaacgtttgatcctgacaccggcctgctaatggagatcatgaatatgaaccagcaactcctcctccccgtgaggcagacttttttctggtataatgcatccattggcgacaatgaatcagaccaggcttctggtgcgtacatctttagacctaaccagcagaagccactcccggtctcacgatgggcacaaatccacttggtgaagactcctctggtgcaagaggtccatcaaaacttctcagcatggtgttcccaggtggtgcggctgtatcccggacagagacatctggagctggaatggtctgtaggacctatacccgttggtgatacgtggggcaaagaggtgatctcgcgatttgacactccactcgaaaccaaaggcagattctataccgacagtaacggacgtgagatactcgagcggaggagagattacaggcctacatggaagttgaatcagaccgaacccgtggcaggaaactactatccggttaacacccgcatttacatcacagatgggaatatgcagctgacggtgttgaccgatcgttcccagggcggaagtagtctgcgggacggatcgctcgaactaatggtgcatagacgtctactgaaggacgatggaagaggcgtgtccgagcccctcatggaaaacggctccggagcatgggtgcgagggcgccatttggtgctcctggacaccgcacaggctgcggctgctggccatcgcctcctcgccgaacaagaggttcttgccccccaggtggtgctggcccccggtggaggagccgcttataacctgggggctccccctcgcacccagttttccggcctgagacgggatctgccgccttcggtacatttgctgactcttgcctcctggggtccagagatggtgctcctaaggctggagcatcagttcgcagttggggaggattcgggcagaaatttgtctgctcctgtcacccttaatctccgcgatcttttctcaaccttcaccataaccagacttcaggaaacaacacttgtggccaaccagctaagggaggctgcctcccgattgaagtggaccaccaacacaggtccaaccccacatcaaaccccctatcagcttgacccagcgaatataacactggagccaatggaaatcaggacctttctcgcatccgtgcagtggaaggaagtggacggt

SEQ ID NO: 16552 - DNA, 3033 bp, Artificial Sequence
  Description of Artificial Sequence: Synthetic coding sequence
atgggagcttacgcaagagcgtctggtgtgtgtgcccgcgggtgtcttgactccgcgggtccgtggactatgagccgtgctctccgcccacctttgcccccactgtgttttttcctcttgctgctggctgcagcgggagctcgagcaggcggctacgaaacctgtcctaccgtgcagcccaacatgcttaacgtgcatctgctcccacacacccatgatgatgtcggatggcttaagaccgtcgatcagtacttttatggcatcaaaaacgacattcagcatgcgggggtccaatacatcctggatagcgtgatttcagcactgctcgccgaccccactcgtaggtttatctacgtggaaattgcattcttttcgagatggtggcaccaacaaaccaacgcgacccaagaagtcgtcagagatctggtccgccaggggcggctggaattcgcaaatggcggttgggttatgaacgacgaagcagcgactcattacggtgcaatagtcgaccagatgacccttggcctgcgcttcctggaggacactttcggcaatgacggacgaccacgggtggcttggcacattgaccctttcggacattcgcgggagcaggcatctctttttgcccagatgggcttcgacggcttctttttcggacgactggattaccaggataaatgggtgcggatgcagaagctggaaatggaacaagtgtggcgggcatccacttccctgaagccgccaactgcagatttgttcaccggagtccttccgaatggttacaatccaccacgtaatttgtgctgggatgtgctgtgcgtggatcaacctcttgtggaagatccgagatccccggaatacaacgcaaaggaactggtggattactttctgaacgtggcgaccgctcaaggtcggtactaccgtaccaaccatactgtgatgaccatgggttcagattttcaatacgaaaacgcaaacatgtggtttaagaacttggataaacttattaggctggtcaatgcgcaacaagcgaaggggtcgtcggtccacgtgttgtactccacccctgcatgctatctttgggaactgaacaaagcaaacctgacctggtcggtgaagcatgacgacttttttccctacgccgatgggccacatcaattttggaccggttacttctcatcgcggcccgcactgaaaagatacgaacgcctgtcctacaacttcctgcaagtgtgcaatcaactggaggctcttgtcggactcgcagcaaacgtggggccttacggaagcggtgactccgcaccccttaacgaagccatggccgtcctccagcaccatgatgcagtctccggaactagcagacaacatgtcgccaacgactacgcgcggcaactcgcagccggatggggcccatgcgaagtgctcctcagcaacgcgctggcgaggctcagaggttttaaggatcactttactttttgccagcaactgaacatttcaatctgcccgctctcacagaccgctgctagatttcaggtcatcgtgtacaatccgctgggcagaaaggtgaactggatggttagacttccagtgtcagaaggagtctttgtcgtgaaggatcctaacggacgtactgtgccatcagatgtggtgatctttccttcctcagattcccaggcacatcctcctgaactccttttttcagcatcgttgccggccctgggtttctccacttactcagtcgcacaagtgccacggtggaaaccccaggcaagagccccgcagccaattccacggagatcctggagcccagctctgactattgagaatgagcatatccgcgccacctttgatcctgatactggacttctcatggagatcatgaatatgaaccagcagctcctgcttcctgtgcgccaaacgtttttctggtacaacgccagcataggagacaacgagtccgatcaggcctcaggggcatacattttcaggcctaatcaacagaagccacttcccgtgtcacgctgggcgcaaattcatcttgtcaaaactcctctcgttcaggaagtccatcaaaacttctccgcttggtgctcccaagtggttcgtctctaccccggtcagcgccatcttgaactggaatggtccgtggggccaattccagtcggcgatacttggggcaaggaagtgatctcccggttcgacacgccactggaaaccaaaggccgattctatacggattcaaacgggcgcgaaatcctcgaaaggagaagagattaccgccctacctggaagttgaaccagactgaaccagtggcaggaaattactaccccgttaacaccaggatttacattaccgacgggaacatgcagttgactgtgctgacggaccgctcgcaaggtggatcgagccttcgcgacggttcgcttgaactgatggtgcatcgccgccttctcaaagatgacggccggggggtgtccgaaccactcatggaaaacggatcgggggcatgggtcagaggtagacatctcgtgctgctggatactgcacaggcggcagctgcaggacaccgcctccttgctgaacaagaagtgctggcgcctcaagtcgtcctcgcacccggaggcggagcggcgtacaatctgggagcaccgcctagaactcagttctcgggccttagaagggaccttcctccctccgtgcatcttcttactcttgcttcgtggggacctgagatggtgcttcttcgattggagcatcagttcgcagtcggtgaagattcaggaagaaatcttagtgcacctgtgactctcaacctccgcgatctgtttagcacctttactataaccaggctccaggaaaccaccctcgtcgctaaccaacttagggaagcggcctcgaggcttaaatggaccactaataccggacccactccacatcaaactccctaccaacttgatcctgccaatatcactctggaacctatggaaatccggacgtttttggcatcggtgcaatggaaggaggtggacggt

SEQ ID NO: 16553 - DNA, 3033 bp, Artificial Sequence
  Description of Artificial Sequence: Synthetic coding sequence
atgggtgcatatgcccgcgctagcggagtgtgtgcacgcggatgcctggactccgcagggccttggactatgagtcgggctctccgcccccctctccctccactgtgttttttcctgctgcttttggccgctgcgggtgcgagggcaggagggtacgaaacctgtcctacggtgcagcctaacatgcttaacgtgcacctcttgccacatacgcacgatgatgtcggctggctgaaaaccgtggaccagtacttttatgggatcaaaaatgatatccaacatgcaggtgtgcaatacattctggattcggtgataagcgccttgcttgcagatccaacccggcgctttatctacgtggaaattgcattctttagccgctggtggcatcagcaaaccaatgcaacccaggaagtcgtgcgcgaccttgtgaggcagggaaggttggaatttgcaaacgggggctgggtcatgaacgacgaggctgcaactcactatggcgctatagtggatcaaatgaccctgggactccgcttcctcgaagatacctttggaaacgacggacgcccaagagtggcttggcatatagatcctttcggacattcgcgggaacaggcatccctttttgcacaaatgggcttcgatggatttttctttggaaggctggattaccaagataagtgggtgcggatgcaaaagctcgaaatggaacaagtgtggagggcatcaacctcgctgaaaccccctactgcagacctctttactggagttctgcctaatggatacaatccacctcgcaatctctgctgggacgtcctttgcgtggatcagcctctggttgaagatcctagatcaccggaatacaatgcaaaggaactggtggattactttctgaatgtggcaactgcccagggaagatactaccgcacgaaccatactgtcatgactatgggctctgattttcagtacgagaatgccaacatgtggtttaagaatcttgataaactgatccgcctggtgaacgcacagcaggccaagggctccagcgtgcacgtgctgtactccaccccggcctgctacctgtgggaacttaacaaggcaaacctcacctggtccgtcaagcatgatgacttctttccatacgcagatggacctcatcagttttggaccgggtacttctcgagccggcctgcacttaagagatacgagcgacttagctacaactttctccaagtgtgtaatcaactggaagccctggtggggctggccgctaacgtgggaccttacggatcaggtgacagcgccccgctgaacgaagcgatggctgtccttcaacatcacgatgcagttagcggcacgtcacgccagcacgtcgccaacgattatgcaagacaacttgcagcaggatgggggccctgtgaagtccttctgtccaatgcgctggccaggctgcgcggatttaaggatcacttcaccttctgccagcagctgaacatttccatctgtcccctgtcgcagactgcagcacgatttcaagtgattgtgtacaatcctttggggagaaaggtgaattggatggtccggcttcccgtgtcagaaggcgtgtttgtggtcaaggacccgaacgggcgcaccgtgccgtcagacgtggtgatatttcccagcagcgactcgcaagcccatcctccagaactgcttttttccgcgtcgctccctgccttgggattttcgacctactcagtggcacaggtccctagatggaagcctcaagcgcgagcaccacagcctattccacgtcgatcgtggtccccggccctgactatagagaacgagcacattcgtgccacctttgaccctgacactggtctgctgatggagatcatgaacatgaaccagcaactgcttttgcctgtgcgccagacttttttctggtacaacgcgtccattggggacaacgagtcggaccaggcaagcggagcctatatctttcgtccgaaccagcagaaacccctcccagtttcccgctgggcccagatccatctggtcaaaacccctcttgtccaagaagtccaccagaatttctcggcgtggtgttcacaagtggttcgcctttacccgggacaaagacatctggaactggaatggtccgtgggtcccattcctgtgggagatacctggggcaaggaggtgatttcacggttcgatactcctctcgagactaaaggcagattttacactgacagcaacggtagagaaattctcgaaagacgtcgtgattaccgaccgacctggaagctgaatcaaactgagccagtggcaggtaactactaccctgttaacacccgtatatacatcactgacggtaacatgcaacttaccgtgctgactgatcggtcacaaggaggatcgtcgctgagagatggttcgctggaacttatggtgcatagacggcttctgaaggatgacgggcgaggtgtctccgagccgttgatggaaaacggatcaggagcatgggtgaggggtcggcatttggtgctccttgacactgcacaggccgccgcggctgggcaccgccttctggcagagcaagaagtgctggcaccacaggtcgtgttggccccaggcggaggggctgcgtacaacctcggcgcaccccctagaacccagttttcgggactgagacgggaccttccgccttccgtgcatctgcttaccctggcgtcctggggaccagaaatggtgctgctgcgcctggaacaccaattcgcagtgggagaggactcgggacgcaacctgtcggctccagtgactctgaatctgagagatcttttctccacttttacgatcactcggctgcaagaaaccactcttgtggcaaatcaacttcgtgaagccgcgagccggttgaaatggactacgaataccggacccacccctcatcaaaccccttaccagcttgatcctgctaacataaccctggaacccatggagattagaacctttctggcatcggtccagtggaaggaagtcgacggc

SEQ ID NO: 16554 - DNA, 3033 bp, Artificial Sequence
  Description of Artificial Sequence: Synthetic coding sequence
atgggagcatacgcacgcgcatccggtgtctgtgcgcgaggttgtttggacagcgccggcccctggaccatgtcacgggcattgaggcctcctctccctcctctgtgttttttcctgcttctgctggccgcagcaggtgccagagctgggggttacgagacgtgtcctactgtgcagccgaatatgctgaacgtgcatctgctgccacatactcacgacgatgtgggttggctgaaaaccgtggaccagtacttttacggaataaagaatgatatacaacatgccggcgtgcaatacatccttgatagcgtgatttcagcactccttgcggatccgacgaggcggttcatttacgtcgaaatcgctttcttctcccgctggtggcaccaacagaccaatgcaactcaagaagtggttagagacttggtccgacaaggacgactggagtttgcaaacggtggttgggtcatgaatgatgaagccgcaacccattacggtgcgatcgtggaccagatgaccctcggacttagatttctggaagatacttttggtaacgatggacgtccgcgagtggcctggcatattgacccatttgggcactcgcgcgaacaagccagcctttttgcacagatgggcttcgatggattcttttttgggaggctcgactaccaagataaatgggttagaatgcagaaactcgaaatggaacaggtctggcgggcaagcacttcgctgaagcctccaaccgccgatctgtttaccggggtgcttcctaacgggtacaaccccccaaggaatctgtgttgggatgttctttgcgtggaccaaccgctcgtcgaagatcccagaagccctgagtacaatgcaaaggagctcgtggattacttcctgaatgtggcaaccgcacaaggtaggtattacaggactaaccacacggtgatgaccatgggatccgatttccaatatgaaaacgcaaacatgtggtttaagaacctggataagctgatccgactggtcaatgcacaacaggcaaagggctcctcagtccatgtcctttattccacccccgcatgctacctctgggagctgaacaaggctaacctcacgtggtccgttaaacatgacgacttctttccatacgcagatggcccacaccaattttggaccgggtacttttcaagtcgccctgccctcaagcgatacgaacgactttcgtacaatttccttcaggtgtgcaaccagcttgaagcattggtgggactggctgccaacgtgggaccctacggttcgggagattccgctccgcttaatgaagctatggcagtcctgcaacatcacgatgcagtgtcaggaacttccaggcagcatgtcgcgaatgactatgcaagacaacttgccgctggctggggaccatgtgaggtcctgctctctaatgctttggcacgccttcggggtttcaaagatcatttcaccttttgtcagcaattgaacatctctatttgccctctgagccagactgcagcacgcttccaagtcatcgtgtacaaccccctgggaagaaaggtgaactggatggtgagactcccagtttcggagggagtgtttgtggtcaaggacccaaacggtcggacggtgccttctgatgttgtgatttttccttcctccgactcccaagcgcatccacctgaactcctcttttcggcctctctgcccgcacttgggttctccacttactctgtggcacaggtcccacgctggaagcctcaagcacgggcaccgcaacctattccacggagatcctggtcgccggccctgactattgaaaatgaacatatcagggcgacgtttgatcccgacactggcctgcttatggagattatgaacatgaaccagcaactgctccttcccgtcagacaaactttcttttggtacaacgcgagcatcggagataacgaaagcgatcaggcctccggagcatacatctttagacctaatcagcagaagcctttgccagtgtcgcggtgggcacaaattcatctcgtcaagacccctcttgtgcaggaagtgcaccaaaacttcagcgcctggtgttcgcaagtggtcagattgtacccggggcagcgccatcttgagcttgaatggagcgtggggccaattcccgtcggagatacctggggcaaagaagtgatttcgcgcttcgatactccccttgaaaccaagggaaggttttacaccgatagtaacggtcgggaaatacttgaaagacgtagagactaccggcctacctggaaactgaaccagactgaaccggtggccggtaattactacccagtgaacaccagaatctacattactgacggtaacatgcaacttacggtgctgaccgaccgatcacaaggcgggagctcactgagggatggttcgttggagttgatggtccacagacgactgcttaaggatgatggacgcggagtgtccgagccgttgatggagaacggaagcggtgcctgggtgcgaggacggcacctggtgcttcttgatactgcacaggcggccgcagccggtcatcggcttcttgcggagcaagaagtgctcgcgcctcaggtcgtgctcgccccagggggcggggctgcctacaacttgggtgctcctccacgtacccagtttagcggacttaggcgagatttgcctccatccgtgcatctcctgacccttgcctcctgggggcctgagatggtgctcctgcgcctggaacaccaatttgcagtgggcgaggactcgggacgaaatctcagcgccccagtgaccctcaatctgagggaccttttttcgacttttaccattactcgacttcaggaaaccaccttggtggccaatcaactgcgagaggccgccagccgactgaaatggactacgaacaccggaccgaccccacatcaaactccttaccaactggaccctgccaacattactttggagccgatggaaataaggacgttccttgcgagcgtacaatggaaggaagtggatggc

SEQ ID NO: 16555 - DNA, 3033 bp, Artificial Sequence
  Description of Artificial Sequence: Synthetic coding sequence
atgggcgcctatgcaagagcgtccggcgtttgtgcccgcggatgtctggatagtgccggtccatggaccatgagtagagcactgagaccgcctctgccccccctttgcttcttcttgctgctgctagcagccgctggagcccgcgccggcggctacgaaacctgcccgactgttcaaccgaatatgcttaatgtacatcttctcccgcatacacatgacgatgttggctggctgaaaacagtagatcaatacttttatggcatcaaaaatgatattcagcacgcaggagtgcagtatattcttgattctgtgatctctgctctccttgcagaccccacgagacgctttatatatgttgaaatcgcctttttcagtagatggtggcatcagcaaacgaatgcgacccaagaagtagtacgagacttagttcgccaaggccgcctggaatttgccaacggtgggtgggtgatgaacgatgaagctgctacacactatggtgctattgttgatcagatgacgctgggccttagatttctcgaagacacgtttgggaacgacggacgtccgagagtggcgtggcacattgacccattcggtcattcaagagaacaggcgtcgctgtttgctcaaatgggtttcgatggcttctttttcggcagattggattaccaagataagtgggtgaggatgcaaaagctcgaaatggaacaggtctggcgagccagtacttcactcaaaccgccgaccgcagatcttttcactggagtcctgccgaacggttataacccgccgcgcaatctgtgctgggacgttctttgtgtagaccagccgttagtagaggacccgaggtcgcctgaatataatgccaaagagttggtcgattactttctaaatgtagctacggcacaaggccgttactatcggacgaatcacacagtgatgaccatgggttctgattttcagtacgaaaatgcaaatatgtggtttaagaatttggataaattgataaggctggtgaatgctcagcaagctaaaggcagctcggtccatgttttgtatagcacgccggcatgctacctctgggaactgaacaaggcaaacttaacatggagcgtgaaacatgatgacttttttccgtatgccgatgggccacaccagttctggaccggatattttagctcacgcccggccctgaagcgctatgagagactttcttataactttttgcaagtctgtaatcagttagaggcccttgttgggctggccgcaaacgtaggtccttatggaagcggcgattcagcaccccttaatgaggctatggccgtgttgcagcatcacgatgccgtttcaggtacttcccggcagcatgtagccaatgattatgcgcgacaactagcggctggttggggaccttgcgaggtactgttgtcaaacgcactggcacgtttgcgtggttttaaagatcattttacgttctgtcaacaattgaatatctcaatttgcccgctgagccagacggccgcccggtttcaagtaatcgtttataatcctttaggacgtaaagttaactggatggttcgtcttccggtgtcagaaggggtatttgtagtcaaggatccgaacggccggacggtgccatctgacgtggtgatctttccgtcgtccgatagccaagctcatccaccggaacttctatttagtgcatcacttccggcgttaggcttttcaacatattcagttgcgcaggtacctcggtggaaaccacaggcgagagccccgcagccgatcccacggaggagttggtccccggctctcacgatcgagaatgaacatatccgagccacgtttgatccagatactggactgctaatggagatcatgaacatgaatcagcagttgctcttgcccgtgaggcagacattcttctggtataatgccagtattggggacaatgaatctgaccaggcttccggggcctacatttttcggccgaatcagcaaaaaccgttgccggtgtcaagatgggcccagattcatcttgtaaagactcctctggtacaagaagtccatcaaaacttctcagcctggtgctctcaggtcgtccggttatatcctggtcaacgccatctagagttggagtggtctgtcggacctatacccgtgggcgatacctggggaaaagaagttatatcaagatttgataccccgttagaaacaaagggcagattttacacggactcgaatggaagggagatcctggaacggagacgcgattatagaccgacatggaaactgaaccagacggaaccggttgcaggcaattactatcctgtcaacactcgtatttacattactgacggaaacatgcaactgacagtattgacagatagatctcagggagggtcatcactacgcgacggctctttggaactgatggtgcatcggaggcttctgaaagacgatgggcgtggagtgagcgaacctcttatggaaaacggaagcggagcctgggtgcgtggaagacatctagttttattagatacagcacaagctgcggcggctggccatcgcctactggccgaacaagaagttttagccccccaggtagtattggcgcctggtggcggtgcggcatataaccttggggcgccaccgaggactcaattttcgggcttacgcagggatcttcctccttcagtacatctgttaactttagcttcttggggaccggaaatggttcttttacgtctcgaacatcaatttgccgtcggtgaagattcaggtagaaatttatccgcaccggtgacactgaacttaagagacttgttttcgacattcactattaccagactgcaagaaacaacattggtagccaaccagttgcgcgaagcagcctcacgccttaaatggaccacaaatactggaccgacgccgcatcaaacaccgtatcagttggaccctgcaaacatcaccttagaaccgatggaaatcaggaccttcttggcgtcagttcaatggaaagaggttgacgga

SEQ ID NO: 16556 - DNA, 3033 bp, Artificial Sequence
  Description of Artificial Sequence: Synthetic coding sequence
atgggtgcttacgcaagagcctccggtgtgtgcgcacggggctgtcttgactcagcaggaccttggaccatgtccagggcgctgcgaccgccacttcctccgctgtgtttctttctcctgctccttgcagcagccggggcaagagcaggaggatacgaaacctgtcccactgtccagccaaacatgctcaatgtgcatcttcttccccatacccacgacgacgtgggttggctgaaaaccgtggatcagtacttctacgggataaagaacgacatccaacatgccggagtgcagtacattcttgattccgtgatctcggccctgctggcagatcctacccggagattcatttacgtggaaatcgcatttttctcacggtggtggcaccagcaaaccaacgccactcaagaagtggtgcgagatctggtgaggcaaggacgactggagtttgcaaatggaggttgggtgatgaacgatgaagcagccacccactacggtgcaatcgtggaccaaatgaccctcggtttgcgctttctcgaggacacctttgggaacgacggacgtccaagagtcgcatggcatatagacccttttggacattcccgcgaacaagcatcgctctttgcgcagatgggttttgatggtttctttttcggccgtctggactatcaggataaatgggtgcggatgcaaaagttggagatggagcaagtctggagggcttcgacttcacttaagcctcctacggctgatctcttcactggcgtgcttcctaacggctacaatcctcccaggaatctttgttgggatgtgctgtgcgtcgatcaaccactggtggaggacccccgttcccctgaatacaacgccaaggaactggttgattactttttgaacgtcgcgaccgcccaagggcggtactacagaacgaatcacaccgtcatgactatgggttcggatttccaatacgaaaatgcgaacatgtggtttaagaacctcgataagctcattagactggtgaacgcacaacaggctaagggatcatccgtgcatgtcctgtactccacccctgcttgttacctttgggagcttaacaaggccaacctgacgtggtccgtcaagcatgatgatttctttccttacgctgatggtcctcatcaattttggactggttacttctcctcccggcccgcacttaagcgctacgaacggctttcatacaactttctccaagtttgtaaccagcttgaagctcttgtgggtctggcagccaatgtgggaccatacggctccggggattcagcgccactcaatgaggccatggcagtgttgcagcaccatgacgcagtgagcggcacttcgcgccagcatgtggccaacgattacgcccgccaacttgcggcaggctggggtccatgcgaagtgctgctctcgaacgccctggcacgcctgagaggtttcaaggatcactttacgttctgtcagcagcttaacatctcaatttgtcctctttcacagacggcagcaagatttcaggtgatcgtgtacaacccccttggtcgaaaggtgaactggatggtgaggctgccagtctccgaaggagtgttcgtggtgaaagaccccaatggacggaccgtcccttcagatgtggtgatcttcccatcctccgattcgcaagcacatcctcccgaattgctgttttcagcctcactgcctgcacttggattctcgacctactctgtggcacaagtgcctagatggaaacctcaggcacgagcaccgcagcccattccacgacggtcatggtcgcccgcactcactattgaaaatgagcatattagagccaccttcgatccagacaccggactcctgatggaaatcatgaacatgaaccagcagctcctccttccggtgagacaaactttcttttggtataacgcatccattggtgataatgaaagcgaccaggcgtccggcgcatacattttccgacctaatcagcaaaagccactgcccgtcagccggtgggcccagatccaccttgtgaaaactcctctggtgcaggaggtccaccaaaactttagcgcatggtgtagccaagtggtgcgactgtacccaggacagcgtcatcttgaacttgaatggtcggtgggacctattcctgtgggggacacctggggaaaagaggtgataagcaggtttgatacgccgctggaaaccaagggccggttttacactgatagcaatggcagagaaattctggaacgtcggcgtgattaccggccaacctggaagctgaatcagactgaacctgtggctggtaattactatccagtgaataccagaatctacataactgacggcaacatgcagctgaccgtcctcacggatcgcagccaggggggttcctccctccgagacggatcgcttgagctcatggtccacagaaggctgttgaaagacgacggccgcggagtgtcagaacctctgatggaaaatgggagcggggcctgggtgagggggaggcatcttgtcctgctggatactgcacaggcagcagccgccggacatagacttctcgcggagcaagaggtccttgccccacaagtcgtgctggcacctgggggtggagccgcttacaatctcggtgcaccccctagaacccagttttcagggcttagacgtgatcttcctcctagcgtccatctgcttacgctcgcatcgtggggccctgaaatggtgctgttgcggcttgaacatcaatttgcagtcggggaagattcgggtcgcaatctttccgcacctgtgacccttaacctccgagatctctttagcacctttactattaccagactgcaagaaacgaccttggtggcaaatcagcttagagaagctgcgtccaggctgaagtggacgacgaataccgggcctaccccgcaccaaacgccataccaactcgatccggctaacattacccttgaacccatggagattcgaacttttcttgcatcggtccagtggaaggaggtcgacggc

SEQ ID NO: 16557 - DNA, 3033 bp, Artificial Sequence
  Description of Artificial Sequence: Synthetic coding sequence
atgggagcatatgcaagagcatcaggagtttgtgcaagaggatgtttagattcagcaggaccttggactatgagtcgtgctttacgtccacctttaccaccactttgtttttttttattattattagctgcagcaggggcacgtgccggaggatatgaaacatgtccaactgttcaaccaaacatgttaaatgttcatttattaccacatactcatgatgatgtgggttggttaaaaacagttgatcaatatttttatggtattaaaaatgatattcaacatgctggagtacaatatattcttgattcagttattagtgctcttttagcagatccaactagacgatttatttatgttgaaatcgcatttttttcaaggtggtggcatcaacaaacaaatgcaactcaagaagtagttagagatttagtaagacaaggtagattggaattcgctaatggtggatgggttatgaatgatgaagcagcaacacattatggagcaattgttgatcaaatgacacttgggttaagattccttgaagatactttcggtaatgatggaagaccacgagtagcatggcatattgatccatttgggcatagtagagaacaagcttctttatttgcacaaatgggatttgatggttttttctttggtcgattggattatcaagataagtgggttagaatgcaaaaacttgaaatggaacaagtttggagagcttctacttcacttaaacctccaacagcagatctatttacaggagttttaccaaatggatacaaccctccaagaaatttatgctgggatgtactttgtgttgatcaaccacttgttgaagatccacgttctcctgaatataatgctaaagaattagtagactatttcttaaatgttgctacagctcaaggaagatattatagaacaaatcatacagttatgactatgggttcagattttcaatatgaaaatgcaaatatgtggttcaagaatttagataaattaataagacttgttaatgcacagcaagcaaaaggttcatcagttcatgtattatactcaactccagcatgttacttatgggaacttaataaagctaaccttacatggtctgttaaacatgatgactttttcccatatgcagatggaccacatcaattttggacaggatatttttcatcacgtccagctttaaaaaggtatgaaagacttagctataactttcttcaagtttgtaatcaacttgaagctttagttggattagcagctaatgttggaccttatggatctggtgattctgctccacttaatgaagcaatggctgttttacaacaccatgatgctgtatctggaacatctagacaacatgttgcaaatgattatgcaagacaacttgctgctggttggggaccttgtgaagttttattatctaatgctttggctagacttagaggatttaaagatcattttacattttgtcaacaacttaatatatctatttgtccattatcacagactgctgctagatttcaagtcattgtttataatccacttggaagaaaggttaattggatggttagattacctgtgtcagagggtgtttttgttgttaaagaccctaatggtagaactgttcctagtgacgttgttatttttccatcttcagattcacaagctcatccaccagaattgttattttcagcatcattaccagctttgggtttttcaacatatagtgttgcacaagtacctagatggaaaccacaagcaagagcaccacaacctattccaagaagatcatggtcaccagccttaacaattgaaaacgaacatattagagcaacttttgatccagatactggacttttaatggaaataatgaatatgaaccaacaacttcttttaccagttagacaaacatttttttggtataatgcatcaatcggagataatgaaagtgatcaagcatcgggagcttatatattcagaccaaatcaacaaaaaccattaccagttagtagatgggcacaaattcatttagtaaaaacaccattagttcaagaagtacatcaaaacttttcagcatggtgttcacaagttgttagactttatccaggacaaagacatttggagttagaatggagcgtcggtcctattccagtaggagatacttggggaaaagaagttatatctagattcgacacaccattagaaacaaaaggaagattttatactgattcaaatggaagagaaattcttgaaagaagaagagattatcgtcctacatggaagttaaatcaaacagagccagttgctggtaattattacccagtaaatactagaatctatattactgatggaaatatgcaattaacagttcttactgatagatctcagggaggtagtagtttaagagacggatcacttgaattaatggtgcatagaaggctacttaaagatgatggtagaggtgttagtgaaccacttatggaaaacggttcaggtgcttgggtaagaggtagacatctagttttattagatactgcacaagctgctgcagccggacatagattacttgcagaacaagaagtattagcaccacaagttgttttagcacctggaggaggagcagcttataatttaggagcaccaccaagaacacaatttagtggtttaagaagagatttgccaccttcagttcatttactaactttagcatcttggggtccagaaatggtattattaagactcgaacatcaatttgcagttggtgaagattcaggaagaaacctttcagccccagtaaccttaaatttacgagatttattttcaacatttacaattactagattacaagaaactacacttgtagcaaatcaattaagagaagcagcttcaagactcaagtggacaactaatactggaccaacacctcatcaaacgccatatcaattagatccagcaaatattactttagagccaatggaaattcgtacctttctagcttcagtacaatggaaagaagtagatggt

SEQ ID NO: 16558 - DNA, 3033 bp, Artificial Sequence
  Description of Artificial Sequence: Synthetic coding sequence
atgggagcttatgctcgagcgtctggcgtgtgtgcaaggggttgcctggattcagctggcccttggaccatgagcagagccttgcggccaccacttccccctctctgcttttttctgcttcttctggccgccgccggtgcaagagctggaggttacgagacttgtccaaccgtgcagccgaacatgctcaatgtccaccttcttcctcacacccatgatgatgtgggctggctgaaaactgtggatcaatacttctatggaattaagaacgatattcaacacgctggtgtgcaatacatacttgattcggtcatctcggccctgctggcagatccgactaggaggttcatatatgtggaaattgcattcttttcacggtggtggcatcagcaaaccaatgcaacgcaagaagtggtccgcgatcttgtgcgtcagggacgccttgaattcgcaaacggtggatgggtgatgaatgatgaagcagcaactcattatggtgcaatcgtggatcagatgaccctgggcctccgctttctggaagatactttcggaaacgacggcagaccacgagtcgcatggcatattgatccatttggtcatagccgggaacaggcaagcctgttcgcacaaatgggttttgacggtttcttttttggacgtctggattaccaagataagtgggtgaggatgcagaagctggagatggaacaggtctggcgtgcgagcaccagccttaagcctccaactgcagatctctttactggagtgctgccaaacggatacaaccctccccgcaacctttgctgggatgtgctgtgtgttgaccagcctctggtggaggaccctagatcccctgaatacaatgcaaaggagctggtcgactacttccttaacgtcgcaaccgcacaaggacgatactaccgcaccaatcataccgtgatgacgatggggtcggatttccagtacgaaaacgcgaacatgtggttcaagaaccttgataagctcattcgcctggtgaatgcacagcaagcaaagggatcctccgtgcacgtcttgtactccactcccgcctgctacctctgggaactgaacaaagccaacttgacgtggtcagtgaagcatgatgactttttcccgtacgcggatgggcctcatcaattctggactggatacttctccagcagaccggcacttaagcgctacgagagactcagctacaattttcttcaagtgtgtaatcaactggaggcacttgtcggacttgcagcaaacgtgggaccgtatggttcgggagattcggccccactgaacgaagcaatggctgtccttcagcatcacgatgcagtttcagggacttcgaggcaacacgtggctaacgattacgcgcgtcagctggcagcaggatggggcccttgcgaagtgctgctgtcaaacgcattggctaggctgcgagggtttaaagatcatttcactttttgtcaacagctcaacataagcatttgtccattgtcacaaactgcagcccgctttcaagtcatagtctacaacccccttggaagaaaggtgaactggatggtgcggcttccagtctcggaaggagtgtttgtggtcaaggatccaaatggtagaaccgtgccctcagatgtcgtgatctttccttcgtcggatagccaagcccaccctcctgaacttcttttttccgcatcgctgccagcccttggattcagcacctactcggtcgcgcaagtgcccagatggaagccccaggcacgtgcacctcaacctatacctagaagaagctggtcccctgcccttaccatcgaaaatgagcatatccgcgcaacttttgatccagatactggactcctgatggaaatcatgaacatgaaccaacaactccttctgccagtgcgtcaaacctttttctggtacaatgcatccattggtgataacgagtccgatcaggcttcaggtgcctacatattccgccccaaccaacagaagccccttcctgttagccgttgggcccagatacatctggtgaaaacccccctggtccaggaagtgcaccagaatttctccgcctggtgctcccaagtcgtcagactttaccctggtcaacgccacctcgagctggagtggtccgtgggtcctattccagtgggagacacttggggtaaggaagtgatcagccggtttgacactcctctggagacgaagggcaggttctacactgactcaaacggccgcgagattcttgaacgccgaagagactacagacctacttggaaactgaaccaaaccgagcctgtggcaggcaactactaccctgtcaacactcgtatttacattaccgacggcaacatgcaacttactgtgcttaccgatagatcacaaggaggatcctcgctgagagatggatcgctcgaactcatggtccatcgacggttgcttaaggacgacggaagaggagtgtcggagccactgatggaaaatggctcgggtgcctgggttcgaggtcggcacctggtgctgctggacactgcccaggcggcggcggcgggacacagactgctggcggaacaagaagtgcttgcacctcaggtcgtgctcgcacctggtggaggtgcagcctacaacttgggtgcaccacccaggacccagttttccggtcttaggagagatctcccaccatccgtgcaccttctgaccctggcatcatggggacctgagatggttttgctgcgcctggagcaccagttcgccgtgggcgaagattcagggcgtaatctgtcagcgcctgttactttgaacttgagggatcttttttccacgtttaccatcactcgactccaagaaaccactctcgtcgcaaatcaactgagggaagcagcaagccgcctcaagtggactactaacaccgggccgacccctcatcagaccccataccagcttgatcccgcaaacatcaccttggagcctatggagattagaaccttccttgcatccgtccagtggaaagaggtggacgga

SEQ ID NO: 16559 - DNA, 3033 bp, Artificial Sequence
  Description of Artificial Sequence: Synthetic coding sequence
atgggggcatacgctagagccagcggtgtgtgcgcccgggggtgcctggattcggccggtccgtggactatgtcgagagctctgaggcctcctctcccacccctgtgtttcttcctcctgctgctggcagcagcgggtgcacgggccggaggatacgagacgtgccctaccgtgcagccgaatatgctgaacgtgcatttgctgccacacacccacgatgacgtgggatggctcaagaccgtggatcagtacttctacggaatcaagaacgacatccagcacgcgggtgtccagtacatcctggattcggtgatctcggcactgctcgctgacccgacccgccgctttatctacgtcgagatcgcgttcttctcccgctggtggcatcagcagactaacgccacgcaagaggtggtgcgggacttggttcgccaagggcggctcgagttcgccaacggtggatgggtgatgaacgatgaagcagcaacccattacggagccatcgtcgaccagatgactcttggactccggttccttgaagatactttcggaaatgatggtagaccccgagtggcctggcacattgacccgttcgggcactcaagggaacaggcatctctgttcgcccagatgggattcgatggattctttttcggccgcctggactaccaggacaagtgggtgcggatgcaaaagttggaaatggaacaggtgtggagagcttccacctccctcaaaccgcctactgccgatctcttcaccggagtgctgcctaatggatacaaccctcctcggaatctgtgctgggatgtgctgtgcgtggatcaaccgctcgtcgaggacccgcgaagcccggaatacaacgcgaaggagttggtggactactttctgaacgtcgcgacggcccaaggaagatactaccggactaatcacaccgtcatgactatgggctccgacttccaatacgagaacgcaaacatgtggttcaagaatctggacaaactgatccgcctggtgaacgcacagcaggccaaaggatcctcagtccatgtgctgtactccactcccgcctgttacttgtgggagttgaataaagcaaatctgacgtggtccgtcaagcatgatgacttttttccatacgcggacggacctcatcagttctggactggatatttctcgtctcggccggcactcaaacgatacgaacgtctctcatacaacttcctgcaagtgtgtaatcaactggaggccttggtgggtttggcggcgaacgtgggcccctacggatccggagattcagccccgctgaatgaggccatggcagtgctccaacaccacgacgctgttagcggaaccagccggcaacacgtggcgaacgattatgccagacagctggccgcgggctggggaccatgtgaggtgctgttgtctaacgccctcgctagactgcgcggtttcaaggaccatttcaccttttgccaacagctcaatatctcgatctgcccgctgtcccaaacggccgcccgcttccaagtgatcgtgtacaaccccttgggacgcaaggtcaactggatggtgcgcctgccagtgtcggagggagtgtttgtggtgaaagacccgaatgggcgcactgtgccgtccgatgtggtgattttcccatcaagcgactcgcaggcacacccaccagagcttctgttctcggcgagcctgcctgctctgggcttcagcacctattcggtggcacaagtcccccgatggaagccgcaggcacgcgctccacaaccgatccccagaagatcgtggagcccagccctcaccatcgaaaacgaacacattagggcaaccttcgacccagacacgggattgctcatggaaatcatgaacatgaatcagcagctccttcttcctgtgcggcagactttcttctggtataacgcctcgatcggagacaacgagtccgaccaggcctcgggagcatacattttcagacctaatcagcagaaaccgctgccagtgtcccggtgggcccagattcatctggtgaaaacccctctggtgcaggaagtgcaccagaatttctccgcctggtgctcgcaggtggtgagactgtaccctggccaacggcaccttgagctcgaatggtccgtgggaccaatcccagtgggtgacacttggggaaaggaagtcatttcgaggtttgatactcctctcgaaactaagggccgcttctacaccgactcaaatggccgcgaaatcctcgaacggaggcgcgattaccggccgacctggaagctgaaccagaccgagcccgtggctggaaactactacccggtgaataccagaatttacatcactgatggaaacatgcaactgactgtgctgaccgaccgctcacaaggcggctcatccctgcgggatggatcgctcgagcttatggtgcatcggcggctcctcaaggatgatgggcggggagttagcgaaccactcatggagaacggaagcggtgcgtgggtcagaggacgccatcttgtgctcctggataccgctcaggctgcggcggcaggccatcgcctgctggccgaacaagaagtgctggcgccacaagtcgtcctggccccaggcggtggagcagcgtacaacctcggagctccgcctcggacccaattctccggcctgcgccgcgatctgccaccctccgtgcatctgctcaccctcgcgtcttggggccccgagatggtgctgctgcgactcgaacaccaattcgcagtcggggaggactcaggaagaaacctctccgctccagtcactctcaatcttagggatctcttctcaactttcactatcacccggctgcaggaaaccaccctggtggccaaccagctgagggaagctgcatcacggctcaaatggactactaacaccggccccactcctcaccaaaccccgtaccagctcgaccctgcaaatatcaccctcgaacccatggagatccgtaccttcctggcatcggtgcagtggaaggaagtggacgga

SEQ ID NO: 16560 - DNA, 3033 bp, Artificial Sequence
  Description of Artificial Sequence: Synthetic coding sequence
atgggcgcctacgctagggcgtcaggtgtgtgcgcaaggggctgtctggattccgcagggccatggactatgtctagagcactgcgccccccattgccacctctctgtttcttcctcctcctgctggcagctgctggggccagggccggagggtacgaaacctgcccaaccgtccaacccaatatgcttaatgtccatctgcttccgcacacccatgacgacgtcggatggctgaaaaccgtggaccagtacttttatggcattaagaatgatatccagcacgccggcgtacagtatattctcgactccgtcatctccgccctgttggccgatcccactcggaggtttatctatgtggagatcgccttcttcagtaggtggtggcatcagcaaacaaatgcaacccaagaggtcgtgcgggatttggtgcgccaaggaagactggagtttgctaacggcggttgggtcatgaatgacgaggcagcaacacattacggcgctatcgtggaccaaatgaccctggggctgagatttttggaggacacctttgggaacgacggacgcccgcgggtggcctggcacatcgaccctttcggccacagtagggaacaggcctcccttttcgctcagatgggcttcgacgggtttttcttcggtaggctggactatcaagataaatgggttaggatgcagaagttggaaatggagcaggtgtggcgagcttctaccagtctgaagccgcctaccgctgatctgttcaccggcgtcctgcccaatgggtacaacccacctcggaatctttgctgggatgtgctctgcgtagaccagcccctggtggaagatccccgcagcccagaatataacgctaaggaacttgtggattattttttgaacgtcgcgaccgcacagggtcgctactatagaactaaccatacagtgatgacaatgggtagcgacttccagtatgaaaacgccaacatgtggttcaaaaacctggacaagctcatccggctggtcaacgcacaacaggccaaagggtcttccgttcacgtgctctattccaccccggcctgctatctgtgggagttgaacaaggccaacttgacatggtcagtgaagcacgatgattttttcccttacgccgatggccctcatcaattctggactgggtacttctcatcaaggcctgctcttaagcgctatgaaagactgtcctataattttctgcaggtatgcaatcagctcgaggccctcgtaggactggctgccaatgtgggcccttacgggagcggagactctgccccgcttaacgaggcgatggctgtgctgcaacaccacgacgcagtgagcggcacctccagacagcacgtcgctaacgattacgcgaggcagctggccgctggctggggcccctgtgaggtactcctctctaacgcactcgcaagactgcgcgggttcaaggaccatttcactttctgccagcagctgaatatatccatctgtccgcttagccagactgccgcaagattccaagtgatcgtgtataacccccttgggcggaaggtaaattggatggtgcggctgcccgtcagtgagggagtgtttgtggtaaaagaccccaatgggcggaccgtgcctagcgacgtggtgattttcccctcaagcgactcacaggctcatccgcctgagctgctgttctccgccagtctgcctgctctgggctttagtacttacagcgtagcccaggttcccagatggaagccccaggctcgggcaccacagcctatcccaagacgctcctggagcccagccctgacaattgagaatgagcacattagagccaccttcgatcctgacacgggcctgttgatggagattatgaatatgaatcaacaacttctcctcccggttcgacagacattcttttggtataacgcctcaatcggggataatgagtctgaccaggctagcggagcatacatctttaggcctaaccagcagaagccgcttccagtgtccagatgggcccagatacatcttgtgaagacaccgttggtgcaagaggtgcatcagaacttctcagcttggtgcagtcaagtcgtcaggctgtatcctggtcagcggcatctggagctggagtggtccgtcgggcccatcccagtgggtgatacttggggaaaagaggtaatttcccgctttgacactcccttggagacaaaaggtcgcttctacaccgacagcaatggacgcgaaattctcgagcgcaggcgagactataggccaacttggaagctgaatcagaccgagccggtggctggaaactactatccagtaaataccagaatctatatcaccgatgggaatatgcagttgaccgtgctgaccgataggagtcagggcggctcttctctgcgggatggatctctcgaacttatggtacatcgccggctgttgaaggacgacggaaggggagtgtccgagccattgatggagaatggcagcggcgcttgggtgcggggtaggcatttggttctgctcgatacagctcaggcggccgcagctgggcataggcttctggccgagcaggaagtgctggcacctcaagtggttctcgcgcccggaggcggagccgcctataaccttggagctccgccaaggacacaattcagcggcttgcggcgcgacctgcccccgagtgtccaccttctgactctggccagttgggggcctgaaatggttttgctgcggctcgagcatcaattcgcagtcggggaagattctgggcgcaatttgagcgctcccgtaacactgaacctcagggacctgttttccacgttcaccattacacggttgcaggagactacacttgtcgctaaccagctgcgggaagcggcgtcccggttgaaatggaccactaacactggacctacaccccatcagactccctatcaactggatccggctaatattacactggagccaatggagatacgaacatttctggcctcagtccaatggaaggaggtcgacggc

SEQ ID NO: 16561 - DNA, 3033 bp, Artificial Sequence
  Description of Artificial Sequence: Synthetic coding sequence
atgggggcctatgcgagagcaagcggtgtgtgcgcgcgggggtgcctggattctgccggaccttggacaatgtcgcgcgcccttaggccccctctcccccctctgtgtttctttctgctgctcctggcagcggccggcgctcgggcaggcggatacgagacatgccctacggttcagcctaatatgctcaacgtgcacctccttcctcacacgcacgacgacgtggggtggctcaaaacagtggatcagtacttctatgggatcaagaatgatatccagcatgccggagttcaatatattctagattcagtgatttcagcattgttggcagaccctacgcgacgcttcatttatgttgagatcgcgtttttcagtcgctggtggcaccagcagacaaatgcaacacaggaagtagtgcgggacctggtcaggcaaggtcgtctagaatttgctaatggggggtgggtcatgaacgatgaggctgccacacactacggcgccatagtcgatcagatgacactgggacttcgttttttggaagatacgtttggcaatgatggccgcccccgagtggcttggcacattgacccgtttggccatagcagagagcaggcgtcactttttgcccaaatggggttcgatgggtttttctttggcagattggattaccaggataagtgggtgcgaatgcagaaactagaaatggaacaagtctggagagcatcgacgtctctgaagcctcccacagctgacctgttcacaggagtgttgcctaacgggtataacccccctcggaacctctgctgggatgtgctgtgcgtggatcagcctcttgtggaagatccacgctcacccgagtataacgcgaaggaactcgtggattacttccttaatgtcgccaccgcccaggggagatactatcgtaccaatcacacggtcatgacaatgggcagcgactttcagtacgagaatgccaatatgtggtttaagaaccttgataagttgatcaggcttgtcaatgctcaacaggccaaaggaagcagcgtccatgtgctatattcaacaccggcatgttacctgtgggaattaaataaagctaacttgacatggagcgtcaagcacgacgacttttttccatatgccgacggcccccaccaattttggacgggttacttctcgtcgcgcccagcactcaagagatacgaacgcctgagctacaacttcctgcaagtgtgtaaccaactagaggctctggtagggctggcagcaaatgtggggccctatggatccggagatagtgcgccactgaatgaggcaatggccgttttgcagcaccacgacgccgttagtggcacatctcgccagcatgttgccaatgactacgctaggcagctcgccgccggatggggaccttgtgaagttctgttgtcaaatgccttggcccggctccgcggctttaaggatcatttcaccttctgccagcagttgaacatctctatttgtccattaagccagaccgccgcccgattccaagtgatagtctataatccccttggacgcaaagttaattggatggtgcggctccctgtgtccgaaggagtgtttgtggtgaaggatcctaacggccggactgtccctagcgacgtcgtgatcttcccgagtagcgactcacaggctcatcctcccgagctactgtttagcgcctcacttcccgctctaggcttttccacctattctgtggctcaggtgcctagatggaagccacaagcacgggcgccacagccaattcccagacgcagttggagccctgctctgaccatcgagaacgagcatattcgagcgacgtttgacccagatactggactcctcatggagatcatgaacatgaaccagcagctcttactaccagtgaggcagacctttttttggtacaacgccagcataggcgataacgagtcggaccaggcctccggcgcctatatcttccgacctaaccagcaaaagcccctgcctgtctctcgctgggcgcagatccatctggttaaaacacccctggtacaagaagttcatcagaacttttctgcctggtgctcccaagtcgtgaggttgtacccaggtcagcgccacctcgaactagaatggagcgtggggccgattccagtgggagacacatggggtaaagaagttatttctcgatttgatactccacttgagactaaggggcgtttctacactgactcaaatggccgagagatattggagaggagaagagactataggcctacgtggaagctgaatcagacggaaccagttgcagggaactactatccagtgaatacacgcatttacattaccgatggcaatatgcagctaacagttcttaccgatcgatcccagggcggttcttcactgagagatggcagcctggagctgatggttcatagacgcctgctgaaggacgacgggagaggtgtgtccgaacctctaatggaaaacggatctggcgcttgggtgcgcggtcgacacctggtactcctggacaccgcacaggccgccgccgccggccatcgtcttcttgcggagcaggaggttttggccccacaggtggtgctggccccaggcggcggtgccgcgtacaatctgggagctccacctagaacacaatttagcggcctgaggcgggatctgccgccgagcgtccatcttctgaccctggcttcgtggggaccagagatggttttactcaggctggaacaccagtttgcggtaggcgaggactccggccggaatctttccgctccagtcacattgaacctgcgggatctgttttccacctttactatcacacggctgcaggaaaccaccctcgtagccaaccagctgagggaagcagcctcgaggttgaaatggaccactaacactgggcctactccacaccaaacaccctaccaactggatcccgctaatatcactctggaacctatggagattcgcacctttctggcatccgtacagtggaaagaggtcgatggt

SEQ ID NO: 16562 - DNA, 3033 bp, Artificial Sequence
  Description of Artificial Sequence: Synthetic coding sequence
atgggcgcttacgcccgggcttccggggtttgcgcccggggctgcctcgactctgccggaccctggactatgagcagagctctgcgaccgccattgccccccttgtgtttcttcttacttctgctggcagcagccggcgcgcgcgccggtggatacgaaacttgcccgactgtgcagcccaacatgttgaatgtccatttgctgcctcatactcatgacgacgtggggtggctcaagacagtggaccaatacttctatgggatcaaaaatgacattcagcacgcaggtgtccagtacatcctggactctgttatctctgcattgcttgccgacccaacgcggcgcttcatctatgttgaaattgcttttttcagcaggtggtggcatcaacagaccaacgccacacaggaggtcgtgcgggatctcgtgaggcagggacgcttagagtttgccaatggcgggtgggtgatgaatgatgaggctgcaacccattatggtgccatagtcgaccaaatgacactcggactgcgttttctggaggacacctttggaaacgatgggaggcctagggttgcatggcatatcgatcccttcggccattcgcgcgaacaggcgagtcttttcgctcaaatgggcttcgacggattttttttcggaaggctcgactatcaggataagtgggtgcgaatgcaaaagttggagatggagcaggtgtggagggctagtactagcttgaaaccccccactgccgatctgtttactggcgtgcttcccaacggttacaatccccccagaaatctctgttgggatgtgctgtgtgtggatcagcctctggtggaagatcctcggtcacctgaatataacgccaaggagctagtggattacttcctgaacgtcgctaccgcgcaggggaggtattatcgcacgaaccatactgtcatgacaatgggctcggatttccagtacgaaaatgctaacatgtggtttaagaatctggacaagctcatccgtctcgtgaacgcgcagcaggcaaagggtagcagtgtccatgtgctgtattccacccccgcctgttacctatgggaactgaacaaagcgaacttaacctggagcgtgaaacatgatgactttttcccttacgctgacggcccacaccaattttggacaggttacttttcctcccgacctgctctgaaacgatacgagcgcttaagctataattttctccaggtatgcaaccagctggaggcactcgtgggtctagccgctaatgtgggcccttatggctcaggcgactcggctcctctcaatgaggccatggcagtcctgcagcaccatgacgccgtcagtgggacatccagacagcatgtggctaatgactatgcccgacaactagctgctgggtggggcccctgcgaagtgctcttatcaaatgccttggccagattgcgagggttcaaagatcactttacattttgccagcagctgaatattagtatctgtccactgtcccagaccgctgcacgtttccaggtgatcgtgtataacccgcttggtaggaaggtgaattggatggttcgcctgccagtgagtgagggagtgttcgttgtcaaagaccccaacgggaggactgtgccttctgatgtggttatttttccgagcagcgactctcaagctcatccacccgagctgttatttagtgccagtctgcctgcactgggcttcagtacatacagtgtcgcgcaagtacctcgctggaaaccacaggcgagagccccacagcccatccccagacgcagctggtccccagcactgacaatagaaaacgagcacatcagagccactttcgaccctgatactgggctgctgatggagattatgaatatgaaccagcagcttcttcttcccgttagacaaacttttttttggtacaacgcttctataggggataacgagtccgatcaggcaagtggtgcgtatatatttaggcctaatcagcagaaaccgcttccagtgtctaggtgggcccagattcatctggtgaaaactcctcttgtacaggaggtccaccaaaacttttcggcctggtgcagtcaggttgttcgcctgtacccaggccagcgccatctggaactcgagtggtcggttggaccaattcctgtgggagacacgtggggcaaggaggtcatcagtcgattcgatacacctctggagacgaaaggcaggttctatacagactctaatgggcgggaaattctggagcgaaggagagactaccggcccacgtggaaattaaatcagaccgagcctgttgccggaaattactatcctgtgaacacacgtatctacattactgacggaaacatgcaactcactgtcctaacggatagatcacaggggggatccagcctccgggatgggtctttagagctaatggtgcatagacgcctccttaaggacgacggtcgcggggtaagcgaaccattaatggagaacgggtccggcgcctgggtcaggggaaggcacttggtacttcttgacaccgctcaggccgcggctgcagggcaccgcctattagcagagcaggaggtccttgcacctcaggtggtgctggcacccggaggcggggccgcctataacctcggcgccccccctcggacccagttctcagggctccgcagggacctgccgccttcagtccatttgcttactttagcctcatgggggcctgagatggttctcctacgcctggaacaccagttcgctgtcggcgaggacagtggccggaacctcagcgcacccgtgaccctgaatttgcgcgaccttttctctacgttcactataacacgtcttcaggaaacaacgctcgtcgctaatcagcttcgggaagccgcttcacggcttaagtggaccaccaacacgggccccacaccacatcagacaccttatcagctcgaccctgcaaacatcacactcgaaccaatggaaataagaactttcctagcatcagtgcaatggaaagaggttgacggc

SEQ ID NO: 16563 - DNA, 3033 bp, Artificial Sequence
  Description of Artificial Sequence: Synthetic coding sequence
atgggagcgtacgcccgcgcttcgggagtgtgcgctcgcggatgcctggactcggctggaccatggaccatgtctcgcgccctccggccaccactgccaccactctgtttctttctgctcctgctggctgcggccggagcgagggccggagggtacgaaacctgtcctaccgtgcagccgaacatgctgaacgtgcatctcctcccacatacccacgacgatgtgggttggctgaaaactgtggatcaatacttttatggcatcaagaatgacatccaacatgccggggtccagtacatccttgactcggtgatctccgcgctgctggcggacccaacgcggcgcttcatctacgtggagattgcgttcttctcgcggtggtggcatcagcagactaatgccactcaggaggtcgtgcgggacctggtgcggcagggaaggctggagttcgccaacggaggttgggtgatgaacgatgaggccgccacccattacggggcgattgtagaccagatgacgctcggacttagattcctggaggatacctttgggaacgatggcaggccgcgggtcgcctggcatatcgatccttttggacactccagagagcaggctagtcttttcgcgcagatgggtttcgacggcttcttcttcggtcggctcgattaccaggataagtgggtccgcatgcaaaaactggaaatggaacaggtgtggcgggcgtcgactagcctgaaacctccgaccgccgacctgttcactggcgtcctgccgaacgggtacaacccgccaaggaacctctgctgggacgtgctgtgcgtggaccagcccctggtggaggacccccggtcccctgagtataatgccaaagaactggtcgactacttcttgaacgtggcaacggcgcaggggcggtactaccgcaccaaccacaccgtgatgaccatgggcagcgatttccaatacgagaacgctaacatgtggttcaagaacctcgacaagctcatcaggctggtgaatgcccaacaggccaaggggtctagcgtgcacgttctctactcgactccagcatgttacctgtgggaactcaacaaggccaacctgacctggtccgtcaagcacgacgacttctttccgtatgcagacggaccacaccagttctggactggatacttttcatcccgacccgcgcttaagcggtacgagaggctgtcctacaatttcctccaagtgtgcaatcagctggaagctctggtgggcctcgccgcaaacgtcggaccctacggcagcggagattccgctcctctgaacgaagccatggcagtgctgcaacatcacgatgcagtgtcaggaacctcccgccagcacgtggcaaatgattacgcccgacagctcgccgccggctggggtccatgtgaagtccttctctccaatgcgttggcaaggctgcgcgggttcaaggaccacttcaccttttgccagcaactcaacatatccatctgtccgctgtcgcagactgcggcgcggttccaggttatcgtgtataatccgctgggtagaaaggtgaactggatggtgcggcttccggtgtccgagggagttttcgtcgtgaaggaccccaatggcaggactgttccgtcggatgtcgtgatattcccgtcctccgattcacaagcccacccgccggaactcttgttctcggcttcgctccctgctttgggattctccacctactcggtggcgcaggtgccaaggtggaaacctcaggcacgagccccgcagcccatcccgcggcgctcttggtcgccggctctcactattgagaacgaacacatccgcgcaaccttcgacccggataccggactgttgatggagattatgaatatgaaccaacaacttttgctccccgtgcgccagacgttcttctggtacaacgcgtcaatcggagacaacgagagtgaccaggcctcaggagcatacatcttcagaccgaatcaacaaaagccactgccggtgtcgaggtgggcccaaattcatttggtgaaaacgcctttggtgcaagaagtgcaccaaaacttttccgcctggtgttcccaggtggtccggctgtacccgggacagcggcacttggagcttgagtggtcggttggccctattcccgtgggcgacacttggggaaaggaggttatttcgcgcttcgacactccgctggagactaagggccgcttttacacggattcaaatggacgcgaaatcctggaacgacgaagagactacagacccacgtggaagttgaaccagactgaaccggtggcgggaaactattacccggtgaacactcgtatatacatcaccgatggcaatatgcaactcacggtcctcactgatagatcgcaaggaggcagctccctgcgcgacgggtccctcgagctgatggtacaccgcagactgctcaaggatgacggtcgcggcgtctccgagcctctgatggagaacggttccggagcatgggtgcgtggacgccatctggtcttgttggacaccgcacaagcagcggcggccgggcaccggctcctcgccgaacaggaagtgcttgcccctcaggtcgtcctggcccctggaggaggagccgcctacaatctcggagcaccgccgcgcactcagttttcgggcttgcggcgcgacctgccgccttccgtgcatctgcttacgcttgcatcatggggaccagagatggtgctcctgagactggaacaccagtttgcggtcggagaagatagcggaagaaacctgagcgcccccgtgaccctgaatctccgggacctgttcagcactttcaccatcactcgcctgcaggagactactcttgtcgcaaaccaactccgcgaggctgcctcacggctcaaatggactaccaatactggtccgacccctcatcaaactccataccagttggacccggccaacattaccctggagccaatggaaatccgaaccttcctggcttccgtgcaatggaaagaagtggacggt

SEQ ID NO: 16564 - DNA, 3033 bp, Artificial Sequence
  Description of Artificial Sequence: Synthetic coding sequence
atgggcgcctacgccagggcatccggcgtgtgcgctagaggatgcctcgactccgctggaccgtggaccatgagccgagcgctgcgccccccactgcctcccctttgcttttttcttctgctgcttgccgcggccggagcgcgtgcaggcggctatgaaacttgccctaccgtacagccaaacatgctgaacgtgcacctgctgccgcatacccacgatgatgtgggatggctgaaaacagtggatcagtacttctacgggatcaagaacgacattcaacacgccggggtccaatatatccttgattctgtgatatcagctctccttgccgatcctactcgacgattcatatacgtggaaatcgcatttttttcccgctggtggcatcaacagaccaatgcgacccaggaggtggtgcgcgatctggttcgtcagggccggctggaatttgccaatggtggctgggtgatgaacgacgaggctgcaactcactacggagcaattgttgaccagatgacactgggtttacggttcctagaagacacttttggcaacgatggcaggcctcgcgtggcatggcacattgatccattcggtcacagccgcgagcaggcatccctttttgcccagatgggatttgacggattcttcttcggccgtctagattatcaggataaatgggtacgcatgcagaagctggaaatggagcaagtctggcgtgcgtctacttctcttaagccgcctactgctgatctgttcacaggtgtgctaccaaacggatacaaccccccaagaaacttatgttgggacgtgctgtgtgtagatcagcctcttgtagaagacccaagatctccagagtataatgccaaagagttggtggactattttctgaacgtagccacagcacagggtaggtattacagaacaaaccatactgtaatgacgatgggatcagatttccaatacgagaatgccaatatgtggtttaaaaacctcgataaactcattcgactggtcaatgcacagcaggctaaaggaagcagcgtccatgtgctgtacagtacacctgcctgctacctttgggaactgaacaaggcaaaccttacgtggtctgtgaagcacgatgacttcttcccttacgctgatgggcctcatcaattctggacgggatactttagctcccgccctgctctgaagcgttatgaaagactctcctataactttctacaggtgtgcaatcagctggaagctttagtgggcctggcagctaatgtgggaccttatggatccggcgacagtgcccctctgaacgaagctatggccgtgttgcaacaccatgacgccgtctccgggacctcaagacagcatgtggcaaacgattatgcgcgacaattggcagcaggctggggaccatgtgaagtccttctgtcaaatgcgcttgcccggcttagagggttcaaggaccactttaccttttgccagcagctcaacatttccatctgccccctctcccagaccgccgcccgatttcaggtcatcgtctacaatcccctgggccgaaaggtgaactggatggtgagacttcccgtaagcgagggcgtgtttgtggtaaaagaccccaatggcaggactgtgccaagcgacgtggtgattttccctagctctgactcccaggcccacccccctgagttgctcttcagtgcttccttgccagctcttggtttttccacctactccgtggcgcaagtcccaagatggaaaccgcaggcccgcgcccctcagccaatcccgcgccgctcctggagcccggctctgactatcgaaaacgagcacattagggctactttcgaccctgacaccggcctactgatggagatcatgaacatgaaccaacagctcttactgcccgtgaggcagacattcttctggtacaacgcaagcatcggcgataatgaatcagaccaggcttccggggcctatatcttccgcccaaatcagcagaagccccttccagtgagtcgatgggcccagatccacctcgtgaagactccactcgttcaagaagttcaccagaacttctccgcctggtgtagccaggtcgttagactgtacccaggacagcgtcaccttgaactggagtggagcgtgggtccaattcccgtgggggatacttggggtaaggaagtgatctccaggtttgacacgccactggagaccaaggggagattttacacagattcgaacggacgggaaatcctggaacgcaggagagattaccggccgacgtggaagctaaaccagactgagccagtcgccggaaattattaccccgtaaacacacgaatatacatcacagacggcaacatgcagctcacagttcttaccgacagaagtcagggagggagttccctccgggatgggtccctcgaattgatggtgcaccgtaggctgctgaaggacgacggaaggggcgtgtctgaacccctgatggagaacgggtctggcgcatgggtgaggggcaggcacttagtgctgctggacactgcgcaggcagcggcagctgggcaccgcctgctggctgaacaggaggtcttagcccctcaagtggtcttggctcctggcggcggcgcagcctataatctaggtgctcccccacgcacccagttcagtggcctgcgacgagacctccccccatcagtgcacctcctcacactggcttcgtggggcccagaaatggtcctgctacgactggaacaccagttcgcggtcggcgaggatagtggccggaacctctccgcacccgtgaccctgaacctgcgggatttgttctcaacgttcactataacccggctccaggaaaccacgttggtggcaaaccagctgagggaggctgcatcccgcctgaagtggacaacgaacaccggaccaacgccccaccagaccccctaccaattggatccagctaacattacactggaacctatggagatccggacctttctagcatccgtgcagtggaaggaggtggacggg

SEQ ID NO: 16565 - DNA, 3033 bp, Artificial Sequence
  Description of Artificial Sequence: Synthetic coding sequence
atgggtgcgtatgcgcgtgcgtcgggtgtatgtgcgcgaggttgtttagattcggcgggtccgtggacgatgtcgcgagcgctacgtccgccgctaccgccgttatgtttttttctattactattagcggcggcgggtgcgcgtgcgggtggttatgaaacgtgtccgacggttcaaccgaatatgttaaatgtacatctattaccgcatacgcatgatgatgtaggttggttaaaaacggtagatcaatatttttatggtataaaaaatgatatacaacatgcgggtgtacaatatatattagattcggttatatcggcgctactagcggatccgacgcgacgatttatatatgttgaaatagcgtttttttcgcgttggtggcatcaacaaacgaatgcgacgcaagaagttgtacgtgatttagttcgacaaggtcgtttagaatttgcgaatggtggttgggtaatgaatgatgaagcggcgacgcattatggtgcgatagtagatcaaatgacgctaggtttacgatttttagaagatacgtttggtaatgatggtcgtccgcgagttgcgtggcatatagatccgtttggtcattcgcgtgaacaagcgtcgttatttgcgcaaatgggttttgatggttttttttttggtcgactagattatcaagataaatgggtacgtatgcaaaaattagaaatggaacaagtatggcgtgcgtcgacgtcgctaaaaccgccgacggcggatttatttacgggtgtattaccgaatggttataatccgccgcgtaatctatgttgggatgtactatgtgtagatcaaccgttagtagaagatccgcgttcgccggaatataatgcgaaagaactagttgattattttctaaatgttgcgacggcgcaaggtcgatattatcgtacgaatcatacggtaatgacgatgggttcggattttcaatatgaaaatgcgaatatgtggtttaaaaatctagataaactaatacgattagtaaatgcgcaacaagcgaaaggttcgtcggtacatgtactatattcgacgccggcgtgttatttatgggaactaaataaagcgaatttaacgtggtcggtaaaacatgatgatttttttccgtatgcggatggtccgcatcaattttggacgggttatttttcgtcgcgaccggcgctaaaacgttatgaacgtttatcgtataattttttacaagtttgtaatcaattagaagcgttagtaggtttagcggcgaatgtaggtccgtatggttcgggtgattcggcgccgttaaatgaagcgatggcggttttacaacatcatgatgcggtatcgggtacgtcgcgacaacatgttgcgaatgattatgcgcgtcaattagcggcgggttggggtccgtgtgaagttctactatcgaatgcgttagcgcgactacgtggttttaaagatcattttacgttttgtcaacaattaaatatatcgatatgtccgctatcgcaaacggcggcgcgatttcaagttatagtttataatccgctaggtcgtaaagttaattggatggtacgtttaccggtttcggaaggtgtatttgtagttaaagatccgaatggtcgaacggttccgtcggatgttgtaatatttccgtcgtcggattcgcaagcgcatccgccggaattactattttcggcgtcgttaccggcgctaggtttttcgacgtattcggtagcgcaagtaccgcgttggaaaccgcaagcgcgtgcgccgcaaccgataccgcgtcgatcgtggtcgccggcgttaacgatagaaaatgaacatatacgtgcgacgtttgatccggatacgggtctattaatggaaataatgaatatgaatcaacaattactattaccggttcgacaaacgtttttttggtataatgcgtcgataggtgataatgaatcggatcaagcgtcgggtgcgtatatatttcgtccgaatcaacaaaaaccgctaccggtttcgcgttgggcgcaaatacatctagttaaaacgccgttagttcaagaagtacatcaaaatttttcggcgtggtgttcgcaagtagtacgattatatccgggtcaacgtcatttagaactagaatggtcggtaggtccgataccggtaggtgatacgtggggtaaagaagtaatatcgcgatttgatacgccgttagaaacgaaaggtcgattttatacggattcgaatggtcgagaaatactagaacgtcgtcgtgattatcgtccgacgtggaaattaaatcaaacggaaccggtagcgggtaattattatccggtaaatacgcgaatatatataacggatggtaatatgcaactaacggtattaacggatcgttcgcaaggtggttcgtcgctacgtgatggttcgttagaattaatggttcatcgtcgactattaaaagatgatggtcgaggtgtatcggaaccgttaatggaaaatggttcgggtgcgtgggtacgtggtcgtcatctagttctattagatacggcgcaagcggcggcggcgggtcatcgattactagcggaacaagaagtactagcgccgcaagtagtactagcgccgggtggtggtgcggcgtataatttaggtgcgccgccgcgaacgcaattttcgggtctacgacgtgatctaccgccgtcggtacatctactaacgttagcgtcgtggggtccggaaatggtattactacgtctagaacatcaatttgcggttggtgaagattcgggtcgaaatttatcggcgccggtaacgttaaatctacgtgatttattttcgacgtttacgataacgcgattacaagaaacgacgttagtagcgaatcaactacgagaagcggcgtcgcgactaaaatggacgacgaatacgggtccgacgccgcatcaaacgccgtatcaattagatccggcgaatataacgctagaaccgatggaaatacgtacgtttttagcgtcggttcaatggaaagaagttgatggt

SEQ ID NO: 16566 - DNA, 879 bp, Artificial Sequence
  Description of Artificial Sequence: Synthetic coding sequence
atggggtttcccgcagctgccctgctgtgtgctctttgttgcggtctcctagcacctgcagcccgggctggttactccgaagagcgctgctcatggcgaggatcgggactgactcaggaaccagggtccgtgggtcagctagcactcgcctgtgcggaaggagccgttgaatggctatacccagcaggagccttacggctgacactcggaggccctgatccacgcgctcgtccgggtattgcatgcctgcgtccggttcgtccgtttgccggcgcacaggtgtttgctgagagagctggaggcgcactcgagctgttactcgccgaggggccaggaccagcaggagggcgatgcgtgcggtgggggccacgtgagcgacgcgccttattcctgcaggctacacctcaccaggacatcagcagaagggtagcagcttttcgtttcgagttgcgagaggatggacgtcccgagctgcccccccaggctcatggcctcggagtggacggtgcctgccggccctgctccgacgccgaattgttactggcagcctgtacatccgacttcgtcatccatggaatcattcatggagttacacacgatgtagaactgcaagagtctgtgattaccgtcgtggcagcccgggtccttcgtcagactccaccgctattccaggccggcaggtcaggtgaccaaggattaacgtctattcggactccacttaggtgcggagtgcaccctggaccagggacattcctctttatgggttggagcagattcggtgaggcgcgattggggtgtgcaccacgctttcaggagttccgcagggcctatgaggccgctagagctgctcaccttcacccttgcgaagtagcactccat

SEQ ID NO: 16567 - DNA, 879 bp, Artificial Sequence
  Description of Artificial Sequence: Synthetic coding sequence
atgggtttccctgcagccgctttgctgtgtgccctgtgctgtggattgctcgctcctgctgctagggccgggtactccgaagagcgatgttcctggcggggaagtggcttaacacaggagcccggctctgttggtcagctcgctctggcttgtgcagaaggagcggttgagtggctatatcccgccggggcactgcggttgaccttgggaggccctgatcccagagcccgcccaggcattgcttgtctacggcctgtcaggcccttcgcaggggcacaggtttttgccgagagggccggaggggctttagaactccttcttgctgaaggcccaggcccggctggcggaaggtgcgttcgctggggcccgcgggagaggcgcgccttgttcttgcaagccactcctcatcaggatattagcaggcgcgtagctgctttcaggttcgagcttagggaggatggcagaccggaactgcctcctcaagctcatggtctcggagtggatggcgcctgtcggccttgcagtgacgctgagcttctgctcgccgcatgcacaagcgatttcgtaattcacggtattattcacggagtgacgcacgacgtggaactgcaggaatctgtgatcacagttgtggccgctagggtactgcggcagacccctcccctgtttcaggcaggccggagcggcgaccaaggtctgactagcatcaggaccccacttcgctgtggcgtgcaccctggacccggtaccttcctgttcatgggatggtcacgctttggtgaggcaaggcttggttgcgcccctaggtttcaggaatttcgacgggcctatgaagcagcgagggctgcccatctgcatccctgcgaggttgctttgcat

SEQ ID NO: 16568 - DNA, 879 bp, Artificial Sequence
  Description of Artificial Sequence: Synthetic coding sequence
atgggttttccggcggcggcgttattatgtgcgttatgttgtggtctactagcgccggcggcgcgtgcgggttattcggaagaacgatgttcgtggcgaggttcgggtctaacgcaagaaccgggttcggtaggtcaattagcgttagcgtgtgcggaaggtgcggtagaatggttatatccggcgggtgcgttacgattaacgttaggtggtccggatccgcgagcgcgtccgggtatagcgtgtttacgtccggtacgaccgtttgcgggtgcgcaagtatttgcggaacgtgcgggtggtgcgttagaattattactagcggaaggtccgggtccggcgggtggtcgatgtgtacgttggggtccgcgagaacgtcgtgcgctatttttacaagcgacgccgcatcaagatatatcgcgtcgtgttgcggcgtttcgttttgaactacgtgaagatggtcgtccggaactaccgccgcaagcgcatggtttaggtgttgatggtgcgtgtcgaccgtgttcggatgcggaattactattagcggcgtgtacgtcggattttgttatacatggtataatacatggtgtaacgcatgatgttgaactacaagaatcggtaataacggttgttgcggcgcgtgttttacgtcaaacgccgccgttatttcaagcgggtcgttcgggtgatcaaggtttaacgtcgatacgtacgccgttacgttgtggtgttcatccgggtccgggtacgtttctatttatgggttggtcgcgttttggtgaagcgcgattaggttgtgcgccgcgatttcaagaatttcgacgtgcgtatgaagcggcgcgagcggcgcatctacatccgtgtgaagtagcgctacat

SEQ ID NO: 16569 - DNA, 879 bp, Artificial Sequence
  Description of Artificial Sequence: Synthetic coding sequence
atgggctttcctgccgcggccctgctctgtgcactatgctgcggcctgttggcccccgccgcccgggccggttattccgaggaacgatgctcatggaggggaagcggattaacccaggagccagggtcagtgggacaactggcactagcttgcgctgagggggcagtggaatggctttaccctgccggtgccttacgcctgacgctggggggcccagacccacgcgcacgacctggtattgcatgtcttaggcccgtccgccccttcgccggagcacaagtatttgccgagcgagccgggggagccctcgaactgcttttggccgagggtccagggcctgctggcgggagatgtgtacgctgggggcccagagagcggcgtgcactgtttctccaagccacgccacaccaggacatttccaggcgggtggccgcctttagattcgagctcagggaggatggccgaccggagctgcctcctcaggctcatggactgggagttgatggtgcctgccgcccttgcagcgatgctgaactcttgctggccgcatgtacatcagacttcgtgatccacggtatcatacacggggtaacccatgatgtggaacttcaggagtcggtaatcaccgtggtcgctgcccgggtccttcgacagacacccccactgtttcaagctggaagatctggagaccagggtctgactagcatccgcacacctctcaggtgtggggtgcaccctgggccagggacgttcctcttcatgggatggagcaggtttggagaagcccggctgggatgtgctccaaggttccaggaatttcgtcgtgcatatgaggccgcccgcgccgcgcacctccatccttgcgaggtggccttacac

SEQ ID NO: 16570 - DNA, 879 bp, Artificial Sequence
  Description of Artificial Sequence: Synthetic coding sequence
atggggtttccggccgcagctctgctgtgtgccctgtgctgtggcctgctcgcccccgccgctagagccggatactccgaggagcgctgttcctggcgagggagcgggctgacgcaagaaccaggctccgtgggacagctcgctttagcctgtgcggagggtgccgtcgaatggctatatcccgcgggtgctttgagactcacattgggaggccccgatccacgagctcgccccggcatagcatgcctgcgtccagttaggcctttcgcaggcgctcaggtttttgctgagcgggccggcggtgccttggagctgctgctcgccgaggggcccgggccagctggaggcagatgcgtgcggtggggcccgagagaacgaagagctctgttcctgcaagctactccgcaccaggacatctcccgccgcgttgccgccttccgatttgaattgcgcgaggacggcagacctgaacttccccctcaggctcacggcctaggcgtggatggagcttgccgtccttgctctgacgccgagctactcctggccgcgtgtacgagcgattttgtgattcacggtattatccatggagttacgcacgatgtagaacttcaggagtctgtcattaccgtggtggccgcaagagtcctcaggcagactccccctctcttccaggccggccgctcgggcgatcagggactcacatcaatccggactcctctcagatgtggggtccaccccggacccggcacctttctgtttatgggttggtctcggtttggtgaggcacggttaggttgcgcgccgcgcttccaggaatttcggagggcttatgaagcagcccgtgcggcccacttgcacccctgcgaggtggctttgcac

SEQ ID NO: 16571 - DNA, 879 bp, Artificial Sequence
  Description of Artificial Sequence: Synthetic coding sequence
atggggtttccagcggctgccctgttgtgcgcactatgctgcggcctcttagcacccgcggcacgcgcaggctatagtgaggagcgatgcagctggcgcggttcaggcttgactcaggaacccgggagcgtcggacaattggctctggcttgtgctgaaggagcggtggagtggctttaccccgctggtgccctccggctgactctgggcggcccggacccaagggctcgccccggaattgcttgtctgaggcccgtaaggccctttgcgggtgcccaggtgtttgccgagcgcgcaggaggagcactggagctgctgctggccgagggacccggccctgcaggcggacgctgcgtccgatgggggccaagggagagaagggcattattcctgcaggcaaccccgcaccaagacatcagccgccgggttgccgcgtttcggttcgagctgcgggaagacgggagaccagaattgccaccgcaagcccacggactgggcgtggatggcgcctgcaggccgtgtagcgatgctgaactgctgctggccgcctgcacgagcgacttcgttatccatgggataattcacggcgtcacccatgatgtcgaactgcaggagagtgtgatcactgtggtagccgcccgagtcctgagacagaccccacctctgttccaggccggacggtccggagaccagggacttacttctatacggaccccgctgcgctgcggcgtgcaccctgggccaggcacgttcttgtttatggggtggagtcgttttggcgaggcgcgcctcgggtgcgcgccaaggtttcaggaatttcgtagagcttacgaagcagccagagctgctcacctacacccttgtgaagttgccctgcac

SEQ ID NO: 16572 - DNA, 879 bp, Artificial Sequence
  Description of Artificial Sequence: Synthetic coding sequence
atgggcttcccagcagcagcgcttttgtgcgctctctgctgcggcctgctcgcaccggcggccagagccgggtactccgaggaacggtgctcatggcgcggcagcggacttacccaggaaccgggttcagtcgggcaactggccctggcttgcgccgaaggagcagtggagtggttgtacccggccggtgcgctgcgtctcactctgggagggccagatccgagagcccggccgggaatcgcgtgcctgcgcccagttagacctttcgccggggcacaggtgttcgctgaacgggccgggggagcgctggagctgctgctggcggagggacccggcccagcaggaggccgctgcgtccggtggggacctagagagcgccgggcactcttcctgcaggcgaccccgcaccaggacatctccagacgagtggctgcttttagatttgagctgcgggaggacggaaggcccgaacttccgcctcaagcccacggccttggcgtggatggcgcttgtagaccatgctcagatgcagaactgctgctggctgcgtgcacttcggacttcgtcattcatggaatcatccacggagtgacccatgacgtggagctgcaggaatcggtgatcactgtcgttgccgccagagttctccggcaaactcctccccttttccaggcgggaagatccggagatcagggactcacttcgattaggactccgctccgctgcggggtgcatccggggcctggaactttcctgttcatgggctggtcccgctttggcgaagcccgcctcggatgcgcccccagattccaagagttccggcgggcttacgaagcagcccgggccgcccacttgcacccgtgcgaggtggctttgcac

SEQ ID NO: 16573 - DNA, 879 bp, Artificial Sequence
  Description of Artificial Sequence: Synthetic coding sequence
atgggtttccctgcagcagcactgttgtgtgcactctgttgtggtttgctggcacctgccgcacgggcaggatacagcgaggagcgatgttcatggaggggctcaggactcacccaggaacctggctccgtcggacaacttgcgcttgcatgtgccgaaggagcggtggagtggctgtacccagcaggagctctgcgtctcactcttgggggtccagatccacgggctcgccccggtatagcgtgtcttagaccagtgcgcccctttgcaggagcccaagtctttgcagaacgggccggtggcgcacttgaactgctccttgcggaaggacctggacccgcaggagggagatgtgtcaggtggggtcccagggagaggcgtgcacttttccttcaagcaaccccacatcaggatatctcaagacgtgtcgcagccttccggtttgaacttagagaagatggtagacctgaactgcctcctcaggcacacggacttggagtggatggtgcctgtagaccatgctccgatgcagagctgctgctggctgcctgtacttcagactttgtgattcatgggattatacacggcgtgacccatgatgtggagttgcaggagagcgtcatcacggtggtcgcggcacgagttctgagacagacccctccactttttcaagcaggccgaagcggtgaccagggactcacctccattcgcactcctctgaggtgtggtgtgcacccaggtccaggcaccttcttgtttatggggtggagccggtttggagaggccaggctgggctgcgcaccaaggtttcaagaatttaggagggcatacgaagccgccagggcagcgcacctgcatccatgtgaagtggccctccac

SEQ ID NO: 16574 - DNA, 879 bp, Artificial Sequence
  Description of Artificial Sequence: Synthetic coding sequence
atgggatttccggcggcagctctgttgtgcgccctctgttgcggactgctcgcacctgcagcccgggccggatactcagaagaacgttgctcctggcgcggtagcggcctgactcaggagccgggatcggtgggccaactcgccctcgcctgcgctgagggagccgtggaatggctgtacccggccggcgctcttcgcctgacgctgggaggacccgatccgagagcgaggcctggaatcgcatgcctgcggcctgtgcggccattcgccggagctcaggttttcgctgaacgcgccggtggcgccctggaattgctgttggctgaaggacctggacctgctggaggtcgatgcgtccggtggggcccgagagaaagacgcgcactgtttctccaagccacccctcatcaggacatcagccgacgggtcgcagcgtttaggttcgaacttcgggaagatgggcggcccgaactgccgcctcaggcccacggattgggcgtggacggagcgtgtcgcccctgctcggacgcggagcttctcctggccgcgtgtacgagcgatttcgtgatccacggaatcattcatggtgtcacccacgacgtggaactccaggagtccgtgatcaccgtcgtcgcggctagagtgctgcggcagactccccctctcttccaagcgggacggtcaggtgaccagggcctgacttctatccgcactccactccggtgcggggtgcatcccggccctggtaccttccttttcatgggatggtcgcgctttggcgaggccagactcggctgcgccccacgcttccaagagttccgccgtgcctacgaagcggccagagcggcccatctgcatccatgtgaggtggctctgcat

SEQ ID NO: 16575 - DNA, 879 bp, Artificial Sequence
  Description of Artificial Sequence: Synthetic coding sequence
atgggatttccggccgctgcactgctgtgtgcactctgctgtggtctgctggcgccggcagcaagggctgggtactccgaagaacgctgctcctggagaggttcaggacttacccaagaaccaggctccgtgggacagcttgcactcgcctgcgccgaaggtgctgtcgagtggctttacccggctggtgctctgcgccttacgctgggcggtccggacccgagggccaggccaggtatcgcatgcctccgcccggtccgcccgttcgcaggggcccaggtgttcgccgaacgcgcgggcggcgctctcgagcttctgctggcagaaggcccaggcccggccggcggacggtgcgtgagatggggtccccgagagcgacgggccctgtttctgcaagccacccctcaccaggatatatccaggcgggtggcggcgtttagattcgagctgcgggaggacggtagaccagaacttcccccgcaagcgcatggcctcggggtggacggtgcatgccgcccatgctcagatgccgaactgttgctggccgcatgcacctccgacttcgtgatccacggaatcatccacggcgtcactcacgacgtcgaacttcaggaatcggtaatcaccgtggttgccgcacgggttttgcggcagactcctccgctcttccaggcgggaagatcaggagatcagggactcacttcgattcgcactccactgcggtgcggcgtgcatcccggaccaggcaccttcttgtttatgggctggagccgcttcggggaggcccggcttggatgtgcaccgagattccaagaattccggagagcttacgaggccgcgagggccgcccatctgcatccgtgtgaggtcgcgctccac

SEQ ID NO: 16576 - DNA, 879 bp, Artificial Sequence
  Description of Artificial Sequence: Synthetic coding sequence
atgggattccctgccgcagcacttctctgtgcactgtgttgcggcctgctggcgcccgctgcccgcgctggatattcggaagagcgctgttcttggaggggcagtggtctgacccaggagccaggatccgtcgggcagctggctttggcctgcgccgagggagcagtcgaatggctgtacccagctggcgccctcaggcttacactgggcggacccgaccccagggcccgcccaggtattgcatgcttgcgtcccgtgcgtccgtttgcaggcgcacaggtcttcgccgaacgcgcagggggggcattggaactccttctagcagagggcccagggccagcaggaggaaggtgtgtgcgttgggggccacgggagaggcgtgccttatttctacaagcaacccctcaccaggatatttccagacgcgtagccgcctttcgcttcgaattgagggaagacggccgaccagagctgcccccacaggctcacggcctgggggtggacggggcatgtcgcccgtgctctgacgcagaacttctgctagcagcctgtacttccgatttcgtcattcacggaattatccacggggtgacacacgatgttgagctccaagagtcggtcattactgtcgtggccgcccgagtcctacgacaaacccctcctctgttccaggcaggcaggtctggcgaccaggggctaaccagtattcggacacccctgcgctgtggtgtgcaccccggcccgggaactttcctctttatgggctggtctcgattcggggaagcccggctggggtgcgcccctcggtttcaggagttccggagggcttacgaagccgctcgggcagcacatctgcacccatgtgaggtcgcgctacat

SEQ ID NO: 16577 - DNA, 879 bp, Artificial Sequence
  Description of Artificial Sequence: Synthetic coding sequence
atgggttttccagcggcagcccttctgtgtgcactctgctgtggcctgcttgctccggctgcgcgggcaggatactcagaagaaaggtgtagctggcgcggatctggcctcacccaggagcctggttcggtgggccagttggcactcgcgtgtgccgaaggggccgtggagtggctgtatccagcaggtgcccttcgcctgactcttggggggcctgatcctcgggcacgaccaggaatagcgtgcctcagacccgtcaggcctttcgcgggggcacaagtgtttgccgaaagggcaggaggagcactggagcttctgctcgcagagggtcccgggccggccgggggccgctgtgtgcgctggggacctcgggaacgtcgagcactttttctgcaagccaccccccatcaggacatctcacgtagggtggctgcattcaggttcgagctgagagaggatgggcggccagaactcccaccgcaagcgcacggactgggtgttgatggagcttgccgaccatgcagcgatgcagaacttctcctggcggcctgcacctcggactttgttatccacggcattattcacggtgtgacgcatgacgttgaattgcaggaatccgtgatcaccgtggtcgcagcaagggtgttgcgacaaactcctcccctgtttcaggcaggaagatcgggggaccaaggacttacttcaatccgcactccactgagatgtggtgtgcatccgggtcctggtacctttctcttcatgggctggtcccgatttggagaggctcgacttggatgtgcacctcgttttcaagagttcaggagagcatacgaagcagctagagcagcacatctgcatccgtgtgaagtcgcgctccat

SEQ ID NO: 16578 - DNA, 879 bp, Artificial Sequence
  Description of Artificial Sequence: Synthetic coding sequence
atgggattcccggcagctgcattgctttgtgcactttgctgcggtctgcttgcaccagccgcgcgagctggctactcggaagaacgctgtagctggcggggatctggcctgacccaagagccaggatcggtcggacagctggccctcgcctgcgccgaaggagccgtggaatggttgtacccggcaggggccctgcggctgaccctgggcggccccgatccgcgcgcccgccctggaatcgcctgcctgcgtccggtgcggcctttcgcgggcgcccaggtgttcgctgagagggcggggggagccctcgaactcttgctcgccgagggacccggaccggcgggaggccggtgcgtgcggtggggaccaagagaacgccgcgccctgttcctgcaagcgactcctcaccaagacatctccaggcgcgtggccgccttcagatttgaactccgcgaggacggcagacccgagctgcctcctcaggcacacggtctgggagtggatggagcgtgtagaccgtgctccgacgcggagctgctgctggccgcgtgtacctcagattttgtgattcacggaatcatccacggtgtgactcatgacgtggagttgcaggaatccgtgatcactgtcgttgcagcccgggtcctcagacaaaccccgccactgttccaggctggaaggtcgggggaccaggggctcacttcaatcagaaccccactgcggtgcggtgtccatccaggaccggggacgttcctctttatgggctggagccgcttcggagaggctcgcctgggctgcgcaccgcggttccaggaatttcgccgggcgtacgaggccgctagggcggctcatctccacccgtgcgaagtcgcactccat

SEQ ID NO: 16579 - DNA, 879 bp, Artificial Sequence
  Description of Artificial Sequence: Synthetic coding sequence
atgggcttccctgctgctgctctcctctgtgccctgtgctgcggccttctcgcgcctgcagccagggcagggtatagcgaagagagatgttcttggcgcggctccggcctaacacaggagcctggatctgtcggacagttggccttggcgtgcgcagagggggcagttgagtggctttatcctgcaggggcactccgcctgacgcttgggggccctgacccacgagcacgcccaggaatagcatgcctccgccccgtacgcccctttgccggcgctcaggtgtttgcggagcgggcagggggcgcactcgagcttctgctggctgagggcccggggcccgcaggcgggcggtgcgtgcgatgggggccacgagagcgccgtgctctgtttttacaggcgacgccccaccaggatattagccgtcgggtggcggcgtttaggtttgagttgcgagaggatggtcgaccggagctgccgccccaggctcacggattaggcgtggacggtgcttgccgcccttgcagcgatgccgagctgctgttggcagcctgtacaagcgacttcgtgatacatgggataattcatggcgtgactcatgacgttgaattgcaagagtccgtgatcacagttgtggcggcccgagtcttacgacagaccccgccactcttccaggcgggcaggtccggcgaccagggactcactagtattagaacccctctgcggtgcggagtgcacccgggccctggaacgttcctgtttatgggatggagccggtttggggaggcaaggcttggctgtgctccacgcttccaggaattcagacgtgcatacgaggccgcccgcgccgctcacttacatccctgtgaagtggcactgcat

SEQ ID NO: 16580 - DNA, 879 bp, Artificial Sequence
  Description of Artificial Sequence: Synthetic coding sequence
atgggattccctgcggcagcacttctgtgtgcactgtgctgtgggctgcttgcacccgccgcaagagcaggttactcggaggagcgttgtagctggcgtggatccggcctcactcaagaacccggatcggtcggtcagttggctcttgcatgcgctgaaggcgcggtggaatggctttacccggcaggagccctcagactgactctcggtggcccggatcctcgagcgcgtcccggaattgcatgcctgcgtcctgtgcggcccttcgctggcgcacaagtgttcgcggaaagggcaggaggagcactggaactgctgctcgcagaaggccctggacctgccgggggccgatgcgtccgatgggggccccgggaaagaagagctctctttcttcaggccaccccacatcaggatatcagcaggcgtgtagcagcgttccggtttgagcttcgcgaggacggaaggccagagttgccacctcaagcacatggactgggagtcgatggagcgtgtcggccatgctcggatgcagaactgctcctcgccgcctgtacctcagactttgtgatccacggtatcattcatggtgttacgcatgacgtggaacttcaggagtccgtgataaccgtggtcgcagcacgcgtacttagacaaaccccgccattgtttcaagccggtaggtcaggtgatcagggactgacctcgattagaactcccctgcggtgtggtgtgcatccaggcccgggaacttttctctttatgggttggtcccgattcggagaggcgcgacttggctgtgcaccgcgctttcaagagtttagacgcgcttacgaagctgcacgcgcggcccacctccacccttgtgaagtggcactccat

SEQ ID NO: 16581 - DNA, 879 bp, Artificial Sequence
  Description of Artificial Sequence: Synthetic coding sequence
atgggttttcctgcggccgcccttttgtgcgcgctgtgttgcgggctgctggcccccgcggcccgggctggatactctgaggaacgatgttcctggagaggatccggtctcacacaggaacctggttccgtaggacagttggcgctggcctgcgcagagggcgccgtggaatggttgtaccctgccggagcgcttcgactcacgttgggggggccagatccaagggctcggcctgggattgcctgcttgagacccgtcaggccctttgcgggcgctcaggtgttcgccgaacgagcgggaggggccctagagctgctgctggctgaaggtcccggaccggcggggggccgttgtgttaggtggggtccgagggagcgccgcgcattgttcctgcaggccacaccacaccaggatatcagccggcgcgttgctgctttccgcttcgagcttcgagaagatggccgccccgaactccccccccaagcccacggactcggagtcgacggtgcctgtcgaccatgcagtgatgctgaattactgctggccgcctgtacctccgattttgtcatccatggcattattcatggagtcacgcacgatgtcgagctgcaggaatccgttattaccgttgtagcagccagggtcctcagacagacacccccactgttccaggccggacgctccggagaccagggcctcactagcatccggaccccactccgttgcggagtgcaccctgggccgggtacctttctctttatgggatggagtagattcggggaagccaggctgggctgcgcccccagatttcaggagttccgcagagcctatgaggcggcaagggctgcacacttgcacccgtgcgaggtagctttgcac

SEQ ID NO: 16582 - DNA, 879 bp, Artificial Sequence
  Description of Artificial Sequence: Synthetic coding sequence
atgggtttccccgctgccgcgctgctgtgcgctctgtgttgtggactgctggccccagctgctcgtgcgggctatagcgaggaacgctgcagctggcgcggttctggcctgacgcaagagcctggtagcgtgggtcagcttgcactggcatgtgccgagggagccgtcgaatggttgtaccccgcgggcgctctgagattgaccctgggcggcccagatccgcgcgctcgcccgggtatcgcgtgcttacgccctgtgcggccatttgctggtgcacaggtatttgccgaacgggctggtggcgcattggaactgctcctggcagaaggtccaggcccagcgggtggtcggtgtgtccgctggggtcctcgtgagaggagagcgctgttcttacaggcaaccccgcaccaggacatttcccgcagagtcgccgcgttccggttcgagctgagagaggatggacgtcccgagctgccgccacaggcccacggcctgggcgttgacggtgcttgccgcccttgctccgacgcggagcttctgctggcggcgtgtaccagcgacttcgtcattcacggcatcatccacggcgttacccacgatgtggaactgcaagagagcgttatcacggtggttgccgcgcgggtgctgcgccagacgccacctcttttccaggccggccgctctggtgaccagggcctcacctctattaggacgccactccgttgcggcgttcacccaggccccggcacatttctttttatgggctggtcccgctttggtgaagcacgcctcggatgcgctcctcgctttcaagagtttcgtcgagcgtatgaagctgctagagcggcccacttgcacccgtgcgaagtcgcgctccac

SEQ ID NO: 16583 - DNA, 879 bp, Artificial Sequence
  Description of Artificial Sequence: Synthetic coding sequence
atgggatttccagccgctgcgcttctctgtgcactgtgttgtggactcctggcccctgccgctcgcgccggatactcagaagaacggtgttcttggcgcggctcagggctcacccaggaacccggctcagttgggcagcttgccctcgcatgtgcagagggagcagtggagtggctctacccggccggggccctgcgtctcactttaggcggtcccgacccccgggcaagaccaggtattgcatgtctgaggcctgtgagaccgttcgccggggcccaagtgtttgcggaacgcgcggggggagcacttgaactgctgctggctgaagggccaggccccgcaggggggagatgcgtccgctggggaccgcgggaaaggcgcgccctgttcctgcaggccaccccccaccaagatatcagcaggcgggtggctgcgttccggtttgagctaagagaggatggacggcccgaactcccccctcaggctcacggtcttggcgttgacggagcgtgtcgaccatgctctgacgcagaactgttgctggccgcctgcacaagcgactttgtgatccacggtatcatccacggcgtaacccacgacgtggaattacaagaatctgtgatcacggtagttgccgcaagagttttgcggcagactcctcctctgtttcaggctggccggagtggggatcagggattgactagcattagaacgcctctgcgctgtggcgtccaccccggccccggtaccttcctctttatgggatggtctcggttcggggaggctcggctgggatgtgcccctcgctttcaggaatttcgccgcgcttatgaagccgccagggccgcacacctccacccctgcgaggtggctttgcac

SEQ ID NO: 16584 - DNA, 879 bp, Artificial Sequence
  Description of Artificial Sequence: Synthetic coding sequence
atgggctttccagccgcagctcttttgtgcgccctgtgttgcggcctgcttgcacctgctgcacgagcaggatacagcgaagagaggtgttcgtggaggggaagcggacttacccaagaacccggctccgtcggtcaacttgcacttgcctgcgcagaaggagcggtggaatggctgtacccggcgggcgcactccggctcactctggggggaccagaccctcgggcacggcctggcattgcatgcctccggccagtgcggccattcgcgggggcccaggtgtttgccgaacgagcaggtggcgcgctggaactcctcctggccgaaggacctgggcccgcagggggaaggtgtgtgcggtggggaccacgcgaaagacgtgctctgtttctccaagcaacccctcaccaagacattagccgccgcgtggcagcatttcgctttgagctgagagaggacggtcgccccgagcttccaccacaagcacacggtcttggagtggacggagcatgtagaccatgttccgatgctgagcttcttttggcagcatgtacttccgattttgtgattcatggaattatccatggggtgacccatgacgtcgaacttcaagaatcggtgattaccgtcgtggcagcccgcgtcctgagacaaactccgcctctcttccaggcaggacggtctggtgatcaaggactcacttcaataagaacccccctccgttgtggtgtccatcccggtcctggaacctttcttttcatgggttggtcccggtttggggaggcgagactgggatgtgccccacggtttcaagaatttagaagagcctatgaagcagcacgagcagcacatttgcacccttgtgaagtcgcacttcat

SEQ ID NO: 16585 - DNA, 879 bp, Artificial Sequence
  Description of Artificial Sequence: Synthetic coding sequence
atggggttcccagcagcagccctgctttgcgcgctttgttgtggattgttggcacctgccgcacgtgcaggctactccgaagaaaggtgtagctggagaggatcgggactcactcaagagcccgggtctgtgggacaactggcactggcctgcgcggaaggagctgtggaatggctttacccggcaggtgcacttagactgactctggggggaccagaccctcgcgcgcgccctggaatagcctgtcttagacctgtgcgtccttttgcaggcgcacaggttttcgccgaacgggccggaggggcccttgaattgcttctggcagaggggcctggacccgcgggaggtcggtgtgtccgatggggtccacgcgaacgccgggcactgtttcttcaagccacccctcatcaagatatctcccgacgggtggcagcattccgtttcgaactccgggaagatggacggcctgaactccccccacaggcccatggactgggcgtggatggcgcttgtcggccctgttcggatgcagaacttcttcttgccgcctgcacctcggattttgtgattcatggtattatccacggcgtcactcatgatgtcgaactgcaagaatcagtcattaccgtggttgccgcccgtgtgcttcgtcaaactccgcccctgtttcaggccggccggtccggtgatcaaggcctgacctcaataagaacccccctcagatgtggggtgcatccaggcccaggaacgtttctgttcatggggtggtcccgctttggcgaagctagactgggttgcgcaccccgcttccaagaatttcgtagagcatacgaggcagctagagcggcgcacctccatccttgtgaggtggcactgcat

SEQ ID NO: 16586 - DNA, 879 bp, Artificial Sequence
  Description of Artificial Sequence: Synthetic coding sequence
atgggtttcccagcagcagcacttttatgtgcattatgttgtggattattagcaccagctgcacgagcaggatattctgaagaaagatgttcatggagaggatcagggttaactcaagaaccaggaagtgttggtcaattagctttagcttgtgctgaaggagctgttgaatggctttacccagcaggagccttaagattgacacttggaggaccagatccaagagcaagaccaggaattgcttgtttaagaccagttagaccatttgcaggagctcaagtatttgcagaaagagcaggaggtgcacttgaattacttttagctgaaggaccaggaccagcaggaggaagatgtgtaagatggggtccaagagaacgaagagcactttttcttcaagcaacaccacatcaagatattagtaggagagttgcagcatttagatttgaattgagagaagatggaagaccagagttacctccacaagctcatggtcttggagttgatggagcatgtagaccatgtagtgatgcagaattgttgttagcagcttgcacttctgattttgttatacatggaattattcatggagtgacacatgatgtagaattacaagaaagtgttattacagttgttgcagcaagagtcttacgtcaaacaccaccattatttcaagctggaagatcaggagatcaaggtttaacctcaattcgtacaccattacgttgtggtgttcatcctggaccaggtacctttttgtttatgggatggtcacgatttggtgaagcaagattgggttgtgctcctcgatttcaagaattcagaagagcctatgaagctgcaagagcagctcatttacatccttgtgaagtagctcttcat

SEQ ID NO: 16587 - DNA, 879 bp, Artificial Sequence
  Description of Artificial Sequence: Synthetic coding sequence
atggggttcccagccgccgccctgctatgtgccctatgctgtggactcctcgctcctgccgcacgggccggatattcggaggaacggtgctcttggcgggggtctgggctgacacaggaacccggatctgtcgggcagcttgccctggcctgcgccgagggggcagtagagtggctgtatcccgctggagccctacgcctgactctcggggggccagatcccagagcgcgccctggaattgcctgcctgaggcctgtgaggcccttcgcaggagcccaggtattcgccgaaagagcaggaggggctcttgagctcttacttgctgaggggcccggaccggccggggggaggtgcgtcaggtggggaccacgggaacgcagggctctgtttctacaagccacaccccatcaggatatatcaaggcgtgtggccgcatttcgattcgagttacgggaagatggacgcccagaactgcctcctcaggctcatgggctcggagtggacggagcatgccggccttgttctgacgcagaacttttactagcggcatgtacatccgacttcgtgatacacggaataattcatggggtaacacatgacgtcgaactgcaggaatcagtcattactgtagtggcagcaagggttctcagacagacaccaccactcttccaggccgggcggtctggagatcagggactcacatcaatccggactcccctgcgatgcggagtccatcccgggccaggaacattcctgttcatggggtggagtagattcggagaagccagactagggtgtgcccccaggttccaagaattccgacgcgcctacgaagcagcccgggccgcacaccttcatccttgcgaagtggccctccac

SEQ ID NO: 16588 - DNA, 879 bp, Artificial Sequence
  Description of Artificial Sequence: Synthetic coding sequence
atgggatttcccgcggcagcactgctttgtgcgctttgctgcggattgctggccccggccgcccgggctggttactccgaagaaaggtgctcgtggcggggatccggactcactcaagagccgggcagcgtgggacaactggcactggcgtgtgcagaaggagcggtggagtggctgtacccagcaggagcgctgcgcctcaccctcggcgggcccgacccacgtgccaggccaggaatcgcgtgccttcgcccggtcagaccttttgccggagctcaggtgttcgccgaacgcgccggcggggcactcgagctgctcctggctgagggaccggggccggcaggaggaagatgcgtgagatgggggcctcgcgaaaggagggctctctttcttcaagccacgccccaccaggacatctcgcggcgcgtggcagcattccgcttcgaactgcgcgaggacggaaggcctgagctgccgccgcaagcacatggcctgggcgtggacggagcatgccggccgtgttcagacgccgaacttctcctggcggcgtgcaccagcgatttcgtcattcatggcatcattcatggagttactcacgacgtggagcttcaagagagcgtgatcaccgtcgtggctgcaagagtgctgagacaaacccctccgttgtttcaagccggtcggtcgggagatcaaggcctgacgtctatcagaaccccactgcggtgcggtgtgcaccccggaccaggaaccttcctcttcatgggatggtcgagattcggagaggccagactgggttgcgctccacgcttccaagaatttcgccgcgcgtacgaggctgcacgcgcggcacatctgcacccgtgcgaggtggccctccat

SEQ ID NO: 16589 - DNA, 879 bp, Artificial Sequence
  Description of Artificial Sequence: Synthetic coding sequence
atgggctttcccgcagcagctctactgtgcgctctgtgttgtggcttactggctccagccgcaagggccggatacagcgaagaaagatgttcctggaggggcagtgggctcacccaggaacctggaagcgtgggccagctggcacttgcttgtgccgaaggcgccgtggagtggctctatcccgccggcgctctacggttaacactgggaggacccgatccccgcgcaagaccaggcattgcttgcctgaggccagtaagacccttcgctggggctcaggtcttcgcagagcgggctgggggcgccctcgaactgctcttggccgaagggcccggccccgccggaggacgctgcgtgcgatgggggcccagggagaggcgagccctgttcctgcaggccacccctcaccaggatattagtcggagggtcgctgcctttcggtttgagctgcgtgaggatggcaggccagagttgccaccccaggcacacgggttgggcgttgacggcgcttgtagaccatgttccgacgctgagctacttctcgccgcctgtaccagtgatttcgtaattcatggtataattcatggagtgactcacgatgtggagttacaggagtctgtgataaccgtcgtggctgcacgagttctcagacagacccctcctctgtttcaggctggtaggtctggtgatcaagggctgactagcattaggaccccattgcgctgcggtgtgcatcccggccccggcactttcttgtttatggggtggtcaaggttcggcgaagcccgcctagggtgtgcaccacgatttcaggagtttcgaagggcttatgaagccgcacgagctgctcatttgcacccatgcgaagttgccctgcat

SEQ ID NO: 16590 - DNA, 879 bp, Artificial Sequence
  Description of Artificial Sequence: Synthetic coding sequence
atgggtttccccgcggctgcactgttgtgtgccctttgctgcggtcttttggccccagccgcccgggcaggctatagtgaggagagatgctcctggcgcggcagcggcttgacccaggagcctggctctgttggtcaactggctctcgcctgcgccgagggcgcagtggagtggctatatcccgccggtgcgctgcgcctcaccttaggtggacctgatccccgggcacgccccggaattgcctgtctacgccctgttcgtccctttgcaggagcccaagtgtttgccgaaagggccggtggtgccctggaattgttgctggccgagggcccgggaccggctggtggccgatgcgtccgctggggaccccgggagcgtcgcgctctgttccttcaggccaccccccatcaggatatctcccgccgcgtggccgcctttaggtttgaactccgtgaggacgggcgaccggagctgcccccacaggctcatggactgggcgtcgacggtgcctgccgcccatgctctgatgccgaactgttgctggcggcttgcactagcgattttgttattcacggcataattcatggagtgactcatgacgtggaactgcaggagagcgtaattacagtagtcgctgctcgtgtgctgcgtcagactcctcccttgttccaggcaggccgcagcggagaccagggcctgacctcaatccgcacacccctgcgctgtggcgtgcaccccggacccggaacattcttgttcatgggctggtcccgattcggcgaagcacgcctgggctgcgcacccaggttccaggagttccgccgggcgtatgaggccgcgcgcgccgctcacctgcacccttgcgaggtggcgttgcac

SEQ ID NO: 16591 - DNA, 879 bp, Artificial Sequence
  Description of Artificial Sequence: Synthetic coding sequence
atgggctttccagccgcagctctcctgtgcgccctgtgctgtggactgctggctcctgcagctcgggctggctactccgaagagagatgctcctggcgcggatcaggactcacccaagaaccggggtcggtaggtcaactggccctggcatgcgccgaaggcgccgtcgagtggctgtacccagcaggggccctcagactgactctgggaggaccggaccctagggcgcgcccaggaatcgcgtgcttgcgcccagtgcggcccttcgcgggtgctcaggtgttcgcggaacgggccggaggtgccctcgagcttctgttggcagagggaccaggtccggctggcggacggtgtgttcggtggggaccaagagaaagacgcgctctgttcctgcaggctactccacatcaagacatcagccgcagagtcgctgcgttcaggttcgagcttcgggaggacggcaggccagagctgccgccgcaggcgcacggcctcggtgtggatggagcgtgcaggccgtgctcagatgccgaacttttgttggcggcttgcacctcagacttcgtgatccatggtatcattcacggtgtgacccacgacgtggaactgcaagaaagcgtgatcactgtcgtggctgcccgggtcctccgacaaactccgccgctgttccaagctgggaggtccggagatcagggactcacgtctatccggacgcctctccgctgcggggttcacccggggccggggacttttcttttcatggggtggagccggtttggtgaagcacgcctgggatgtgcccctcggttccaggagtttagacgagcatacgaagctgccagggcggctcatctgcacccttgcgaagtcgcactccac

SEQ ID NO: 16592 - DNA, 879 bp, Artificial Sequence
  Description of Artificial Sequence: Synthetic coding sequence
atggggtttcctgcagcggcactcctgtgcgcactgtgctgtggtctgcttgctccggctgcaagagcaggatactcagaggaacggtgttcctggcgaggatcgggtctgacgcaagaacctggttccgtgggccaactggcactggcctgcgctgaaggtgcagtcgagtggctctaccccgcaggtgcactgagattgactcttggtggccccgatccaagagcgcgtcccggcatcgcgtgtctgcgcccggtgaggccatttgctggagctcaagtctttgcagaaagggccggtggcgccctcgagctgctgttggcagaaggtcctggtcctgcggggggtaggtgtgtgagatggggcccaagggaacgaagggccctctttctgcaagctactccgcatcaggacatttcgcgcagagtggcagcctttaggtttgaactgcgcgaagatggacgacccgagctccctcctcaagcacacggacttggagtggatggagcatgcaggccctgttcagatgcagagttgcttctcgcagcctgcaccagcgactttgtgattcatggcattatccatggtgtgactcacgatgtggaacttcaggagtccgtcattactgtcgtggcagcacgcgtcctgaggcagacccctcctctttttcaggcaggccgctcgggcgatcaaggcctcacctccattcgcaccccacttcgatgtggtgtgcatcctggacctggaactttcctgttcatgggatggagcagatttggtgaagcccgacttggatgtgcacctagatttcaggaattcagaagagcatacgaagcagcaagagcagcccatcttcatccatgcgaagtggcccttcat

SEQ ID NO: 16593 - DNA, 879 bp, Artificial Sequence
  Description of Artificial Sequence: Synthetic coding sequence
atgggcttccctgccgcagcattgctttgtgccctgtgttgtggccttctggcgcccgcggctagagcaggatacagcgaagaaaggtgttcatggagagggtctgggctcactcaagaacctggatcggtgggacagctggctcttgcatgtgcagagggagcggtggagtggctgtaccctgcaggtgcacttcgtcttaccctcggagggccagatccccgggcacggccaggtatcgcctgcctccgaccagtgcgccctttcgcaggggcacaggtgttcgccgaacgggcagggggtgcactcgaactgcttctcgcggagggacccggtcctgcaggcggtcgttgtgtaagatgggggccccgggagaggcgggcgctgttcctccaagcaactccgcatcaagacatttcaagaagggtggcagcatttcgctttgaactcagggaagatggtcggccggaacttcccccgcaggcacatgggcttggagtcgatggtgcctgtagaccttgtagcgatgcggaacttctgcttgctgcatgcaccagcgattttgtgatacacgggattatccacggagtgactcacgacgtggaattgcaggaatcggtcattaccgtggttgcagcgcgcgtgttgcggcaaacgccacctctttttcaggccggcagatcgggagatcaagggctgacttcaattaggaccccactgcggtgcggtgtccatcccggaccgggcaccttccttttcatgggatggagtaggttcggagaagcgaggctcggatgcgccccaagatttcaggaatttcgacgtgcgtacgaggcggcacgagccgcccatctccatccatgtgaggtcgcacttcat

SEQ ID NO: 16594 - DNA, 879 bp, Artificial Sequence
  Description of Artificial Sequence: Synthetic coding sequence
atgggcttccccgctgccgctcttttgtgcgcgctctgctgtggactcttggcgcctgccgcccgcgccggttactctgaagagcgatgctcatggcgtgggtctggcctgacgcaggagccgggttccgtcggccagttggctttggcgtgtgccgagggcgcagtggagtggctctatcctgccggcgcccttaggctgacgttgggcggcccggatccacgtgcccgccccggcatcgcctgcctgcggcccgttcgccccttcgcgggggcccaggtcttcgccgagcgcgccggtggtgccctcgagctgctgctcgccgagggaccgggtcccgctggcggccgctgtgtgcggtggggtccgcgtgaacgccgtgcccttttcctccaggccacaccccaccaggacatctcccgccgcgtcgccgctttcagattcgagctgcgcgaagatggccgccccgagctgccccctcaggcccacggcctgggtgtcgatggtgcttgccgcccctgttctgacgccgagctgctgctcgccgcctgcacgtctgatttcgttatccatggcatcatccacggcgtcactcacgacgtcgagttgcaggaatctgtgatcacggtggtcgcagccagggtcctgcgccagaccccacctctcttccaggccggtcgatccggtgatcagggtcttacatctatacggacacccctgagatgcggcgtacacccaggcccgggtacgttcttgttcatgggttggtcacgcttcggggaggcccgactgggctgtgctccacgcttccaggaatttcggcgggcctacgaggcggctcgtgccgcccacctccacccctgcgaagtcgcccttcac

SEQ ID NO: 16595 - DNA, 879 bp, Artificial Sequence
  Description of Artificial Sequence: Synthetic coding sequence
atgggttttcctgctgcggctctgttatgtgcactgtgttgcggcttgttggcgcccgcagcccgggccggctattccgaagagcgttgctcttggcgcggctcaggcttaactcaggagccaggaagtgttggccaactggccttggcatgtgcagaaggagccgtcgaatggctctatcctgccggggcactgcgactcacactggggggcccggaccccagagcccgccccggaatagcttgtctgagaccagttagaccctttgcgggagcgcaagtgtttgctgagagagccgggggcgctctcgaactgctcctggctgagggccctgggcccgcgggcggtaggtgtgtcaggtgggggccccgagagaggcgagccctgttcttgcaggcaactcctcatcaggacatctctcgccgcgttgccgcttttcgctttgagttacgcgaggatggacgacccgaattgcccccccaggctcacggcttgggggtggatggtgcttgtcggccctgcagcgacgcagaactacttctagccgcttgcacctccgattttgtcattcacgggattattcatggtgttacccacgacgtggaattgcaggagtctgtaatcacagtggtcgctgcccgtgttcttcgtcagacgcctccactgttccaagctggcaggtccggggaccagggcctgacgtccatccggactcctcttcggtgcggcgtgcatccaggcccgggcacattcttattcatggggtggtctcggttcggagaagcacgccttggctgtgctcctaggttccaggaattccgcagggcatacgaggccgcaagagcagcccatcttcacccatgtgaggtggccttgcat

SEQ ID NO: 16596 - DNA, 879 bp, Artificial Sequence
  Description of Artificial Sequence: Synthetic coding sequence
atgggatttcccgcagcggctctgctttgtgccctgtgttgcggactccttgctccagcagcaagggccggctacagcgaggagcgttgctcctggcgcggctcaggactgacccaggagcccggttccgtgggccaactggcacttgcatgcgctgaaggcgcagtcgagtggttgtacccagccggggccctgcgtctgactctcggagggcccgatcctcgagcaagacctggaattgcgtgccttagaccagtgcgacctttcgccggagcacaagtttttgccgaacgcgcgggtggtgcactggaactgctcctcgccgaaggacctggacccgcggggggtcgttgcgtgcggtgggggccccgcgaaagacgcgcgctctttttgcaagcgactcctcatcaggacatttcacggcgggtggctgcctttcggtttgaacttagggaagatggacgtcccgaactcccaccacaagcacatggccttggtgtcgatggagcgtgtagaccttgttcggacgcagagctgctgctcgctgcatgtacctcggattttgtgatccacggaatcattcatggtgtgacccacgacgtcgaactgcaagaaagcgtgataactgtggtggcagctcgagtcctgagacagactccgcccctcttccaagcaggacgctcgggagatcagggcctcacctcgattagaacccctttgcgctgtggcgtgcatccgggtccaggtaccttcctctttatgggatggtcgagattcggtgaagctagactcggatgtgctccgaggtttcaggaatttcggcgcgcttacgaggcggccagagcggcccacctgcacccatgcgaggtcgcattgcat

SEQ ID NO: 16597 - DNA, 879 bp, Artificial Sequence
  Description of Artificial Sequence: Synthetic coding sequence
atgggttttccggctgccgcccttctgtgtgccctctgttgtggtctcctggcgcccgcagccagggccggatacagtgaggaacgctgttcatggcgaggttccggcctcactcaggagccgggttcggtaggacagctggcgctggcctgtgcagagggcgctgtcgagtggctctaccccgccggcgcactccgtctcacccttggagggccagacccacgtgctaggcctggaattgcctgccttcggccggttcgcccattcgccggagcgcaagtgttcgcagaacgagccgggggagctttggagttgctcttggcggagggcccgggaccagcaggcggtcgttgcgtgcgttggggaccacgggagcggcgtgctctttttttgcaagcaacgccccaccaggacatatccagacgtgtcgcggcgtttagattcgaactgcgtgaagacggccgacctgaacttcctccacaagctcatggactgggtgtggacggagcttgccgcccatgtagtgacgctgaactcctcctagctgcgtgcacatcagactttgttatacatggcatcattcatggggtgacgcatgacgtggagctccaagaaagtgtgattacagtggtcgctgctagagtattgagacagaccccacccctgtttcaggcgggacgtagtggagatcaggggctgacatctatccgtacgcctctccgctgtggggtgcaccctggtcccggtacctttctcttcatgggctggagtcgctttggcgaagcgcggcttggctgcgcgccaaggtttcaggagttcagacgagcttatgaagctgcacgggcggcgcatctccatccgtgcgaggtagccctacat

SEQ ID NO: 16598 - DNA, 879 bp, Artificial Sequence
  Description of Artificial Sequence: Synthetic coding sequence
atgggtttccccgccgccgcgctactgtgcgcattgtgctgcggattactcgctcctgctgcacgtgccgggtactcggaagagcggtgcagttggcgagggtctggtctgacacaagagcccggctcggtgggccagctggccctggcatgtgccgaaggtgccgtggaatggctgtatccggccggcgctctgcgactgactctgggggggccggaccctcgagcacggcctggtattgcctgtctgaggcctgtacggcccttcgccggagcacaggtttttgctgagcgtgctggaggcgcactggagctgctgttggcagaggggcccggtcccgccggcggcaggtgcgtccgatggggcccacgagaacggagagccctctttctgcaggctaccccccaccaggacataagccggagggtggcagcgtttaggtttgaacttcgtgaggacggacgacctgagctgccacctcaggcccatggccttggcgtggatggcgcctgtagaccctgctcggatgcagaactcctgttagcggcctgtacatctgacttcgtcatccacggcatcattcatggggtcactcacgatgtagagctccaggagtccgtaatcacagttgtggccgcaagggtgctgcgccagactccaccgctcttccaagccgggcgttcaggagatcagggactgacctccatcaggactccattgaggtgcggcgtgcaccctggaccaggtacctttctcttcatgggctggtctcgcttcggagaagcacgacttggctgtgctcctagatttcaggagtttaggcgggcctatgaggccgccagggcagcccacctacacccatgcgaagtggcgctgcac

SEQ ID NO: 16599 - DNA, 879 bp, Artificial Sequence
  Description of Artificial Sequence: Synthetic coding sequence
atggggtttccggcagccgcacttttgtgcgcactttgttgcggccttcttgcccctgcagcgcgcgcgggatactcggaagaacgctgcagctggaggggatcgggactcacccaggaaccaggatcggtcggccaactggcacttgcgtgtgcagagggtgcggtggaatggctctacccagctggggcacttcgccttactctcggcgggccagatcctcgtgcaaggcccggaattgcttgtctccgccccgtgaggcctttcgccggagcccaggtgttcgcagaacgggctgggggtgccctggagctgcttcttgccgaaggcccggggcctgcgggaggtaggtgtgtgagatggggaccacgggaaagaagggcgctgttccttcaggcaacccctcaccaagatatctcccggagagtcgcggccttccgcttcgaactgcgggaggatggcagacctgagcttcctccccaagcccacggtcttggtgtggatggtgcctgccgcccttgttcggacgcagaactgcttctggcagcatgcacttcagattttgtgattcatggcattattcacggagtgacgcatgatgtcgaacttcaagaatcagttattaccgtggtcgcagcgcgcgtcctgcgccagactcctccactgttccaagccggccgtagcggcgaccaagggcttacgtctataaggactcctctgagatgtggagtgcacccaggaccaggtacctttctcttcatgggctggtcgagattcggggaggccagattgggctgtgcgccgaggtttcaggaattcagaagagcatatgaagccgcaagggcggcccatctgcatccatgtgaggtggctctccat

SEQ ID NO: 16600 - DNA, 879 bp, Artificial Sequence
  Description of Artificial Sequence: Synthetic coding sequence
atggggttcccagctgcagcgcttttatgcgccctgtgctgcggtctgctggcacctgccgccagagccgggtattcagaagaacgatgctcttggaggggctctggcctgactcaggagcccggttctgtgggacagctggctctcgcatgtgccgaaggagcagtcgaatggttatacccggccggggcactgagactgacactcggaggtcccgacccgagggctcggccagggattgcttgcctgcgcccagttaggccattcgctggcgctcaggtgttcgccgagcgggccggaggcgccctggaacttctcctcgccgaaggtcctgggccggcaggcgggcggtgcgtgcgttggggacccagagaacgccgggccctcttcctacaggccactcctcaccaggacatctcccgcagagtcgccgcattccgattcgagctgcgcgaggacggtcgcccagagctccctccacaggcacacggactaggggtggacggcgcctgtcgaccgtgtagtgacgcagaactgctgctagcagcctgcacctctgacttcgtgattcacggtattattcacggagttacccacgatgtagaacttcaggagtccgtgatcaccgtggtcgccgcacgcgtgcttcgacaaaccccccctttattccaggccggacggagtggcgaccaaggtcttacatccattagaacacctctcagatgtggggtacatcctggcccaggtactttcctctttatgggctggtctaggttcggggaagctagacttggctgcgctcctaggttccaggagttccgcagggcgtacgaggccgcacgagccgcgcacctgcatccctgtgaagttgctctacac

SEQ ID NO: 16601 - DNA, 879 bp, Artificial Sequence
  Description of Artificial Sequence: Synthetic coding sequence
atgggctttccagcagccgctctgttgtgtgccctgtgttgcgggctgctggcaccggccgcgagggccggttacagtgaggagcgttgttcctggagaggcagtggcttgactcaggaaccagggtccgtcggccagctggccttggcttgcgccgaaggagccgtcgaatggctgtatcctgccggcgcactgcgactgactctggggggcccagatcctagagctcggcccgggattgcttgccttcgtcctgtcaggcctttcgctggggcacaggtctttgcagagagagcgggaggtgcgctggaactgcttctggctgagggacctggacccgctggtgggaggtgtgtgcggtggggtccaagagaacgacgggcgctttttcttcaggccacgccacaccaggacatctcccgacgcgtggctgctttccgatttgagctgcgcgaagacgggaggcctgaactacccccacaggcacatggtttaggggtggacggagcctgtcgcccatgtagtgacgccgaacttctactcgccgcctgcacctccgatttcgttatacatggaattatccacggcgtgacgcacgatgtcgaactccaggagtcagtaataacagtagtcgccgcgagggtgctgcgccagaccccacccctcttccaggctgggaggagtggtgaccaaggactgacttctatccggacgcccctgagatgcggagtgcacccaggccctggcacattcctgtttatggggtggtcacggttcggggaggcacgccttggttgtgcgcctagattccaagagtttaggcgtgcatacgaggccgccagagccgctcacctccacccctgtgaggttgccttgcac

SEQ ID NO: 16602 - DNA, 879 bp, Artificial Sequence
  Description of Artificial Sequence: Synthetic coding sequence
atgggattccctgccgccgcgctcctgtgtgccctgtgctgtggcttgcttgcgccggccgcgcgcgcaggatactccgaagagaggtgcagctggagaggctccggcttgactcaagaaccaggctcggtggggcagttggcattggcatgcgcagaaggagccgtggaatggctgtaccctgcgggggcactccggctgaccctgggcggtcccgacccacgtgcccgcccgggtattgcttgtctgcggccggtcagaccatttgcgggtgcacaagtgttcgcggaaagggcaggaggggcactggaattgctgctggctgaaggccctggtccggccggtggacgctgcgtgcggtgggggccaagggagcgccgcgcgcttttcctgcaggccaccccgcatcaagatatctcccgccgcgtcgcggcgttccggttcgagctgcgcgaagatggccgcccggaactgccgccgcaggcacacggcctcggcgtggacggcgcatgcaggccctgctccgatgcggagttgctgcttgccgcctgcacctcagatttcgtgatccatggcatcattcacggcgttactcatgacgttgaactgcaggagtccgtcatcacggtggtggcagcgcgcgtgctccgacagaccccgccgctctttcaggccggacgatcaggagatcaaggacttaccagcattcgcacccccctccgctgcggggtgcacccgggaccgggaacgtttctgtttatgggatggagccggttcggtgaggccagactcggctgcgccccaagattccaggaattcagacgcgcatacgaagctgcgcgggcggcacaccttcatccttgcgaagtggcgctgcat

SEQ ID NO: 16603 - DNA, 879 bp, Artificial Sequence
  Description of Artificial Sequence: Synthetic coding sequence
atgggctttccagcagcagctttgctctgtgctctgtgctgtggcctcctcgcgccggccgctcgggctgggtactcagaagagagatgtagctggcgagggtccggcctgacccaagagccagggtcggtaggccaactggccctagcatgcgctgaaggcgcagtggagtggctttacccagccggcgccctgagattgaccctgggaggaccagatccccgagctcgacctggtatcgcctgtctgcgcccagtccgacctttcgcaggtgcacaggtcttcgcggaacgtgcaggcggcgctttggaacttttacttgcagagggccccggcccggctgggggacgatgcgtacgttggggacctcgagagaggagggccctgttcttgcaagcaactcctcaccaagacattagccggagggttgcagcctttcgattcgaattaagggaggatggaagaccagagcttccaccacaggctcacggccttggagtggatggagcctgtaggccatgtagtgacgccgaattattgctggctgcatgcacctcggacttcgtaatacatggcatcatccacggagtaacccacgatgtagagttacaggaaagtgtcatcacagtggtggccgcccgggtgttgagacagacacctcctttgttccaggctggtcgctctggggatcagggtttgactagcatcagaacccctctgaggtgcggggtgcaccccgggcctggcactttcctcttcatggggtggagccgatttggagaggccagactgggatgcgctccccgattccaagaatttcgacgtgcatacgaggctgcccgggctgcccacttgcatccatgcgaagtggccctgcat

SEQ ID NO: 16604 - DNA, 879 bp, Artificial Sequence
  Description of Artificial Sequence: Synthetic coding sequence
atgggattcccggcagcggcactcctctgcgcattgtgttgtggactgctggcgcctgctgcccgcgcaggatactcggaggaaagatgctcctggcgggggtctgggctcactcaggagccgggatccgtcgggcaattggctctggcgtgcgccgaaggtgccgtcgaatggctgtatccggcgggagcccttaggcttaccctgggcggaccagacccaagagcccgcccgggtatcgcctgcctgcgtccggtgcgccctttcgccggggcgcaggtctttgcggaacgggctggcggcgccctggagttgctgctcgcggaagggccgggaccggcaggcggacgatgtgtacggtggggaccgcgcgaaaggagagccctgttcctgcaagctactccgcatcaggatatttcacggagggtggcagctttcagattcgaactgcgcgaagatggcaggccagagcttccgccccaggcgcacggactcggagtggatggagcgtgtcgcccctgctcagacgcagagctcctcctggccgcctgtacgtccgacttcgtgattcacggtatcatacatggagtgactcacgacgtcgaactccaggagtccgtgatcaccgtggtcgccgctcgggtcctcaggcagaccccaccattgttccaagctggtagaagcggtgaccaagggcttacctccatcagaactcctttgcggtgcggggtccaccctggaccgggcacctttctctttatgggctggagcagattcggagaagcgaggttggggtgcgccccaagattccaggaatttaggagggcctacgaggccgcccgggccgcccacctgcatccgtgcgaagtcgcccttcat

SEQ ID NO: 16605 - DNA, 879 bp, Artificial Sequence
  Description of Artificial Sequence: Synthetic coding sequence
atgggattccctgctgcagctttgctctgcgctctgtgttgtgggctgcttgcccccgctgcacgagcaggatactctgaggaaagatgctcctggagggggagcggcctgacccaggagcctgggagcgtagggcagctggctctcgcgtgtgccgagggcgcagttgagtggctctacccagctggcgccttgagactgactctgggtgggcctgatcctagagcaagaccgggtatcgcctgtctgcggcccgtaaggccttttgctggggctcaggtcttcgctgaaagggctgggggagccctggagttgctactcgccgaaggtccaggcccagcaggagggaggtgtgttcgatgggggccccgggagcggcgggccctttttctccaggccacgccacaccaggacatctctcgtcgcgtcgccgccttcaggtttgagctgagggaggacgggcgcccagagctgccgccccaggctcacggcctgggcgtggacggcgcatgtcgtccatgtagcgatgccgagctgctgcttgcagcctgtacatcagatttcgtgattcacggcatcatccacggagtgactcatgatgtcgagctgcaggagtctgttattactgtagtagctgcaagggtgctgcgtcagacacctcccctttttcaagccggacggagtggggatcaggggctgaccagcatccggacccccttgcgatgcggagtgcaccccgggcccggtacttttttattcatgggctggagccgatttggggaggccaggttgggttgcgcccctcgctttcaggagtttcgtagagcttacgaagcagcccgggctgcacacctgcatccctgtgaggttgctttacat

SEQ ID NO: 16606 - DNA, 879 bp, Artificial Sequence
  Description of Artificial Sequence: Synthetic coding sequence
atgggattcccggcagccgccctgctgtgcgcgctgtgctgcggtctgctcgcccctgctgcgcgcgcgggctattcggaggagaggtgttcgtggcgcggatccggacttacccaagagcctgggtcagtcggacagctcgcgctggcatgcgctgagggcgccgtggagtggctctacccggccggcgcacttagactcaccctgggaggaccagatccgcgcgcccgccctgggatcgcctgcctccggccggtccgcccgttcgctggagcccaagttttcgcggagcgggccggtggcgcgctggagctgcttctcgccgagggaccaggacccgcagggggcaggtgtgttcgctggggaccccgggaacggcgcgcactctttcttcaggcgacgccacatcaggatatcagccggcgcgtggccgcattccggtttgagctgagagaggacggcagaccggagctgccaccgcaggcccacgggctcggagtggacggggcgtgtagaccatgctcagacgcggagttgctgctggccgcgtgtacctcggactttgtgatccacgggatcatccacggagtgactcacgatgtggaactccaagaatccgtgatcactgtggtcgccgctagagtcctgcgacagactcccccgctgttccaggcagggagatccggtgaccaaggactcacttccatcaggactcccctccggtgcggagtccatccgggccctggaaccttcttgttcatgggttggtccagattcggcgaggcacggcttggatgcgccccgagattccaggagttcagaagagcctacgaagccgcaagggccgcccatctccacccgtgcgaagtcgctctgcac

SEQ ID NO: 16607 - DNA, 879 bp, Artificial Sequence
  Description of Artificial Sequence: Synthetic coding sequence
atggggtttcccgctgccgccctcctctgtgccctatgctgtgggttactggcccctgccgccagagctggatactccgaggaaagatgttcttggagagggtctgggctcactcaggaacctgggtcagttgggcagctcgccttggcttgtgcagaaggagcagtcgaatggctttatcccgccggagctctgcgcctgacactgggggggcctgaccccagagcccgccccgggatagcctgtttgcgccccgtcaggcctttcgctggggctcaggtttttgccgaacgagccgggggagcactggaactcctactggcggaagggcctggaccggccggggggcgctgcgttcgatgggggcccagggaaaggagagccttattcctccaggctacacctcaccaggatatatccaggagagtggcagcatttaggttcgagctcagggaagatggacgacccgaactccctccacaggcccatggacttggagttgatggagcctgccggccctgctctgacgccgaactcctgctagccgcatgtacatctgatttcgttatacacggaatcatccatggggttactcacgatgttgaacttcaggaatctgtcattacagtggtagccgcacgggtcttaagacagactcctccattattccaggccggacggagtggagaccaggggctgacttctataagaacaccactgcggtgtggagtgcacccaggaccaggaacttttctatttatggggtggtctcgcttcggagaggcccggctcggatgtgccccccggttccaggaatttaggcgggcatacgaagctgcaagagcagctcaccttcatccatgcgaagtagctttgcat

SEQ ID NO: 16608 - DNA, 879 bp, Artificial Sequence
  Description of Artificial Sequence: Synthetic coding sequence
atgggtttcccagcagccgcactgttgtgtgccctttgctgtggtttgctggcacccgcagcccgcgcaggatactcagaagaaaggtgttcctggagagggtcgggacttactcaggaacctggatcagtcggtcagctggcccttgcatgtgcagagggtgccgtggagtggctttatccagcaggcgcactgagactcactctgggtggtccagaccctagggcacgcccagggattgcatgcttgcgacccgtgcggccttttgcaggcgcccaggttttcgcagagagagcaggtggagcacttgaactcctccttgccgaggggcctggtcccgccggtggcaggtgcgtgaggtgggggcctagagaaagacgcgccctcttcctccaagcgacccctcatcaggatatctcccggagagtcgctgcgtttcgatttgaattgcgggaggatggacgaccggagcttccccctcaggcccacggactgggggtggatggagcttgccgtccatgtagcgacgcagagctcttgcttgccgcgtgcacctcggattttgtgatccatggaattatccacggggtgacccatgacgtggaacttcaggaaagcgtcattactgtggttgcggcaagagtgttgcgacagacccctccgctgtttcaagccggtcgttcaggtgatcaagggctcacgtcgatcagaacccccttgcgctgtggtgtccacccgggtccaggcacctttctgttcatggggtggtcgcgcttcggagaagcgcgtcttggctgcgcaccccgctttcaggaatttaggcgagcatacgaagcagcacgcgctgcgcaccttcatccttgtgaggtcgcattgcat

SEQ ID NO: 16609 - DNA, 879 bp, Artificial Sequence
  Description of Artificial Sequence: Synthetic coding sequence
atgggttttccggctgctgctttgctctgcgctttgtgttgtgggcttctcgcccccgcagcacgcgccggatatagcgaggaaaggtgctcctggagggggtccggtctgactcaggaacctggatctgtgggacagctggccctggcatgcgcagagggcgcggtggaatggctgtatcccgcgggcgctttgcgacttactctcgggggccccgacccccgcgcgcgacccggaatagcatgcttgcggccagtcaggccattcgcaggtgctcaagtgtttgcagagagagctggaggcgctcttgaactcctgttggccgagggcccaggaccagctggcggtcgatgcgtccgctgggggccacgagaacgccgagcactgttcctgcaagccacaccgcaccaggatatctcacgaagagtcgccgcattcaggttcgagctgcgcgaggacggcagacctgaattgccccctcaggcgcatggtctgggagttgacggcgcttgcagaccctgttccgatgcggaactgctgctggcagcctgtacatcagactttgtcatacacggcattatccacggagtgactcatgacgtcgagttgcaggaatctgtgattaccgtggtggcggctagggtactgcgccagacacccccactcttccaagcaggcaggagtggagatcaggggctgacgagcatacgcaccccccttcgctgcggggtgcaccctgggcctgggacttttctgtttatgggctggtccaggtttggggaggcccggctgggatgcgccccgcggttccaggagtttcgcagggcttacgaagcggctagagctgcacatctccatccctgtgaagtggcactgcac

SEQ ID NO: 16610 - DNA, 879 bp, Artificial Sequence
  Description of Artificial Sequence: Synthetic coding sequence
atggggtttccggcagcagcacttctgtgtgcactgtgttgtggcttgcttgcccctgcagcaagagcggggtactcggaggaaagatgttcctggaggggcagtggtctgacccaggaacccggcagcgtgggtcagctcgcactggcctgtgcagaaggggcggtcgaatggctttatcccgcgggagccctgaggctgactctgggaggccctgatcctagagctcgtcccgggattgcatgccttaggcctgtccggcctttcgcgggagcacaggtgtttgcggaacgggccggcggagcactcgagctccttcttgcagaaggtcccggtcctgcgggaggacggtgcgtgcgctgggggccgagagaaaggcgtgcgcttttcttgcaggctacccctcatcaggatatatcccgccgggtcgccgcatttcgctttgagctgcgagaagatggtaggccagaactcccaccacaggcacacggtcttggcgtggacggagcatgtcgaccttgctcggatgcagaacttctgctggctgcttgcaccagcgacttcgtgattcacgggattattcatggggtgactcatgatgtggaactgcaagaatccgtgatcactgtcgtggcagcgagagtgctgcggcagaccccgccccttttccaagcgggacggtccggagatcaaggtcttaccagcataagaactccacttagatgcggcgtccatcctggacctggtacttttctgttcatgggatggtcacgtttcggagaagcccgcctgggatgtgcacccagatttcaggaattccgtcgggcatacgaggccgcaagagccgcccaccttcatccttgtgaagtggcacttcac

SEQ ID NO: 16611 - DNA, 879 bp, Artificial Sequence
  Description of Artificial Sequence: Synthetic coding sequence
atgggcttcccagctgccgctctactatgcgccttatgctgcggcctacttgcccctgccgcaagagctggatactccgaggaacgttgctcttggcgtgggtcaggactcactcaggagcctggctctgtcggccaactcgcccttgcctgtgcagagggcgctgtggagtggctatatcctgccggggccttgcgtctgactttgggagggcctgatcctcgagccagaccaggcatcgcttgtctcagacccgtacgtccttttgcaggggctcaggtgttcgcagaacgggctgggggcgctctggaactgttgctggccgagggtcctgggcctgccggagggagatgtgttagatgggggccccgagaaagacgcgcacttttcctgcaggcgacaccacatcaggatatatctagaagggttgccgcctttcgtttcgagctgagggaagacggtagaccagaattgccgccgcaagcgcatgggctcggtgtggacggcgcctgccgcccgtgcagcgacgctgaactccttctggcggcctgcacatccgactttgtgatccacggcataatccacggagtaacccatgacgtggaattgcaggagtccgtgattaccgtggtggctgcccgagtgctcagacaaaccccacccctattccaggcaggacgaagcggcgaccagggcctgaccagcatcagaactcccctccgttgtggcgttcaccccgggcctggcacttttttattcatgggttggtcccgattcggcgaggccagactggggtgtgcacccagattccaggaattccgaagggcctacgaagcggctcgggcggcccacctccacccctgtgaggtcgctctgcac

SEQ ID NO: 16612 - DNA, 879 bp, Artificial Sequence
  Description of Artificial Sequence: Synthetic coding sequence
atggggtttccagctgcggcactgctgtgtgcactgtgttgcggtctgctcgctccagcagctagggccggctactcagaggagagatgctcctggcgtggaagtggcttaacccaggagcccggatccgtgggccagctggcccttgcgtgtgctgagggcgccgttgagtggttgtaccccgcgggcgccctcaggttgacgctcggaggacctgacccaagggctcgacccgggattgcctgcttgcgtccagttcgcccttttgccggcgcccaggtgttcgcagagcgagccggcggagccctggaactgttgctggctgagggccccggacctgccggaggaagatgcgtacgttgggggccccgcgaaaggcgcgcgctcttcctgcaagccacacctcatcaggacatctctcgaagagttgccgcattccggtttgagttacgcgaggacggacggccagagctgcctccccaggcacacgggttgggcgtggacggcgcttgtcgcccatgtagcgacgctgagctcctgctggcggcctgcaccagcgacttcgtcatccacgggattatacatggcgttactcacgatgtggagctccaggaatccgtgataactgtcgtggctgcccgggtgctgcggcaaactccgcctctttttcaggcgggacgtagtggtgaccagggcctgactagcatacgcacgcccctgaggtgtggcgtgcacccaggccccggtacatttctgttcatggggtggtcgagattcggtgaagctcgtctagggtgtgccccacgattccaggaatttaggagggcatacgaggctgccagagctgcccatctccatccttgcgaagtagctcttcac

SEQ ID NO: 16613 - DNA, 879 bp, Artificial Sequence
  Description of Artificial Sequence: Synthetic coding sequence
atgggctttcccgccgccgctctcctgtgtgccctgtgttgcggcctgctagccccggccgcccgggctggctacagcgaggaaaggtgctcatggagaggaagtggcctgacacaggagccaggctcagtgggacagctggccctcgcatgtgcagaaggcgcagtcgaatggctgtatcccgcgggggccctccgattaacactaggcggacctgatcccagagcaagaccgggaatcgcatgtctccggcctgtcagacctttcgccggagctcaggtgttcgccgagcgcgccgggggagcgctggagctgttgctggcggagggtcccgggcctgccggagggaggtgtgtgcgctgggggccacgtgagcgccgcgccctgtttctgcaggcaaccccgcatcaggacataagccgaagagtcgctgcttttcgctttgaactaagagaggatgggcgccctgagcttccaccccaggcgcacgggctgggcgtggatggagcttgtcgaccttgtagtgacgccgagctcttactagccgcatgtacgtctgacttcgtgatacatgggatcatacacggcgttactcatgacgtggagcttcaggaaagtgtgatcaccgtggttgcagccagagtgcttcggcagaccccacctttgttccaagctggtaggagcggcgaccagggcctcacctccatcagaactcccctaaggtgcggagttcatcctgggcccggcactttcttatttatggggtggagccgattcggggaagctaggttgggttgcgcacctcggttccaagaatttcgaagggcttacgaggccgccagagcggctcacctccacccttgcgaggtcgccctgcac

SEQ ID NO: 16614 - DNA, 879 bp, Artificial Sequence
  Description of Artificial Sequence: Synthetic coding sequence
atgggcttcccggctgcagccctgttgtgtgctctctgctgtggcttactggcccccgcagcaagggctggctacagtgaagagcgttgctcttggcgaggttcagggctgacacaggaacccggctcggtcggccaattggctttggcctgcgctgagggagcagtagagtggttatacccagctggcgccttgagacttactttaggtggccccgacccccgggctcgtcctggcatcgcctgtttgcggcccgtgcgccccttcgccggagcccaggtgtttgccgaaagagcgggaggggcattagagctgctcctggccgagggccccggccctgctggcggcaggtgcgtacggtggggacccagggagcgccgtgccctctttctacaggctactcctcatcaggacatatcgagaagagtggcagcctttcgttttgagctgcgcgaggacgggcgcccagaactgccgccacaggcccacggccttggcgtggacggggcatgtaggccttgttccgacgccgagctgttgttggccgcttgtacttctgacttcgtgattcacggaatcatacacggcgtgacgcacgatgtggagctccaagaaagcgtgatcactgtggtggccgctcgtgtgcttcggcagacaccccctttgttccaggctggacgatctggggatcaggggctgacctcaattaggacaccacttcgttgcggggttcatccaggccccgggacattcctctttatgggttggagtaggttcggggaagccagactggggtgcgcacccaggttccaggagtttcgccgggcctatgaggctgctagagcagcacacttgcacccctgcgaagtggcgttgcat

SEQ ID NO: 16615 - DNA, 879 bp, Artificial Sequence
  Description of Artificial Sequence: Synthetic coding sequence
atgggattccctgccgctgcactgctttgcgcgctctgttgtgggttgctcgcacctgcagcccgtgccggatactccgaagagcgctgttcgtggagagggagcggacttactcaagagcctggttcggtgggccaactggcactggcatgtgcggagggagcagtggaatggctttacccagcgggtgctcttcgtcttacgcttggggggcccgacccccgggcccgtccaggaatcgcatgtcttagacctgtacggccctttgccggagcacaggtgtttgcagaaagggccggaggcgcactcgaactgctgctcgcggagggacctggacctgccggtggacggtgcgttcgttggggacctcgtgaacgccgagctctgtttctgcaagcaaccccacatcaggatatttcaagacgggtggccgcttttcgattcgagttgcgggaggacgggcgtccagaactgccgccccaggcacacggcctgggagtcgatggtgcgtgccggccctgtagcgacgcggaacttcttttggcagcctgtacctcagatttcgtgattcacggtattatccatggagtgactcatgatgtagagttgcaagaatcggtcattaccgtggtggccgcacgcgtgcttcggcagactcctcctctctttcaagcaggacgatccggtgatcaagggctcacctctatcagaactccccttcggtgcggggtgcatcccggacccggtacctttctgtttatggggtggtccagattcggcgaggcacgacttggttgcgcaccgcggttccaggaatttagaagagcgtacgaagcagcacgagccgcgcatctgcacccttgtgaggtggcactccat

SEQ ID NO: 16616 - DNA, 879 bp, Artificial Sequence
  Description of Artificial Sequence: Synthetic coding sequence
atggggttccccgccgctgctctgttgtgcgccctctgctgtggtttactggcccctgcagctcgcgcagggtattccgaagaaagatgctcgtggcgtggatccggcctgacgcaggaacccgggtctgttggtcaactagccttggcctgtgcagaaggggctgtcgagtggctgtatcccgccggggctttaaggctcacgcttggaggaccggatccaagggccaggcccggcattgcttgcttgcggccggtcaggccgttcgccggtgctcaagttttcgctgaaagagctggcggagccctcgagctgctgcttgccgagggtcccggcccggcagggggccgatgtgtccggtgggggccaagagaaaggagagctcttttcctgcaggccaccccacatcaagatatctctcggcgggtagcagcgttcagattcgagctacgcgaggacggtaggcctgagctgcccccccaggcacacggcctgggagttgatggcgcatgccgcccgtgttccgatgccgaactgctgctggctgcctgcacttccgactttgtgatacacggaatcatccacggtgtgacacacgatgttgaattgcaagaaagcgtgatcacggtggttgccgccagggttttgaggcaaacccctccgctctttcaagctggcagatcaggcgatcagggccttacctctattcgaacccctctcaggtgcggcgttcatccagggccagggaccttcctctttatgggctggtctaggtttggcgaagccaggctaggctgtgcgccgaggttccaggagtttagacgcgcttacgaagcagctagagctgcgcatttgcacccgtgcgaggtagccttgcac

SEQ ID NO: 16617 - DNA, 879 bp, Artificial Sequence
  Description of Artificial Sequence: Synthetic coding sequence
atgggctttccagccgccgctctgttgtgcgcgctgtgctgcggcctgctcgccccggctgcgagagcaggatactcagaagaaaggtgcagttggagaggatctggactcacccaagagccaggttcagtgggtcaactcgccctggcgtgtgccgaaggcgctgtggagtggctgtatccagctggagcgctgagactgacactcggaggcccggacccccgcgctaggccaggcatagcgtgcctgaggccggtcaggcccttcgcaggcgcccaggtgtttgctgaaagagctggaggcgcactggagctccttctggctgaaggcccaggaccagccggaggtagatgcgttaggtggggcccgcgcgagaggagagctctcttcttgcaggccacgccgcaccaggacatttcaagacgcgttgcggctttccgcttcgagctgagagaagacggcaggccggagctgccaccccaagcccatggcttgggcgtggacggtgcctgccgcccctgttccgacgctgaactcctgctggccgcgtgtaccagcgacttcgtgattcacggaatcatccacggagtgacacacgatgtggaacttcaggagtccgtgattaccgtagttgccgctagggtcctgaggcagactcctcctctttttcaagccggcaggagtggcgatcagggcctgacatctatccgcacccccttgaggtgtggcgtccaccccggccctggcacatttctgtttatgggctggagcagattcggcgaggctagacttggatgcgccccaagattccaagaattcagaagagcctacgaggccgccagggcagctcacctccacccctgcgaagttgcgctgcat

SEQ ID NO: 16618 - DNA, 879 bp, Artificial Sequence
  Description of Artificial Sequence: Synthetic coding sequence
atggggtttcccgctgctgcccttttgtgcgctctgtgttgtggactgttagcgcccgcagcacgagcaggctacagtgaggagaggtgctcctggagaggaagcgggctcacacaagaaccaggcagtgtgggccagttagctctcgcatgcgccgagggcgccgtcgagtggctctatcccgcgggtgctctgcgcctgactctgggaggtcccgaccctagagccagacctgggatcgcgtgcctgcggcccgtccgaccattcgctggtgcacaggtttttgccgaaagagcagggggcgcactagaactgctgctggccgagggacccggaccagccggcggccggtgtgtgcggtggggacccagggaacggagggccctgtttttacaagctaccccccaccaggatatatcgcgaagagtagccgcctttcgctttgagctccgggaggatgggaggccagagctccccccccaggcccacggcttaggagtggacggtgcctgtcgcccttgttccgacgcggagctcttgctcgccgcctgcacctctgacttcgtaattcacgggattattcatggagtaacgcatgatgtagagctgcaggaaagcgtgattaccgtggtagctgcccgggtcctcaggcagacccctccgctttttcaggcaggacgatcgggcgatcagggcttgacttctattcgcacgcccctgcgatgcggagtccacccaggacctggaaccttcttgtttatgggctggtcccgctttggagaagctcgcctgggttgcgccccacgcttccaagagttcagacgcgcttatgaggcggctagggccgcccacctgcatccttgcgaagtggcgctgcat

SEQ ID NO: 16619 - DNA, 879 bp, Artificial Sequence
  Description of Artificial Sequence: Synthetic coding sequence
atgggattcccagccgctgccttgttgtgcgcgctttgctgcggtctccttgctccagctgctcgtgccggttacagcgaagagagatgcagttggagaggcagcggacttactcaagaaccaggttctgttggtcagttagccctggcttgcgctgaaggcgctgttgaatggttataccctgcaggtgccctcaggctcactttagggggacctgatccacgtgcaaggcctggtattgcttgcctcaggcctgtaagaccttttgcaggggcccaagtcttcgctgagagggcgggcggagcccttgaacttcttcttgctgagggtccgggcccggctggaggtagatgtgtccgatggggcccaagagagcgtagagccctttttttacaggctaccccgcatcaagatatatcaaggagagtggctgcttttagattcgaactgcgtgaagacggaagaccagaactgccaccacaggcccatggcttgggagttgatggggcgtgcaggccttgcagtgatgccgagttgttgcttgccgcctgtacatcggattttgtgatacatggtataatacacggagttactcatgatgtcgaactccaggagagcgtgattacagtggtggctgctcgtgttcttaggcaaaccccgcctctttttcaagctggcagatcaggggatcagggactcacgtccataaggacacctcttaggtgtggagtgcatccgggccctggcactttccttttcatgggatggtccagattcggcgaggcacgattgggttgtgctccacgattccaagaattccggcgtgcatatgaggccgcccgcgccgcccaccttcatccatgcgaggtcgccttgcat

SEQ ID NO: 16620 - DNA, 879 bp, Artificial Sequence
  Description of Artificial Sequence: Synthetic coding sequence
atggggttcccggcggcggccctgctctgcgccctctgttgcgggctgctggccccagcggctagagctggatacagcgaagagaggtgttcgtggaggggctcgggcctcactcaggaaccggggtccgtcggacagctcgcactggcctgtgcggagggtgccgtggagtggctctacccggctggtgcgctgcggcttactcttggaggacccgatccgcgcgcaaggcccggaatcgcgtgcctccgcccggtccgtccgttcgccggagcacaggtgttcgccgagagagccggaggcgcactggaactcctgctcgcggagggtccgggcccggcaggaggacgttgcgtgcggtgggggcctcgagaaagacgggcgctgttcctgcaggcaaccccgcaccaagatatctcaagacgggtcgccgcatttcgctttgaattgagagaggacggtaggccggaactgcctcctcaggcccatgggctgggagtggatggagcgtgtagaccttgctccgatgccgagctgctccttgccgcgtgcacctcagacttcgtcatccacgggatcatccacggagtgacccacgacgtcgagcttcaagaatcggtcatcaccgtggtcgccgcccgcgtcctgagacaaactccgccactgttccaggctggacgcagcggtgaccaaggcttgacgtccatcaggacccccctgcgctgcggagtgcaccccggaccgggcaccttcctgtttatgggatggtcgagattcggagaggcgagactcggatgcgcaccaagatttcaggaattccgcagagcatacgaggccgcccgcgccgcccacctgcatccgtgcgaggtcgcgcttcac

SEQ ID NO: 16621 - DNA, 879 bp, Artificial Sequence
  Description of Artificial Sequence: Synthetic coding sequence
atgggtttcccagccgctgctcttctctgcgctctttgttgtggacttctggcaccagcagctagagccggctacagcgaggaacgctgctcttggaggggttctggccttacacaggaacctggctcagtcggccagctggccttggcttgtgccgagggagcagttgaatggctgtacccagcaggtgctctgcgtcttactctcggaggcccagaccccagggcacgtcccggcatcgcatgtcttcgccctgtcaggccctttgccggagcacaggtgttcgccgaaagagccggaggagctctggagcttctcctcgctgagggtcctggtcccgccggcggcaggtgtgtcagatggggcccaagagagcgtcgtgctctttttctgcaggcaaccccccaccaggatatcagcagacgtgttgccgcctttcgctttgagctccgtgaggatggcagaccagaactgcccccccaagcccatggcctcggagtggatggcgcctgtagaccatgctctgacgctgaactcttgctggctgcctgcacttccgatttcgttattcatggcatcattcacggtgtaacccatgacgtagaactgcaggagagtgtgattactgtggtagctgccagggtgctgagacagacacctccactgttccaggccggcaggtcaggagaccagggcctcaccagtattcgtactccactccgttgtggcgtacatcccggacccggaactttcctgttcatgggatggtctaggttcggtgaagctagattgggatgcgctccacgctttcaggagttcaggagagcatatgaagcagcaagggccgcacatctgcacccctgcgaagtggcactgcat

SEQ ID NO: 16622 - DNA, 879 bp, Artificial Sequence
  Description of Artificial Sequence: Synthetic coding sequence
atggggtttccagccgccgctctgctctgtgcactctgttgtggcctccttgcgcctgccgcccgtgcaggatattccgaggaacgatgctcctggaggggaagcggcctgacccaagaaccagggtcggtgggccaactcgccctggcatgcgcagaaggagccgtcgagtggttgtaccccgcgggagcactgcggcttacccttggcggccctgatccaagagctagaccaggaattgcatgcctgcgtcccgtgcggccatttgccggcgcccaagtgtttgccgagcgcgcaggaggagcgctggagctgcttttggcggaaggtcctggcccagcaggtggtcggtgtgtgcggtgggggccgagggaaaggcgtgccctgttcctccaggcaactcctcatcaggatatcagccgacgggtggctgcgtttcgctttgaactcagagaagatggtcgacctgaattgccgcctcaagcacatggactcggagtcgatggcgcatgtagaccttgttcagatgcggaacttctgcttgccgcatgtaccagtgactttgtgatccacggaataatccatggagttactcatgacgttgaactccaagaatccgtgatcaccgtggtcgcagctcgtgtcctccgacagacccctccgctcttccaggcagggagaagcggagatcaaggtctgacttcaattagaacccctctgcgctgtggcgtgcacccgggaccgggaactttcctgttcatgggatggtccagatttggagaggcacgtctgggatgtgcacctcggttccaagaattccgaagagcctacgaggcagccagagccgcacacctgcatccctgtgaagtggccctgcat

SEQ ID NO: 16623 - DNA, 879 bp, Artificial Sequence
  Description of Artificial Sequence: Synthetic coding sequence
atgggattcccagccgccgctttgctttgtgcgctttgttgcgggcttctggcccctgcagcaagagcaggatactcggaggagcgctgttcctggagaggctcgggcctgacccaggaacctggctcggtggggcaactggcgctggcatgcgctgaaggtgcagtggaatggctttaccccgcaggtgcgctccgccttaccctgggtgggcccgatccccgcgcaaggcctggcatcgcatgtcttagaccggtccgtccctttgcaggtgcacaggtgtttgcagaacgggcaggtggggctcttgagcttctgctggcggaaggtccaggacccgccgggggacggtgtgtccgctggggcccacgggaacggagagcactttttctccaggcaaccccacatcaggacatttcccgacgggtcgcagcttttcggtttgaacttcgcgaggacggccgacctgagttgcctccacaagcacacggactgggagtggacggggcatgtaggccgtgttcagacgcagaattgcttcttgcagcttgcacctctgattttgtcatccatggtatcattcacggtgtcacgcacgatgtggaactccaggagagcgtgattactgtggttgccgccagagtcctgcgacaaaccccaccactgtttcaagccggacgctcaggtgatcaaggtcttaccagcattagaacccctctgaggtgtggagtgcatcctggacctggaacctttctgttcatgggctggagcagatttggggaagcaagactgggatgcgctccacgattccaagaatttcgccgggcctacgaagctgctagggcagcccacctgcatccatgcgaggtggcactccat

SEQ ID NO: 16624 - DNA, 879 bp, Artificial Sequence
  Description of Artificial Sequence: Synthetic coding sequence
atgggatttccggccgccgcccttctttgtgccctgtgttgcggactgctggcgccggccgcacgcgcgggctattcggaggagcgctgctcctggcgcggctccggactcacccaagaaccgggatcagtgggccagctggcactggcctgcgcggaaggcgccgtcgaatggctgtacccagccggagcactgagactcactctgggtggcccagacccgagggcgcggccgggcatcgcctgcctccgcccggtccgtccgtttgccggggcacaagtctttgcggaaagagccgggggtgccctcgaactgctcctggccgaaggccctggaccagccgggggacggtgcgttcgctggggaccccgggaacggcgggcgctcttccttcaggctaccccgcaccaggacatcagcagacgcgtcgccgcctttcgcttcgagttgcgggaagatggacggccagaactgcctccacaggcgcacgggcttggtgtggatggcgcttgcagaccgtgttctgatgctgaacttctgctggcggcttgtaccagcgatttcgtcatccacggaatcatccacggagtgacccatgacgtcgaactgcaggaaagcgtgattacggtggtcgccgcacgggtgcttcgccagaccccgcccttgttccaggcggggcgctcgggagatcaaggcctcacgtctatcaggactcctctgagatgcggagtgcatccaggaccgggaacctttctcttcatgggatggtcgagatttggagaagccaggctgggttgcgcaccgcggttccaggagttcagacgggcgtacgaggctgcccgggccgcacacctgcatccgtgtgaggtcgcactccat

SEQ ID NO: 16625 - DNA, 879 bp, Artificial Sequence
  Description of Artificial Sequence: Synthetic coding sequence
atgggcttccccgcagctgcgctcctgtgcgccctatgttgcggcctgctggcccctgccgcccgggctggatactccgaagagcggtgctcttggagaggctccggcctgacgcaggagccaggtagcgtggggcagctggcccttgcctgtgcagagggagcagtcgagtggttgtaccccgctggtgcactgaggctgaccttgggcggccctgacccacgggcacgtccagggattgcgtgcctccggccagtgcgccccttcgctggggcccaggtattcgctgagcgagctggcggcgccctcgaattgttgctggctgaaggtcccggccccgccggagggaggtgtgtacgatgggggccccgcgagcggagggccctgtttctccaggctactccccaccaggatatctcccgcagagtcgccgcctttcgattcgagctgagggaggatggtagacccgagctcccccctcaggcacatggcctgggggtagatggagcatgcagaccttgttccgatgcggagttgcttctggccgcgtgtaccagcgacttcgtgatccacggcatcattcacggggtgactcatgatgttgaactgcaggagagcgtgataaccgtggtcgctgcgagagttctcagacaaacaccaccgctgttccaggctgggcgctctggcgatcaaggtctgaccagtattcgaacacctttacgctgcggagttcaccctgggcccggcactttccttttcatgggctggagccggtttggtgaggccagactgggctgcgcgcccagatttcaagagtttcgccgtgcctacgaggcagctagggcggcccacctgcacccttgtgaggtcgccttgcac

SEQ ID NO: 16626 - DNA, 879 bp, Artificial Sequence
  Description of Artificial Sequence: Synthetic coding sequence
atgggattcccggctgctgcgctcctctgcgcgctctgctgcggactgctggcgcctgcagcccgggccgggtactccgaagagagatgctcctggagaggaagcggactcacccaggaacctgggtcagtgggccaactcgctctggcatgcgccgagggagccgtcgagtggctgtacccggctggcgcgctccggctcacgctcgggggccctgacccacgcgcccgaccaggcatcgcgtgtcttagaccggtgcgcccgtttgctggagcccaagtgttcgcagaacgggccggaggggcgcttgaattgctgctggctgaaggtccgggccctgccggaggccgctgcgtgcgttggggcccgcgggaacgccgcgcactctttctgcaagctaccccacaccaggatatcagcagacgggtggcggcttttaggttcgaacttagagaagatggaaggccggagctgccgccgcaagcgcacggtctgggcgtcgacggtgcttgcagaccgtgcagcgacgccgaactcctcttggcggcttgcacctcagactttgtgattcacggaatcatccatggtgtcacccacgatgtggaattgcaagagtcggtcatcaccgtcgtggcagcccgcgtcctgcgccaaactccaccgctgttccaggcgggacgctccggagatcaagggctgactagcatccgcactccgctccggtgcggggtgcatccgggacctggcaccttcctcttcatgggatggtccagatttggagaagccagactgggatgtgcaccgcgattccaggagttccggcgggcctacgaagcagcccgagctgcacatctccatccctgcgaggtggcactgcac

SEQ ID NO: 16627 - DNA, 879 bp, Artificial Sequence
  Description of Artificial Sequence: Synthetic coding sequence
atggggttccccgcagcagcccttctgtgcgcattgtgctgtggactgctggccccggctgctcgggccggctacagcgaagaaagatgctcgtggcgggggtccgggctgacccaggaaccaggctcggtgggacagctggcgcttgcatgcgcagagggagctgtcgagtggctgtacccggctggggcactgcgcctgacgctgggaggtccagaccctagagctcggccgggcatcgcgtgccttcgtccggtgcgcccttttgcgggagctcaagtgttcgctgaacgggcaggaggggctctcgagctgcttctggccgagggccctggcccggccggtggaaggtgtgtgcggtgggggcctagagaacgccgagccttgttcttgcaagctactcctcatcaggacatctcacgccgggtggcggctttcagatttgagctccgagaagatggccgcccagaactgccgccacaggcccacggactcggagtcgatggagcctgccgaccgtgttcggacgccgaactgctgctcgctgcttgcactagcgacttcgtgatccacgggatcattcacggtgtcactcatgatgtggagctgcaggagtccgtcatcaccgttgtggcggcgagagtgctccggcagaccccgccgctttttcaagctggacgaagcggagatcagggattgacctcaatccggactccactcaggtgtggcgtccaccccggccctggaaccttcctgtttatgggctggtcccgcttcggagaggcaaggctcggatgcgcgccgcgctttcaagaattccgccgggcttacgaggccgcgcgggcggcacatctgcacccgtgcgaagtggcactgcac

SEQ ID NO: 16628 - DNA, 879 bp, Artificial Sequence
  Description of Artificial Sequence: Synthetic coding sequence
atgggttttccagcagcagccctgctttgtgctctttgttgtggccttctggctcccgcagctcgcgccggatactcggaagagcgctgtagctggcgcggatccgggcttactcaagagcctggatcagtgggccaacttgcactggcctgcgcagaaggtgcagttgagtggctgtaccctgcaggggctctgagattgacccttggaggtccggatccgagagccagaccggggattgcgtgtcttagacctgtgaggcctttcgcaggagcacaagtgttcgcagagcgggcaggaggagcactggaattgctgcttgcagaagggcctggacctgcaggaggccggtgcgtgcgatggggaccccgggaaagacgcgcgctttttctgcaagccacccctcatcaagatatttccagacgggtcgccgctttcagatttgaacttagagaggacggtcgacccgaactgcctcctcaagcacatggccttggcgtggatggagcgtgtcgcccgtgttccgatgcggaactgctcctggcggcctgtacctctgactttgtcatccatggaattatccacggagtcacccacgacgtggaattgcaggaatctgtcatcactgtcgtcgccgccagagtgttgagacagactccacctctctttcaggcaggacgttcaggcgatcagggtcttacgtcaattagaacccccttgcgttgtggggtgcaccctggtccaggtacctttcttttcatgggatggtcgcggtttggcgaggcgcgccttggatgcgcacccagatttcaggagtttcgccgggcatacgaagcagcacgggcggcacatcttcatccctgtgaagtggccctgcat

SEQ ID NO: 16629 - DNA, 879 bp, Artificial Sequence
  Description of Artificial Sequence: Synthetic coding sequence
atgggctttcccgctgcagctctgttgtgcgccctctgttgtggactgctagcgccagcagcacgggctggttattctgaggagaggtgctcctggaggggctcagggttaactcaggagcccgggtcggtagggcagcttgccctggcctgtgctgagggtgccgttgagtggctgtatcctgctggcgctctgaggctcaccctgggcggaccagacccaagggcacgccccggaattgcatgcttgcgccctgtgcgaccatttgcaggcgcccaagttttcgcggagagggcaggcggcgccttagagctcctcctggcggagggacccggccctgctggcggccggtgcgtacgctgggggccccgggagaggcgtgcactgttcctacaggctactccccaccaagatatcagcagaagagtggctgcttttcggtttgagcttagagaagacgggcgacccgaactgcccccccaggcgcacggcttgggagtcgatggggcctgcaggccgtgctccgatgccgagcttctccttgctgcttgcacttctgatttcgtaatccatggtattatccatggagtgacgcacgatgtggagctgcaggaaagtgttatcaccgtcgttgcagccagggtgctaaggcagactccacccctgtttcaggccggtcggtctggtgatcaaggattaacgtccatccgtacaccgttaagatgtggcgttcatcccggacccggtacctttttgttcatgggatggtctcgttttggagaagcccggctggggtgcgcacctcggttccaagaattccggagggcttatgaggccgccagggcggcacacctgcatccctgcgaggtcgctctgcat

SEQ ID NO: 16630 - DNA, 879 bp, Artificial Sequence
  Description of Artificial Sequence: Synthetic coding sequence
atggggttcccggcagcggccctcctttgtgcgctgtgttgtggactcctggcgccagccgcgcgcgcaggctactcggaagagcgctgttcgtggcgcggatccgggctcactcaagaaccgggatccgtgggacaactggctctcgcttgcgccgaaggagccgtggaatggctgtacccggcaggcgctctgcgcctcaccctgggaggacctgacccgagggcccgccctggcatcgcctgcctgcgaccggtgcggccgttcgccggagcccaggtctttgcagagcgggctggcggagcactggagctgctgctggccgagggtccagggcctgcaggtggccggtgcgtgcggtggggtcctagagagcggcgcgcactcttccttcaggccactccgcaccaggacatttcgaggcgcgtcgcggcctttcggttcgaactgcgggaagatggacgcccggagctgccaccccaagcccacggcctgggcgtggatggagcttgccgcccctgtagcgacgccgagttgctgctcgctgcctgtaccagcgacttcgtcatccacgggatcattcacggtgtcacccatgatgtggagctccaggagtcggtgattaccgtcgtggccgcccgcgtgctccggcagactccgccactgttccaggctgggcgctccggagatcaaggactgacctctatcagaactccactgcgctgtggagtgcatccgggaccgggaaccttcttgttcatggggtggtcgcgttttggagaggctagactcggatgcgcgccgagatttcaggaatttcgcagggcatacgaggctgctagggcagcacatctccacccgtgcgaagtggcactgcac

SEQ ID NO: 16631 - DNA, 879 bp, Artificial Sequence; identical to SEQ ID NO: 16612
  Description of Artificial Sequence: Synthetic coding sequence

SEQ ID NO: 16632 - DNA, 879 bp, Artificial Sequence
  Description of Artificial Sequence: Synthetic coding sequence
atgggattccctgccgcagccctcctgtgcgcgctgtgttgtggcctcctcgcgccagcggcaagggccggatattcagaggagcgctgctcttggagagggtcaggtctgacccaggagcctgggtcagtgggccaattggcactggcgtgcgctgaaggtgctgtcgagtggctttaccccgctggtgccttgcggcttaccttaggaggccctgaccctagggccagaccggggatcgcctgccttaggccggtacgcccgtttgctggggcccaggtctttgctgaaagagccgggggggcacttgagctgttgctggcggagggtcccggaccagccggcggacgatgtgtgcgctggggcccccgggagcgccgagctttgttcctgcaggcaaccccccatcaagacatatctaggcgcgtggccgcattccggttcgagttgagagaagacggaagacccgagctgccaccccaggcgcacggcttgggcgtggacggcgcatgcaggccttgtagtgatgccgaacttctgctcgcggcctgcacctccgattttgttatccacggcatcatccacggggtcacccacgacgttgaactccaggaatctgtcatcaccgtggtcgctgcaagagtcctgagacagacacctcctctgtttcaggctggacgcagtggagaccaagggctgacctctatcagaactcccctcaggtgtggagtgcatcctgggcctggaacatttttgttcatgggctggtcacgatttggcgaagccagactgggttgcgccccaagattccaagagttcaggagggcttacgaggctgcccgggcagctcaccttcatccctgcgaagtggcacttcat

SEQ ID NO: 16633 - DNA, 879 bp, Artificial Sequence
  Description of Artificial Sequence: Synthetic coding sequence
atgggctttccagccgccgctctgctctgtgccttgtgctgtggcttgctggcccctgcagcacgtgctgggtactccgaggaacgttgcagctggcgagggagcggactaacccaggagcccggatctgttgggcagttagccctagcttgcgccgaaggagctgtagagtggctgtatcccgcgggtgcattgcgactgaccttgggcggaccagatccaagagctcgccccggcatcgcctgtctgagaccagtccgccctttcgccggagcacaggtattcgctgaacgggcaggtggggctttggaattactcctcgctgaagggcctggccctgcaggaggtcggtgcgttcgctggggacctcgtgaaagaagagccctatttctgcaggccaccccccatcaggatattagcaggcgcgtggccgcctttcgctttgagctgagagaagatggccgcccggagctgccccctcaggcgcacggtcttggcgtcgacggggcctgccgcccgtgttctgatgcagaactgctcctcgccgcctgtacttctgacttcgtgatccatggcataatccacggggtgacccatgatgttgagttgcaagaaagcgtcattaccgtcgttgccgctcgcgtcctccggcagactcctccactttttcaagcgggaaggagcggggatcagggactgacaagcatccggactccactgagatgcggggtgcaccccggccccggtacattcctatttatgggatggagcaggtttggagaggcacgccttgggtgtgctccaagattccaagagttccgcagggcctatgaagccgcccgtgctgcccacctgcacccctgcgaagtggccctgcat

SEQ ID NO: 16634 - DNA, 879 bp, Artificial Sequence
  Description of Artificial Sequence: Synthetic coding sequence
atgggctttcctgcagccgcactcctgtgcgccctgtgctgtggcctgctggcaccggccgctagagcaggatattccgaagaaaggtgcagctggagaggatccggactgacccaggaaccaggctccgtgggacagctggccctggcttgcgccgagggagcggtggaatggttgtatcctgctggagcattgcgccttactttgggtggccctgacccaagggctcggccaggcatcgcctgtctaaggccagtaaggcccttcgctggagctcaggtgtttgccgagagggccggcggagccctggaacttctgctcgccgaaggtcccggaccggccggcggccgctgcgttaggtggggacctcgagagaggcgggcactgttcctgcaagccactccacaccaggacattagcagaagagtggccgcgttccggttcgaacttagggaggatggaaggccggaacttccccctcaggcacatggcttgggcgtagacggagcctgccgcccttgttcagatgctgaactcctgctcgcggcctgcaccagcgacttcgtcatccacggcatcattcatggggtcacccacgacgtggagctccaggaatccgtcatcactgtggttgctgcaagggtgctcagacagactccccctctgttccaagcgggaaggtctggagaccagggcctcactagcatccggacccctctgaggtgcggcgtccaccctggccccggcaccttcttgtttatgggttggagcagatttggagaggctagattgggctgtgctcctaggttccaggagttccgcagagcttacgaggcggctagggctgcacaccttcatccatgcgaggtagccctgcat

SEQ ID NO: 16635 - DNA, 879 bp, Artificial Sequence
  Description of Artificial Sequence: Synthetic coding sequence
atgggatttcctgccgcggcactgctgtgtgccctgtgttgcggcctgttagcacctgcggcgcgagcaggatacagtgaggaacgctgcagctggagaggaagtggacttacacaagagccgggatcagttggtcaattagcgcttgcttgcgccgaaggtgctgtagaatggttgtatccggcaggagctcttagacttaccttgggggggcctgacccaagagcacgcccggggatcgcctgtttaagacctgtacggcctttcgcaggagcacaggtgtttgccgaacgagcaggcggagctttggaactgctcttagcggagggaccaggcccggcgggcgggcgttgcgttagatgggggcctcgcgaacgcagagctttatttctccaagccactccgcatcaagatatttcacgacgcgttgcggcatttcgatttgaactgcgcgaagatggcagacctgagctgccgccgcaggcgcatggattaggagtcgacggtgcgtgtcgcccttgtagcgacgcagagttgttattggccgcttgcacatctgattttgttatacacggcatcatccatggcgtgacgcatgacgtcgaattacaggaatctgtgatcacagttgttgccgcacgcgtgctccgtcaaaccccgccattattccaagcaggaagatccggcgaccagggtctaacatcaatccggaccccgcttcgttgcggagtccatccgggcccgggaacatttctgtttatgggatggtctcgtttcggagaagcacgactcgggtgcgctccgaggtttcaggagtttcgaagagcctatgaagcagctagagcagcccatttgcatccttgtgaggtggctttgcat

SEQ ID NO: 16636 - DNA, 879 bp, Artificial Sequence
  Description of Artificial Sequence: Synthetic coding sequence
atgggattccccgctgccgctctgctgtgtgcactctgctgtggcctcctggctcctgccgcaagagctggttacagcgaggagagatgttcttggcgggggtctggtctcactcaggagcctggctcagttggacagctggccctggcctgtgcagaaggtgccgtggaatggctttacccagccggcgcccttcgcctgaccttgggaggacccgaccctagagcccggcctggtatcgcgtgcttgcgccccgtccgcccatttgccggtgctcaggtgtttgcggaacgggccggaggggccctcgagcttctgctcgcggagggccccgggccagccggaggacggtgcgtgcgatggggtcctcgggaacggcgggctcttttcctgcaggcaacgccccaccaggacatttcacggagagtcgcggcgtttaggttcgagctccgagaagacggtcggcctgaactcccaccacaggcccacgggttgggggtcgacggagcctgtcgaccatgcagcgacgccgaactgctgctggccgcttgtacatcagacttcgttattcacggcatcatccacggcgttacgcacgatgtcgaattgcaggagagcgtgattactgttgtggccgccagagtacttcggcagactccaccactgttccaggcaggcagatcaggtgaccaaggtctgacttccatcaggacccctctgcggtgtggggtccatcccggccccggaacattcctttttatggggtggagtcggtttggagaggccagattgggttgtgctccccggttccaggagtttcgaagagcctatgaggccgcaagagctgcacatctgcatccctgcgaggtggccctccac

SEQ ID NO: 16637 - DNA, 879 bp, Artificial Sequence
  Description of Artificial Sequence: Synthetic coding sequence
atgggctttccagccgctgcgcttctctgtgccttatgctgcgggctacttgctccggctgctcgcgcgggttatagtgaggaacgatgtagctggagagggtccggcctgacacaggaaccaggctcggtgggtcaattagctctggcttgcgccgagggtgccgtggagtggctttacccagccggggctctgcgcctcacgctaggggggcctgaccctcgcgcgcgaccgggcattgcctgtctgaggcccgtcagacctttcgccggtgcacaggtgtttgcggagagagccggaggcgctttagaactgcttctggccgaaggacccggacccgcaggcggtcgatgcgtgaggtggggccctagggagcgacgggccctgttcctgcaggccacaccgcatcaggacataagccggcgggtggcggcttttagattcgagctacgggaggacgggcggcctgagttgccacctcaggcgcatggcctgggagtagacggggcatgccggccttgttccgatgccgagctgctgctagccgcttgcacaagcgacttcgttatccacggcattatccatggggtgacccacgatgtcgagttgcaggagtcagtcattacagttgtggcggcccgggtccttagacagacaccccctctgttccaagctggacggtctggcgatcaggggttaacaagcattagaacaccactgagatgtggcgtccacccagggcctggcacctttttgttcatgggctggagcagattcggggaggccagattaggatgtgctcctaggtttcaggagtttcgaagagcttacgaagctgccagagctgcccacttgcacccctgcgaggtggctttacac

SEQ ID NO: 16638 - DNA, 879 bp, Artificial Sequence
  Description of Artificial Sequence: Synthetic coding sequence
atggggtttcccgctgctgctttgctctgcgcgctctgttgcggtctgctcgcacctgcggctcgagccggttactccgaggagcgatgtagttggcgtggttctggactgacacaggagcctggctctgtgggtcagctggccctcgcatgcgcagaaggagcggtggagtggctgtacccggccggcgccctccgcctgaccttaggtggacctgacccccgagcgaggcccggtatcgcatgtctgagaccggtgagaccatttgcaggtgcccaggtcttcgccgagagagctgggggggccttggagctgctgctggctgagggaccaggcccagctgggggcaggtgtgtgaggtggggtcccagggagcgcagggctctgtttctgcaggcgaccccgcaccaggatatcagtcgccgggtagccgcatttcgcttcgagcttagagaagatggcaggccagagctgcctcctcaagcacatggcttgggcgtggacggagcctgtaggccctgctctgatgctgagttgctgcttgctgcgtgtaccagcgacttcgtgatccacggcattatccatggagttacccatgacgtggaactccaggagagcgttattaccgtggtcgccgctcgggtccttaggcagaccccccccctgttccaggcaggacgatccggagatcaggggctaacctctatcaggacacctcttcgttgtggcgttcacccaggacccgggacttttctctttatggggtggagccgtttcggtgaagcacggctggggtgtgccccgagatttcaagaattcaggcgagcgtacgaagcggccagggcagcccatctccatccctgcgaagtggcattgcat

SEQ ID NO: 16639 - DNA, 879 bp, Artificial Sequence
  Description of Artificial Sequence: Synthetic coding sequence
atgggattcccagctgctgcgctcctttgtgcgttgtgctgcgggctgctggccccagcggctcgcgcaggctatagcgaagaaaggtgtagttggcgaggcagcgggctgactcaggaaccaggaagcgtcggccaactggcccttgcctgcgccgagggagctgtggagtggttgtacccagccggcgctctgagactgacactggggggcccggacccgcgagcccggccaggtattgcctgtctgcgacctgtgcgcccattcgcgggcgcccaggtttttgcggagcgagcgggaggagcattggagctgttgttggccgagggccccggtcctgctggcggccggtgtgtccgatggggacctcgggagcggagggcactgttcctccaggctaccccgcatcaggatatcagtcgacgggtagccgcgtttcgattcgaactgagagaagatggtcgccccgagctcccaccccaggcgcatggtcttggggtggacggagcgtgcaggccgtgctcagatgcagaattgctgctcgccgcttgtacttcagattttgtcattcatggcatcatccacggggtcactcatgacgttgagctgcaggagtccgtgattaccgtggtagcggctagggtcctcagacagacgcctcctctcttccaagccggacggagcggggaccaggggcttaccagcatccggacccctctccgctgcggggttcaccctggaccgggcaccttcctgtttatgggttggtcccgcttcggtgaggccagattggggtgtgcgccgcggtttcaggagtttaggagagcatatgaagctgccagggcagcccacctccacccctgtgaagtcgccctccat

SEQ ID NO: 16640 - DNA, 879 bp, Artificial Sequence
  Description of Artificial Sequence: Synthetic coding sequence
atgggcttccccgcggccgccttgttgtgcgcgttgtgttgcggcctgctggctccagccgcgcgcgccggatactcagaagaaagatgttcgtggagaggatcaggactgacccaggaacctggctcggtgggacagcttgcgctggcgtgcgctgaaggagcagtcgagtggctgtacccggctggagcactgaggctcactctgggaggaccggatccgcgcgcgcgacctgggatcgcatgccttcggccggttcgcccattcgcgggcgcccaggtctttgcggagcgggcgggcggagcgctcgaactgctgctggctgagggcccgggtcctgcgggtgggcggtgcgtgcgttggggaccgagagaacggcgggccctgttcctgcaggctactccgcatcaagacatttcgaggcgggtcgctgctttccgcttcgagctgcgagaagatggaaggcctgaactcccccctcaagcccatggactcggcgtcgacggggcctgtcggccgtgcagcgacgcagaattgttgctggctgcatgcacctccgatttcgtgatccatggtattatccatggagtcacccatgacgtggagttgcaggaatcagtgatcaccgtggtggcggcacgcgtcctgaggcaaacgcccccgctctttcaggcaggacgctcgggggaccaaggactgacctcaatccgcactccgcttaggtgcggcgtgcatcctggaccgggcactttcctgttcatgggctggtcaagatttggagaggcccgcctgggttgtgctcccagattccaagaatttcgcagagcctacgaggcggcccgagccgcccacttgcacccctgcgaagtcgcgctccat

SEQ ID NO: 16641 - DNA, 879 bp, Artificial Sequence
  Description of Artificial Sequence: Synthetic coding sequence
atgggcttccccgcagctgccctactttgcgcattgtgctgtggactgttggcccccgcagcacgagccgggtattctgaagagcgttgctcttggagaggctccgggctgactcaggaaccaggcagcgtgggccagctggccctcgcctgtgccgagggagccgtggaatggctctaccctgcaggtgcgttgagactcacgttaggtggccccgaccctcgagcacgcccaggcatcgcctgtctccgcccagtccggccttttgccggcgcccaggtctttgccgagcgggctggcggggcccttgagctcctcctggctgaaggtccgggacccgcgggtggcagatgcgttcgatggggcccccgggaaagaagggccttgttcttacaggccacccctcatcaggatatcagtagacgcgtggctgcctttcggttcgaactacgtgaggacggtagacccgaactgcccccgcaggcacatggccttggcgttgacggtgcttgtagaccatgctctgatgccgagcttctcctggcggcgtgcaccagcgattttgtgatccacgggattatccacggagtgacccacgacgtggaactgcaggaaagtgtcatcacggtagtggccgccagagtactgagacagactcctccactgttccaggctggacgtagtggcgaccagggactgacaagcatccgcacaccccttcggtgcggagtgcatcccggacccggtacgttcttattcatgggttggtcccgctttggtgaagctaggcttgggtgcgcccccagattccaagagtttcgacgggcctacgaagcggcccgcgccgctcacctccacccttgcgaggtcgccttgcac

SEQ ID NO: 16642 - DNA, 879 bp, Artificial Sequence
  Description of Artificial Sequence: Synthetic coding sequence
atgggatttccggccgctgcacttttgtgcgcactctgctgtggcctcctcgccccggccgccagggccggatacagcgaagaacggtgctcgtggcggggatccggattgactcaagagccgggctcggtgggtcagctcgccctggcgtgcgccgagggtgcagtcgagtggctgtacccagcgggtgcccttcggctcactctgggcgggcccgatccaagagcgaggccgggaatcgcctgtcttaggccggtgcgcccgttcgccggagcgcaagtgttcgccgagagggccgggggcgcgctcgaactgctgctcgccgaagggcccggtccggcgggaggcaggtgcgtgcgctggggaccccgggaacgccgcgccctcttcctgcaggcaaccccgcaccaagacatctcacggcgggtcgctgcctttcggttcgaacttagagaggacgggcggccggaattgcctccgcaagcccacggccttggcgtggacggagcttgccggccttgctcagacgctgagctgctcctcgcagcgtgcacttccgatttcgtcattcacggaattatccatggagtgacgcatgatgtcgaactccaggaatcagtgattactgtggttgcggctcgtgtcctgcgccagactcctcctctgtttcaagcgggacggtcgggcgaccagggtctgacttccatcagaactccgctccgctgcggggtgcatcccgggccaggaacttttctcttcatgggatggtcgcgcttcggggaggctagactgggctgcgcaccgcggttccaagagtttcggcgcgcctacgaggccgcacgggccgcacacctgcatccgtgcgaggtcgccctccac

SEQ ID NO: 16643 - DNA, 879 bp, Artificial Sequence
  Description of Artificial Sequence: Synthetic coding sequence
atggggtttcccgcagccgcgctgctctgcgctttgtgctgtggcctgttagcacctgccgccagggccggctattcggaggagcgctgtagttggcgaggaagtggtttaacccaagagcccggaagtgtgggtcaactcgccctggcttgtgccgagggagcagtagaatggctgtaccctgctggggccctcaggctcacgctaggggggcctgatccccgagcccgaccaggtatcgcatgcttgcggccagtgcggccgtttgctggggcgcaggtgttcgccgagcgagccggaggggctctggagttgctactcgccgaaggccctgggcccgccggtggccggtgtgtacggtggggccctagggagcgcagggcactctttcttcaggccactccccaccaggatatctcccggcgtgtggctgcattcaggttcgagctgagggaggacggtcgccctgaactacctccacaggctcatggactgggggtggacggtgcgtgcaggccatgtagtgatgctgaacttctgctcgccgcctgcaccagcgattttgtcatccatgggatcattcacggtgtgacccacgacgtggagctgcaagagagtgtgattacagttgtggcagcacgggttctaagacagacccccccactgtttcaagccggacgctccggcgaccagggcctgaccagcatccggacgcctctgcggtgcggcgtgcatcccggcccgggaacctttctttttatgggatggagtcggtttggcgaggcgcgccttggctgcgcccccaggttccaggaatttcggcgtgcctacgaggccgccagggccgcccatctgcatccgtgcgaggtggccttacac

SEQ ID NO: 16644 - DNA, 879 bp, Artificial Sequence
  Description of Artificial Sequence: Synthetic coding sequence
atgggattcccagctgccgcgctcctgtgtgcactgtgttgcggtttgctggcgccggcagcccgggcgggatactcagaagaacgctgctcctggcgggggtcgggtctgacccaggaacctggatccgtgggacagttggcgcttgcgtgcgctgagggagcggtggagtggctttatccggccggagcccttaggctcacgctgggaggcccagatccccgcgctcgcccaggcatagcatgcctccggcctgtccgaccttttgcgggagcccaagtctttgctgagcgcgccggaggagcgctcgagcttctgctggcggaagggccgggaccggctggagggaggtgcgtgcgctggggcccacgcgaaagaagagcgctgttcctccaggcaactccgcaccaggatatctccaggcgcgtggccgctttcagattcgaactcagagaagatggtagaccagaacttccgcctcaggctcacggactgggtgtggacggcgcgtgccgcccgtgttcagacgcagaactcctgctggccgcatgcacttccgatttcgtgatccatggtatcatccacggggtcactcacgatgtggagttgcaggaatcagtcattactgtggtggcggcacgcgttctgagacagaccccgcccctgtttcaagcggggagatccggagatcagggcttgacctcgatcagaactccattgcgctgtggtgtgcatcctggcccgggaaccttccttttcatgggatggtcgcgcttcggcgaagctcggctgggatgcgccccacgcttccaggagttccggcgggcctacgaggctgcacgcgctgcccacctgcacccgtgcgaagtggcgctccat

SEQ ID NO: 16645 - DNA, 879 bp, Artificial Sequence
  Description of Artificial Sequence: Synthetic coding sequence
atgggttttccagcggctgcattgttgtgcgctctttgttgcggtctgctcgcacctgcggcccgtgccgggtactcggaagaacgatgctcttggcgtggatcgggcctgacgcaagaaccgggaagcgtgggacagctggccctggcgtgtgccgagggagcagtggaatggctctaccctgcgggtgcccttcgcttgactctgggaggacccgacccacgggcacggcccggcattgcttgtcttaggcctgtgcgtcctttcgctggtgcacaggtgtttgcagaacgagcaggaggtgcgcttgaactgctgctggcggaaggcccaggccctgcaggtggtcggtgtgtgcgatggggtcctcgggagcggagggccctttttctgcaagcaactccacatcaggacatttcccgccgggtggctgcatttcgctttgaactccgggaggatggaaggcctgagcttccgccacaggctcatgggcttggtgtcgatggagcttgcagaccttgttccgacgcggaactccttctggccgcatgcactagcgacttcgtcattcatggtataatccacggagtgactcatgatgtcgagcttcaggaaagcgttatcaccgtagtggcagcaagggtcctgaggcagaccccaccgctcttccaggccgggcgatcgggagatcagggcctgacctcgatccggactccactccgctgcggagtccatcccggtcccgggacgttcctgtttatgggatggagcagatttggcgaggcaagattgggatgcgcaccaagatttcaggaatttcggcgggcatatgaagccgcaagagcagcccacctgcatccatgtgaggtggcactgcat

SEQ ID NO: 16646 - DNA, 879 bp, Artificial Sequence
  Description of Artificial Sequence: Synthetic coding sequence
atgggattccctgctgccgcactgttgtgtgcactttgttgtgggcttctggcccctgcagcaagagcagggtactccgaagaacgttgctcgtggcggggatccggacttacccaggagccaggaagcgtcggacaactggcactggcatgcgcagaaggtgcagtggaatggctttaccctgcaggagcacttcgcctcacccttggcgggcccgatcctcgcgcaagacctggcattgcctgtctccgacccgtccggccttttgccggagcccaggttttcgccgaacgcgctggaggagccctcgagctgctgctcgcggagggaccagggcctgctggagggaggtgcgtgcgctggggacctcgggaaagaagggcactgtttctgcaagcaactcctcaccaagatatttcccggcgtgtggcagcgtttcgatttgaacttagggaggacggcagaccagagcttccaccacaggcgcatggcctgggtgtggatggcgcctgtcggccatgtagcgatgccgagcttctgcttgcagcctgtacttccgatttcgttatacacgggatcatccatggtgtgacccacgacgtggaacttcaggaatcggtgattaccgtggtcgcggcacgagtgcttcggcaaactcctccactgtttcaagccggcagatcgggggatcaaggtctgacttccattcggacccctctgcgctgtggtgtgcatccagggcctggaacttttctgtttatgggatggtcccgctttggggaagcaaggctgggatgtgccccgcgctttcaggaatttaggagggcctacgaagcagcacgtgcggctcatctccatccttgtgaggtggccctgcat

SEQ ID NO: 16647 - DNA, 879 bp, Artificial Sequence
  Description of Artificial Sequence: Synthetic coding sequence
atgggatttccggctgctgccctgctgtgcgcactgtgctgtggcctgctcgccccggcagcacgcgccgggtactccgaagaaagatgctcgtggcgaggatccggcttgactcaggagccaggctccgtgggacaactggctctcgcctgcgccgaaggagcagtggaatggctgtacccagccggagccctgcgcctgactctcggaggaccggatccacgcgcgcggccaggaatcgcatgccttcgcccggtgcggccgttcgctggggcgcaagtctttgccgagcgcgcgggcggggccctggagctgttgctggcagaaggaccggggcccgccggtggacggtgcgtgcgctggggaccacgagaacgcagagctctgttcctgcaggcgactccgcaccaggacatctcgagacgggtagcggccttcagattcgagctccgcgaggacggacggcccgagctgccccctcaggcgcacggcctgggcgtggatggtgcttgccgcccgtgctcagacgcagagcttctgctggcagcttgcacgtcagacttcgtcatccacggaattatccatggtgtgacccatgacgtcgaactccaggaaagcgtgatcactgttgtggctgcgcgcgtgctgagacagacccctccactcttccaggccggccgctcgggagatcagggactgacctcgatccgcactccgctgagatgcggagtccacccaggacctggcaccttcctctttatgggatggtcgcggttcggagaagccagactgggatgtgccccaagattccaggaattccgccgcgcctacgaggccgcccgcgcagcgcatctccacccttgtgaggtcgcgctgcac

SEQ ID NO: 16648 - DNA, 879 bp, Artificial Sequence
  Description of Artificial Sequence: Synthetic coding sequence
atgggctttcctgcagcagctttactctgtgctttgtgctgtgggctgctcgccccggctgcccgggctgggtacagtgaagaaagatgttcctggcgaggcagtggcctcacccaggaacctgggtcggtggggcagctggccctggcctgcgcagagggggcggtggagtggttatatccagcaggtgccctgcgactcaccttgggtgggcctgatccgagggcacggccgggaattgcctgcctccgaccagtgaggcccttcgctggcgctcaggttttcgctgagcgcgccgggggagctctcgagctcctgctggctgaagggcccggcccggcaggcgggcgttgtgtccgttggggacctagggagcggcgggccctgttcttgcaggcaaccccacaccaggatataagcagacgggtcgccgcattccgtttcgagcttcgtgaggatggcaggccagaactcccccctcaggcacatggcttaggagtggacggtgcttgccggccatgcagtgatgcagagttactcctggccgcttgcactagtgacttcgtgatccacggaatcatccacggggtgacccatgacgtggaactgcaggagtccgtcatcactgtggtggccgcccgtgtgcttaggcagacacctcccctcttccaggcaggccggtctggtgaccagggcttgactagcataagaaccccactccgctgcggggtgcatcctgggcctggaacatttttatttatggggtggtcacgcttcggagaggctcggcttggctgtgccccacggttccaggaatttaggagggcctacgaggcagctcgggcggcacatctccatccctgcgaagtagctcttcat

SEQ ID NO: 16649 - DNA, 879 bp, Artificial Sequence
  Description of Artificial Sequence: Synthetic coding sequence
atgggcttcccagctgccgctctgctgtgcgcgctgtgctgtgggttacttgctccagctgcccgggctgggtattccgaagaaaggtgttcctggcggggctcaggtttgactcaggaaccaggttccgtgggccagctggctctggcatgcgcagagggggccgtcgagtggctttatcctgctggggccctgcgcctgacactcggtgggcctgaccctcgggccaggcctggtattgcgtgcctgcggccggtgcgaccatttgctggggctcaggtcttcgccgaaagggctggcggcgcactggagctgctcttagccgaggggccagggccggcgggtggtcgctgtgtgaggtggggtccaagagaacgccgtgcccttttcctgcaggcgaccccacaccaggacatcagcaggagggtagccgccttcagatttgaactgagagaggatggacggcccgagctgccccctcaggcacacgggttaggggtggacggagcctgtcgtccatgctcggatgcagagctgttgctggctgcgtgcaccagtgacttcgtgatccacggtatcattcacggagtgacgcatgacgtggaacttcaggaatcagtaattacggtggtagcggccagagtcctgagacaaacaccacctttgtttcaagccggtcgttctggagaccaggggctgacgtctattcggaccccactgcgatgcggtgtccaccccggcccgggaacttttctctttatgggatggtcccggttcggcgaagcgaggctcggatgcgctcccaggttccaagagttcagaagggcctacgaagccgcccgggccgcacatttacatccctgtgaggtggccctgcac

SEQ ID NO: 16650 - DNA, 879 bp, Artificial Sequence
  Description of Artificial Sequence: Synthetic coding sequence
atgggctttcctgcagctgcgctcctttgtgccctgtgttgcgggctacttgcacctgccgcccgagcaggctactccgaggagcgatgttcatggcgcggctctggcctgacacaggaacctggctccgtgggccagctggccctggcctgcgcagaaggggcagtggagtggttgtaccccgctggtgcactcaggctcactctgggcggtccagatccgagggccagacctggaatagcttgtttgcggccagtgcgacctttcgccggggcccaagtgttcgctgaaagggctgggggagcactggagttactgcttgccgaaggtccagggcctgccgggggcagatgcgttagatggggaccacgagaacgccgcgccctgtttcttcaggcaaccccccatcaggatattagccgaagagtcgcggcgtttagattcgaactacgggaagatggacgccccgagttacctccccaggcgcacggcctgggggtagacggtgcctgccggccctgctctgacgcagagctgttattggcggcatgtacctcagacttcgttattcacggtatcatccatggtgtaacccacgacgttgagctccaagaatccgtaatcaccgtggtggcggcccgggtgctgcgccaaacacccccactgttccaagcaggcagatccggtgatcagggtctcacaagtattcggacccctctcagatgcggagtgcaccccggtcccggaacttttctctttatggggtggtcaaggttcggggaggcacggctaggctgcgctccaaggtttcaggagttcaggcgggcctatgaggccgcgcgcgccgcacatctccatccctgtgaggtggccctccac

SEQ ID NO: 16651 - DNA, 879 bp, Artificial Sequence
  Description of Artificial Sequence: Synthetic coding sequence
atgggattcccagctgcagcacttctttgcgctctttgctgcgggttgttagcacctgcagcccgtgcaggatattccgaggagcgatgttcttggcgaggttctgggctgacacaagagccaggatccgtaggacagttagctctcgcatgcgcggagggtgccgtggagtggctttacccggctggcgcattgcgtttgactcttggaggaccggatccaagagcacgcccaggtattgcttgccttcgaccagtcagaccatttgcaggcgctcaagttttcgcagagcgagcgggaggagctctcgagctcctattggcagaaggaccaggaccagcgggaggccgttgcgttagatggggacctcgcgagagacgcgctttattcctccaagctactccacatcaagatatctcacgaagagttgccgcgttccgattcgaacttcgtgaagatggtcgaccagagttgccacctcaagctcatggcctcggagttgatggagcgtgtcgtccttgttcagacgctgagctcttgcttgcagcatgtacgtcagatttcgtcattcacggaattattcacggggttactcatgatgtcgaactgcaggaatctgttattacagtggttgcagctcgggttctacgtcagacgccaccacttttccaggcgggtcgaagtggggaccaaggattgacgagtattagaactccattacgatgtggagtgcacccgggaccgggaactttccttttcatgggttggagtcggttcggggaggcaagacttggatgtgcaccaagattccaagaattccgtagagcctacgaggcagcacgtgctgcacatctgcatccatgcgaggtagcgttgcat

SEQ ID NO: 16652 - DNA, 879 bp, Artificial Sequence
  Description of Artificial Sequence: Synthetic coding sequence
atgggcttcccggccgcggccctgctgtgcgctctctgctgcggactgctggccccggcggccagagcaggctactcggaggaaaggtgcagctggcgcggctcgggtctgacccaggagcctggatccgtcggccagctcgcactcgcgtgtgccgaaggcgccgtcgagtggctgtaccctgctggagcccttcgactcacccttgggggcccagatcctcgcgcccggcctggaattgcctgtctcagaccggtaagaccctttgccggagctcaggtttttgctgaacgcgcaggaggggccctggagcttttgctggcagaaggcccaggcccagcaggaggaagatgcgtgcggtgggggccgcgagaaaggcgggccctcttcctgcaagcgaccccgcaccaggacatctcccgccgggtcgccgctttcagattcgaactccgcgaggacggacggccggagctgccacctcaggcccatggactcggagtggatggcgcctgtagaccctgttccgacgctgagttgctcctggcagcctgcaccagcgacttcgtcatccatggaatcatccatggagtgacccacgacgtcgaacttcaagaatccgtgatcactgtggtggccgcacgggtgttgaggcagactccacctctgtttcaggctggtcgctcgggagatcagggactgacctcgatccggactcccctccgctgcggcgtgcatccgggccccggtaccttcctcttcatggggtggtcaaggttcggagaagctcgcctcggatgcgcccctcgctttcaagagttccgacgcgcctacgaagctgctcgcgctgcccacctgcatccatgcgaagtcgccctccac

SEQ ID NO: 16653 - DNA, 2250 bp, Artificial Sequence
  Description of Artificial Sequence: Synthetic coding sequence
atgctccgagcaaaaaatcagctattcttgctctccccccattatctgagacaggtgaaagaatcctcgggctctcgactcatacagcagagactgttacaccagcaacaaccactgcaccccgaatgggctgccctggccaaaaagcagctcaaaggcaagaacccagaggacctcatctggcatactccggagggaatcagtattaaaccattgtatagcaaacgcgatacaatggacttgcccgaagagctgcccggggtgaagccattcactaggggaccttatcctacaatgtatacgtttagaccgtggacaatccgacagtatgcgggtttctcaacggtggaagaaagtaataagttttacaaggacaatatcaaagcgggtcagcaaggcctttctgtggcattcgatctggcaacacatcgaggctacgatagcgataacccccgggtgcgcggtgatgtgggtatggccggcgtggctatagatactgtggaggacaccaagatcctcttcgatggaattcccctcgaaaaaatgtctgtgtccatgaccatgaacggagccgtgattccagtgcttgccaattttatagttactggtgaggaacaaggggttcccaaggagaagctgactggcacaatccagaatgacattctgaaagagttcatggttagaaacacttacatttttccgccggaacctagcatgaagatcattgcagacatctttgaatatactgcaaagcatatgccaaaatttaacagcattagcatatctggctaccacatgcaagaggctggagcagacgccattctggaactggcgtatacacttgctgatggcttggaatacagccgaacgggcttgcaggccggcctcacaattgatgagttcgcccctcgcctatctttcttctggggaatagggatgaatttttatatggagattgccaaaatgagagccggaagacggctttgggctcacctgattgaaaagatgttccagcctaaaaatagcaagagtctacttttgcgagcacattgtcagacttccgggtggtcactgaccgagcaggatccctataataacatcgtgagaaccgccatcgaagcgatggcggcagtatttggtgggacccagtcactgcacaccaactcctttgatgaagcgttgggcctgccgaccgtgaagagcgctcgaatagcacgaaatacacaaatcattatccaggaagagtctggcattcccaaggtggccgatccatggggcgggtcgtatatgatggagtgtcttacaaacgacgtgtacgacgccgctttgaagctgatcaacgaaattgaagaaatgggcggcatggccaaagcagtcgcggaggggatccccaagttacgaatcgaagaatgcgccgctaggcgacaggcaaggatcgatagcggcagtgaagtgattgtgggcgttaataaatatcagttggaaaaggaggatgcagttgaagtcctggccatagacaatacttcagtgcgaaatcgccaaatcgagaagctcaaaaaaataaagagcagtagagaccaggcgcttgccgagcgatgtttggctgctctgacggaatgcgcggcctcgggagacgggaacattttggccctcgctgttgacgccagccgagcacgatgcacagtgggggaaatcaccgacgctctgaagaaagttttcggagagcacaaggctaatgatcgaatggtgagcggggcctatcgacaggaatttggggaaagcaaggaaattaccagtgcaataaaacgtgtgcataaatttatggagagagaggggaggcgacccaggcttctggtggccaagatgggacaggatggccacgacagaggtgcgaaagtaatcgctacagggtttgcagatctgggtttcgatgtcgatattggaccgctgtttcaaactcctcgagaggtggcgcaacaggctgtagatgctgatgtacacgcagtggggatctccaccttagctgctggccacaagacattggtccccgagctaattaaagagttgaattctctcgggaggcccgacattcttgtgatgtgtggcggagtaatcccaccccaggattatgagtttctgttcgaagttggtgtttctaatgtctttggacctgggacccgaatcccaaaggcagccgtgcaggtattggacgatatcgagaagtgtttggaaaagaaacagcagagcgtc

SEQ ID NO: 16654 - DNA, 2250 bp, Artificial Sequence
  Description of Artificial Sequence: Synthetic coding sequence
atgctgcgggctaagaaccaattgtttttgctgtccccacactacctgcgccaggtcaaggaatcgtcaggtagccgcctgatccagcaacggctcctccatcagcaacaaccgcttcacccggaatgggctgcccttgcgaagaagcaactgaaaggcaagaatcctgaagatttgatttggcacactcctgagggaatctcgatcaagccgttgtactccaagcgagacactatggacctcccggaagaactcccgggtgtgaagccgttcactcgcggcccgtacccgacgatgtacaccttccgcccatggaccattcggcagtacgctggcttctcgaccgtcgaggagtccaacaagttttacaaggacaacatcaaggctgggcagcagggcctctccgtggcgttcgacctggccacccatagaggatatgattcggacaacccgagggtgcggggtgatgtgggaatggctggtgtggcgattgacacggtggaggacaccaaaattctgttcgatggaatccctctcgagaagatgagcgtgtcgatgaccatgaacggagcagtgatccccgtgctggcaaacttcatcgttaccggggaggaacaaggagtgccgaaggagaaactgacgggaactatccaaaatgacatcctgaaagagtttatggtccgcaacacgtacatctttcccccggaaccgagcatgaagatcatagctgacatcttcgaatacaccgccaagcatatgcccaagtttaactcgatctctatctctggataccacatgcaggaagcgggcgcggacgccattctggaactggcatacaccctcgcggacggactggagtactcgagaaccggtctgcaggcaggattgactattgacgagttcgcccctcgcctgtcgttcttttggggaatcggcatgaacttctacatggaaatcgcaaagatgcgtgcaggacgccgcctgtgggctcacctgatcgaaaagatgtttcaaccgaagaacagcaagtctctgcttttgagagcgcattgtcaaacttccggctggtcgctgactgagcaagacccttacaacaacatcgtgagaacggccatcgaagcgatggccgcggtgttcggaggaactcagagcctgcacactaactccttcgatgaagcactcgggctcccgaccgtgaaaagcgccaggatcgccagaaatactcagatcattatccaggaggagagcggaatcccgaaggtcgccgacccttggggaggatcctacatgatggaatgtctgaccaacgacgtgtatgatgcagccctgaagctgatcaacgagatcgaggagatgggaggtatggccaaggcggtggccgagggcattcctaagctccgcatcgaggaatgcgcggcgcggcgccaggccaggatcgattccggctcggaggtgatcgtgggagtcaacaaataccagctcgagaaagaggacgcggtcgaagtgttggccattgacaatacttcagtgaggaaccgccagatcgagaagctgaagaaaatcaaatcatcaagagatcaggctctcgcagaaagatgtcttgcagccctgactgagtgcgccgcgtcaggcgacggaaatatcctcgcgctcgcggtggatgcgtcacgcgcccggtgcaccgtcggagaaatcactgatgccctgaagaaggtgttcggagagcataaggcaaacgaccggatggtatcaggagcctaccgccaggagtttggcgagtctaaggagattacttcggctattaagcgcgtgcacaagtttatggaacgggaaggacgccgcccgagactgctggtcgcaaagatgggacaggatggccacgatagaggagccaaagtgattgccactggattcgcggatctgggattcgatgtggacatcggacctctgttccaaacgcctcgggaagtggcgcaacaggccgttgacgcggacgtgcacgcggtgggaatctccaccctggcggccgggcacaaaacccttgtgccggaactcatcaaagaattgaacagcctcggacgcccggatatccttgtgatgtgtggcggcgtgatccccccgcaggactacgagttcctctttgaagtgggcgtctcgaacgtctttggaccgggaacccggatcccaaaggctgcggtgcaggtgctcgatgacatcgagaagtgccttgagaagaagcagcagtcagtc

SEQ ID NO: 16655 - DNA, 2250 bp, Artificial Sequence
  Description of Artificial Sequence: Synthetic coding sequence
atgcttcgggcaaagaatcaactttttcttctttcccctcattacctccgtcaggtgaaggaatcgtcggggtcaaggcttattcagcagcgcctccttcatcagcagcagcctttgcatccagaatgggccgcactcgctaagaaacaactgaaggggaagaatcccgaagatttgatttggcatactcctgagggcatatcgattaagcctctgtacagcaagcgggacactatggacctgcctgaggaactcccgggtgtgaaaccattcactaggggaccttacccaaccatgtacaccttcaggccctggaccatccggcagtacgcaggattctcgaccgtcgaggaatccaacaagttttacaaggataacatcaaggcagggcagcagggcctgtcggtggcattcgatttggcgacccatcgaggatacgactcggacaacccaagagtcagaggcgacgtgggaatggccggcgtcgcaatcgacacggtggaggatactaagattctctttgatggaatcccactggagaaaatgtccgtgtcgatgaccatgaacggagcagtgatcccggtgcttgcaaactttattgtgactggagaagagcagggagtccccaaggaaaagttgaccggaacgatacagaatgacatcctgaaggagtttatggtgaggaacacttacatatttcccccggaaccatcgatgaagattatcgcggatatctttgagtacacggccaagcacatgccaaagttcaattcgatcagcatctctgggtaccatatgcaggaagcaggagcggacgccattctggaactcgcatacactcttgccgatgggctggaatactcgaggactggactgcaagcaggacttactatcgatgagttcgcacctcgcctgtcgtttttctggggaattggcatgaacttttacatggaaatcgcaaaaatgagagccgggcgccgcctgtgggcacatcttattgagaaaatgttccagccaaagaattcaaagagcctgcttcttagggcacactgccaaacttcaggatggtcgctgactgaacaggacccatacaataacattgtccgcaccgcaatcgaagcaatggcagcggtgtttggtggtacccagtccctgcacaccaattcctttgatgaggccctcggtctgcccaccgtgaagtccgcgagaatcgcaagaaacacgcagatcattatacaagaagaaagcggtattcctaaggtggccgacccttggggaggatcatacatgatggaatgcctgaccaatgacgtctacgatgccgcgctcaagctgattaacgagatcgaagaaatgggaggaatggcaaaggcagtggccgaggggattccgaaacttagaatcgaagaatgtgcagcacggcgtcaagctcggatcgactcggggtcagaggtcatcgtgggagtgaacaagtaccagctggaaaaggaggatgcagtggaagtgctggctattgacaatacttcagtgagaaaccgccagatagagaagctgaagaagatcaaaagttcccgtgatcaggcactcgccgaaagatgtctggccgcactgaccgagtgtgcagcatcgggagatggaaacattctcgcactggcagttgatgctagcagagctcgatgcactgtgggggaaattaccgatgcgcttaagaaggtgttcggcgagcataaggcaaacgataggatggtgtccggcgcgtaccgacaagaatttggagaatcgaaagaaatcacgtccgcgattaagcgggttcataagttcatggaaagagagggtcggcgccctcggctgctggtggcaaaaatgggtcaggatggccacgataggggcgcaaaagtgattgcaaccggatttgctgatctcggctttgatgtcgatattggacctctttttcagaccccaagggaagtggcacaacaggcagtggatgctgatgtgcatgctgtgggaatttcaactctggcagctgggcataaaaccctcgtccccgagctgatcaaagagctgaactccctgggacgtccagatattcttgtgatgtgtggaggggtgattcctcctcaagattacgagtttttgtttgaggtgggtgtgtccaacgtgtttggccctggtacccgtatccctaaagcagcagtccaagtcctggacgatattgagaaatgcttggaaaagaaacaacagtcagtc

SEQ ID NO: 16656 - DNA, 2250 bp, Artificial Sequence
  Description of Artificial Sequence: Synthetic coding sequence
atgctgagagctaaaaaccagctctttctgctctcccctcattacctgcgccaggtcaaggagtcttctggctcacgcctcatccagcaaaggctgctgcaccagcaacagcctctccaccctgagtgggccgctttggccaaaaaacagctgaaggggaagaatcctgaagatcttatctggcacactccagaaggtatatctatcaagcctctgtactcaaaaagagataccatggatcttccggaggagttgcccggggtgaagccattcacccgaggcccttacccgacgatgtacaccttcagaccctggactatcaggcagtacgccggcttcagtacagtagaagaatcaaataaattttataaagacaatatcaaagccgggcaacagggactgtccgtcgctttcgacctggcaacgcaccgcgggtatgatagcgataaccctcgggttagaggtgacgtgggcatggccggagtggccattgacacagtcgaggacactaaaattctgttcgatggcatacccctggaaaaaatgagcgtctcaatgacgatgaacggagccgtgattcctgtcttggctaactttatcgtgacaggagaggaacaaggggttccaaaggagaaattgacgggaaccatccagaacgacatcctcaaggagtttatggtaagaaatacttacatcttccctcctgagccctcaatgaagatcatagccgatatcttcgagtacactgctaaacatatgccaaagtttaattccatctccatctctggctatcatatgcaggaggctggagctgacgccatcctggaactcgcgtataccctggcagacggcctggagtacagtcgcactggcctccaggccggattgacaatagacgagttcgctccgcgactgtcttttttctgggggatcggcatgaatttttacatggagatagctaagatgcgggctgggcgcagactttgggctcatctcatcgagaaaatgttccagcctaaaaactctaaatcacttctgcttcgggcacattgccaaacatccggttggtcactgacggaacaggacccgtacaacaacatcgtgcgaactgcaatcgaagcaatggccgccgtgttcggtggaacacagtcactgcataccaattcttttgacgaagctctcggcttgcccacagtaaaaagcgcccggatcgctcggaatacgcagatcatcatccaggaggagtctggcattcctaaagtcgctgacccatggggggggagttacatgatggagtgcttgacaaacgatgtgtatgacgccgccctcaaacttataaatgagatcgaggaaatgggcggcatggctaaggccgtggcggagggcattcccaagctgcgaattgaggaatgcgcggcccggaggcaggccaggatcgatagcgggtctgaggttatcgtgggggtgaataagtatcagctggagaaggaagatgccgtcgaagtgctggccatcgacaacacctctgtgaggaacagacagattgaaaaactcaaaaagatcaagagctcacgagaccaggcgcttgcggaacgatgcctggcggccctcaccgagtgtgctgccagcggggacggaaacatcctcgctctcgctgtggatgcgtctagagctcgctgtaccgttggcgaaatcacagacgcactgaagaaagtcttcggagagcacaaagctaatgatcggatggtaagtggcgcttataggcaggaattcggggagtccaaagagataacatcagcgatcaagcgggtacataagttcatggagcgcgaaggcaggaggccacgactcctcgttgccaagatgggccaggatggtcatgacaggggggccaaagtcattgccaccggtttcgctgatctgggtttcgacgtggacatcggacctcttttccaaacccctagagaggtcgcacagcaagcggtcgatgctgatgtccacgccgtcggcatctccactttggctgcgggccacaaaactctggtgccggagttgatcaaagaactgaactccctgggcagaccagatatcctggtgatgtgtgggggagtgataccaccgcaagactacgagttcctgtttgaggtaggtgtcagtaatgtctttggcccagggactaggatcccaaaggccgccgtccaagtcctcgacgatatagaaaaatgcctggaaaaaaagcagcagtcagtg

SEQ ID NO: 16657 - DNA, 2250 bp, Artificial Sequence
  Description of Artificial Sequence: Synthetic coding sequence
atgctgagggccaagaaccagctgtttttgctgagcccgcactacttgcggcaggtgaaggaatcgtcaggatcaaggctgattcagcagcgcctcctccatcagcagcaaccgctccatccggaatgggccgcgctggcgaagaagcaactgaaaggaaaaaacccagaagatcttatttggcacacccccgaaggtattagcatcaagccactgtactccaagcgcgacaccatggacctgccggaagagcttcctggtgtcaagccctttacccggggcccgtacccaaccatgtacactttccggccatggactatcaggcaatacgcgggattctccaccgtggaggaatctaataagttttacaaggacaacatcaaagcgggtcaacaggggctctccgtggccttcgaccttgcgacgcaccggggatacgactccgataatccgcgcgtgcgcggagatgtcggaatggcaggagtcgccatcgacactgtcgaagatactaagatcctcttcgacggaatcccgctcgagaagatgtcggtgtctatgactatgaatggagctgtgatcccagtgctggcgaactttattgtgactggtgaggaacagggagtgcctaaagagaaacttaccggaaccattcagaacgacatcctgaaggagttcatggtcagaaacacgtacatcttcccaccggagccctcaatgaagatcatcgcagacatctttgagtacaccgcgaagcatatgccgaaattcaactcaatctcaatctcgggataccatatgcaggaagccggcgccgatgccatcttggaattggcttatacgctggccgacggactcgaatactcgcgcactggacttcaggcaggcctcaccatcgacgagttcgcccctcggttgagctttttctggggtatcgggatgaacttctacatggaaatcgccaagatgcgcgcaggacggcgcctgtgggctcacctgattgagaaaatgttccaacccaagaattccaagtccctcttgctcagggctcactgtcagacgtcgggatggtcgttgactgagcaggacccgtacaataacatcgttcggactgccatcgaagccatggctgccgtgttcggcggaacccagagcctccacactaactcatttgacgaagcgctgggactgccgactgtcaagtcagccagaatcgctcggaacacccagatcatcatccaagaagagtcaggaatcccgaaagtcgccgatccatggggaggctcctacatgatggaatgcctgacgaacgacgtctacgatgccgctctcaagttgatcaatgagatcgaggaaatgggaggaatggctaaagccgtggccgagggcatcccgaagctccggatcgaagaatgcgccgcgagacgacaggctaggattgactcgggctcagaggtcatcgtcggagtcaacaaataccagctggaaaaagaagatgctgtcgaggttctggccatcgacaacacctccgtcagaaacagacagatcgagaagctgaagaaaatcaagtcaagcagagatcaagccctggctgagcgttgccttgcagccctcaccgaatgcgctgcgtctggagacgggaatatccttgccctcgcggtcgacgcttcccgggcgcggtgtaccgtgggcgagataacggacgccctgaaaaaggtgtttggagaacacaaggctaacgaccgcatggtgagcggagcttaccgccaagaatttggagaaagcaaggaaattacttcggccatcaagagagtgcataagttcatggagcgcgaaggccgcagacctcggctcctggtcgcaaagatgggccaggacggccacgatcggggagctaaggtgatcgcaaccggattcgccgacctgggattcgacgtggacatcggaccactgttccaaacgccgcgagaagtggcgcaacaagctgtggacgcggacgtgcatgccgtgggtatctcaaccctcgctgccggacacaagaccctggtcccggaactgatcaaggaactgaacagcctgggacgcccggatattctggtgatgtgcggaggagtgatacccccgcaagactacgagttcctcttcgaggtgggagtcagcaatgtctttgggccgggtactcgcatccctaaggcggccgtccaagtgctggacgatatcgagaagtgcctggaaaagaagcagcagtccgtg

SEQ ID NO: 16658 - DNA, 2250 bp, Artificial Sequence
  Description of Artificial Sequence: Synthetic coding sequence
atgctcagggctaagaatcagctgttcctgctgtctccccactatctgagacaggtgaaagagagctcagggagcagactcatccagcagagactcctacaccagcagcaacccctgcaccccgaatgggcagctctggcaaaaaaacaactcaagggtaagaatccggaggatctcatatggcacactccagaagggattagcattaagcccctgtacagtaaacgagatactatggacctcccagaagaactgcccggggtcaagccttttacccggggaccatacccaacaatgtatacatttcgaccttggacaattcggcagtacgctggattctccaccgtagaagagtctaacaaattctacaaagacaacataaaagccggtcagcagggattgagcgtggctttcgaccttgccacccacagaggatatgattctgataaccctagagtccggggtgacgtgggcatggccggagtcgcaatagacacagtcgaagacaccaagatattgtttgatggcatcccattggagaagatgtctgtatctatgaccatgaacggggctgtaattcctgtcctggccaacttcatcgttacaggagaggagcagggtgtgcccaaggagaaactgactgggacaatccagaatgatattttgaaggagtttatggtccggaatacttacatttttcctccagagccatcaatgaaaataattgctgacatattcgagtatacagctaaacacatgccaaagtttaacagtatatcgatcagcggatatcacatgcaggaggctggcgctgacgccattcttgagttggcctatacgctcgccgacgggctggaatacagccggactggcctccaagcagggctgaccatcgacgaatttgccccacgtctttcctttttctggggcatcggaatgaacttttatatggagatcgctaaaatgcgcgccgggcggaggctgtgggcccacctgattgagaagatgttccagcctaagaatagcaaaagcctgcttctaagagctcactgtcaaacttccggctggagcctgacggaacaggatccttacaacaatatagttaggacagcgattgaggcgatggccgcagtgtttggcggtactcagtctctccacacaaatagcttcgatgaggcacttggactgcctactgtcaagtctgcacggatcgctagaaatacccagatcatcatccaagaagagagcggcatccccaaggttgctgacccctggggaggctcctacatgatggagtgcctgaccaacgacgtgtacgatgccgcactcaagctcattaatgagatcgaggaaatgggggggatggcgaaggccgtggctgaaggcatacccaagcttcgtatcgaggagtgcgccgctcgtcgtcaggcacggatcgatagcgggagcgaagtcattgttggcgtgaacaaatatcagctggagaaggaagatgcagtggaagtactggccatcgataatacttccgtccgaaatcgccagattgaaaaactgaagaagattaagtcatcacgtgaccaagcactagccgaacgttgtttggcggccctgacagaatgtgcggcttccggtgacgggaatattctagccctagccgtggacgccagccgagcccggtgtaccgttggcgaaatcaccgatgcactgaaaaaagtctttggcgagcataaagccaacgatcggatggttagtggtgcgtaccgacaagagttcggcgagagtaaggagataacatctgctattaagagggttcataaatttatggagagggagggccggaggccacgcctcctcgtcgcaaagatggggcaggacggtcatgaccggggggcgaaggttattgccaccggcttcgcagatctgggctttgacgtagatattggtccacttttccagaccccccgagaagtcgctcagcaggccgtggacgccgacgtccatgcagtggggatttccactttggctgcgggacacaagactctggtcccggaactcatcaaggagctcaattcactcgggcgacccgatatcctggtaatgtgcgggggagttatccccccgcaggattatgaattcctgtttgaggtgggcgtctctaacgtgtttggccctggaacaaggatccccaaagcagcagtccaggtgctggacgacatcgaaaagtgtctggaaaagaagcagcagtcggtg

SEQ ID NO: 16659 - DNA, 2250 bp, Artificial Sequence
  Description of Artificial Sequence: Synthetic coding sequence
atgctgagagctaaaaaccaacttttcttgctttccccacattatcttcggcaagtgaaggaaagctcgggttcgagattgattcaacaacgacttctgcaccagcaacaacccctccatcctgaatgggccgcccttgctaaaaagcagcttaagggaaagaatccagaggatctgatttggcatactccagaaggcataagcatcaaacctctttactcaaagagggataccatggatctccctgaagaacttccaggcgtgaagccattcacgcggggtccttaccctactatgtacacgttcagaccttggaccattcggcaatacgccggattttctactgtcgaagaatcaaataagttctacaaagacaacattaaagcaggtcagcagggactctcggtggcctttgacctggccacccatcggggatacgatagcgataatccaagagtgaggggagacgtgggaatggctggggtcgcaatcgatactgtcgaggatactaagatcttgttcgacgggatacctttggagaaaatgtcggtgagcatgaccatgaacggagcggtgatccctgtcttggcaaactttattgtcactggagaagagcagggagtccctaaggaaaagctcaccggaactattcagaacgatatacttaaagagtttatggtcagaaacacttacatctttcctcccgaacctagcatgaagataattgctgatatctttgaatacactgccaagcacatgccgaagtttaactcaatcagcatcagcggctaccatatgcaagaggccggtgcagatgcaattctcgaactggcttacacccttgcagatggtctggagtactctcggactggccttcaagccggccttaccatagacgagttcgcaccgaggctctcgttcttttggggaataggaatgaatttctacatggaaatcgcaaagatgagagctggacgcagactgtgggcacatcttatcgagaagatgtttcagccaaagaattccaaatcgcttctgctccgggcccactgtcaaacgagcggttggtcgcttaccgagcaggatccatacaacaatatcgtcagaacggccattgaagccatggcagccgtctttggcggaacccagagccttcatacgaactcctttgatgaggcacttggactccctaccgttaaatcggccagaatagcacgtaatacccagataatcattcaggaagaatccggcatccctaaggtcgccgatccctggggtggatcatacatgatggagtgtctcaccaatgatgtgtatgacgcggcactcaagctcattaacgaaatagaagaaatgggaggcatggcgaaggcagtggcagaaggcatacccaaactcagaattgaagaatgtgcggcacgtaggcaggcacgaatagattcgggatccgaagtgatcgttggagtgaataagtaccagctggaaaaggaggatgcggtggaggtcctggctatagataacacttcggtgcggaacagacagatcgaaaagctgaagaagattaagtcgtccagagatcaagccctggcagagaggtgtcttgcagcacttaccgagtgtgcagcatcaggtgatgggaacatcttggcacttgcagtcgacgcatccagggcacgatgcactgtgggggaaatcaccgacgcattgaagaaagtgtttggtgaacacaaggcaaatgaccggatggtgtccggggcgtaccgacaagagtttggagaatcgaaagagattacctcggcaattaagagagtgcataagtttatggaacgcgaagggcgcagaccgcggttgctcgttgctaagatgggacaagatggccacgatcgaggtgcgaaagtcattgcgactggatttgcagacttgggattcgacgttgacatcggccccctctttcagactcccagagaggtcgcacagcaggcagtggatgcagatgtgcacgcagtgggtattagcactcttgcggcaggacataaaactcttgtccctgaactgattaaagagctgaattcattgggtcgcccggatattctcgttatgtgtggcggagtcatcccacctcaagactatgagtttctgtttgaggtgggagtctctaacgtctttggaccgggcactcgaatccccaaagcagccgtgcaggtccttgatgacattgaaaagtgccttgagaaaaagcaacaatcagtc

SEQ ID NO: 16660 - DNA, 2250 bp, Artificial Sequence
  Description of Artificial Sequence: Synthetic coding sequence
atgctgagagccaagaatcagctcttcttgctctccccgcattaccttcgccaagtgaaagaatcctccggaagcaggttgatccaacaaagacttctccaccagcagcagccactgcacccagaatgggcggccctggccaaaaaacagctgaagggaaaaaaccctgaagatctcatctggcacactccagagggaatctcaatcaagcctctttactccaagcgcgacactatggacctgccggaagagctgccgggtgtgaagccattcacgagaggcccgtacccaacgatgtatacctttcgcccatggactatccggcaatacgctggattttccaccgtcgaagagagcaacaaattctataaagacaacatcaaggccggacagcagggactgtctgtggctttcgacctggctacccatcggggttacgacagcgacaacccgcgcgtgcggggtgacgtgggcatggcaggagtcgccatcgacaccgttgaggatacgaagatcctctttgacggaatcccgctggaaaagatgtcggtcagtatgactatgaatggagcggtgatcccggtgctcgcaaactttattgtgacgggagaagagcagggagtcccgaaggagaagctcaccggaacgatccaaaacgacatccttaaggagtttatggtgcggaacacctacattttcccgcccgagccgtcgatgaagattatcgcggatatcttcgaatacaccgcaaaacacatgccgaagttcaatagcatctcaatctcggggtaccacatgcaagaagcgggagccgacgcaattctggaattggcctacaccctggcagatggtcttgaatactccaggaccgggctgcaggcaggactcaccatcgatgaattcgccccacgcctgtctttcttttggggcattgggatgaatttctacatggagatcgcaaaaatgcgcgccggacggcgtctctgggcgcatctcatcgagaagatgttccaaccgaagaattccaaatcgctgctgctgcgagcacactgccaaacctcgggatggtccttgaccgaacaagacccttacaacaacatcgtgagaactgccatcgaggccatggccgcagtgtttggaggaactcagtcactgcatactaacagcttcgacgaagccttgggccttccgactgtgaaatcggcccggatcgcacgcaacacccagattatcatccaggaggaatcgggaattccgaaagtagccgacccctggggaggctcctacatgatggagtgtctcactaacgatgtgtacgacgccgcgctcaagctcatcaacgagatcgaggaaatggggggaatggccaaagcggtggccgaagggatcccaaaattgcgcatcgaagagtgcgccgcgagaaggcaggcaagaattgattcaggatcagaggtcattgtcggagtgaacaagtaccagctcgaaaaggaggacgccgtggaagtgcttgcaattgacaacacttcggtgcgcaaccgtcagatcgagaagttgaagaaaatcaagtcgagccgcgatcaggcgctggctgaaagatgcctcgccgccctgaccgagtgcgctgcctccggtgacggaaacattctggcgctcgctgtggacgcctccagagcccggtgcacggtgggggaaatcactgacgctctcaagaaggtgttcggagaacataaggctaatgaccgcatggtgtcgggagcctacagacaagagttcggtgagtcaaaagaaatcactagcgcgatcaaacgcgtgcacaagttcatggagcgagagggaagaaggcctcggctgctggtcgccaaaatgggtcaggatggacacgaccgcggagcgaaagtcatcgcgaccggcttcgctgacctgggattcgatgtggatatcggcccactgttccagacgcctcgcgaagtcgcccaacaggccgtcgatgccgatgtgcatgcagtgggaatcagcactctggctgcgggtcataaaacgctggttccagagctgatcaaggaactgaactccctgggacgcccagacatcctggtgatgtgcggcggtgtgatcccgccacaggattacgaattcctgttcgaagttggagtctccaacgtgttcggcccagggacccggattccaaaggccgctgtccaggtcctggacgacatcgaaaaatgtctggaaaagaaacagcagtcagtg

SEQ ID NO: 16661 - DNA, 2250 bp, Artificial Sequence
  Description of Artificial Sequence: Synthetic coding sequence
atgttgagagcgaaaaatcaactgttccttctgagcccacattacctgagacaggtgaaagagagctcaggatcacgccttatccagcaaagactcctccaccagcagcaacctctccatcctgagtgggcagctctggccaagaagcagcttaagggaaagaaccctgaggacctgatatggcatacgccggaaggaatctcaattaagccgctgtacagtaaacgggatactatggatctgcccgaggaattgcccggagtgaagccgttcacccgcggtccttaccccactatgtacactttccgcccgtggaccatccggcaatatgcagggttctccactgtcgaagaatctaacaagttctacaaggataacatcaaggccgggcaacagggcctgagcgtggcgtttgacctggctactcatagaggctacgactcagataacccgcgagtgaggggagacgtcggtatggcaggcgtggcaatcgacacggtggaggacaccaagatccttttcgatggaatcccgctggaaaagatgtccgtgagcatgacgatgaacggggctgtgatcccggtactggcaaacttcatcgtcacgggagaagagcaaggagtccctaaagagaaactgactggaacgatccaaaatgatatcctgaaggaattcatggtgcggaacacttacattttcccaccagagccatccatgaaaatcattgcggatatcttcgagtacactgcgaaacatatgccaaagttcaattcaatctcaatctcgggttaccatatgcaggaggcgggggcggatgccatactcgaacttgcctacaccttggcggatgggctcgaatacagccggactggactccaggcaggccttaccatcgatgaattcgccccgcggctttctttcttttggggcattgggatgaacttttacatggagatcgccaaaatgcgcgctgggcgcaggctgtgggcccatcttatcgaaaagatgttccaaccgaagaatagcaagagcctgctcttgagagcccattgtcagacctcgggttggtcactgactgaacaagatccatataacaacatcgtcagaactgcaatcgaggcaatggccgcggtgttcggtggaacccagtcacttcacaccaacagctttgacgaggccttgggcctcccaacggtgaaatcggcgcggatcgctcggaatacgcagatcatcatccaggaggagagcggaatcccgaaggttgcggacccttggggaggatcatacatgatggaatgcctgaccaatgacgtgtacgatgctgcgctgaaactcatcaatgagattgaggaaatgggaggtatggccaaggctgtcgcggaaggcattcctaaactccgcattgaagaatgtgcggcccggcggcaggccagaatcgattcgggaagcgaggtcatcgttggagtgaacaaataccagctggagaaggaggacgccgtggaggtgctggccattgataacacttcagtcagaaatagacagatcgagaagctgaagaagataaagtcatcgagggaccaagcgctggccgagcgctgcctcgccgctttgacggagtgcgcagcgagcggggacggcaatatcctggccctcgccgtggacgcctcgcgtgctagatgcactgtcggagaaatcaccgacgcgttgaaaaaggtgttcggcgagcacaaagcaaacgataggatggtgtctggtgcgtaccgacaggaatttggagaatcaaaggagatcacctcggccatcaagagagtgcacaaattcatggagagggaaggcaggaggccgcggctgctggtggccaagatgggtcaggacggacatgaccgcggagctaaggtgatcgcaaccggatttgccgatctcgggttcgacgtcgacattggaccgctctttcagacccctcgcgaagtggctcaacaggccgtcgatgcagatgtccacgcagtggggatttccactctcgccgcaggtcataaaacccttgtgccagagctcatcaaggagctcaattcgctgggcagacccgacatccttgtgatgtgcggaggggtgatcccgccgcaagattacgaatttctcttcgaagtgggagtgtccaacgtgttcggccctggaacccggatcccaaaggctgcagtgcaggtcctcgacgacattgaaaagtgcctggagaagaagcaacagtcggtg

SEQ ID NO: 16662 - DNA, 2250 bp, Artificial Sequence
  Description of Artificial Sequence: Synthetic coding sequence
atgctccgtgctaagaatcagctgttcctgttatcgcctcactacctcaggcaggtcaaagagtcaagcggctcgcggctgattcaacagcgactcctgcaccagcaacagcccctacacccggagtgggcagccctggctaagaagcaattaaaaggcaaaaacccggaggatctgatctggcacacacctgaagggatcagcattaagcctttgtattccaaaagagatacgatggacctgcctgaagagttacctggggtcaagccattcacaagaggcccatatcccaccatgtatacgttccgaccatggacaattaggcagtatgcggggttctccactgtggaggagagtaacaagttttataaggacaacattaaggccgggcagcaggggctgagcgtggcctttgacctggcgactcatagagggtatgatagcgataatccacgggtgagaggggatgtgggcatggcgggcgtagcaattgacaccgtggaggacactaaaattctgttcgatgggatacccctggagaagatgagcgtttccatgacaatgaatggggcggtcatcccggtgcttgccaacttcattgtcaccggagaggagcagggcgttcctaaagaaaagttaacaggaaccattcagaacgatattctaaaggagttcatggtgcggaacacctatattttcccgcccgagccgtccatgaagatcatagcagatatttttgagtatactgcgaagcatatgcccaaattcaactccatctcaataagcggttatcatatgcaggaggctggggcagatgccattctcgagctcgcctacacactggcggatggccttgaatactctaggaccggactgcaagccggcttgaccatcgatgagttcgcaccgagactgtcatttttttggggcatcggcatgaatttctacatggaaattgccaaaatgagagccggacgcagactgtgggcgcatttgatagagaaaatgttccagcctaaaaatagcaagtctcttcttctgcgcgcccattgccagaccagcggttggtcactaactgagcaggatccctataacaacatagtacggaccgccatagaagcaatggcggctgtatttggaggaacacagtccctccatactaattcattcgacgaggccctcggactgcccaccgtgaagagcgcccgcatcgcaaggaatacccagattatcatacaggaggaatccgggatccctaaagtggccgacccatggggaggctcttatatgatggaatgtctgacaaacgatgtctacgatgccgccctcaagcttatcaacgaaatcgaggagatgggcggcatggctaaggcggtcgctgaagggattcccaagcttcggatcgaagagtgcgctgcccggaggcaggccagaatagatagtgggagcgaggtgatcgtcggagtgaacaagtatcaacttgagaaagaagacgctgtggaagtgctggcaattgacaatacctctgtgagaaatcgacagattgagaaactcaagaagatcaagagttcgcgggaccaggcacttgctgagaggtgcttagcagctctgacagaatgtgcagcttccggagacggcaatattttggctctcgcagtcgatgcctctagggctcggtgcaccgtcggcgaaattacagatgcgctgaagaaagtgtttggagagcacaaggccaacgacagaatggtgtctggagcttacaggcaggagttcggagagtcaaaggaaatcacctccgccattaaacgtgtccataaattcatggaacgagagggcagacgaccgcggctgctcgtggccaagatgggccaagatggccatgacagaggtgccaaggtcatcgctacaggctttgcagatttggggttcgacgtcgacatcggacctctatttcagaccccccgagaagttgcacagcaggcggtcgacgccgacgttcacgctgtcgggatctctacattggcagctggccacaaaaccctggtgcccgagttgatcaaagaacttaacagcttggggaggcccgatattctagtgatgtgcgggggggtgattccccctcaagactacgagttcctgtttgaagtcggggtgtcaaatgtgtttggcccaggaacccgaattcccaaagccgcagtgcaggtcctggatgacatcgaaaagtgcctcgaaaaaaaacaacaatccgtg

SEQ ID NO: 16663 - DNA, 2250 bp, Artificial Sequence
  Description of Artificial Sequence: Synthetic coding sequence
atgcttagggccaagaaccaactgtttcttctctcgccgcattaccttcgccaggtcaaagaatcgtcaggatcccgactcatccagcagagacttctgcaccagcaacaacctcttcaccccgagtgggcagccctcgcaaagaaacaactgaaggggaaaaatcccgaggatttgatttggcataccccggagggtatctcaatcaagccactctactccaaacgcgacaccatggatctgccggaagagctgcccggagtgaaaccgtttacccggggaccttaccccactatgtacaccttccgcccttggacgatacgccaatatgcgggtttttctactgtcgaggaatcgaacaagttttacaaggacaacattaaggccgggcaacaagggctttcagtggcctttgatctcgcaacgcatcgcgggtacgatagcgataatccacgtgtgagaggtgatgtgggaatggctggtgtggcaattgacaccgtcgaagatactaagatactctttgacggaattccactggaaaagatgtcggttagtatgaccatgaacggagcagtcattccagtcctcgctaacttcattgtgactggtgaagagcaaggagtgcctaaggaaaaacttaccggaactattcaaaacgatatcttgaaggaattcatggtgcggaacacttacatattccctcctgagccttccatgaagatcattgcagacatattcgaatacactgccaagcatatgccgaagttcaactcgatctcgatatctggataccatatgcaggaagcaggcgccgatgcaatcctggaactggcatacactcttgcagatggtcttgaatactcccgaacgggattgcaggcaggcctgaccatcgatgagttcgcaccacgacttagtttcttttgggggatcggtatgaatttctatatggagatagcaaagatgcgggcaggtcggcgcctctgggcccacctgattgaaaagatgtttcagcccaagaatagtaagtcccttctgcttcgcgcacattgtcagacctcaggatggtcccttaccgaacaggacccatacaacaatatcgttagaactgcaattgaagcgatggcagcagtgtttggtggtactcagagcttgcacactaactcctttgatgaagcgcttggtctgccaactgtcaagtccgcgagaatcgcacggaacacccagattatcattcaagaagaatcggggattcccaaggtcgccgatccctggggagggagctacatgatggaatgcctgactaacgacgtgtacgacgccgcactgaagctcattaacgagattgaagaaatgggtggaatggccaaagcagtggcagaaggaataccgaaacttagaatcgaggagtgtgcagcccggagacaagcccggattgactcaggcagcgaggtgattgtgggagtgaacaaataccaactcgaaaaagaggacgcggtggaagtgttggccattgataatacctcggtccgaaataggcagattgaaaagctgaagaagatcaagtcctcaagggaccaagcgttggcagagcgctgcctggcagctctcaccgaatgtgcagcctcaggagatggaaacatacttgctcttgcggtggatgcatcaagagctagatgtacggtgggcgaaattaccgatgcacttaagaaagtgttcggtgaacataaagctaatgatcggatggtcagcggcgcttataggcaggaatttggagaatctaaggagatcactagcgcgataaagcgggtgcacaaattcatggagcgtgaagggcggaggcctagactgctggtggcgaaaatggggcaagatggacacgatcgcggtgccaaggtcattgcaaccggttttgcagatctgggatttgacgtcgatattggtccgctttttcagacgccccgagaagtggcccagcaagcggtagatgcggacgtccatgccgtaggaatctccactttggcagcaggacataaaacgctcgtcccagagcttatcaaggagcttaacagcttgggcaggccagacatcctcgtgatgtgtggcggggtgattccgcctcaagactacgagtttctgtttgaggtgggagtgtccaacgtctttgggcctgggactagaataccaaaggcagcggtgcaagtgcttgacgatatcgagaagtgcctggaaaagaagcagcaatccgtg

SEQ ID NO: 16664 - DNA, 2250 bp, Artificial Sequence
  Description of Artificial Sequence: Synthetic coding sequence
atgctgcgggccaaaaatcaactatttttgctgtcaccccattatctccggcaggtaaaggagagttcaggttcccgcctgattcagcagcgcctgcttcatcaacaacagccacttcaccccgagtgggccgcactcgctaaaaagcaactcaaggggaagaacccagaagacctgatttggcacacccctgagggcatttcaataaagcctctttacagcaaacgggatacaatggatctacctgaggagttgccaggagtgaagcccttcacacgagggccctaccctaccatgtacacctttagaccttggaccataaggcagtacgccggcttctctacagtggaggaaagcaacaagttttacaaggataatataaaggccggacagcagggactgtctgtggcatttgatcttgctacgcatcggggctacgatagcgacaatccacgcgtgagaggcgatgtgggcatggccggagtggcaatcgacaccgtagaggacacgaaaatcctgtttgacgggatcccactggagaagatgtctgtgagtatgactatgaacggggctgttatccctgtcttagccaacttcatagtgaccggagaagagcagggtgtgcctaaggagaagctgacaggcacaatccagaatgatatcctcaaagaatttatggttcgaaacacatacatcttccctcctgagccaagcatgaaaatcattgcggacatattcgagtacacagctaagcacatgcctaagttcaatagtatctctataagcggctatcacatgcaggaggctggagctgacgccatcttagagctagcttacaccttagctgacggtctcgaatactctcggactggcctgcaggccggcttgaccatagacgagtttgccccacgcctatcttttttttggggaataggcatgaatttctacatggagattgcaaagatgagagccggacgcagactttgggcgcatttgattgagaaaatgttccaacccaagaactccaaatccctcttgctgcgcgcgcactgccaaacctctggatggagcttgacagaacaggatccttataacaacatcgtcaggactgccatcgaagctatggccgcggtgttcggcggcacccaatcccttcacactaactccttcgatgaggctctcgggctgccaacagtcaaatctgctaggatcgcccgcaacacgcagataattattcaagaggagtcgggaattcccaaagtggctgatccctggggggggagctacatgatggagtgtctcactaatgatgtctacgatgccgctctgaaactgataaatgagatcgaggaaatgggaggtatggctaaggcggtagcagagggcatccctaaactgaggatcgaagagtgtgctgctcgcaggcaggctaggatagactcgggatccgaagttattgtcggggtgaacaaatatcagctggagaaggaagacgctgtggaagtgttggccatagacaatacatccgttcggaaccgccagatcgagaaactgaaaaagatcaaatccagcagagatcaggccctggctgagaggtgtctggcggcactgacagagtgcgcggcgagtggcgacgggaatattctcgctctggcagttgacgcttccagagcacgctgtactgtgggagagataacagatgcacttaaaaaggtattcggagagcacaaggcaaacgacaggatggtgtccggcgcgtacaggcaggaattcggcgaaagcaaggagatcacatccgcaataaaaagagtgcataagttcatggaacgggaaggtcgtcggcccagactgctggtagctaaaatgggccaagacggccatgaccgaggtgcaaaggtcattgccaccggctttgcagatctcggcttcgacgttgatatcgggccactgttccaaaccccacgcgaagtcgctcaacaggccgtggacgctgacgttcatgcagtgggcatttctacgctggcagcaggccacaaaaccctagtgcccgaactgatcaaagaattgaacagcctagggcggccagatattttggtcatgtgcgggggagtcatcccacctcaggactacgaattcttatttgaagttggcgtctcaaacgtctttggtcctggcacacgcattcctaaggctgcagtacaggtgctcgacgacatcgagaaatgcctggagaaaaagcagcagtctgtg

SEQ ID NO: 16665 - DNA, 2250 bp, Artificial Sequence
  Description of Artificial Sequence: Synthetic coding sequence
atgctccgtgcaaagaaccagttatttctgctgtcgccccattatctgaggcaagtcaaggaaagttcaggctcccgactcatacagcagcggctcttacatcagcagcagccgttgcaccccgagtgggcagcactggccaagaaacagctgaaggggaaaaaccccgaagatctgatctggcacactcctgagggcatttctataaaaccactgtactcaaagcgggatactatggacctgcctgaagaactaccaggagtgaaaccattcactagagggccctatccgactatgtacacttttagaccatggactatacggcaatacgctggattctcaaccgtagaggaatctaataaattttataaggataacatcaaagcaggacaacagggactatccgttgctttcgatctggccacacatcgaggctacgattctgataatcctagagttcgaggggatgttgggatggcaggggttgccattgacacagtggaagataccaagatactgtttgacgggatccctttggagaagatgtctgtgtccatgactatgaacggagctgtcatacccgtgctcgcaaacttcatagtcactggcgaggagcagggggtgccgaaagaaaaactgaccggcacaattcagaatgacattctcaaggagttcatggtgcggaacacatacattttccctccagaacccagcatgaagattatagcggatattttcgagtatactgcgaaacatatgccgaagttcaacagtatctccatatccggctaccacatgcaagaagcaggagcagatgcgattctggaactggcatatactctggcggatggtttggaatatagcagaacggggttgcaggcaggtctcacgatcgacgagtttgccccacgtttgtctttcttttggggaattggaatgaatttttacatggagattgctaagatgcgcgctggtagacgattatgggctcacctgatcgagaagatgtttcagcctaagaacagtaagtcgctgcttctccgagcccattgtcagacttccggatggagcctcacagagcaggacccatacaacaacatcgtccgtaccgccatcgaagccatggctgccgtcttcggcggcacgcagagcttacatacaaacagctttgatgaggcactcggattaccaacagtgaaatccgcgagaatcgcgcgcaatacccaaatcattatccaggaggagtcaggcattcccaaggtagccgacccctgggggggtagctatatgatggagtgcctaactaatgatgtgtatgacgctgcgctcaaactcataaacgaaattgaagagatgggagggatggctaaggctgtcgcagaaggaattcccaaactccggattgaagagtgcgcagcccgacgtcaggcccgcatcgattccggctccgaggtcattgtgggagtgaacaaataccagttggagaaggaagacgccgtggaagtattggccatcgataatacgagcgtccggaatcgacaaatcgagaagctgaagaaaattaaaagcagtagggatcaagcattggccgaacgttgcttagctgccctcacagagtgcgcagcttctggggatggcaacatcctggctctggccgtcgacgcctctcgtgcacgatgcaccgtgggggagataaccgatgcactgaaaaaggtcttcggagaacataaagccaacgacagaatggtgtccggggcatatcgacaagagttcggagaaagcaaagagataacatcagccatcaaaagggttcataagtttatggaacgcgagggaagacgtcccaggttgctagtcgctaagatgggccaggatgggcacgaccgcggcgcaaaggttattgcgaccgggtttgcagatttaggctttgatgtcgacatcgggcccctgttccagactcccagggaagtcgcacagcaggcagtggacgccgacgtccacgctgtgggtatatctacccttgccgccggtcataaaacattggtgcctgagcttattaaggagttgaacagcttgggtcggcctgatatcctggtcatgtgtgggggggtcattcccccacaggattacgagtttctcttcgaggtgggagtatccaatgtgtttggacccggcacccggatccccaaggcagctgtgcaagtgctcgacgacatagagaagtgtctggagaaaaaacaacagagtgtg

SEQ ID NO: 16666 - DNA, 2250 bp, Artificial Sequence
  Description of Artificial Sequence: Synthetic coding sequence
atgctaagggctaaaaaccagctatttctgttgtctccccactatctgaggcaggtcaaagagtcaagtgggagccgcctgattcagcagcgcctgcttcaccaacagcagccactacacccagagtgggccgccctcgctaaaaaacagttaaagggaaaaaatcccgaagacctgatatggcacactccagaaggcatctccataaagcccctttactcgaaacgcgataccatggaccttccagaagagttgcctggtgttaaaccattcactaggggaccttacccaacaatgtacacattccgaccttggacaatccgtcagtacgccggctttagcactgtagaggagtctaataagttctacaaggacaacataaaagccggtcagcaaggcctgtctgtggctttcgatctggccactcatcgggggtacgattccgataatcctagagtccggggggacgtgggaatggctggggtagcaattgatacagtcgaggataccaagattttgttcgatggtatcccgctggagaagatgagcgtttcaatgactatgaacggtgcggtgattccggttctggccaattttattgtgactggagaggagcaaggagtccccaaagagaagctgaccggaactattcagaatgatatactcaaggagttcatggtccgaaacacatacattttcccccctgaaccttccatgaaaattatagcggacatcttcgaatacactgctaagcatatgcctaagttcaattcaatctctatctctggataccacatgcaggaggcgggcgcagatgccattcttgagctcgcatacacactggcggacgggcttgagtacagtaggacaggtctccaagcagggttgacaatcgacgaattcgctcccaggctatcattcttttggggcatcggaatgaacttctatatggagatcgcaaaaatgcgtgcaggccgtcggctctgggcccacctgattgaaaagatgtttcagcccaagaactctaaaagcctcctactgcgagctcattgccagacttccggctggtctctcactgaacaagatccatataataatatcgtgcggactgccattgaggcgatggctgctgtattcggagggacgcaatcgttgcataccaactcttttgatgaggctctgggactgcccactgttaaatcggctcggatcgcgagaaatacccagatcataattcaggaggagagcggtatccccaaagttgcggacccttggggtgggtcatacatgatggagtgtctgaccaacgacgtttacgatgctgctcttaagctgataaacgagatcgaagaaatgggtggcatggctaaggcagtggccgagggcattccgaagctccgcatcgaagaatgcgcagcccgccggcaggcacgcatcgattctggctccgaagtcatcgtcggtgtcaataaataccaactggaaaaagaagacgcagtggaggttctggctattgacaataccagtgttagaaacaggcagatcgagaaactcaaaaagatcaaaagttcccgtgatcaggcactggctgaaaggtgcctcgccgcgctaaccgaatgcgcggcctccggggatgggaatatcctggcattggctgttgacgcctccagggcacggtgcactgtgggcgaaatcactgatgctttgaagaaagtgttcggagaacacaaggctaatgacagaatggtgtctggcgcctatagacaggagtttggcgagagtaaagagattacatccgcaataaaaagagtccataagttcatggagcgtgagggccggagaccaaggctgttagtggctaaaatgggccaggatggccacgacaggggagctaaagttattgccaccgggttcgccgacctcggctttgacgttgatataggtcccttattccagacgccacgcgaggtagcgcagcaagccgtggacgcagacgtccacgctgttgggatctccacgctggccgccggacataaaaccctggttccagaactgattaaggaattaaacagtctcggaaggccagacattctggttatgtgcggcggtgtcatacctcctcaggactacgagttcctgttcgaggtcggagtttccaatgtgtttggaccagggacaaggatcccaaaggccgctgtgcaggtcctcgacgatatcgagaagtgtctggagaagaagcagcagtctgtc

SEQ ID NO: 16667 - DNA, 2250 bp, Artificial Sequence
  Description of Artificial Sequence: Synthetic coding sequence
atgctgcgcgcaaagaatcaacttttcctcctgagccctcattacctgcgccaggtcaaagagtcctccggttcacggctgatccagcagcggctccttcatcagcagcaacctctccaccctgagtgggccgccttggctaagaaacaactcaagggaaagaacccggaggacctcatatggcacacccccgagggcatctcgatcaagcccctctatagcaagcgcgacacgatggacttgcctgaagaactgcctggagtgaagccttttactagaggtccatacccgactatgtacacctttagaccgtggactatccgccagtacgccggattctcaaccgtggaagaatccaataagttctataaagataacattaaagcgggccagcaaggactgtcggtggccttcgatctggcgacgcaccgcggttacgattcagataacccaagggtgagaggagacgtggggatggctggtgtggcgatcgatactgtggaagataccaaaattctgttcgacggcatcccgctcgagaagatgtccgtgtcgatgactatgaacggagctgtgatcccagtcctggccaacttcattgtgactggcgaagagcaaggggtgccgaaggagaagctcacgggtacgatccaaaatgacatcctgaaggagtttatggttcgcaatacttacatctttccgccagagccatcgatgaagatcattgcagatatcttcgaatacactgcaaagcatatgccaaagttcaactccatttcgatttccggataccacatgcaagaagcaggtgcagatgctatcctggaactggcttacaccctcgcggatggactcgagtactcgcgcactggactgcaggcgggcctgactattgacgagtttgcgccacggctctcgttcttctgggggatcggaatgaacttctacatggagatagcgaagatgcgcgccggacggcggctgtgggcgcatctcattgagaagatgttccagcccaagaacagcaagtccctgctgctgcgcgcacattgtcaaacctcgggatggtcgctgactgaacaggatccatacaacaacatcgttcgaactgcgattgaggccatggccgccgtctttggaggtacccaatcactgcacaccaacagctttgacgaagccctgggactcccgactgtgaaaagcgccaggatcgcccgcaacacccagatcatcatccaggaggaatcgggcatccccaaggtcgccgacccatggggaggttcctacatgatggaatgcctgacgaacgacgtgtacgatgcggcgctgaaactgatcaatgagattgaagagatgggaggaatggcaaaggccgtggccgagggaatccccaagctgaggatcgaagaatgcgcggcgcggagacaggcacgcattgactctgggtctgaggtgatagtcggagtgaataagtatcaattggaaaaagaggacgctgtggaagttctcgcgatcgacaatacttccgtgaggaataggcagatcgaaaagctcaaaaagatcaaatccagccgggatcaggcgctggcggaacggtgcctggcagccctgactgagtgcgccgcctcgggagacggaaacattctggcactcgctgttgacgcttcccgcgctcggtgcactgtgggcgagatcactgatgcactgaagaaagtgtttggcgagcataaggcaaacgaccgcatggtgtccggagcgtacaggcaggagttcggagaatccaaggaaatcacttcggctatcaagagagtgcacaagttcatggagcgcgaaggaaggcgcccgcgcctcctggtcgcaaagatgggacaggacggtcacgatcgcggagccaaggtgatcgcgaccggcttcgccgacctgggattcgacgtggatatcggcccgttgttccaaacccctcgcgaggtggcccaacaggcggtcgacgccgatgtccacgctgtgggtatctcgactctcgcagcaggacacaagaccttggttccggaacttatcaaggagcttaactccctgggacggcccgacattctggtgatgtgcggaggagtcattcccccacaagactacgaatttctgttcgaagtgggagtctcgaatgtgttcgggcccggaacccgcatcccaaaggccgccgtgcaagtgctggacgacatcgaaaagtgtcttgagaagaagcaacaatcggtc

SEQ ID NO: 16668 - DNA, 2250 bp, Artificial Sequence
  Description of Artificial Sequence: Synthetic coding sequence
atgctgagagccaaaaatcagctcttcctgctttcgccacactacctgagacaggtcaaagagtcatccgggtcacgcctaattcagcagcggctcctccatcaacaacagccattgcatccagagtgggcagctctcgccaagaagcagctgaaggggaaaaatccagaggacctgatttggcatacgccggagggtatcagtattaaacccctgtactctaaacgtgatacgatggacctacctgaagaactgcctggagtcaagccgtttacccgcggtccttatccaacaatgtacacttttcgcccctggaccattcgacagtatgctggattctccacagtcgaagagtccaacaagttctacaaagataacattaaggctggccagcaggggcttagtgttgccttcgacctagcaacccatagaggatatgattccgacaatccaagagttagaggggacgtgggaatggccggagttgccatcgacaccgttgaagacacgaagattctattcgatggtatccccctagagaagatgagtgtgtccatgactatgaacggggcagtcatcccggtcttggcaaactttattgtgaccggtgaggaacaaggcgttcccaaggaaaagctgacagggactatccaaaacgacatcctgaaggagtttatggtccgtaatacatacattttcccgcctgagccttctatgaagattatcgctgatatctttgagtataccgctaaacacatgcctaagttcaactcgatatcaatctctgggtatcatatgcaggaagccggcgctgatgcaatcctggaacttgcttacacactggcggacgggctggagtactctcgaactggcctgcaagccggtttaactatcgatgagtttgctccacgcctctccttcttttggggaataggcatgaacttctacatggagattgcaaagatgcgagctggccgtcgactatgggctcatcttattgagaagatgtttcagccaaagaacagcaagtctctgttactccgagcccattgccagacaagcggctggagtctcactgaacaggatccgtataacaatattgttcggaccgccatcgaggcaatggccgcggtgttcgggggcacccagtctcttcatacaaactctttcgacgaagccctcggtcttccaaccgtgaagagtgcgcggatcgcccggaatactcagatcataattcaggaggagagtggtatccctaaagttgctgacccctgggggggttcgtacatgatggagtgtctgaccaatgatgtttacgacgctgccctgaagctcatcaatgagatagaggagatggggggaatggccaaagcggtcgcggagggaatacccaagctgaggattgaggaatgtgctgcccgtcgccaggctcgaatcgacagtggctccgaggtgattgtgggggtgaacaagtatcagctggagaaggaggacgctgtggaggtcctggccatcgataacacgagtgttcgtaatcgccagattgagaaactgaaaaagatcaaaagctcaagagaccaggccctggctgaacggtgcctggctgccctgaccgaatgcgctgcatctggagatgggaacatattggctttggctgtggacgcaagccgcgccagatgcacggtaggggaaattactgacgccctcaagaaagtgttcggcgagcacaaggctaatgataggatggtgtctggtgcttatcggcaggaattcggcgagtcgaaggagattacatcagcaattaaacgcgtccataagtttatggagagggaaggacgtagacccagactgctggtagcaaaaatgggtcaagacggtcatgaccgaggagccaaggttattgccaccggctttgccgaccttggctttgacgtggatataggcccattgttccaaactccgagagaagtggcacagcaggccgtggatgctgatgtgcatgccgtgggtattagcaccctcgctgccgggcacaaaaccttggttcccgagcttattaaggagctgaactcacttggacgaccggatatattggttatgtgcgggggcgtaatccctccacaggactatgagtttctctttgaggtcggagttagcaacgtgttcggccctggtactagaatccctaaagctgcagtccaagttttggatgacattgagaagtgcctggagaaaaaacagcaatcagta

SEQ ID NO: 16669 - DNA, 2250 bp, Artificial Sequence
  Description of Artificial Sequence: Synthetic coding sequence
atgctccgtgccaagaatcagctcttcctcctgtcaccgcattacttgagacaggtgaaggaatcgagcggatcacgcctgatccagcaaaggctcctgcatcagcaacagccgctgcatcctgagtgggcggctctggccaaaaagcaacttaagggcaagaaccccgaggacctgatctggcacactccagaaggaatctccatcaagccgctgtactccaagcgcgataccatggatctgcctgaagagctgccgggtgtgaagccgttcactagaggaccttaccctaccatgtacacttttcgcccttggaccatccgccagtacgcgggtttttccacggtggaggaaagcaacaaattctataaggacaacatcaaggcaggacagcagggcctcagcgtggctttcgacttggccacgcatagaggttacgattccgacaaccctcgggtgcggggggacgtgggcatggccggagtggccatcgacactgttgaggacaccaagatcctgttcgatggaatcccgctggagaagatgtcggtttcgatgactatgaatggggcagtgatcccggtgctcgcgaactttattgtgaccggcgaggagcagggcgtgccgaaagagaagctgaccgggaccatccagaacgatatcctgaaagagttcatggtccgcaacacctatatcttcccacctgagcctagcatgaaaatcatcgctgatatcttcgaatacaccgccaagcacatgcctaagtttaactcaatctcgatctcaggataccacatgcaggaggccggggccgacgcgatcctggaactggcctataccttggccgatggactggagtattctcggaccggcctgcaagcaggactcaccatcgacgaattcgccccgagactgtccttcttttgggggatcggaatgaacttctacatggaaatcgccaaaatgagagcaggacgcagactttgggcccatctgatcgagaagatgttccagccaaagaacagcaaatcccttctcctgcgcgcccattgccagacttcaggttggtcattgaccgaacaggatccatacaataacatcgtgcggaccgccatcgaggcgatggcagcggtgtttggtggaacgcagtcgctgcacaccaattcgtttgacgaagcgctcggactcccgactgtcaagtccgcccgcatagctcggaacactcagatcatcatccaggaagaatcgggaattccaaaagtcgctgatccgtggggcggaagctacatgatggaatgtctcaccaacgacgtgtatgacgcagcgctcaaactcatcaatgagatcgaagagatgggcggaatggccaaggcggtcgccgaggggatcccgaagctgcgcattgaagaatgcgccgcgagacgacaggcgcggatcgatagtggctccgaggtgatcgtgggagtgaacaaataccagctggaaaaggaggacgcagtcgaagtgctggcgatcgacaatacctcggttcggaatcggcagatcgaaaaacttaagaagatcaagagctcaagggaccaggcgctcgcggaaagatgccttgccgccttgaccgagtgcgcagcctcgggagatggtaacatccttgcgctggccgtggatgcatcccgcgcgagatgcaccgtgggggaaattacggacgcccttaagaaggtgttcggcgagcacaaggccaatgaccggatggtgtcaggagcctacaggcaagagttcggtgaatccaaagaaatcacctcggcgatcaaaagggtgcacaagttcatggaacgcgaggggcgccggccgcgcctgctcgtggctaagatgggacaggacggtcacgacagaggagccaaggtgatcgccaccgggttcgcggacctgggcttcgatgtggacatcggaccactgtttcaaacccctagggaggtggcccagcaagcagtcgacgccgatgtgcacgcggtcgggatttcgacgctggccgcgggacacaaaaccttggtgcctgagctgatcaaggagctgaactccctgggcaggccggatattctggtgatgtgcgggggcgtgatccctccgcaagactacgagtttttgttcgaagtcggagtgtcgaacgtgtttggacctggaacccggatccccaaagccgcggtgcaagtcctggacgatattgaaaaatgtctggaaaagaagcaacaatcggtg

SEQ ID NO: 16670 - DNA, 2250 bp, Artificial Sequence
  Description of Artificial Sequence: Synthetic coding sequence
atgcttagagccaaaaatcagctgttccttctgagccctcattatctgcgccaagtcaaggaaagcagcggatcccggctgatccaacagagacttctgcatcaacaacagcctctgcacccagaatgggcagcacttgcaaagaagcaactgaagggaaagaatccagaagatcttatctggcacacgccagagggaatatcgatcaaaccactctactcgaagagagatactatggatcttccagaagagcttcctggagtcaagccctttacccgcggaccttacccaaccatgtacacttttaggccgtggaccatccgccaatacgctggattctcgaccgtggaggaaagcaacaagttttacaaggataacataaaggcgggacagcaagggctttccgtggcctttgatctcgcaacccatcgcggctacgattcggacaatccccgggtcaggggtgatgtgggtatggctggcgtcgcaattgatactgtggaagataccaaaatcctcttcgacggaatcccacttgagaagatgtcagtctccatgactatgaacggtgccgtcattcccgtgctggcaaactttatcgtgaccggtgaagaacaaggagtgcctaaggaaaagctgactgggactattcagaacgatattctcaaggagtttatggtgagaaatacctacatttttccccctgaaccttcgatgaaaatcatcgcagatatcttcgagtacactgccaagcatatgcccaagtttaactctattagcatctcgggttatcacatgcaggaggcaggagccgatgcaattctggagctcgcctacacgctggctgacgggcttgagtactctcgtaccggtctgcaagcaggtcttactatcgacgaatttgcgccaagactttcgttcttttggggtatcggcatgaacttttacatggaaattgccaaaatgcgcgcagggagacgcctctgggcgcaccttattgaaaagatgttccaacctaagaattccaagagccttcttctgcgtgcacattgtcaaacctctggatggtcactgactgaacaagatccttacaacaatattgtcagaacggcgattgaagcgatggcagcagttttcggtggaacccagagcctccatactaactcctttgacgaagctctgggcctgcctactgtgaaaagcgccagaattgcacgcaacactcagattatcattcaagaggaatcgggcatacctaaggttgccgacccttggggaggatcgtacatgatggagtgccttacgaacgacgtgtacgatgcagccctgaaactgatcaacgaaatcgaagaaatgggcggcatggcaaaagcagtggccgagggtattccaaagctcaggatagaagaatgtgcagctcggcggcaggcccggattgacagcggatccgaagtcatcgtgggcgtgaataagtaccagctggaaaaagaggacgccgtggaagtgctcgcaattgacaacacttcggtcagaaacagacagatcgagaaactgaagaagattaagtcgtcacgggaccaagcgctcgcagaaaggtgcctggctgccctcacggagtgtgcggcatctggcgatgggaacattcttgcactggctgtggatgctagccgcgcgcgttgtactgttggagaaataaccgacgcactcaaaaaagtgtttggagaacacaaggcaaatgacagaatggtcagcggagcttaccgccaggaattcggagagtcaaaggagattacttcggcaattaagagagtccataagtttatggagagagaaggtcgcagaccacggctccttgtggcgaagatggggcaagatggtcacgatagaggggcaaaggtgatcgccactggcttcgcagatctgggcttcgacgttgatataggccctctcttccagacccctcgggaagtggcgcaacaggcagtggatgcagatgtgcatgcagtcggtatttcgacccttgcggctgggcataagaccctcgtgccagaattgataaaggaacttaactcactgggtagaccggatattctggtgatgtgcggtggagtgattccacctcaagactacgaatttctgtttgaagttggagtgtcaaatgtttttggcccaggcaccaggataccaaaggcggccgtccaggtgctcgacgatattgagaaatgtctggagaagaaacaacaatcggtg

SEQ ID NO: 16671 - DNA, 2250 bp, Artificial Sequence
  Description of Artificial Sequence: Synthetic coding sequence
atgctgagggctaagaatcagctgtttttgctgtctccacattacttacgccaggttaaagaaagctcagggtctcggctgatacagcagcgtctcctccatcaacagcaaccattgcacccagagtgggcggccctcgcaaagaagcagcttaaaggaaaaaaccctgaagatttaatttggcacacaccggaggggatttctatcaagccattgtacagcaagagggataccatggatctaccagaggagttgccgggcgtgaaaccctttacacgagggccataccccactatgtacacttttcgtccatggacaatccgccaatacgccgggtttagtactgtggaagagtcaaataaattttacaaagacaacataaaggctggacagcagggcctcagtgtggcctttgacctcgccacccatagaggttacgatagcgacaatcctagagtaagaggagatgtgggcatggccggtgtggcaattgatacggttgaagacactaagatcctgtttgacgggatcccgttggaaaaaatgtcagtttccatgactatgaatggggctgtcattccggtactcgcgaacttcattgtgaccggggaagagcagggcgttccaaaggagaagctgaccggcactatacagaacgacattttgaaggagttcatggtgaggaacacctatatcttcccaccggaaccttcaatgaaaataattgccgacatttttgagtataccgcgaagcacatgccgaaatttaacagcattagcatcagcggatatcacatgcaggaagctggggccgatgccatcctggaactggcttacacactagcggacggcctggagtactcaagaacaggtctgcaggccgggctgacaattgacgagttcgcgcctcggctgtctttcttttgggggattggcatgaacttctacatggagatagctaaaatgcgggccggaagaaggctctgggctcacctgatcgaaaagatgtttcagcctaaaaactcaaagagcctcctgttgcgtgcacattgtcaaacaagcggttggagtttgaccgagcaggacccctataataatatcgtgaggaccgcaatcgaagccatggccgctgtgttcggtggaacccagtccctgcacacaaattcttttgatgaggcactgggacttcctactgttaagtccgctagaatagccagaaacacccagatcatcatacaagaggagtccggtattcccaaggtggccgacccatggggcggcagctacatgatggaatgtctgacgaacgatgtctacgatgcagctcttaagttgataaacgagatcgaggagatgggggggatggccaaggcagttgcggaaggcataccgaaactgcgaatcgaggaatgtgctgctcggagacaggctcggatcgactccggaagcgaagttatcgtaggggtgaataagtaccagttggagaaagaggacgcggtggaagtgctggcgattgataacacttccgtgcgaaatcgccaaattgagaagttgaagaaaattaagagctcaagagatcaggccctcgccgaacgatgtctcgctgccctgaccgagtgtgctgcttcaggcgatggcaacatcctggctcttgcagtggacgccagcagggctcgttgtacagtcggtgaaataacggacgctctgaaaaaagtatttggcgagcacaaagcgaacgatcgaatggtcagcggagcttacagacaggagttcggggagagtaaggagatcacttcagccattaagcgagtgcacaagtttatggaacgggagggacgcaggccccgactgctggtggcaaagatgggtcaggacgggcacgaccgaggcgccaaggtgattgcgaccgggtttgcagatctggggttcgatgtcgatattggcccactgtttcagacgccgagggaggtggcccagcaggctgtggacgcagacgtgcatgccgtaggtatctcaacactcgcagccgggcacaaaacgctcgtgcccgagctcattaaagaactgaattcattgggccgaccagatatcctggtgatgtgtggtggcgtaatcccccctcaggactacgaattcttgtttgaggtcggcgtatcaaatgtattcggccccgggaccaggatccccaaggctgctgtccaggttctcgatgacatcgagaagtgtctcgaaaagaagcagcaaagcgtg

SEQ ID NO: 16672 - DNA, 2250 bp, Artificial Sequence
  Description of Artificial Sequence: Synthetic coding sequence
atgctcagagccaagaatcagttgtttctcttgagtccgcattatcttcgccaggtcaaggaatcaagcggctccaggttaattcagcagaggctcctgcatcagcaacagcctttgcacccagagtgggctgccttagccaagaagcaactgaaggggaaaaacccagaggacctgatatggcacacacccgagggaatatccattaaaccactatattccaagagggacactatggatctacctgaagagctgccaggcgtgaaaccattcacccgtgggccgtaccccaccatgtacaccttcagaccatggacgattcggcagtatgccggattttctacagttgaggagagtaataagttctataaggacaatattaaggcaggccagcaggggctctccgtggcatttgatctggctacacacagaggctatgattccgataacccaagagtgagaggggatgtcggaatggccggggtggctatcgacacagtggaagatacaaaaatcctgttcgacggaatccctctggaaaagatgtccgtgtccatgaccatgaatggcgcagtgatacccgtactggcgaacttcattgtaacgggggaggagcaaggcgtgcccaaagaaaagcttacaggaaccattcagaatgacattctgaaagaattcatggtgcgtaacacatatatatttccccccgagccatccatgaagatcatcgccgatatttttgaatataccgccaagcacatgcccaagttcaacagtatttctatctccggatatcacatgcaggaggccggggctgatgcaatcctggaactggcgtacacccttgctgatggcctcgaatactctaggacagggctccaagctgggctgactatagacgaattcgcccctcgcctatccttcttctggggaatagggatgaacttttatatggaaatcgctaaaatgagggcaggaagaagattgtgggcccatcttatcgagaaaatgtttcagccaaagaactctaaatcccttctgctcagagcccactgtcagacctcgggctggagtttgaccgagcaggacccatataacaatatagttcggacggcaatcgaggctatggctgcagtctttggagggacccaatcgctgcacacgaactcgtttgatgaggctttaggcctgcctacagttaagtctgcacgaatagcgaggaatactcagatcattattcaagaagagtccggcatacccaaggtggccgacccctggggcggttcctatatgatggagtgcttgacaaacgacgtttacgatgctgccctgaagctgatcaacgagattgaagaaatgggcggtatggccaaggcggtggcagaagggatcccaaaactaagaatcgaagagtgcgcagcacgcagacaggcacgaatcgacagtggaagcgaggtgattgtcggggtcaacaaataccagctggaaaaagaggacgctgttgaggtgttggccattgataacaccagcgtgaggaataggcaaatcgaaaagttgaaaaaaatcaagtcttcccgagaccaagcccttgccgaaagatgcctggccgcgctcactgaatgtgctgcctcgggggacggtaacatacttgcgctggccgttgacgccagcagagcccgctgcacagtcggagagatcactgatgccctgaagaaggtattcggagaacacaaagcaaacgatcggatggtctctggagcctatcgtcaggaattcggagagagcaaagagattacatccgccatcaagagagtccataagttcatggaaagagaaggtcggagaccccgcttgctggtagcaaagatgggccaagatgggcacgatagaggcgccaaggtcatcgccacaggctttgctgacctggggtttgacgttgacataggcccattattccagacccccagagaggttgctcagcaggcggtggatgccgacgttcacgccgtgggtataagtaccctggcagccgggcacaaaacgctggtaccggaactaatcaaggaacttaattccttgggtcggcccgatattttggtgatgtgcggtggtgtgatcccaccccaggattacgaatttctttttgaggttggggtcagcaatgtcttcggccctggcactaggatccctaaagcggctgtacaggtgctcgacgacattgaaaagtgcttggagaagaagcaacagtctgtc

SEQ ID NO: 16673 - DNA, 2250 bp, Artificial Sequence
  Description of Artificial Sequence: Synthetic coding sequence
atgctgcgcgctaagaaccagctcttcctgctctcgccacactacctgcgtcaggtcaaagagtcatccgggtccagactgatccagcaacgactgctgcatcagcagcaaccactgcacccagagtgggccgctctggcgaaaaagcagttgaagggcaagaatcccgaagatctgatctggcacaccccggagggcatctctatcaagcctctctactcgaaacgcgatactatggacttgccggaagagttgcctggcgtgaagccgttcacccgcggcccgtacccgactatgtatacctttcggccatggacgatccggcaatacgccggctttagcactgtcgaggaatccaacaagttctacaaagacaacatcaaagccggacagcaaggcctttcggtggcgtttgacctggcaactcatcggggctacgacagcgacaacccaagagtgcgcggagatgtaggtatggcaggggtggcgattgacaccgtggaagataccaagatcctcttcgacggtattccgcttgagaaaatgtcggtgagcatgactatgaatggggccgtgatacccgtgctcgcaaatttcatcgtgaccggcgaagagcagggggtgccgaaggagaaattgactggaaccatccaaaacgatatcctgaaagaattcatggtgcggaacacgtacatctttccgcctgagccttcgatgaagattattgcggatatctttgaatacactgcaaaacatatgcccaagttcaactcgatcagcatctccggctatcacatgcaggaggcgggggctgatgcaatcctggagctggcgtacaccctcgccgacggattggaatactctaggaccggactccaagcaggactgaccatcgacgagttcgcgccacggctttcgttcttctggggcatcggtatgaacttctacatggaaatcgcgaagatgcgcgcgggccgccggctgtgggctcaccttatcgagaaaatgttccaacctaagaattccaagtcactgctgttgcgggcacattgccaaacctcaggatggtcccttaccgaacaagacccatacaacaatattgtcagaaccgccatagaagccatggcagctgtgttcggaggcacccagtcactgcatactaatagctttgatgaagcacttggacttccgaccgtgaaatctgccaggatcgcccgtaacacccagattatcatccaagaggaatcagggatcccaaaggtggccgacccatggggaggctcatatatgatggagtgcctcactaacgacgtctacgatgccgccctgaagctcattaacgaaatcgaggagatgggagggatggccaaggcggtcgcggaggggattccaaagctccggatcgaagagtgcgctgcccggcgccaggccagaattgattcggggagcgaagttatcgtcggagtgaataagtaccagctcgaaaaggaggatgcggtggaagtgttggccatcgataatacctcagtgcggaacagacagatcgagaagctgaaaaagatcaagtcctcgcgtgaccaggccttggccgaacggtgcctggctgccttgaccgagtgcgccgcctccggagacggtaatatcttggccctggccgtcgacgcctcccgggcacgctgtactgtcggagaaatcactgacgccctgaagaaggttttcggagagcataaggcaaacgaccggatggtgtccggcgcctaccgccaggaattcggagaaagcaaggagatcacttcagctatcaagcgggtgcacaaattcatggaaagagaagggcgccgcccgagactgcttgtggccaaaatgggccaggacggccacgacagaggggccaaggtgatagcgaccggattcgccgatctcggattcgatgtggatatcggacccctctttcagactccaagggaggtggcacaacaagccgttgacgcggacgtgcacgctgtcgggatcagcacgctcgcggccggtcataagactctcgtcccggaattgatcaaggaactcaactcactgggacgcccggacattcttgtgatgtgcggaggagttattcccccacaggattacgagttcctgttcgaagtcggagtgtcgaacgtgtttggaccagggacgcgcatcccgaaggccgcagtgcaggtactcgacgatattgagaaatgtctggagaaaaagcaacagtcggtc

SEQ ID NO: 16674 - DNA, 2250 bp, Artificial Sequence
  Description of Artificial Sequence: Synthetic coding sequence
atgcttcgcgccaagaatcagctgtttttgctttcgcctcactacctcagacaagtgaaagaatcttccggatcccgattgattcaacagaggcttcttcatcagcagcaacctctgcaccctgagtgggcggcacttgcgaagaaacagctcaagggcaagaatccagaagatcttatctggcatactccagaaggcatttccattaagccgctttactccaagagggatactatggatcttcctgaagaattgcccggagtgaagccattcacgcggggcccttaccctaccatgtacactttccggccatggactatcaggcagtatgccggtttctcgaccgtcgaggaatccaacaagttttacaaagacaacattaaagcaggacagcaaggcttgagcgtggcgttcgacctcgccactcatcgcggttacgactcagacaacccacgggtgcgtggtgatgttgggatggcaggagtggcgatagatactgtagaggataccaaaattctgtttgatggcatccctttggagaaaatgtctgtgtcgatgaccatgaacggtgcagtcattcctgtgcttgcaaactttatagtgacgggcgaagagcagggagtgcctaaggaaaagctgaccggtaccattcagaacgacattctcaaggagtttatggttcggaatacctacattttcccaccagaaccttcgatgaagattattgcagacatctttgaatacactgcgaagcatatgcctaaattcaattccatttcaattagcggctatcatatgcaggaggccggtgccgatgcaatcctggagctggcatatactctggccgacggtcttgaatactcccgaaccggactccaagcaggattgaccatagacgagttcgcacctagactttcgtttttctggggaatagggatgaacttctacatggagatcgccaagatgagagcaggtcggagactctgggcacatcttatcgagaagatgttccagcctaagaattcgaaatcgcttctgcttcgcgcgcactgtcagaccagcgggtggagcctgaccgaacaggatccttacaacaacattgtgagaactgcaattgaggcaatggcagctgtgtttggcggaactcagtcgcttcataccaattcctttgatgaagcactcggacttcctactgtgaagtccgccaggatcgcaagaaacacccagataatcatccaagaagaatcgggaatcccgaaggtggcggacccatggggcggttcatacatgatggaatgtctcactaacgacgtgtacgacgcagcgctgaagttgatcaacgaaattgaagaaatggggggaatggcgaaggcagtggcggaaggaattccaaaactgcggatagaagaatgtgcagcacggcgtcaagcacggattgactcgggttcggaggtgatcgtcggagtgaataagtaccagctcgagaaggaagatgcagtggaggtgctcgctatcgataacacctccgtcagaaacagacagatagaaaaactcaaaaagatcaagtcaagccgtgatcaggccctggcagagcggtgcctggccgccctcaccgaatgtgcagccagcggagatggtaacattctggcacttgcggtggatgccagcagggcacgctgtaccgtcggagaaattactgacgcactgaagaaggtctttggtgaacataaagcgaatgatcggatggtgtcgggggcgtatcgccaggaattcggcgaaagcaaggaaataacctcggcgattaaacgtgtgcacaagttcatggaacgcgaaggacgccgcccgaggctgctggtcgcaaagatgggtcaggatggtcacgataggggggccaaggtcatcgcaaccggattcgcggatctgggatttgatgtggacatcggtcctctgtttcagacgccacgggaggtggcacaacaggcagtggacgccgatgtgcacgcagtcggcatttcgactcttgcagcaggtcacaagaccctcgttccagaactcattaaagagctcaacagcctgggtagacccgacatcctggtcatgtgtggaggtgttataccaccccaagattacgaatttctgtttgaagtgggggtgtcgaatgtgttcggtccaggaactcgtatcccaaaagcagccgtgcaagtcttggatgacatcgaaaaatgcctggaaaagaagcaacagtcggtg

SEQ ID NO: 16675 - DNA, 2250 bp, Artificial Sequence
  Description of Artificial Sequence: Synthetic coding sequence
atgctgcgggccaagaatcaactatttctgttaagtcctcactacctgcgtcaggtgaaggaaagctccggtagcaggctgattcaacagcgcctgcttcaccagcaacaacctctgcatccggagtgggccgcactggcaaaaaagcagctaaaaggcaagaacccggaggatctgatctggcataccccggaggggatcagtatcaagcccctgtatagtaagcgcgataccatggacctgccggaggagctgcctggagttaaaccatttacccgagggccgtacccgaccatgtatacgttcagaccttggacgattcgtcagtatgctggcttctcaaccgtcgaggagagcaacaaattctataaggacaacatcaaggcgggtcaacaagggctgagcgtggctttcgatctggccactcaccgtggctacgacagcgacaaccctcgcgtgaggggtgatgttggcatggcgggggtggctatcgatacggtggaagatactaaaattctgttcgatggcattccgttggaaaagatgagcgtaagcatgaccatgaatggtgcggttatccctgttctggctaacttcatcgtcacgggtgaagagcagggcgtgccgaaggagaaattgaccggtacgattcagaacgatatactgaaggaatttatggttcgtaacacctacattttcccgccagagccatcgatgaagatcattgccgacatttttgagtatacggcaaagcacatgccaaaatttaactctattagcatcagcggttatcatatgcaggaggcgggcgcggatgcaatccttgaattggcatacactctggcggacggtttggaatatagcaggaccggcctgcaggcgggcctgactatcgacgagttcgctccacgactgtcgttcttctggggtattggaatgaatttttatatggagatcgctaaaatgcgcgcgggccgacgcctatgggcccacctcatcgaaaagatgttccaaccgaagaacagcaagagcctgttactgagggcacactgccagaccagcggttggagcctgactgaacaagacccttacaacaatattgtccgtacggcaatagaagcaatggcggccgttttcggcggcacccaaagcttgcatacgaattcctttgatgaagccctgggtctgccgactgtgaaaagcgcccgcattgcccgtaacacccaaattattatccaagaggagtcaggtattccaaaggttgccgatccgtggggtgggtcgtatatgatggagtgtttgaccaacgacgtgtatgacgcagctctgaaactgatcaatgagattgaagagatgggcgggatggccaaggctgtggctgaaggtatcccgaaactgcgcatcgaggaatgcgcggcgaggaggcaagcaagaattgacagcggctccgaggtgatcgtgggtgtcaacaaataccagcttgaaaaggaggatgcggtagaggtgttggcaatcgacaacaccagcgtgcgcaatcgacagatcgaaaagttgaagaaaattaagtccagccgcgatcaggcactggcagaacgctgcttagcagcactaaccgagtgtgctgcgtccggtgatggcaacattttggccttggccgtagacgcaagcagggcgcgctgtacggttggtgagattacggatgccctgaaaaaagtgttcggcgagcataaagcgaatgaccgcatggttagcggcgcgtatcgacaggaatttggggaatccaaagaaattacctccgccattaagcgggtgcataaatttatggaacgcgagggccggcgccctcgcctgttggttgccaagatgggccaggatggccacgatcgaggtgcaaaagttattgccaccggttttgccgacctgggatttgacgtggatattggaccactgtttcaaacgcctagagaagttgcgcaacaggcagttgatgccgacgtgcatgctgtgggcatctctaccctggcagccggtcataagaccctcgtgccggagttgataaaggaactcaatagcttgggacgccccgatatcctggttatgtgtggaggcgtgatcccacctcaggactatgagtttttgttcgaggttggcgtgagcaacgtgttcggtccaggtaccaggattccaaaggctgccgtgcaggttctggacgacatcgaaaagtgcctggagaagaagcaacaaagcgtg

SEQ ID NO: 16676 - DNA, 2250 bp, Artificial Sequence
  Description of Artificial Sequence: Synthetic coding sequence
atgctgagggccaagaatcaactattcctgctgtcaccacactacctgcgtcaggtgaaagaaagctccggttcccgtttaatacagcagaggctcttgcatcagcagcagcctctgcaccccgagtgggccgccttggcaaagaagcagctcaaaggcaaaaaccctgaggacctgatctggcatactcctgaaggcatcagtataaaacccctttacagtaagcgagataccatggatctacccgaggagctgcctggagtgaagccgtttaccagaggtccctacccaacaatgtacacattccgcccctggaccatcagacaatacgctggcttttctaccgtggaagagagcaacaaattctacaaagataatattaaggccgggcaacaggggctgtccgttgccttcgatctggcaactcacaggggatacgacagcgacaatcctcgcgtgaggggggatgttggaatggcaggggtggcgattgacaccgtggaggacaccaagattctttttgacggcatccccctggagaagatgagtgtgagcatgaccatgaacggcgccgttattccagtgctcgccaactttatcgtcaccggagaggaacagggcgtgccaaaagagaaactgactggcacaatacagaatgatatattaaaagaattcatggtcaggaatacctatatattccctccagaaccctctatgaagattatagcagacatttttgagtacacagctaagcacatgcccaaattcaattctattagtatctccgggtatcatatgcaggaagcgggcgccgatgccatcttggagctggcgtacacactggcagacggcctggagtattcacgcaccggcctgcaagcaggactgacgatagacgaattcgctcctcggctgtccttcttttggggtattggaatgaacttctacatggagatcgctaagatgcgcgcgggccgccgcctgtgggcccacttaattgaaaaaatgtttcagcctaaaaattccaagagcctgctgctgagggcccattgtcagaccagcggttggtcgctgaccgagcaggatccttataacaatattgtgcggaccgctatcgaagctatggcggctgtctttggtggcacccagtccttacacacgaacagttttgatgaggcattaggcctgccaactgtgaaaagcgctcggattgctcggaacacccagatcatcattcaggaggaatctggaatccccaaggttgccgacccctggggagggtcctacatgatggagtgtcttacaaacgacgtctatgacgccgccctgaaattgatcaatgagatcgaggaaatgggcgggatggctaaggccgtggccgagggcatccctaaattgagaatcgaagagtgcgccgccagacgacaagcaagaatagattctggctctgaggtgatcgtcggagttaataaatatcagctggaaaaagaggacgccgtggaagttctcgcaattgataatacttcagtgcggaacaggcagattgaaaaactgaagaagattaagagctctagggaccaggccttggccgaacggtgtctggctgccttaacggagtgcgcagcatctggggatggaaacatcctggcactggcagttgatgccagcagagcccgttgcaccgtgggagagattaccgacgctttgaagaaggtcttcggagagcacaaggctaacgataggatggttagcggagcgtacaggcaggaatttggggagagtaaagagatcacctcagccatcaagagggttcataagtttatggaacgcgagggacgacgacccaggctgcttgtggccaagatggggcaggacggccacgataggggagccaaagttatcgcgaccggattcgctgacctaggtttcgatgtcgatattgggcccctgttccaaacacctcgggaggtagctcagcaggccgtggacgccgacgtccatgctgtggggatttccacgctagccgccggccataagacgctggtgccagaactgatcaaggaacttaacagcctgggtcggcctgatatcctcgtgatgtgcggaggagtcattccccctcaggactacgaattcctcttcgaggtgggtgtgagtaacgtgtttggccccggaacccgcataccaaaagctgcagtacaagtgttagatgatattgagaagtgtttagaaaagaagcagcagagtgtg

SEQ ID NO: 16677 - DNA, 2250 bp, Artificial Sequence
  Description of Artificial Sequence: Synthetic coding sequence
atgctgagggctaaaaaccagctgtttttactaagcccccattatttgagacaggtgaaagaaagtagtgggagccgactgatccagcagcgactcctccatcagcagcaacccctgcacccggagtgggccgcactcgctaaaaaacagctaaaaggaaagaatcccgaggacctgatctggcacacgccagaaggcataagcataaagcccctgtacagtaagcgggacacaatggacctgccagaggaactgccgggggtcaagccattcacacgcggtccataccctaccatgtataccttcagaccctggaccatccgccagtacgccgggttcagcactgtggaagagtcaaacaagttttacaaagacaacatcaaggccgggcaacagggcctgtccgttgccttcgacctggcaacacatcgcggatatgattccgacaatcctagagtgcggggcgatgtgggaatggctggcgtagcgattgatacagtggaagataccaagatcctcttcgacggaatcccgctggagaagatgtccgtgtctatgaccatgaacggggctgtgatccctgttttggctaatttcatagtgaccggggaggagcaaggagtacctaaggaaaaattaacaggtaccatacaaaacgacatccttaaggagttcatggtgcgaaatacatacattttcccgcctgagccaagtatgaaaatcatagcggacatttttgagtacaccgcgaagcacatgccaaagttcaactctatctctattagcggctatcatatgcaagaagcaggcgcagatgcgatccttgaactagcatataccttggctgacggcctggaatatagtcgaacaggactgcaggctgggctgacaattgacgagtttgcccccaggctttcattcttctggggcatcgggatgaacttctacatggagattgccaaaatgcgggcaggccgtaggctctgggctcacctcatagaaaaaatgtttcaacctaaaaactcaaagtcgctccttctccgggcacattgtcaaacatccggctggagcttaacagaacaggacccttacaataatattgttcgcacagctattgaagccatggcggccgtcttcggaggaacacaatcactccacactaactccttcgacgaggcactcggcctgcctactgtaaagtctgctcggatcgcacgtaacacacagatcattatccaggaagagtcagggattcccaaggtcgccgatccctgggggggctcttacatgatggagtgcctgacaaatgatgtgtatgatgcggccttgaaattgatcaatgagatcgaggaaatgggaggaatggctaaggctgtggccgagggtatccctaagttaagaatagaggaatgcgccgcgcgccgacaggccaggattgacagtggctcagaggtgatagtcggggtgaataagtaccaattggagaaagaagacgccgtagaagtgctggctatcgacaatacatcagttagaaacaggcagattgagaaactaaaaaagattaagagcagcagagaccaggccctcgcagaacggtgcttggctgcactaaccgaatgtgcggcctcaggggacggaaacattttggcccttgctgttgatgcgtcgcgagctagatgtaccgttggtgaaatcaccgatgctctgaagaaagtttttggtgagcacaaagccaacgatcggatggtttccggggcttatcgccaggaattcggagagagcaaagagattacgtcagccatcaaaagagtgcacaagttcatggagagggagggtagaaggccacgactgctggtcgcaaagatgggacaggatggacacgaccgcggagcaaaggtgatagcaacaggctttgcagaccttggtttcgatgtggatattggaccacttttccaaaccccacgggaggttgcccagcaggccgtggatgccgatgtgcatgcggtcggaatatctacattggcagccggccataagacactggtgccagagctgatcaaagaattgaactctcttgggcgcccagacatactggtgatgtgcgggggtgtcatacccccgcaggattacgagttccttttcgaggtgggagtgtcgaacgtgttcgggcctggcacccgtatacccaaagctgcggtgcaagtattggacgacatcgaaaagtgtctggagaaaaaacaacagagtgtt

SEQ ID NO: 16678 - DNA, 2250 bp, Artificial Sequence
  Description of Artificial Sequence: Synthetic coding sequence
atgcttcgggcaaagaaccagctgttcctcctgtccccccactacttgcgccaggtgaaggaatcgtccgggtcaaggcttattcaacaacggcttcttcatcagcaacagcctctgcacccagaatgggccgcactggcaaagaaacagcttaaggggaaaaaccctgaagatcttatctggcatactccagaaggcatctcaatcaagccactttactcaaagcgcgacaccatggatcttcctgaggaacttccgggtgttaaaccgtttaccaggggtccttaccccaccatgtacacttttagaccatggaccattcgccaatatgcaggtttctcaaccgtcgaagagtccaacaagttctataaagataacattaaggctggacaacaaggactttcggtggcctttgacctcgcaactcataggggttacgacagcgacaatccccgtgtacggggagacgtcggcatggcaggcgtggccattgacactgtcgaggacaccaaaatcctttttgacggcattccactcgagaagatgtcggtgtccatgaccatgaatggtgcggtgattcctgtgcttgcaaactttatcgtgactggcgaggaacagggtgtgcctaaagagaaactgaccggcaccatccagaacgacatactcaaggagtttatggtgagaaacacctacattttcccccctgaaccctcaatgaagataattgcagacatcttcgagtataccgctaagcatatgcccaagttcaattcgatttcgatctccggataccatatgcaggaagctggagctgacgctatcctggagctggcgtacactcttgcggatgggcttgaatactcgcgtactggccttcaggcgggcctcacgattgacgaatttgcacctcggctgtcgttcttttggggaattggaatgaacttttacatggagattgccaagatgcgtgcagggcgacgactttgggcacacctgattgaaaagatgtttcagccgaaaaacagcaagagccttctgctccgtgcacactgtcaaactagcggatggtcacttactgagcaagatccatacaacaatatcgtccggaccgcaattgaagccatggctgcagtgtttggcggcactcagagcctccacaccaattcctttgatgaagcactgggtctgcccaccgtgaaatcggcaagaatcgcccgaaacacgcagattatcatacaagaagaatcagggattcctaaggtggcagatccttggggtggatcgtacatgatggaatgcctcaccaacgatgtgtacgatgcagcgcttaagctgattaatgaaattgaagaaatgggtggaatggcaaaggcagtcgcagagggcatccccaagctccgcattgaagaatgtgccgcaaggagacaagcacgaatagatagcggatcagaggtcatagtcggggtcaacaaataccagctggaaaaagaagatgccgtcgaagtgctggcaatcgacaacacgtctgtgcggaacagacaaatagaaaagctgaagaagatcaagagttccagagatcaagcactggcagaaagatgtctggccgcactgactgaatgcgcggcatccggagacggcaacatccttgcacttgccgtggacgcatccagagctcgctgtactgtcggagaaattaccgacgctctcaaaaaggtgtttggtgagcataaggcaaacgaccgcatggtcagtggagcatacagacaagagttcggggaatcgaaggaaatcaccagcgcgatcaaacgcgttcataagttcatggagagagaagggcgacgtcctagacttctggtggccaagatggggcaagatgggcatgaccggggagcaaaggtcatagcaactggctttgcagacttgggcttcgatgtggatataggccctctttttcaaaccccgcgggaggtcgcacaacaggcagtggatgccgacgtccacgcagtcgggatctcaactcttgcagctggtcataaaactctcgtgccagagcttatcaaagaacttaactctctgggcagaccggatattctcgtcatgtgtggcggagtgattccacctcaggattacgaattcctgtttgaagtgggggtttcaaacgtgttcggtcctggcacccgtattcctaaggcagcagtgcaggtgctggacgacattgaaaagtgccttgaaaagaagcagcaatccgtg

SEQ ID NO: 16679 - DNA, 2250 bp, Artificial Sequence
  Description of Artificial Sequence: Synthetic coding sequence
atgctccgggcaaagaatcagctgtttctcctgagtccgcattatctgcgccaagtgaaagagtcgtctggaagcagactgattcaacagcgcctgctccaccagcaacagccactccatcccgagtgggctgccctcgctaaaaagcagctcaagggaaagaacccagaggatcttatctggcacacgccagagggaatttcaatcaaacctctatatagtaagcgcgacacaatggacttacctgaggaactgcccggagtgaagccatttacaagaggtccatatccgacaatgtacaccttccgcccttggacgattcgtcagtacgcgggattcagcaccgttgaagagagcaataagttttacaaggacaatataaaagctggccagcagggcctgagcgtggccttcgacctcgctacacatcgtggctacgatagcgacaatccacgagtacgtggcgacgtgggcatggccggagtggccattgacaccgtcgaggacacaaaaatcctcttcgatggcattcccctggagaaaatgtccgtgagcatgacgatgaacggggcagtcattcctgtcttggccaactttatcgtgacaggagaggagcaaggcgttcccaaggaaaaactgacgggtacaattcagaatgatatcctcaaggaattcatggtccgaaatacttatatttttccgccggagccttctatgaaaatcatcgcggacatttttgagtacaccgcaaagcatatgccgaaatttaacagcataagcatatccggatatcacatgcaagaggccggcgctgacgcaattctggagctcgcatataccctggcggatgggcttgagtactcccgaaccggactccaagcaggtctgaccatagatgagtttgccccccgtctgtcattcttctgggggatcggcatgaacttctacatggaaatagcaaagatgagagccggacgcaggctctgggcccaccttattgaaaagatgttccagccaaagaactccaaatcccttctgctccgcgctcactgccagacctccgggtggtccctgacagagcaggatccctataataacatcgtccgcaccgccatcgaggctatggctgctgttttcggaggcacccagagtctccacaccaactctttcgacgaggctctcggtctgcctaccgtgaagtcagcgcgcattgcccggaatacacagattatcatacaagaggaatccggcatacccaaggttgccgacccctgggggggaagttatatgatggaatgtctgacaaatgacgtgtatgacgcagcattgaagctgattaacgagatagaggagatggggggcatggccaaggccgtggccgaaggcatccccaaactccgaatcgaagagtgtgcagctagacgacaagcaagaattgattcaggaagcgaagtgatcgtaggagtaaataagtaccaactggagaaggaggacgctgttgaagtcttggccattgataacactagtgttcgaaatcgacaaatcgagaaactgaaaaagattaagagctcaagggatcaggccctggccgagcgctgtctcgctgccttaacggaatgtgctgctagtggcgatggcaatatcctggcactggccgtcgacgcatccagagcgaggtgcacagtcggagaaattactgatgccctgaagaaggtgtttggcgagcacaaagctaacgatcgtatggtttcaggggcctaccggcaggaatttggagaaagcaaggagattacctcagcaataaagcgtgtgcataagtttatggaacgagaggggagacggcctagattattggtggctaaaatgggtcaggacggccacgaccgaggagccaaggtcatcgcaacagggttcgccgatctagggttcgacgtcgatatcggaccgctgttccaaacaccccgcgaagttgcacagcaggctgtggatgctgacgtacacgctgttggaatctcgactcttgcagccggacacaagactctggttcctgagctaatcaaggagctcaattcccttggtcgccctgacattctagtaatgtgtggcggagtcattccaccacaggactatgagttcctgtttgaggttggtgtgagtaacgtgttcgggccgggaacaagaatacctaaggctgccgtacaggtgcttgacgacatcgaaaaatgcctggaaaagaagcaacagtccgtt

SEQ ID NO: 16680 - DNA, 2250 bp, Artificial Sequence
  Description of Artificial Sequence: Synthetic coding sequence
atgttaagggctaaaaatcagctgtttttgctcagtccacactatttacgtcaggtgaaggagtcaagcggatcccggttgatccagcagcggttgctacatcagcagcaacccctgcacccagagtgggctgcactcgcgaagaagcagctcaagggaaagaatcctgaggatctgatttggcacacaccggaaggcatcagtattaaacctctgtatagcaaacgggacaccatggacctaccggaggagcttccaggagttaaaccctttactagagggccctatcctaccatgtatacattccggccgtggacaattagacaatacgctggcttttctactgtggaggagtcaaacaagttttataaggataatatcaaagcggggcagcagggactgtctgtggcattcgacttagctacgcaccgtgggtacgatagtgacaatccaagggtgcgcggggatgtgggcatggccggtgtggccatcgacaccgtcgaagacacaaaaatcctcttcgatggaatccccctggagaagatgagcgtcagtatgaccatgaacggcgcagtaatacctgtcctcgctaacttcatcgtgactggagaggagcagggggtgccaaaggagaaactcactgggacaatccagaacgacatactcaaagagttcatggtccggaatacatacatctttcctcctgaaccctctatgaaaatcatcgctgacatcttcgagtacaccgctaaacacatgcccaagtttaacagtattagtatttccggctaccacatgcaggaggccggtgctgatgcgatcctggaactcgcttatactctagccgatggactcgagtattcacgcacaggactgcaggccgggctaaccatcgatgagtttgctccccgacttagctttttttggggtataggaatgaacttctatatggaaattgcaaagatgagggccggaaggcgcctgtgggctcacctgattgaaaagatgttccagccaaagaacagcaagtcactcctgctgagagcacattgtcaaacaagcggttggagtctcacagagcaggatccgtacaacaatatagtcagaacggcgattgaagctatggctgcagtttttggaggtacacagtccctacataccaattcatttgacgaggccctcggacttccaactgtgaaatctgccagaatcgcccgcaacacacagatcataattcaagaggagtctggaatcccaaaagttgcagacccatggggcggatcctacatgatggagtgtctgacaaacgatgtctatgacgccgctcttaagctgattaacgagattgaggagatgggtggaatggctaaggctgtggccgagggcattcctaagctgcggattgaagaatgcgcagcccgaaggcaggctcgcatcgatagtgggtccgaggttattgtgggcgttaacaaatatcaactagaaaaggaggatgccgtggaagtgctggctatcgacaacacatctgtaaggaacagacagatagaaaaactgaagaagatcaagtctagtcgcgatcaagcactggcggagaggtgtctggctgcgttgacagagtgcgcagcgagcggcgacggtaacatccttgccttggcggtggacgcatccagggctcgttgtaccgtgggcgaaatcacagatgcactaaagaaggtgttcggagagcataaggccaatgaccggatggtctcaggagcctaccgacaggaattcggggagtcgaaagagataacgtcagcaatcaaacgagtgcacaagttcatggagagggagggcaggcgcccacggctgctcgtggctaaaatgggacaggatggccacgatcgcggtgctaaagttattgctaccgggttcgccgacttggggttcgatgtggacatcgggccgttgttccagaccccaagggaagtcgcacagcaagctgtggacgccgacgtccatgccgtcggcatttcaactctcgccgcaggccataaaacactcgtccccgagttgatcaaggaacttaattcactgggccggccggatatacttgtgatgtgcggcggggtgattcctccacaagattatgaatttctattcgaggtgggtgtgagcaacgtgtttgggcccggtacaaggattcccaaagctgctgtccaggtcttggacgatattgaaaagtgtctggaaaagaagcagcagtccgtt

SEQ ID NO: 16681 - DNA, 2250 bp, Artificial Sequence
  Description of Artificial Sequence: Synthetic coding sequence
atgctccgtgctaagaatcaactcttccttctctcgcctcattaccttaggcaggtcaaggagagcagcggatcgagacttatacagcagagactgctgcaccaacagcaaccccttcatcctgaatgggcagcactcgcaaagaaacaactcaaaggcaaaaacccagaagatctcatatggcatacccccgaaggcatttctattaagccactttattccaaacgggacaccatggatctgcctgaagaactgcctggcgtaaagccatttaccaggggaccttaccctactatgtacacttttcgaccctggaccattagacaatacgccggcttctcaaccgtggaagaaagcaacaaattctacaaggataacatcaaagctgggcagcagggactctcggtggcatttgatctggcaactcatagaggatatgattcggataacccaagggtccgcggcgatgtgggaatggcgggagtggcaattgacactgtggaggataccaagattctgttcgatggtatacctttggagaaaatgtctgtgagcatgaccatgaatggtgcagtcattccagtgctggccaactttattgttaccggcgaggaacaaggagtgccgaaagagaagctgacgggaactatacaaaacgatatactgaaggaattcatggtgagaaacacctacatttttccacccgagccaagcatgaagattatcgccgacattttcgaatacactgctaaacacatgccaaaattcaactctatatcgatctccggataccatatgcaagaggccggtgcagacgccatcctggaactcgcgtacacgctggcagatggcctggaatatagcagaaccggactccaggcgggactcactattgacgagttcgcgccacgcctgtcattcttttggggaattgggatgaacttctacatggaaatcgccaagatgcgtgcaggaaggcgcctttgggcgcacctgattgagaaaatgtttcaacccaaaaactccaagagccttctcctccgggcccattgtcaaacctccggttggtcgctgaccgaacaagatccttacaacaatattgtgagaactgccatcgaagccatggcggcagtctttggcggtacccaatcccttcatactaatagcttcgatgaggctctcggtctgccgaccgtcaagtcagcacggatagccagaaacacgcagataatcattcaagaagaatcaggtattccgaaagttgccgacccatggggaggtagctacatgatggagtgtctgacgaacgatgtgtacgacgctgctctgaagttgattaacgaaattgaagagatgggaggaatggccaaggccgtcgcagagggcatccctaagctgcgtattgaggaatgcgcagcccgtagacaagcaaggatcgacagcggaagcgaagtgatagttggtgttaacaagtaccagctggagaaagaggacgcggtggaggtgctggctatcgataacacttccgtgcgcaatagacaaattgagaagctgaagaaaatcaaatcctccagggatcaggcactcgcagaacgctgcctggccgccctgactgaatgtgcagctagcggggatggaaatatcctggcccttgcggtcgatgcctcccgcgcacgatgtactgtgggagagattaccgacgcgctgaaaaaggtgtttggagagcacaaggcaaatgatagaatggtgtcgggggcttacagacaggaatttggagaatcgaaggaaattactagcgctattaagcgagtccataagttcatggagcgtgagggccgacgcccgagattgctcgttgcaaaaatggggcaggacggtcacgatagaggggcaaaggtgattgcaaccgggtttgcagatctgggcttcgatgttgatattggcccacttttccagactccacgagaggtcgcccagcaggcagtggatgcggatgtgcatgcagtgggaatatccacccttgccgcaggacacaagactcttgtgccagaattgatcaaagaactgaacagcctgggtcgtccggatattcttgtgatgtgcggtggcgtcatccccccgcaagactacgaatttctgtttgaagtgggagtctcaaacgtgtttggacccggaactcggattcccaaagccgcagtccaggtccttgatgatatcgagaagtgcctcgaaaagaagcagcaatccgtc

SEQ ID NO: 16682 - DNA, 2250 bp, Artificial Sequence
  Description of Artificial Sequence: Synthetic coding sequence
atgctgagggctaagaaccaactgttcctgctttccccccattacctgagacaggttaaggaatcaagcggtagtaggctgatccagcaacgtctcttgcaccagcaacaacccctgcaccccgaatgggctgctttagccaagaagcagctgaaaggcaagaaccccgaggaccttatctggcatactccagaaggcattagtataaaacctctctacagtaagcgagacaccatggatttaccagaggagctgcctggcgttaaacctttcactagaggcccatatcccaccatgtatacatttcgcccctggaccatacgacagtatgctggttttagtactgtcgaggagtccaacaaattctacaaagacaacattaaggccggacagcagggcctgtccgtggcctttgatctggccacccatcgcggctatgactctgataatccccgggtcaggggggatgtgggcatggctggcgtggccattgacacagtggaggatacaaaaatactattcgatggcattccgctagaaaaaatgtccgtgagtatgaccatgaatggagcagttatcccagttctggcaaattttatcgtgacaggcgaggagcagggcgtcccaaaagaaaagctgacaggaactatccagaatgatatcttaaaggagttcatggtgagaaatacctatatcttcccacctgagcccagtatgaagatcatcgctgatattttcgagtatacagcaaaacacatgcctaagtttaatagcataagcatcagcgggtaccacatgcaggaagcaggtgccgacgcaattctggaactggcttacacactggcagacggcctggagtacagtcgcactggactgcaagctggcctgaccatagatgaattcgcacctagactttcattcttctgggggattggtatgaacttttacatggaaatagctaaaatgcgggccgggagaaggctgtgggctcatctgatcgaaaagatgttccagccaaagaattccaagagtctacttctcagagcccattgccagacctccggctggagtctcaccgagcaggacccttataacaacatcgttcggaccgctattgaggctatggccgccgtgttcggcggcactcagagtttgcacaccaactcctttgatgaggctctcggcctgcccacagttaagtccgctagaattgcccggaatacccaaatcattattcaggaggagtccgggataccgaaggtcgctgacccctggggcggctcatacatgatggagtgtttaaccaacgatgtatacgatgctgccctcaagctgataaacgagatagaggagatgggcggcatggctaaagccgtggctgaaggcatacccaagctgaggatagaggagtgtgctgcacgcaggcaagcccgtattgattccgggagcgaggtgatcgtgggggtgaacaagtatcagctggaaaaagaggatgccgtggaagtcctggcaatcgataatacatcagttaggaatcggcaaattgaaaaactgaaaaagataaaatcttctcgcgaccaggctctggccgagcgctgccttgcagccctgactgaatgcgcagctagcggcgacgggaacattctagcactggccgtcgacgcaagccgcgctagatgtaccgtgggggaaataacagacgccctgaagaaagtttttggcgaacataaggctaacgatcgaatggtgtctggcgcctaccgtcaggagttcggcgagtcaaaggagattacctcagccataaagcgggtgcacaagtttatggaaagggaagggagacgccccagattactggtggccaaaatgggccaggacggccacgacaggggcgccaaagtcatcgctaccgggttcgcagacctcggctttgacgtggacatcggacccctattccaaacaccgagggaggtcgcccagcaagccgtggatgcagatgttcacgccgtgggcatctccacactggctgccgggcacaaaaccctggttccagaactcattaaggaactaaattctcttggaaggcccgatatactggtcatgtgtggcggggttattccaccacaggactacgagtttctcttcgaagtgggtgtctccaatgtcttcggccctggaactcggatcccaaaggcagccgtccaggtcctggacgacatcgaaaaatgcctagagaagaaacagcagagcgtg

SEQ ID NO: 16683 - DNA, 2250 bp, Artificial Sequence
  Description of Artificial Sequence: Synthetic coding sequence
atgctgagggctaagaaccagctgtttctgctgagccctcattatcttaggcaggtcaaagagagctcaggcagtcgccttatacagcagcgactcctccaccagcaacagccccttcaccccgaatgggcagcactggccaagaagcagcttaaagggaagaatccagaggatttgatatggcacaccccggaagggatctccataaaaccgctgtacagcaagcgggacactatggatcttcccgaggagctgccgggagtgaagccattcacacggggaccatatcccaccatgtacacttttagaccatggacgatacggcagtatgcaggattcagcaccgtggaggagagcaacaaattttataaggacaatatcaaagcagggcaacagggattgagcgttgcatttgacctggcgacccatagaggttatgactcagacaaccctcgcgtgagaggggatgttggcatggctggggtggctattgatacggtggaggacaccaaaattttgttcgatggcatcccgttagagaagatgagtgttagcatgacgatgaacggagccgtgattccggtcttggctaattttatcgtaactggggaagaacagggggtgccaaaggagaagttgactggtaccatccaaaatgacattctcaaggaatttatggtgagaaatacctacattttccctcctgaaccttctatgaagattattgccgacatctttgagtatacggccaagcacatgcccaaattcaattctatctccatcagcggctaccacatgcaggaggccggagccgacgcaatcttagagctcgcttacactctggccgacggtcttgagtactcacggacgggactccaagcaggattaaccatcgacgaattcgcaccccgtctgtcattcttttgggggattggcatgaacttctacatggagatcgccaagatgcgagccggcagacgcttatgggcgcacttgatcgagaaaatgtttcagcccaagaactccaagtctctgctgcttcgggcacattgtcagaccagtggctggtcactgacagaacaggatccttacaataatattgtgcgaaccgctattgaagccatggccgctgtgttcggaggcactcagtcactgcacaccaattcttttgacgaggccttagggctcccaacagtgaagtcagctcggattgctcgtaacacccagattattatccaagaagagtctggtatccctaaagtagccgatccttgggggggtagttatatgatggagtgcctcacaaatgacgtttacgatgccgccttgaagctcatcaatgaaattgaggagatgggcgggatggccaaggcggtggcagaggggatacccaaattgcgcattgaagagtgtgccgcgcgccgtcaggcacgcatcgattccggaagtgaggtcattgtgggcgtcaataaataccagctggagaaggaggatgccgtggaagtgctagccatcgacaatacgtcggtgcgtaataggcagatagagaagctcaagaaaattaagagttcgcgcgatcaggcactggccgaacgctgtctggctgcgttgacagaatgcgctgcttctggcgatggaaatatcttggcactggctgtggatgccagccgtgcacgctgcacagtaggcgaaatcaccgatgccttgaaaaaggtgtttggagaacataaggctaatgaccggatggtgagcggagcatatagacaagagttcggcgagagcaaagaaataacttctgccatcaaacgcgttcacaaattcatggagcgagaaggtcgaagaccccggctgctcgtggccaagatggggcaggacggtcatgaccgaggtgcaaaggtgatcgctacggggttcgcggatctcggctttgacgttgacatcgggccgttattccaaactcctagggaggtcgctcagcaggctgtcgacgctgacgtgcatgccgtgggcattagtactctcgccgctggccacaagactctagtccccgagctgatcaaagagcttaactccctcggtcgccccgatatcctagtgatgtgtggaggcgtgattccgccacaggactacgaatttctcttcgaggtcggtgtgagtaatgttttcggaccgggaaccagaattcctaaagcagctgtacaggtcctcgacgacatcgagaagtgtctcgaaaagaaacaacagtccgtt

SEQ ID NO: 16684 - DNA, 2250 bp, Artificial Sequence
  Description of Artificial Sequence: Synthetic coding sequence
atgctgcgggcaaagaaccagctgttcctcctgtccccgcattacctgcgccaggtcaaggaatcatcgggcagccggctgatccagcaacgcctgctgcaccagcagcaacctctgcaccccgaatgggcagctctggccaagaagcaactcaaagggaagaacccggaggacctgatctggcatacgcctgaaggaatctcgatcaagccgctgtactccaaaagggacacgatggatctgcccgaagagcttcccggtgtgaagccgtttacccgcggaccgtaccctactatgtacacttttcggccctggaccattagacaatacgccggcttctccactgtggaggaatccaacaagttttacaaagacaacatcaaggccggccagcagggtctgagcgtcgcttttgacctggctactcaccgaggttatgatagcgacaatccgcgcgtgcgcggggacgtggggatggccggggtggcaattgacaccgtcgaggatactaagatactgttcgatggaatcccattggagaagatgtctgtgagcatgaccatgaacggcgccgtgattcctgtgctggccaatttcatcgtaactggagaagagcagggagtgccgaaagagaagctcaccggaaccatccagaatgatatcctgaaagagtttatggtgagaaacacttacattttcccgcctgagccatcgatgaagattatcgccgacatcttcgagtacacggcaaagcacatgcctaagttcaactctatcagcatctcaggataccatatgcaagaggcgggagccgacgcgatcctcgagctggcctacacccttgcagacggtctggaatactcgcgaactggcctgcaagcagggctgactatcgatgaattcgccccacgcctctccttcttctggggaataggaatgaatttctatatggaaattgcaaagatgagagctggcagacgcctgtgggcccatttgatcgagaaaatgttccagcctaaaaactccaaatcccttctgttgcgcgctcactgccaaacgagcggatggtccctcaccgaacaagatccgtacaataacatcgtgcgcaccgccatcgaggctatggctgcagtgttcggtggcacccagtcactgcacaccaacagcttcgacgaggcgctcggcctgccgaccgttaagtctgcacgcatcgcccgcaacacccagattatcatccaggaggaatcgggaattccaaaggtcgccgacccgtggggtggatcttacatgatggagtgtctcactaatgacgtgtacgacgcggccttgaagctgattaacgagatcgaagaaatgggaggcatggccaaagcagtggctgaaggcatcccgaagttgaggattgaggaatgcgctgcaaggcggcaggcgagaatcgactccggttcggaagtgatcgtgggcgtcaataagtaccagttggaaaaagaagatgcagtggaagtcctcgcgatcgataacacttcggtccggaacaggcaaatcgaaaagctgaagaaaatcaagtcgtcacgcgatcaggcgcttgctgaacgctgcctggccgccttgacggaatgcgcagcatcaggggatggaaacatcctcgccctggccgtcgatgcgtcccgggcgcggtgcactgtgggagagatcactgacgcgctgaagaaggtgttcggagagcacaaggccaacgaccggatggtgtccggagcctatagacaagaattcggagaatccaaggagatcacttccgcaatcaaacgagtccataagttcatggaaagagagggacggcgtccaagactcctcgtggccaagatgggacaggacggccacgacaggggcgccaaggtgatcgcaactggattcgcggacttgggttttgatgtagacataggtccactcttccagaccccacgcgaagttgcgcagcaggctgtagacgcggacgtgcatgcagtgggaatctcaactctcgcagctgggcataaaactctggttccggagctgattaaggagctcaattcgctcggccggccagacatccttgtgatgtgtggcggggtgatacccccgcaagactacgaattcttgtttgaagtgggagtcagcaatgtgttcgggccgggcaccaggattcccaaagctgcagttcaagtgctcgacgatatcgaaaagtgcctggagaaaaaacagcaatcagtg

SEQ ID NO: 16685 - DNA, 2250 bp, Artificial Sequence
  Description of Artificial Sequence: Synthetic coding sequence
atgctcagggcaaaaaaccagttgtttttgttgagcccacattatctgcggcaggttaaggaatcttctggcagccgtctgattcagcagagactcctgcatcaacagcagcctctgcatccagaatgggccgccttggccaagaaacagcttaagggtaagaacccagaggacctgatctggcacacacctgaggggatctcaataaagccactgtactcaaagagggacactatggacctgcctgaggagcttcctggggtcaaaccttttacccgcggaccctatccgacgatgtacacttttaggccttggaccattcggcaatacgctggcttctctaccgtagaggaatcaaacaagttctacaaggacaacattaaggcagggcaacaggggctctctgtggccttcgaccttgcgacacatcgggggtatgactctgacaaccccagggtgcggggggatgtgggaatggcgggtgtggctatagatacggtggaggacaccaaaatcctgttcgatgggattccacttgagaaaatgagcgtgagtatgacgatgaacggggccgtgatcccggttttggcaaatttcatcgtcactggtgaggagcagggagtgcccaaagaaaaattgacgggcactatccagaacgatatcctgaaggagttcatggttcgcaacacgtatatcttcccaccagagccgtcaatgaagatcatcgccgatatcttcgagtacacagccaagcatatgccaaaattcaattcaatctcaatttcaggctatcacatgcaggaggctggggctgatgctatcctcgagttggcgtatacacttgcagacggcctagaatattcccggacggggctgcaggctggcctcacaatagacgaatttgctcctaggctgagtttcttctggggtattggcatgaatttttacatggagatcgccaagatgcgtgctggccgacgtctttgggcccacctgatcgaaaagatgttccagccgaagaattctaagtccctccttctgagggcccattgtcagacatccgggtggtcattgacagagcaggatccctacaacaatatagtgcgaacagccattgaggctatggctgccgtgtttggaggaacccagagcctgcatacaaactcctttgatgaagcactagggttgcccactgtgaaatccgcgcgcattgctagaaatacacagattattatccaggaggagagcggcattcctaaggtcgctgatccctggggaggttcatatatgatggaatgccttacaaacgacgtgtatgatgctgcgctcaagctcattaacgagatcgaagaaatggggggcatggccaaagccgtggccgaaggcattccaaagctgaggattgaggagtgcgccgcaagaagacaagccagaatagactctgggtcggaagtgatcgtgggcgtgaataaataccagctggaaaaagaggacgcagtagaggtgctggcaattgataacacctcagtacgtaataggcagatagagaaactgaagaagataaaatctagccgggatcaggcactcgccgagaggtgcctagcagctttaacagagtgcgccgcgagcggggacggtaatatcttggcccttgccgttgatgcttccagagcaagatgtacagtcggagagattacggatgccctcaaaaaggtgttcggtgagcataaagccaacgatcgcatggtgtccggtgcataccgacaagagttcggtgagtccaaagagattaccagcgcgataaaaagggtgcacaagtttatggagagagagggccgacgtccccggctgttggtagccaagatgggtcaagacggtcacgacaggggcgcaaaggtgatcgccaccggctttgccgatcttgggttcgacgttgatataggtccgttattccagacacctcgcgaggtggctcaacaggcagtagacgccgatgtacatgctgtaggtatctctaccctggcggccggacacaagactctggtgccagagcttatcaaggaactgaattccctgggacggcctgatatcctggtgatgtgcggaggagtgattcctccccaagattacgagtttctattcgaagtcggtgtgtctaacgtgttcggaccgggtacaagaatccctaaggcagcagtacaggtattagacgacatcgagaaatgtctagaaaaaaaacagcagtctgtg

SEQ ID NO: 16686 - DNA, 2250 bp, Artificial Sequence
  Description of Artificial Sequence: Synthetic coding sequence
atgttgcgcgccaaaaaccagttgtttctgctgtccccacactatctgcgacaggtgaaagaatcatcggggagtaggttgatacagcagcgcttgttacatcaacagcagccccttcaccctgagtgggccgctctggcaaagaagcagcttaagggcaagaatcccgaagacctgatctggcacacccccgagggtattagtattaagcccctctactccaaacgggacacaatggacctccccgaggagctgccgggcgtgaagccatttactcgcggcccttatcccaccatgtacactttcaggccgtggacgatccgtcagtacgcaggatttagcaccgtggaggagtcaaataagttttacaaggacaacatcaaagcaggccagcagggtctgagtgtggccttcgatctcgctacgcacagggggtacgactctgataatccacgggttcgcggcgatgtcggaatggctggggtcgcgatagacaccgtcgaggataccaagatcctgtttgacggtatccctttggaaaagatgagcgtatctatgactatgaatggcgctgtcatccctgtgttggccaactttatcgttacaggagaagaacagggcgtgccaaaagaaaaactgactggcaccattcagaacgatatactgaaggagttcatggtcagaaacacctatatcttcccgcccgagccatccatgaagataatcgcagacatcttcgaatatacagccaagcacatgcctaagttcaacagcatctccatcagtgggtaccacatgcaggaggccggagccgacgccatcctagagctggcctatacacttgccgacggtctagagtattcgagaactggacttcaggccggcctcacaattgatgagttcgccccccggctgtcctttttttggggaattgggatgaatttttacatggaaattgctaaaatgcgtgccggcaggcgcctgtgggcacacttgattgaaaaaatgtttcagcctaaaaacagtaagagtctgctgctacgtgcgcattgccagacatcggggtggtccctaacggagcaggacccctacaataacattgtacgcactgccattgaagccatggccgcagtgtttggggggactcaatctttgcacaccaattcattcgatgaggctttaggcctgcctactgtcaaatccgcgagaatagcacggaacacgcaaatcataattcaggaagagtctggcattcctaaggtggcagacccctggggaggcagttatatgatggagtgtttgaccaatgatgtctacgacgccgccttgaagctgattaatgagattgaagaaatggggggcatggccaaggctgttgctgaggggattccaaagctgaggatcgaggaatgtgccgctcgtcggcaggcccggatcgactccggctctgaagtgattgttggcgtgaacaagtaccagctggagaaggaagacgctgtggaagttttggccattgacaatacaagcgtgcgcaaccgccagatcgagaagctaaagaagattaagtcgtcaagggaccaggcattagccgagaggtgccttgccgccctaactgagtgcgcagcaagtggagatggcaacatactagcactcgccgtggatgcctccagagcacgttgcactgtaggggaaatcactgacgcactgaagaaggtgtttggagagcacaaagccaacgacagaatggttagcggggcgtatcgccaggaattcggagagagcaaagagatcacatcagctatcaagagagtccataaattcatggaacgagagggtcggagacccagactgctagtggctaaaatgggacaggacggccatgaccgaggagctaaagtaattgcaacgggttttgcagatttaggttttgacgtggatatcggacccctgttccaaacccctcgggaagtggcccagcaagccgtagacgccgacgtgcatgccgtcggtatcagcactctggccgccggacataagacactggtccccgagctcattaaagagctaaactccctcggccggcctgatatcctggttatgtgtggcggagtgatcccccctcaggactatgaattcttgtttgaggtcggagtctcaaacgtttttggcccgggcacccgaattccgaaagccgcggtgcaggtcttggatgacatcgagaagtgtctggagaaaaaacagcagtcggtc

SEQ ID NO: 16687 - DNA, 2250 bp, Artificial Sequence
  Description of Artificial Sequence: Synthetic coding sequence
atgctccgcgccaaaaaccaactttttcttctctcaccgcactacttgcggcaggtgaaggagtcctcagggagtaggctaatccagcagaggctgttgcaccagcagcaacctctacatccagaatgggcggcccttgctaaaaagcagctgaagggtaagaatccagaggacctcatctggcatacaccagaaggcatctccatcaagcccttgtatagcaagcgggacacaatggacctgcctgaggagctccctggcgtaaaaccttttacaaggggcccttacccgactatgtacactttccgaccttggaccatacgacagtacgctggttttagcaccgttgaagagtcgaacaagttctataaggacaatattaaagctggacagcaggggttatcagtagctttcgacctggcaacacaccgagggtacgactctgataatccccgcgttcgaggagacgtgggcatggccggggtggcaattgacactgtggaggacaccaagattctctttgatggtatcccgctggagaagatgtccgtcagtatgacaatgaatggtgccgtgattcccgtgctagcaaatttcattgtgacgggggaggagcagggagtgccgaaagaaaagttaacgggcaccatacagaacgatatccttaaggaattcatggttagaaacacgtatatctttccccctgagccctcaatgaaaatcattgcagatatctttgagtacacagccaagcacatgcctaagttcaactcgatcagcatctccggttatcacatgcaggaagcgggagccgacgctatcctggagctagcttacactttggcagatggtctcgagtatagcagaacaggtttgcaggctggcctcacgatcgacgaatttgcgccacgattgtctttcttctggggcatcgggatgaatttctatatggaaattgcgaaaatgcgcgcgggtcgcaggctttgggctcatctcattgaaaagatgttccagccaaaaaacagcaaatccctccttctgagagcacattgtcaaacatcgggctggagtcttactgaacaggacccatataacaacatcgtgagaacagctattgaagccatggccgcggtttttgggggaacacaatcactgcatactaactcattcgatgaggctctcggtttgccgaccgtcaaatcggccaggatagcccgcaatactcagatcataatccaggaggagtctggaatccccaaggtcgctgatccttggggcgggagctacatgatggagtgcctcaccaatgacgtgtatgacgctgctcttaaactaatcaacgagatcgaggagatgggcgggatggcaaaagccgtagctgaaggtattcctaagttgcgaatcgaagagtgcgcagctaggaggcaggcaagaatagatagcggatctgaagtgatcgttggagtgaacaagtatcagctggagaaagaggatgctgtggaggtgttggccatcgacaatacaagcgtgagaaatagacagatcgaaaagttgaaaaaaattaaatccagtcgagaccaggcactagcagaaagatgcctggctgctctgaccgagtgtgctgcctcaggagacgggaatattctagctttggccgtggacgcctcccgagccaggtgtacagtgggtgaaataaccgatgcgcttaagaaagttttcggcgagcataaggcgaatgacaggatggtttcaggagcataccgccaagagtttggcgagagtaaggagataacaagcgccatcaagcgcgtgcataagttcatggagcgagaggggagaaggcctcggctactagtcgctaagatgggtcaggatggccacgaccggggcgccaaagtcatcgctacgggctttgccgatctaggcttcgatgtggacataggaccccttttccaaacaccaagggaggtggcccagcaagccgtagatgcagacgtacacgctgtcggaatatccaccctggccgccggtcataagaccctggtgcctgagctgatcaaagagcttaacagtctggggaggcctgatatattggttatgtgtggaggggtgattcctccgcaagattacgagtttctcttcgaggtaggtgtgagtaatgtgtttggtcctgggaccaggatccccaaggctgccgtccaggtcctggacgacatcgagaaatgcctggaaaagaaacagcagtccgtg

SEQ ID NO: 16688 - DNA, 2250 bp, Artificial Sequence
  Description of Artificial Sequence: Synthetic coding sequence
atgctgagggcgaaaaaccagctgtttctgctgagcccacattatctccgacaagtgaaagagtcctccggctcccgactcattcaacaaaggcttctgcaccaacagcagcctctccatcccgaatgggccgcgctggcgaagaagcagcttaaggggaaaaaccccgaggacctgatttggcacactcctgagggcatctcaatcaagcctctctatagtaagagagacaccatggatctgcccgaagagctacctggcgtgaagccctttacacgtggcccatatcccaccatgtacacctttaggccatggactattaggcagtacgcaggattttctactgtggaggagtcgaacaaattctataaagacaacatcaaagctggccaacagggcttgagcgtggcattcgatttagcgacacacagaggttatgatagcgacaatccacgcgtgagaggcgacgtggggatggcgggcgtggcaatagacacagtcgaagatactaaaatcctgttcgatggcatccctttagagaaaatgagcgtcagcatgactatgaacggcgccgtgattcctgtacttgctaacttcattgtgacgggtgaggaacaaggggtgcctaaggaaaagctgacgggcactattcaaaacgacatcctaaaggaatttatggttagaaatacgtacatctttccacccgagccttctatgaaaataatcgctgacattttcgagtacacagccaaacacatgcctaagttcaactcgatctccatctccggttatcacatgcaggaagctggggcagatgccatcctggaattggcatacaccctggcagacggattggagtactctaggacgggtctgcaggccggactgacaattgatgaatttgccccccgcctgtcatttttttggggcataggaatgaacttttacatggagattgctaagatgagagccgggcggcggttatgggcacacctcattgagaaaatgttccagcctaaaaactcaaagagtcttcttctgcgcgcacattgccagacctccggctggtccctaaccgaacaggacccctacaacaatatcgtgcgtacagctatcgaagccatggctgctgtgttcggaggtacgcaatctctccacacaaactcattcgatgaggctctaggtctgcccaccgttaagtcagcccgtatcgctagaaatacccagatcatcattcaggaggagtccggtattcccaaggtggctgacccatggggtgggagctatatgatggagtgtctcacaaacgatgtgtatgacgcagcattgaaactgattaacgaaattgaagaaatgggaggtatggccaaagctgtagcagaagggattcccaagctgcgcatagaagagtgcgccgccagacgccaggcgcgtattgacagtggaagcgaggttatagttggggtgaacaagtaccagcttgagaaggaagacgctgtggaggtgctagctatcgataacacttccgttcgcaaccggcaaatcgaaaaactgaaaaaaattaagagcagtcgtgatcaggctctggccgagagatgtcttgcggccctgaccgagtgcgccgcctccggagatggaaacatcctggccttagccgtggacgcgtcgcgcgcacggtgcacggtgggagagataaccgatgctctcaagaaggtctttggagagcataaggccaacgatcgcatggtatcaggcgcctaccgacaggaattcggagagtccaaagagatcacctctgccataaaacgagttcacaagttcatggagagggagggaaggagaccgaggctccttgtggccaagatggggcaggatggtcatgatcgtggtgctaaagtcatagctaccggattcgctgatttaggtttcgacgttgatatcgggccattatttcagacacccagagaggtcgcccagcaggccgtcgatgcagacgttcacgccgtcggaatttccactcttgccgccgggcacaagaccctcgtgccagagctcattaaagagctgaattcccttgggcggcctgatatcctggtcatgtgcggtggcgtgattcccccccaggactacgagttcctgttcgaggtgggcgtgtcaaacgtgtttggtcctggtactaggatcccgaaagccgcagttcaggtgttagacgatatagagaagtgtcttgagaagaagcagcagtctgtg

SEQ ID NO: 16689 - DNA, 2250 bp, Artificial Sequence
  Description of Artificial Sequence: Synthetic coding sequence
atgctgagggccaagaaccagctttttctgctttcgccgcattacctgcgccaagtcaaggaaagctccggttcgcgtctgattcagcaacggttgctccaccagcaacagcctcttcatcccgagtgggcagcactcgccaagaaacaacttaagggcaaaaaccctgaagatcttatatggcatactccagaaggaatttcaattaagccgctgtactccaagcgggataccatggatctcccagaagagctgcccggtgtgaaacccttcaccaggggcccgtatccaacgatgtacacttttagaccatggaccatccggcaatacgcaggtttcagcactgtggaggaatcgaacaagttttacaaggacaacattaaggcagggcaacagggtttgtcagtcgcattcgatctcgccacccacaggggatatgatagcgacaaccctagagtgaggggagacgttggtatggcaggcgtcgctattgatactgtggaggataccaagattctgttcgacggaatcccgctggagaaaatgagcgtttcgatgaccatgaacggagccgtaatccctgtgctcgcaaatttcatcgtcactggtgaagagcagggtgtgcccaaagagaaactgactgggaccattcaaaatgatattctgaaggaattcatggtgaggaacacctacatattcccaccggagccaagcatgaagattattgcagacattttcgaatacaccgcaaagcacatgcccaagtttaactccatttccatttcaggataccatatgcaggaagcaggtgcagatgcgattcttgaactggcctacactctcgcagacggactggagtactcgaggactggcctccaggcaggactcactattgatgagtttgctcctcgactgagctttttctggggaattgggatgaacttctacatggaaattgcaaagatgcgtgcaggcaggcgcctgtgggcacatttgatcgagaagatgtttcaaccaaaaaactcgaagagccttctcctgcgtgcccattgtcaaacctctggatggtcccttaccgaacaagatccatataacaacatcgtgcgcaccgcaatcgaagcaatggcggccgtctttggtggaacccagtcacttcataccaattcgtttgacgaggcactggggcttccaactgtgaaatccgccagaattgcccggaacactcagattatcattcaagaggagtccggaattcccaaggtggctgatccgtggggaggtagctatatgatggagtgtctcactaacgatgtgtacgacgctgcacttaagctcattaatgaaattgaagagatggggggtatggcaaaggcagtggccgaaggaatccccaaattgcgcattgaagaatgcgcagcgcgccggcaagcacggatcgattctgggtccgaagtcattgtgggggtcaacaagtaccaactcgagaaggaggacgcagtggaagtgcttgccattgataacacgtcggtgcggaacaggcaaatcgaaaagttgaagaagataaagtccagccgggaccaggccctcgcagagagatgtctggccgctctgactgaatgtgcggcaagcggagacgggaacattctcgcactggcagtggacgcctccagagcacgctgtaccgtgggtgaaattaccgacgcactcaagaaagtgttcggagagcacaaggcaaatgacagaatggtgtcaggagcatacagacaggaatttggcgaatccaaagaaatcacgtcagcaattaagagagtgcacaagtttatggaacgagaaggacgaaggccacggttgcttgtggcaaaaatgggtcaagacggccacgatcgcggcgcaaaagtgattgctactggctttgccgatcttggatttgacgtggacataggcccgctgtttcaaacgccccgcgaagtggcacagcaagcggttgatgccgacgtgcacgcggtcggcatcagcacccttgcagcaggtcataagactctggtgccagaattgatcaaagagcttaattcgctcggccgtcctgacattctcgtgatgtgtggtggagtgatccctccccaagactacgaattcctgttcgaagtcggagtttccaatgtctttgggcctgggaccaggatcccaaaggcagcggtgcaggtgctggacgacattgaaaagtgtctcgaaaagaaacaacaatcggtc

SEQ ID NO: 16690 - DNA, 2250 bp, Artificial Sequence
  Description of Artificial Sequence: Synthetic coding sequence
atgttgcgagctaagaatcagctgttcctcttaagcccccactacctgcgccaagttaaggaatcctcaggctcacgactgatccagcagcgtctcctgcatcagcagcaacctcttcaccctgagtgggcagctcttgctaagaaacagctgaaagggaaaaatccagaggatctgatctggcatacccctgaaggaatatccatcaaaccactatattcaaagcgggacacaatggatctgcctgaagagctgccaggtgtgaaaccgtttacccgcgggccgtatcccactatgtacaccttccgtccttggaccatccgccagtatgccgggttttctactgtcgaggagagcaataaattctataaagacaatatcaaggcaggacagcaggggctgtccgtcgcctttgatctggctactcaccgggggtatgacagtgacaaccccagggtgcgcggcgatgtcggaatggccggcgtggctatcgacactgtcgaagacacaaaaattctgtttgatggcattcctttggaaaagatgagcgtaagtatgactatgaacggcgccgtgattcccgttctggccaattttatcgtaacgggggaagagcagggtgtgccaaaggaaaaactcaccggtacaattcaaaacgatatactgaaagagtttatggtcaggaatacatatatctttcctcctgaaccctctatgaagatcatagccgatatattcgagtacacagcgaaacacatgcctaaatttaactccatctcaatatctggctaccacatgcaggaggcaggagctgatgccattctagagttggcctacacactagcggacggtctggagtacagtaggacgggactgcaggccggtctgacgattgacgagtttgccccccggttgtccttcttttggggtattggcatgaatttttacatggagatagccaagatgcgggctggacgaaggctgtgggcccacctgatcgaaaagatgtttcagccaaaaaactcaaaatccctgttactcagagctcattgccagacctctgggtggagtcttacagagcaggatccctacaacaacattgtgcgaacagcgattgaagcaatggcagccgtgtttggaggcacgcagtccctgcacacaaacagcttcgatgaggctctcggcctccccacagtgaaaagtgcgagaattgctcgcaacacacagatcattattcaggaagagtcaggaatccccaaggtggcggatccctgggggggctcctatatgatggagtgtctgacaaacgatgtctatgatgccgccctcaagctgattaacgagatcgaggaaatggggggaatggccaaagcagtcgcagaagggatacctaagctacggatcgaggaatgcgccgctcgacgccaagcacggatagactccgggagtgaagtaatcgtgggcgtgaacaagtatcagttggaaaaagaggacgccgtcgaagtgttggccattgataatacaagcgtgagaaatcgacagatagagaagctcaagaaaatcaaatcatcccgggatcaagcgctggcagaaaggtgtctcgcggccctcaccgaatgcgccgccagcggggacggaaacatcctggccctggccgtcgatgcctcacgagctcgttgcaccgttggagagattacagatgcgctgaagaaagtgttcggggagcacaaggccaatgatcggatggtgtcgggagcttaccgacaggagtttggcgaaagcaaagagattacctctgccatcaaacgggttcataaatttatggagcgggaggggcggaggccacgtctactagtcgctaaaatgggtcaggacgggcacgacagaggggctaaagtgatagcaacaggcttcgccgacctgggtttcgacgtcgacatcggccccctttttcagacaccccgggaggttgcgcaacaggccgtcgacgcagacgtccatgctgtgggcatctcaaccttagctgccggacataaaacactcgtgccagagctcatcaaagagctcaatagtctcggacgaccagatattctcgttatgtgtgggggcgtgatccccccccaggattacgagtttctctttgaggtgggcgtgagcaatgtgttcgggcctggtactagaatcccaaaggccgctgtgcaggttttagatgacatcgaaaagtgtttggagaagaaacaacagagcgtt

SEQ ID NO: 16691 - DNA, 2250 bp, Artificial Sequence
  Description of Artificial Sequence: Synthetic coding sequence
atgctacgggccaagaatcagcttttcttgctttcaccgcattatttacgtcaagttaaggagagctctgggtcccgtttaatccagcagaggttgctgcatcaacagcaacctttacaccctgaatgggcagctttagctaagaagcaactgaagggtaaaaacccagaggatctgatctggcacacgccagaaggaatcagcattaaaccgttatactccaaacgggacaccatggatctgccagaggaacttccaggggttaagccttttactagagggccatatccgactatgtacacctttagaccatggaccattaggcaatacgctggtttttcgacagtagaagaaagtaacaaattttacaaagataatattaaggctgggcaacaaggtctcagcgtggccttcgatttggccacacaccgtggttatgattccgataaccctagagttcgtggcgatgtcggaatggctggtgttgcaatagacaccgtcgaagacacaaaaattttgtttgacggtattccattagagaagatgtccgtgtctatgaccatgaacggagcagttattcctgtccttgctaacttcattgtcactggtgaagagcaaggagttcctaaagaaaaacttaccggtaccattcaaaacgatatcctcaaagaatttatggttcgaaacacctatatcttcccacctgagcccagcatgaagatcatcgctgatatatttgagtataccgctaaacacatgcctaaatttaactcaatctctatatctgggtatcatatgcaagaagcaggtgccgatgctatactcgagttggcctatactttggccgacggacttgaatactctcgtactggactccaggccggactcactatagatgagttcgctcctcgtctctccttcttttggggaataggaatgaatttttatatggaaatcgctaagatgcgggctgggcggagactttgggctcacttgatcgaaaagatgtttcaacctaagaatagtaagagcctacttctcagagctcactgtcaaacatcgggttggtccctaactgaacaagatccatacaataacatcgttaggacagcaatagaagctatggcagcagtttttggtggaactcaatctctccatacaaatagctttgatgaggccttaggcctccccactgttaaatctgctcgtatcgctagaaacactcaaattataattcaagaagaatcgggaataccaaaagttgcagacccttggggaggttcttacatgatggagtgccttaccaacgatgtatacgatgctgccctcaagctaatcaatgaaattgaggaaatgggaggtatggctaaggcagttgccgagggtattccaaaattgcgaatagaagaatgcgcagcccggaggcaagctcgtattgatagcggcagtgaggtaattgtcggcgttaataagtatcagctagaaaaggaagatgcggttgaagtcctcgccatagataacacctcggtccgtaataggcagattgaaaaactgaagaaaattaagtcgtcaagagaccaggctttggccgagagatgtcttgcggctttgacagaatgtgctgctagtggtgatggtaatattttagctctagcagtcgatgcatccagagcaagatgcactgtcggagaaataaccgatgctctgaaaaaggtcttcggggagcacaaggcaaacgatcgaatggtcagcggagcatatagacaagagtttggggaatcaaaagaaattacttcagctatcaaacgagtgcataagtttatggaaagggaagggaggcggccacgtcttctcgttgccaaaatgggccaggacggacacgacagaggagccaaggtgattgctacaggctttgctgatttgggctttgacgtagatatcggtccactgtttcagactcctcgtgaagttgctcaacaagcagttgatgcggatgtgcatgcggtcgggattagcactcttgctgcaggacacaagacactcgtaccggagctcattaaggagttgaattccttgggtaggccggatatactagtcatgtgcggtggtgtcatcccaccccaggactatgaatttctgtttgaagttggggttagtaacgtctttggacccggtaccagaattcctaaggcggcggttcaggtgttagatgacatagaaaagtgcctagaaaagaagcaacagagtgtt

SEQ ID NO: 16692 - DNA, 2250 bp, Artificial Sequence
  Description of Artificial Sequence: Synthetic coding sequence
atgcttagagcaaagaatcagttgttcttgctctcgcctcattacctgcgccaggtgaaagaatcgtccggttcgcggctgattcagcaacgactgctgcatcaacagcaacctctgcacccagaatgggctgccttggcaaaaaagcaactgaaaggcaaaaaccctgaagatcttatctggcacactcctgagggaatttcgatcaagcccctttacagcaagagggataccatggatctccctgaagagctgcctggagtgaaaccctttacccgagggccgtatcctactatgtacacctttcggccatggactatcaggcaatacgctgggtttagtactgtggaagaatcgaacaagttttacaaggataacataaaggcaggtcagcagggactttcggtggcatttgatcttgcaacccacaggggttacgattcagataatcctagagtccggggggatgtgggaatggcaggcgtcgccatcgacaccgtggaagatacgaagatactttttgacggcataccgttggaaaagatgtctgtgtccatgaccatgaacggagccgtcattccggtcctcgcaaactttatagtcaccggagaggagcaaggagttcccaaggagaagctcactggaactattcaaaacgatatcttgaaggagttcatggtgcgcaacacttacatcttccctcccgagccatcaatgaagatcatagccgatatctttgaatacaccgcaaagcatatgccgaaattcaactcaatctcaatttccggttaccacatgcaagaagcgggagccgatgcaattcttgagcttgcctacaccctggcagatggccttgaatacagccggactggtctgcaagcgggactgactatcgacgagtttgcaccacgactgagcttcttttggggaattggaatgaatttctacatggagatcgcaaagatgagagcaggacgacgtctgtgggcacatcttattgaaaagatgttccagcctaaaaactcaaagtcgctgctgctcagagctcattgtcaaacctccggatggtcccttactgaacaagatccgtacaacaacatcgtgagaacggcgatagaagcgatggcagctgtgtttggcggaactcaatcgctccacaccaactcatttgatgaagcattgggacttccgactgtcaagtcggctcgcattgctagaaatactcagattatcatccaagaagaaagcggcatccctaaggtggcagatccatggggtggatcatacatgatggagtgccttaccaacgacgtgtacgacgccgcactgaaattgattaatgaaattgaagagatgggaggtatggcaaaggcagtggccgaaggcattccaaagctccggatcgaagagtgtgcagcacggaggcaagcacgcatcgattcggggtcggaagtgatcgtgggggtcaacaagtaccagcttgaaaaggaagatgcagtcgaagtgctggcaattgataacaccagcgtgcgaaacagacagattgaaaaactcaagaagatcaaatcttcacgcgaccaggcccttgcagagagatgtttggcggcccttacggaatgtgccgcctcgggggacggcaatatccttgcactcgcagttgacgcctcgcgggcccgatgcaccgtcggagaaattactgatgcactcaagaaggtgtttggagaacacaaggccaatgacagaatggtcagtggtgcatataggcaagagtttggtgaatcgaaagaaattacctccgcaatcaagcgcgtgcacaaattcatggaaagagaggggagacggccccgcctgctcgtggcaaaaatgggtcaggatggacatgacagaggagcaaaggtgattgctaccggatttgcagaccttggatttgatgtggatattggccctttgtttcagaccccacgcgaagtggcccagcaggcagttgatgcagacgtgcatgccgttggcattagcacgctcgcggccgggcacaaaacccttgtgcccgagctgattaaggagttgaattcgttgggaaggcctgatatccttgtgatgtgcggtggcgttattccacctcaagactacgagttcctgtttgaagtgggagtatcaaatgtattcgggcccggaacccggataccaaaggcagcagtccaggtccttgatgacatcgaaaagtgtctcgaaaagaaacaacaatcagtg

SEQ ID NO: 16693 - DNA, 2250 bp, Artificial Sequence
  Description of Artificial Sequence: Synthetic coding sequence
atgctcagagcaaagaaccagctgtttctcctttccccgcattatctgagacaggtcaaagaaagctcggggagccgcctcatccagcagaggctcctccaccagcaacagccactgcatcctgaatgggcggccctggcgaaaaagcagctgaagggcaaaaatccggaagatctcatctggcacactcccgagggtatcagcattaagcctctctactcaaaaagggatactatggacctgccagaagagctccccggagtgaaacctttcaccagaggaccttacccgaccatgtacaccttccgcccgtggaccattagacagtacgccggatttagcaccgtcgaagaatcaaacaagttctacaaggacaatatcaaggccggtcagcagggcctgtccgtggcattcgacctcgcgactcaccgtggatacgactcggacaacccaagggtccgcggcgacgtcgggatggccggcgtcgccatcgacaccgtggaggacactaagattctgtttgatggtatcccactggagaaaatgagcgtgtccatgactatgaacggcgcagtgatcccggtcctggcaaactttatcgtgaccggggaggaacagggtgtgccaaaggaaaaactcaccggaactatccaaaacgacattctcaaagagttcatggtgcgaaatacctacatcttcccgccggaaccttcaatgaagatcatcgctgacattttcgaatacacggccaagcacatgccgaagttcaattcgatctcaatttcgggatatcatatgcaggaggctggtgcggacgccatcctggagctggcgtacactctggccgacggcctggaatactcgagaaccggcctccaagccggcctgaccatagacgagtttgccccacgcctgtcgttcttctggggaattggcatgaacttctacatggaaatcgccaaaatgagggcaggccgccggctgtgggcccatctgattgagaagatgttccaaccgaaaaacagcaagtcccttcttctgagagctcactgtcagacctccggatggtccctcactgaacaagacccttacaacaacatcgtgcggaccgccatcgaagccatggcggcggtgttcggcggaactcagtcgctgcacaccaattcttttgatgaggcactgggacttccgaccgtgaagtcagcaaggattgctagaaacactcagatcattatccaagaagaaagcggtatcccaaaggtggccgatccatggggaggcagctacatgatggagtgcctgaccaacgacgtgtacgatgccgctcttaagctcatcaatgaaatcgaagaaatggggggtatggccaaagctgtggccgaaggcatcccgaaacttcgcatcgaagagtgcgccgcgagacggcaggctaggatcgattcgggatcagaggtgattgtcggagtgaacaagtaccagctcgaaaaggaggacgccgtggaggtcctggcgatcgataatacctcggtgagaaaccgccaaattgagaagctcaaaaagatcaagtcgtcccgggaccaggcgctggcagaacgctgcctggctgctttgactgaatgcgccgcgtccggagatgggaatatcctggccctggcggtggatgcgtcgcgagcccgctgcactgtcggtgaaatcactgatgcgctgaagaaagtctttggcgagcacaaggccaacgaccgcatggtgtcaggagcctaccgtcaagagttcggggaatccaaggaaatcacctcggccatcaagagggtgcacaaattcatggagcgggaagggagacgcccgcgactcctggtcgcaaaaatgggacaggacggacatgatagaggggccaaagtgatcgcaaccggattcgccgacctcggcttcgatgtggacatcggaccgttgtttcagactccgcgcgaggtggcccagcaagcggtggacgccgacgtgcacgccgtgggaatctcgactctggcggctgggcataagacccttgtccccgagctgatcaaggagctgaactcgctgggtcgccctgatattctcgtgatgtgcggaggtgtcatacctccgcaggactacgagtttctcttcgaggtcggcgtgtcgaacgtgttcggcccgggaactcgcatcccgaaggctgctgtgcaagtgctggatgatatcgagaaatgcctcgaaaagaagcagcagtcggtt

SEQ ID NO: 16694 - DNA, 2250 bp, Artificial Sequence
  Description of Artificial Sequence: Synthetic coding sequence
atgctgcgcgcaaagaatcagttgttcctgctctcgccgcactacctgcgacaggtaaaggaatcaagcggaagccgcctcattcaacagcggcttctccaccagcagcagccactccacccagagtgggcagcgttggcgaagaaacaactgaagggaaagaacccggaggacctgatctggcacaccccagaaggaatctcgatcaagccgctgtactcgaagagagatactatggatctgccagaagagctgccaggcgtcaagccgttcaccaggggcccgtacccgactatgtacacctttcgcccttggaccatcagacagtatgcgggcttctcaactgtggaagaaagcaacaagttctacaaagacaatatcaaggccggacagcaaggactttcggtggccttcgatttggccacccatcgcgggtacgattcggataatcctcgtgtcaggggtgacgtcggaatggccggagtcgctatcgacaccgtcgaggacactaagatcctgttcgacggaatcccgttggaaaagatgtccgtgtcaatgactatgaatggagcggtcatcccagtgctggcaaacttcatcgtcaccggagaagaacaaggtgtcccaaaggagaaacttactgggactatccagaacgacatcctgaaggaattcatggtgcgcaacacttacattttcccacccgaaccatccatgaaaatcatcgcggacatttttgaatacactgccaagcatatgccaaaattcaactcgatttcgatctccggataccacatgcaagaagccggcgcagatgctatcctggaactcgcttatacccttgccgatggattggaatactcccgcaccgggctccaagcaggactgaccattgatgagttcgctccgagactcagctttttctggggcattggcatgaacttctacatggagatcgcgaagatgagggcaggacgcaggctgtgggctcatctcattgaaaagatgttccaaccaaagaattcgaaatccctgctgttgcgagcgcactgtcagactagcggatggtcgctgacggaacaagacccgtacaacaacatcgtcagaaccgccatcgaggcaatggcggccgtgttcggggggactcagtcgctccacaccaattcattcgatgaggccctcggactgccgactgtgaagtccgcccggattgcgcggaatactcagatcatcatccaagaggaatcaggcatccctaaggttgccgacccctggggtggatcctacatgatggagtgtcttaccaatgatgtgtatgacgctgcactgaaactgatcaacgaaatcgaagaaatgggtggcatggcaaaagcggtggccgaggggattccgaagctccgaattgaagagtgcgctgctcggcgccaagctcggattgattcgggatccgaggtgatcgtgggagtcaacaagtaccaactggagaaggaggacgcagtggaagttctggcaatcgacaacacttcagtccgcaaccgacaaattgagaagctcaagaaaatcaaatcctcacgggaccaggcgctggccgagagatgcctggccgcactcaccgaatgcgcagctagcggagatggaaacatcctcgccctcgcggtggacgccagtcgcgcgcgttgcaccgtgggagaaatcaccgatgctctgaagaaggtgtttggagaacataaggccaatgacaggatggtgtcaggggcgtaccgccaggagtttggagaatcgaaagagatcacctccgcgatcaagagggtccacaagttcatggagcgcgagggcagaaggccgaggctgctcgtcgctaagatgggacaagacggccatgaccggggcgcaaaggtcatcgctaccggattcgcggacctcggatttgacgtggatattggtcctctcttccagacgccgcgcgaggtcgcccaacaggcggtggatgcagatgtgcacgccgtcggaatctccacgctcgccgctggccataagaccctggtcccagagctgatcaaggaactgaacagtctggggcgccctgatatcctcgtgatgtgcggaggagtgattccacctcaggattacgaatttctgttcgaggtgggagtctcaaacgtgttcggaccgggaaccagaatcccgaaggcagctgtccaggtgttggatgatatcgaaaagtgtttggaaaagaagcagcaatccgtc

SEQ ID NO: 16695 - DNA, 2250 bp, Artificial Sequence
  Description of Artificial Sequence: Synthetic coding sequence
atgttacgagcgaaaaatcaactatttctattatcgccgcattatttacgtcaagttaaagaatcgtcgggttcgcgattaatacaacaacgtttactacatcaacaacaaccgctacatccggaatgggcggcgctagcgaaaaaacaattaaaaggtaaaaatccggaagatttaatatggcatacgccggaaggtatatcgataaaaccgctatattcgaaacgagatacgatggatttaccggaagaactaccgggtgttaaaccgtttacgcgtggtccgtatccgacgatgtatacgtttcgaccgtggacgatacgacaatatgcgggtttttcgacggtagaagaatcgaataaattttataaagataatataaaagcgggtcaacaaggtctatcggtagcgtttgatttagcgacgcatcgaggttatgattcggataatccgcgagtacgaggtgatgttggtatggcgggtgtagcgatagatacggtagaagatacgaaaatactatttgatggtataccgttagaaaaaatgtcggtatcgatgacgatgaatggtgcggttataccggtattagcgaattttatagtaacgggtgaagaacaaggtgtaccgaaagaaaaactaacgggtacgatacaaaatgatatattaaaagaatttatggttcgaaatacgtatatatttccgccggaaccgtcgatgaaaataatagcggatatatttgaatatacggcgaaacatatgccgaaatttaattcgatatcgatatcgggttatcatatgcaagaagcgggtgcggatgcgatattagaactagcgtatacgttagcggatggtttagaatattcgcgaacgggtctacaagcgggtttaacgatagatgaatttgcgccgcgattatcgtttttttggggtataggtatgaatttttatatggaaatagcgaaaatgcgtgcgggtcgtcgtttatgggcgcatctaatagaaaaaatgtttcaaccgaaaaattcgaaatcgttactactacgtgcgcattgtcaaacgtcgggttggtcgctaacggaacaagatccgtataataatatagttcgaacggcgatagaagcgatggcggcggtatttggtggtacgcaatcgctacatacgaattcgtttgatgaagcgctaggtttaccgacggtaaaatcggcgcgtatagcgcgaaatacgcaaataataatacaagaagaatcgggtataccgaaagttgcggatccgtggggtggttcgtatatgatggaatgtctaacgaatgatgtttatgatgcggcgctaaaactaataaatgaaatagaagaaatgggtggtatggcgaaagcggttgcggaaggtataccgaaattacgtatagaagaatgtgcggcgcgtcgtcaagcgcgaatagattcgggttcggaagtaatagtaggtgtaaataaatatcaactagaaaaagaagatgcggtagaagtattagcgatagataatacgtcggtacgtaatcgtcaaatagaaaaattaaaaaaaataaaatcgtcgcgagatcaagcgttagcggaacgttgtctagcggcgttaacggaatgtgcggcgtcgggtgatggtaatatactagcgttagcggttgatgcgtcgcgtgcgcgttgtacggttggtgaaataacggatgcgttaaaaaaagtttttggtgaacataaagcgaatgatcgtatggtttcgggtgcgtatcgacaagaatttggtgaatcgaaagaaataacgtcggcgataaaacgagttcataaatttatggaacgagaaggtcgacgaccgcgtctactagtagcgaaaatgggtcaagatggtcatgatcgtggtgcgaaagttatagcgacgggttttgcggatttaggttttgatgtagatataggtccgttatttcaaacgccgcgtgaagttgcgcaacaagcggtagatgcggatgtacatgcggtaggtatatcgacgttagcggcgggtcataaaacgttagttccggaattaataaaagaactaaattcgttaggtcgtccggatatattagttatgtgtggtggtgttataccgccgcaagattatgaatttctatttgaagtaggtgtttcgaatgtatttggtccgggtacgcgtataccgaaagcggcggttcaagtattagatgatatagaaaaatgtttagaaaaaaaacaacaatcggta

SEQ ID NO: 16696 - DNA, 2250 bp, Artificial Sequence
  Description of Artificial Sequence: Synthetic coding sequence
atgctgagggccaagaatcaactgtttcttctaagccctcactatcttaggcaggtgaaagaaagctctggaagccgattaatccaacaaagattgctgcaccagcagcaaccactgcacccagaatgggcggccctggctaaaaagcagcttaaaggcaagaatcctgaagatctcatctggcatacacccgagggtatcagcatcaagcctctctacagcaaaagggacacaatggatcttcccgaagaactgcccggggtcaagcctttcacccgcggcccctaccccaccatgtacactttccgaccatggacaattaggcagtatgccggctttagcactgtggaggaatcaaacaagttttacaaagacaacatcaaagcaggccaacaaggactctccgtcgccttcgaccttgcaactcatcggggatacgatagcgataatccgcgcgtcagaggcgatgtgggcatggcaggcgtggcaatcgacaccgtggaggataccaagatcctcttcgatggcatacctcttgaaaagatgtcagtatcaatgaccatgaatggggcagtaattcccgtgcttgccaacttcatcgttaccggcgaggaacagggggtcccaaaagagaagctcactggcaccattcagaatgacattttaaaggaatttatggtgaggaacacttacatattcccccccgagccaagtatgaaaattatcgccgacatcttcgagtatactgctaaacatatgcccaaattcaacagcatcagtatctcggggtatcatatgcaggaggcgggggctgacgctatcttggagctcgcatataccttagcggacggactcgagtactctaggacaggactgcaggctggtctcactatcgacgaatttgcaccccgccttagtttcttctggggaatcggaatgaacttctatatggagatagccaaaatgagggcaggtagacgcctctgggcccatcttatcgaaaagatgtttcaaccaaaaaactctaagtcactgctcttaagagcccactgccagacatcaggatggtccctgaccgagcaggatccttataataatatcgtcaggaccgctatagaagctatggctgcggttttcggcggaactcagagcttgcatactaacagctttgatgaagcacttggtcttccaacagttaagagcgcgcgcatcgcgaggaacacacagatcattatccaggaggaatccggaattcctaaagttgctgacccttggggtggctcttatatgatggagtgcctgactaatgatgtctacgatgctgctctgaaattgatcaatgagatcgaagaaatgggaggcatggcaaaggcggtagcggagggaattccaaagctcaggatcgaagaatgcgcagcgaggcgccaggccagaatcgatagcggcagcgaggtcatcgtcggtgttaacaaataccagcttgagaaggaggacgctgttgaggtgctggctattgacaatactagtgtgcgcaaccgccagatcgagaaacttaagaagatcaagtcctctcgcgatcaagccctggccgaaaggtgcctcgctgcactgaccgagtgcgctgccagtggagacggcaatattcttgctcttgcagtagatgctagcagagcacgatgcactgtgggtgaaattaccgacgcgctgaagaaagtattcggcgagcataaggcaaacgacaggatggtgagcggagcctaccggcaagaatttggagagagtaaggagatcaccagcgcaataaagcgtgtacacaaatttatggaacgtgaggggagacggcccagacttctggtggctaaaatgggccaggatggccacgatagaggggccaaggtcatcgctaccggttttgccgacctcggcttcgatgtggatataggacctctgttccagacaccaagagaagtggctcagcaagctgttgacgcagatgtgcatgccgtaggcatctctactctcgcagccgggcataaaaccctcgtcccagagctcattaaagaactgaactcactgggtaggccagatatactcgtcatgtgcgggggagtgatcccaccccaagactatgagtttctctttgaggtgggtgtatccaatgttttcggtcctgggacaagaatccccaaagctgccgtccaggttttagacgacattgagaagtgtcttgaaaagaaacaacaatctgtg

SEQ ID NO: 16697 - DNA, 2250 bp, Artificial Sequence
  Description of Artificial Sequence: Synthetic coding sequence
atgcttagagctaagaatcaattatttttattatctccacattatttacgacaagttaaggaatcatctgggtcaagattaattcaacaaagattattacaccaacaacaaccattacatccagaatgggcagcattagccaaaaaacaacttaaaggaaaaaatccagaagatttaatatggcatacaccagaaggaatttcaattaaaccattatattctaaaagagatactatggatcttccagaagaattacctggagtaaaaccattcactagaggtccatatcctactatgtatactttcagaccttggacaattagacaatatgcaggattttcaactgtagaggaatcaaataaattctataaagataatataaaagcaggacaacaaggactaagtgttgcattcgacttagctacacatagaggatatgatagtgataatccaagagttagaggtgacgttggtatggcaggagtagcaattgatactgttgaagatactaaaatattatttgatggaatacctcttgaaaaaatgtctgtttcaatgactatgaatggagctgttattccagttttagctaatttcattgttacaggtgaagaacaaggagttccaaaggaaaagcttactggaactattcagaatgatattttaaaggagtttatggttagaaatacctatatatttccacctgaaccatcaatgaaaattattgccgatatttttgaatatactgctaagcatatgccaaaattcaattctatttcaattagtggatatcatatgcaagaagctggagctgatgctattcttgaattagcatacacactcgctgatggacttgaatattcaagaaccggtttacaagcaggattaacaattgatgaatttgcaccaagattgtcttttttctggggaattggaatgaatttttatatggaaattgcaaaaatgagagcaggacgtcgattgtgggctcatttaattgaaaaaatgttccaaccaaagaattctaaatctcttcttttaagagctcattgccaaacatcaggatggtctttaactgaacaagatccatataataacattgtaagaacagctatagaagctatggcagcagtatttggaggtacacaatctcttcatacaaattcttttgatgaagcattgggattacctaccgtaaaatcagcaagaattgctagaaatactcagattattattcaagaagaatcaggaattccaaaagttgctgatccatggggaggatcttatatgatggaatgtttaacaaatgatgtttatgatgcagctcttaaacttattaacgaaattgaagaaatgggaggtatggcaaaggctgtggcagaaggaattcctaaacttagaattgaagaatgtgcagccagaagacaagcaagaatcgatagtggatcagaagtaattgttggagttaacaaatatcaattagaaaaggaagatgctgtagaagtattagcaattgataatacaagtgtaagaaatagacaaattgagaagttaaaaaaaattaagtcatcaagagatcaagccttagctgaaagatgtctagcagcattaactgaatgtgccgcatcaggagatgggaatatccttgctttagcagttgatgcttcacgtgctagatgtactgtaggtgaaattacagatgctcttaaaaaagtatttggggaacataaagctaatgatagaatggtttcaggagcttatcgtcaagaattcggagaaagtaaagaaattacaagtgccattaaaagagttcataaatttatggaaagagaaggaagaagaccaagacttttagttgctaaaatgggacaagatggtcatgatagaggagcaaaagtaattgcaacaggtttcgctgatttaggatttgatgtagatattggacctctttttcaaacaccaagagaagtagctcaacaggctgtagatgctgatgtacatgcagttggtatttcaactttagctgctggacacaaaactcttgttccagaattaattaaggaattaaattcattaggaagacctgatattttagtgatgtgtggtggagtcattccaccacaggattatgaattcttattcgaagtaggagtatcaaatgtttttggacctggaacaagaattccaaaggcagccgtacaagttttagatgatatagaaaaatgtcttgaaaaaaaacaacagtcagtt

SEQ ID NO: 16698 - DNA, 2250 bp, Artificial Sequence
  Description of Artificial Sequence: Synthetic coding sequence
atgttgagagctaaaaatcagttgtttctattaagccctcactaccttcgccaggtgaaggaatcctcaggcagcagactaattcagcaacgactactgcatcagcagcagccacttcatccagagtgggctgccctagccaagaagcaattaaaagggaagaaccccgaggacctgatttggcatactccagaggggatctccattaagccgctgtattccaagcgagacactatggacctcccggaggagctcccaggagtgaagccatttacccgaggcccataccccactatgtacacatttaggccttggactatccgtcagtacgccgggttctccacagtcgaggaatctaacaagttttataaggataacattaaagcgggccagcagggtctgagtgttgctttcgatctggcaacccacagggggtatgacagcgacaatccgagagtgaggggagacgtaggcatggctggcgttgccattgacaccgtcgaggacactaaaatcctgttcgacgggatccccctggagaagatgagcgtgtccatgaccatgaatggagcggttattcctgtattggccaactttatcgttactggcgaggaacaaggcgtgcctaaagaaaagctaacaggcacaattcagaacgatattttgaaggagttcatggtcagaaatacttacatcttccctcctgagcctagcatgaagatcattgccgacatatttgaatatacggcaaagcatatgccaaaatttaactccataagtattagtggatatcacatgcaggaggctggggcagatgctattctagaattagcctatactttggcagacggcctggagtactcacgcacagggctgcaagccggactgaccattgatgagtttgcccccaggttgagttttttttgggggatcggtatgaacttctatatggaaattgcgaagatgcgtgccgggcgacgcttgtgggcccacttaatcgaaaaaatgtttcagcccaagaattctaagagtctgctgctcagagcccactgtcagacctctggctggtccctgactgaacaggatccctacaacaacattgtgagaacggctatcgaggccatggccgccgtttttggcgggacccagagtttgcacactaattcctttgatgaagccttgggtctgccaactgtcaaaagtgcgcgaatagcccgcaatacccaaatcatcattcaggaggagagcggaattcctaaggttgccgacccttggggtggtagctacatgatggaatgtctgaccaacgatgtgtatgacgctgcccttaagctgatcaacgaaattgaagaaatgggcggaatggctaaggctgtcgcagagggcatcccaaagctccgtatagaggaatgtgctgccaggcggcaggcccggatagatagcggaagtgaggtgatcgtgggggtgaataagtaccaattagagaaggaagacgcagtggaggtacttgctattgacaataccagtgtcaggaacaggcagattgaaaaactgaaaaaaattaaatccagtagggatcaggctctagccgaacgctgcctggccgcactgaccgaatgcgcagcctcaggggacggaaatatccttgccctagccgtcgacgcctcaagggccaggtgtacagtcggcgagatcacggatgctttgaagaaagtattcggagagcacaaggcaaacgacagaatggtgtcgggcgcttatagacaagaatttggagaaagtaaagagattacttcagcaattaagcgggtccacaaatttatggagcgggaagggcgaaggccccgccttcttgtggctaaaatgggccaagacgggcacgaccgcggcgcaaaagtgattgccactggattcgccgatctgggctttgatgtggatatcggacctctgtttcagactcctagagaagtcgcacagcaggccgtcgatgcagacgtgcatgctgtcggaatcagcacactggctgcaggacataagaccctggtgccagaactgattaaggagctgaattccctggggcgcccagacatcctcgtaatgtgcggtggggtgatcccgccccaggattatgagttcttgttcgaagtaggcgtctcaaatgtcttcgggcctgggacgcggattcccaaagcagccgtgcaggtcctggacgacatcgagaagtgtctcgaaaaaaagcagcagagcgta

SEQ ID NO: 16699 - DNA, 2250 bp, Artificial Sequence
  Description of Artificial Sequence: Synthetic coding sequence
atgttgcgtgcaaaaaaccaactttttctcctctcccctcattatctgaggcaggtgaaggaatcgtccggatcccgacttattcagcaaaggctgcttcaccagcagcagccccttcaccctgaatgggcagctcttgcaaagaagcaactgaagggcaaaaacccagaggacctgatatggcacacccccgaaggaatctctattaagccgctgtacagcaagcgagatactatggatctcccagaggaactgccgggggtgaagcctttcacccgcgggccttaccctaccatgtacacttttaggccctggaccatacgtcaatatgctgggttcagcaccgtggaggaatccaataagttttacaaggataacattaaagcaggacagcaaggtctttctgttgcatttgatctggccactcacagaggttacgattcggacaatcctcgggtcaggggcgacgtgggaatggcaggtgtggcaatcgataccgtggaagatactaaaatcctttttgatggcataccccttgaaaagatgtccgtgtccatgactatgaatggagccgtcattcctgtgctggcaaactttatagtgactggtgaagagcaaggagtgcctaaggagaagctgaccggtactattcaaaatgacatccttaaggagttcatggtgcgcaacacctacatctttccaccagaaccctccatgaagattatcgcagacattttcgaatacactgccaaacatatgcccaagttcaactccatttcgattagcggataccatatgcaagaagcaggcgcggatgcaattctggagctggcatacactctcgccgatggtcttgaatactcaaggaccggcctccaagccggactgactatcgatgaatttgctccacgtctctcatttttctggggtattgggatgaacttttacatggaaattgcaaaaatgcgggcgggtcggaggctttgggcacatctcatcgagaagatgtttcagccaaagaattcgaagtcgctcctgctgagagcacattgtcaaacttcgggatggtcgctgaccgaacaggatccctacaataacattgtgcgcaccgcaattgaagcaatggcagcggtgtttggaggtacccaatccctccatactaattctttcgatgaagcactgggactgcccactgtcaaatccgcacgcatcgcccggaacacccaaatcatcatacaggaggagtccggaatccctaaggtggccgatccttggggaggatcatacatgatggagtgccttacgaatgacgtttacgacgccgcacttaagctcattaacgagattgaggagatgggagggatggctaaggcagtggcagaaggcattcctaagctccggatagaggagtgtgccgcccgtcgtcaagcgaggatcgactccggatcggaagtgatcgtcggagtgaacaagtaccaacttgagaaagaagatgcggtggaagtgcttgcaattgacaacacttccgtccgaaatagacagatcgaaaagttgaaaaagattaagtcatccagagatcaagcattggcagaacggtgtctggcggcgctgactgaatgtgcagctagcggcgatggtaacatcctggcgctggctgtggacgcatcgagagctcggtgtaccgtcggagaaattactgatgcactgaaaaaagtgttcggagagcacaaagccaacgatcgaatggtgtctggtgcctacagacaagagttcggagagtccaaggagattacctcggccattaagcgagtgcataagtttatggagagggaaggacgccgaccacgactccttgtcgccaagatgggtcaggatgggcatgatcgcggtgccaaagtcatcgcaactggttttgcagatctgggctttgatgtggatatcggcccactgttccagacgccccgtgaagtggcccagcaagcagtggatgcagatgtccacgcagtggggatttcaacccttgcggcgggacataaaacccttgtgcccgaactgattaaggaactgaatagccttggccggccagacattcttgtgatgtgcggaggggtgattccacctcaagactacgaattcctgtttgaagtcggagttagcaacgtgttcggccctggcacccgcatccctaaagctgcagttcaagttctcgatgatatcgagaaatgtctcgaaaagaagcagcaaagcgtg

SEQ ID NO: 16700 - DNA, 2250 bp, Artificial Sequence
  Description of Artificial Sequence: Synthetic coding sequence
atgctgcgcgctaagaaccagcttttcttactttccccccattacctgcgtcaggtgaaagaaagcagcggcagcaggctgatccagcaacgattgctacaccagcaacagccccttcatcctgaatgggccgctctggcaaaaaagcagctgaagggcaaaaatccagaggacctgatctggcacacacccgaagggatcagcatcaagcccttatactcaaaacgcgacacaatggatttgccggaagaattacccggtgtgaaaccttttacacggggcccctatcccaccatgtatacgtttaggccctggacgatacgacaatacgcaggtttctcaactgtcgaagaaagcaataagttttacaaagacaacattaaagccggacagcagggacttagcgtcgctttcgatctagccacacaccggggatacgacagcgataaccctcgggtccgcggcgacgttggaatggccggcgtcgccattgataccgtggaggacaccaagatattattcgacggcatcccgctcgagaaaatgagcgtttccatgacaatgaatggggccgtgattccagtactcgcaaacttcattgttacgggtgaggagcagggcgtacccaaggaaaaactgaccgggaccattcagaacgacatcctaaaggagtttatggtgcgcaatacatacatatttcctccggagccctccatgaagattatagcagatatctttgagtacaccgcgaaacacatgcccaagttcaactcaattagcatttctgggtaccatatgcaagaggccggggctgatgccattctggagctggcatatactttagctgacggcctggaatattctaggaccggcctccaagccggcctaacaatcgacgaattcgccccacgcttgagtttcttttggggcatcgggatgaacttctacatggaaatagctaaaatgcgggctggaagacggctgtgggcccaccttatagagaagatgtttcaacctaaaaacagcaagtctttactgctgagggcgcactgtcagacctccggatggagtctgacagagcaggacccctataataatatcgtccggactgcgattgaagccatggccgccgtatttggaggcactcaaagcctccacacaaattcctttgacgaggcactcgggctgcccactgtgaagtccgctagaatagcacgaaacacccagattataatccaggaggagagcggcatcccgaaggtagccgatccctggggaggttcatacatgatggagtgtctgactaacgacgtatacgatgcagcactgaagttgataaacgagattgaggagatgggagggatggccaaggcggtggcagagggtatacctaagctgcgaattgaggagtgtgccgcccgaagacaggcacggattgatagcgggtccgaagttattgtaggggtgaacaaataccagctcgaaaaggaggacgccgtcgaggtgctggctattgataatacaagtgtgcgcaatagacagattgagaaattaaaaaagatcaagagcagcagggaccaggcactggcagaaagatgcctcgccgcactcactgagtgtgcggcgagtggagatggtaatatactggcgctcgccgtggacgcttcacgagcccggtgtacagtgggcgagatcaccgacgctctgaagaaagtgttcggtgaacacaaagccaatgatcgcatggtctccggagcatacaggcaagaattcggagagagcaaggagatcacctcagcaatcaaacgggttcataaatttatggagagagagggacgccgtcctagattacttgttgccaaaatgggccaggacggacacgacagaggcgctaaggtgatcgccacagggtttgcagatctgggctttgacgtcgacattggacctctattccaaacgccgagggaggtggcccagcaggcagtggatgctgacgtgcacgctgttggcatcagtactttggccgcaggacacaagacactggtgcccgaactaatcaaggaactcaattctttgggcaggcccgacatcctagtcatgtgcggtggagtcatcccaccccaggactacgagttcctgttcgaagtgggggtctctaacgtttttggtccgggcacacgtattcccaaggcggctgtccaggtgctggatgatattgaaaagtgcctcgagaaaaagcagcagtcagtt

SEQ ID NO: 16701 - DNA, 2250 bp, Artificial Sequence
  Description of Artificial Sequence: Synthetic coding sequence
atgttgcgagccaagaaccaactctttctgttgtctccccactatctaagacaggtgaaagagtcttccggcagcaggctaattcagcaaaggctgcttcaccagcagcagccactgcaccccgaatgggcggccctagctaagaagcagctcaaaggtaaaaacccagaggatctgatttggcacactccagaagggattagcatcaagccgctctactccaaacgtgatacaatggacctgcctgaggaactgcctggtgttaagccctttacacgtggcccatatcctaccatgtacaccttcaggccctggacgattcgtcagtatgctgggttcagtacagtggaagaaagcaacaagttctataaagacaacatcaaggctggacagcagggactgtcagtcgcctttgatttggccacacacagggggtatgattctgataacccccgggtacgaggagacgtgggtatggctggggtagcgatcgacaccgtggaagataccaagatcctttttgacgggattcccttggagaagatgtccgtctccatgaccatgaatggagcggtaattcctgtcttagctaactttatcgtgactggtgaggagcagggagttcctaaggagaagttgaccggcacaatacagaacgacatcctgaaagaattcatggtcaggaacacatacatcttcccacctgaacccagcatgaagatcatagcggacatttttgagtacacagccaagcatatgcccaagttcaattccatctcgatctctggctaccatatgcaggaggctggcgccgacgccatactggagctggcttatacactggccgacgggttagagtattcacggacgggcctgcaggccggcttaaccattgatgaattcgcaccacgcttgtcgtttttttggggtatcggaatgaatttctatatggagatagccaaaatgcgggcgggaaggaggttgtgggcccacctgattgagaaaatgttccagcccaagaatagcaagtctttgctactgcgagcacactgccaaaccagtgggtggtcgctgacagagcaggatccctataacaatatagtgagaaccgctattgaagccatggccgccgtcttcgggggaacgcagagtctgcacacaaattcctttgacgaagccctgggcctgcctacggtcaagtccgctcgaatcgcccggaacactcaaatcatcattcaggaagagagtggaatcccaaaagtcgccgacccatggggaggttcttacatgatggaatgtttgaccaatgatgtgtatgatgcagccttgaaactaattaatgagatcgaggaaatgggaggcatggcaaaggccgtagcagaaggcattcctaaacttcgtatagaggagtgtgccgctagaaggcaggcgcgcatagattccgggagcgaggttattgtgggcgtcaacaagtatcagctggagaaggaggatgccgtggaagttctggcgattgacaatacaagtgtcagaaataggcagatcgagaagctgaaaaaaatcaagtctagtagggaccaggccctcgctgaacggtgcttggctgcactcacagaatgcgccgcctccggtgacggcaacatcctggcactggccgtagacgcgtcacgagctagatgtactgtaggggagataaccgatgcgctcaagaaagtcttcggagagcacaaggcaaacgatcggatggtaagcggggcctataggcaggagtttggcgaatccaaggagattacgagcgctattaagagagtgcacaaattcatggagcgcgagggccggaggccccggcttttggtggccaaaatgggacaagacgggcacgacaggggggcaaaggtcatcgcgacaggtttcgccgacttaggctttgatgttgatataggacccctatttcaaacaccgagggaggtcgctcagcaggcggtggatgctgacgtgcacgcagtgggcatctcaaccttagccgccggacacaagactcttgtccctgaactgataaaagaactaaactcacttggccgaccagatatcctggtcatgtgcgggggtgtaatcccaccacaggactacgagttcttgttcgaggtgggcgttagtaatgtatttggcccaggcacacggatccctaaagccgcagttcaggtgttggatgacatcgaaaagtgcttggaaaaaaaacagcagagtgtg

SEQ ID NO: 16702 - DNA, 2250 bp, Artificial Sequence
  Description of Artificial Sequence: Synthetic coding sequence
atgctgcgggcaaagaaccagctgtttctgctgtcacctcactacttgagacaagtgaaggaatcctcgggcagcagactgattcagcagcggttgcttcaccaacaacagccactgcatcctgaatgggcagctctggcaaaaaagcagctgaaaggaaagaaccctgaagatctcatctggcatactccagaagggatctccatcaaaccgctgtactcgaagcgggacaccatggatttgcccgaggagttgccaggagtcaaaccattcaccaggggtccctacccaaccatgtacaccttcagaccatggactatcaggcaatacgccggattctcaacggtggaggagagcaataagttctacaaggataacattaaggcaggacaacagggtctttcggttgcgtttgatctcgcaactcaccggggctacgactccgataatccgcgcgtcaggggagacgtgggcatggccggagtcgcgatcgatactgtggaggataccaaaatacttttcgatggaatccctcttgagaagatgtcagtgtccatgaccatgaacggagcagtcattcctgtgctggcaaactttattgtgactggtgaagaacagggtgttccaaaggagaaacttacgggcactattcaaaacgacatacttaaggaattcatggtgagaaacacctacatttttccccccgagccttccatgaagattattgcagacatattcgaatacaccgcgaagcacatgccgaagtttaactcgatttcgatttcgggctaccacatgcaagaagcaggtgcagatgcgattcttgaattggcatacaccctggcagatggacttgagtactcgcggacggggctgcaagcagggcttactatcgacgaatttgccccccggctctcattcttttggggcattggaatgaacttctacatggaaattgcaaagatgcgggcgggcaggcggctttgggcgcaccttatcgaaaagatgttccagcctaagaatagcaagtcactgctcctccgggcacattgtcaaacgagcggttggagccttactgagcaagatccttacaacaatattgtccgaactgcgattgaagcgatggcagcggtgttcggagggacgcagagcctgcacaccaacagctttgatgaagcgctgggacttccaaccgtgaagtctgcacgtatcgctcgcaacacccaaatcatcatacaggaagagtccggtattccaaaggtcgcagatccttggggagggagctacatgatggaatgtcttaccaatgatgtctacgatgcagccctgaaactcattaacgaaattgaagaaatgggcggaatggccaaggccgtcgccgaaggaatcccgaaactccgcatagaggaatgcgctgcacgcagacaagcacgcattgactcaggttccgaggtcattgtgggtgtgaataagtaccaacttgaaaaggaagatgctgtggaagtgcttgcaattgacaacacgtcggtccgaaatagacaaatcgagaaactcaagaaaatcaagtcgtccagggaccaggcgctcgcagaaagatgcctggccgccctgaccgaatgtgcggcatccggagatggcaacattcttgcactggcagtggatgcttcgagagcacgctgcactgtgggtgaaatcaccgatgcacttaagaaagtctttggagaacacaaagcaaatgatagaatggtcagtggtgcctacagacaagagttcggtgaaagcaaagaaattacctcagcaattaagagagtccacaagttcatggagagagagggacgccgacctcgccttctggtcgcaaaaatgggacaggatggtcatgatagaggcgcaaaggttatcgcaactggcttcgcggatttggggtttgacgtggatattggtccactttttcaaaccccacgggaagtggcccaacaggcagtcgatgcagatgtgcatgcagtgggcatctcaacccttgctgctggacataagactctggtcccagaactcatcaaagagcttaactcgcttggcagacccgatattcttgtgatgtgcggaggcgtgattccaccccaagactacgaatttcttttcgaagtgggtgtcagcaacgtctttggtccgggtaccagaattcctaaagcagccgtgcaggtcttggacgacatcgaaaaatgccttgagaaaaagcagcaatctgtc

SEQ ID NO: 16703 - DNA, 2250 bp, Artificial Sequence
  Description of Artificial Sequence: Synthetic coding sequence
atgttgagggccaagaaccagttgttcctgttgtcacctcattacctgcggcaggtgaaagaatcctcgggaagccggcttattcaacagaggcttctgcatcaacaacagcccctgcatccagagtgggcagccctggccaaaaaacaactcaaagggaaaaaccccgaagatctgatctggcacacccctgaaggaatatctattaagccattgtactcaaaaagagacaccatggatcttcctgaagaactcccaggagtgaagccatttacccgaggcccctatccaaccatgtatacctttcgcccttggaccataagacagtacgcaggtttttcaactgtcgaggagtcgaacaagttttacaaggataacattaaggcgggtcaacaaggactctcagtggcatttgatcttgctacccatagaggttacgattcagacaaccctagagtgaggggagatgtgggaatggcaggagtagcgatcgacactgttgaggataccaagattctcttcgatggaatccccctcgagaagatgtccgtgagcatgactatgaacggtgcggtgattcctgtcctcgcaaactttatcgtgacgggagaagaacaaggggtcccaaaggaaaaacttactgggacgattcagaacgacatcctcaaagagtttatggtccgcaacacttacattttcccacctgaaccttccatgaagattatagcagatatctttgaatacaccgcgaagcacatgccgaagtttaacagcattagcatatcgggataccacatgcaggaagccggagcagacgcgattcttgaactggcatacacccttgccgatggcctggagtactcaagaactgggcttcaggctggtctgaccatcgatgaattcgcaccgcgactgtcctttttctggggaatcggtatgaatttctacatggaaattgcaaaaatgcgcgccggacggcgactttgggcgcatcttattgagaagatgtttcagccaaagaactccaagtcgctgctcctgcgtgcacattgtcagacctcagggtggtcccttaccgaacaagatccttacaacaatattgtgcgcactgccatcgaagcaatggcagctgtgttcggaggaacccagagcctgcataccaattcttttgatgaagccctgggtttgccgaccgtcaagtcggcccgcattgcacggaacactcaaatcatcatacaagaggagtcgggtattcctaaggtggcagatccttggggagggtcctacatgatggagtgtcttactaatgatgtgtacgacgcagctctgaagctcattaacgaaatcgaggagatgggaggaatggccaaggccgtcgcagagggtatccccaaacttaggatcgaagaatgtgcagcaagacgacaagcacgaatagactccgggtcggaagtgatcgttggagtgaataagtatcaactcgaaaaagaggacgcagtggaagtgctggccattgacaatacttctgtgaggaacagacaaatcgaaaaacttaagaagattaagtcgtccagagatcaagcgctcgccgaaaggtgtctggccgcacttaccgaatgcgcagcgtcgggcgacggaaacatactggcactcgccgtggacgcctcaagagcaaggtgcactgtcggtgagattaccgatgccctgaagaaggtctttggtgagcacaaggcaaacgatagaatggtcagcggagcataccgacaagagtttggggaatcaaaagaaatcacttcggcaatcaaacgcgtccataagtttatggaaagggaagggcggcgcccacggctccttgtcgcaaagatggggcaggacggccatgaccgaggcgcgaaggtgatcgcgaccggatttgcggacctggggtttgatgtcgatatcggaccgctttttcaaaccccgagggaggtcgcccaacaagcagtggatgcggacgtccatgcagtgggcatttcaacccttgcagcgggacataagacgctggtgccggaactgataaaggagcttaattccttgggacgccccgacattcttgtcatgtgtgggggcgtcatcccaccacaagattacgagttcctgtttgaggtgggtgtgtccaacgtgtttggccccggaacccgcatccccaaggcagcggtgcaagtcctcgatgatatcgagaagtgcttggagaagaagcaacagtcggtg

SEQ ID NO: 16704 - DNA, 2250 bp, Artificial Sequence
  Description of Artificial Sequence: Synthetic coding sequence
atgctgcgcgcaaaaaaccagctgttcctgctctcaccacactacctcagacaggtcaaggagtccagcgggagccggttgatacagcagcgccttttgcaccagcagcagccgctccaccctgagtgggctgctctggccaaaaagcagctgaaaggcaagaaccccgaggatctgatttggcatacgccagaaggaatcagcataaaacccctttactccaaacgcgacaccatggacctgccggaggagttgcctggcgtaaagccattcaccagaggcccttaccccaccatgtacactttcagaccctggaccatccggcaatacgccggattctctacagtagaggagtccaataagttctataaggacaatatcaaggctggacagcagggcttgtccgtggcatttgacctcgcaacccaccggggatacgacagtgacaaccctcgagtgaggggagatgtgggaatggcaggggtggcaattgatacagtggaggacacgaagatcctgtttgatggaattcctctggagaagatgtccgtcagcatgaccatgaacggagcggtcatcccagttttggctaacttcatcgtgacaggcgaagaacagggggtgccgaaagagaagctgacgggcaccattcagaatgatatcctcaaggagtttatggtgagaaatacttacattttcccaccagagccctcaatgaagatcatcgccgacatatttgagtataccgctaagcacatgcctaaattcaactctatttcaatctcaggataccatatgcaggaggcaggggcagacgctattctcgaactggcatacactctggccgacggcctcgaatacagcagaactgggctgcaggcaggattgacgatcgatgaattcgcccctcggctctccttcttttggggcattggtatgaacttttacatggaaatcgcgaagatgagagctggccgccgcctctgggcgcatcttattgagaagatgttccagcctaagaatagcaagagcctgttgctgcgcgcccattgccagacctctggatggagtctgactgagcaagacccctacaataatattgtacgcactgctattgaagctatggcagcagtctttggcgggacacagagcctccacaccaatagtttcgatgaggccctgggcctgcctactgtcaagagtgccagaatcgcccgaaatacccagatcatcattcaggaagaatctggtattccgaaggtggcagacccctggggaggatcctacatgatggaatgcttgactaacgacgtatacgacgccgccctgaaactgatcaacgaaatcgaggaaatgggtggtatggcaaaagccgtggccgaggggatacccaagttgagaattgaggagtgcgcagccagaaggcaagcccgaatcgacagcggaagcgaggtcatcgtcggagtgaataagtaccagttggagaaggaggatgcagtggaagtacttgctatcgataacacctcagttcgcaaccggcaaattgagaagctcaagaagataaaatcatctcgggatcaggccctggctgagaggtgtctggccgccctgacagaatgtgctgcgtcaggcgacggcaatattctggctctggctgtggacgctagccgcgctagatgcacagtgggtgagatcactgatgccctcaagaaagttttcggcgagcataaggctaacgaccgcatggtcagtggtgcttataggcaggagtttggtgagtccaaggaaattacatctgcaataaaaagggttcacaaatttatggaacgcgaagggcgacggcctcgacttctggtggccaagatggggcaggacggacatgataggggcgcgaaggttatcgctacgggcttcgcagacctgggatttgacgtggacatcgggcccctgtttcagacaccccgggaggtagcacaacaggcagtcgacgctgacgtacacgccgtcggcatctcaaccctggccgcaggtcataagacgctcgttcctgaactgatcaaggagcttaatagcttgggaaggcctgacatactcgtgatgtgtggaggggtcatacctccccaggattacgaattcttgtttgaggtcggcgtatccaacgtgttcggccccggcacccggatacccaaggccgctgtacaggttcttgacgatattgagaaatgcctggagaagaagcagcagtctgta

SEQ ID NO: 16705 - DNA, 2250 bp, Artificial Sequence
  Description of Artificial Sequence: Synthetic coding sequence
atgttgagagctaaaaaccagctcttccttctttccccgcattacctgagacaggtgaaagagtcaagtggctcacgcctcatccagcagcgcctgctccaccaacagcagccacttcaccccgagtgggccgccctggccaaaaagcaacttaaaggaaagaaccctgaagatttgatctggcacacacccgagggcataagtattaaaccactttatagcaaaagggacacaatggacctgcctgaggagcttcccggcgtgaagccattcactagaggtccctatcctaccatgtacaccttcagaccctggacgatcagacagtacgcaggcttttcaactgttgaagagtctaacaagttctataaggataacatcaaagccggccagcaaggtctttccgtggcattcgatctggcaactcaccgcggctatgattccgataaccccagggtgcgcggcgacgtaggaatggccggagtggcaattgacacagtcgaggacaccaaaatactgtttgacggcatcccactggagaagatgtcagtgagcatgacgatgaatggagccgtgattcccgtactggccaacttcattgttacaggagaggagcagggcgtccccaaagagaagctgaccggcactatccagaacgacatcctcaaggagtttatggtgagaaatacttatatttttccgcctgagccaagtatgaagataatcgctgacatattcgagtacacagcgaagcacatgcctaagttcaattctatctcaatcagtggttaccacatgcaagaagccggagctgacgccattttggaactcgcatacacgctcgctgatggactggaatactctaggacaggtcttcaggcaggcttgacaatcgatgagttcgcaccaagactgtctttcttttggggtattggtatgaacttttacatggagatcgccaaaatgcgcgctggcagaaggttgtgggctcacctgattgagaaaatgttccagcccaagaactcaaagtctcttcttctgagagctcactgccagacaagcggctggtctctcacggagcaagacccttataacaacatcgtcaggaccgcaattgaagccatggctgctgtattcggtggcactcagagcctccacacgaactcattcgatgaggccctgggcctcccaaccgtgaagagcgctcgcatcgccagaaacacccagatcattatccaggaggagtccggtatacctaaggtggcggacccatggggcggttcctatatgatggagtgtcttacaaacgatgtttatgacgccgccctcaagctgattaacgagattgaggaaatgggaggaatggcaaaggctgtcgctgagggcatacctaagttgagaatcgaagaatgcgccgctaggaggcaggcgaggatcgactctggatcagaagtgatcgtgggcgttaataagtaccagctggagaaagaggatgccgtcgaagtgctggccattgacaacacaagcgtgaggaatcgccagatcgaaaaactgaaaaagattaaatcctctagggaccaagcccttgccgaaaggtgccttgcggccttgaccgagtgtgccgcgagtggcgacggtaacattctggccctggccgtggacgcaagtagggccagatgcactgtgggtgaaatcaccgatgctttgaagaaggttttcggagagcacaaggcaaacgatagaatggtgagcggtgcctacaggcaggaattcggtgagagcaaggagattaccagcgcgatcaaaagggtgcataaattcatggagagagagggcagaagaccgaggttgctggtggctaagatgggccaggatggacacgacagaggcgccaaagttattgccaccggctttgctgatcttggtttcgatgttgatatcggcccattgtttcaaactccaagggaggtcgcccagcaagctgtcgacgctgacgttcacgctgtcggcatcagcacattggccgccggccataagaccttggtgcccgagttgattaaagagctgaacagcctgggaaggcccgacatcttggtcatgtgcggcggtgtcataccaccgcaggactatgagttcctgttcgaagttggagtcagtaatgtgtttggaccaggtacacgcattcccaaagccgcagtccaggttctggatgatatagagaagtgtttggagaaaaaacagcagtctgtg

SEQ ID NO: 16706 - DNA, 2250 bp, Artificial Sequence
  Description of Artificial Sequence: Synthetic coding sequence
atgctgcgcgcgaaaaaccagctgttcctgttgagcccgcactacctgcggcaagtgaaggaaagctctggatcccggctcatccagcaacgcctgctgcatcaacagcagccgctgcacccggaatgggccgcactggcaaagaaacagctcaaaggtaaaaacccagaagatttgatttggcatactccagaagggattagcatcaaaccgctgtactcaaagagggacaccatggacctgccagaggaactgcctggggtgaagccattcacccgtgggccttacccgaccatgtacacctttaggccgtggactatccgacaatacgctggctttagcaccgtagaggaatcaaataagttctataaagacaacatcaaagctggacagcaaggcctcagcgtcgctttcgatctggccactcatcggggatacgactcggacaacccaagagtccgcggagatgtgggaatggcaggagtggccatcgacactgtcgaagataccaaaattctgttcgacgggatcccattggagaagatgtcagtgtccatgaccatgaacggagccgtcataccagtcctggcgaatttcatcgtgactggagaggaacaaggcgtgccgaaagaaaagctgaccgggaccatccagaatgacatcctcaaggaattcatggtgcggaatacgtacatcttccctcctgagccctcaatgaagatcattgcagatatcttcgagtacaccgcgaaacacatgccgaagttcaattcgatctcaatttccggataccatatgcaagaggctggtgctgacgccatcctggagctggcatacactctcgcggacggattggagtactcccgaaccggactgcaggctgggctgaccatcgacgaattcgccccacggctctcgttcttttggggaatcggcatgaacttctacatggaaatcgccaagatgagggcagggcggaggttgtgggcccacctgatcgaaaagatgttccagccgaagaactctaagagcctgttgctgcgcgcgcattgccagaccagcggttggtccttgactgaacaagacccttacaacaatatcgtgcgcaccgcaatcgaggccatggcggccgtctttggcggcacccaatcgctccacactaactccttcgacgaggctcttggactgccgactgtcaagtcggctcggatcgcgcggaacacccagatcatcatccaggaggaatccggtattcccaaggttgcagatccgtggggtggatcctacatgatggaatgcctgactaatgacgtctacgacgcggccttgaaactgatcaatgaaatcgaggaaatgggtggcatggcgaaagccgtggcagaagggatcccgaagttgaggatcgaggaatgcgcggcgcgcagacaggcgcgcatcgattcgggatcagaagtcatcgtgggagtgaataagtaccagctcgagaaagaggacgcagtcgaagtgctcgcaattgataacacttcggtccggaaccggcagatcgaaaaactgaagaagatcaagtcgtcgagggaccaggctctggcagagcggtgtttggcggctttgaccgagtgtgcagcgtcgggcgatggcaacatcctggcgctggctgtcgacgcctcgcgcgcccggtgcactgtgggggaaattaccgacgctctgaaaaaggttttcggtgaacacaaggcgaacgataggatggtgtcgggggcgtaccggcaagaattcggagagtcgaaggagatcactagtgcgattaagagagtgcacaagttcatggaacgggagggacggcgccctcgcctcctggtggcgaaaatgggccaggacggacatgacaggggtgcaaaagtcatcgcaaccggctttgctgacctgggattcgatgtggacatcggaccattgttccagactccgcgcgaggtggcccagcaagcggtcgatgccgacgtgcacgcggtcggaatttcaacgctcgcggccggccacaagacgctggtgcctgaattgataaaggagctgaactcactcgggcgaccggatattctcgtgatgtgcggaggagtgatcccgccccaggattacgaatttctgtttgaggtcggcgtgagcaacgtgttcggacctggaaccaggatcccaaaggccgctgtgcaggtgctcgatgacattgagaaatgccttgaaaagaagcagcaaagcgtg

SEQ ID NO: 16707 - DNA, 2250 bp, Artificial Sequence
  Description of Artificial Sequence: Synthetic coding sequence
atgctgagagcaaaaaatcagctgttcctgctttcaccccattatctgcggcaggttaaagaaagttctggaagtaggctcatccagcagcgcctgcttcatcagcagcagcctcttcatccagagtgggccgctctggccaaaaaacagctgaaagggaaaaatccagaagaccttatatggcacactccggaagggatctctataaagcctctctactccaaacgggatacaatggatttgcctgaagaacttccaggagtgaaaccctttactcgaggaccttacccaactatgtacacttttcggccttggactattagacagtacgccgggttcagtacagtggaggagtcaaacaaattctataaagataatatcaaagccggacaacaggggctatcggttgctttcgatctggcaactcaccgaggatacgacagtgataatccccgcgtgcggggagatgtaggaatggccggagtcgcaatagatacagtcgaagatacaaaaatcctctttgatgggattccactcgaaaaaatgtccgtatccatgacaatgaatggagcagttatacctgtgctcgccaatttcattgtcactggagaggaacagggggtgccaaaagaaaaactcacagggactatccagaatgacatactcaaagaatttatggtacgtaatacatatatctttccacccgagcccagtatgaaaatcattgctgacatattcgaatatactgctaaacacatgccaaagtttaattctatctcaatctcaggataccatatgcaggaagcgggggccgatgccatcctcgaactcgcttatacacttgccgatgggctagaatactctaggacagggttgcaggccgggctaactatcgacgaatttgcaccacgcctcagttttttttggggaattggaatgaatttctatatggaaattgctaaaatgagggcaggacgtagactttgggcacacctcatagaaaaaatgttccagccaaaaaactccaaatcactgctcctcagggcacattgtcagactagtgggtggtctctgactgaacaggatccctataataatatcgtacgcactgctatcgaggcaatggccgcagtgttcggaggaactcagtctctccacacaaactcatttgatgaagcccttgggctgccaactgtgaaatccgcccgcatcgcaaggaatacacagataataatccaggaagaaagtgggatacccaaagtcgctgacccatgggggggatcctatatgatggagtgcctgactaacgacgtttatgatgcagccctgaaactgatcaatgaaatcgaagaaatgggagggatggccaaggccgtagccgaagggatccccaaactgcgcatcgaagaatgtgccgcacggcgacaggctaggatagattctggatcagaagttatcgtaggagtgaacaaatatcagctagaaaaagaagatgccgtggaggtgcttgccatcgataatacttctgtcaggaataggcagatagaaaagctaaaaaaaatcaaaagtagtagggatcaggcacttgccgagaggtgtttagcagctctcactgaatgcgcagctagtggagatggaaacattctcgctctggctgtggatgcttcccgagctaggtgtacggtgggagaaatcacagatgcactcaaaaaagttttcggagagcataaagctaacgatcggatggtgtcgggggcttacaggcaggaattcggggaatccaaagaaataacttctgcaatcaagagggtccataaattcatggaaagggaagggaggagacctaggctgctggtagcgaaaatggggcaggatggacatgatcggggggccaaagtcattgcaacaggatttgcagatctgggattcgacgttgatatagggcctctctttcagactcccagggaggtggcccagcaggccgtcgatgctgatgtgcacgccgtggggatatcaacacttgctgcagggcacaaaacacttgtcccagagctcataaaggaacttaactctctcggacggcccgatatactcgtaatgtgtggaggggttataccccctcaagattacgagtttctcttcgaagtaggagtgtcaaatgtgtttgggcctgggactagaatccccaaagctgccgttcaggtgcttgatgacattgagaaatgcctggaaaaaaagcagcagtcagtg

SEQ ID NO: 16708 - DNA, 2250 bp, Artificial Sequence
  Description of Artificial Sequence: Synthetic coding sequence
atgctccgggccaaaaatcaactttttctcctgtctccccactacctgcggcaagtgaaggaaagcagcggttcacggcttatccagcagcgcctccttcatcagcagcagccgctgcacccagaatgggccgcactcgcgaagaaacaactgaagggcaagaatccagaagatctcatctggcacactccggaaggaattagtatcaagccactctactccaagcgtgacactatggatctgccggaggagctgccgggcgtcaagccgttcacccgaggaccttaccctaccatgtacaccttcagaccatggaccatacgccagtatgccggtttctccactgtcgaagaatcgaacaaattctacaaagataacatcaaagctggccagcagggcctcagcgtggcattcgatctcgcaacccacagaggatacgactccgacaatcccagagttcggggggatgtggggatggccggagtggccatcgacaccgtggaagatactaagatcctgttcgatggaattccgttggagaagatgagcgtctcaatgactatgaacggcgctgtgatccctgtcctcgccaacttcatcgtgactggagaggagcagggggtgccgaaggagaaactcaccgggaccatccagaatgatatccttaaggaattcatggtgagaaatacttatatcttcccgccggagccatcgatgaagattatcgctgacatctttgaatacacggcgaaacatatgccgaaattcaactcgatctcgatcagcggttaccacatgcaggaagccggagcggacgctattctggagttggcctataccctggcagacggactggaatactccagaactggcctgcaggcgggcctgaccatcgacgagttcgctccgcggctgagcttcttttggggaatagggatgaacttttacatggaaatcgctaaaatgcgggcgggacgccgcctttgggcccacctgatcgaaaagatgttccagccgaaaaactcgaagtcgttgctgctcagggcgcattgccaaacttcggggtggtccctgacggagcaagacccctacaacaacatcgtgcgcactgccattgaagctatggcggccgtgtttgggggtacgcagtcgctccataccaactcattcgatgaagcgctggggctcccaactgtgaagtcggctcggatcgcgagaaacactcagatcatcattcaagaggagtcgggaattccgaaagtggccgacccttggggaggtagctatatgatggaatgccttactaacgacgtgtacgatgcagctctgaaactgatcaacgaaatcgaggaaatgggaggcatggccaaggccgtggccgaagggatccctaaactcaggatcgaggaatgtgcggcaagacggcaggctagaatcgactcgggatcggaggtcatcgtgggcgtgaataagtaccaactggaaaaggaggatgccgtcgaggtcctggcaatcgacaacacttcagtgcggaatagacagatcgagaagctgaaaaagatcaagtcatcgcgggatcaggcgctggctgagaggtgcctggcggcgctgactgagtgtgctgcgtccggagacggcaacattctcgccctcgcggtggatgcttcacgcgcccgctgcactgtgggtgaaatcactgatgccctcaagaaggtctttggagagcacaaggcaaacgacagaatggtgtcaggcgcctaccggcaagaattcggagaatcaaaagaaatcacttccgcaatcaagcgcgtccataagtttatggagcgtgaaggacgccgcccacgcctcctggtggcgaagatgggacaggacggtcacgaccggggggcaaaagtgattgcgacgggattcgccgacctgggattcgacgtggacatcggtccgctgttccagaccccacgagaagtggcacagcaggcggtggacgctgacgtgcatgctgtgggaatctctaccctcgcggcgggccataaaacgctcgtgccggagctcattaaagagttgaattcgctggggaggccggacatccttgttatgtgtggcggcgtgattccgccgcaggattacgaattcttgttcgaggtgggtgtctccaacgtctttgggccgggaacccgcatcccgaaggctgccgtgcaggtgttggacgatatcgagaagtgcctggagaaaaaacaacaatcggtc

SEQ ID NO: 16709 - DNA, 2250 bp, Artificial Sequence
  Description of Artificial Sequence: Synthetic coding sequence
atgcttagagctaagaatcaactgtttcttctttcccctcactaccttaggcaggtgaaggaaagctcaggatccagacttattcaacaacgccttctgcatcaacaacagcctcttcatcctgagtgggctgctctggcgaagaagcagcttaaaggaaagaacccagaagatcttatatggcacactccagagggaatctcgattaaaccactgtactccaagagagatacgatggatctgcctgaagagctgccaggcgtcaagccttttacgagaggtccataccctactatgtacacgttccgtccttggaccatccgacagtacgcgggatttagcaccgtggaagagtcgaataagttttacaaagataacataaaagccggtcaacagggcctgtctgtggcatttgatctggcaacccaccggggttatgattcggataacccccgggtgaggggtgacgtcggcatggcgggggtggcgatagataccgtggaggataccaagatactgttcgatggtatcccacttgagaagatgtccgtgagcatgaccatgaacggcgccgtcattccggtccttgcgaactttattgtgactggcgaagaacaaggtgtcccaaaagagaagttgaccggcaccattcaaaatgacattcttaaggaattcatggtgagaaacacgtacattttccctcccgaaccaagcatgaagataatagcagacattttcgaatacactgcgaagcacatgcctaaattcaacagcatctccatctcgggatatcacatgcaggaagccggggcagatgccatcctcgaactggcatacactcttgcagacggattggagtactcgcggactggcctgcaagctggactcactatagacgagttcgcgccaagactgtctttcttctgggggatcggaatgaacttttacatggagatcgctaaaatgcgcgcaggaagaaggctttgggcacaccttatagagaagatgtttcaaccaaagaacagcaagtcgctgttgctgcgggcacactgccagacctcaggatggtcactgactgaacaggacccatataacaacattgtgcgcacggccatcgaagcaatggcagcagtgtttggcggcacgcaatctctgcacaccaactcgtttgacgaagcgctcggccttcctaccgtgaaaagcgctaggattgcccgtaacacccagatcattatccaagaggaatccggtattccaaaggtcgcagacccatggggcggttcctacatgatggagtgtctcaccaatgatgtgtacgacgcagcactgaaattgatcaacgaaatcgaggaaatgggaggtatggcaaaggctgtggcagaagggatcccaaagctgcggatcgaggagtgtgccgctcgcagacaggcgcgcattgattcgggatcagaagtcatcgtcggagtcaataagtaccaactggaaaaagaggatgccgtggaagtgctggctattgacaatactagcgtgagaaatcgccaaatcgagaagctgaaaaagattaagtcctcacgtgatcaagcgcttgcagaaagatgccttgcggcactgactgaatgtgcagcgtcgggggatggaaacatactggcacttgcagtcgatgcatcccgtgcgcggtgtaccgtgggagaaatcaccgatgcactgaagaaggtttttggagagcataaggcaaacgaccggatggtttcaggcgcctaccgccaggaatttggagaaagcaaagaaattactagcgccattaagagggtgcacaaattcatggagagagagggtaggcgccctcggcttctggtcgccaagatggggcaagatggccatgatagaggtgcgaaagtgatcgcgaccggttttgccgacctcggtttcgatgtggatatcggaccactttttcagactccaagagaagtggcccagcaggcagtggatgccgacgtccatgctgtcgggatctctaccctggcagcaggacataagaccctcgtccccgaacttatcaaggaattgaattccctgggacgccctgatatcctcgtgatgtgtggaggcgtgatacccccacaggattacgaatttctcttcgaagtcggggtgtcgaatgtattcggtccaggaactaggatccccaaagcggcggtgcaagtgttggatgatattgagaagtgtctggaaaagaagcagcagtcggtg

SEQ ID NO: 16710 - DNA, 2250 bp, Artificial Sequence
  Description of Artificial Sequence: Synthetic coding sequence
atgctgcgggcaaaaaatcagctgttcctcctttcaccgcattacctgaggcaagtgaaggagtccagtgggtctagacttattcagcaacgactgctgcaccagcagcagcctctgcatccggagtgggccgcattagctaaaaagcagctgaaaggcaaaaacccagaggaccttatttggcacaccccagagggtatctccataaagcccctgtacagcaagagagatactatggatttgccggaggaactccctggcgtgaaaccatttacccggggcccgtacccaacgatgtatacgttcagaccttggaccatcagacagtatgcggggttctccactgtcgaagaatctaacaaattctataaggataatatcaaggcggggcagcagggacttagtgtcgcattcgacttggctacccaccgtggatatgatagcgataatcccagagtcaggggtgatgttgggatggcgggtgtcgccatagataccgtagaagatacgaagatattatttgacggaatccctctggagaagatgtccgtcagtatgactatgaatggggccgtgatccccgtgctggctaacttcatcgtaacgggtgaggaacagggggtaccaaaggagaagttgacaggcactatccaaaacgatatccttaaagagttcatggtccggaatacctacatatttcccccggaaccttctatgaagattatcgcagacatctttgagtatactgcaaagcacatgcccaagtttaatagcatttcaatcagtggctatcatatgcaggaagcgggcgccgacgccattctagagcttgcctacactctggcagatggcctggagtattccaggactggactgcaagccggacttacaatagacgagtttgcccccaggctgtctttcttctggggcattggcatgaacttctacatggaaatcgctaaaatgcgcgctggtcggcgcttgtgggctcatctcatagagaaaatgttccagcccaagaattcaaagtcccttctgcttcgcgctcactgccagaccagcggatggtccctgaccgaacaggacccatataacaatatcgtccgaaccgctattgaggctatggccgcagtgtttggcgggacccagtccctgcataccaactcgttcgacgaggcactgggcctgccaaccgtgaaatccgccaggattgcccggaatacacagattattatccaggaggagtccggaatccccaaggtcgccgatccctggggcggatcctacatgatggagtgtctgactaacgatgtgtacgatgcagccctgaagctgataaacgaaatcgaggaaatgggtggtatggcaaaggcggtcgccgagggtattcccaaactccgcattgaggagtgcgcagccaggaggcaggctcggatcgattctggctctgaagtaattgtgggcgtgaacaaatatcagctcgagaaggaggatgccgtggaagtgctcgcaattgataacacttctgttcggaacaggcagatagaaaagctgaaaaaaattaaatcttctcgggatcaggctctcgccgaacgctgcttagctgccttaaccgagtgcgctgcctctggggacggcaacattttggcgctcgctgtcgatgcctctagagctcgctgtactgtcggcgagataaccgatgcattaaagaaggtttttggggaacataaggccaacgacaggatggtttccggcgcctatcgacaggaatttggggagtcgaaagaaattacatctgcaattaagcgggtgcataagttcatggaacgtgaggggcgccgtccacggttgctagtagcaaagatggggcaggacggccacgacagaggggcaaaggtaattgccacgggtttcgccgacctcgggttcgatgtggacatcggaccactgtttcaaacgccccgagaggtcgcccagcaggctgtcgacgcggacgttcacgccgtcgggatctctacactggcggcgggtcacaagactctagtgcccgagctgattaaagaactgaactcgctagggcggccagacatcctggtcatgtgcggcggcgtcatccctccgcaggactacgaattcctgttcgaggtgggggtttctaacgttttcggtcccggcactcgcatcccaaaagccgcagtccaggtgctcgatgacatcgagaagtgtctggaaaagaagcagcagtctgtt

SEQ ID NO: 16711 - DNA, 2250 bp, Artificial Sequence
  Description of Artificial Sequence: Synthetic coding sequence
atgctgagagcgaaaaaccagctttttctgctgtcacctcactacctcaggcaagtgaaggaaagctccggtagccgtcttattcagcaacgcctcctgcatcagcaacagcctctgcatcccgaatgggcagcacttgccaagaagcaactgaaggggaagaacccggaggacctgatatggcacacccctgaagggatctcgataaaacccctgtacagcaagcgagataccatggacctcccagaagaactgcctggggtgaaaccatttactcgcggcccataccctaccatgtacacgtttagaccatggaccattaggcagtacgcagggttttccaccgtagaagaatctaataagttctacaaggacaacattaaagcaggacagcaaggactcagcgtggcattcgacctggcaactcatcgcggatacgattcggacaacccacgggtgagaggggatgtaggtatggctggagtggcgattgacacggtggaagatactaagattctcttcgatggaatcccacttgagaaaatgtcagtctcgatgactatgaacggagcagtgattcctgtcctcgcaaactttatagtaaccggcgaggaacaaggagtgccgaaagaaaagttgaccggaaccattcaaaacgatatactgaaagaattcatggtcagaaacacttacatttttccacccgagccatcaatgaaaatcatcgcagatatcttcgaatacaccgcaaagcatatgccgaagtttaactcgatctccatttccggttatcatatgcaagaggcgggggcggatgcaatccttgaacttgcatacactttggccgatggactcgagtactcacggaccggactgcaggcaggactgaccatcgacgaatttgcacccagactttcgttcttctggggaattgggatgaatttctacatggagatcgccaagatgagagcaggccggagactttgggcacaccttattgaaaagatgtttcagccaaagaactccaagagcctgctgctgcgagcacactgtcaaacttccggttggtcccttacggaacaggacccctataacaatatcgtgcggactgcaatagaggcaatggcggcggttttcggtggcacccaatccctccataccaattcgtttgacgaggcgcttgggctgcctactgtgaaaagcgcaaggatcgctcgaaacactcaaatcattatccaggaagagtcaggtattccaaaggttgccgacccgtggggaggttcctacatgatggaatgcctgactaacgatgtttacgatgcagccctcaaactcattaatgaaatcgaagaaatgggcggtatggcaaaggcagtggcagagggcattcctaaactccggattgaagagtgcgcggcacgtaggcaggcccgcatagattcggggagcgaagtcattgtaggtgtgaataagtaccagctggaaaaagaggatgccgttgaagtgctcgcaattgataatacgagcgtcagaaatcgccaaattgagaaactgaagaagattaagtcatcgagggatcaggcactggcagagcggtgtctggcagcccttaccgagtgtgcggcctctggtgacggaaacatacttgcgcttgctgtggacgcatcgagagcacgatgtactgtgggagaaattaccgatgcccttaagaaggtctttggtgagcacaaggctaacgataggatggtttcgggcgcctacagacaagaatttggcgaatcaaaagaaattaccagtgctataaagagggtgcataagtttatggagcgtgaaggtcgtcgacctcggctgctggtggccaaaatgggacaagatggtcatgacaggggtgctaaggtcatagcaactggatttgctgatctggggtttgacgtggatatcggaccccttttccagacgcctcgggaagtggcacaacaggccgtggacgctgatgtccatgccgtgggcatctctactctcgcagctgggcacaaaacgctcgtgcccgagctcattaaggaattgaactcgttgggtagaccggatattctggtcatgtgcggaggcgtcattccgcctcaagactacgagtttttgttcgaagtgggagtctcaaatgtgttcggccctggaacccgcataccaaaggcggcagtccaagtccttgatgatatcgaaaagtgtcttgaaaagaagcaacagtcggtg

SEQ ID NO: 16712 - DNA, 2250 bp, Artificial Sequence
  Description of Artificial Sequence: Synthetic coding sequence
atgttgcgtgctaagaaccagctatttctgctgtcgccacactacctgcggcaggtcaaggaatctagtggaagtcggttgatccagcagcgacttctgcatcagcaacagccgttacaccctgagtgggcggccctcgctaagaaacagttgaagggcaagaacccggaggatctaatctggcatacaccagagggtatctcaattaagccactgtactcaaagcgtgacactatggacctgccggaggagctacctggtgtcaagccgttcacacgtggcccttatcctaccatgtatacttttcgtccgtggacaattagacaatacgccgggttctccacagtggaagagtctaataaattctacaaagacaatatcaaggccggtcagcagggactctccgtcgcgtttgatcttgccacacaccgcggatatgacagtgataacccgagggtgaggggagatgttggcatggcaggggtggcaatagatacggttgaggacacaaagatcttattcgatgggattcctttagagaaaatgtctgtcagcatgaccatgaatggcgcggtcattcccgtcttagccaatttcatagtcacgggtgaagagcagggagtgccgaaggaaaaactgacgggcacaatccagaacgatattctgaaggagttcatggtcagaaacacttacatcttccctccagagccatcgatgaaaattattgccgatattttcgagtatactgcaaagcatatgccaaaatttaactccattagcatttccggatatcacatgcaggaagctggggctgacgcgatcctagagcttgcgtatacattggccgatggacttgaatattctaggacaggactacaggctggtttgaccatcgacgaattcgcgccacgattgagctttttttggggtattggtatgaacttttatatggaaatcgccaagatgcgagcaggaaggcgcctttgggcacaccttatagagaagatgttccagcccaaaaacagtaagtcgttgctgttgcgggctcattgtcagacatctggctggtcgcttacagaacaggacccctacaataacattgttcgaactgccatcgaggctatggccgcagtattcggcggcacacagtcccttcataccaactcctttgacgaagcccttggtctccccaccgtgaaaagcgctaggatcgcacgaaatacacagattattatccaagaagagagcgggatccccaaagtcgcggacccttgggggggctcttatatgatggaatgcttgacgaatgacgtgtacgatgcggcgctcaagctgattaatgagatcgaggaaatgggaggtatggctaaggccgtggctgagggcatccccaagctacgaattgaggaatgcgctgcccgtaggcaggcacgaattgactccggatcagaagtaatcgtaggtgtcaacaaatatcaactagagaaggaagatgccgtggaggtactagccatcgataatacctccgttcggaatagacagattgagaagcttaaaaagatcaagtcgtcaagagatcaggccctcgctgaacggtgtctggcggccctgaccgaatgtgccgcttcaggcgatggtaacatcttagccctcgctgttgacgctagtcgggctaggtgtactgttggtgaaatcaccgacgctctaaagaaggttttcggtgagcacaaagcgaacgacagaatggtgtcgggagcatatcgtcaggaattcggcgaatcgaaggagattacttcggctatcaaaagggttcacaagtttatggagcgtgaaggccgccgaccaagactccttgtggccaaaatgggccaggatggacatgatcgaggtgctaaggtcatagcgacgggtttcgcagatctgggcttcgatgtagacattggaccgttgttccaaacgcctcgggaggtcgcccaacaggctgtcgacgcagacgtccacgcggttggtatcagtacactggcggccggtcacaagactctagtacctgagttgataaaagaactgaattctttgggtcgccccgacatcctcgtgatgtgtggaggagtcatccccccccaggactatgagttcctgttcgaagtcggtgtaagtaacgttttcggtcctggtactcgaatccccaaggctgccgtccaggttctcgatgatattgaaaagtgtctggaaaaaaaacagcaatccgtg

SEQ ID NO: 16713 - DNA, 2250 bp, Artificial Sequence
  Description of Artificial Sequence: Synthetic coding sequence
atgttaagagcaaaaaaccaattgttcctcctgtcaccgcactacctcagacaggtgaaagagagcagcgggtctaggctgatccagcaacggctcttacaccagcagcagcctttgcacccagaatgggccgcactggccaaaaagcagttaaaaggaaaaaatcctgaagatttaatttggcatacaccagagggaataagcattaagcctctctacagcaaaagggatactatggatctcccagaggagctccccggggtaaagccattcaccaggggtccttaccccacgatgtacacattccgtccctggacaatcaggcaatatgccggattcagcaccgtcgaggagagcaataaattctataaggataacatcaaggctggccagcaggggctgtctgtggccttcgatctagcaacacacaggggctacgacagcgataacccaagagtgaggggagacgttgggatggcgggcgtcgctatagatacagtagaggacaccaagattctatttgacggaatcccattggagaagatgtccgtttctatgacgatgaatggcgccgtcatccctgtcttggccaacttcattgttacaggagaggagcagggggtccccaaagagaagttgacgggcaccatccagaacgatatcctgaaggaattcatggtgcgaaacacatatatcttccccccagaaccttccatgaagatcattgcagacatcttcgagtataccgcaaaacatatgcccaagttcaattccatcagcatcagcggctatcacatgcaagaggccggcgctgacgccattctggagttggcatatacactggctgacggtcttgaatattcgagaacaggacttcaggctgggctcactatcgacgagttcgcccccagactctcctttttctggggcatagggatgaatttttacatggaaatagccaagatgcgagcgggcaggagactgtgggcgcatctgattgaaaaaatgtttcagccaaagaacagcaagagcctcctgctgagggcacattgccagacctctggctggtcacttacagaacaagacccctacaacaatatagtcagaaccgccatagaagctatggccgctgtgttcggaggcactcagtcccttcacaccaactctttcgacgaggcccttgggctccccactgtcaaatccgctcgtatcgctagaaatactcagatcatcatccaagaggaatccgggatccctaaagtcgcagacccctggggagggtcttacatgatggaatgtctcacaaacgatgtgtacgacgctgctctgaaactcattaacgagatcgaggagatgggaggaatggccaaggcagtggccgagggaataccaaagctacgaatcgaagaatgtgccgcccgccgacaagcccgcatagactcgggatctgaagtgattgtgggggtcaataagtaccagctcgaaaaggaggatgccgtcgaagtcctcgctattgacaacacctccgtgcgtaatcgccaaattgagaaattgaaaaaaatcaaatcatccagggaccaggcactagctgagcggtgcctggccgccctgaccgaatgtgccgcaagcggcgacggaaacatcctggcccttgcagtggatgcttcccgggcacggtgtacggtcggagaaatcaccgacgccctcaagaaggtgtttggtgaacataaggctaacgataggatggtatctggagcatacagacaggagtttggagagtccaaggagataacttctgcaataaagcgggtgcacaagtttatggagagggaggggcggcgacccaggctcctggtggcgaagatgggtcaggacggacatgatagaggggcaaaggttatcgccaccggtttcgccgacttgggatttgacgtggatatcggacctttgttccagaccccaagagaagtcgcccagcaggctgttgacgctgatgtccacgctgtgggtatttcaaccctggcagccggccacaagactttggtccccgagcttatcaaggagcttaatagtctcgggaggcccgacatcttagtgatgtgcggaggtgtgatccccccgcaggattacgagttcctgtttgaggtaggtgtgtccaacgtgttcggacctggcacacggatccccaaggctgccgtgcaggtcctggatgatatagagaaatgcctagaaaagaagcaacagtccgtg

SEQ ID NO: 16714 - DNA, 2250 bp, Artificial Sequence
  Description of Artificial Sequence: Synthetic coding sequence
atgcttcgagctaaaaatcagctattcctattgtctccgcactatctccgtcaagttaaagaatcatcaggatctcgtctcatccagcaacgattattgcatcaacaacaaccactccatccggaatgggctgctctggcaaaaaaacagctcaaaggaaagaatccggaagatctgatttggcatacaccagaaggcatttcgataaagccgctctattccaaaagagacacaatggacctaccagaggaactaccaggtgttaagccatttactagaggaccatacccaactatgtatactttccgtccgtggactattagacaatatgcaggattttcgacagtcgaagaatcgaacaaattctacaaagataatataaaagcgggtcaacagggattgagtgttgcttttgatcttgctacccacagagggtatgactcagataatcctagagtccgaggagacgtaggaatggccggagttgcgatcgacactgttgaggatacaaagattctttttgatggaattccattggaaaaaatgtctgtctccatgacaatgaatggagcagttattccggttctagcgaattttatagttacaggcgaggaacaaggcgttcctaaggagaaattgaccgggaccattcaaaacgatatattgaaggaattcatggttcgtaatacatatattttcccgccggagccttctatgaagatcatcgcagacatttttgaatacaccgctaagcacatgcctaaatttaattccatctctatttcgggatatcacatgcaagaagccggagccgatgccattctggaacttgcttatacacttgctgacggccttgaatactctagaacgggtctccaagctggacttacaatcgatgaatttgcaccgcgtctctcttttttttggggaattgggatgaatttctatatggaaatcgcaaaaatgcgggcaggcagacggctctgggcacacctaatagagaaaatgttccaaccaaaaaattcgaagtcattgctactgcgtgcgcattgccaaacttcaggatggtcgcttacggagcaggacccatataataacattgttagaacagcgattgaagctatggctgctgtttttggtggcacacagtctctgcacaccaactcatttgacgaagcgcttggattgcctacagttaagagcgcacgcattgcaaggaatacccaaattatcattcaagaggaaagcggcattccaaaagttgcagatccgtggggtgggtcgtatatgatggaatgcttaactaatgacgtttacgatgcagctctcaaactgattaatgagattgaggagatgggaggaatggctaaggcagtggccgaagggatcccgaaactcagaattgaagagtgtgcagctcgtagacaagccagaatcgattcaggatctgaggtcatcgttggagtcaataaatatcagttggagaaggaagatgcggttgaggtactagctattgataatactagcgtgcgaaatcggcaaatagaaaagctaaaaaagatcaaatcatcgagagaccaggctctcgccgaaagatgcttggcagctcttaccgaatgcgccgcttctggagatggaaacattctggcattagcggtagatgcttcgagagctcgatgtactgttggcgagatcacggatgcgttgaagaaggtgttcggggaacataaggctaatgatcgtatggtttcaggcgcataccgccaggagttcggagaatccaaggaaattacttctgcaataaaacgggtgcataagttcatggaaagagagggaagaaggccacgtctactggttgcgaaaatgggacaagatggacatgatcgaggtgccaaagtaattgcaaccggattcgcggatttgggatttgatgtcgatattggaccgctgttccaaactcctagagaagttgcgcaacaggcggtcgatgctgatgttcatgcagtgggtattagtactctcgcagccggacataaaacactagttccagaactcattaaggaattgaatagtctgggacgacccgacatccttgtgatgtgcggaggtgttatcccaccgcaggactatgaattcctttttgaggtaggcgtatctaatgtttttggaccgggaactcggatcccgaaagcagcggtgcaagttttggatgacattgagaagtgtttagagaagaaacaacagtccgtg

SEQ ID NO: 16715 - DNA, 2250 bp, Artificial Sequence
  Description of Artificial Sequence: Synthetic coding sequence
atgctgagagcaaaaaaccaacttttcctgctgtctccgcactacctccggcaggtgaaggaatcgtccggatcgagactcatccaacagcgcctgttgcatcagcaacaaccactccatccggagtgggccgcactcgccaaaaaacaacttaaaggcaagaatccagaggatcttatctggcacaccccggagggtatcagtattaagccgctgtactcgaagcgggacactatggatctcccagaggagctcccgggggtgaagcctttcacccggggcccttacccaactatgtataccttccggccgtggaccatccggcaatacgccggatttagcactgtggaggaatccaacaagttctacaaggacaacatcaaagcgggccaacagggactgtcagtggcgtttgaccttgccactcatagaggatacgatagcgacaacccgagagtgaggggggatgtgggaatggccggcgtcgcgatcgacaccgtggaagatactaagattctgtttgacggtatcccgttggaaaagatgagtgtgtcaatgactatgaatggagctgtgatccccgttttggccaatttcatcgtcactggggaagaacagggagttcccaaggaaaagctgaccggtaccatccagaatgatatcctgaaagaattcatggtgcggaacacttacatcttcccccctgagccatcgatgaagatcatagccgacatctttgaatacaccgcgaagcatatgccgaagttcaacagcatctcgatctccgggtaccacatgcaagaagcgggtgcggatgcgatcctggagctcgcctataccctggctgacggactggaatactcgaggaccggactccaggccggtctgacgatcgacgagtttgctccgcggctgtctttcttttggggcatcggcatgaacttttacatggagatcgccaaaatgcgcgccggacgccggctctgggctcacctgatcgaaaagatgttccagccaaagaattcaaaatctctgctgttgcgagcacactgtcagacctcaggatggtccctgaccgaacaggacccgtacaacaacatcgtcaggactgccatcgaggccatggcagctgttttcggcggcactcagtccctgcataccaactcgttcgacgaggcgctcggactgccaaccgtaaaatcggctcgcattgcccgtaacacccagatcatcatccaagaagaaagcggaatcccgaaggtcgccgatccgtggggaggctcctacatgatggaatgtctgactaacgacgtgtacgatgcggcgctcaagctcatcaatgaaatagaagagatgggcgggatggccaaggcagtggcagaaggcatccctaagctgagaatcgaggaatgcgctgcacgcaggcaggcgcgaattgacagcggatcagaggtcatagtgggcgttaacaaatatcagctggagaaggaggacgctgtcgaggtgctggctattgataacactagcgtgcgaaatagacaaattgagaagttgaagaaaatcaagtcgagtcgtgaccaggcactcgccgagcgctgcctggccgccctgactgaatgcgctgcctcgggagatggaaatatcctcgcactggcggtcgacgcctcgcgggccagatgcaccgtgggcgagattactgacgcgctcaagaaggtgttcggagaacataaggcgaacgaccgcatggtgtccggtgcgtaccgccaagaattcggagagtcgaaagaaataacgtcagccattaagcgggtccacaagtttatggagcgcgaagggcggcggcctagactgctggtggcaaagatggggcaggatggacacgaccggggagccaaggtgatcgccaccgggttcgcggatcttggcttcgacgtggacataggcccgctcttccaaacgccgcgtgaggtggcacagcaggccgtggacgccgacgtgcacgcggtcggaatttcgaccctggcggctggacacaaaacgctcgtcccggagcttatcaaagagctcaactccttggggcggcctgatatcttggtgatgtgcgggggtgtgatccctccccaagattacgaattcctgttcgaagtgggagtctccaatgtattcggtcccggaactcgcatcccgaaggctgccgttcaggtcctggatgacatcgaaaagtgcctcgaaaagaaacagcagagcgtg

SEQ ID NO: 16716 - DNA, 2250 bp, Artificial Sequence
  Description of Artificial Sequence: Synthetic coding sequence
atgcttcgggcgaagaatcagctgttcctgctgtctccgcactacctgcgtcaggtaaaggaatcatccggttcgagactcatccagcagcggctcctgcaccagcagcaaccactgcaccctgaatgggctgccctggccaagaagcagctgaaaggaaagaacccggaagatcttatctggcacaccccggaagggatcagcatcaagcctctgtactcgaaacgcgatactatggatctgccggaagagttgccgggagtcaaaccgtttacccgggggccatacccgaccatgtacactttccggccgtggactattagacagtacgccgggttttccacggtcgaggaatcgaacaagttctacaaggataacatcaaagccggccagcaagggttgtcggtcgcgttcgacctcgccacccatagagggtatgactcggataatcctagagtcagaggagatgtcggtatggccggcgtggcgatcgacactgtcgaggacacgaaaattttgttcgacggaatcccactggaaaaaatgagcgtttcaatgaccatgaacggggccgtgatccccgttttggcaaatttcatcgtgaccggtgaggaacagggagtgcccaaggaaaagctgactggcaccatccaaaacgacatcctcaaggagttcatggtgaggaatacgtacatcttcccgcccgaaccatccatgaagatcattgctgatatcttcgaatacaccgctaagcatatgccaaagttcaacagcatcagcatctccggttaccacatgcaggaagcaggagcagacgcgatcctggaactggcctacactcttgccgacggactggagtattctaggactggactccaagcgggcctgactatcgacgagttcgctccgcggctcagcttcttctggggcattggaatgaacttctacatggaaatcgccaagatgcgggccggacgcaggctgtgggcccatctcatcgaaaagatgtttcagccgaagaacagcaaatcactccttctgcgggcacattgccaaacctcaggctggtccctcactgagcaggacccatacaacaacatcgtgcggactgccatcgaggcaatggcagcagttttcggcggtactcagtcactgcacaccaattcgtttgatgaggcgttgggactccctaccgtgaagtccgctcgcattgctcgcaacacccagatcattatccaggaggagagcggaatcccgaaggtggccgacccttggggcgggagttacatgatggagtgcctcaccaatgatgtgtacgatgcagcactcaagctgatcaacgaaattgaagaaatgggcggcatggcgaaagctgtggcggaaggcatcccgaagctccggatcgaagaatgcgctgccaggcgccaggcgcgaatcgactcgggatccgaagtgatcgtgggagtgaacaagtaccagctggagaaggaggatgctgtcgaggtgctggcaatcgacaataccagcgtgcgcaaccggcaaatcgagaaactgaaaaagatcaagtcctcccgggaccaagccctggcagagcgctgtctggccgcactgactgaatgcgcggcatcgggagacggcaacatactcgccctggcggtggatgcgtcgagagcgagatgcactgtcggcgagatcaccgacgctttgaagaaggtctttggagaacataaagcgaatgacagaatggtgtcaggggcctaccgccaagagtttggagagtccaaggaaatcacctcggccattaaacgcgtccacaaattcatggaacgagagggacgccgccctcggctccttgtcgctaagatgggccaggacggacacgatcgcggagccaaagtgatcgccactggatttgcggacctgggtttcgacgtggatattggtccgctgttccaaaccccgagagaagtggcccaacaggccgtggatgccgacgtgcacgctgtcggaatctcgactctggcggccggacataagaccctcgtgcctgagttgatcaaggagcttaactcactgggaaggccagacattttggtgatgtgtggaggtgtcataccaccccaagactacgaattccttttcgaagtgggggtgagcaatgtgtttggacccggaacgcgcatcccaaaggccgcagtgcaggtgctcgacgatatcgaaaagtgcctggagaagaaacaacaatccgtc

SEQ ID NO: 16717 - DNA, 2250 bp, Artificial Sequence
  Description of Artificial Sequence: Synthetic coding sequence
atgctaagagctaaaaaccaactatttctacttagcccgcattacttgcgtcaagtaaaagaaagttcagggtctcgtcttatccaacaaaggttgttacatcagcagcaacctctacatccggaatgggccgcgctggccaaaaagcagctgaagggtaagaatcctgaagatctgatctggcatacgccggaaggaatttctatcaaaccactctatagcaaacgcgatacgatggatttaccagaagaactcccgggcgttaaaccgttcacgagaggaccgtacccgacaatgtatacattcagaccctggactattcggcagtacgccggctttagcactgtcgaagaatcaaataagttttacaaagacaatattaaggctggacaacaaggtcttagcgtcgcgtttgacctggcgactcatcgtggatatgactctgataacccgcgggtgcgcggagatgtcgggatggccggtgtggcaatcgatacagtcgaagacacaaaaattctgtttgacggcattccactggagaaaatgtccgtttcgatgacgatgaatggagcggtaataccggtgttggcgaatttcattgtgacgggtgaagaacaaggagtccccaaggagaaactaactggaacaattcaaaatgatatcctaaaagagtttatggtgcggaatacatacatttttcctcctgaaccgtcgatgaaaattatcgctgacatttttgaatacacagctaaacatatgccgaagtttaactcaatctcaatcagcgggtatcatatgcaagaagcgggtgcagacgcgatactcgaactagcgtatacactggctgatgggttggaatacagtcgcaccggactacaagctggtttaacaatcgacgaatttgcacctagactttcttttttttgggggataggtatgaatttctatatggaaatagcaaagatgagagctggtcggcgactgtgggcgcatctgatcgaaaaaatgtttcaaccgaaaaattctaaaagcttgttgttaagagcacactgtcagacaagtggctggtctctcacggagcaagatccgtacaacaatatcgtgcgaacggctattgaggctatggcggcagtatttggtggtacacagagcttacatacgaattcctttgacgaagctctaggactgccgacggttaaaagcgcgcggattgctcgtaatacacagatcatcattcaggaagaaagcggcatcccgaaagtcgcggatccctggggcggtagttatatgatggaatgcttgacgaatgatgtttatgacgcggcacttaaattgattaatgaaatagaagaaatggggggcatggcgaaagcggtcgccgaaggaataccgaaactcagaattgaagagtgtgctgcgcgccgtcaggcgcgtatcgatagtggatccgaggtgattgtcggagtaaacaagtaccaattagaaaaagaagatgctgtagaagtgcttgcgattgataatacttcagttcgcaaccgtcaaatcgaaaagttaaaaaaaataaagagctcaagagaccaagcattagcggagagatgtctggcagctcttacagagtgcgctgcgtcaggagatggaaacattcttgcattagcggtggatgctagccgcgctcgatgtacagttggagaaatcacagacgcgttgaaaaaagtctttggagaacataaagctaacgacagaatggtttctggggcctatcggcaagagtttggtgagtctaaggagataacatcagccattaaacgcgtacataaatttatggaacgggaaggccgtaggccgaggttacttgtagcaaaaatgggccaagatggccatgataggggagccaaagttatagccacgggctttgccgatttaggattcgatgttgacatcggacctctttttcagacacccagagaagtcgcccaacaggcggtggatgcggatgtccacgcagttggaatctctacgcttgcagcaggacataaaactttggtccctgagcttatcaaggaactgaattcacttggcaggccggacattcttgtgatgtgtggtggagttattccgccgcaagactatgagtttctttttgaggttggcgtttcaaatgtatttgggccgggtacccgtattccgaaggctgctgtgcaagtgttagacgatatcgaaaagtgtcttgagaaaaaacaacaatctgtg

SEQ ID NO: 16718 - DNA, 2250 bp, Artificial Sequence
  Description of Artificial Sequence: Synthetic coding sequence
atgctgcgagcgaagaatcagctgttcttgctgtcaccgcattaccttaggcaggtgaaggaatcctcgggatcaagactcatccagcaaaggctcctgcaccaacagcaaccgctgcacccggaatgggcggcccttgcgaagaagcaactcaagggtaagaatcccgaagatctgatctggcatactcctgaaggcatctcgatcaagccgctgtactccaagagagatacgatggatctgccggaagagctcccgggcgttaagccattcacccgcggaccgtatccgaccatgtacaccttccgcccttggaccattcgccaatacgccgggttctcgactgtcgaagagagcaataagttctacaaggacaacattaaagcgggccaacagggactctcggtggcgttcgatctggctacccacagaggctacgattcggacaacccgagagtccgcggtgatgtgggcatggccggggtggctatcgacaccgtggaggacaccaagatcctgttcgacggaattccgctcgagaagatgtcagtcagcatgactatgaacggagctgtcatccccgtgttggcaaactttatagtgactggagaggagcagggcgtccccaaggagaaactgactgggactatccaaaatgacatccttaaggagttcatggtgaggaacacctacattttcccgccggaaccttccatgaaaatcattgccgacatcttcgaatataccgcaaagcacatgccgaaattcaattctattagcatctccggataccacatgcaggaggccggggcagatgcaatcctcgagctggcctacactttggccgatggccttgagtacagccgcactggactgcaggcgggactcacgatagatgaattcgcgcctcggctttccttcttctggggaattggtatgaacttttacatggagatcgccaagatgcgcgccggacggagactctgggcccacctgatcgaaaagatgttccagccgaagaactccaaatcgttgcttctgagagcccattgtcagacctcagggtggtcgttgaccgaacaggatccttataacaacatcgtgcgcactgcaatcgaagctatggccgcagtctttggcggcactcagtcgttgcacaccaattccttcgacgaggccctgggcctcccgaccgtgaagagcgctcgcattgcgagaaacactcaaatcatcatccaggaagagtcgggcatcccgaaggtggccgatccttggggtggaagctacatgatggaatgtctgactaacgacgtctacgacgccgccctcaaactcatcaacgagatcgaagaaatgggcggaatggcaaaggcggtcgcggagggtatcccgaagctgcggattgaagagtgcgccgcacggcggcaggcaagaatcgacagcggatccgaagtgatcgtgggtgtcaataagtaccagttggaaaaggaggacgccgtggaggtgctggccatcgataacacgtcagtcaggaaccggcagatcgaaaagctgaagaaaatcaaatcctcgcgggaccaagcactcgccgaacgctgcctggctgctctgaccgagtgcgcggcctcgggggatggaaacattctggcactggccgtcgatgcctcgcgggcccgctgcacggtgggcgagattactgacgccctgaagaaggtgtttggcgaacacaaggctaacgatcgcatggtatcgggagcctaccggcaggaattcggcgagagcaaagaaattacctcggccatcaagcgggtccacaagttcatggaacgcgagggtcgccggccgcgcctgctggtggcgaagatggggcaggacggacacgatagaggcgcaaaagtgatcgccacgggattcgcggatctggggttcgacgtggatattggcccgctgtttcagaccccccgcgaagtcgcacaacaagcggtggatgccgatgtgcacgccgtgggaatctccactctggccgcaggacataagactctggtgcctgagctgatcaaggaattgaattcactgggacggccggacatcctcgtgatgtgcgggggagtgataccgccccaggattacgagttcttgttcgaagttggcgtttccaacgtgttcggccccggcacccgcattccaaaggctgcggtgcaagtgctggacgatatcgaaaagtgcctggaaaagaagcaacaatcggtc

SEQ ID NO: 16719 - DNA, 2250 bp, Artificial Sequence
  Description of Artificial Sequence: Synthetic coding sequence
atgctcagagcgaagaatcagctattcctgctctcacctcactatctgaggcaggtcaaggagagctcggggagtaggcttatccagcagcgcctcctacatcaacaacagcctctccatcctgagtgggctgctctggccaagaaacagcttaaaggcaaaaatcctgaggatctgatttggcataccccagagggcatttctattaaacccctgtacagcaagagggacaccatggatttgcccgaagaacttccaggtgtgaagccttttacaagagggccatacccaaccatgtacaccttccgaccctggaccattcgacagtacgctggattttctactgtggaagaatccaataagttttacaaagacaacataaaagcaggtcagcagggtctgtctgtcgctttcgacttggcgacacaccgggggtacgattcggacaaccctagggtgaggggagacgtcggcatggctggcgtcgccatagacactgttgaagacacaaagatcttgttcgatggaataccacttgagaaaatgagtgtcagcatgactatgaacggtgcagtgatacctgttttggccaactttatcgttaccggcgaggagcagggagtaccgaaggagaagctcacaggtacaattcagaacgacatcctcaaggagttcatggtgagaaatacttatatatttccccctgagccgtccatgaaaattatagccgacatcttcgaatacaccgcgaagcacatgccaaagtttaactccatctcgatctctgggtaccacatgcaggaggccggcgcagacgctattcttgaactcgcctataccctcgccgatggcctggaatatagtcgcacgggcttacaggctggtctcaccattgacgaatttgcgccaaggctcagtttcttttggggcatcggtatgaatttctatatggagatcgcaaagatgcgggccgggcggcgcctctgggcccacctgatagaaaagatgtttcagcccaaaaatagcaagagcttactcttaagggcccactgtcagacctctggctggtccttaactgaacaggacccttacaacaacatcgtgagaactgcaatcgaagctatggcggcagtatttggcggaacccagtctttgcacactaacagcttcgatgaggccctgggccttcccactgtcaagtctgcaagaatcgcaagaaatacccagatcatcatccaggaggagtcgggtattccaaaggtcgcggacccttggggcggatcctacatgatggagtgcctgaccaatgatgtgtacgacgccgccttgaagcttatcaacgagatcgaagagatggggggaatggccaaagcagtggccgaagggattcccaagctcaggatcgaggaatgtgccgctaggagacaggcccggatcgattcagggtctgaggtaattgtcggcgtgaataagtatcagctggaaaaggaggatgccgtggaagtgctggctattgacaacacatccgttagaaaccgtcagatcgaaaagctgaaaaagattaaatcaagcagagaccaggcgttagcggagagatgcctcgctgctttgacagagtgtgcagcttccggcgacgggaatattttagccctggctgtggatgcttctagggctaggtgcaccgtcggagagatcactgacgcactgaagaaggttttcggcgagcacaaagcaaacgataggatggtgtccggcgcgtataggcaagagttcggggaatcaaaggagattacaagcgcgattaaaagggtgcacaagtttatggaacgagaaggccggcggcccagattactggttgctaagatgggtcaggatgggcatgaccgcggggctaaggttattgccaccggctttgcagatcttggctttgatgttgatattggaccactgttccaaaccccccgggaggtagcccagcaggccgtcgacgccgacgtgcatgcggttggcatctccactctagcggcagggcacaagactctggtgcctgaactgatcaaagagctaaacagccttggccgacctgatattctagtaatgtgtggcggagttatccccccccaggactatgaattcctgtttgaggtgggtgtgagtaatgtgtttggcccgggtacccgcatcccgaaagccgccgtccaagtgttagatgatatcgagaaatgcctggaaaagaagcagcagtccgtt

SEQ ID NO: 16720 - DNA, 2250 bp, Artificial Sequence
  Description of Artificial Sequence: Synthetic coding sequence
atgttgagagcaaagaatcaactgtttttgctctcgccgcactatctccgccaggtgaaagagagctcggggtcacgcctcatccagcaaaggctcctccatcagcagcaaccgttgcatcctgaatgggcggccctggccaagaagcaactgaaggggaaaaacccagaggatcttatctggcacactccagagggcatctctattaagccgctctacagcaaacgcgacactatggatctgcccgaagaacttcctggagtgaagcccttcacccggggaccctacccgaccatgtacacgttccgcccctggaccatacggcagtacgccggcttcagcaccgtcgaagaatctaacaaattctacaaggacaacattaaggcaggccaacaaggtctgtccgtcgcgttcgacctggcaactcatcggggctatgattccgacaatcctcgagtccgcggtgacgtgggaatggcgggcgtcgctattgatactgtggaagatactaagatcctgttcgatgggattccgctggagaaaatgtctgtcagcatgaccatgaacggagcagtgatcccagtgcttgccaacttcatcgtgactggagaagaacagggagtgccaaaggaaaagctcaccggtactatccagaatgatatcctcaaagagttcatggtccggaatacctacatcttcccgccggagccgtcgatgaagataattgccgacattttcgagtacaccgccaaacatatgccaaagtttaacagcatatcgatcagcgggtaccacatgcaggaagcaggagcggacgctatcttggaactggcgtacacccttgccgacggactggaatattcccgcaccggactgcaggccgggctcaccatcgatgaattcgcccctcggcttagcttcttctggggtatcggcatgaatttctacatggaaatcgcgaagatgagagccgggcgccggctgtgggcgcacctcatcgaaaagatgttccagccaaaaaactcaaagtcactcctcctccgcgcccactgtcagacctcaggctggtcgcttacggaacaggacccgtacaacaatatcgtgaggaccgcgatcgaggcaatggccgcggtgtttggaggaacgcagtcgctgcacaccaactcatttgatgaggcactgggtctgccgacggtgaagagcgcaagaatcgcccgcaacactcagatcatcatccaagaggaatcggggatcccgaaggttgcagatccttggggtggatcctacatgatggagtgtttgacgaatgacgtctacgacgcggccctgaagctgatcaacgaaatcgaagagatgggtggaatggccaaggcggtggctgagggaattccgaagctgaggatcgaggagtgcgcagccaggcggcaagccagaattgactccgggtccgaggtgatcgtgggcgtcaacaagtaccagctcgagaaggaggatgcggttgaagtcctggctatcgataacacctcagtcagaaatagacagatcgagaaactcaaaaagatcaaatcctcacgggaccaagccctggctgaaagatgtctcgccgcgctcactgagtgcgcggcatcgggcgacggtaatatcctggcactggccgtcgacgcatcgagggccagatgcactgtcggcgaaataaccgatgctctgaagaaagtgttcggagaacataaagccaatgaccgtatggtgtcaggtgcttacagacaagagtttggagagagcaaggaaatcacctcggcgatcaagcgcgtgcataagttcatggaacgcgaggggcgcaggccacggctgctcgtggccaaaatgggccaagacggacatgaccgtggagcaaaagtgatcgcgaccggcttcgcagacttgggatttgatgtggacatcggtcctctttttcagactccgcgcgaagtggcgcagcaggcggtggatgccgacgtgcacgctgtgggaatctccacccttgcagctggccacaaaactctggtgccagaactgattaaggaactgaattcgctgggccgcccagatatcctggtgatgtgcggaggagtgatccctccgcaagactacgagttcctgttcgaggttggagtgtccaacgtgtttggaccaggaacgagaatcccgaaggccgccgtccaggtcctcgacgacattgagaagtgtctggaaaagaagcaacagtccgtg

SEQ ID NO: 16721 - DNA, 2250 bp, Artificial Sequence
  Description of Artificial Sequence: Synthetic coding sequence
atgcttagggcgaagaaccagctcttcctgctgtccccacattacttgcgccaggtaaaggaatcaagcggttcccgcctgatccagcagcgactgttgcaccaacagcagcccctgcacccggaatgggccgccctcgccaagaaacagctaaagggcaaaaatccagaagatctaatctggcatactcccgaaggaatttcaattaagcccctatattccaagcgcgataccatggacctgccagaagagctgcctggggtcaaaccgttcactcgcggcccctacccaaccatgtacactttccgcccatggaccataaggcagtacgccgggttctctaccgttgaggagtccaacaaattttacaaagataatattaaggcagggcagcaaggtttgagcgtcgctttcgacctcgctacacaccgggggtatgacagcgataaccctagagtccgcggtgatgtgggaatggcgggtgtcgccatcgataccgtcgaagatacaaaaattctttttgacggcatccccctggaaaaaatgagcgttagcatgaccatgaacggggctgtaatcccagtgctggcgaactttattgtaaccggcgaagagcagggagtgcccaaggagaagctcactggcactatccagaatgacatcttgaaagaatttatggtgcgaaacacatacattttcccaccggagccaagtatgaagattatcgcagacattttcgagtacactgctaaacatatgcccaaatttaactctatctctatatcaggataccacatgcaagaagcgggcgctgacgccatactcgaattggcgtatacgttggcagatggactggagtacagcagaactggcttacaggctggcttgactattgacgaatttgcacctaggctctcatttttttggggtatcggtatgaacttctacatggagattgccaagatgcgagctggccgcagattgtgggcacacctgattgagaagatgttccagcctaaaaacagtaagagtttactcttacgggcccactgtcaaacgtccggttggtccctcaccgaacaggatccatacaacaacatcgtcaggactgccattgaggccatggccgcggtcttcggcggtacacagtccctgcatactaattccttcgacgaagcgctcggtctgcccacagtgaaatcagccaggattgccagaaacacccagataatcattcaggaggagagcggcattccaaaagtggccgatccttggggtgggtcttacatgatggaatgtctcaccaatgatgtgtatgacgccgcattaaagctcatcaacgagatagaggagatggggggaatggcaaaggctgtggccgaaggcatacctaagcttcggatcgaggagtgtgctgcgcggaggcaggctcggattgacagcggatctgaggtgatagtgggagtaaacaaataccagctggagaaagaggacgccgtggaggtgctggccatcgataatactagcgtgagaaacagacaaatcgagaaactcaagaaaataaagagtagcagagatcaggcactcgccgagagatgtttggcagcccttactgagtgtgccgcaagcggcgatgggaacatcctggctttggccgtagatgcctctagggcaaggtgtactgtgggagagattaccgatgcactgaagaaggtgtttggcgagcacaaagcaaatgatcgcatggtgtctggggcctataggcaagagttcggggaatctaaagagatcacaagcgcaattaaacgcgttcataaattcatggaacgagaaggtagaaggccacgcctgctggtcgctaagatgggacaggacgggcacgacagaggggcgaaagtcatagccacagggttcgcagacctcggctttgacgtcgacatcggaccactgtttcagacgccgagagaagtggctcaacaagccgtcgacgcagatgttcatgccgttgggatctctacgttggccgcggggcacaagaccctggttcccgaactgatcaaggaattgaattctcttggtcggccagacatcttggttatgtgtggcggcgtaatcccaccccaagactatgaattcttgttcgaggtgggcgtctcaaacgtgttcggtcctgggacaagaatacccaaagctgccgtccaggttctagatgatatcgaaaagtgccttgagaaaaagcagcagtctgtt

SEQ ID NO: 16722 - DNA, 2250 bp, Artificial Sequence
  Description of Artificial Sequence: Synthetic coding sequence
atgctgcgcgcgaagaaccagctcttcctgctgtcccctcattacctcagacaggtcaaagagtcctcgggctcaaggctgatccagcagcggctgctccatcagcaacaacccctccaccctgaatgggccgcgctggccaagaagcaactgaagggaaaaaacccggaagatttgatctggcacaccccggaaggaatctcaatcaaacctctgtattctaaacgggacactatggacttgccggaagaactgccaggggtcaagccttttactcggggaccctacccaaccatgtacacttttaggccgtggaccatacgccaatacgccggcttcagcaccgtggaggaatccaacaaattctacaaggacaatatcaaggcgggacagcagggattgtccgtggcgttcgacctggccacccacagaggatacgactcggataatccaagagtgagaggcgacgtggggatggctggtgtggcaatcgacactgtggaggacaccaagatccttttcgacggaattccccttgaaaagatgtcggtgagcatgactatgaacggagcggtgatcccggtgctcgccaacttcatcgtcacgggcgaggagcaaggagtgcccaaggagaagctgactggcaccatccaaaatgacatcttgaaagaattcatggtccgaaacacctacatcttcccgccagaaccttccatgaagatcatcgcggacattttcgaatacactgccaagcacatgccgaagttcaacagcatctcaatctctggctaccatatgcaggaggcaggagcagacgcaatcttggaactggcttacacgctcgctgacggattggagtattcgcgcactggactgcaagcgggattgacgattgatgagttcgccccgcgcctctcctttttctggggcattgggatgaatttctacatggagattgctaagatgcgggccggtcgccggctctgggcccacctgatcgaaaagatgttccagccgaaaaactcaaagtcgctcttgctccgcgcccactgtcagacttccggatggtccctcaccgagcaagacccttacaacaatatcgtgcggaccgcaatcgaggcaatggccgcggtgttcggtgggacccaatcactgcatactaattcttttgacgaggcactcgggctcccgactgtgaagtcagcccggatagcgcgaaacactcagatcatcatccaggaagaatcgggcattccaaaggtggcggatccgtggggagggtcctacatgatggagtgcttgactaacgacgtgtacgacgctgcgctgaagctgatcaacgagattgaagagatgggagggatggcgaaggcggtggccgaaggaattcctaagctgaggatcgaagaatgtgcagctagacggcaggctcgcatcgattcgggaagcgaagtgatagtcggagtcaacaaataccagctggagaaggaggacgctgtggaagtgctcgcaatcgataatacctccgtgcgcaataggcagatcgagaagctgaagaagatcaagtcctcgcgcgatcaggcgctggctgagaggtgcctggcagcgctcaccgaatgcgcggcgtccggcgacgggaacatcctggcgctggcagtggacgccagccgagcgcgctgcaccgtcggagagatcactgacgcactgaaaaaagttttcggcgaacacaaggctaacgatagaatggtgtcaggagcctaccggcaggaatttggagagtccaaggagatcacttcggccatcaaaagagtgcacaagtttatggagcgggaaggtagacggcctcggcttctggtggcaaagatgggacaggatggacatgatcggggggcaaaggtgatcgctaccggcttcgcggatctcggattcgacgtcgatatcggcccactgttccagaccccaagagaagtggcccaacaagccgtggatgccgatgtgcacgctgtcgggatcagcactctggccgcaggccacaagacccttgtgccagaactgatcaaggaactgaattctctgggacgcccagatatcctggtgatgtgcggcggagtcatcccaccgcaggattatgaattcttgttcgaagtgggagtctccaacgtgttcggacccggaactcgcatccctaaagcggcggttcaagtgctcgacgatatcgagaagtgcctcgagaaaaagcagcaatcggtc

SEQ ID NO: 16723 - DNA, 2250 bp, Artificial Sequence
  Description of Artificial Sequence: Synthetic coding sequence
atgctgcgggctaagaatcagttgttccttctgtcgcctcattacctcagacaggtgaaggagtcaagcggcagtcgcctgatccagcagcgtctgctgcaccagcagcaaccgctgcaccccgaatgggcagctctagcgaagaaacaacttaagggaaaaaaccccgaggacctgatttggcacacgcccgagggaatctcaatcaagcctttatactcaaagcgcgatacaatggacttgcctgaagagcttcccggtgtcaagccgttcacccggggaccctacccaaccatgtacaccttccgaccctggaccatacggcaatacgctggcttttctactgtggaggagtccaacaaattctacaaagacaatattaaggcaggccaacaaggtttgtcggtcgcctttgacttagctacccatagaggatacgattcggacaaccctagagtaaggggggatgttggtatggcaggcgtggcaatcgataccgtggaagacaccaagattctgtttgatggaatcccactggaaaaaatgagcgtaagcatgacaatgaatggcgctgtgatccctgtcctggcaaactttatcgtgacaggggaggaacaaggcgtgcccaaggagaaactgacgggcaccatacaaaatgatatcctgaaagagtttatggtccgcaatacatatatcttcccccctgagccttccatgaaaatcattgcagatatcttcgagtacacagctaaacatatgccaaaatttaactcaatctccatcagcggataccacatgcaagaagcaggcgcagatgctatactggaattagcgtataccctggccgatggactggagtatagtcggaccgggctgcaggctggactcaccatagatgaatttgcgcctcgtctctcattcttctggggcattgggatgaacttttacatggaaatcgctaagatgagagccggtagaaggctgtgggcacatctgattgagaagatgttccaaccaaagaatagcaaatctttgctgttgagagcacactgccaaactagcggatggtcacttaccgaacaagacccgtataacaacatcgtaagaaccgcaattgaggctatggcagcagtctttgggggcacccagagtctgcataccaactccttcgatgaggcccttggcctgccaaccgttaagagcgctaggatcgctaggaacacgcaaatcattatccaggaggaaagcggcatcccaaaagttgcggatccatggggtggctcctatatgatggaatgtcttaccaacgacgtgtacgatgctgcgctgaagcttattaacgaaattgaagagatgggaggaatggcgaaagcggtcgccgaggggatccctaagctgaggatcgaagagtgcgctgcacgacgacaggctcgaatcgacagcggatctgaggttattgtgggagtgaacaaatatcagctggaaaaagaagacgctgtcgaggtgctggctatcgacaatacctccgtgagaaatagacagatcgagaagctgaaaaagatcaagagcagcagagaccaggcattggccgagagatgccttgcggcgctgactgaatgtgctgcttccggcgatggtaatattctcgcccttgcggtggacgctagcagagcaaggtgtaccgtgggagaaatcactgacgccctgaagaaggtcttcggggagcataaggccaacgatagaatggtcagcggagcctacaggcaagagtttggagaatctaaggaaatcacatcagctattaaaagagtgcataagttcatggaacgcgagggcagaaggccacgcttactggttgctaagatgggtcaggatggccacgaccgcggtgcaaaagtgattgctaccggatttgccgatttgggctttgatgtcgatatcgggcccctatttcagacacctcgggaagtagctcagcaggctgtcgacgccgacgtccacgccgtgggcatcagcacccttgctgctggccacaagacactggttcccgaactgatcaaggaactcaatagcctgggacgcccagatatcttagtgatgtgcgggggagtcattcccccccaggactatgaattccttttcgaggttggagtctcaaacgtttttggacccggcactagaatccccaaagccgctgtgcaagttctcgacgatatcgagaaatgtctggaaaagaagcaacaaagtgta

SEQ ID NO: 16724 - DNA, 2250 bp, Artificial Sequence
  Description of Artificial Sequence: Synthetic coding sequence
atgctacgagctaaaaaccaactgttcctgctgtccccccactaccttaggcaggtgaaggaatcttctgggagtcgcctgatacagcagcgcctactccatcagcagcagccattacaccccgagtgggccgctctcgctaaaaagcagcttaaaggtaagaaccccgaggacctgatttggcacacacccgaaggaatttccatcaagcctctgtactctaagagggataccatggatttgccagaggagcttccaggggtgaagcctttcacgcgggggccatacccaaccatgtatactttccggccctggacgatacgccaatatgccggattctcaaccgtggaagagtctaacaaattctataaggataatattaaggcgggacagcaggggctgtcagtggctttcgatcttgcaacccatcgaggttacgatagcgacaacccacgcgtgcggggcgatgtgggcatggcaggggtggctattgacactgtcgaggacacgaaaattcttttcgatggcatcccgcttgagaagatgtccgtgtccatgacaatgaatggcgctgtgatccctgtcttagcaaactttatagtcacgggtgaggaacagggagtgcctaaggaaaagcttacaggcaccattcaaaacgatatcttgaaggagtttatggttcggaatacctatatcttccctcctgaaccatcaatgaaaataatagccgacatcttcgagtatactgctaagcatatgcccaaattcaactctatcagtatcagcggataccacatgcaggaagccggtgccgacgctattctggagctggcctacactctggctgatggactggagtacagcaggaccggtctgcaggccgggctgacgatcgacgagttcgctccgagactgtccttcttctggggtatcgggatgaacttctacatggagatagcaaaaatgcgggctggtagacggctgtgggcccatcttatcgagaagatgtttcagcctaagaactctaagtctttattacttcgagcccattgtcagacttcaggatggtctctgacagagcaggatccttacaataatattgtccgcaccgcgatcgaggctatggccgccgtgttcggcgggactcagagcctacacacaaactccttcgacgaagctctaggcctacctacggtaaagtcagccagaatcgcccggaatacccaaatcatcatccaggaggagtccggcatccccaaggttgccgacccttggggaggatcttatatgatggaatgcctgactaatgatgtgtatgacgcagccctaaagctgatcaatgagatcgaggaaatgggagggatggccaaagccgtggccgaaggaattccaaaactgcgcatagaagagtgtgcagcacgtagacaagctcggatcgactccggctctgaggtgatagtaggagtgaataagtaccagctggagaaagaggacgctgtggaagtcctggcaattgataacacctctgtgcgcaaccgtcaaatcgagaagctgaagaaaattaagagttctagggatcaagcgttggccgagcgctgcctcgctgccctgaccgaatgcgctgcctctggcgatgggaatattctcgcactggcagtggatgccagtcgagcccgatgtacagttggtgagatcaccgatgctctcaagaaggtattcggggagcataaggccaatgacaggatggttagcggagcttaccgccaagagtttggggagtccaaagagatcacttctgccatcaaaagagtgcacaagtttatggaacgagaggggaggcggccacgactcttggtcgcgaagatgggacaggatggacatgatagaggggccaaagtgatagccactggctttgctgacctgggctttgacgtcgacatcgggccgctgttccagactccaagggaggttgcacagcaggctgtagacgctgacgtgcacgccgtgggcattagcactctggcggccggccataaaactctggtgcccgaactcattaaagaactgaattctttagggagacctgatatcctggtcatgtgcggaggagtaattcccccgcaagactatgaattccttttcgaagtgggtgtcagcaacgtgttcggacccggcacccgtattcctaaagctgccgtgcaagtgctcgatgatatcgagaagtgcctggaaaagaaacagcagagcgtt

SEQ ID NO: 16725 - DNA, 2250 bp, Artificial Sequence
  Description of Artificial Sequence: Synthetic coding sequence
atgctgagggcaaagaatcagctgtttctgttgagccctcactatctgcggcaggtgaaagaaagtagtggcagccgacttatccagcaacgactcctccaccagcaacagcctctgcatcctgaatgggcagccctggctaagaagcagcttaaagggaagaaccctgaggatctgatctggcatacacctgaggggatctctattaaacccctctactccaaacgggatacaatggacctgccagaagaactgccgggcgtgaagccatttactcggggcccttaccccactatgtatacgttccggccttggactataaggcagtacgccggcttcagtactgtggaagagtcaaacaagttttataaggataacattaaggcgggtcagcagggactcagcgtagcatttgacctggctacgcatcggggatacgactctgacaaccctcgggtgaggggcgacgtgggtatggcgggtgtggccattgacactgtcgaggacaccaaaatcctcttcgacgggataccactggagaaaatgtctgtttcaatgacaatgaacggagcggtgatccccgttctggccaacttcatcgttacaggcgaggaacagggcgtgcctaaagagaaattgacagggactattcagaacgatattctgaaagaattcatggttcgcaacacctacatcttccctcccgagccctcaatgaagattatcgcagatatttttgaatatacagccaagcatatgccgaagtttaactctatttctattagcggctaccacatgcaagaggccggagcggacgcaattttggagctggcatacacactggctgatggactcgagtattcacgaacaggccttcaggcaggtctcacaatcgatgaatttgcccctaggctgtcattcttctggggcatcgggatgaacttttatatggaaattgcgaaaatgcgcgccgggcgaagactttgggctcacttgattgagaagatgttccaaccaaaaaactccaaatctctgcttcttagagctcattgccagacttccggatggagtctgaccgaacaggatccttataataatattgtacggactgcaattgaggccatggccgccgtgtttggtggaacacagtctctccacactaactctttcgacgaggctttgggccttccaacggtgaagtcagcccggatcgcaagaaacacccagatcattatccaggaggagtctggcatccccaaagtggccgacccctgggggggatcttacatgatggagtgtctgaccaatgacgtctacgatgccgccctcaagctgatcaatgagatcgaggaaatgggcggtatggccaaagccgtggccgaaggaattcccaagcttcgaatcgaagagtgcgccgctcggcggcaggcccggatagatagcggctccgaagtcatagtgggagtgaataaataccaactggagaaggaggacgccgtggaggtgctggcaattgacaacaccagtgtcaggaatcgacagatcgaaaagttgaaaaaaatcaaatcttcccgagatcaggctctggcagaaaggtgtcttgctgcactcacagaatgtgccgcctctggcgatgggaacattctggccctcgccgttgacgcctctcgcgccaggtgcactgtaggtgagattaccgatgccctgaagaaggtatttggggagcataaagcgaatgatcggatggtgagcggagcctaccgccaggagttcggagaaagcaaagagatcacaagcgccattaagcgcgtgcataagttcatggagcgggaggggcgccgacctcggctgctggtggccaaaatgggtcaggatggtcacgacagaggagcaaaggtaattgcaactggctttgcggatctgggctttgacgtagacattggtcctctcttccagacacctcgagaagtggcccaacaggcggttgacgcggatgtgcacgcggtgggcatcagcacactcgctgcagggcataagactctcgtgcctgagttgatcaaggaactgaactcactgggacggccagacatcctggtcatgtgcggaggcgtcattccgccacaagactacgagttcctgttcgaggtgggcgtaagcaatgtctttggccctggaaccagaatcccgaaggccgctgtgcaggtgctcgatgatatcgaaaaatgtctcgagaagaaacagcagtctgta

SEQ ID NO: 16726 - DNA, 2250 bp, Artificial Sequence
  Description of Artificial Sequence: Synthetic coding sequence
atgctgagagctaaaaaccagctatttctgctgtctccccactatcttaggcaggttaaagaatcttctgggtctagactgatacagcagcggttgttgcatcagcagcagccattacatcccgaatgggccgccctagcaaaaaaacaacttaagggaaaaaatcccgaggatctgatttggcacacacctgaaggaatcagtatcaaacctctctatagtaaacgggatacaatggatcttcccgaggaactgccaggagtaaagccatttactagaggaccatatcccactatgtatacatttcggccttggactattcggcagtatgcagggttctctacagtagaagaaagtaacaaattctataaagataatatcaaagccggacagcagggactgagtgtagctttcgatttagccactcatcgcggatatgactcagataacccaagggttaggggggatgtggggatggccggggtcgccatcgatactgtcgaggatactaaaatacttttcgatggaatccccctcgaaaaaatgtctgtgagtatgacgatgaacggagctgtcatacctgtcctggcgaattttatagtgacaggggaagagcagggggtgccaaaagaaaaattgacaggaacaatacagaacgatattttgaaggagttcatggtccgcaatacatatatattcccccctgaaccctctatgaaaatcatcgccgatatcttcgaatacacagcaaagcatatgccaaaattcaatagtatctctatttctggatatcatatgcaggaagctggggcagatgcgatcctcgaactagcttatactctagctgatgggctggaatacagtagaacagggctccaggctggactgactatcgatgaattcgctccacgactatccttcttctggggaatagggatgaacttttacatggaaatagcaaaaatgcgcgctgggcgacgcttatgggcccacctcattgaaaaaatgtttcagcctaaaaactctaaatccctcctactgagagctcattgccagacaagtgggtggagtcttacagaacaggatccatacaataacattgtgcggacagccatagaagctatggccgcagtattcggggggacacaaagtctgcacacaaattctttcgacgaagcccttggactccctacagtgaagagtgctagaatcgccaggaatacgcagattataatccaagaagaaagtggaattcctaaagtggccgacccctgggggggatcctacatgatggaatgcctcactaatgacgtctatgatgccgctttgaaactcattaatgaaattgaagaaatggggggaatggcaaaggctgttgctgaaggaattccaaaactccgaatagaagaatgtgctgcacgacgccaggcacggatagattcagggtccgaggtgatcgttggggtcaacaaatatcagctggaaaaagaagatgccgtggaggtcctcgccatagataatacatctgtgcgcaatcgacaaatagaaaaactaaaaaaaatcaaatcatctagagatcaggcactagctgagaggtgcttagcggctcttactgaatgtgcggcatctggggatgggaacatcctcgctctcgcagtagatgcttctcgcgctcgctgtacagtaggggagattacagatgctttaaaaaaagtgttcggggaacataaagcgaatgatcgcatggtatctggagcatataggcaggaatttggggaatctaaagaaataactagtgctataaagcgggtgcacaaattcatggaacgggaggggagacgacctcggctccttgtggccaaaatgggacaggatggacacgatagaggggccaaagttatcgccacaggattcgcggatttgggattcgatgtggatatcgggccactgtttcagacacctcgggaagtggcccaacaggctgtggatgcagacgttcacgccgtggggatcagtactctcgctgcaggacacaaaacactggtgcctgagctaatcaaagaacttaattccttggggcgtcctgatattctggtgatgtgcggaggagtgatcccaccccaggattatgaattccttttcgaggttggagttagtaatgtgttcgggccagggactcggatacctaaggccgccgttcaggtgttagatgatatagagaagtgccttgaaaagaaacagcagagtgta

SEQ ID NO: 16727 - DNA, 2250 bp, Artificial Sequence
  Description of Artificial Sequence: Synthetic coding sequence
atgctgcgggcaaagaaccagctttttctcctgtcccctcactacctgagacaggttaaggaaagtagcggctctcggctgatccagcaacgcctcctgcaccaacagcaaccgttgcatcctgagtgggctgcgctggccaagaagcagttaaaaggcaagaacccagaggacctcatctggcacacacccgagggaatctcaatcaagcctctctattctaaacgggacaccatggacttgcctgaggagttgcctggcgtcaaacctttcacacgcgggccttacccaaccatgtataccttccgcccctggacgattcggcagtatgccggcttcagcacagtggaagaatcgaacaagttttacaaggacaatataaaggccggtcagcaaggcctgagcgtggcattcgacctcgccacacacagagggtacgactcggacaatcccagggtgcggggggatgtcggcatggccggggtagctatcgacaccgtggaggacactaagatccttttcgatggcataccactggagaagatgagtgtgagcatgactatgaatggggctgtgattcccgtgctggccaactttattgtgacaggggaggaacagggtgtacccaaagaaaagctcaccgggactatacaaaacgatattcttaaggagtttatggttagaaacacgtacatctttcctccagaacccagtatgaagatcatcgccgacatctttgaatataccgcaaagcatatgcccaagttcaatagcattagcatcagcggataccacatgcaagaggcaggagctgacgctatcctggaactggcttataccttggcggacggtctagaatactcgagaaccgggctgcaggccggtctgacaatcgacgagtttgccccaaggctgtctttcttttgggggatcggcatgaatttttacatggagattgccaagatgcgagcagggcgcagattgtgggcgcacctgattgagaagatgttccagccaaagaactccaagtctctgttgcttcgggcacactgtcagactagcgggtggtcccttacagagcaggatccgtacaacaatattgtgcgtactgctatcgaggccatggcagctgtgttcgggggcacacaatcattgcataccaattcatttgatgaggccttgggtctgcctacagtaaagagcgctagaattgcacgcaatacacagatcatcatccaggaggaatcagggattcccaaagtggcagatccttggggggggagctatatgatggaatgcctcacaaacgatgtgtatgatgcagcattgaaactcattaacgagatagaggagatgggaggcatggccaaagccgttgctgaaggtatccctaagcttaggatcgaggagtgtgccgccaggaggcaggctcgcatcgatagtggaagcgaggtgattgtgggagtgaacaaatatcaactggaaaaggaggatgcagttgaggtgctagccatagataatacctcagttcgcaaccggcagattgagaaactcaaaaagataaagtcgagccgagaccaggcgttggcggagaggtgccttgcagcactcactgagtgtgcggcgtccggtgacggtaacattctggctctggctgtggatgccagtagagcaaggtgcacagtgggcgaaatcacagacgctctcaagaaggtgtttggagagcacaaagccaatgatagaatggttagcggggcgtaccgccaggaattcggggagtcaaaagagattacaagcgctattaagcgcgtgcacaagttcatggagcgggaggggaggagaccccgattactggtggcaaaaatgggccaagatgggcatgacaggggagccaaagtcatcgccacggggttcgcagaccttggctttgatgtggatatcggtcctctgtttcaaacaccacgcgaggtggcccagcaggctgtggatgctgacgtgcatgccgtaggaatcagcacattggccgccggacacaagaccctggtccctgagctgatcaaggaactgaatagcttgggaaggccggacattctagtcatgtgcggaggcgtgatccccccccaggactacgaattcctctttgaggtgggcgtttccaatgttttcggacccggaacacgaatcccaaaagctgcagtccaggttctggacgatatcgagaagtgtctggagaagaaacagcagagcgtg

SEQ ID NO: 16728 - DNA, 2250 bp, Artificial Sequence
  Description of Artificial Sequence: Synthetic coding sequence
atgctcagggcgaaaaaccaactgtttcttctcagcccccattacctcagacaagtgaaagagtcatcaggctcgagattgatccaacagcgactgctccatcagcagcagcctctgcatcctgagtgggcggcccttgcgaaaaaacagctgaagggaaagaacccagaagatcttatctggcatacgcctgagggtatttcgattaaacctctttactctaagagggatacgatggatctgcctgaagagcttccaggtgtgaagccatttaccagaggaccctacccgaccatgtacacttttagaccatggactattagacaatacgcaggtttctccacggtggaagagtcgaataagttttacaaagataacataaaggcgggacagcaaggcctttcggtcgcctttgatctggcaacgcaccgaggttatgattccgataaccctagagtgcggggcgacgtgggcatggcaggagtggcaatagataccgtggaggataccaaaattctgttcgacgggatcccgcttgaaaagatgtctgtgtccatgactatgaacggcgctgtcatccctgtgcttgccaatttcatcgtcaccggtgaagaacaaggagtccctaaggagaaactcactggaactatacagaacgatattctgaaggagttcatggtgaggaatacgtacattttccctccagagcctagcatgaagattattgctgatatctttgagtataccgcgaaacatatgccaaagtttaactcgatatccatatctggataccatatgcaggaagcaggggcagatgcaatccttgaactcgcttacacccttgccgacggattggagtattccaggaccggcctccaagccggcctgacgatagatgagtttgcacctcgtctgtcctttttctggggaattggtatgaacttctacatggaaattgccaagatgagagcaggccggagactgtgggcccatttgattgagaagatgttccaaccaaagaacagcaagtcgttgctcctcagagcacactgccagacttcagggtggagccttaccgagcaggatccgtacaacaacatagtgcgtaccgcaattgaggccatggctgccgtgttcggtggaactcagtcgcttcatacgaactcgttcgacgaagccttgggtctgcctactgtcaaatcggcaagaattgcacgaaacactcagatcataatccaggaggagtcagggattcccaaggtcgccgatccttggggaggttcctacatgatggaatgtctcactaacgatgtctacgatgcagcactcaaactgattaacgaaatcgaagagatgggaggtatggcaaaagccgtggcggaaggaatccctaaacttcgaattgaagaatgcgccgcacgccggcaagctcgcattgattcaggaagcgaggttattgtgggcgtgaataagtaccaacttgagaaggaggatgccgtggaagtgcttgctatagacaatacctccgtccgtaatagacagatcgaaaagctgaaaaagatcaagtcgagccgagatcaggcacttgcagagcgctgtcttgccgccctgaccgaatgtgctgcaagcggagacggcaatatcctggccctggctgtcgatgcatcacgcgcacgctgtaccgtgggagagatcactgacgcacttaagaaggtctttggagaacataaggcaaatgacagaatggtgagcggggcctaccgccaagaattcggtgaatccaaggaaattacctcggcaatcaagcgggtgcataagtttatggagagagaaggaaggcgtcctcggttgctcgtggccaaaatgggccaagatggccatgatagaggggcgaaggtgattgcaacgggttttgcggatcttgggtttgatgtggatattggacctctcttccaaacccctagggaagtcgcacaacaagcagtcgatgccgatgtgcatgccgtcggcatctcaaccctggcagccggtcataaaaccctcgtgccggaactcatcaaggaacttaattcactcgggcgtcccgatattctcgtgatgtgtggaggagtgatacccccacaggattacgagtttctcttcgaagtgggagtgtcaaatgtctttggaccaggtacccggattccaaaggcagctgtccaagtgctggacgatatagagaaatgtctcgaaaagaagcaacaatcagtt

SEQ ID NO: 16729 - DNA, 2250 bp, Artificial Sequence
  Description of Artificial Sequence: Synthetic coding sequence
atgctgcgggctaagaaccaactcttcctgttgtcaccgcactaccttagacaggtcaaagagagctccggctccagactgatccagcagcggctcctgcatcagcagcagccactgcatccagagtgggcagcacttgcaaagaagcaacttaagggcaagaatcccgaagacctcatctggcacacccctgaagggattagcattaaaccgctgtactctaaaagggataccatggacctcccggaggagcttcctggggtgaagccgttcaccagaggcccatacccgactatgtacaccttccggccgtggaccatccgccagtacgccggattctcaactgtcgaagaatcaaataagttttacaaagataacataaaggccggacagcagggtctgagcgtggccttcgatctggcaacccatcggggttacgactcagataaccctcgggtccgcggcgacgtgggaatggctggagtggcgatcgataccgtggaagacaccaagatcctcttcgatggaatccctctggaaaagatgtcggtaagcatgactatgaatggagcggtgatccctgtgctggctaacttcattgtgaccggtgaggaacaaggcgtccctaaagagaagctgactggcactattcagaacgacatcttgaaggaatttatggtccggaatacttacatttttccaccagagccatccatgaagatcatcgcagacatctttgagtataccgcaaagcacatgcctaagtttaactccatctcgatctccggatatcacatgcaggaagcaggagccgacgcaatcctcgaattggcttacaccctggccgacggcctggagtactcgcggacgggtctgcaggccggattgactattgatgagttcgctcctcggctgtcgttcttctggggtatcggaatgaacttttacatggaaattgccaagatgcgggcgggtcggcgcctgtgggcgcatctcatcgaaaagatgtttcaaccgaaaaattcgaaaagcctgctgcttagagctcattgtcagacgtcggggtggagcctgactgagcaggacccgtacaataacatcgtccgcactgcaattgaagccatggcggccgtcttcggagggactcagtcgctgcacaccaactcgttcgacgaggccctggggctgcctaccgtgaagagcgcccgcatcgccagaaatactcagatcattatccaggaagaaagcggaatcccaaaggtggcggatccctggggaggctcgtacatgatggagtgcctgaccaacgacgtctatgatgcggcattgaagctcatcaacgaaatcgaagagatgggcggaatggcgaaggccgtggcagaaggaatcccgaaactccggatcgaagaatgtgcagcgcgccgccaggcgcggatcgactccggaagcgaggtgatcgttggagttaacaagtaccagctggaaaaggaagatgccgttgaggtgctggccatcgacaatactagcgtgcggaatcgccagatcgagaagctgaagaagatcaagtcctcccgcgaccaggccctcgcggagagatgccttgcggcgctgactgagtgcgctgcctcgggagacggtaacattcttgctctggccgtcgacgcctcgcgggcacggtgcactgtgggggaaatcaccgatgctttgaagaaggtcttcggagaacacaaggccaatgaccgcatggtgtctggagcgtaccgccaggagttcggagagtcaaaagaaatcactagcgccatcaagcgcgtccataagttcatggaacgagagggtcggcggccgcggctgttggtggcgaagatgggacaagacggacacgatagaggcgctaaggttatcgctaccggattcgccgacctcgggttcgacgtggatatcggacctctgtttcagaccccgagagaagtggcgcagcaagctgtcgacgcagacgtgcacgcggtcggcatctcgaccctcgctgcaggccacaagactctggtcccagaactgatcaaggagctgaactcactgggacggcctgatatcctcgtgatgtgtgggggcgtgatccctcctcaagattatgaatttctcttcgaagttggagtctccaacgtgttcggtccgggcactcgcatcccgaaggccgccgtgcaggtgctggacgacatcgagaagtgccttgagaagaagcagcaatccgtg

SEQ ID NO: 16730 - DNA, 2250 bp, Artificial Sequence
  Description of Artificial Sequence: Synthetic coding sequence
atgctgagggcaaagaatcaactttttctgctctctccccattacctgcgacaagtgaaggagtcaagcggatcgagacttattcagcagcgtttgctgcaccaacagcagcccctgcacccagagtgggcagcattggcaaagaagcaacttaaggggaaaaatcccgaggatctgatttggcatactcctgagggcattagcataaagcctttgtacagcaagcgggacactatggacctgcctgaggaacttccaggagtgaaacctttcaccagggggccttaccccactatgtacacgttcagaccctggacgatccgtcaatacgcaggattttcgactgttgaagagtcaaacaagttttacaaggacaacataaaagccgggcaacaaggattgtccgtggcgttcgatcttgcaacccataggggttacgatagtgacaatccacgcgtgagaggcgatgtgggcatggcaggagtggccattgacactgtcgaagatacgaagattctgtttgatggaatacctctggagaaaatgtcggtgagcatgactatgaatggcgccgtgattcccgtccttgctaactttatcgtgactggagaagagcagggagtgcctaaagagaagctgacgggaacgatccagaacgacattcttaaggaattcatggtcagaaatacctacatctttcctcctgaaccttccatgaagattatcgcagatatcttcgaatacaccgctaagcatatgccgaagtttaactcaatcagcatatccgggtatcacatgcaggaagcgggagcagatgcaatccttgagcttgcctacaccctggcagacggacttgaatactcccggactggccttcaagccggacttacgattgatgaatttgcaccccggctctcgttcttctggggcattggaatgaatttctacatggaaattgcaaagatgagggcaggtcgcaggctgtgggcccaccttattgagaagatgttccaaccgaagaacagcaagtcactgttgttgagagcacactgtcagactagcggttggtcgcttaccgagcaagatccatacaacaatatcgtgcggaccgcaatcgaagctatggcggcagtgtttggaggtactcagagcctgcacactaacagctttgacgaagcgcttggacttccaaccgtcaagtcagcgcgcatcgcaagaaatacccaaatcataattcaggaagagtcgggcattccaaaggtggccgatccttggggaggaagctatatgatggagtgcctgactaacgatgtctacgatgcagccctcaaactcatcaacgagatcgaggaaatgggtggtatggccaaggccgtcgcagaaggaatcccaaagctgcgaattgaagagtgtgcagcgcgcaggcaagcacgcattgatagcggatcagaagtgatcgtgggagtgaacaagtaccaacttgagaaagaagatgcagtcgaagtgctggcaattgataacacttcggtgcgaaaccgccagattgaaaagctcaagaagatcaaatcctcccgtgaccaagcacttgcagaaagatgcctggcagccttgactgaatgcgcagcatccggtgatgggaacattctggcactcgctgtggatgcgtcgagagctaggtgtactgtgggagaaatcactgatgcactgaaaaaggtgttcggagaacataaggcaaacgatcggatggtgtcgggtgcataccggcaggaatttggcgagagtaaggaaattacctccgctataaagagagtgcacaaattcatggagcgggaaggcaggcgcccaagacttctcgtggcaaagatgggtcaggatggccacgataggggcgcgaaagtcatcgctactggatttgctgatctgggttttgatgttgatattgggccgctctttcaaaccccaagagaagtggcacagcaagcagttgatgcagatgtgcatgctgtcggaatttccaccttggccgccgggcataagacccttgtgccagagcttatcaaggaactgaactcgttgggacgacccgatattctggtgatgtgtggcggcgtgataccacctcaggattacgaatttcttttcgaagtgggtgtgtcgaacgtgttcggacccggcaccagaattcccaaagcggcggtgcaagtgttggacgacattgaaaaatgtctggaaaagaagcaacaatctgtc

SEQ ID NO: 16731 - DNA, 2250 bp, Artificial Sequence; identical to SEQ ID NO: 16664
  Description of Artificial Sequence: Synthetic coding sequence

SEQ ID NO: 16732 - DNA, 2250 bp, Artificial Sequence
  Description of Artificial Sequence: Synthetic coding sequence
atgctgagagctaagaaccagttgttcctgctcagtccacactatttgcgtcaggtgaaggagtcgtcaggcagcagactcatccagcagaggctgctgcaccagcaacaacctctgcaccccgaatgggctgccctggccaagaagcagcttaaaggcaaaaatccagaagatcttatctggcacacgccggagggcataagtatcaaaccattgtattcaaaaagggatactatggacctgccagaggagctgcccggcgtcaaacccttcactaggggcccgtaccccactatgtatacatttagaccctggactattagacaatacgctggatttagtactgtcgaagagtctaataagttttataaggacaatattaaggcgggacagcagggtctgtctgtggccttcgatcttgcaacccatcgcggctatgatagtgataaccctcgcgttcgcggcgatgtaggcatggctggggtcgctattgatactgtcgaggatacgaagatactgttcgatggtatccctctggagaagatgtccgtttccatgacaatgaatggcgccgtaatccctgtactcgctaacttcatagtgacaggggaagaacagggagtgcccaaagaaaaactgaccgggaccattcagaacgatatcctaaaagagtttatggtcaggaacacttacatctttccaccagaaccgtctatgaagatcattgctgacatttttgaatacactgcgaaacacatgcccaaatttaattcgatcagtatatctgggtatcacatgcaggaagctggcgcagatgcaatcctggagctcgcatatacattggccgatgggttggagtattctagaactggactgcaggccggacttaccatcgacgaattcgctccacggctctcgtttttctggggcatcggtatgaatttctatatggagatcgccaaaatgcgggctggaaggaggctgtgggcccatttgattgagaagatgtttcagccgaaaaacagcaagtctctgttgttgcgggcccactgccagaccagcggctggtctttgacggaacaggatccctacaacaacatcgtccgaactgctatcgaggcaatggctgccgtcttcggaggcacccagagccttcacaccaatagtttcgatgaggccttaggcctgcccactgttaaaagcgctcggatagccagaaatacacagattattattcaggaagagtccggaattcctaaggtggccgatccgtgggggggctcttatatgatggaatgtctcaccaatgacgtctacgatgccgccctgaaactcattaatgagattgaggagatgggcggaatggccaaagctgtggcggaaggaatccctaaactgaggatagaagagtgtgctgctagaaggcaagcccggatcgacagcggttcagaggtcattgtgggtgttaataagtatcaactggagaaagaggacgcagtcgaggtcttggcgattgacaatacctcagttcgaaacagacaaatagagaaactcaaaaagatcaaatccagtcgcgaccaagctctcgctgagcgctgtctggctgcactcaccgaatgtgccgcctccggtgacggtaatatcctggccctggccgttgatgcctcacgagcgcgttgcaccgttggtgagatcactgacgcattgaagaaagtgttcggggaacacaaagccaacgacagaatggtgtccggagcctatagacaggagttcggggagtccaaagaaatcacctcagcaataaaaagagtccacaagttcatggaaagggaaggccggaggccacgactgctagttgcgaaaatgggtcaagacggacatgataggggcgccaaggtaattgccactggttttgccgacctcggatttgatgtcgatatcggtcccctgtttcagaccccgagggaagtcgcccagcaggctgtggacgcggatgtccacgcggtcggaatttctaccctagctgctgggcataagaccttagtccccgagctgatcaaggaattgaatagtctaggcagaccggatattctcgtgatgtgtggcggagttatccccccacaggactatgagttcttgttcgaagttggcgtgtctaacgtctttggcccaggaacaaggatccctaaagctgccgttcaggttctggatgacattgagaaatgccttgaaaagaagcagcagagcgtt

SEQ ID NO: 16733 - DNA, 2250 bp, Artificial Sequence
  Description of Artificial Sequence: Synthetic coding sequence
atgctcagggccaaaaatcaactctttttgctgtctccccactatttgcgtcaagttaaggaatcatccgggtcacgcctcattcagcagcgactcctgcaccaacagcaacctctgcaccccgaatgggccgccctcgctaagaagcagctgaaaggcaagaatccagaagatttgatttggcatactcccgaagggatcagcattaaacccctgtatagtaagcgagatacaatggatcttccggaagaactgccaggcgtcaagcctttcacacgtggtccctaccccaccatgtacacgttccgtccttggacaatcagacaatatgctggattttcgaccgtagaagaatccaacaaattttataaggacaatataaaggcaggacagcagggactgtctgtcgcctttgatctcgcgacgcatagaggctatgactctgacaatcctcgggtacgcggcgacgtcggtatggccggagtggctatagataccgtcgaagacaccaagattctattcgacggaatcccccttgagaaaatgtcagtgagcatgaccatgaatggagctgttatacctgtgctcgcaaattttattgttaccggggaagagcagggagtccctaaggagaaacttactgggacaattcagaacgatatattaaaggagttcatggttcgcaacacgtacatcttcccccctgagccatcaatgaagatcattgccgatatctttgagtatacagccaaacacatgcctaaattcaacagtatctcaattagtggttaccacatgcaggaggctggggccgatgccatcttggagctcgcgtacacactggccgacggcctagaatactctcgcacaggacttcaggctggactgactattgatgaatttgctcctcgtctgtcattcttctgggggattgggatgaatttttatatggagattgccaagatgcgggctgggcgacgactttgggctcacttgattgagaaaatgttccagcctaaaaattccaagtcactgctcttacgagcacactgtcagacttctgggtggtccctgaccgagcaggatccgtataataacatagtgaggactgccatcgaggcgatggctgcggtgttcggaggtacacaaagtctccacacaaattcctttgatgaggccctgggcttgcccacagtgaagtctgccaggatcgcccggaacacccagattattatccaggaggaaagtggcattcctaaggttgctgacccatggggcggaagttacatgatggaatgtctgacaaacgatgtgtatgacgccgctttgaagctcataaacgagatcgaggagatgggagggatggccaaggccgtggccgaggggattcctaagcttcgaatcgaggagtgcgccgcccgacgacaggctaggattgactccggctctgaagtaatagtgggagtaaacaagtaccagctggaaaaagaggatgccgtcgaggtcttggccatagacaatacttcagtgagaaacagacaaatcgagaagttgaaaaaaattaagagtagccgtgaccaggcactcgccgagcgctgcctcgccgcgctcaccgaatgtgctgcttctggcgacggtaacattcttgctttagctgtcgacgcaagccgggcgcgctgcacggtcggggagattacggacgcgttgaagaaggtattcggcgagcacaaggccaacgaccgcatggtttccggagcctaccggcaggagttcggagagagtaaggagatcactagcgcgatcaagcgggtgcataaattcatggagagggaggggaggcgtccacggctgcttgttgccaagatgggtcaggacggccatgataggggagcaaaagtaattgccacaggctttgcggatcttggattcgacgtcgacatcggccccttgttccagacccctcgagaggttgcacagcaggccgtcgatgccgacgtgcacgcagtgggcatctctaccctggcagcgggacacaagacccttgtgcctgagctgatcaaggaattaaattccctcggccgccctgacatcctggtgatgtgcggcggggttatcccaccccaggactatgagtttctattcgaggttggtgtctccaatgtcttcggacctggtactcgcatacccaaggccgccgtccaagtcctagacgacattgaaaaatgtctggaaaaaaagcagcagagtgtg

SEQ ID NO: 16734 - DNA, 2250 bp, Artificial Sequence
  Description of Artificial Sequence: Synthetic coding sequence
atgttgagagcaaaaaaccaactttttctcctcagcccccactatctccgccaggttaaggaatccagcggctcccgcctgatccagcagaggttgctccaccagcagcagccactgcatcctgagtgggctgctctcgccaagaagcaactcaagggcaagaaccctgaggatttgatctggcacaccccagagggtatttccattaagcctttgtacagcaaaagagacactatggatctcccagaagagctgcctggtgtgaagcctttcaccaggggaccctaccccactatgtacacatttaggccatggaccatccgtcaatacgctggcttctccactgtggaggagtccaacaagttttataaggataacatcaaggcaggccaacagggactttctgtggcctttgacttggccactcacaggggctacgatagcgacaaccccagggttaggggtgatgtcggcatggccggcgtcgcaatcgatacagttgaggacaccaagatcctcttcgatggcatcccccttgaaaagatgagcgtgtccatgacaatgaacggcgctgtgattcctgtgctcgcaaatttcattgtgacaggtgaagaacaaggagttcccaaggaaaagctgaccggcaccattcagaacgacatattgaaggagttcatggtgagaaacacctacatcttcccccctgagcctagtatgaaaatcattgctgatatcttcgaatacacagcaaaacacatgcctaagttcaactctatctcaatatccggttaccacatgcaggaggcaggagctgacgccattcttgagttggcttacacccttgctgatggcctggagtactctcgtaccggtctccaggccggattgactattgatgagttcgctcctagattgtccttcttctggggaatcggcatgaacttctacatggagatcgctaagatgcgcgctggaaggcgtctgtgggctcacctcattgaaaagatgttccaacctaaaaattcaaagagcctcctgctgcgcgcacattgccaaacatctggatggtcactgacagaacaggacccttacaacaacattgttagaaccgctatcgaggccatggcagccgtattcggtggaactcaaagcctccataccaactccttcgatgaggccctcggtttgccaaccgtgaagtctgctagaattgccagaaacacccagatcataatccaggaggaaagtggaattcccaaggtcgctgacccctggggcggaagttacatgatggagtgcctgacaaacgatgtgtacgacgctgccctgaagctcattaatgaaatagaggagatgggtggaatggctaaagctgtggccgagggaatcccaaagctccgtattgaggaatgcgctgctcgtcgccaggctcgcatcgattccggcagtgaagtcatagtcggtgtgaataaataccagcttgagaaggaggacgctgtggaggtgttggctattgacaacacaagcgtccgcaaccgccaaattgaaaagctcaagaagattaagagttctagagatcaagccctggccgaacgctgtctggccgccctgaccgaatgcgccgcctcaggtgacggaaacatccttgctttggccgtggatgcttcacgtgctagatgcacagtgggcgagatcactgatgccctcaaaaaggtgtttggcgagcacaaggcaaacgaccgtatggtgtctggagcttaccgtcaggagttcggcgagtcaaaggagatcacttccgctataaagcgcgtgcacaaatttatggagcgtgagggcagaagaccacgcctgctcgtggccaagatgggccaggacggccacgataggggtgctaaggttatcgccactggttttgccgatctcggattcgacgtagatatcggacctctcttccaaactcccagagaggtggcacaacaagccgtagatgctgacgttcacgcagttggaatctccacacttgccgctggacacaagactctggtccctgaactcattaaggagctcaacagtttgggacgtcccgacattctcgtgatgtgcggaggagtcatccctcctcaggactatgagtttctgtttgaggtcggagtaagcaatgtctttggacctggcacacgtattcccaaggccgccgttcaggtgctggatgatatcgagaagtgcctggaaaagaagcagcagtctgtg

SEQ ID NO: 16735 - DNA, 2250 bp, Artificial Sequence
  Description of Artificial Sequence: Synthetic coding sequence
atgctcagggctaaaaatcagctatttctgctatctccccattatctgcggcaggtaaaggagtcctctggcagcaggctgattcaacagcgattgctccatcaacaacagccactccaccctgagtgggcagccctggcaaagaaacagttgaaaggcaagaatcccgaagacctaatctggcacacacctgaaggaatcagtatcaagcctctttacagcaagagggacaccatggatttgcccgaagagctgcctggcgtgaaacccttcactcgggggccttatcccacaatgtacactttcagaccttggaccataagacagtacgcaggcttctctaccgtcgaggagagtaacaagttttacaaggacaacattaaagccggacagcagggacttagcgtggcatttgatttggctacccatcggggatacgactctgataaccctcgggtgcggggtgatgtagggatggctggtgtggctatcgataccgtggaggataccaagatcctctttgatgggatccctctggaaaaaatgtctgtcagtatgaccatgaatggggcagtcattcccgtgttggccaattttatcgtgactggcgaagagcagggagtacctaaagagaagttgacagggaccatccaaaatgacatcttgaaagagtttatggtgagaaacacctacatctttccacccgagccatccatgaagattattgcggatatcttcgaatacaccgcgaaacacatgccgaagttcaatagtataagcataagcggataccatatgcaggaggctggtgccgatgcgatcctggagctggcttacactctcgctgatggcttggaatactcgcggactggactccaagctgggttgacaatagatgagttcgcccctcgcctgtcctttttctggggtatcggtatgaacttctacatggaaattgccaaaatgcgagccgggcgaagattgtgggcgcacctgatagagaagatgttccagccaaaaaatagcaagtcactgctgcttagggcacattgccagacctcggggtggtcactgacagaacaagacccttataacaatatcgtgcggacagcgatagaggccatggctgctgtctttgggggcactcagtctctacatacgaacagctttgatgaggctcttggcctgccgaccgtcaaaagtgccagaatcgctagaaacacccaaatcatcatccaggaagaatcagggattcccaaggttgctgacccatggggaggcagctacatgatggagtgccttaccaacgacgtctacgacgcagcactgaagctgattaacgagattgaagaaatgggaggaatggcgaaggcagtagccgaggggatccctaagctgcggattgaagaatgcgcagccagacgccaggcaagaatagactccggaagtgaagtaatcgtgggagtgaataagtaccaattagaaaaggaggacgccgtggaggtgctcgccatcgacaacacaagcgtccggaacaggcagatcgagaaattgaagaagatcaagagctcccgggatcaggccttagcggaacggtgcttggccgccttgacagagtgcgccgcaagtggggacggtaacattctggctctggccgttgatgcaagcagggctaggtgcacagttggggaaatcacggacgccttgaagaaggtgttcggcgagcataaggcaaatgaccgcatggtctctggagcatataggcaggaatttggagaatccaaggaaatcacatccgccatcaaaagagtgcataagtttatggaacgggagggtcgacgacctcggctattggttgcaaaaatgggacaggatggtcacgatcggggagccaaagtcatagccaccgggttcgctgatttagggtttgatgtcgacatcggccccctttttcagactcctcgcgaggtggcgcaacaggcagtggacgctgacgtgcacgctgtgggcatctccaccttggccgcaggacataaaacactcgtgccggagctcatcaaagaattgaatagcctcggtagaccagatatcttggtgatgtgtgggggggtgattccaccgcaggactatgaatttctcttcgaagttggggtgtcaaatgtgttcggaccgggaacacgcattcccaaagccgctgtccaagtgcttgacgatattgaaaagtgcttagaaaagaaacagcaatctgtg

SEQ ID NO: 16736 - DNA, 2250 bp, Artificial Sequence
  Description of Artificial Sequence: Synthetic coding sequence
atgttgcgcgccaagaatcagttgttcctgctgtcgcctcattacctacgccaagtgaaagaatcctcaggttcgcgcctgatccagcaaagattgctccaccagcaacagcccctgcacccggagtgggccgcccttgctaagaagcaactgaagggaaagaacccggaggacctgatctggcacacgccggaaggcatctccattaaacctctgtattcgaagcgcgacactatggacctgcccgaagaattgccaggagttaagcctttcacccgcggcccgtaccccactatgtacacctttagaccctggaccatccgacagtatgcgggcttcagtacggttgaggagtcgaataagttttacaaggacaatattaaggcaggccagcagggattgtcggtcgcattcgacctcgccacacaccgcggttacgactcggacaatccacgcgtgaggggtgatgtgggcatggccggagtggccatcgatacagtggaggacaccaagatcctgttcgacggcatccccctcgaaaagatgagcgtgagcatgaccatgaacggagctgtcattccggtactggcgaacttcatcgtcaccggtgaggagcagggggtgcccaaagagaagctgacgggtaccatccagaatgacattttaaaggagttcatggtcaggaatacatacattttccccccggagccttcgatgaagatcattgcagacatcttcgaatatacggctaagcacatgcccaaattcaatagcattagcataagtggctatcatatgcaagaggcgggcgcggacgccatattggagttggcttatacattggccgacggactggagtacagtcgcaccgggttgcaagccggactgaccatagatgagttcgcccctcgcttgtcgtttttctggggtattggaatgaacttctatatggagatagccaaaatgcgcgccggccgccgattatgggcccatctaatcgaaaagatgttccagccgaagaactccaaaagcctactgctccgggcccactgccaaaccagcggttggagcttgacagagcaggatccctataataacattgtccgtacagccattgaagccatggcagctgtttttggcggcactcagagtctccacacaaattctttcgacgaggcgctggggttgccaaccgttaagtccgcaaggatcgccaggaatactcagatcattattcaggaggaatcgggcattccgaaagtggcagatccatggggcggatcgtacatgatggagtgtttgactaacgatgtgtatgatgccgccctcaagctgataaatgagatcgaggagatggggggaatggcaaaagccgttgccgagggtattccaaaactgagaatcgaagagtgcgcggctcgacgccaagcccggatcgacagcggttccgaggtgatcgtgggcgtaaataagtaccagcttgagaaagaggatgccgtcgaggtattggccatcgacaacacgtcggtacggaaccgtcaaatcgagaaacttaaaaagatcaaatcatcacgtgatcaagccctcgcggagcgctgcctggccgcacttactgagtgcgcggcgtcaggggacggcaatattttagcactggcggtcgatgccagtcgagctagatgcacagttggcgagattacggatgcgctgaagaaggtgtttggtgagcataaagctaatgatcgcatggtgagcggcgcttatcgccaggagttcggagaatccaaggagatcacgtccgccatcaagcgtgtgcataaatttatggaaagggagggacgccggccgcgattgctggtggccaagatgggtcaggatggccacgataggggtgccaaggttattgctaccggctttgccgatctgggcttcgacgtcgacataggaccactgttccagacccctcgggaagtggcccaacaggctgtggacgccgacgtgcatgcagtggggatttcgaccttggccgcaggacacaagaccctggtacccgagctgatcaaagagttgaacagtttgggaaggcccgatatattggttatgtgtggcggagtaatccccccccaggactatgagttcctttttgaggtaggagtttccaatgtcttcggcccaggcactcgcattcctaaggcagcagtgcaggtgcttgatgacatagagaagtgtctggaaaagaagcagcagtccgtt

SEQ ID NO: 16737 - DNA, 2250 bp, Artificial Sequence
  Description of Artificial Sequence: Synthetic coding sequence
atgcttcgcgccaagaaccaactgtttcttctcagcccacattatctgcgccaagttaaggaatcatccggatcaaggcttatacaacagcgactgctccaccagcaacagccactccatccagagtgggccgcccttgctaagaagcagctcaagggtaagaaccctgaagatttgatctggcatacccctgaaggtatttctattaagccactgtactcgaagcgcgacactatggacctgcctgaagaactccctggggtgaaacccttcactagaggtccttaccccactatgtacacctttagaccgtggaccattagacagtacgcgggtttttccacggtggaagagtccaacaaattctacaaagacaacattaaggcaggacagcaaggcctgagcgtcgcctttgatcttgctactcatagaggatacgatagcgataatccaagggtgcggggcgacgtgggaatggctggagttgccatcgataccgtcgaggatactaagattctctttgatggaatcccacttgaaaagatgtcggtgtccatgaccatgaacggtgcggtgataccagtgctggcaaactttattgtgaccggcgaagaacagggtgtgccgaaggaaaaactcaccggtactattcagaacgacattttgaaagagtttatggtgcgaaatacgtacatcttcccacctgaaccttcgatgaaaatcatcgcagatatcttcgaatacactgccaagcatatgccgaagttcaattcaatctccatatctgggtaccatatgcaagaagcgggtgcagatgccatactcgaactggcctatacgctggcggatggactggaatacagccggaccggccttcaagcaggacttaccattgatgagttcgcacctcgactctcgttcttttggggaataggcatgaacttttacatggaaatcgcaaagatgagagccggcagacgcctgtgggcacatctgatagagaagatgtttcaaccgaagaattcaaaatcgctgttgctgagggcacactgtcagacctccggttggtcgctgactgaacaggatccatataacaacatcgtcaggactgccatcgaagcaatggcagccgtctttggtggaacccagagcctccacaccaattcgttcgatgaggccctcggcctgcctaccgtgaagagcgcaagaattgcacggaacactcagattatcattcaagaggagagcggaattcccaaagtggcagatccgtggggtggttcgtacatgatggagtgtcttaccaacgacgtctacgacgcagcacttaaactgataaatgagattgaagagatggggggcatggcgaaggccgtcgcagagggtattcccaaactcaggatagaagaatgcgcagcacgccgccaagcaagaattgactccggttcggaagtgattgtcggcgtgaacaaataccaacttgagaaagaggatgcagtggaggtgcttgcaattgacaacactagcgtgaggaataggcagatcgagaaactgaagaagattaagtccagccgtgatcaagccttggccgaaaggtgtcttgctgcgctgactgagtgtgccgctagcggtgacggaaatatcctggcgctcgccgtcgacgcctcgagggcgaggtgcactgtgggcgaaatcactgacgcactcaagaaggtgtttggcgagcataaggcaaacgacaggatggtgagcggtgcataccgacaagagtttggtgagtcgaaggaaattacttcagcgattaagcgggtgcacaaattcatggaaagagaaggccgtagacctaggctcctggtggcaaagatgggtcaggacggacatgataggggggcaaaggtcattgccactggatttgcagatctcggatttgatgtggatatcggtccactgtttcagacgccccgggaggtggcacagcaagcagtggacgccgacgtgcacgcagtgggtatttcaacgctggcagcaggacataagactctcgtgccggaactgattaaagaacttaatagcctcggacgccctgatattctggtcatgtgcgggggcgtgattccaccacaggattacgagttccttttcgaggtgggcgtgtcgaacgtgtttggtcccggtaccagaattcccaaggcagcagtccaagtcctggatgacattgagaagtgtctggagaagaaacaacaatcggtc

SEQ ID NO: 16738 - DNA, 2250 bp, Artificial Sequence
  Description of Artificial Sequence: Synthetic coding sequence
atgctgcgcgccaagaatcagctgttcctgctttccccccactacctgaggcaggtgaaagaaagttcgggatcgagattgatccagcagcggctgctgcaccaacagcagccactgcacccggagtgggccgccctggcgaaaaaacagctcaaggggaaaaatccggaggacctgatctggcatactccggaagggatttcgatcaagccgctgtactctaaaagagataccatggacctgccggaggaactccctggagtgaagccgttcacccgggggccctatccgactatgtacaccttcagaccatggactattcggcagtacgccggattcagcactgtcgaagagtcgaataagttctacaaggataacatcaaggcgggccaacagggcctcagcgtggccttcgacctggccactcaccggggctacgactccgataacccgcgggtgcgcggagatgttggaatggccggagtggcaatcgataccgtggaggacactaagatcctcttcgacggtatccccctcgagaaaatgagcgtttcgatgaccatgaacggagccgtgatccctgtgctggcaaatttcattgtgaccggagaggagcagggagtcccgaaagaaaagctcaccgggaccatccaaaacgacatcctgaaagaattcatggtccgcaacacttacatcttcccaccggaaccgagcatgaagattatcgctgatatcttcgagtacaccgcaaagcacatgccaaaattcaattcgatcagcatctcgggataccacatgcaagaggccggtgccgacgcaatccttgaactcgcctacactctggctgatggactggagtattctcgcaccggattgcaggctggcctgaccattgatgaattcgcccctcggctgtcgttcttttggggaatcggtatgaacttctacatggaaatcgctaagatgcgcgccggccggagactctgggcacatctgatcgaaaagatgttccaacccaagaactcgaaatccctgcttcttcgcgcgcactgccagacctcaggatggtcactgactgagcaagatccgtacaacaacatcgtgcgcaccgccatcgaggcgatggccgcagtgttcggaggaacccagtctctgcacacgaactctttcgacgaagcgctcggcttgccaactgtcaagtcggcccgcattgcccgcaacacccagattatcattcaggaagagagcggtattccgaaggtggcggacccatggggcgggagctacatgatggaatgtctgactaatgatgtgtacgacgcggctctgaagctgatcaacgagatcgaagaaatggggggaatggccaaggccgtggctgaaggcatcccgaaacttcggatcgaagagtgcgcggcccgacggcaagcgagaatcgatagcggcagcgaggtcatcgttggagtgaacaaataccagctcgagaaagaagatgcagtcgaagtgctggctattgataatacttcagtgcgaaacaggcaaatcgaaaagctgaagaaaatcaagtcgtcgcgggaccaggcactggcggaaaggtgcctggccgccctgactgaatgcgccgcatcgggtgacggaaacatcctggcgttggccgtggacgcgtcgcgcgcacgctgcactgtgggagagattactgacgcgctgaagaaggtgtttggagaacataaggccaacgaccgtatggtgtccggggcctaccgccaagagttcggggagtcaaaggagatcacctccgctatcaagcgggtgcacaagtttatggagagagaaggacgcagaccgcgcctgctcgtcgcgaagatgggtcaagatggacacgatagaggcgcaaaggtgatcgcgactggattcgccgacttgggattcgacgttgacatcggtcctctgttccagacccctcgggaggtggcccaacaagccgtggatgctgatgtccacgcagtcggcattagcaccctggcagcaggacataagaccctggtgccggaattgatcaaagagttgaattccttgggcagacctgatatcctggtgatgtgcggaggcgtgatcccgccacaggattacgaattcctcttcgaagtgggggtgagcaacgtctttggacctggcactcgcatcccaaaagccgccgtccaggtgctggatgacattgagaagtgcctggaaaagaaacaacagtcggtc

SEQ ID NO: 16739 - DNA, 2250 bp, Artificial Sequence
  Description of Artificial Sequence: Synthetic coding sequence
atgttgcgggccaagaaccagctgttcctcttgagcccccactacctgcgccaggttaaggagagcagcggatccagactgatccagcagcggctcctgcatcagcagcaacccttgcatcccgaatgggcagccctagcaaaaaagcagctcaagggcaagaacccagaagacctgatctggcatacgcccgagggtattagcataaaacccctctattcgaaacgggacaccatggacctcccggaggagttgcccggtgttaagccgttcactagaggcccgtatcccacgatgtacacgttccggccatggaccatccgtcaatacgccggtttcagcaccgtcgaggagagcaacaagttttataaggataacatcaaagccgggcagcaaggcctctcggttgccttcgacctagctacccaccgcggctacgattcggacaacccacgtgtccgtggtgacgtcggtatggccggggtggctatcgataccgttgaggacaccaaaatcttgtttgacggcatccctttggaaaagatgtccgtctccatgacaatgaatggtgccgtcatccccgttctggccaactttatcgtgaccggtgaagaacagggtgtgccgaaggagaaactcaccggtaccatccaaaatgacattctcaaagagttcatggtccgcaacacctacatcttcccccccgagccttccatgaaaatcatcgccgatatttttgagtatactgcaaagcacatgcctaagtttaacagtatctctatctcgggctatcacatgcaggaggccggcgccgacgctattctggagctcgcctataccctcgctgacggcctggaatattctcgcacgggactgcaggctggactgaccatcgacgagttcgcccctcggctcagtttcttctggggtattggcatgaatttctacatggagatcgctaagatgcgcgccggtcggcgcttgtgggctcatctgatcgagaagatgttccagccgaagaactccaagagtcttcttcttagggcccattgccagacctctggttggtccttgaccgagcaggatccttacaacaacattgtgcggaccgccatcgaagcgatggctgccgtgttcggcggtacccagtccttgcacacaaactccttcgatgaagccctgggcctgccgaccgtcaaaagtgcccggatcgccagaaacacgcagattatcattcaggaggaatcgggtatccccaaggttgcggatccttggggtggctcttatatgatggagtgcctgaccaacgatgtgtatgatgctgccctcaagttaatcaacgagatcgaggaaatgggaggtatggccaaggcggttgctgagggtattcccaagctgcgcatcgaagaatgtgccgcacggcgccaggctcgcatcgactcaggcagtgaggtgatagtgggagtgaacaagtaccagcttgaaaaggaggacgccgttgaggtgctcgccattgataacacctcggtccgtaaccgccagatcgagaagctgaagaagatcaagagttcgcgcgaccaagcgctggctgagcgctgtctcgctgctctgaccgagtgtgccgcgtctggcgacgggaatattctcgcattagccgttgatgcctcgcgggcacgttgcacagtgggggagatcaccgacgccttgaagaaggtgttcggcgagcacaaggccaacgaccgcatggtgtctggcgcttaccgccaggagtttggtgagagcaaggaaatcacttccgctattaaacgcgttcacaagttcatggagcgggaaggacgccgcccccgtctgttggtggcaaagatgggtcaggacggtcacgaccgtggtgcgaaagttatcgcaactggcttcgcggatttgggctttgacgtggacatcggcccgctttttcaaacgcctcgcgaggtggcccaacaggctgttgatgctgatgttcacgcggttggtatctccacactcgctgctgggcacaagactctcgtgcctgaactgattaaggagctcaacagccttggacgacccgacatactggtcatgtgcggcggtgtcattccgcctcaagattatgagttcctgttcgaggtcggtgtctccaacgtcttcggccccgggacacgtattcccaaagctgccgttcaggttctggacgatattgagaagtgcctggagaaaaaacagcaatctgtg

SEQ ID NO: 16740 - DNA, 2682 bp, Artificial Sequence
  Description of Artificial Sequence: Synthetic coding sequence
atgattcttctcgcggtcctgtttttgtgctttattagctcatatagtgcttcagtcaaggggcacacaacagggctcagcctgaataacgatagactgtacaaactgacttactccacagaggtgctgctggatcgcggcaaggggaagcttcaggattctgtcggctaccggatatcatcaaatgtggatgtggccctgctgtggcgcaacccagacggggacgatgaccagttgattcagatcaccatgaaagacgtcaacgtagagaatgtaaatcagcaacgcggcgagaaatccatcttcaaggggaagtcccccagtaagataatgggcaaagagaatctggaggccttgcagagacctaccctgctgcacctgatccatggtaaagttaaagagttttacagttatcaaaacgaagccgtagcgatagaaaatatcaagagaggcctggccagtctcttccaaacccagctgtcaagtggaacgaccaacgaggtggacattagtggcaattgcaaggtaacataccaggcacaccaggacaaggtcataaagatcaaggccttagattcttgtaaaatagccagaagtggatttactacgccaaaccaggtgctcggcgtgtcttccaaggcgaccagcgttaccacctacaaaattgaggacagtttcgttatagccgtgctggcggaggagactcacaacttcggattgaacttcctccagacaatcaaggggaagattgtgagcaagcagaagttggagctgaaaactaccgaagctgggccacgcctgatgtcgggtaaacaagccgcagcaatcatcaaggccgtggatagtaagtacacagcaattcccatcgtcgggcaggtatttcagagtcactgtaaaggatgtccctcgctcagtgaactgtggcggtccacacggaaatacctacagccggacaatttgtctaaggccgaggccgtgcgtaactttttggcttttatacagcatcttcgcacagccaaaaaggaggagatcctgcagattctaaaaatggagaacaaggaggtcctcccacagctggtcgacgccgtgacaagcgcccagacctctgactctctcgaggcgattcttgactttctggacttcaaaagcgactcctctattatattgcaggaacggttcctgtacgcgtgcggcttcgcatctcaccccaacgaggagctactgagggccctgatctccaaatttaagggatccattgggtccagtgatattcgggagacagtcatgattatcactggcacgttggtgcggaagttgtgccagaatgagggctgtaagctgaaggcagtggttgaggcaaagaaactcatcctgggcgggttggagaaagccgaaaaaaaggaagatacacgcatgtacctactcgcccttaagaacgccctgctgccggaagggattccttctctattgaaatatgccgaggccggagagggtcccatttctcatttagctaccaccgctttgcagcgatatgatctgccctttattacggacgaggttaagaaaactctgaaccgcatttaccaccagaaccggaaagtccacgagaagactgtgcggactgcagcagccgccataattttgaacaataacccttcttatatggacgttaaaaatattctcttaagtatcggcgaattgccacaagagatgaacaagtatatgctagccatagtgcaggacattctgcgcttcgagatgcccgcgtcaaagatagttagaagagttctcaaagagatggtggcacataattacgataggttctcccgtagcgggagtagcagcgcatacactggctacatcgagcggagtcccagatccgcatccacgtactcacttgatatcctctacagcggctccgggatccttcgcaggtccaacctgaacatattccagtacataggaaaggccggcctgcacggctcacaggtggtgatagaagcccagggcctggaggcactcatcgccgctaccccggacgagggcgaagagaacttggacagctatgctggaatgagtgctatactgttcgacgtgcagctgcgcccagtaactttttttaacggctatagcgatctgatgagtaaaatgctttcagcctcgggcgatcccatctcagtcgtgaagggcctaatcctgctcattgaccattcccaggaactccagcttcaatctgggctcaaggctaacatagaggtgcagggaggtcttgctatcgacatcagcggcgctatggagttctctctatggtaccgggagtctaaaacccgagtgaaaaatcgagttaccgttgttataacgaccgacatcaccgtggacagctcatttgtgaaggcgggtttggaaacttctacggagactgaagccggtctggagttcatcagcacagtgcagttttcccagtatccttttctggtctgcatgcagatggataaggatgaggcgccgtttcggcagtttgaaaagaaatacgagcgactgtccaccgggcggggttatgtttcccagaagcgaaaggagtctgtgctcgccgggtgtgagtttcctcttcaccaggaaaattcggaaatgtgcaaggtggtgtttgcccctcagcccgatagtacctcatcaggctggttc

SEQ ID NO: 16741 - DNA, 2682 bp, Artificial Sequence
  Description of Artificial Sequence: Synthetic coding sequence
atgatattattagcggtattatttctatgttttatatcgtcgtattcggcgtcggtaaaaggtcatacgacgggtttatcgctaaataatgatcgactatataaattaacgtattcgacggaagttctactagatcgtggtaaaggtaaattacaagattcggtaggttatcgtatatcgtcgaatgtagatgttgcgttattatggcgaaatccggatggtgatgatgatcaactaatacaaataacgatgaaagatgtaaatgtagaaaatgttaatcaacaacgaggtgaaaaatcgatatttaaaggtaaatcgccgtcgaaaataatgggtaaagaaaatttagaagcgttacaacgaccgacgttactacatctaatacatggtaaagttaaagaattttattcgtatcaaaatgaagcggttgcgatagaaaatataaaacgaggtttagcgtcgctatttcaaacgcaactatcgtcgggtacgacgaatgaagttgatatatcgggtaattgtaaagtaacgtatcaagcgcatcaagataaagttataaaaataaaagcgctagattcgtgtaaaatagcgcgttcgggttttacgacgccgaatcaagttttaggtgtttcgtcgaaagcgacgtcggtaacgacgtataaaatagaagattcgtttgtaatagcggtattagcggaagaaacgcataattttggtctaaattttttacaaacgataaaaggtaaaatagtatcgaaacaaaaactagaattaaaaacgacggaagcgggtccgcgtttaatgtcgggtaaacaagcggcggcgataataaaagcggttgattcgaaatatacggcgataccgatagtaggtcaagtatttcaatcgcattgtaaaggttgtccgtcgttatcggaactatggcgttcgacgcgaaaatatttacaaccggataatttatcgaaagcggaagcggtacgtaattttttagcgtttatacaacatctacgtacggcgaaaaaagaagaaatactacaaatattaaaaatggaaaataaagaagtactaccgcaattagtagatgcggtaacgtcggcgcaaacgtcggattcgttagaagcgatactagattttctagattttaaatcggattcgtcgataatattacaagaacgttttctatatgcgtgtggttttgcgtcgcatccgaatgaagaactattacgtgcgctaatatcgaaatttaaaggttcgataggttcgtcggatatacgagaaacggtaatgataataacgggtacgttagttcgtaaattatgtcaaaatgaaggttgtaaactaaaagcggtagtagaagcgaaaaaactaatattaggtggtttagaaaaagcggaaaaaaaagaagatacgcgaatgtatctattagcgttaaaaaatgcgttattaccggaaggtataccgtcgttactaaaatatgcggaagcgggtgaaggtccgatatcgcatttagcgacgacggcgttacaacgatatgatctaccgtttataacggatgaagtaaaaaaaacgctaaatcgaatatatcatcaaaatcgaaaagtacatgaaaaaacggtacgaacggcggcggcggcgataatattaaataataatccgtcgtatatggatgttaaaaatatattactatcgataggtgaactaccgcaagaaatgaataaatatatgttagcgatagtacaagatatactacgttttgaaatgccggcgtcgaaaatagtacgacgagttctaaaagaaatggtagcgcataattatgatcgtttttcgcgttcgggttcgtcgtcggcgtatacgggttatatagaacgatcgccgcgttcggcgtcgacgtattcgctagatatattatattcgggttcgggtatactacgtcgatcgaatctaaatatatttcaatatataggtaaagcgggtttacatggttcgcaagttgtaatagaagcgcaaggtttagaagcgttaatagcggcgacgccggatgaaggtgaagaaaatttagattcgtatgcgggtatgtcggcgatactatttgatgtacaactacgtccggtaacgttttttaatggttattcggatctaatgtcgaaaatgctatcggcgtcgggtgatccgatatcggtagtaaaaggtctaatattattaatagatcattcgcaagaattacaattacaatcgggtctaaaagcgaatatagaagtacaaggtggtctagcgatagatatatcgggtgcgatggaattttcgctatggtatcgtgaatcgaaaacgcgtgttaaaaatcgagtaacggtagtaataacgacggatataacggtagattcgtcgtttgtaaaagcgggtttagaaacgtcgacggaaacggaagcgggtctagaatttatatcgacggtacaattttcgcaatatccgtttctagtatgtatgcaaatggataaagatgaagcgccgtttcgtcaatttgaaaaaaaatatgaacgtttatcgacgggtcgtggttatgtatcgcaaaaacgaaaagaatcggttctagcgggttgtgaatttccgctacatcaagaaaattcggaaatgtgtaaagtagtttttgcgccgcaaccggattcgacgtcgtcgggttggttt

SEQ ID NO: 16742 - DNA, 2682 bp, Artificial Sequence
  Description of Artificial Sequence: Synthetic coding sequence
atgattcttctggctgttctgttcctgtgttttatctcctcatactccgcatcggtgaagggacataccactggtctgtccctgaataacgatcggctctacaaactgacttactcaacggaggtgctgcttgatcgcggaaaaggtaaactccaggactccgttggctaccggatcagctcaaacgtggatgtggcactgctctggagaaatcctgacggtgacgatgatcaactgattcagatcactatgaaagatgtcaatgtggaaaacgtgaatcagcaaaggggagaaaagtcaatctttaaaggaaagtcaccttcgaagattatgggtaaagaaaaccttgaagcacttcaaagacccacgcttctgcatcttatacatggtaaagtgaaagagttctatagctaccaaaacgaggcagtggcaatcgaaaacataaaacggggactggcctcacttttccaaacgcaactctcttctggcactactaacgaggtggacattagcggtaactgtaaggtgacctaccaagcccatcaggataaggtcatcaagattaaagcccttgactcatgcaagatcgcacggtcaggcttcacgaccccaaaccaggtcctgggtgtcagcagcaaggccacctccgtgactacctacaagattgaagattcgtttgtgattgcagtgctggctgaagaaacccacaatttcgggcttaacttccttcaaaccatcaagggtaagattgtgtcgaagcaaaagctggaacttaagaccacggaagcagggccacgcctcatgtccggtaaacaagccgcggcaattatcaaggctgtggactcaaagtacactgctattcccattgttggccaggtgtttcagtcgcattgtaagggctgcccatcgctctccgaactgtggcgttcaactcggaagtacctccagcctgacaatcttagcaaggcagaagcagttaggaactttttggccttcatccagcatctccggaccgcaaagaaagaagagatacttcaaatcttgaaaatggaaaacaaagaagtgcttccgcaactggtggatgcggtgaccagcgcacaaacctcagattcgctggaggccattttggattttcttgacttcaaatctgattcctcaattatcctccaagaaagatttctttacgcatgtggctttgcatcgcaccccaacgaagagctcttgcgcgcgcttatcagcaagtttaaggggtccataggatcgagcgatattcgagagactgtcatgatcattactggtacccttgtgcgaaagttgtgtcagaacgaaggatgtaagctgaaggcagtcgtcgaggcaaaaaagctgatcctcggcggtcttgaaaaggctgaaaagaaagaggacacccggatgtacctcctggcactgaagaatgccctcctcccggaaggaattccatccctgctgaagtacgcagaagcaggagaaggtcccattagccacttggccactaccgctctgcagcgttacgacctgccattcatcactgatgaagtgaaaaagaccctgaacagaatataccatcagaacagaaaagtccacgaaaagactgtgcgcaccgcagctgccgcgataattctgaataacaacccaagctacatggacgtgaaaaacatcttgctgtccatcggtgagctgccacaggagatgaataagtacatgttggcaatcgtccaagatatactgcgattcgagatgccggcctcgaagattgtgcgacgggtgctcaaggagatggtggcacataactacgaccgattttcgcgcagcgggagctcatcggcctatactggatacattgaacggagccctcgctccgcctccacttattcgcttgatatcctttactcgggatccggaatacttcggcgatccaatctgaacattttccaatacataggaaaggcaggactgcacggatcgcaggtcgtgattgaagcacagggccttgaagccctcatcgctgcaactccagatgagggagaagaaaatcttgactcctatgccggtatgtcggcaatccttttcgatgtccagctgcggcctgtcacgtttttcaatggatactcggatctcatgtccaagatgctcagcgcatcgggtgatcctattagcgtcgtgaaaggtctgatcctgctcatagatcattcacaagaacttcaactccaaagcgggcttaaggcaaacattgaggtgcaaggaggactcgcgattgatatcagcggagcgatggagtttagcctgtggtaccgcgaatcgaaaactagagtgaaaaatcgtgtgactgtcgtgattacgactgacatcacggtcgattcgtcgtttgttaaggccgggctcgaaacctcaacggaaaccgaggccggacttgaattcatatcgactgtccagtttagccaatacccttttctggtgtgcatgcaaatggacaaagacgaggcaccatttaggcagtttgaaaagaagtacgaacggctgagcacgggtcgcggttacgtcagccaaaagaggaaggaatctgttctcgcgggttgtgaatttccccttcatcaagagaactctgaaatgtgcaaagtggtgtttgcaccacaacctgactccacttcctccggatggttc

SEQ ID NO: 16743 - DNA, 2682 bp, Artificial Sequence
  Description of Artificial Sequence: Synthetic coding sequence
atgatcctactcgcagtgttgtttctctgtttcatcagcagttatagtgcctcggtgaagggtcataccactgggctctcactgaataatgaccgtctctataagctcacatactccaccgaagtcctcctggatagagggaaaggcaaactgcaggatagtgtgggctatcgaatcagttccaacgtggacgtggccttgttatggcggaaccccgacggcgatgatgaccagctgatccaaattactatgaaagacgtgaacgtagagaatgtgaaccagcagcgcggcgagaagagcatatttaagggcaagagcccaagtaaaatcatggggaaggagaacttggaggccctccagcgtcctactctgctccacctgattcacgggaaggttaaagagttttatagctaccagaatgaggccgttgccattgagaacattaaacgagggcttgcctctttgttccaaactcagttgtcctcagggacgaccaatgaggttgatatctctgggaactgcaaggttacatatcaggcccatcaagacaaagttatcaaaatcaaagccctggactcctgcaagatagctaggtccggttttactacacccaatcaggttctgggggtctcgagtaaagccacttctgtaactacatataaaattgaggacagtttcgttatcgctgtcctcgcagaggagacacacaacttcggtctcaatttcttacaaactatcaagggcaagatcgtgagcaagcaaaagttggaactcaagacaacagaagccgggcccaggcttatgtcaggtaaacaagcagctgcgattatcaaggccgtcgactcaaaatatactgccatacccatagttgggcaagtcttccagagtcattgcaaagggtgcccatctctgtctgagctctggcggtcaactagaaagtacctgcagccggacaacttgtcgaaggctgaggctgtcagaaactttctcgcctttatccagcatttgagaaccgctaaaaaggaggagatcttacagatcttgaaaatggaaaacaaggaagtacttcctcagcttgtggatgccgtcacttcagcccaaacttcagattcgctcgaagcaatcctcgacttcctggatttcaagagcgattcttccatcatcctgcaggagcggtttctgtacgcttgtgggtttgcatcccaccccaacgaggaattgctgagagccttgatatccaagttcaaaggctcaatcggatcctctgacataagggaaacagtaatgattatcacaggtacgcttgtgcggaagttgtgccagaatgagggctgtaagttaaaggctgtggttgaagcaaagaaactgatactgggcggactcgagaaggccgagaagaaagaagatacccggatgtatttgctggcccttaagaatgctttgctaccagagggcatcccctccttgctgaagtacgccgaggccggggagggccccatctcacacctggccactaccgcactgcagcggtacgacttaccttttatcaccgatgaggtcaagaagacattgaataggatctatcatcagaacaggaaagtccacgaaaaaaccgtgcgcaccgccgccgccgccattattttgaataataacccaagttacatggacgtcaagaacatcttgctgagcatcggtgaactcccccaggagatgaacaaatacatgctggcaatcgtgcaggatattttgcgattcgagatgccagcatcaaaaatcgtgcggagagtgttaaaggagatggtagcccataattacgacaggttctcgcgctcaggcagcagtagtgcatatactgggtatatcgagagatccccccgtagcgcaagtacttactcactggacatcctctatagtggctcgggaatattgcgacgttcaaatcttaacatttttcagtatatcggcaaagctggccttcacggctcacaggttgttatcgaagctcagggccttgaagcactaatagctgctactccggacgagggggaagagaatctggatagttacgccgggatgagcgctatcctctttgatgtacagctgcgccctgtgacattctttaatggttattctgatctcatgtcaaagatgttaagcgcgtctggggatcccatcagtgttgttaagggactcatactgctgattgaccacagtcaagaactccaactacagtccgggctgaaggccaacattgaggtccaagggggactggctattgatatcagcggcgcaatggagttctcgttatggtatcgggaatcaaagactcgggtaaagaatagggtcactgttgttattaccaccgacatcaccgtggattcaagctttgtgaaggcgggcctggaaacatccaccgaaactgaggccggattggagtttatttctacagtacagttttcacagtacccattcctggtgtgcatgcaaatggacaaagacgaagctccttttcgacaatttgagaagaaatacgagcgcttaagtactggccgaggctacgtgtcccagaagaggaaggaatccgtgctcgcgggctgtgaattcccactgcaccaagagaacagtgaaatgtgcaaggtggtgtttgcgccccagccggactcaacctctagcggttggttc

SEQ ID NO: 16744 - DNA, 2682 bp, Artificial Sequence
  Description of Artificial Sequence: Synthetic coding sequence
atgattctgctggcagtgcttttcttgtgcttcatctcatcctactcggcgtccgtgaagggccacaccacgggactgtcgttgaataacgatagactgtataaacttacttatagcaccgaagtgctgcttgaccggggaaaaggaaagctccaggattccgtgggataccgcatttcctcgaacgtcgatgtggcgttgctgtggcgcaacccagacggcgacgacgatcaactgattcagatcaccatgaaggacgtcaacgtggaaaatgtgaaccagcagagaggcgaaaagtccatcttcaaggggaaatcaccgtcaaaaatcatgggtaaggagaaccttgaagcgctccaacggcctactcttctgcatctgattcatgggaaggtcaaggaattctactcataccagaacgaagctgtcgcaatcgagaacattaagaggggactggcttcactgtttcaaacgcagctcagcagcggcaccactaacgaagttgacatttctggaaattgcaaagttacctaccaggctcaccaagacaaagtgatcaagataaaggcgctggactcatgcaagatcgcacggagcggattcaccaccccgaaccaggtgctgggggtgtcaagcaaggcgacctcggtgacgacttacaaaattgaggattcgttcgtgatcgcggtgctcgccgaagaaactcataactttgggctgaatttcctccaaactatcaaaggcaagatcgtgtcgaagcaaaaactggaactgaaaaccacggaagccggtcctcggctgatgtccgggaagcaagcagcagccatcatcaaggcagtggatagcaaatacacggcaatccctattgtgggacaggtgtttcagtcccattgcaaaggatgcccgtcgctgagcgaactgtggagatccacccggaaatacctccagcctgacaacctgtccaaggcagaggccgtcaggaatttcctggccttcatccagcacttgcgcaccgcgaagaaggaggagatcctccaaatcctcaagatggagaacaaggaggtcctgccgcaactggtggatgctgtcacttcggcccagacctcggatagcctcgaagccatcttggatttcctcgacttcaaatcagactcctcgataatcctccaagagaggtttttgtacgcttgtggatttgcgtcccacccaaacgaggaactgctgcgcgccttgatttcgaagttcaaaggatcaatcggttcgagcgacatccgagaaactgtcatgatcattacgggaacccttgttagaaagttgtgccaaaacgagggttgtaaactcaaggctgtggttgaggccaaaaagctcatactgggaggtcttgagaaggctgaaaagaaggaagatactcgcatgtacctgctggcgctgaaaaatgcccttcttcccgagggaattccgtccctgctgaagtacgccgaagcgggagaaggcccaatctcccaccttgccactacggcgctgcagagatacgacctgcccttcatcaccgacgaagtgaaaaagaccctgaaccggatctaccatcagaatcggaaagtgcacgaaaaaactgtgcgcactgctgcggcagctatcatcctgaacaacaacccttcgtacatggacgtcaaaaacatcctgctttcgatcggcgagttgccgcaggagatgaataagtatatgctcgctatcgtgcaagatatcctccggtttgaaatgcctgcgtcgaagattgttagacgcgttttgaaggagatggtcgcccacaattacgatcgcttttcgcggtcgggatcctcgagcgcctacaccggatacatcgaacgatccccaagatccgccagcacctactcacttgacatcctctactccggctcaggaatcctccgccgctcgaaccttaacatcttccagtacatcggtaaggctggccttcacggatcacaggtggtgatcgaagcccagggactcgaagcactcatcgcagcaacccccgacgagggagaagaaaatctggattcgtacgctggtatgagcgccatcctgttcgacgtgcagctgcgtccggtgactttcttcaatgggtactctgatctgatgtcaaagatgctgtcggcgtcaggcgatccaatcagcgtggtgaaggggctgatcctgctgatcgaccatagccaagaactgcaactccagagcggcttgaaagccaacatcgaagtgcaggggggacttgcgatagacatctccggcgcaatggagttctctctctggtaccgcgaatcaaagacccgggtgaagaatcgggtcaccgtcgtgatcaccactgacatcaccgtggattcgtctttcgtgaaggcgggactggagactagcactgaaaccgaggctggactggagtttatctccaccgtccagttcagccagtacccattcctcgtgtgtatgcagatggataaggacgaggcaccatttcgccagttcgagaagaagtacgaaagactttcaaccggacgtgggtatgtttcacaaaaacggaaggaaagcgttctcgccggatgcgagttcccactgcaccaggaaaatagcgagatgtgcaaagtggtctttgcaccacaaccggactctacgtcgtcaggctggttc

SEQ ID NO: 16745 - DNA, 2682 bp, Artificial Sequence
  Description of Artificial Sequence: Synthetic coding sequence
atgattctactggccgtgctgtttctctgctttatcagttcttatagcgccagcgtgaaggggcatacaaccggactgtcacttaataatgacagactttataaacttacgtacagtactgaggtacttctggatcggggaaaggggaagctacaggactccgttggatataggatttcctctaacgtggacgtcgctctgctctggcgcaatcccgacggcgacgacgaccagctgatacagatcacaatgaaggacgtgaatgtcgagaacgttaaccagcagcgaggggagaaaagcatctttaaaggtaaatcacccagtaagatcatgggcaaagagaaccttgaggccctgcagagaccgaccctgttgcacttaatccacggcaaggtaaaagaattttactcataccagaacgaggcagtcgccatcgagaacataaagcgcggcctcgcgtccctcttccagactcagctcagtagcggcactaccaacgaggttgacattagcggcaattgcaaggtgacataccaggcgcatcaggacaaggtgatcaagattaaggccctggactcttgtaagatcgcaaggagtggtttcactacgccaaatcaggtgctgggagtgagctctaaagccacctctgttacaacttataaaattgaggattcatttgtcatcgcagtgcttgcagaggaaactcacaatttcggtcttaactttctccaaacgattaaaggaaagattgtgtctaaacagaaattggaactgaagaccaccgaggccgggccaagattaatgtctggtaagcaagccgctgccattatcaaggccgtcgattcaaagtacaccgcgatccccattgtcggacaggttttccagtctcactgcaaaggatgtccgtcactgtccgaactctggcggtcgactcgaaagtacctacaacccgataacctcagtaaggccgaagctgttcgaaattttttggccttcatccaacacctgcggactgccaaaaaagaggagatcctgcagatcttaaagatggaaaacaaggaagtgctgccccaacttgtggacgccgtcacgtctgcacagacgtccgattccttagaggcaatccttgatttcttggatttcaagtcagactcaagcatcattcttcaggaacgtttcctatatgcttgcggcttcgcctctcaccctaacgaagagctcttgagagccctgatctcgaagtttaagggtagcattgggagctcagacatccgtgagacggttatgatcatcacaggtacactcgtccggaaactatgccagaacgaggggtgtaaactcaaggctgtagtcgaggctaagaaacttattctgggtggccttgagaaagcagagaagaaagaagatactcgcatgtacctgctggccttaaaaaatgccctgctgccggagggcatacctagtctgctgaaatatgccgaagccggggagggccccatctcacatctcgcaacgaccgccctgcagagatatgatctgccgtttattactgatgaggtgaagaaaaccctcaacaggatatatcatcaaaatagaaaagtacacgagaagactgttcgaaccgccgcagccgctattatattaaacaacaatccaagctatatggatgtgaagaacatcctgttatccatcggggagctgccacaagaaatgaacaaatacatgttagccatcgtacaagacatcttgaggttcgagatgcctgcttcaaaaatcgtgaggcgggtgctcaaagagatggtggcccacaactacgacaggttctccaggagtggcagcagctccgcctataccggctacatcgaaagatcgcctcgatctgcttccacatatagcttggacattctctattcaggaagtggtatactcagaagaagcaacttgaatatcttccagtacatagggaaagcaggcctgcacggctcccaggtggttattgaggctcaggggcttgaggctttaatcgccgccacccccgatgagggagaagagaatctggacagctacgctggcatgtcggctatcctctttgatgtgcaactgcgtcctgttacgttcttcaacgggtattccgatctcatgtcaaagatgctatccgccagtggagatcctatttctgtggtgaaagggcttatcttactcatagatcacagtcaggagttacagctgcagtcaggattgaaagctaatatcgaagtacagggcggcttggctatcgacatttcaggcgccatggagttctccctctggtaccgggagtccaaaacccgcgttaagaacagagtgaccgtggtgatcactacagatatcacagtcgactcctctttcgtgaaggcaggattggaaactagcacagaaacagaagccggcctggagttcatctcaacggttcaatttagccagtacccattcctggtgtgtatgcaaatggataaggatgaggctccctttagacagttcgaaaagaaatacgagcgcttgtccacgggcagaggatacgtgagtcagaaacggaaggaatcagtcctggccggttgtgagtttccactgcaccaggagaattctgagatgtgcaaggtggtgtttgccccgcagccagacagtacgtcctctggttggttt

SEQ ID NO: 16746 - DNA, 2682 bp, Artificial Sequence
  Description of Artificial Sequence: Synthetic coding sequence
atgatcttgctcgcagtgctttttctctgcttcatttcctcctactcggcctctgtcaaaggacatactaccggtttgtcactgaacaatgatcgactgtacaaactgacgtactcaaccgaggtgcttcttgatcgcggcaagggaaagctccaagattcagtgggttacagaatcagctcaaacgtggacgtggcgctcctgtggcgaaacccagacggagatgacgaccaactgattcagataacgatgaaagatgttaacgtcgagaacgtgaaccaacagcgaggcgaaaaatccattttcaaaggaaaatcaccctctaaaatcatgggaaaggaaaaccttgaggccctccaaagaccaacccttctgcatttgattcacggcaaggttaaggagttttacagctaccagaacgaggctgtggcaattgaaaacataaagcgcggtcttgcatcactgttccaaactcaactttcctcggggactactaacgaagtcgatatttcaggtaactgcaaagtgacttatcaggcgcatcaagataaagtgattaagattaaggccctggactcatgcaagattgcgagatcgggctttacgacccctaaccaggtcctcggagtgtcgtccaaggcaacctccgtgaccacctacaagattgaagattcatttgtgatcgcagtgcttgccgaggagactcataactttggcctcaacttcctgcagactattaagggtaaaatcgtgtcgaaacaaaaactggaacttaagaccaccgaggcaggacccagactgatgtcgggtaagcaagccgcagccatcataaaagccgtggactcaaagtacaccgcaataccgatcgtcggacaagtgtttcagtcgcactgtaagggatgtccatcactttcggagctttggagaagcactcggaagtaccttcaacctgacaatctttcgaaggcagaagccgtgcgaaactttcttgcctttattcagcaccttagaaccgcaaagaaggaagaaatacttcagatcttgaagatggaaaacaaagaagtccttcctcagcttgtggatgccgtcacttccgcccagacctccgactcgcttgaggcaatactggattttctcgatttcaaaagcgactcctccattatactgcaggagcgcttcctttacgcatgtggcttcgcttcacatccaaacgaagagctgctgcgcgctctgatttccaagtttaagggttcaattggctcgtcagatattagagagactgtgatgatcattaccggtaccctggtgaggaaactgtgtcagaatgaaggatgtaaactgaaggcagtggtggaagcaaagaagctgattctgggaggtcttgaaaaggcggagaaaaaggaagataccagaatgtacctgcttgcacttaagaatgctctgcttcctgaaggaatcccatcccttctgaaatacgcagaggcaggcgagggacctatctcacatctggctactaccgcactgcagcgttacgacttgccctttatcactgacgaggtcaagaaaactcttaacagaatctaccaccaaaaccggaaagttcacgaaaagacggttagaacggcggcagcggcaattatcctgaacaacaacccttcttatatggatgtaaagaacatcctcctctcaattggagaacttccacaagagatgaacaaatacatgctggctatcgtgcaggacattctccggtttgaaatgccagcgtcgaagattgtccggcgtgtcctgaaggaaatggtcgcccacaactacgacaggttttcacgtagcggtagctctagcgcatacaccgggtatattgaacggtcgccacgttcggcctccacttacagcctcgatatactgtactccggttccggaatactgagaagatcgaacctgaacattttccaatacattggtaaggcaggtctgcatggatcccaagtggtgattgaagcacagggccttgaagctctcattgcagccaccccagacgaaggggaggaaaacctggattcgtacgcaggcatgtcagcaatattgtttgatgttcagctcagaccagtaacctttttcaacggatacagcgacttgatgtccaagatgctgtcggcatcgggggatcctatttcggtggtgaaaggcctcatacttttgatagatcattcgcaggaacttcagctgcagtcaggtctgaaagccaacattgaagttcaaggtggtcttgcaatcgatatttcgggggcaatggaattttccctttggtacagagagtcaaaaactagagtgaagaaccgggtcaccgtggtcatcactaccgatattacggtggattcctcgttcgtcaaggccggtctggaaacgagcaccgagactgaggcaggtcttgaattcatcagcactgtccaattctcgcaatatccttttctggtgtgtatgcaaatggataaggatgaagcacccttccggcaatttgaaaagaagtacgagaggctttccactgggagaggatacgtgagtcaaaagagaaaggagtccgtgctcgccggatgtgaatttcctctgcatcaagagaactcggaaatgtgtaaggtggtgttcgcacctcagccggatagcactagctccggttggttc

SEQ ID NO: 16747 - DNA, 2682 bp, Artificial Sequence
  Description of Artificial Sequence: Synthetic coding sequence
atgattctgctcgctgtgctctttctgtgttttatctcctcctattcggccagcgtgaaaggtcataccacgggcctttcattgaacaatgatcggctgtacaagctcacttacagcaccgaggtcctcctggataggggcaagggtaagctgcaagactccgtcggatacaggatttcatccaatgtggacgtggccctgctctggcgtaaccccgatggagacgatgaccagttgattcagattactatgaaggatgtgaatgtcgaaaacgtgaaccagcaacgcggtgaaaagtccattttcaagggaaaatctcccagcaagataatgggcaaggaaaacctggaagccctgcaaaggccaactctgctgcatctcatccacggaaaggtgaaagagttttacagttaccagaacgaggccgtggcgattgaaaacataaagagaggtctggcgtctctgttccaaactcagctgtctagcggaaccaccaatgaagtggatatctcagggaattgtaaagttacctaccaggcacatcaagacaaagtgatcaaaatcaaggccctcgacagctgtaagatagcacgctcggggtttaccactccaaatcaagtgctgggagtctcaagcaaggcgacttcagtaactacttacaagatcgaggactcctttgtgatcgcagtccttgctgaagaaactcacaacttcggactcaacttccttcaaacgattaagggcaaaatagtgtcgaagcagaaactggaactgaaaaccaccgaagccgggccccgtctgatgtccggaaagcaagcagcagccatcataaaggcagtcgatagcaagtacaccgcaattcctatcgtcggacaagtctttcaatcgcattgcaagggctgcccatccctgagcgaactctggagaagcaccagaaagtacctgcagccagataacctttcaaaagcagaggccgtgcgaaactttctggcgtttattcaacatctgcgcaccgcgaagaaagaggaaatcctgcaaattctgaagatggagaacaaggaggttcttcctcagctcgtggacgcagtgacttctgcacagacctctgattcgttggaagcaattctcgacttccttgactttaagtcggattcatcgataatacttcaagagcgttttttgtatgcttgcggatttgcatcgcaccctaatgaggaattgctcagagcattgatctccaagtttaaggggtcgattggctcgtcagatatcagggaaactgtcatgattatcactggaacccttgtgcgcaagctctgccagaatgaaggttgtaaactgaaggcggtggtcgaagcaaagaaacttatcctcggtgggcttgaaaaggcagagaaaaaggaagatacccggatgtaccttttggctctcaaaaacgcactgttgccggagggaatcccctcgcttcttaagtacgcggaggcaggtgagggacccatttcgcacttggccacgacggccctccaaaggtacgatcttcctttcattaccgatgaagtcaaaaagacgcttaatagaatttaccatcagaatcgcaaggtccacgaaaagactgtgagaaccgcagcagcagctataatccttaacaacaatccgagctacatggacgtcaagaatatactgctttcaattggtgaactgccacaagaaatgaacaagtacatgctggccatcgtgcaggacatcctgcgcttcgaaatgccagctagcaaaatagtcagacgtgtgctcaaggagatggttgcacataactacgacaggttctcaagatcgggttcttcatcagcatacactgggtacatcgaacgcagccctcggagcgcatcgacttattcgcttgatatcttgtactccgggtccggcatcctgagacggagcaacctgaatatcttccagtacattggaaaggccggacttcatgggagccaggtggtgatagaggcacagggtcttgaggcactgattgcggccactcctgacgaaggtgaggaaaaccttgattcttacgcaggaatgtccgcgatcctgtttgatgtgcaattgcgcccagtgacctttttcaacgggtactccgatttgatgagcaaaatgctttcagcatcgggcgaccccatttcggtggtgaaaggcctgatcctgctgattgatcatagccaggaactccagttgcaatccgggcttaaggcaaacatagaagtccaaggcggcctggctatcgacatctccggagcgatggaattctccctttggtaccgggaatccaaaacccgcgtgaagaacagagtgactgtggttattactaccgatataaccgtcgattcatcatttgtaaaagctggtctggagacttctactgaaactgaggcggggctcgagttcatatcgacggtgcagttctcgcaatacccattcctggtctgtatgcaaatggataaagatgaagcgccctttagacaatttgaaaagaaatacgaacgcctttccaccggacgcggctatgtgtcgcaaaagaggaaggaatcagtgctggcgggatgcgaatttcctctccaccaggagaattcggagatgtgtaaggtggtttttgcacctcaaccagatagcacttcgtcaggatggttt

SEQ ID NO: 16748 - DNA, 2682 bp, Artificial Sequence
  Description of Artificial Sequence: Synthetic coding sequence
atgattcttctggctgtcctgtttttgtgtttcatctcatcttacagcgccagcgtgaagggacacaccactggtttgtccctcaacaacgatcggctgtacaaactgacctactcgaccgaagtcctccttgatagggggaagggtaaattgcaagatagcgtaggatacagaatatcgagcaatgtggatgtagcgcttctctggcgtaatcctgatggggatgacgaccaactcatccagataactatgaaggacgtgaatgtggaaaatgtcaaccagcagcgaggagaaaagtctatcttcaaagggaaatcgccttccaagattatgggaaaggagaacctcgaagcactgcagcgacctactcttttgcatcttatccacggaaaggtgaaggagttttactcgtaccagaatgaagcggtcgcaatagaaaacataaaacgcggtctggctagcctgttccaaacccaactctcatcaggaactaccaacgaagtggacataagcgggaactgcaaggtaacttaccaagcacaccaggataaggtgattaagattaaggcgctcgattcatgtaagattgcacgcagcggattcaccactcccaatcaggtccttggtgtgtcctcgaaagctacctcagtgaccacttacaagattgaggattcgttcgtcattgctgtcctggcggaagaaacccacaattttggccttaacttccttcaaactatcaagggaaagattgtgtccaagcagaagttggaactgaaaactaccgaggcaggacccagactgatgtctggcaagcaagcggcagcaatcatcaaagccgtggactccaagtacaccgccatacctattgtgggccaagtgtttcagtcacattgtaagggatgtccttcgttgtcggagctttggcgatccactcgcaagtacctgcagccagataatctctccaaggccgaggcggtgcggaactttttggcattcatccaacatctgaggactgcaaagaaggaagagattcttcagatcctcaagatggaaaacaaggaagtgcttccccaactggtggatgccgtgacttccgcacagacttccgattccctggaggcgattcttgattttctggatttcaagtccgattcctcgattattctccaagaaagattcctgtacgcctgcggatttgcatcccatccaaatgaagaactcctcagggcgcttattagcaagtttaagggttcaattgggtcatcggacattcgggaaactgtcatgattatcactggcacgctggtgcgcaaactttgccaaaatgaaggatgtaagctgaaggcagttgttgaagcaaagaagctgattcttggcgggcttgaaaaagcagaaaagaaggaggacacgcgaatgtacctgcttgcgctgaagaacgcactgctgccagaagggatcccaagcctgcttaagtatgcggaagcgggagaaggaccaatcagtcatctggcaaccactgcactccagcgttacgaccttccctttatcacggacgaggtgaagaaaacccttaatcggatttaccaccaaaacagaaaagtgcacgaaaaaaccgtgcgcactgcagcagcagcaattatcctcaacaacaacccctcttacatggatgtgaagaatattctgctttcgatcggtgaacttcctcaagagatgaacaagtacatgcttgccattgtgcaggacatccttcgatttgagatgcctgcctcaaagatcgtcaggcgcgtgctgaaggagatggtcgcgcataactacgatcggttctccaggtccggatcatcctcagcctacaccggctacatagagaggagcccaagatcagcatcaacctactccctggacattctttactccgggagcggaattcttaggcggtcgaacctgaatatctttcaatacataggcaaggctggactccatgggtcacaagtggtcatcgaagcccaaggtcttgaagcattgattgcagctactcccgacgaaggagaagaaaaccttgactcgtacgctggaatgtcggcgatccttttcgatgtgcaactgcgacctgtgacctttttcaatggatacagcgatctcatgagcaagatgcttagcgcgtccggtgacccgatttcagttgtgaaaggtcttatactgctgattgatcatagccaggaacttcaactgcagtcaggcctgaaggcaaatatcgaggtgcaaggaggtctggcaattgatatatcaggcgcaatggagtttagcctctggtatcgcgaatccaaaacccgtgtgaaaaacagggtgactgtggtgattactacggatataaccgtggattcgtcatttgtgaaggctgggctggaaacttcgaccgaaacggaagcaggactggagttcatttcaactgtccaattttcacagtacccatttctggtgtgtatgcaaatggataaggatgaagccccttttcgtcaatttgaaaagaagtacgagcgactctcaaccggacggggatacgtctcgcaaaaacggaaggagtcggtgttggcaggttgtgaatttccacttcaccaagagaacagcgagatgtgcaaggtggtgtttgcacctcaacctgatagcacttcatcgggttggttc

SEQ ID NO: 16749 - DNA, 2682 bp, Artificial Sequence
  Description of Artificial Sequence: Synthetic coding sequence
atgatccttctggcagtgctgttcctttgtttcatatcatcgtactcggcctccgtcaaggggcacactacgggccttagcctgaacaacgacaggctttacaagctgacttacagcactgaagtgctcctggatcggggaaaagggaagctgcaagattcggttggttaccgtatctcatcaaatgtggacgtcgcactgctgtggaggaatcctgatggggacgatgatcaactgatacagataaccatgaaagatgtgaacgtcgaaaacgttaatcagcagaggggggagaagagcatctttaaagggaagagcccgagcaagattatgggaaaggaaaatctggaagcactccagcggccaaccctgctgcatcttattcatgggaaagtcaaagaattctactcgtaccaaaatgaggcggtcgcgattgagaatatcaaacggggtttggcatccctgtttcagacccaactctcgtcggggacgactaacgaggtggacatctcaggtaattgcaaggtgacctatcaagcgcatcaggacaaggtgataaagattaaggcactggattcgtgtaagatcgcaagatcagggtttaccactcccaatcaagtgcttggtgtgtcgtccaaagcaacgtccgtcaccacgtacaagattgaagattcctttgtgattgcggtgcttgctgaggaaacccacaacttcggattgaacttccttcagactatcaaggggaaaatagtctcaaagcaaaaacttgaacttaagaccaccgaagcaggaccaaggttgatgtctggtaagcaggccgccgcgattatcaaggccgtggattcgaagtacactgctattccaattgtcggacaagtttttcaatcgcattgcaagggttgtccgagcctttcggaactttggagaagcactcgaaaatacctgcagcctgacaacctttcgaaagctgaagcagtgcgcaactttctggcatttatccaacatttgagaaccgccaagaaggaagaaattctgcagattctgaaaatggagaataaggaggtgctgccacagcttgtggatgcagtcacttccgcacaaactagcgactccctcgaagctatcctggactttcttgatttcaaatcggactcatccatcattctgcaagaaagattcctgtacgcatgtggcttcgcatcgcatccgaacgaagagttgctccgcgcactgatttcgaagtttaagggaagcattggatcgtcggatatcagagaaaccgtgatgatcataaccggtaccctcgtccggaagctctgccaaaatgagggatgtaaactgaaggcagtggtcgaagcaaagaaattgatactggggggactggagaaggcagaaaagaaggaagatactcgtatgtatttgctcgcactcaagaacgcacttctgccagagggcatcccttccttgctgaaatatgccgaggcgggtgaaggacctatatcacacctggcaactaccgcccttcaacgctacgacctcccatttatcaccgacgaggtgaagaaaacgctgaacagaatttaccaccaaaatagaaaggtgcatgaaaagactgttcgaaccgcagcagcagctattatcctgaacaacaacccttcatacatggatgtgaaaaacatcctgctctccatcggagaactccctcaagagatgaataagtacatgctggccatagtgcaggatatccttaggtttgagatgcccgcatcgaagattgtgaggcgagtgctgaaagaaatggtggctcataactacgaccgattcagccggagcgggtcgagcagcgcctacaccggatacattgaacgatcaccccggtcagcctccacctactcccttgacattctttactctggttcggggatcctccggcgcagcaaccttaacatatttcaatacataggcaaagcaggtctgcatggctcgcaagtcgtgattgaagcacagggactcgaggcacttattgcagccacccccgacgagggtgaggagaacctcgactcgtacgcaggaatgtctgcaattctttttgatgttcagctgcgcccggtgactttctttaacggttattccgatcttatgtcgaaaatgctttccgcgtccggagatccaatttcggtcgtcaaaggccttatcctgcttattgatcattcccaagagcttcaacttcaatcggggctcaaggctaacatcgaggtgcaaggtggactggcgatcgatatttctggtgcaatggagttttccctttggtaccgtgagagcaaaactcgagttaagaatagagtgactgtcgtcattactactgatataactgtggattcctcctttgtgaaagcaggccttgaaacgtcgactgaaaccgaagcgggacttgagttcatctcgaccgtgcagttctcccaatacccatttctggtgtgtatgcaaatggataaggatgaggcaccatttagacagtttgagaagaagtacgaaagactctcaactggacggggttacgtctcgcaaaagcggaaagagtctgtgttggctggctgcgaatttcccctccaccaagaaaattccgaaatgtgtaaggtcgtgttcgctccccagccagattcgacgtcgtccggatggttc

SEQ ID NO: 16750 - DNA, 2682 bp, Artificial Sequence
  Description of Artificial Sequence: Synthetic coding sequence
atgatccttctggccgttctgttcttgtgctttattagcagttattccgcctccgtgaagggccacaccaccgggctttcgcttaacaatgatagactgtacaagctgacatattccactgaagtcctgctggaccgcggtaaaggcaagttacaagatagcgtaggataccggataagttcaaacgtggacgtggcactcctatggcgcaatccagatggcgacgacgatcaattgattcagatcaccatgaaggacgtgaatgttgagaatgttaaccagcagcgcggtgaaaaatctatattcaaggggaagagtccaagtaaaattatgggaaaggagaatctggaagctcttcagcggcccaccctgctccatttaattcatgggaaagtgaaagaattctattcatatcagaatgaggccgttgctatcgaaaacattaaaagggggctggcgtcgctcttccaaacacaactgtcatccggcacaaccaatgaggttgacattagcggcaactgtaaggtcacgtaccaggcacaccaagacaaggtcattaagatcaaagcattggacagctgtaagattgctaggtcaggatttactacgcctaatcaggtgctcggggttagtagcaaggctacatctgtcaccacatacaagattgaggactctttcgtgatcgctgttctcgcggaagagactcacaactttggtttgaactttttgcagaccatcaaggggaaaatcgtgtctaaacagaagctggagcttaagacaactgaagcgggaccacggcttatgagcggaaagcaagcagccgctattataaaggctgtagatagcaagtatactgcaattcccatcgtggggcaagtcttccagtcccattgtaagggctgtccatcccttagcgagctgtggcgctcaacacgcaagtatctccaacccgataacctttcgaaggcagaggcagtgaggaatttcttagcttttatccaacacctgagaacagccaagaaagaggaaatcctacaaattcttaagatggaaaataaagaggtcttaccccagctggttgatgccgtcacctcagctcaaacctccgattcgttagaggccatacttgatttcctggactttaaatctgattccagcataatcctgcaagagcgcttcttgtacgcgtgcggattcgccagtcatccgaatgaagagttgctgcgcgccttgatcagcaaatttaaaggctctattggctcctctgacattagagagacagtgatgattattacaggtaccctggttcgaaagctttgccagaacgaaggctgcaaactgaaagcagtcgtggaagccaagaagctaattcttgggggtctggaaaaagcagagaaaaaggaggatacacggatgtatctgctagcactcaaaaacgcactgctaccggaaggcatacctagcttgctcaagtatgccgaagccggcgagggccccatatcgcatctggccactactgcccttcagcgctacgatctcccatttatcacagacgaggtcaaaaagaccctcaacagaatctatcatcaaaatcggaaagtgcacgaaaagaccgtgcgcactgcagcggctgctataatcttgaataataacccaagttacatggatgttaaaaatattttactgtccatcggtgaattgcctcaagagatgaataaatacatgctggcgatcgtccaggatatccttagatttgagatgcccgcctccaaaatcgtccggagagttctcaaggaaatggtcgcccacaactacgacagattttctcgctctggctcatcaagtgcgtacacaggatacattgaacgcagtccgcgcagtgcttctacatactctcttgatatactgtattccggaagcggaatcctgcggagaagcaacctaaacatttttcagtatatcggcaaggctggcctacacggtagccaggtggtgattgaggcccagggccttgaggcactcattgccgcaacccccgatgaaggcgaggaaaatctggattcttatgccggcatgtctgcaatcttgttcgatgtgcagttgcggcctgtgacttttttcaatgggtatagtgacttgatgtccaaaatgctctccgcttcaggcgaccctataagcgtggtgaaggggctaatactgctgattgaccatagccaggagttgcagttgcaaagtgggctgaaggcaaacatcgaggttcaaggaggccttgccatcgacattagcggggcaatggagttcagtctttggtatagagaaagcaagacacgtgtgaaaaaccgagtcacggtagtgataaccacagatatcaccgttgacagtagttttgtgaaggctggattggaaacatcaaccgaaactgaagccggcctcgagtttataagcacagtccagtttagtcagtacccctttttagtgtgtatgcaaatggacaaagatgaggctccgttcagacagttcgagaaaaagtacgagcgactgtccacgggacgcggatacgtgtcccaaaagcgcaaagagagtgttctggccggctgcgagttcccactgcatcaggagaactcggagatgtgtaaggtagttttcgcaccccagcctgactccacatcgagcgggtggttt

SEQ ID NO: 16751 - DNA, 2682 bp, Artificial Sequence
  Description of Artificial Sequence: Synthetic coding sequence
atgattcttcttgctgttctgtttctgtgttttatcagcagttattccgcctcagtgaaaggacacactaccggcttatccctgaataatgacagactgtacaaactcacctacagcaccgaagtgctcctcgaccgggggaagggaaagctccaggatagcgtcggctaccgcatttccagcaatgtcgacgtggccctgttatggcgaaacccggacggcgacgacgaccagttgatacagattactatgaaagacgtgaatgtcgagaacgtgaaccaacagaggggcgaaaagtccatcttcaaggggaagtctccttccaagatcatgggcaaagaaaatctggaagccctacagagacccaccttactacatttaattcatggtaaagtgaaagaattttatagctatcagaatgaggcggtcgcgatcgaaaacattaaaagaggtctggcttcgctcttccaaacccagctgagctccggtactactaatgaggtagatatttctgggaattgcaaggtaacatatcaagctcaccaggataaagtcatcaagattaaagctctcgattcctgcaagatcgccagatcagggtttaccacccctaaccaagtgctgggtgtgtcttctaaagcaacaagcgtaaccacctacaagattgaggattcttttgtgatagccgttctggccgaagaaacccacaacttcggcctcaacttcttgcaaacgattaaaggcaagattgtcagcaagcagaagctggagcttaagacgacagaggcgggcccccgtttaatgtctggcaagcaggccgctgcgattattaaggccgtggattccaagtacaccgccatacccattgttgggcaggtgttccagtcacactgtaagggatgtccatcactctcggaactgtggcggtcaacgagaaaatatctgcagcccgataacttgtccaaagccgaagctgtgagaaattttttggcctttatccagcacttgcgcactgcaaaaaaagaagagattctccagatattgaaaatggagaataaagaggtgctgccgcagcttgtggacgctgttacctcagctcagacaagcgacagcctggaagctattctggacttcttagatttcaagtcagattcctccatcattctgcaggaaagattcttgtatgcctgcggtttcgccagtcaccctaacgaagaactcctgcgtgccctgatctcaaagtttaaagggtctattgggtcttctgatatcagagagacagtcatgataattacaggcactcttgtgagaaagttatgccaaaatgagggctgcaaactaaaggccgtggttgaagcgaagaagctgattctgggaggtctggaaaaagcagagaagaaggaagacacccggatgtaccttcttgctttgaagaacgcacttctacccgaggggataccctccctgctcaagtacgcggaagccggggaaggtcccataagtcacctggccacaacagcccttcagagatacgacctcccattcatcactgacgaagtgaagaaaaccctcaatcggatttatcaccagaacaggaaggtgcacgaaaagacagtgcgtacagctgcggctgcaatcattcttaacaataacccaagctacatggatgtgaaaaatattctgctttccataggagagctgcctcaggagatgaacaagtatatgttggctatcgtacaggacattctgaggttcgagatgccagcctccaagatagtgcgacgagtattgaaggagatggtggcccacaactatgacagattctcacggtcagggagcagctcagcctatactgggtatatcgagcgctctccacggtcagcatcaacatattctctggacatactgtacagtggctccggcatcttaaggcggtccaacctaaatatctttcagtatattgggaaagccgggttacacggaagccaagtggtcattgaggcccaggggctggaggcactcatcgctgcaactcctgatgagggggaggaaaacctggatagctatgctggaatgtctgccatcctattcgacgttcagctgagaccagtgaccttttttaacggttatagcgacctgatgtcaaagatgctgtcagcctccggtgatcctatctctgtggttaaagggctgattctcctaatcgaccacagccaggaacttcagctgcagagtggccttaaagccaacattgaggtgcagggcgggcttgcaatagatatttctggagccatggagttttccctgtggtatagggagtccaaaacaagagtgaagaatagagtgacagttgtcataacaaccgacatcaccgtggactcttcctttgtgaaagccggtctcgagaccagcaccgagacggaagcaggcctggagtttataagcactgtccagttttcacagtatccgttcttagtttgcatgcaaatggataaggacgaagccccgttccggcagttcgagaagaagtacgaacgtctaagcacaggccggggatatgtttctcagaagcggaaggaatcagtgctggccggatgtgaattccctctccaccaggaaaatagcgagatgtgcaaggttgtctttgcccctcagcctgattctacatcgtccggttggttc

SEQ ID NO: 16752 - DNA, 2682 bp, Artificial Sequence
  Description of Artificial Sequence: Synthetic coding sequence
atgattctcttagccgtcttgtttctgtgttttatatccagttacagcgcctccgtaaaagggcatacaaccggcttgagcttaaataacgatcgcctgtataagttaacctattcaactgaagtgcttttggacagaggaaaagggaagctgcaagatagtgtcggctatagaatctcttctaacgtcgatgtggccctgctctggaggaaccctgacggagacgatgaccagctcattcaaataacaatgaaagatgtgaacgttgagaacgtgaaccaacagagaggtgaaaaatccatcttcaaaggaaaaagccctagcaagattatggggaaagagaacttggaggccctgcaacggcctaccctattgcaccttatccacggcaaggtcaaagagttttacagttatcagaacgaggcggtagccatagaaaacattaagagggggttggcaagtttgtttcagactcagctctcatcaggaacaacaaatgaggtggacattagtggaaattgcaaggtgacttatcaagctcaccaggataaggtcatcaaaattaaagccttagactcctgcaagatcgcgcggtctggcttcactacccctaaccaagtcctgggggtctcctctaaagcgacctctgttacaacgtacaagatcgaggatagcttcgtcatcgctgtgctggctgaggagactcacaacttcggtctgaacttccttcagaccatcaaagggaaaatcgtctctaagcagaaattagagctgaagacaacagaagctggacctcgcttgatgtccgggaagcaggcggctgctatcatcaaggcggtggactcgaaatacacggccatacccatcgtcggccaagttttccagtctcattgtaaaggatgtcctagcctctctgagttatggaggagcactaggaagtacctacagcccgataatctgagcaaagccgaagccgtgagaaactttttggcattcattcagcacctgcgtaccgcaaagaaggaggaaatcttgcagatcctgaagatggaaaataaggaggtgttgccccagctggtggatgcggttacatctgcgcagacatccgactccctggaggccatcctggacttcctagacttcaagagcgatagctcaatcatcctgcaggagcggtttctctatgcatgtgggtttgcatctcacccaaacgaagagcttctgagggctctcatatccaagtttaagggcagcattgggagtagcgatattagggaaactgtcatgatcattactggtactctggttaggaaactgtgccaaaacgaggggtgtaagttgaaggccgttgtggaggctaagaagctgattttaggcggactagaaaaggctgaaaagaaggaggacactcgcatgtatctgttagcacttaaaaacgcactgttgccagaaggcatccccagtttgctgaagtacgccgaggccggggagggccctatttcccacctggccacaaccgcactgcagcgctacgaccttccgttcatcaccgatgaagtgaagaagactcttaacaggatttaccaccagaaccgtaaggttcatgaaaagactgtgcggacagccgccgccgcaatcatactgaataacaatccaagctatatggacgtcaagaacattctgctgagtatcggagagctgccacaagaaatgaacaaatacatgcttgccatcgtgcaggacatcctgagattcgagatgcccgcatccaagatcgtccgcagggtgttgaaagaaatggtcgctcacaactacgacagattcagtcgctctggatcttcctctgcgtacaccggctatatcgaaaggtcgccgcgcagcgcgtccacatattccctggatatcttatattctggttcaggtattcttcggcgatccaatctgaacatcttccagtatatcggcaaagctggactccacggcagccaggtggtgatcgaggcccaggggctcgaagctctaatcgccgctacacccgacgagggagaggagaacctggacagctacgcgggtatgtccgcaattctctttgacgtgcagttgcgacccgtcacctttttcaacgggtactcagacctgatgagtaagatgctgtcagctagtggcgatcctatttccgtcgtgaaagggctcatcttgttgatcgatcattcgcaggaactgcagttgcagtctggcctgaaggccaacatcgaagtgcagggcgggctggcaatcgatattagcggcgctatggagttttccttgtggtaccgcgagtccaagaccagggtcaagaacagagtaaccgtagtgattacaaccgatattacagtcgactccagtttcgtgaaggctggcctggagaccagcacagaaacagaagccggcttggaatttatatccacagtccaattttcccagtatcctttcctggtgtgtatgcaaatggataaggacgaagcaccgtttagacagttcgaaaaaaaatatgagcgtttgtctactgggcgtggttacgtgtcacagaagcgaaaggagtctgtgttggcaggatgtgaattcccgctgcaccaagaaaacagtgaaatgtgtaaagtcgttttcgctcctcagccagactccacttcctccggatggttc

SEQ ID NO: 16753 - DNA, 2682 bp, Artificial Sequence
  Description of Artificial Sequence: Synthetic coding sequence
atgattctgctggccgtcctgttcctgtgctttatctctagctactctgccagcgttaagggccacacaactgggctatctttaaataatgatcgcctttacaagcttacttatagcacagaggtccttctggaccgaggtaaaggtaaattgcaagacagcgtgggctataggatcagctctaatgtggacgtcgccttgttatggagaaaccccgacggcgacgacgaccagctgattcagattacaatgaaagatgtcaacgtggagaacgtgaaccaacagagaggggaaaaatccattttcaagggcaaaagccctagcaaaatcatgggtaaagaaaatctagaagctcttcagcgacctacattgcttcatctcattcatggaaaagtgaaagagttctatagctaccagaatgaggccgttgctatcgaaaatatcaagcgaggtcttgccagtctgttccagactcagttgtcgagtgggacaacaaatgaagtcgacatttcagggaactgtaaggtcacctaccaggcccatcaagataaagttatcaagattaaggctctcgacagttgcaagatcgcaagatcaggtttcactaccccaaaccaagtcctgggcgtctctagtaaggccactagcgtaacaacttataagatagaagactctttcgtcatcgccgtgcttgcggaggagactcataattttggactcaattttttacagacaatcaagggaaagatcgtttcaaaacagaaactggagcttaagacgacggaagctggaccccgtttgatgtccggcaagcaggcggccgcaatcatcaaagccgtggatagcaagtacacagcaattccaatcgttggccaggttttccagagccactgtaaaggctgccccagcctttccgagttgtggcgttccacaagaaaatacctgcagcctgacaacttgtcaaaagccgaggccgtcaggaactttctcgcattcatacaacacttgcggacggcaaagaaggaggagattttgcagatattgaagatggagaacaaagaagtcctgccacagctggtcgacgctgtgacatcggcccaaacctctgattccctcgaagcaatactcgactttctggacttcaagagcgactctagcattatacttcaggaaagattcctgtatgcctgcggattcgcttcccatcctaatgaagagctgctacgggcactgatctctaaattcaagggctcaatcgggtctagcgacattagggagaccgtcatgatcataactggcacgttggtacggaaactgtgtcagaatgaggggtgtaagcttaaagctgtcgtcgaggcaaagaagctcatcctcggagggctcgaaaaagctgagaagaaggaggatacccggatgtaccttcttgccctgaagaacgccctgctacccgagggcatcccctcactgctcaaatacgccgaggctggtgagggacctatctcgcacttggcgactaccgctctgcagcggtacgatcttcctttcatcactgacgaagttaaaaagacactgaaccgaatctaccaccagaacaggaaagtacacgagaaaaccgtgcgcaccgccgcagctgccatcatcctcaacaataatccctcctatatggatgttaagaacattctgttgtctattggtgagctccctcaggaaatgaataaatacatgcttgccattgtgcaggacatcctgcgttttgagatgcccgcaagtaaaattgtcagaagggtcctgaaggagatggtcgcccacaactacgataggtttagcaggtcaggctccagctctgcctataccgggtacattgagcgttcccctaggagcgcctcaacttactcactcgatatcctttactctggcagcgggatactgagacgaagcaatctaaacatcttccagtatatcggcaaagcaggcctgcatggcagccaggttgtgatcgaagcgcagggactcgaagcgctcattgcagctacacccgatgagggcgaagaaaacttggattcgtacgctggcatgagcgccatcctcttcgacgtccagctcaggcctgtgacgttcttcaacgggtactctgatctcatgtcaaaaatgttgtccgcatcaggtgatccgattagcgtcgtcaaggggctcatcctattaatcgatcacagccaggaattgcagctgcagagcggcttgaaggccaacatcgaggtgcagggcggactcgctattgatattagcggagctatggaattctccctgtggtacagagagtcaaaaacgagagtcaagaatagagtgactgttgtgataactacagacatcactgtggactcatcgttcgtgaaagctggcctcgaaacgtccactgaaactgaggcaggcctagaatttatatccacagtccagtttagtcagtatccctttctggtgtgcatgcagatggataaagatgaagccccatttaggcagttcgaaaagaagtacgagcggctctccacagggcggggatacgtgtcccagaagcgcaaggagagcgtgctagccggctgcgagttccccctgcaccaggagaacagcgagatgtgcaaggtggtctttgcacctcaaccagattctacatctagtgggtggttt

SEQ ID NO: 16754 - DNA, 2682 bp, Artificial Sequence
  Description of Artificial Sequence: Synthetic coding sequence
atgatcttattagcagtgctcttcttatgcttcatcagtagctacagcgcaagcgttaaaggacacactacaggactgagtttgaacaatgatcgcctttataagctgacgtatagtactgaagtcttactcgaccgaggcaaaggcaaactccaagatagcgttgggtaccggatctcctccaacgtggatgtggccttgctctggcgtaaccctgatggtgatgatgaccagcttatccagatcaccatgaaagacgttaatgttgagaacgttaatcagcaaagaggcgagaagtccattttcaagggtaaatcccccagcaagatcatgggcaaggagaacctggaagctctgcaaaggcccactctgcttcatttgatccacggaaaagttaaggaattttattcttaccaaaacgaggccgttgcgattgaaaacattaaacggggcctggcttctttattccagactcaactgagctccggtacaaccaatgaggtggatatttctggaaattgcaaggtcacgtaccaagcccatcaggacaaggtgatcaaaatcaaagccctcgatagctgtaagatcgcgagatccggcttcacaacgccaaaccaggtgttgggggtctccagtaaagcgacaagcgtgaccacttacaagatcgaagactcattcgtaatagctgtgctggccgaggagacccacaacttcggcctgaacttccttcagacgataaagggtaaaattgtcagcaagcagaaacttgagctgaagaccacggaggccggccctcggttaatgtccggaaaacaggccgctgcgatcatcaaagccgttgacagcaaatacaccgcgattcctatcgtgggacaggtgttccaaagccattgtaagggatgcccgagcctctcggaactttggcgaagcaccagaaagtacctgcagcctgacaacttgtccaaggccgaggcagtccgaaacttcttggcctttattcaacatttgcgcactgccaaaaaagaagagatcctccagatcctgaagatggagaacaaagaagttttacctcagttagtcgatgccgtcacatcagcccagacatcggactcactggaggctattctggactttctggactttaaatctgattcatcaattattctgcaagagcgttttctctacgcctgcggattcgcttcccaccccaatgaggaactgttgcgggccttaattagcaaattcaaaggttctattggctcaagcgacatcagggagacagttatgattattacaggtacactcgttcgaaagctgtgtcagaacgaggggtgtaagctgaaagcagttgtagaggctaaaaaactgatcctaggcggacttgagaaggctgaaaagaaagaggatacccgaatgtatctgctcgcccttaagaacgccctgctgcctgaagggattccatcccttcttaaatacgccgaggccggcgagggtcccatctctcacctggcaacaacggctctgcagagatacgacctgccattcattactgacgaagttaagaaaactctgaacaggatatatcatcaaaacaggaaggtccacgagaagaccgtccggacagccgccgctgcgataatactgaataacaacccctcatacatggatgtcaagaacatcctgctgtcgatcggcgaactgccgcaggagatgaataagtacatgctggctatagttcaggacatccttcggtttgagatgccagctagcaagatagtgcggcgagtgctgaaggaaatggtggcacataattacgaccgctttagtcgctcagggagctcgtctgcctacaccggatatatagagagatctcccaggagcgcatcaacgtatagccttgacatcctgtattctggcagcggcatcttacggcgctcaaacttgaatatatttcaatacatcggaaaggcaggcctccacggttctcaggtggtgatagaagcgcagggattagaggccctgatcgcagccaccccagatgagggagaggaaaacctggacagctatgctggcatgagtgctattcttttcgatgtgcagcttcgacccgttacattttttaacggttacagcgacctgatgagtaagatgctgagtgccagcggggatcccatctctgttgtgaagggccttattcttctcattgatcatagccaggaactgcaattgcagtcagggttgaaagctaacatagaagttcagggcgggcttgctatcgacataagtggcgcgatggagttcagcctttggtacagggagtccaagacccgggtgaaaaatcgggtcaccgtggtgattacaacagacataacagtggattctagcttcgtgaaggccggtttggagacttcaaccgaaaccgaggctggccttgagtttatctctacggtccagttctcacagtacccattcctcgtctgcatgcagatggacaaagacgaggccccatttcgccagtttgagaagaaatacgagcggctgtctacaggacgtggctacgtttctcagaagagaaaggagtcggtgctagccgggtgcgagtttcctctacatcaagagaattcggaaatgtgcaaggtagtatttgccccacagcccgactccacatcaagcggctggttt

SEQ ID NO: 16755 - DNA, 2682 bp, Artificial Sequence; identical to SEQ ID NO: 16743
  Description of Artificial Sequence: Synthetic coding sequence

SEQ ID NO: 16756 - DNA, 2682 bp, Artificial Sequence
  Description of Artificial Sequence: Synthetic coding sequence
atgatacttctggctgtactgtttctgtgtttcatatcctcctactctgccagcgtgaagggccataccacaggcctgtccctgaataacgacagattgtataagttgacctactccacagaggtcctgctggatagagggaaaggaaagctccaagattcagtcggctaccggattagctccaacgtggatgttgccctgctgtggaggaatcccgatggcgacgacgaccagctgattcaaattactatgaaagacgtaaacgtggagaacgtgaatcagcagcgaggtgaaaagagcatcttcaaaggtaaatctccctcaaaaatcatgggtaaggagaatctggaagccttgcaacgaccaactctacttcacctgattcacggcaaggtgaaggagttctatagctatcagaatgaggccgtggcgatagaaaatatcaagcgaggtctcgcctctctttttcagacgcagctcagtagtggaaccacgaatgaggtcgacatttccggaaattgcaaggtgacctatcaggcccaccaagataaagtgatcaagattaaagcgcttgattcttgtaaaatcgctcgtagtggctttaccacaccgaatcaggtgctgggggtaagctcaaaagctacctccgtaaccacctacaaaatagaggatagctttgtcatcgctgtactggcagaggaaacacataatttcggtctgaatttcctccagactatcaaggggaagatagtctccaagcagaagttggagcttaagaccacagaggccggccctcgactaatgagcggcaaacaggcagctgccatcatcaaggcggttgactctaaatacacggccatccctatagtgggccaggtcttccagagccattgcaagggctgcccatcattgtcagagctctggcggagcactcgtaagtatctccaacctgataatctttcaaaagcggaagcagtgaggaattttttggctttcatccagcatctccgcactgccaaaaaagaggagatattacagattctgaaaatggaaaacaaagaggtgctgccgcaactagtggacgccgtgaccagtgcccagacaagcgattctttggaggcgatcttggattttctggactttaagagcgactcatccatcatactgcaggagaggttcttgtatgcgtgcggattcgcttcgcatcctaatgaggagcttctccgcgccctcatttcaaagttcaaggggagcatcggatccagcgacatccgcgaaaccgtcatgatcattaccggtacactagtgcgtaaactttgtcagaacgaggggtgcaagttaaaagcagtggtggaagctaagaagttaattctgggcggactggagaaggccgaaaagaaggaggacacaagaatgtatctgctggctctgaaaaatgcattactccctgagggtatccccagtttgcttaagtatgccgaagccggtgagggccccatctctcatctggccaccaccgccttacagaggtacgatctgcccttcatcaccgatgaagtgaagaaaacattaaatagaatctatcaccagaacaggaaagtccacgaaaaaactgtgaggactgccgccgcggctataatactaaataacaatccatcgtacatggacgtgaaaaatatcttactgtcaatcggcgagctgccccaggagatgaacaaatatatgcttgccattgttcaggacatactccggtttgagatgcctgcgtcaaaaatcgtcaggcgcgttttgaaggagatggtggctcacaactacgaccgcttcagtcggtcaggctcatcctccgcctataccgggtacattgagaggtcccctcgctccgcgtctacttactcattggacattctatactcggggagtggcattcttcgtaggtccaacctgaacatttttcagtatataggaaaggccgggctccatgggtctcaggtggtgattgaagcacagggtctggaggccctgatcgccgccacacccgacgagggggaagaaaaccttgattcctacgctgggatgtctgccatactatttgacgttcagttgcgccctgtcaccttcttcaacggatacagcgacctgatgagcaagatgctgtctgcgtctggcgaccctatcagcgtggtgaaagggctcattctactgatcgatcattcgcaagagcttcagctgcagtctggactcaaggctaatatcgaagtgcagggggggttagccattgatatttcaggcgctatggagttcagtctttggtaccgcgaaagtaagaccagagtcaagaatagggttactgtggtgattaccacggacatcaccgtggattccagcttcgtcaaggctggactggagacatccactgaaaccgaggccggtttggagtttatatctacggtgcagtttagccagtacccatttctggtgtgcatgcaaatggataaagacgaggctccctttagacagtttgagaaaaaatacgaacggttgagtactggacgaggatacgttagccaaaagcggaaggaaagcgtgctggccggttgtgagttccctctgcaccaggaaaactcagaaatgtgcaaagtagtattcgctcctcagccagacagcacttcatccggatggttc

SEQ ID NO: 16757 - DNA, 2682 bp, Artificial Sequence
  Description of Artificial Sequence: Synthetic coding sequence
atgattctgctcgcggtgctgtttctttgcttcatctcctcatacagcgcctcagtgaaaggacataccaccggactgtcactaaataatgatagactctacaagctgacatactcaacagaggtgctgctggatcggggcaaagggaaactgcaagactcagtcgggtatcgcatctcgagtaatgttgatgtggctcttctttggagaaatcccgatggcgatgacgatcaactgatacagattacaatgaaggacgtaaacgtggaaaacgtaaaccagcagcgcggggaaaaaagtatcttcaagggaaaaagcccttcaaaaatcatgggtaaggagaatcttgaggcattgcagcggcccaccctcctccacctaattcatggtaaggtgaaagaattctactcctatcagaacgaggccgtcgccatcgaaaacatcaagcgtggactggcctctctgtttcagactcagctctcgtccgggacaaccaatgaggtggacatttccggaaactgtaaagtgacttaccaggcccaccaggacaaagttataaagattaaggccctggattcttgtaagatcgcgagatcagggttcacgactcccaaccaggtgctcggcgtgtcttctaaagctacgagcgtgacgacatataaaattgaggatagctttgtgatcgcagtcttggcggaggaaacccacaattttggcctcaactttctgcagactatcaaagggaagatcgtcagcaagcagaagctcgaacttaagaccacagaggcaggccctaggcttatgtctggcaagcaggcagctgctattatcaaggctgtggactctaagtacacggccattcccatcgtcggacaagtattccagtcacactgcaaggggtgtcccagcctgtccgagctgtggagaagtacccgcaagtatttacaaccagataatctgagcaaagccgaagccgttcgaaattttctggcttttatacagcatctgcggactgctaagaaggaagaaatcctccaaatacttaagatggaaaataaggaggttctcccccagctggtcgacgctgtaacttcggcgcagacaagtgatagtctcgaggctatcctcgatttcctcgatttcaagtcagactcttccatcatccttcaagaaaggttcctgtacgcgtgcgggttcgcatctcatccaaacgaggagttgctccgggcacttattagcaagttcaagggtagcattggatcgtcagatattcgtgagactgtcatgatcattacaggcacacttgtgaggaagctgtgccagaatgaggggtgtaagctgaaggccgtggtagaagcgaagaagcttattctgggaggcctggaaaaagcggagaagaaggaggatacacgtatgtacctactggcgctcaagaacgcgcttctgccagagggaatcccttcactgctaaagtacgctgaggctggcgagggccccatttcccacttggccaccaccgctcttcagcggtacgatcttccattcattactgatgaggtgaaaaaaacccttaaccgcatctatcatcagaacagaaaggtccacgagaagacagtgcgcaccgcagccgctgccattatattaaacaacaaccctagctacatggacgtcaagaatatcctcctgagtattggagaactgccacaggaaatgaacaaatatatgctggctattgtgcaggacattctccgatttgaaatgccagcgtcgaaaatcgtccggagagtgctcaaggagatggtggcacacaactacgatcgtttttctcgttctgggagctcttccgcctataccggctacattgaaaggtcccctaggtcagcgtccacgtattctcttgacatattgtactctggcagtggcattcttcgcaggtctaacctcaatatttttcagtatataggtaaagccgggcttcatggatcccaggtggtgatcgaagcacaaggtctggaagcgctgattgcagcaactcccgatgagggagaggaaaatctggatagctacgctggcatgtccgccattttattcgatgtgcagctgcggcctgtgaccttctttaacggctactctgatctcatgagtaagatgctgtcagcgtctggcgaccctatcagcgtcgtcaagggactcatcctcctgatcgatcattctcaggagctgcagctgcagtccggcctgaaggccaatattgaggttcagggaggtctggccatcgatatctccggcgccatggaattcagcctgtggtatcgagagagcaagaccagggttaagaacagggtcaccgtggtaattaccaccgatattaccgtggactcctcctttgtcaaagcagggttggaaactagcacagagacggaggcagggcttgaatttatttcgaccgtacagttcagtcagtacccttttctggtgtgcatgcagatggataaagatgaggcccctttccgacagttcgaaaaaaagtacgaacggctttcaacgggtagaggttacgtgagccagaaaagaaaggaatccgtgctcgcggggtgtgagttccccctgcaccaggaaaacagcgaaatgtgcaaggtggtctttgctccccagcccgatagtactagttccgggtggttt

SEQ ID NO: 16758 - DNA, 2682 bp, Artificial Sequence
  Description of Artificial Sequence: Synthetic coding sequence
atgattcttttagccgtgttgtttttgtgcttcataagctcatactccgcttctgttaaaggacacacgactggactatcattgaacaacgataggttgtataagttgacttattccaccgaagttcttcttgatagaggcaaagggaaacttcaagactcagtaggttatcggatctctagtaatgtggacgtagctctcctttggaggaatccggatggagatgacgatcaacttattcagataacgatgaaggacgttaatgtagagaacgtgaatcagcagcgtggtgagaagtcgattttcaaggggaagtcccctagtaagatcatgggtaaggagaatcttgaggcactccaaagacctactttacttcaccttatacacggaaaagtgaaagaattttattcgtatcagaacgaagctgtagccatcgagaatatcaagaggggactagctagcttatttcaaacccaattatctagtggtactacaaatgaagttgatatttccgggaattgcaaggttacgtaccaggcgcaccaagataaggttatcaagataaaggctcttgattcctgtaaaatcgctagatctggatttactacccccaatcaagtcctcggggtttcatcaaaggccaccagtgttactacgtataaaattgaggattcatttgtgatcgcagtcctcgcggaagaaacacacaactttggtttgaacttcttgcaaactatcaagggaaaaatcgtgagtaagcaaaagttggaactcaaaaccactgaggcaggtccacgtctcatgtctggcaagcaggctgcggctattattaaagctgtggattccaaatatacagcaatcccgatcgttggacaggtattccaatctcattgcaaggggtgcccgagcttgtccgaactttggcggtcaacacgtaagtatctgcaaccagataatctttccaaagccgaagcggtcagaaattttttggcatttattcagcaccttcgtactgctaagaaggaagagattctgcagatacttaaaatggagaacaaagaagttctgcctcagcttgtggacgctgtgacctccgcccaaactagtgatagccttgaggcgatactcgattttttggatttcaaatctgattcctcgattattctacaagagcggttcctttatgcttgcggatttgctagtcatccaaacgaagagttgctgagggctctaatttccaagttcaagggttctataggctccagcgatattagagagactgttatgattatcacgggcactttggtgcgtaaactttgccaaaacgagggatgtaaactaaaggcggtcgtggaggcaaagaagttgattctgggtggtcttgaaaaggccgagaagaaagaagatactcggatgtatctactggctctaaagaacgcgctgttgcccgaaggaattccaagtttgcttaagtatgcagaggcaggggagggtccaatttcccatcttgcaaccaccgcactccaacgctatgatcttcccttcatcacggatgaagtgaagaaaaccttgaatcgaatttatcatcagaaccgaaaggtccatgagaagactgttaggactgccgccgctgccattatcctgaacaataacccgagctatatggatgttaaaaacatccttttgtctataggggaactccctcaagaaatgaataaatacatgttggccattgtgcaagatattttgcgatttgaaatgccagcctcgaaaattgtgaggcgagttctcaaggagatggttgcacataattacgacagattttctcgaagcgggtcttccagtgcctatactggttatattgagaggagcccaaggtctgctagtacatactcattggatatcctctattcaggttcaggcattctgcgaagatcaaatcttaacatttttcaatacattggaaaggctggattgcatggatctcaagtagttatcgaggctcaggggttggaagctttaattgctgctactccagatgaaggggaggagaacctagattcctatgctggaatgagcgcaatactgttcgatgttcagctcaggccagttaccttctttaacggctactcagacctgatgtctaagatgttgtcagcttccggtgatcctataagtgttgtaaaaggcctgattcttttgattgatcattcacaggaattacaactgcaatcagggcttaaggctaacatcgaggttcaagggggacttgctatcgatatttcaggtgctatggagttctcgctctggtacagagaatcaaaaactcgcgtgaaaaacagggtgactgtggttatcacaacggatataaccgttgatagctcctttgttaaggccggactggaaacatctacagaaacagaggctggcttggaattcatctctacagttcaatttagtcagtacccttttttggtctgcatgcaaatggacaaggacgaggctccttttaggcaatttgagaaaaagtacgagagattatctaccggaaggggatacgttagtcagaagcgaaaggaaagtgttctcgctggatgtgaattccctctgcatcaagagaactctgagatgtgcaaggttgttttcgctccacagcctgatagtacctcatcgggctggttt

SEQ ID NO: 16759 - DNA, 2682 bp, Artificial Sequence
  Description of Artificial Sequence: Synthetic coding sequence
atgattttattggctgtcctcttcctctgtttcatttcctcctactcggcatccgtgaagggacatacgacagggctttctctgaacaacgacaggttatacaaacttacttactccaccgaggtgctgttggaccgaggcaaagggaaacttcaggacagtgtgggatatagaatcagctcaaacgtcgacgttgctctcctatggagaaatcccgatggtgacgatgatcaacttatccaaataacgatgaaggatgtgaacgtggagaatgtgaatcagcaacgaggggagaagtctatctttaaggggaagtcaccatcaaaaataatggggaaagaaaatttggaagccctccagaggccaactcttctgcaccttatccatggaaaggtgaaggaattctacagctatcagaacgaagctgttgcaattgagaatattaagcgtggactggcttctctgtttcagacgcagctgtcgtctggtacaaccaatgaggtcgacatctcagggaactgcaaggtgacctaccaggctcaccaggataaggtaattaaaatcaaggctttggactcctgcaagatcgctagaagtggattcaccacacctaaccaagtgctcggcgtatcatctaaagctacaagcgtgacaacctataagatcgaagactccttcgtcattgctgtcctggctgaagaaacccacaacttcggactcaatttcttgcaaactatcaagggcaagatcgtgtccaaacagaagctcgagctcaagaccaccgaagccggtcctagactcatgtccggcaagcaggctgccgccataataaaagccgttgactcgaaatacactgccatccccattgtgggacaggtcttccaatctcactgcaaggggtgtccttcactgagcgagttgtggcgcagcacccgcaagtatctccagcccgataaccttagcaaagctgaagccgtgaggaattttcttgcttttatacagcacctccggaccgcaaaaaaggaagagattctgcagattctgaagatggagaacaaggaagtactcccacaactggtcgacgcggtgaccagtgcgcagactagtgactcacttgaggcaatcctagacttccttgatttcaagagcgactcttcaataatactgcaggagagattcctatacgcatgcggattcgccagtcacccgaatgaggagctactccgggcgcttatctccaagttcaaaggaagcatcggaagctcagatatcagagaaactgttatgatcatcacaggcactcttgtaagaaaactttgccagaacgaggggtgcaagctgaaagccgtggtggaggccaaaaaactcattttaggcggcctagaaaaagctgaaaagaaggaggacacccgaatgtacctgttggccttgaagaacgccttgctccccgaaggaatccctagccttctgaaatacgccgaagccggtgaaggtcccatttcgcatctcgcgactacagccctgcagagatatgatttgcctttcattacagatgaggttaagaagacattgaacaggatctatcaccagaaccgaaaagtgcatgaaaagaccgtgcggacagctgcagccgcgattatcttaaataacaatccctcttatatggatgtgaaaaatatcctcctctctataggcgagctgcctcaagaaatgaataaatacatgctagcgatcgtgcaggatattttgagattcgagatgcccgcaagtaagattgttcgtcgcgtgctgaaagagatggtcgctcacaattatgaccgcttttcgcggtccggcagctcctctgcctacacagggtatatagagaggagtcctaggtctgcttccacttactcactagacattctatactccggtagcgggattttgcgtaggtcaaacttgaatatttttcagtatatcggaaaggccgggctgcacgggagtcaagtcgtcattgaagcacaaggcctcgaggctctgatcgccgcaacccccgatgagggcgaagagaatctcgattcatatgcaggcatgagcgcgattctatttgatgttcaactgcgccccgtgacattttttaacggctacagcgatctaatgtctaagatgctgagtgcctcaggagatcctatctcagtggtaaaaggactgatcctacttatcgaccattcgcaggagttgcagctccagtcggggctaaaggctaacatcgaagtccaaggggggctggcaatagatatcagtggggctatggagttcagtctgtggtacagggaaagcaaaactcgggtgaagaacagggttacagtcgttataacgacggacattaccgtggattcgagcttcgtgaaagccggactggagacctccactgagacagaggcgggactggagtttatctcaaccgttcagttctcccagtacccgtttctggtttgtatgcaaatggacaaggatgaggcgcccttccggcagtttgaaaaaaagtatgaaagactctccaccggcaggggctacgtgagccaaaagcgtaaagagtctgtcctggcgggctgtgagttcccacttcatcaggaaaacagtgaaatgtgcaaggtggtcttcgccccccagcccgattccacctcctctggttggttc

SEQ ID NO: 16760 - DNA, 2682 bp, Artificial Sequence
  Description of Artificial Sequence: Synthetic coding sequence
atgatcttgctcgcggtcctcttcctttgttttatctccagctactcggccagtgtgaaagggcataccaccggactctccctcaacaacgatcggctctacaagctgacctactccactgaagtgctgctggacagaggaaagggaaagttgcaggattccgtgggatacagaatatcgtcgaacgtggacgtggccctgctttggcgcaaccctgacggggacgacgaccagctgatccagatcaccatgaaagacgttaacgttgaaaacgtgaatcagcagcggggagagaagtccatcttcaagggtaaaagcccgtccaaaatcatgggaaaggaaaacctggaagctctgcaaagacctactctcttgcacctgatccatggcaaggtgaaggagttttactcgtaccagaatgaagcggtcgcgatcgaaaacatcaaaagaggactggcttcgcttttccagacccagctgtccagcggtaccaccaacgaggtcgacatctcggggaactgcaaggtgacctaccaggctcaccaggacaaggtgatcaaaatcaaggctctcgattcttgcaagatcgcgcggtcaggattcaccactcccaatcaggtgctgggcgtgagcagcaaagcgacctctgtgaccacttataagatcgaggacagctttgtgatcgcggtgctcgcagaggaaacccacaatttcgggctcaactttctgcagaccatcaagggaaaaatcgtgtccaaacaaaagctggagctcaaaaccaccgaggccggacctagattgatgtcaggcaagcaagcggccgccattatcaaagcagtcgactcgaagtacaccgctatcccgatcgtgggtcaagtgttccagtcacactgcaagggatgccctagcctgtcagagctgtggagatcaactagaaaatacctgcagccagacaacctgtcgaaggctgaggccgtgcggaacttcctggccttcatccagcacttgagaaccgccaagaaggaagagatcctgcagatcctgaagatggagaataaggaagtcctgccccagctcgttgatgctgtgacctccgcacagacctcggactcgctggaggcgatcctggacttcctggacttcaaatcagactccagcatcatcctccaagaacggtttctgtacgcatgtggttttgcatcccaccctaacgaggaactcctgagggcgcttatcagcaaattcaaaggatccatcggatcctcagacatccgcgagactgtgatgatcattacgggcactctggtgcggaaactctgtcaaaacgagggatgcaaactgaaagctgtcgtggaagcgaagaaacttatactggggggactggagaaggcagaaaagaaggaggacaccagaatgtacttgctcgcgctgaaaaatgcactgcttccggaaggtatcccaagcctgctgaagtacgccgaagccggagagggtcctattagccacctggcgactacggcgctccagaggtacgatctgcccttcatcaccgacgaggtgaaaaagaccctcaatagaatctatcatcagaaccggaaggtgcatgaaaagactgtccgcaccgccgccgctgcgatcatccttaacaataacccatcctacatggatgtgaagaatatcctgctctcgatcggggagctgccgcaagagatgaataagtatatgctggcaatcgtgcaggatatcctccgctttgagatgcctgcctccaagatcgtccggcgcgtgttgaaggaaatggtcgcccataactacgatcgcttctctcgctccggaagctcctcagcctacaccgggtacattgaacggtccccccggagcgcttccacctactccctggacatcctgtattccggatcgggtatcctgcgaagatcaaacctcaatatcttccagtacatcggaaaggccgggttgcacggctcccaagtggtgatcgaagcacaaggcctggaagccctcatcgcggcgaccccagacgagggagaagaaaacctggatagctacgctggcatgtcagccatcctcttcgacgtacagctgcggcctgtgactttcttcaacgggtactcagacctcatgtccaagatgctttctgcatccggagatcccatctccgtggtgaagggcctgatcctcctgatcgaccattcacaggagctccaactgcaatcgggacttaaagccaatatcgaagtgcaaggaggactggcgatcgacatctccggagcaatggagttcagcctgtggtacagagaatcgaaaactcgcgtgaagaatagggttaccgtcgtcatcaccaccgatattactgtggattcatcattcgtgaaagctggtctggaaaccagcactgagactgaggcggggctcgaattcatctcgaccgtgcagttttcacagtacccgttcctcgtctgtatgcaaatggataaggatgaagcaccattccgccaattcgagaagaagtacgaaagactgagcaccggacgcggttatgtcagccaaaaaaggaaggagtcggtgcttgcagggtgcgaattcccgcttcatcaggagaattcagaaatgtgcaaggtcgtgttcgccccgcagccggactcaacgtcatcgggatggttt

SEQ ID NO: 16761 - DNA, 2682 bp, Artificial Sequence
  Description of Artificial Sequence: Synthetic coding sequence
atgatactcctcgctgtcttgttcctgtgcttcatctcctcttacagcgcgtccgttaagggccacacgaccggtctcagtttgaacaacgacaggctttacaagctgacctactccactgaagttctgctcgatcggggaaagggtaagttacaggactctgtcggttaccgtatctcgtccaatgttgacgtcgccctactttggcggaaccccgacggcgacgatgaccagctcattcagatcactatgaaggacgtgaatgttgagaacgttaaccagcagcgcggagagaagtccatttttaagggaaagtccccttccaagattatgggcaaggagaatttggaggctctgcagcggcctaccctcctgcatctgattcacggcaaggtgaaggagttctattcttaccaaaatgaagctgtggccatcgagaacatcaagagagggctggcctcgttgtttcaaacccagctctcttccggaaccacgaacgaggtggacatctccggcaattgtaaggttacctaccaggcccaccaagacaaagtcatcaagattaaggccctcgatagctgcaagatcgcccgctctggtttcaccaccccgaaccaagtcctcggagtgagcagtaaggccaccagtgttaccacgtataaaatcgaggacagtttcgtcatcgctgtcctcgccgaggaaacccataattttggcctgaacttcttgcaaacgatcaagggtaagatcgtttcgaagcaaaagttggagcttaagacaactgaggcgggtccgaggctgatgtcaggtaagcaggcagccgctatcatcaaggccgttgattccaagtacactgccatacctatcgtgggccaggtcttccaatcgcattgcaagggctgcccgtcactgtctgagttgtggcgctctactaggaagtacttgcaaccggacaacctttctaaggccgaggctgtccgcaacttcctcgccttcatccagcaccttcggacggcaaagaaggaggaaatcctgcagatcctaaagatggagaataaggaggttcttccccagcttgtcgacgctgtcacttccgcccagacttccgattcccttgaggcgatcctggacttcctcgacttcaagtctgattcctctataatcctgcaagagcgtttcctctacgcctgtggattcgcctcccatcccaacgaagagttgttgcgcgccctaatctcaaagttcaagggctccatcggtagctctgacatccgggaaacggtgatgatcattactggaacattggtacgaaagctttgccagaacgagggatgtaagctcaaggccgtcgtcgaagcaaagaagttgatcctcggtggtctcgagaaagccgagaaaaaggaggatacccgaatgtatctgttggcgctgaaaaatgccttattaccagagggtattccctcccttctgaaatacgctgaagcgggggagggtcccatttcccatctcgcgacaaccgctctgcagcggtacgatctccccttcattaccgacgaggtaaagaagaccttaaaccgcatctaccaccagaaccgaaaggtccatgaaaagaccgtccgtaccgcagcggcggccatcatcctcaacaacaaccctagctacatggacgtgaagaatatcttgctctccatcggtgagcttccacaggaaatgaacaagtacatgttggccatagtgcaagacattctgcgcttcgagatgcctgcctccaagattgttcgccgcgtgttaaaggaaatggttgctcacaactacgaccgcttctcccgttctggctcctcctccgcgtacaccggttacatcgaacgttccccgaggtccgccagcacttacagcttagatattctttattctggctccggtattcttcgacgttcgaatcttaacatcttccagtacatcgggaaagccggactgcacggctcccaggtggtcatcgaagcgcagggccttgaagctctgatcgctgctacgcccgacgaaggcgaggagaacttggactcgtacgccggtatgagcgccatcctcttcgatgtacagctacggcctgttacattcttcaacggctactccgacttgatgtccaagatgcttagtgctagcggcgaccctatctcggtggttaaaggactgatcttgctcattgatcattcccaggagttacagctccagtctggcctgaaagcaaatatcgaagttcagggtggcttggctatagatatcagcggggcgatggagttcagcctgtggtacagagagagcaagacgcgtgtcaagaaccgcgtcaccgtcgtcattaccaccgacatcacagtggactcgtcattcgtgaaagccggtcttgaaacgagcaccgagacggaagcgggtctggagttcatttcgaccgttcagttcagccagtatccatttttggtctgcatgcagatggacaaggatgaagctccattccggcaatttgagaagaagtatgagcggctgtctaccggtcgcggttacgtttcgcagaagcgcaaggagtcggtcttggcaggctgtgaatttccccttcatcaagagaactctgagatgtgtaaggtggtgttcgccccccagcccgactcgacctcttccggctggttc

SEQ ID NO: 16762 - DNA, 2682 bp, Artificial Sequence
  Description of Artificial Sequence: Synthetic coding sequence
atgattctgctcgcggtgctgtttctgtgctttatcagctcatacagcgctagtgtcaagggccatactaccggactgtcactcaacaacgacagactgtacaagctgacctactccactgaagtgcttctcgatcgcggcaagggaaagctgcaggattcagtgggatacaggatctccagcaatgtggacgtggctctgctgtggagaaatcctgacggagacgacgatcaactcatccagatcacgatgaaggacgttaatgttgaaaatgtgaaccagcagaggggagaaaagtctatctttaagggaaagtccccatcgaaaatcatgggcaaagaaaacctggaggcgctgcaacggcccaccctcctgcacttgattcacggtaaagtgaaagaattctacagctaccagaacgaagctgtcgctatcgaaaacatcaagcgcggactggcgtccctgtttcagactcagttgtcctccggaactaccaatgaggtcgatatctcaggaaattgtaaagtcacttaccaggcccaccaggacaaggtgatcaaaatcaaggcccttgactcatgcaagattgctcggtccggatttactaccccgaaccaggtgctgggagtgagcagcaaagcgacctccgtgactacctacaaaatcgaggactcattcgtgatcgcagtattggctgaggagactcacaacttcggcctgaattttctgcagacgatcaagggcaagatcgtgtcgaagcagaagctggagctgaaaaccaccgaggccgggccccggctgatgtccggcaagcaggcggcggccattatcaaagcggtggactccaagtacaccgctattcccatcgtgggtcaggtgttccaaagtcactgcaagggatgtccatcgctctccgaactctggaggtcaacccggaagtacctccaaccggacaatctgtccaaggcggaagccgtgagaaactttctggccttcatccaacacctccgcaccgcaaagaaggaggagatccttcagatcctgaaaatggaaaacaaagaggtgctcccccagctcgtggatgccgtcacttcagcccaaactagcgattccctggaggcaatactcgactttctcgacttcaagtctgacagctctatcatcctccaggagcgcttcctgtacgcatgcggcttcgcgtcccatcccaatgaagaactccttagagccttgatctcgaagttcaagggatccatcggaagctcggatatccgggagacggtcatgatcattactggtaccctggtgcggaagttgtgccaaaacgaaggctgcaagttgaaggcagtggtcgaggcgaaaaaactgatcctgggcggccttgagaaggctgagaagaaagaagatactagaatgtaccttctggccctgaaaaatgcgttgctgccggagggcattccgtccctcctcaagtacgcagaagcgggggagggaccgatctcccacctggcaaccacggcgctgcaaaggtatgaccttccgtttatcaccgacgaagtgaaaaagactctcaaccggatttaccaccaaaaccggaaagtccacgagaaaaccgtccggaccgccgcagcggcaattatcctcaacaataacccgtcgtacatggacgtgaaaaacatcctcctgtccatcggagagctcccgcaagagatgaacaaatacatgctggctatcgttcaggacatactccgcttcgaaatgccggcgagcaaaattgtgagaagagtccttaaagaaatggtggctcacaactacgatcgcttttcccggtccggaagctcgtccgcatacacgggatacatcgagagaagcccacgctcggcctcaacgtactcgctggacatcctgtactcgggatcaggtatcttgcggaggagcaacctcaacattttccagtatatcggaaaagctgggctgcacggctcacaagtggttattgaagctcaaggactcgaagccctgatcgcagcgactccggatgaaggagaagagaatctggatagctatgcgggaatgtccgctatcctgttcgacgtgcagcttagacctgtgaccttcttcaacgggtactcggatctgatgtccaagatgttgtcggcctcgggggacccgatttcagtcgtcaagggcttgatccttctcatcgatcattcgcaggaactccagctgcaatcgggactgaaggctaacatcgaggtgcaagggggactcgcaatcgatatatcgggcgcgatggagttctccctttggtaccgggagagcaagacccgcgtgaaaaatcgggtcactgtggtcatcaccactgatatcactgtcgactcctcgttcgttaaggccggcctcgaaacctctaccgagactgaggccggactggagtttatcagcacggtgcagttctcacagtatccgttcctggtctgtatgcagatggacaaagacgaggctccattccggcagttcgagaagaaatacgagcgcctcagcactggacggggatacgtgtcacaaaagagaaaagagagtgtccttgcagggtgcgaattcccactccaccaagagaactcggagatgtgcaaggtggtgttcgcgccccagccagactcgacctcatcggggtggttc

SEQ ID NO: 16763 - DNA, 2682 bp, Artificial Sequence
  Description of Artificial Sequence: Synthetic coding sequence
atgattctgctggccgtgctgttcctttgtttcatctccagctacagcgcatcagtgaagggtcacactaccggactttcgctgaacaatgatagactctacaagctgacctattccaccgaggtgcttctcgacaggggaaagggcaagctccaagactcggtcggttacagaatctcctcgaacgttgacgtggccctcctgtggcgcaatccggacggagacgacgatcagctcatccaaatcaccatgaaggacgtgaacgtcgagaacgtgaaccagcagcgcggcgaaaaatcgatcttcaaaggaaagtcaccctctaagattatgggaaaggaaaacctcgaagccctgcagcggcccaccctcctgcatctcatccacggaaaggtcaaagagttttacagctaccaaaatgaagcagtggcaattgaaaacatcaagcgaggacttgcatcgctcttccaaactcagctctcaagcggaaccaccaacgaggtggacatctccggcaactgcaaggtcacctaccaagctcaccaggacaaggtgatcaaaatcaaggccctggattcgtgcaagatcgctcggtccggcttcaccaccccgaatcaggtcctgggagtgtcgagcaaggcaacttcggtgactacttacaagatcgaggattcattcgtgatcgccgtattggctgaggaaacccacaatttcggtctgaacttcctccagactatcaagggaaagatcgtctccaagcagaagctggagctgaaaaccaccgaggcgggaccgcggctcatgagcggaaaacaagcggcagcgatcatcaaagccgtggattcgaagtacaccgcaattccgatcgtgggacaagttttccagtcgcattgcaagggttgtccgagcctctcggagctgtggcggtcaacgagaaagtacctgcagccggacaatctgtcgaaagccgaggctgtgcgcaatttccttgccttcatccagcatctccggactgccaagaaggaggaaatcctgcagatactgaagatggagaataaggaggtgctgccgcagctcgttgacgctgtcacctcagcccaaaccagcgactccctggaagctatcctggacttcctcgacttcaagtccgactcctccatcattctccaagaacggttcctttacgcctgcggtttcgcgagccatcctaatgaggagctgctgcgcgcactgatttccaagttcaagggctcgatcggctcgtcggatattagggaaacggtcatgattatcactggaactctggttaggaagctgtgccagaatgaaggatgtaagctgaaagctgtggtcgaagccaagaaactcattcttggcggactggaaaaagcagaaaagaaggaagatacccgcatgtatctgctggccctgaagaacgcactcctgccagaaggaatcccgtccctcctgaagtatgcggaggcgggagaaggacctatcagccacctggccaccaccgccctgcagcgctatgacctcccgtttatcacggatgaggtgaaaaagaccctcaaccgcatctaccatcaaaatcggaaggtgcatgaaaagacggtgcggactgccgcagcggccatcattctgaataacaacccatcgtacatggatgtgaagaacatcctcctgtcgattggggaactgccacaggaaatgaataagtacatgctggcgattgtgcaggatatcttgcggtttgagatgcctgcgtcaaagattgtgcgcagggtcctcaaggaaatggtggcacataactacgatcgtttctcacgcagcggttcctcgtccgcctacaccggctacatagagaggtcacctagatcggcctcaacctactccctggatatcctttactcaggatcaggaatcctccgaagatcgaatctcaatatctttcaatacatcggcaaggcggggcttcacggaagccaagtggtgatcgaagcccaggggctggaggccctgatcgctgctactccggacgaaggagaggaaaacttggactcatacgcaggcatgtccgcaattttgttcgacgttcaacttcgtccagtgactttcttcaacggctactcagacctgatgtcgaaaatgctctcggcatcaggggacccgatctcggtggtgaaggggctgattctcctgatcgatcactcccaagaactccagctgcagtccggcctgaaggcgaacatcgaggtgcagggaggactggcgatcgacatctcaggcgcaatggaattttcgctctggtacagagagtccaaaactagagtgaagaacagagtcacggtcgtcatcactaccgacatcaccgtggattcctccttcgtcaaggccggactggagacgtccaccgaaactgaggccggactcgagttcatctccactgtgcagttctcgcagtatccgttccttgtctgtatgcaaatggataaggacgaggcgccgtttcgccagttcgaaaagaaatatgagcgactgtctaccggccggggatacgtctcgcaaaagcgcaaggagagcgtgctggccgggtgcgagttcccgcttcaccaggaaaactccgagatgtgcaaggtggtgtttgcgccgcaaccagactctacttcgtctggatggttc

SEQ ID NO: 16764 - DNA, 2682 bp, Artificial Sequence
  Description of Artificial Sequence: Synthetic coding sequence
atgatcctcctagctgtgttattcttgtgtttcatttcttcctacagtgcaagcgtgaaaggccataccaccgggctgtcattgaacaatgataggctgtacaagctgacttattcaacagaggtactgctggacagagggaagggcaaactccaggattcggttggctaccgcattagctcaaacgtggatgtcgccctgttatggaggaaccctgatggggatgacgatcagctgatacagatcacaatgaaggacgtgaatgtggagaatgttaaccaacagaggggcgaaaagtccatcttcaaaggcaagtcaccctctaagatcatgggaaaggagaaccttgaagctctgcagcgccccacactgttgcatctgattcacggcaaagtgaaggagttctatagttaccaaaacgaagccgttgccatcgagaacattaaaaggggacttgcctccctgtttcagacacagctaagctcaggaacgacgaatgaggtcgacatcagcggaaattgcaaagttacttatcaggcccatcaggacaaggtgattaaaatcaaagctttagattcatgtaaaatcgcacgaagcgggttcactacccctaaccaggtactcggtgtctctagcaaagctacttctgttacgacttataaaatcgaagatagtttcgttatcgccgtgctggccgaggagacccacaacttcgggttgaacttcctgcagaccattaagggcaagatagtgagtaaacaaaagctcgagcttaagaccaccgaggccgggcctcgtctaatgagtgggaagcaggctgctgcgatcatcaaggctgtggattcgaaatatacagctatcccgatcgtgggacaagtattccagtcacattgtaagggctgccctagtctcagtgagctctggcgttccactaggaagtacctccagccggataacctcagtaaggccgaagccgtgcggaatttcctggcctttattcaacacttgcggacagccaaaaaggaggaaatcttgcagattctgaagatggagaacaaagaggtcttgccacagcttgtggacgccgtaacatcggctcagactagtgactcccttgaggccatattggatttccttgacttcaagtccgatagttccattattctccaggagcgttttttgtatgcctgcggctttgcatcacatccaaatgaggagctgttgagagcactgatctctaaatttaagggttcgatcggctcatctgatattagggagactgtgatgatcattactggaacactggtgagaaaactgtgtcagaatgaaggctgtaagctgaaggcagttgtcgaagccaagaaactgatcctgggagggctggaaaaagctgaaaagaaggaagacacccggatgtatctgctcgctttgaaaaacgcacttctgccagaggggattccaagccttctcaaatacgcagaagcaggggagggccctattagccatctggcgactacagccctgcagcggtatgacctcccctttatcaccgacgaagtcaagaaaactcttaatcgcatttatcatcagaaccgaaaggtccacgaaaagacggtccgaacagccgccgcggccataatacttaacaataatcctagctacatggacgtaaagaatattcttctcagtataggggagttgcctcaagaaatgaacaaatacatgctcgctatagtgcaggacatcttgcgcttcgagatgccagccagcaagattgttagacgggtgctgaaagagatggtcgcgcataactacgacaggtttagcagatcagggagcagtagcgcttacaccggctatattgaacggtccccccgctccgcatctacttactcactggatatattgtacagtggttcggggattctaaggagatccaacttgaacatcttccagtacataggcaaggccggcttacacgggtcccaggtggtgattgaggcccagggcctggaggcactgatcgctgcaactccggacgagggtgaagaaaacctcgattcttacgccggcatgtccgctatactgttcgacgttcagttgcgccctgtgacattctttaatggatattctgatctcatgtcgaaaatgctttctgcctctggcgaccccatcagcgtagtgaagggactcatccttttgattgatcatagtcaggagctgcagctccagtcgggattaaaggcaaacatcgaggtgcaagggggcttagcaattgacatctccggggcgatggagtttagtctatggtacagagagagcaagacacgtgttaagaacagagtgacagttgtgattaccactgatatcacagtcgacagctctttcgtaaaggccggcctggagacatccactgagacggaggccggcctggaatttataagtactgtacagtttagccagtacccctttctcgtctgcatgcagatggataaggatgaagcaccttttcgacagtttgagaaaaagtatgaacgactttccactggacggggatatgttagccagaagagaaaggagtccgtgctcgccggttgtgaattcccactgcatcaggagaatagcgagatgtgcaaggtggtttttgcacctcaacccgatagcacctcatccggatggttc

SEQ ID NO: 16765 - DNA, 2682 bp, Artificial Sequence
  Description of Artificial Sequence: Synthetic coding sequence
atgattctgctcgccgttttatttctgtgcttcattagctcatacagtgcaagcgttaaaggtcacacaacaggtctgagcctcaataatgatcgactctacaagctgacatactctacagaggtgcttctggacaggggtaaaggcaagctgcaggattccgtaggataccggattagctccaatgttgacgttgccttgttgtggcgaaaccccgacggtgacgacgatcagcttatacagataaccatgaaggacgtcaatgtcgagaacgtcaaccaacagcggggagaaaagtcgatatttaaaggaaagtcacccagcaagattatgggcaaagagaatttagaggctctacagaggccaaccctactccatcttattcacggcaaggtgaaggagttctattcctatcaaaacgaggcagttgcaatagagaatattaagagggggctggcgagcctcttccagacccagctgtcaagcgggactacaaatgaggtggatatctccggaaactgcaaggtcacataccaggcccaccaggataaggtgattaaaatcaaagcactcgatagttgtaagattgcccggtcaggctttactactcctaaccaggtactcggagtatcatctaaggctacatcagtaacgacctataaaatcgaggacagttttgtcatagccgttttggctgaggaaactcacaatttcgggctaaacttcctgcagaccatcaagggcaagattgtctctaaacagaagctagaactaaagactaccgaggcaggaccacgcctcatgtccggaaaacaggctgccgccatcataaaggccgtggattccaaatataccgcgatccctattgtggggcaggtgttccagtcccattgtaaagggtgcccctccttgtctgagctttggcgcagtaccaggaaatacctgcagcctgacaaccttagcaaggccgaggccgtgcggaatttcctagcttttatccagcacttacggactgccaagaaagaggaaatactgcagattctgaagatggagaataaagaggtcctcccacagctggtggatgcagtgacttctgctcagacatctgattcactggaggccatcctcgactttcttgactttaaaagtgatagctctattattctgcaagaaagatttctttatgcgtgcggcttcgcctcccatccaaacgaagagttactgcgagccctgatctcaaagttcaaaggctccatcggatcctctgacatccgcgaaaccgttatgatcatcaccggtactctggtgcgcaagttgtgtcagaatgaagggtgtaaactaaaagcagtcgttgaagctaagaagttgatcctgggcggactggagaaggcggaaaaaaaagaagatacgaggatgtatctgctggcactcaagaacgccctgcttcctgaggggattccttctctcctcaagtacgctgaagcaggcgagggcccaatctctcatctagcaacaaccgcattgcagagatatgatctgccatttattaccgacgaggtgaagaagaccctgaaccggatttatcaccaaaacaggaaagtgcacgaaaagaccgttagaacagccgctgccgccattattctgaacaacaacccctcctatatggatgtgaagaatatattgctctccatcggcgaactacctcaggagatgaacaaatacatgctggcaattgtacaggacatcctgagattcgagatgccggcatcaaaaatcgtgcggcgtgtcttgaaagagatggtcgcacacaactacgatcggttctcccgctcagggtcaagttccgcgtatacgggctacatagagcgaagtcctcgctccgcatcgacctattccttggatattttgtacagtgggagcggcatattgagacggagcaacctgaatattttccaatatatagggaaagcaggattgcacgggtcccaagtggtgatcgaagctcagggactggaggcactgatagctgctacacctgacgagggggaagagaaccttgacagctatgcggggatgtctgccattttatttgatgtgcagcttcgtccagttaccttctttaatggatattcagatttaatgagtaaaatgctctcagcatccggggatcccatttccgttgttaagggactgatcttgctaatagaccacagccaggaactgcagctccagtccggcctcaaagccaacatcgaagttcaggggggcctagccattgatatctccggcgctatggagttctctctgtggtaccgggagagtaagaccagagtaaagaaccgagtcacggtcgttatcacaacagacatcacagtagactcctcttttgttaaggccggcctcgagacatctacagagacagaagctggcctggagtttattagtaccgtgcagtttagtcaatatcctttcctggtgtgtatgcagatggacaaagacgaggccccttttcggcaattcgaaaaaaagtatgagagacttagcaccggacgaggatatgtctcccagaaaaggaaagaatccgtgctggccgggtgcgagttccctctgcaccaagagaactctgaaatgtgtaaggtggtcttcgcaccgcagccagactcaacttcctcaggctggttc

SEQ ID NO: 16766 - DNA, 2682 bp, Artificial Sequence
  Description of Artificial Sequence: Synthetic coding sequence
atgatcctgctggccgtccttttcctgtgcttcattagcagctactcggccagcgtcaagggccacaccaccggactctcacttaacaacgacaggttgtacaagctgacctacagcaccgaggtgttgttggaccggggtaagggaaaactccaggacagcgtgggttaccggatctccagcaatgtggacgtggcgctcctgtggcggaatccagacggggacgatgatcagcttatccagattactatgaaagatgttaatgtggagaatgtgaaccagcagcgcggggaaaaaagcatcttcaagggaaaatctccatcgaaaatcatgggcaaggagaacctcgaagccctccaaaggccaactcttctgcatctcatccacggaaaagtgaaggagttctattcgtaccagaatgaggcagtggcgatcgaaaacatcaaacgtggactggcctcgctgttccaaacccagctgtcgtctggcacgaccaacgaagtcgatatttccgggaattgcaaggtgacgtaccaggctcatcaggacaaggtgatcaagataaaggctttggactcatgcaagatcgcacggtcggggtttacgactccaaaccaagttcttggcgtgtcgtccaaggcaacgtctgtcactacctacaagattgaggacagttttgtcatcgccgtgcttgcggaggagacgcacaatttcggactcaatttcctgcaaactattaagggaaagattgtgagtaagcagaagctggaattgaaaaccactgaggcagggcccagactcatgtcaggcaagcaagccgcagcaatcatcaaggccgtcgactccaagtatactgccatccccatcgtgggccaggtgttccagagccattgtaaagggtgcccttccctctccgaactgtggagatcgactcgcaaataccttcaaccggataacttgtccaaggctgaagctgtgcgcaacttcttggctttcatccagcacctgcgcactgcgaagaaggaggagatcctccaaattctcaagatggaaaacaaagaggtgttgccgcagctggtagacgccgtcacgtcagcccaaacctcggactcgctggaagcaatcctcgatttcctggacttcaaatccgacagttcgatcatcctgcaagaacggttcttgtatgcttgcggctttgcgtcccatccgaacgaagagctgctgagagccctgataagtaaattcaaaggatcaatcggatcatccgacatccgagaaaccgtcatgattatcactggaactcttgtgcgcaaactttgccaaaatgaggggtgtaagctcaaggcggtggtcgaagccaaaaaactgatcctgggtggcctggagaaggcggagaaaaaggaggatacgcgtatgtacctcctggccttgaagaacgcactcctgccggaaggaattccgtcgctcttgaagtacgctgaagcgggcgaaggaccgatcagccacttggccaccaccgctctccagcggtacgatctgccgtttatcaccgacgaagtgaaaaagacgcttaaccgaatctaccaccagaatcgcaaggtccacgagaaaaccgtgaggactgctgccgcggcaatcattctgaacaacaacccttcctacatggatgtgaagaacatcctcctttcgataggagagcttccccaggaaatgaacaagtacatgctcgcgatcgtccaagacatcctgagatttgaaatgccggcatccaaaatcgtgcggagagtgcttaaggaaatggtggcgcacaattacgatagattctcccgcagcggctcatcgtcagcatacactgggtacatcgaaagatccccacgctcagcaagtacctattcacttgacatcctgtattcgggatcaggtattctccggcggagcaatctcaacatcttccaatacatcggaaaggcgggactgcacggatcgcaggtggtgatcgaggctcagggtctggaggcactcatcgctgcgaccccggatgagggcgaggaaaacctggactcgtacgcgggaatgtcggccatccttttcgatgtgcagctccggccggtgactttctttaacgggtactcggacctgatgagcaagatgctgtcggcgtcgggtgacccaatctctgtggtcaagggactcatcctgcttattgaccattcgcaggaactgcaactgcagtcaggcctgaaagctaatatcgaggtccagggaggcctggccatcgatatctccggagcaatggaattctccctgtggtaccgcgaatctaagaccagggtcaagaacagggtgactgtagtgataaccaccgatatcactgttgattctagctttgttaaggccggacttgaaacctccaccgagactgaagcgggactcgaattcatctccactgttcagttctcacaatacccgttcctggtgtgtatgcagatggataaggacgaagcccctttccgccaattcgagaagaagtacgaacggctctccaccggacgcggatacgtgtcccaaaagagaaaagaatccgtcctggctggctgcgaattcccactgcatcaggagaactccgaaatgtgcaaggtggtctttgcgccgcaacctgactccacctcctcgggatggttt

SEQ ID NO: 16767 - DNA, 2682 bp, Artificial Sequence
  Description of Artificial Sequence: Synthetic coding sequence
atgatccttctggctgtgttgtttttgtgcttcatcagcagctatagtgcatctgtgaagggtcacactacgggcctttcattgaacaacgaccgcctgtacaaactcacttactccacggaagtcctgctggaccgcggcaaaggaaagctgcaagattcagtgggttacagaatatccagcaacgtggacgtggcactcctgtggcgcaacccggacggtgacgacgaccaattaatacaaataaccatgaaggacgtcaacgtcgagaatgtgaatcagcagcgaggggagaaatcaatcttcaaaggcaaatccccctcaaaaattatggggaaagaaaatcttgaagccttgcagcgacccacactgttacacctgatccatgggaaggtgaaagaattttatagctaccagaatgaagctgtggctatagagaacatcaagcggggtctcgccagcctgttccagactcaactcagtagtgggaccacaaatgaagtagatatctcagggaattgcaaagttacctatcaggcccaccaagacaaggtcataaagattaaggcattggactcgtgcaagattgcccgatcagggttcacaactcctaaccaggtgctgggggtgtcgagtaaagcgacctccgtgacaacctacaaaatagaagatagcttcgtgatcgcagttcttgcagaggagacccacaacttcggtctgaatttcctgcagaccattaaggggaagattgtctctaagcagaagttggagctgaagacgactgaggctggtcctcgcctgatgagcggaaagcaggcagctgcgattataaaagcagtggactccaagtatacagccattccaattgtgggtcaggtttttcagtcccactgcaaggggtgtccaagtctgagcgagctttggcgaagcacacgtaagtacctccagcctgataacttgtctaaggcagaggctgtgcgcaacttcctggcgttcattcagcatctgcgcactgccaaaaaggaggagattttacaaatactaaagatggagaataaggaggtgctgccgcaacttgtcgacgcagtgacgagcgcccagactagcgattctttggaagcaatccttgacttccttgacttcaagtcggatagctcaattattctgcaggagagattcctatatgcctgtggctttgccagtcatccaaatgaagagctcctacgagcgctcatatctaagtttaaggggtccatcggaagcagtgatatccgtgaaactgtgatgatcattacaggcacgctggttcggaaactgtgccagaacgaggggtgtaaattgaaagccgtggtggaggctaagaagctcattctgggcggtcttgaaaaggcagagaagaaggaagacaccaggatgtacctgctggccctgaagaatgccctgttgccagagggcatcccaagcctgctgaagtacgcggaagctggtgagggtcccatttctcacctggcaactaccgctctccagcgatacgatttgccattcataaccgatgaggtcaagaaaaccctgaatagaatataccaccagaatcgtaaggtgcacgagaagacagtcagaacagctgcagctgctattattctaaataacaacccaagctacatggatgtcaaaaacattttgttaagtatcggggagctgcctcaggagatgaataagtatatgttggcaatcgtacaggacatcctcaggtttgaaatgcctgcttcgaaaattgtgagaagggtgcttaaggaaatggttgcgcataattacgaccgcttttctaggagcggctcaagcagtgcatacaccggatacatcgaaaggtctcccagatccgcctccacctactccttagatatcctgtatagcggctccggtatactgcggagatctaatcttaatattttccagtatattgggaaagcgggcctacacggatctcaagtcgtgattgaagcacaaggactggaggcattaatcgctgccactccagatgagggggaggaaaatctggatagttacgccgggatgtcagcaatactgttcgatgtgcaattacgtccagttaccttcttcaacggctactccgacctaatgtccaagatgttatccgcttcaggggacccaatcagcgtcgtcaagggtctgattctgttgattgatcattcacaggagctccaactgcagtccgggttgaaagcaaatatcgaagtacagggagggctagccattgatattagcggagctatggaattctctctgtggtaccgtgagtcgaagacacgcgtcaagaaccgcgtgacagtggtcataacgacggatattacagtggactcatctttcgtgaaggccggcctcgaaacaagcaccgaaaccgaagcaggtctggagttcatatctacggtacagtttagtcagtatccattcctggtttgtatgcagatggataaagacgaggccccattcaggcagttcgaaaagaagtacgaacggctcagtaccggtaggggttacgtgagtcaaaagcggaaggagtcagtactggccggatgcgagtttcctctgcatcaggaaaactccgagatgtgcaaggtcgtgttcgccccccagcctgattctacatcaagtggttggttt

SEQ ID NO: 16768 - DNA, 2682 bp, Artificial Sequence
  Description of Artificial Sequence: Synthetic coding sequence
atgatcctgctggccgtcctgtttctgtgtttcatctcatcatactccgcgtctgtcaagggacatactaccggtctgtcactgaacaatgatagactgtacaagctcacttactcgacggaagtactcctcgacagggggaagggcaaactccaagattcggttggataccggatctcctcgaatgtggacgtggcgttgctgtggcggaacccagatggagatgacgaccagcttatccaaatcaccatgaaggatgtcaacgtcgaaaatgtgaatcagcaacgcggggaaaagtccattttcaaaggcaagtccccatcaaagatcatgggcaaggagaacctggaggctctgcagcgcccaaccctgctccacctgatccacggtaaggtcaaagagttctactcataccagaatgaggccgtggcgatcgagaacatcaagcggggcctcgcgagtctgttccagacccagttgtcctcggggactactaacgaagtcgacatcagcggaaactgcaaggttacctaccaagctcatcaagacaaggtgatcaagatcaaagcacttgactcctgcaaaatcgcccgctccggttttaccaccccgaaccaggtcttgggagtgtcatccaaagcgacctcggtgaccacgtacaagatcgaagattcgtttgtcatcgcggtgctggccgaagaaacccacaacttcggattgaatttcctgcagaccatcaagggaaagatcgtgtcgaagcaaaagttggaactcaaaaccactgaagccggaccgagactgatgtctggaaagcaggcggccgcgatcataaaggcagtcgactccaagtacactgcgatcccgattgtgggacaggtgttccagtcccactgcaaaggctgcccgagcctcagcgaactttggcggtccactagaaagtatctgcagcctgacaacctgtcaaaggctgaagctgttcgcaacttcctggccttcatccagcacctcaggactgccaagaaagaggaaattctgcaaatcctcaaaatggagaataaggaggtgctcccccagcttgtggacgcagtgactagcgcgcagacgtcggattccctggaggcaatcctggatttcctggactttaagtctgatagtagcatcatcctgcaagagcgattcctctacgcctgcggatttgcttcgcaccccaatgaagaactcttgcgcgccttgatctcaaagttcaagggatcgatcgggagctctgatatccgggaaactgtgatgatcattaccgggactctggtgcgtaaactctgtcagaacgagggttgcaagctgaaggcagtcgtggaagcaaagaagttgattctcgggggcctggagaaagccgagaaaaaagaggatacccgcatgtacctcctggcactgaagaacgccctgcttcctgaaggaatcccaagccttcttaagtacgcggaagccggagagggcccgataagccatctggcgactactgccttgcagcggtacgatcttcctttcattactgacgaggtgaagaaaacgctgaaccgcatttaccatcaaaatcgcaaagttcatgagaaaacggtgaggactgcagcggccgccattatcctgaacaacaacccgtcgtacatggatgtaaagaatatcctcctgagcatcggagaactgcctcaggagatgaacaagtacatgttggctatagtccaagacatcctgagattcgaaatgccggcctccaaaatcgtgcgacgggtgttgaaggagatggtagctcacaactatgatcgcttctcgcggtctgggagctctagcgcatacactggctacatcgaacggtcaccgagaagcgctagcacctactcattggacattttgtactccggttccggcattctgagaaggtcgaatctcaacattttccaatacattggcaaagcgggactccacggctcgcaagtggtgatcgaagcccaaggactggaagccctcatcgctgcaacgcctgacgagggggaggagaatctggattcgtacgcaggcatgtctgccatcctctttgacgtccaactgcgcccggtgaccttctttaacggatactcagaccttatgagcaagatgctgtccgcatccggtgacccgatttccgtggtgaagggattgatcctcctcatcgaccattcgcaggaacttcagctccagtctgggctgaaggccaatatcgaggtccagggtggcttggctatcgacatctcgggcgccatggaattcagcctgtggtaccgcgaaagcaagactcgggtgaagaatcgggtgaccgtggtgataaccacggacatcactgttgactcctcgttcgttaaggcgggactggagacttcgaccgagacggaagctggattggaattcatctcaactgtgcagttctcccagtacccgttcttggtctgtatgcagatggataaagacgaagccccattccgccagttcgagaagaagtatgaaaggctgtcgaccggacggggatacgtctcgcaaaaaagaaaggaatcggtcctggccgggtgcgagttcccattgcaccaagaaaacagtgaaatgtgcaaggtggtgtttgccccacagcccgactcgaccagctcgggatggttt

SEQ ID NO: 16769 - DNA, 2682 bp, Artificial Sequence
  Description of Artificial Sequence: Synthetic coding sequence
atgatcctcctcgcggtcctcttcctttgcttcatctcctcttactcggccagcgtgaaggggcatactacgggactttcactcaacaacgatcgcctgtacaagctgacttattcgaccgaggtgctgctcgatcggggcaagggcaagctgcaggattcggtgggctacagaatttcgtcaaacgtcgatgtggcactcttgtggcgcaacccggacggagatgatgaccagttgatccaaatcactatgaaagatgtgaacgtggagaatgtgaatcagcagagaggagagaaatcgatattcaagggcaaatccccctcaaaaatcatgggaaaggaaaacttggaggccctgcaacggccaaccctccttcacctgatccacggaaaggtgaaggaattctatagctaccaaaacgaagccgtggccattgaaaacatcaagaggggtctggcgtcgctgttccagacccaactgtcatccgggaccactaatgaggtggacatctcgggcaactgcaaggtgacctaccaggcgcaccaggacaaggtgatcaagatcaaagccctggactcgtgtaagatcgccagaagcggattcactacccctaaccaggtgcttggagtctcctcgaaagctactagtgtcaccacttacaagatcgaggattcattcgtcatcgcggtgctcgctgaggaaacccacaattttggcctgaacttcctgcagaccatcaagggaaaaatcgtgtcgaaacagaagttggaactgaagaccactgaagctggccctcgactcatgtctggtaagcaggctgccgccatcatcaaggccgtggacagcaaatatactgccatccccatcgtggggcaggtgttccagagccactgcaagggttgcccgagcctgtcggagctgtggcgctcaacccggaagtacctccaacctgacaatctgtccaaggccgaggctgtcagaaatttcctggcgtttatacagcatctgaggactgctaagaaggaggagatcctccaaatcctcaagatggagaataaagaggtcctgccgcagttggtggacgcggtgacttcggctcaaacttcagactcgctcgaagcaattctggattttcttgactttaagtctgactcatcgatcattctgcaagaacggttcctgtacgcgtgcggctttgcgtcgcatccaaacgaagagctgctccgcgcccttatctcaaaattcaagggcagcatcgggtcgtcagatatccgggagactgtcatgatcataactgggactctggtgcgcaagctctgtcaaaatgaaggctgtaaattgaaggcggtggtggaggctaaaaagctcatcctgggaggactcgaaaaagctgagaagaaggaagatacgcggatgtacctccttgctctgaagaacgccctgctgcctgaagggatcccatcactgctcaagtacgccgaggcgggcgagggtccaattagccaccttgccactaccgcactgcagcggtacgacctcccgttcattactgatgaagtgaagaaaaccctgaaccggatctaccaccagaaccgcaaagtgcacgaaaagacggtgcgcactgcggctgcggccatcatcctgaacaacaatccgtcgtacatggatgtgaagaatatcctcctcagcatcggagaattgcctcaggaaatgaacaaatacatgctggcaatcgtgcaagacatcctccggttcgaaatgccggcgtccaaaatcgtgcggcgggtcttgaaggagatggtcgctcataactacgacagattctcgaggagcggttcatcatccgcgtacactggatacatcgaaaggagcccgcgaagcgcatcaacttactcactcgatatactttactcgggttcgggaatcctgaggcgttctaatctgaacatttttcaatacatcggtaaggctggcctgcacggctcgcaggtcgtcatcgaagctcagggactcgaagcactcatcgctgcgactccagatgaaggggaagaaaatctggactcgtacgcaggaatgtcggcgatcctctttgatgtgcagctgcggcctgtgaccttcttcaatggatactcggaccttatgtcgaagatgctcagcgcgtccggagatccaatttctgtcgtgaaggggctgatcctgctgatcgaccattcgcaggagttgcaactgcaatccggactcaaggccaacatcgaggtgcaagggggcctcgcgattgatatctccggcgccatggagttcagcctctggtaccgggaatcaaagactagagttaaaaacagagtcacggtggttatcaccactgacatcaccgtggactccagcttcgtcaaggccggtctggagacttccaccgaaactgaagcaggactcgaattcatctcaaccgtgcagttctctcaatacccgttcctcgtttgcatgcagatggacaaagacgaggcgccattccgccaatttgagaagaagtacgagaggctgtcgaccggtcggggatacgtcagccaaaaacgcaaggagtcagtgctcgccggctgcgagttcccgctgcatcaagagaactcggagatgtgtaaggtcgtgttcgccccacagcctgacagcacctcgtcggggtggttt

SEQ ID NO: 16770 - DNA, 2682 bp, Artificial Sequence
  Description of Artificial Sequence: Synthetic coding sequence
atgatcttactggccgtgttattcctgtgcttcatctcatcctacagtgctagcgtgaagggtcacaccactggcctttccctcaataacgaccgactgtataaactcacctacagcaccgaagtgctattggaccgcggcaagggcaagctacaggacagcgtgggttacagaatctcttctaacgtagacgtcgcacttctgtggagaaatccagacggagatgacgaccagctgatccagataaccatgaaagacgtcaatgtggagaatgtgaatcagcaacgcggcgagaagtccatcttcaaggggaagtctcccagtaaaatcatggggaaggagaacctcgaggctctgcagagacctaccctgctccacctgattcatgggaaggtgaaggagttttatagctaccaaaatgaagccgtagctatagagaacattaagcgtggtcttgccagcctctttcagacacagctgtcctcaggaaccacgaatgaggtggacatttcaggcaactgcaaggtgacttaccaagctcaccaagacaaagtgataaaaatcaaagctttagacagctgtaagattgcccgcagcggatttactacccccaaccaggttttaggtgtttctagcaaggccacctcagtgaccacttacaaaattgaggactctttcgtgatcgctgtgctggctgaggagactcataacttcggactgaatttcctccagaccattaaggggaagattgtgagcaaacagaagttggagcttaaaacaaccgaggccggcccccgtttgatgtctggtaaacaagctgctgcgattatcaaagcggtcgactcgaagtacaccgccatacccattgtcggtcaggtgttccagagccactgcaagggctgcccatccctgtccgaactgtggcgttcgaccaggaaatacctccaaccagacaatttatcgaaggccgaggccgtacggaatttcctggcttttattcaacaccttcgtaccgccaaaaaagaggagatactgcagatcctgaaaatggaaaataaggaggtcttgcctcagctggtggatgccgtgacatccgcccaaacaagtgacagcctagaagccatcctggacttcctggatttcaagagcgacagcagcatcattcttcaggagagattcctttatgcctgcggctttgcatcccatccgaatgaggagctcctgcgagccctgatttctaagtttaagggttcaataggatcctctgatattagggagactgtgatgattataacaggaacgctcgtcaggaagctgtgtcagaacgagggatgcaaactcaaagcggtcgtggaggccaaaaaactcattctcggtggacttgagaaggctgagaaaaaagaagatacccgcatgtacctactggccttaaagaacgccctcctgccagaagggataccgtcattgctcaagtatgctgaagctggtgaaggccctatcagtcatcttgccaccaccgccttgcagcggtacgacctgcccttcattacagatgaggtgaaaaaaaccctcaaccgcatctaccaccagaataggaaggtgcacgaaaagacggtgcggactgccgctgcagcaatcatccttaacaataaccccagttatatggacgtaaagaatattctcctctcaattggcgaattaccgcaagagatgaataagtacatgttagcaatcgtgcaggatatcctgcggtttgaaatgcccgcatccaagatcgtgaggagggttctgaaggagatggtcgcgcacaactacgataggttcagcagaagcgggagctcttcggcctatactgggtacattgaaagatcaccgagaagtgcctctacctattcactggacattctgtatagcggctccgggattctgcggaggagcaacttgaacatcttccagtatattggaaaagccggtctacatgggtctcaggttgtgatcgaagcccaaggactcgaggccctgatcgctgccacgccagacgagggcgaagagaaccttgactcttatgcaggtatgtctgctatcctgtttgatgtgcaactgcgacccgtcaccttcttcaacggctacagcgacctcatgagcaagatgctgagcgcgtccggtgaccccatttcagtcgtgaaaggtctcatactacttatcgatcacagtcaggaactgcagctccaatccggattgaaagctaacattgaagtgcaggggggcctagcgatagatatcagcggggcgatggagttctccttgtggtaccgggagtcgaagacacgggtgaaaaatagggtgaccgtcgtgatcacaactgatataacagttgacagttccttcgtcaaagcgggcttggagacttccacagagaccgaagctggtctcgagttcattagcacagtccagttcagtcagtatccattcctagtctgcatgcagatggacaaagatgaggccccattccgtcagttcgagaagaaatacgaaagattaagcacagggcgtggctatgtgagccagaaaaggaaggaatcggtactcgccgggtgcgagtttccactccaccaagagaactcagagatgtgtaaggtggttttcgcccctcagcccgactcgacaagttccggctggttc

SEQ ID NO: 16771 - DNA, 2682 bp, Artificial Sequence
  Description of Artificial Sequence: Synthetic coding sequence
atgatcctgctggctgttctgttcctgtgcttcatctcctcatactcggctagcgtaaagggacacactactgggctgtcacttaacaatgacagactgtataagctgacttacagcacggaagtgctgctcgatcggggaaaggggaaattgcaggattcggtcggataccggatctcttccaatgtggacgtcgcgctgctgtggcgaaacccggacggagatgatgaccagctcattcagataactatgaaggacgtgaacgtggaaaatgttaatcagcaacgcggcgaaaagtccatcttcaagggaaaatcgccatccaagatcatgggcaaagagaatctggaggcgcttcagcggccgaccctgctgcatctcatccatggtaaagtgaaggagttctactcttatcagaacgaagccgtggccatcgagaacattaagcgcgggctggcctcgctcttccagacccagctctcgtcgggcaccactaatgaagtcgacattagcggtaactgtaaggtgacttaccaggcacatcaagacaaggtcatcaaaatcaaggccttggatagctgtaagatcgcgcgctcaggattcacgaccccgaaccaagtactgggagtgagcagcaaggctacctccgtgactacctacaagatcgaagattcgttcgttatcgccgtcttggccgaagaaacccacaattttgggctgaatttcctccagaccatcaagggcaaaattgtctctaagcaaaagttggaactcaagaccacggaggccggaccacgcctgatgtcgggcaagcaagcagcagcaatcatcaaggccgtggattcgaagtacactgcaatcccgatcgtgggacaggtgttccagtcacactgcaagggctgcccgtcccttagcgagctctggagatccaccagaaagtatctgcagcccgataacctctcgaaagcagaagccgtgcgcaatttcctcgccttcatccagcacctgcgcaccgcaaagaaagaagagatcctgcaaattctgaaaatggaaaacaaggaggtgcttccccaactggtggacgctgtgactagcgcacagacctcggacagcctcgaagccatcctggacttcttggacttcaagagcgactcatccatcatcctgcaggaacggtttctgtacgcatgtggattcgcttcacatccgaacgaagagttgctgagagcgctgatttccaagtttaaaggatcgatcgggtcgagcgacatcagggaaaccgtcatgatcattaccgggactctcgtcagaaagctgtgccaaaacgagggctgcaaacttaaagctgtggtggaagctaagaaattgatcctgggcgggctcgagaaagctgagaagaaggaggacacgagaatgtacctcctggcccttaagaacgctttgctgccagagggcatcccatccctgctgaagtacgcagaggcaggagagggaccaatctcccacctggccactactgcgctgcaacggtacgaccttcccttcattactgatgaggtgaagaaaaccctcaacagaatctatcatcaaaacagaaaagtccacgaaaagactgtgcggaccgcggccgccgcaattatcctcaataacaatccttcctacatggacgtgaagaacatcctgctctccatcggagaactccctcaagagatgaacaagtacatgttggcgatcgtgcaggacatcctcaggtttgagatgccggcctccaagatcgtgcgccgcgtactgaaggaaatggtagcccataactacgatcgttttagtcgctccgggtcatcaagcgcctacactggatacattgagcgctcgccccgctcggcgagcacctactcgttggacatcttgtactcaggttcgggcatcctccggcggtccaacctgaacatcttccagtacatcggaaaagcaggactgcatgggagccaagttgtgatcgaagcccagggactggaagcgttgatagccgcgactcctgacgaaggagaggaaaacctcgattcctacgccggaatgtcggcgattctctttgacgttcaactgcgccctgtgacctttttcaatggctactcagatcttatgtcgaaaatgctgtcggctagcggcgatccaattagtgtcgtgaagggtcttatcctgctgatcgatcactcgcaggagcttcagcttcagtcaggactcaaagccaacattgaagtgcagggagggctcgccatcgacatctcgggagcgatggagttttcattgtggtaccgcgagtctaagacccgggtgaaaaacagggtgaccgtagtcatcaccactgatatcacggtcgactcctcgttcgtgaaggcgggactcgaaacctcgactgagactgaagctggactggaattcatatcgacggtgcaatttagccagtacccgtttctggtttgtatgcagatggacaaggacgaagccccgttccgacaattcgaaaagaagtacgagaggctcagcacgggtcggggatatgtgtcacagaaacggaaggaatccgttcttgccggctgcgagttccctctccaccaagaaaatagtgagatgtgtaaggtcgtgttcgcgccgcagccggattccaccagctccggttggttc

SEQ ID NO: 16772 - DNA, 2682 bp, Artificial Sequence
  Description of Artificial Sequence: Synthetic coding sequence
atgatccttttggcagtgcttttcctttgcttcattagtagctactcagcatccgtgaaggggcatacgaccggactgtcactgaacaatgatagactgtacaaacttacgtactcgaccgaagtgcttctggatagaggtaagggaaagttgcaagatagcgtcggttacagaatcagcagcaacgtggatgtggcacttttgtggagaaaccctgacggtgatgacgaccaactgatacaaattactatgaaggatgtcaacgtggaaaatgtcaaccaacagaggggcgaaaagtccatctttaagggtaagtccccatcaaagattatgggaaaggaaaacctggaagcattgcagcggcctacgcttctgcatcttatacatgggaaggtcaaagagttctactcataccagaatgaggcagtcgccatcgaaaacattaagaggggactggcctctctgtttcagactcagcttagctccggaaccactaatgaggtggatatatccggcaactgtaaagtgacctaccaagcacaccaagacaaagtcatcaagatcaaagccctggactcctgtaagattgcaagatcgggattcaccaccccgaaccaggtgcttggtgtatcctctaaggcaacctcggtgacgacttacaagattgaagattcctttgtcattgcagtgcttgccgaggaaactcataactttggactcaattttctgcaaaccattaaggggaagatcgtctcgaaacagaagttggagctgaaaactaccgaggcaggtccacgtctcatgtccgggaagcaagcagcagcaatcatcaaagccgtggacagcaaatacaccgccattcctattgtgggtcaagtgtttcaatcgcattgtaaagggtgcccatccctcagcgagctctggagatccacccgcaagtacctgcagcccgataacctttcgaaagcagaggccgtgcggaattttctggcgttcattcagcatcttcgtactgcaaagaaggaagagatactgcagattctgaagatggaaaacaaagaagtgctgccgcaattggtggatgccgtgacgtctgcacagacctcagacagccttgaggcaatacttgactttttggacttcaagagcgacagctcgatcatccttcaggaacggtttctgtacgcctgtggttttgccagccatcctaacgaagagcttctgagagcacttatctcaaagtttaagggatcaattgggagctccgacatacgggaaactgtcatgataatcaccggaacccttgtccgaaaactctgccagaacgaggggtgcaaacttaaggctgtcgtcgaagcgaagaagctgatcctggggggtctggaaaaggccgagaagaaagaggacacccgcatgtaccttcttgccctgaaaaacgcacttctgcctgaagggattccatcgcttctcaagtacgcagaagcaggagagggcccgattagtcacctggcaaccactgcgctgcaacggtatgatctgcctttcattactgatgaggtcaaaaagaccttgaaccgcatataccaccagaacaggaaagtccacgagaaaacggtgaggaccgcagcggcggccattattctgaataacaaccctagctacatggacgtcaaaaacatcctgctttcaattggagaacttccccaagagatgaacaagtacatgctcgcgatcgttcaagatatacttcgatttgaaatgccagcatctaaaatcgtgagacgcgtgcttaaggaaatggtggcacataactacgataggttttctaggtccgggtcgtcgtcagcttacaccggttacattgaacggtcgcctcggtccgcctcgacttattcgctcgacattctgtacagtggaagcggtattcttcgccgctcaaacctgaacatttttcagtacattggtaaggctggtctgcacggatcccaagttgtgattgaagctcagggcctcgaagctctgatagccgcaaccccggatgagggcgaggaaaaccttgattcctacgccggtatgtccgcaatcctctttgatgttcaactgcgcccagtgactttcttcaatgggtattcagatcttatgtcgaagatgcttagcgcgagcggagatcctatctccgtggtgaagggacttattctgctcattgaccattcccaggaattgcagctgcagtccgggctgaaagccaatattgaggtgcagggcggacttgcaattgacattagcggagcaatggaattctcactttggtacagagagtcaaagactcgcgtgaagaacagagtgaccgtggtcatcactaccgacataaccgtggactcttcgtttgtcaaggctggcctcgaaacctccacggaaaccgaggcaggcctggagttcattagcactgtccaattctcacaatacccatttcttgtgtgtatgcagatggataaggatgaagccccatttcgtcaatttgagaagaagtacgaacggttgtccactggccgaggttacgtctcccagaagcgcaaagagagcgtccttgccggatgcgaatttcctctgcatcaggaaaacagcgagatgtgcaaggtcgtgtttgctcctcagcctgattctacctcatccggttggttt

SEQ ID NO: 16773 - DNA, 2682 bp, Artificial Sequence
  Description of Artificial Sequence: Synthetic coding sequence
atgatcctgctcgcggtgctgttcctgtgctttatctcttcttactcggcatcagtgaagggacatactactggcctgtcgctgaataatgatcgtctgtataagttgacgtactccaccgaagtgcttcttgacagaggaaagggtaaactccaagatagtgtgggttaccgtatttcgtcgaacgtcgatgtcgcattgctttggaggaaccccgacggagatgatgatcaactgattcagatcacgatgaaggacgtaaacgtggaaaacgttaaccagcaacggggcgaaaagtccatattcaagggaaagagcccttcaaagatcatgggcaaagaaaacctggaagcactccagaggccgactttgcttcatcttattcacgggaaggtgaaggagttttacagctaccaaaatgaggccgttgcgattgaaaacataaaacgagggctggcaagcctgtttcagacgcagctttcatccgggaccaccaacgaagtggacatttccggcaactgcaaggtaacctaccaagcacatcaggacaaggtcataaagattaaagctctggattcatgtaagatcgcccgctcgggcttcaccaccccaaatcaagtgctcggagtcagctcgaaggcgacctccgtgactacctacaaaatcgaggactcctttgtcattgccgtcttggctgaagaaactcacaatttcggacttaactttctgcagactatcaaggggaaaattgtcagtaagcaaaagttggagcttaaaacgaccgaagcaggaccccggctgatgtccgggaagcaggcagcagccataatcaaagcagtggatagcaagtacactgccattcccatcgtgggtcaggtctttcagtctcactgtaaaggatgtccctctctgtcggaattgtggagatcaacgcggaaataccttcagcctgataatctcagtaaggcagaagcagtccgcaactttctcgcatttatccaacaccttagaaccgcaaagaaggaggaaattcttcaaattcttaagatggagaataaggaggtccttccacaactcgtggatgcagtgacctccgcacagaccagcgactctctggaagcaattcttgattttcttgactttaagtcggattcatcgattattctgcaagaaaggttcctctacgcctgcggttttgctagccatccgaacgaagagttgctgagagctctgatctcgaaattcaaagggtcgataggttcctccgatattcgggaaactgtgatgataatcactggcacgctggtgcgtaaactttgtcaaaatgaaggctgcaagctcaaggctgtggttgaggcgaagaaactgattcttggcggattggagaaggccgaaaagaaagaggacacgagaatgtacctgctcgcgctcaagaatgctcttctcccagaaggcattccatcccttttgaagtacgcagaggcaggagaagggccaattagccatctggcaaccactgcactccagcgctacgatctgccattcatcactgacgaggtcaagaaaaccctgaaccgaatttaccatcaaaatcggaaggtgcacgaaaagaccgtgcgtaccgccgccgctgccatcatattgaacaacaatccaagctacatggacgttaagaacattctgctttccatcggagaacttccgcaagaaatgaacaaatacatgttggcgatagtccaggatattctccgatttgagatgcctgcatctaagatagtgcggagagtgcttaaagaaatggtggcacataactatgataggttttcgagatccggttcatcatccgcatacactggatacatcgaacgctctcccaggtcggcttccacttactcgttggacatcttgtacagcggaagcggaattcttcggagatcgaacttgaacatttttcagtatattggtaaagccggactgcacggatcccaggtggtcattgaagcacaaggacttgaagcacttattgccgccactccggacgaaggtgaggagaatcttgattcgtacgcaggtatgtccgcgatcctgtttgacgtacaactccgaccagtcaccttctttaacgggtatagcgatctgatgtcgaaaatgctttcggcgtcaggtgatcccatctcggtggtcaagggccttatcctcctcatcgatcattcacaagagctgcaacttcagtcgggcctcaaggcgaatatagaagtccagggaggactggcaatagacatctcgggtgcaatggaattttcgctgtggtaccgcgagagcaagactagggtgaaaaaccgcgtgactgtggtgattactaccgatattacggtggacagttcattcgtgaaagcaggactggaaacttcgaccgaaaccgaggcaggtcttgagttcattagcactgtccaattttcgcaatacccttttctggtgtgtatgcaaatggataaggatgaggcgcctttccgacaatttgagaagaaatacgaaagactgtccactggtcgcggctacgtgagccagaagcggaaagagtcggtgctcgcaggttgtgaatttccactgcatcaagaaaatagcgagatgtgtaaggtggttttcgccccacagcctgattcgacctcatccggatggttc

SEQ ID NO: 16774 - DNA, 2682 bp, Artificial Sequence
  Description of Artificial Sequence: Synthetic coding sequence
atgattctgcttgcggttctctttctgtgttttatatcctcctactccgcatctgtaaaaggacacaccactggcttgtcccttaataatgatcgactatataaattaacatattctacagaagttcttctggatcggggaaagggaaaactgcaagattcagtcgggtatcgtattagctctaatgttgatgtggcattgttgtggcgtaacccggatggagacgatgatcaactcattcagataactatgaaagatgtaaacgtcgagaatgtgaatcaacaacgaggcgaaaaatctatttttaaaggcaaaagtccatctaaaatcatgggcaaagagaacttggaagccttacagagacctacactgttgcatctcatacacggtaaagtcaaggagttctactcataccagaacgaggccgtagcgattgagaatattaaaagggggctggcttccctgttccagacgcaattgagttctggtacgacaaacgaagtagatatttccggtaattgtaaagtgacgtaccaggcgcatcaggataaagtcatcaaaatcaaggccctcgattcttgcaaaattgcgcgtagcggctttaccacacctaatcaggtgctcggagtttcgtcgaaagctacaagtgttacgacatataaaattgaagactcgttcgtaatcgccgtactcgcagaagaaacgcataattttgggctaaattttttacaaacgatcaaggggaagattgtaagcaagcaaaaattagaactgaaaacaaccgaggctggcccgagactcatgtcgggaaaacaagcggcggcaattatcaaggcagttgattctaaatatacggcgattcctattgtcgggcaagtcttccagagccactgtaagggttgcccttccctgtcagaattgtggcgctcaacgagaaaatatttgcagccggataatctgtctaaggcagaagcggtacgcaatttcttggcgtttattcaacacttgcgcactgcaaaaaaagaggagattttgcaaattcttaaaatggagaataaggaagttctgccacaactggtagatgcggtgacatcggcacagacgtcggattcattggaagctatccttgattttttggacttcaaatctgactcgtctatcatcttacaagagcgtttcctgtatgcatgcggcttcgcgagccatccaaacgaagaactgttacgtgcattaatttcaaaattcaaaggatcgattggatctagcgacatcagagagacggtgatgatcattactggcacccttgtcagaaagttgtgccaaaatgaaggttgtaaactgaaagcagtcgttgaagctaagaaactcatcttgggcggattagaaaaagccgagaagaaggaagatacacgtatgtatttactggctttaaaaaatgcgcttctgcctgaaggcattccttcattacttaagtatgcggaagctggcgagggaccgattagccacctcgcaacaacagccttgcagcgttacgaccttccattcattacggatgaagtcaaaaagacgctcaacagaatttaccatcaaaatcgcaaagtccatgaaaaaacagtgagaacggctgcggcagcaatcatcttgaataacaatccctcgtatatggacgtgaaaaacattcttttaagcattggcgaactgcctcaagagatgaataaatatatgctggcgatagtgcaagatattcttcgatttgaaatgccggcatctaaaattgttcgaagagtcctgaaggagatggtggcacataattatgacagattttctagaagtgggtcatccagcgcgtacacaggttatattgaacggagcccgagatcagcttcgacctattctctggacatactttatagcggatccggaattctgagaagatccaatcttaatatttttcaatacattggaaaggcaggcttgcacgggtcacaagttgtaattgaagcacagggacttgaagctcttatagccgcaacacctgatgaaggagaagaaaatctggattcttatgctgggatgtccgctatcctttttgatgtccagcttcgtccggttactttctttaatgggtattccgatttgatgagcaagatgctgagtgcgtccggagatccgatttcggtggttaagggcttgattcttctgattgaccacagccaagagctacagttgcaatccggtttgaaggccaatattgaagttcaaggcgggctggcgatcgatatctcaggtgccatggagttctcgttgtggtatcgagagagtaaaactcgtgtgaaaaatagggttacggtcgttatcacaacagatatcacggtagattcttcttttgttaaagcaggcctcgaaacatcaaccgaaacagaggccggactggaatttatctcaacagtgcagttttcacaatacccatttcttgtgtgcatgcagatggacaaggacgaggcgccgtttagacagtttgagaaaaaatacgaacgactgtctacgggaagaggatatgtaagccaaaaaagaaaagaaagcgtcttggccgggtgtgaattccctcttcaccaagaaaattctgagatgtgcaaagtggtttttgcaccacaaccggattcgacttcttcaggttggttt

SEQ ID NO: 16775 - DNA, 2682 bp, Artificial Sequence
  Description of Artificial Sequence: Synthetic coding sequence
atgatacttctagccgtgcttttcctatgcttcatctcctcatacagcgcttcagtgaaaggccacacaacaggactctcattgaacaacgaccgcctgtacaagctgacgtattcgaccgaggtccttcttgatcgtgggaagggcaaactccaggactccgttggatatcgcatttccagtaacgtggatgtggcacttctgtggaggaacccagatggcgatgatgatcagttgatccagataacgatgaaggacgttaatgtcgaaaatgttaaccagcagaggggcgaaaagtcaatcttcaagggcaaaagcccttctaaaattatgggaaaagaaaatctggaggccctccagcgcccgacacttttgcatctgatccatggaaaagtgaaggaattctattcatatcaaaatgaggccgtagcgattgaaaacatcaagagagggctagctagcctcttccagacacagctgagcagcgggaccaccaacgaagtggatataagtggcaactgtaaggtgacctatcaggctcaccaggataaagtcataaaaatcaaggccttggattcttgtaagattgcacggagcgggttcaccactcccaatcaagtcctgggagtgtccagtaaagccactagcgttacgacttacaaaatagaggattcgttcgttatagcagtgctcgccgaggagactcataattttggcctaaacttcctccagactattaagggaaaaattgtgtccaagcagaaactggagttgaagaccactgaggctgggcccaggctgatgtccggcaagcaggctgccgctataattaaggccgtggactctaagtacaccgctatacccatcgtaggccaggtgttccagtcccactgtaaaggttgcccctctctgtccgaactttggagatctactaggaagtacctgcagcctgacaacctcagcaaggctgaggctgttcgaaatttcctggcattcatccagcacctgcggacagctaaaaaggaagaaatcctgcagatcctgaaaatggagaacaaggaggtcctcccccagctcgtggatgctgtgaccagtgctcagacaagcgattccctcgaggccattctggactttttggacttcaaatcagatagttccataatactccaggaacggtttctgtacgcttgcggctttgccagtcacccaaacgaggaacttctgcgcgccttaatctccaagttcaagggcagtataggcagcagcgatattcgagaaactgttatgattatcaccggaaccctcgtcagaaaactctgtcaaaacgagggatgcaaactgaaggcagtggttgaagcaaagaagctgatcctgggcggccttgaaaaggctgaaaagaaagaagatacaaggatgtacctactggcactgaaaaatgccctattgcccgaagggatcccctcactcttgaaatatgccgaagccggagaggggcctatctcgcacctcgccactaccgctctgcaacgatacgatctgccatttatcactgatgaggttaagaaaaccctgaatcggatataccaccagaatcggaaggtgcatgaaaagaccgtaagaactgcagcggctgccatcattctgaacaacaacccctcatacatggacgtcaagaacattctgctctcaataggcgaactacctcaagagatgaacaaatacatgcttgccattgtgcaagacattttgaggttcgaaatgcctgcgtctaagatcgtccgccgtgtcctgaaagagatggtggcccacaattatgaccggttttcacgctctgggtctagctcggcgtataccggatacatcgagagaagcccacgtagcgcctcgacctacagcctggacatcctgtacagcggtagcggaatcttgcgccgctctaatctcaatatctttcagtacatagggaaagcaggcctgcacggttcacaagtcgtaattgaggctcaggggctggaggctcttatcgccgccacccccgacgagggcgaggagaatctggattcttacgctggtatgagtgcgatcctcttcgacgttcagcttaggcccgtgacttttttcaatggatattcagatctgatgagcaaaatgcttagcgctagcggtgaccctatcagcgtagtgaaaggcctcatcctattgatcgaccactctcaagagctgcagttgcagagcgggctcaaggctaatatcgaagtgcagggcggactggccatcgatataagcggtgcgatggagttctcactgtggtatagggagtctaaaactcgcgtgaaaaacagggtaactgtggttattacgaccgatatcaccgtggattcctccttcgtgaaagcaggattggagacaagtaccgagaccgaagctggcctggagttcatcagtacagtgcagttttctcaatatccttttctggtgtgcatgcaaatggacaaagacgaggcaccctttaggcagtttgaaaaaaagtacgagaggctgtctacaggtcgcggatacgtgtctcagaagaggaaagagtccgtgctggctggctgtgagttccccttgcaccaggagaactctgaaatgtgcaaagtcgtttttgccccccaacccgactcaacatcctctggctggttc

SEQ ID NO: 16776 - DNA, 2682 bp, Artificial Sequence
  Description of Artificial Sequence: Synthetic coding sequence
atgattcttcttgcagtgctctttctttgtttcatctcctcatactcagcgagcgtcaaaggtcacaccaccgggctcagcctgaacaacgatcgcctttacaaattgacctactcgactgaagtgctgctggatagaggtaagggaaaactccaggactccgtcggttacagaatctcgtccaatgtcgacgttgcgcttctttggcggaatccagatggagacgatgaccagctgatccagattaccatgaaggatgtgaatgtggaaaatgtgaaccaacagcggggcgaaaagtccattttcaaaggcaaaagcccttcgaagattatgggaaaggaaaaccttgaggcgctccaaagacctactttgcttcatttgatacatgggaaggtgaaggagttctattcctaccaaaacgaagcagtcgcaatcgaaaacataaaacggggactggcatccctgttccaaacccagctgtcgtccggaactactaacgaagtcgatatctcaggaaactgcaaggtcacttaccaagcccatcaagacaaggtcatcaaaatcaaggcactggattcctgtaagatcgccagatcgggattcactactcctaaccaggtgctgggagtctcgtcaaaggcaacttctgtgaccacgtacaagattgaggactcgtttgtgatcgcagtgcttgcggaggagactcacaactttggactgaatttcctgcaaaccatcaaaggtaagattgtgtcgaagcaaaagctggagctgaaaacgaccgaagcaggtcctcgccttatgtccggaaagcaagccgctgccattatcaaggctgtggattcaaagtacacggcgattcctattgtgggtcaagtgttccaatcgcattgtaaagggtgcccctccctttccgagctctggagatccacccggaaataccttcaacccgataatctgtcgaaagcagaagccgtccggaactttctggcattcatacagcatcttagaactgccaagaaggaagaaatacttcagattctcaagatggagaacaaagaggtcctccctcaactcgtggacgctgtgacctccgcacaaacctcggactcactcgaagcgatcctcgatttccttgatttcaagtcagattcaagcataattctccaggaacgttttctgtacgcatgtggatttgcatcacatcccaatgaagaactcctgcgggcacttatatcgaagttcaaaggaagcattggatcgtcagatattagagaaactgtgatgatcataacggggacgctggtgagaaagctctgccagaatgaaggatgcaagctcaaggcggtggtcgaagcaaagaaacttattctggggggtcttgagaaggccgagaaaaaggaagatacccggatgtacttgcttgccttgaagaacgccctccttcctgagggtatcccttcgttgctgaagtacgcagaagctggagagggtccaattagccatctcgcaaccactgcccttcaacggtacgacctcccttttatcaccgacgaggtgaagaaaaccctcaatcgtatttaccatcaaaaccgtaaggtgcatgaaaagaccgtcaggactgcggcagccgcaattatcttgaataacaaccccagctacatggacgtgaaaaacatccttctgtcaataggcgagctcccccaggaaatgaataagtacatgcttgccatagtgcaagatatccttcgctttgaaatgcctgcttccaagattgtgcggcgtgttctgaaggaaatggtcgctcacaattacgataggttctccagatcgggtagctcgtcagcatacaccgggtacattgaaaggtcgccgcgctcagcaagcacctactcactggatattctttactcgggatcggggattctgagacgatcgaatctcaatatctttcagtacatcggcaaggccggattgcacggatcgcaggtcgtgattgaagcacagggacttgaagcccttatagcagcaactcctgatgaaggagaggagaaccttgattcctacgcggggatgtcggctattctttttgatgtgcagcttcggccagtgacgttctttaatggatactccgacctgatgtcgaaaatgctgtcagcatcaggggaccccatatcggtggtgaagggcttgattctgctcattgaccactcgcaagagctccagctgcaatcggggctgaaggccaacattgaagtgcaaggaggattggcaattgatatcagcggagctatggaattttcgctgtggtaccgggaatccaagacccgggtcaagaaccgtgtgactgtcgtaatcaccactgatattactgtggacagttcatttgtcaaggcagggctcgaaacttccacggagactgaagccggacttgaattcatttcaactgtgcagttttcgcagtacccctttcttgtgtgtatgcaaatggacaaagatgaggcgccttttaggcagtttgaaaagaagtatgaaaggctttccactggtcgcggctacgtctcgcaaaagcggaaggagagcgtcctggccggatgtgagtttcctctccaccaggaaaattccgaaatgtgtaaggtggtgtttgcaccacaacccgactcgacctcaagcggatggttc

SEQ ID NO: 16777 - DNA, 2682 bp, Artificial Sequence
  Description of Artificial Sequence: Synthetic coding sequence
atgattctcctggctgtgctgtttctgtgttttattagctcttatagcgccagtgtgaaagggcatacgaccggtctttccttaaacaatgaccgcctgtacaaattaacttattcaacagaagtactgctagatcgaggaaagggaaaattgcaggacagcgtgggctatagaataagctccaatgtggatgtagccctgctgtggagaaaccccgatggcgatgacgatcagttgatccaaataactatgaaagacgtcaacgtggagaacgtgaaccaacagcggggtgagaaatcaatcttcaagggcaagtcgccatcaaaaatcatgggcaaggaaaacctggaagccctgcaacgacccaccctgctccatctgatccacggcaaggtgaaagagttctatagctatcagaacgaagctgtggcaattgagaacatcaaaagggggctcgcctctctcttccagacacaactgtcatccggtaccacaaatgaagtggacatttctggaaattgcaaagtgacatatcaggcgcaccaagacaaagtgattaagattaaggcactcgattcttgcaaaatcgctagatccggctttactaccccgaatcaagtcctcggagtgagttccaaggccacctccgtcaccacatataaaattgaggattccttcgtgatagctgtgctagcagaggagacccacaatttcggcttaaatttcctgcagaccattaagggaaagatcgtttctaagcaaaaactggagttgaagaccactgaggctgggcctcgattgatgtccggaaagcaggcagcggccataattaaagccgttgattcgaaatacacagccattccgattgttggccaggtgttccagtctcactgcaagggctgcccttcactctccgaactctggaggtcaaccagaaagtacctccagcctgacaatctttctaaggcggaagctgtgagaaactttctggcttttatccaacatctgaggacagcaaagaaggaagagatcctgcagatacttaaaatggaaaataaagaggttttgcctcagctcgtcgatgcggtgacttcagcgcagaccagcgactctctcgaggcaatcctggacttcctcgattttaagtctgattcttctataatccttcaagagcgtttcttatacgcttgcggcttcgcgagtcacccaaatgaggagctattacgggccctgatttcaaagtttaaaggatctatcggcagttcagacatacgggagacagtgatgattataacaggaacccttgttcgcaagctttgtcagaatgagggttgtaagctaaaggcagtggtagaggctaagaagttgatcctgggaggactggaaaaagccgagaagaaggaggacacccggatgtatctcctagccctcaagaacgccctgttgccggagggtattccttcattgctcaagtatgctgaggctggcgaaggtccgatctcacatttggctaccacggctctgcaacgatatgacctaccttttataacagatgaagtcaaaaaaacactgaacagaatctaccaccagaatagaaaggttcacgaaaagacagtgaggaccgcagctgccgccatcattcttaataacaacccatcttatatggatgtgaagaatattctgctgtcaataggcgaattacctcaagagatgaataagtatatgctagcaatcgtccaagacattctgcgttttgagatgccagcatctaaaatcgtccgaagagttctgaaagagatggtagcgcataattatgaccgctttagccgatccggctcgagtagcgcatacaccggctatatagagcgaagtccccgtagtgcatcaacttactctctcgatattctctacagcggttcagggatactgaggaggtccaatctcaacatttttcaatacattggcaaggccgggctgcacgggagccaagtggtgatagaggcccagggcctcgaagcgctgatcgctgcaacgccagatgaaggagaagagaatttggattcttacgctgggatgtcggccatactgttcgatgttcaattgcgccccgttaccttcttcaacgggtacagcgatctgatgtctaagatgttatccgctagcggcgaccctatctcagtggtaaaaggcctgatactacttatcgatcattcgcaggagcttcagttgcagtcagggctgaaagctaatatagaagtacagggcgggttggccatcgatatttccggggcgatggagttcagtttatggtatcgggagtccaagacacgagtaaaaaacagagtgaccgtggtcatcactacagatattaccgttgattcttcgttcgtcaaggccggattggagactagcactgagactgaagccggactggaatttatcagtaccgttcagttttcccagtacccattcctcgtctgtatgcagatggacaaggatgaagcccccttccgacaatttgagaaaaaatacgagcgtttgtcgacgggccgcggttatgtttcccagaagcgcaaggaaagcgtactggctgggtgtgagttcccactccaccaggaaaacagcgaaatgtgtaaagtggtcttcgctccccagccggactctacttccagcgggtggttc

SEQ ID NO: 16778 - DNA, 2682 bp, Artificial Sequence
  Description of Artificial Sequence: Synthetic coding sequence
atgatcctgcttgcagtgctgttcttgtgctttatctcctcctactccgcttcagtcaagggtcatacgacgggattgagcctgaataacgaccgcctgtacaagttgacctactcaactgaagtcctgctcgaccgcggaaaggggaagctgcaggattccgtcggatacaggatctcctccaatgtggatgtggctctgctgtggcggaacccagacggtgacgatgaccaactcattcagatcactatgaaagacgtcaatgtggagaacgtgaaccagcaacgcggagagaagtcgatcttcaagggaaagtcgccaagcaagatcatggggaaggaaaacttggaagcgctgcagcggcctaccctgctccatctgatccatggaaaagtcaaggaattctactcgtaccagaacgaagcagtggccatcgagaatatcaagcgcggattggcctcccttttccagacccagctgtcgtccgggaccactaacgaagtcgacattagcggcaattgtaaggtcacctatcaagcccaccaagacaaggtaatcaaaatcaaggccctcgacagctgcaagattgcccgctcaggatttaccactccaaaccaggtcctgggagtgtcatcaaaggctacctcggtgactacttacaagatcgaagattccttcgttatcgccgtcttggcagaggaaacgcataacttcggactgaacttcttgcagactatcaagggaaagatcgtgtcaaaacaaaagctggaacttaagaccaccgaagcggggccgcggctgatgtcgggaaaacaggctgccgccatcatcaaggccgtggactcaaaatacactgcaatcccgatcgtgggccaagttttccagtcgcattgtaagggctgcccttcactgtctgagctgtggcggagcaccagaaagtacctgcagcccgataatctgtccaaagccgaagcagtccggaatttcctggccttcatccagcacctccgcaccgcaaaaaaggaagagatcctgcaaatccttaagatggagaataaggaagtcctgccgcagctcgtggacgctgtcacgagcgcacagacttccgattcactcgaagccatcctcgatttcctcgacttcaaatcggactccagcattatcctgcaagagaggttcttgtacgcgtgcggtttcgcgtcccaccctaatgaagagcttctgcgcgccctcatctcaaagtttaaaggatcaatcggctccagcgacatcagagaaaccgttatgattatcactggaactctggtgcgcaagctctgccagaatgagggttgcaaactgaaggctgtcgtcgaagccaaaaagctgatcctgggtggtttggaaaaagccgagaagaaggaagatacccgtatgtacctcctcgccctcaagaacgcactgctgccggagggaattccaagcctcctcaaatacgccgaggctggcgagggaccgatctcgcatctggctactacggccctgcaacggtacgacctcccattcatcactgatgaagtgaagaaaacgttgaatcggatttaccaccaaaaccgcaaggtgcacgaaaaaaccgttcggaccgctgcggccgcaatcatcctcaacaacaatccctcgtacatggatgtgaagaacatactgctgagcatcggagaattgccgcaggagatgaacaagtacatgctggcaatcgtgcaagacattcttagattcgagatgccagcgtcgaagatcgtccggcgggtcctgaaagaaatggtggcccacaattatgaccggttttccaggagcgggagctcttcagcctacaccggatacatcgaaagatcacctcgctcagcatcgacttacagcctcgatatcctgtacagcggttccggaatcctccgccggagcaacctgaacatttttcagtacattggaaaggccggcctgcacggctcccaagtggtgatcgaggcccaaggtctggaggcgctgatcgcagccaccccggatgagggcgaagaaaacctggattcgtacgccggaatgtcggcgatccttttcgacgtgcaacttaggcccgtgactttcttcaacggatacagcgatttgatgtcgaaaatgctgtcggcgagcggtgatccaatctcggtggtgaaaggtttgattcttctgatcgatcattcgcaagaactgcagttgcaatctggattgaaagccaacatcgaggtacaaggtggtctggccatcgatatctcaggagcgatggagttctccctgtggtacagggagtcaaagacccgagtcaaaaacagagtgaccgtggtgatcactaccgacatcaccgtggattcgtcattcgtcaaagccgggctcgagacttcaacggaaaccgaagccgggctggaattcatctccactgtgcaattttcacagtacccatttctggtgtgcatgcaaatggacaaggatgaggccccgttccgccagttcgaaaagaagtacgaaagactgagcactggccgcggttacgtcagccagaaacgcaaggaatccgtgcttgccggctgcgagttccccctccatcaggaaaattcggaaatgtgcaaggtcgtgttcgccccgcagccggatagcacctcgagcggctggttc

SEQ ID NO: 16779 - DNA, 2682 bp, Artificial Sequence
  Description of Artificial Sequence: Synthetic coding sequence
atgattctgctggccgttttgttcctctgtttcatcagtagctattctgcaagtgttaagggtcataccacagggctgtccctaaacaatgatcgactatacaagctgacatacagcacggaggtgcttctggaccgaggcaaagggaaactgcaggattctgtgggatatcggatctcaagcaatgtcgatgtggccttgttgtggcggaatcccgacggggacgatgaccagctgattcagataactatgaaggacgttaatgtggagaatgtgaaccaacagcgcggagagaaatctattttcaagggcaagtccccaagcaagatcatgggtaaggaaaacctggaagccctacagcgaccgacacttcttcacctcatccacggaaaggtgaaggagttctatagctaccaaaatgaagctgtggccatcgagaatatcaaaagaggcttggcttccttgtttcagacacagctctcctctggcaccaccaacgaagtggatatctccggaaattgtaaggtgacttaccaggcacaccaggacaaggttatcaagataaaagcactagacagctgcaagatcgctaggagcggattcaccactcccaaccaagtactaggggtatccagtaaagccacgtcagtcacgacctataagatagaggacagtttcgtcatcgccgttttggccgaggagacacacaattttggattgaacttccttcaaacgatcaagggcaaaattgtctccaaacaaaaactagagctgaagacgacagaggctggcccaagacttatgtccgggaaacaggctgctgctattatcaaagcggtggactccaaatatactgctatacctattgtgggccaggttttccagagccattgcaaaggctgtccctcactgtctgagctgtggaggagtactcgcaagtacttgcagcccgataacttaagcaaagccgaggccgttagaaacttcctggcatttatacaacatctcagaacagctaaaaaggaggaaatcttacagatccttaagatggagaacaaggaagtgcttccacagttggtggatgccgtgacctctgctcagacatctgacagcttagaagcaattcttgactttcttgatttcaaatcggactccagtataatcctgcaggaacgattcctgtatgcttgtggattcgcatctcatccaaacgaggaattgctgcgagccctgatttcgaaatttaaggggagtattggttcctcagatattagagagacagtcatgataatcacaggcaccctcgtaaggaaactatgtcaaaatgaagggtgcaaactgaaggcggtcgtggaagccaaaaagttaatcctaggaggcctggagaaagcagaaaagaaggaagatacccgcatgtatctgttagcgctgaaaaatgccttgctcccagagggcataccgtcactgctaaagtacgccgaagccggggaaggcccaatcagtcaccttgcgactacagcccttcagcgatacgacctcccctttatcaccgatgaagttaaaaagacactcaaccgtatctaccaccagaaccgcaaggtgcatgagaagacagtcaggaccgctgccgctgcgattattctgaataataaccccagttacatggatgtcaagaatatactcttatcaataggggaactacctcaggaaatgaataagtacatgctggccatcgtccaggatatactgagattcgagatgcccgcttccaagattgtgaggagggttctgaaggaaatggttgcgcacaattacgaccgcttttcccggagtggatcaagttctgcctatactggatacatcgagcgtagccctcggagcgccagcacctactctctggatatcctctacagcgggtcgggaatactcaggcgaagcaatctcaacattttccaatacatcgggaaggcaggcctgcacggctctcaggtcgttatcgaggcccaaggcctagaggctttgatcgccgcgacccccgatgagggcgaggaaaatctcgatagctatgctggaatgagcgctatcttatttgatgtccagctgaggccagtgaccttctttaatggctactcagaccttatgtccaagatgcttagcgcttcaggtgacccaatttcagttgttaaaggcctgatactactcatagaccactcccaggagttgcagctgcagtcggggctgaaggcgaatattgaggtgcagggcggtctggccattgatattagcggtgctatggagttttccctctggtaccgagagagtaaaacacgcgtgaagaaccgcgttacagtggttatcaccacggatatcaccgttgactcctcatttgttaaagcgggacttgagacctctacggaaaccgaggcaggcctggagttcatctcaaccgtacagttttcccaatatccatttctggtttgcatgcagatggacaaagacgaagcaccgttccgccagttcgaaaaaaagtatgagcggctgtctacaggcaggggctatgtgtcccagaaacgaaaagaaagtgtattagccgggtgcgaatttcctttgcatcaggagaattcagagatgtgcaaagtcgtgtttgccccgcaaccggactcaacctcctctggatggttc

SEQ ID NO: 16780 - DNA, 2682 bp, Artificial Sequence
  Description of Artificial Sequence: Synthetic coding sequence
atgatcctactggccgtgctgtttctgtgttttatcagcagctacagcgcgagcgtaaaaggtcacaccacaggtcttagccttaataatgatagattgtacaagctcacttactccactgaggtgttgctggatagaggtaagggcaagttgcaggactccgtcggatatcggatatcatccaacgtggacgtggcccttctgtggaggaaccccgacggagatgacgatcagctaatacagattactatgaaggatgtcaacgtagaaaatgtaaaccagcaaaggggggaaaagtccatctttaaagggaagagcccttcaaaaatcatggggaaggagaatttagaagcactgcaaaggccaacactgttgcacctgattcacggaaaggtaaaggagttctatagctaccagaatgaggcggtggcaatcgaaaacatcaagagaggactagcaagtctattccagacccaactgtcttctgggaccacaaatgaagtagacatttcgggaaactgcaaagtcacgtaccaggcacatcaggataaagttatcaaaatcaaggccttggactcgtgcaagatcgccagaagcggttttactacgcctaatcaggtgctgggtgtaagttctaaggccacgagcgtcactacatataagattgaggattcatttgtgattgctgtactcgccgaagagactcacaacttcgggctcaactttctgcagacgattaaaggcaagattgtctccaaacagaagctggagctgaagaccacagaggcgggacccaggctgatgtccggcaagcaggctgctgcgattataaaagcagtcgatagtaaatacacagcaatccctatcgttgggcaggttttccagtcccactgtaagggatgcccttcactgagtgaattgtggagatcaaccagaaagtatcttcagccggacaatctgtctaaagccgaggctgtgcgcaactttctggcattcatacagcacttgagaacagcgaaaaaggaggagatactgcagatcctaaaaatggagaacaaggaggtcctaccccagctagtagacgccgtcacttccgcccagacgagcgactcactagaggccattctcgatttcctggatttcaagtccgactccagtataatcctgcaggagcggtttttatatgcatgtgggtttgcaagtcaccctaacgaagagctgctccgcgccctgatcagcaagttcaagggttcgataggttcctccgacattcgagaaactgtgatgataatcactggtacactggtacgaaagctgtgccagaacgaaggctgcaagctgaaagcagtagtggaagctaagaaacttattctgggtggtctggagaaagcagaaaagaaggaagacacccggatgtatttattggctttaaaaaacgcgttgttgcccgaaggcatccccagcttactaaagtatgccgaagccggggaggggcctatttcgcatcttgcaactacggcgttgcagagatatgacctgccctttattaccgacgaagttaagaagacgctgaacagaatctaccaccagaacagaaaggtccacgagaaaaccgtgaggaccgccgcagcagcgattatcctcaacaataaccccagctatatggatgttaagaacattttgttgtccattggggagcttccgcaggagatgaacaagtacatgctggcaattgtccaggatatcctcagatttgaaatgcccgccagtaagatcgtgcgcagagtgctgaaagagatggttgcccataactatgatagattttcccgctctggctcttcttcggcctacaccggctacatcgaacgtagtccaagatctgccagcacatacagcttggacatcctgtatagtgggtcagggatcctgcgccgttcaaacctcaatatcttccagtacataggaaaagccggtctgcacggaagtcaggtcgtgatcgaagcccagggactggaagccctgatagctgcaacccccgatgaaggtgaggaaaatcttgattcctacgccggcatgagtgccattctgttcgacgtgcagctgagacccgtcactttttttaatgggtatagcgacttaatgagcaaaatgctttctgcctccggggaccctatctcagtagtaaaaggtctgattctcctgattgaccattcccaagagctgcagctgcagtccggcctcaaggcaaacatagaggtgcagggcggcctggccatcgatatctccggagcaatggagttcagtctgtggtatcgcgaaagtaagacacgggtgaaaaaccgcgttacagttgtgattaccacggatattactgtagactcttcctttgtgaaagctggtctggaaaccagtaccgaaaccgaagcagggctggagtttatctctacggtgcaatttagccagtaccccttcctcgtttgtatgcagatggacaaggatgaggccccgttccggcagttcgaaaaaaagtacgaaaggctgtcaacgggccggggttacgttagccagaaaaggaaagagagtgtactcgcaggttgcgagttcccacttcatcaggagaattcggagatgtgtaaagttgtgttcgccccccagcctgactccacgtcctctggctggttc

SEQ ID NO: 16781 - DNA, 2682 bp, Artificial Sequence
  Description of Artificial Sequence: Synthetic coding sequence
atgatcctactggccgtgctttttttatgtttcataagctcttactccgccagtgtgaaaggccacacaactggactaagcctcaacaatgaccgcctctataaactgacttactcaacggaggtgttgcttgataggggaaaggggaagcttcaggacagcgtgggttaccggatctcctctaatgtggatgtagccttgctgtggcgcaacccagacggggatgacgaccagctcatccagataaccatgaaggatgtcaacgtggagaacgtgaaccaacagcggggggagaaatcaatttttaagggtaaaagcccttcaaaaattatgggaaaagagaatcttgaggcactccagcggccaacgttattacatctgatacatggaaaggtaaaagagttctacagctaccagaatgaagcggtagctattgaaaatatcaagaggggactcgcatccctgttccagactcagctgtctagtggtactacaaacgaggtcgacataagtggaaattgcaaggtgacgtatcaggcacatcaggacaaggtgataaagattaaggcccttgacagttgtaagatcgccaggagtggcttcacaacgccgaatcaggtgcttggggtgtcctccaaggccacctccgtcacaacatataagattgaagattcctttgtcatagccgtgttagctgaggagacgcacaactttggcctgaactttttgcagaccatcaagggcaagatcgtatcaaaacaaaagcttgagttgaagacaaccgaggctgggccgcggttgatgtcaggaaaacaggctgccgcaataatcaaggcagtggactccaagtacacagcaattccaattgtggggcaggtttttcagtcccattgcaagggctgcccttccctgtcagagctgtggcgttcaacacggaaatatcttcagccagataatctatcaaaagctgaagcggtgcgcaacttccttgcttttatccagcatttgaggacggccaagaaagaagagattctccagatcttgaaaatggagaataaagaagttttacctcagctcgtcgacgcagtcaccagcgcacagacctcagactctctcgaggccattcttgattttctcgattttaagtctgatagcagcatcattctgcaagagaggttcctgtacgcatgtgggttcgcctctcacccaaatgaggagctgctgagggcactgattagtaagttcaaggggagtatcggctcgtcggacattcgggaaacagttatgatcataactgggacgctcgtaaggaaactatgccagaatgagggatgcaaactgaaggcggtggtcgaggcaaagaaactgattctcggtggccttgaaaaggccgaaaagaaggaggatacacgcatgtacctgttggcgctgaaaaatgctttgctcccagagggcatcccaagcctcctgaagtatgctgaagcaggtgaggggcccatcagccacttggctacgactgctcttcagcgctacgatttgccctttatcaccgacgaggtcaagaagaccctaaacagaatctatcatcagaacaggaaggtgcatgagaagaccgtcagaacagccgctgccgcgatcatcctcaacaacaaccctagctatatggacgtcaagaatattctcctgagcattggggagctgccccaagagatgaacaaatatatgctcgccatcgttcaggacattctgcgattcgagatgcccgcatcgaagatcgtgagaagggtcctgaaagagatggtggcacataactatgaccggttctccagatctggcagctcctcagcgtacacaggatatatagagcgtagcccgcgttctgcatcaacgtactctctggatatactttattccgggtctggcatcttgcgtcgttctaatcttaatatctttcagtacatcggaaaagcaggactccacggttcacaggtagtcatcgaggctcagggactcgaagctcttattgctgctacaccagacgagggggaggagaatttggatagctacgcagggatgtcagccatcctcttcgatgtgcaactcagaccggttaccttcttcaatggctactctgatctaatgagcaaaatgttatctgcatcaggcgaccctatttctgttgtaaagggactgatcctgctgatcgaccattcccaagagctgcagctgcagtctggactgaaagccaatatcgaggttcagggggggctggcaattgacattagtggagcaatggaattctcactctggtatcgggagagcaaaaccagagttaaaaatcgagtgacagttgtcattactaccgacataaccgtagactcttcctttgtgaaagccggactagagacttctacagagaccgaagccggactcgaatttatttcaacggtacagttttctcagtacccattcttggtgtgcatgcagatggataaagacgaggccccattccggcaattcgaaaaaaagtacgagcgcttgagcaccggccgcggctatgtatcccagaagaggaaagaatcggtactcgcaggatgtgagtttccattacaccaggagaactccgagatgtgtaaagtggtttttgccccccagccagacagcacatcgtccggctggttt

SEQ ID NO: 16782 - DNA, 2682 bp, Artificial Sequence
  Description of Artificial Sequence: Synthetic coding sequence
atgattcttctggccgtgctttttctttgtttcatttcttcctactcggcatcagtgaagggccatacgaccggactgtcacttaacaatgatcgtctctacaaactcacctacagcaccgaagtgcttcttgatagaggtaaaggcaaactccaagactctgtcgggtaccgcatctcctcgaatgtggatgtggccctcctttggcgcaatccagacggtgatgacgaccagctgattcaaattacgatgaaagacgtcaatgtcgaaaacgttaatcaacaaagaggagaaaagtcgatcttcaagggtaagtccccttcgaagataatgggcaaggagaatcttgaagcactccagcggcctaccttgctgcacctgattcatggcaaagtgaaagaattctactcctaccagaacgaggctgtcgcgattgaaaacatcaagcggggactggcatcgctcttccaaacccagctttcatcgggaactaccaacgaggtcgatatctccggcaattgtaaagtgacctaccaagcacatcaggacaaggtcattaagataaaagcacttgattcctgtaagattgccagatccggatttactaccccaaaccaggttctcggtgtgtcatcaaaggcaacgtccgtcactacttataagatcgaagattcgttcgttatcgcagtccttgccgaagagactcacaatttcggtctgaatttccttcagactatcaagggaaagattgtcagcaagcaaaaacttgagctcaaaaccaccgaagcgggtccacgactgatgtcaggtaagcaagccgcggcgattatcaaagcagttgattcaaaatacactgccatccctatcgtgggtcaagtgtttcagtctcactgtaaaggatgcccatcgctttcggagctttggcggtcgacgcggaaatacctgcagcccgataacctgagcaaagctgaagccgtcagaaacttcctggcatttatccagcacctgaggaccgcaaagaaggaagaaatcttgcaaatcctgaagatggagaacaaagaagtgcttcctcagttggtggacgcagtgacttcagcccaaacctcggatagcctggaggctatcctggattttctggactttaagtccgactcgtccattattctgcaggaaagattcctttacgcctgtggttttgcatcgcatcccaacgaggaactcctcagggcccttattagcaagttcaaggggagcatagggtcgtcagatatacgtgaaacggtgatgattatcactggaaccctcgtgaggaagctgtgccaaaacgagggttgcaagctcaaggcagtggttgaggcgaaaaaactgatcctgggcggccttgaaaaagctgaaaagaaagaggacacccggatgtatttgctggcgcttaagaacgccctgctcccggaaggaataccttccttgcttaagtacgcagaagcgggtgaaggtcccatttcgcatcttgcaaccaccgcgcttcagcggtacgatcttccttttatcactgatgaagtgaaaaagacgcttaatcgcatttaccaccagaatcgcaaggtccatgaaaaaactgtgagaaccgccgcagcagccattattctgaacaacaacccttcatacatggatgtgaagaacatactgctgtccataggtgaactccctcaagaaatgaacaagtacatgcttgcaattgtgcaagacatcctgcggtttgagatgccggcctccaaaattgtgcgccgtgtactcaaggagatggtggcacacaactacgatagattctcgaggtccggtagctcatccgcgtacaccggatacattgaacgttcacctaggtcggcgtcaacctactcactggacatcctctattcaggatcggggatcctgcgacgttcgaatctcaacattttccagtacatcggcaaagcaggactgcatggttcacaggtggtcattgaagcgcaagggcttgaggccctgattgcagctactcctgatgaaggagaggaaaacctggattcgtacgctgggatgtccgcaatcctcttcgatgtccaactcagaccagtgacctttttcaacggatactccgatctgatgagcaaaatgctgtcggcgtccggagatcctatctcggtggtgaaagggttgattctgttgatcgatcattcccaagaacttcaactccaatctggtctgaaggctaacatcgaagtgcaaggtggtcttgcaattgatatcagcggggcaatggaattcagcctgtggtacagggaatcgaaaactagagtgaagaatagggtgactgtggtgatcactaccgatattacggtcgacagctcgttcgttaaagcaggcctggagacttcgactgagactgaggcaggtttggaattcatttccactgtgcaattttcccagtacccttttcttgtctgtatgcagatggataaagatgaagcgccgttcagacagtttgaaaagaagtacgagcggctcagcacgggtagggggtacgtctcgcaaaaaaggaaggaaagcgtgctcgccggctgtgaattccctcttcatcaagaaaactccgaaatgtgtaaggtggtctttgcaccgcagccggactcgacttcaagcggttggttc

SEQ ID NO: 16783 - DNA, 2682 bp, Artificial Sequence
  Description of Artificial Sequence: Synthetic coding sequence
atgattctgctcgcggtgcttttcctctgtttcatctctagctacagtgccagtgttaaggggcacaccacagggctgtcgctgaacaatgatcggctctataaactgacatactccacagaggtcctgttagaccgcgggaaaggtaaactccaagacagcgtgggctatcggatatcatccaacgtcgatgtggccctgctctggagaaatccagacggggacgacgaccagctcatccagataaccatgaaagacgtgaatgtagagaatgtgaaccagcagaggggcgagaaatccatctttaagggaaagtctccctcaaagataatgggtaaggagaacctcgaggccctgcagagacccacgcttctacatctcattcatggtaaggtaaaagagttttattcctatcagaatgaggccgtggccattgagaacatcaagcggggactcgcctctctgtttcagactcagctgagttctgggactactaatgaggtagacatatcaggcaactgcaaagtcacgtatcaagcccaccaggataaagttattaagatcaaagcactggacagttgtaaaatcgcccgatctggattcaccacccctaaccaggtgctgggagttagctctaaggcgacctccgtgacaacctataagatcgaggactcattcgtcattgctgttttggctgaggaaacacacaacttcggtctgaatttcctacagactatcaaaggtaagattgtgtccaaacagaaattggagttgaagaccacagaggccgggcctagactcatgtcaggtaaacaggcagctgcgatcattaaagctgttgatagtaagtatactgccatcccaattgtaggtcaagttttccagtctcattgcaaaggctgcccaagcttatccgagctttggcgttccacacggaaatacctgcagccggacaacttgtcaaaggcagaagcagtgagaaatttcctagcttttattcagcaccttcgaaccgcaaaaaaggaggaaatcctgcagatccttaagatggagaacaaagaagtgctgccacagttagtggacgcagtcacctcggcccaaacgagcgactcgctggaagcaatactcgatttcctggatttcaagtcggacagcagcattattctgcaggagagatttttgtatgcctgcgggtttgccagtcatccgaatgaggagctccttagagccctcataagcaaattcaaaggttctatcggcagtagtgatattcgggagaccgtcatgattattaccggaacactggtacgaaagctctgccagaatgaaggatgcaagctgaaagctgtggttgaggccaagaaactgattcttggcggcctggaaaaagccgaaaagaaggaagacacgaggatgtatttgctcgcactgaaaaacgcactgttgccggagggcatcccatccttactgaaatatgcagaggcgggagaaggccccataagtcacctcgcaacaaccgccttacagaggtacgacttgccattcatcactgatgaggtaaagaagacactgaatcgcatctaccaccaaaaccgaaaagttcacgaaaaaactgtgcgcacggccgctgcagccataatacttaacaataacccctcctacatggacgtcaaaaacattctgctctctataggggagcttccccaggagatgaataaatatatgctagcgatcgtccaggatattctacgattcgaaatgccagcgtctaaaatcgtgcggagagtgctaaaagaaatggtggcccataactatgacagattttctcgaagtggcagctctagtgcctacaccgggtacatcgagcgaagcccaagaagtgcttcaacatatagtctggatattctctactccgggagtgggatccttagacgtagtaacctcaatatcttccagtacatagggaaagccggacttcacggatcacaggtggtgattgaagctcagggactggaggcattgatagcagccacaccggacgaaggagaagagaacctcgattcctacgccggcatgagcgcgattctgttcgatgttcaactgcgccccgtgacgtttttcaatgggtatagcgatcttatgtcaaagatgttgtccgcatcgggggaccccatctcggtggtaaagggactcatcctcctgattgaccactcccaggagctacagctgcaaagtggtctgaaagccaacattgaggtgcaaggaggcctggcgattgacatatcaggcgccatggaattctccctctggtaccgggagagtaagactcgtgtgaagaatagagttactgtggtcatcaccactgacatcactgtcgattcctccttcgttaaagcgggcctggagaccagtacagagaccgaggccggcctggagtttatctccactgtgcagttttctcaatacccttttcttgtttgtatgcagatggataaggatgaagccccctttagacagttcgaaaagaagtacgagcggctgagcaccggcagagggtacgtcagtcagaaacgaaaagagtctgttctggctggctgcgagtttcctctgcaccaggagaatagcgaaatgtgtaaggtagtcttcgctccacagccagactccacctcctccggctggttc

SEQ ID NO: 16784 - DNA, 2682 bp, Artificial Sequence
  Description of Artificial Sequence: Synthetic coding sequence
atgatccttctggcggtgctgttcctctgtttcatctcttcgtacagcgcgagcgtgaaaggccacaccactggtctttcgctcaacaatgacaggctgtataagctcacctacagcaccgaagttttgctggaccgcggaaagggaaagctgcaagatagcgttggataccggatatcctccaacgtggacgtcgcactgctttggcgcaatccggacggcgacgacgatcaacttatccaaatcactatgaaggacgtcaatgtggagaatgtgaatcagcagcggggcgagaaaagcatcttcaaggggaagagcccttctaaaatcatgggaaaagaaaacttggaagccctgcagcggccgactctgctgcacctgatacatggaaaggtgaaagaattctactcctaccagaacgaagcagtggcgattgaaaacatcaagcgcgggctggcctcacttttccagacgcagttgtcgtccggcacgaccaatgaggtcgacatctcaggtaactgtaaagtgacctaccaagcccatcaagacaaggtgattaagatcaaggccctggattcatgcaaaatcgccagatccggattcaccactcccaaccaggtgctcggcgtctctagcaaagccacgagcgtcactacctataagatagaggatagctttgtgatcgctgtgctggcggaagagactcacaactttgggctcaactttctgcagaccatcaagggcaagatcgtgtcaaaacagaaacttgagctgaaaacgaccgaagctggtccgagactgatgtcagggaagcaagctgccgcgattatcaaggccgtcgattcaaaatacaccgccatcccaatagtggggcaggtgttccagagccactgtaaaggatgcccaagcctgtctgagctgtggcgttccacccgcaagtacctccagcccgacaatctgtccaaagccgaagccgtgcgcaactttctggcgttcatccagcatctccgcaccgccaagaaggaagaaatccttcaaatcttgaaaatggagaacaaggaggtgctgcctcagctggtcgatgcagtgactagcgcgcaaacctcggactcacttgaggccattcttgatttcctcgacttcaagtccgactcctcgatcatcctccaagagagattcctgtacgcctgtggttttgcctcgcatccgaacgaagaacttctgcgggccctcatctcaaagtttaagggatccatcggatctagcgatatccgcgagactgtgatgatcattacggggaccctcgtgcggaagctgtgccaaaacgagggatgcaaactgaaagcggtggtggaagcaaagaagctcatcctgggcggactggagaaagccgaaaagaaggaggatacgaggatgtacctcctggctctgaaaaatgcactgcttccagaggggatcccgtccctgttgaagtacgctgaagcgggggagggtccaatctcacatctggctaccactgcactgcaacggtacgatctgccgttcatcactgacgaagtgaaaaagaccttgaatcgaatctaccaccagaacagaaaggtgcacgaaaagaccgtcagaaccgctgccgcggccatcattctgaacaacaatccatcctacatggacgttaagaacatcctcctgagcatcggcgaattgccgcaggagatgaacaagtacatgctcgcgatcgtccaagatattctccggttcgagatgccggctagcaagatcgtccggagggtcttgaaggaaatggtcgcccacaactacgacaggttttcacggtcgggctcttcttcagcatacaccggctacatcgaacgctcgccgaggtcggcttcgacttattccctggatattctgtactcgggctccggaatccttcgcagatcgaacctgaatatctttcagtacatcggaaaggcgggcctccacgggagccaagtggtgatcgaggcacagggccttgaggctcttatcgcagccacccccgatgaaggagaagaaaatctcgactcgtacgcgggaatgtcggcgatcctgtttgacgtgcagttgcgcccggtgactttcttcaatggatacagcgacctgatgtcaaagatgctctcagcttccggagatccaatctcggtcgtgaaggggctcatcctcctcatcgatcattcgcaagaactgcaactgcagtcgggattgaaggcaaacatcgaggtgcagggcggcctcgctattgacatttccggagctatggaattctcattgtggtaccgcgaatccaagacgagagtgaagaatcgcgtcaccgttgtcatcacgacggatatcaccgtcgactcctctttcgtgaaagcgggactggaaacttcgaccgagactgaagcagggttggagttcatctcaactgtccagttcagccagtaccctttcctggtgtgcatgcaaatggataaggacgaggcaccgtttaggcaattcgaaaagaagtacgagcgactgtcaaccggaagaggatacgtgtcccaaaagcggaaggaaagcgttctggcgggatgcgaatttccgctgcaccaggagaactccgaaatgtgcaaggtggtgttcgccccacaaccggactccacctcctcgggttggttc

SEQ ID NO: 16785 - DNA, 2682 bp, Artificial Sequence
  Description of Artificial Sequence: Synthetic coding sequence
atgatcctgcttgccgtgctgttcctttgtttcatctcgagttactcagcgagcgtgaagggtcacacgactggactgagcctgaataatgatcggctctacaagctcacctactccaccgaagtcctcttggataggggaaaaggaaagctgcaagactcggtgggataccggatctccagcaatgtggacgtggcgctcttgtggcgcaacccagacggagatgatgatcaactgattcagatcacgatgaaggatgtgaatgtggaaaacgtgaaccaacagcggggagaaaagtccatcttcaagggcaagtccccgtcaaagatcatgggtaaggaaaaccttgaagccctccaacggccgactctgctgcatcttattcatgggaaggtgaaggaattctactcctaccagaacgaggcagtcgccatcgaaaacatcaagagaggactggcatccctcttccaaactcaactctcctcaggaactaccaatgaagtggacatcagcggaaactgcaaagtgacgtaccaggcgcatcaggataaggtcatcaagatcaaggctcttgactcgtgcaaaatcgcacggtcggggtttacgactccgaaccaagtcctcggagtgtcctcgaaagcaaccagcgtcacgacttacaagattgaggactcgttcgtcatcgccgtgctggctgaggaaacccacaatttcgggttgaatttcctgcaaaccatcaagggtaaaatcgtgtcgaaacagaagctcgaactgaaaaccactgaagcagggccgaggcttatgagcggaaagcaggctgccgcaattatcaaagccgtggacagtaagtacactgccatcccaatcgtgggccaagtgttccagagccactgcaagggatgcccgtcactgagcgaactgtggcgctccactaggaagtacctgcagccggacaacttgtccaaagccgaagcggtgagaaacttcctcgcctttatccaacaccttcggactgcgaaaaaagaggaaatcctgcagattctcaaaatggaaaacaaagaagtgctgcctcagctggtggacgcggtgacttcggcacagacttcggatagcctggaagcgatcctggattttctggacttcaagtccgattcatcaatcatcctgcaagagagatttctgtatgcctgtggctttgcttcccatccgaacgaagaactcttgcgcgcactcatctcgaagtttaagggttcaatcggatcatcggacattcgcgaaaccgttatgattatcaccgggaccctggtgcgaaagctctgccaaaatgagggctgcaagctgaaggccgtggtggaggcgaaaaagctgatcctgggcggactcgagaaggccgagaagaaggaagatactaggatgtacctcttggctctgaagaacgccctgctcccggaaggaatcccatctctgctcaaatacgcagaagcaggagagggaccgatctcgcatctggccactaccgctttgcagagatacgacctgcctttcattactgacgaggttaaaaagaccttgaaccgcatttatcaccagaaccgcaaggtccacgagaaaaccgtgcgcaccgcagcagccgccatcatcctgaacaataacccttcgtacatggatgtcaagaacattttgctcagcatcggagagcttccccaggagatgaacaagtacatgctggccatcgtccaggatattctgcgcttcgaaatgccggcctccaaaatcgtgaggcgggtcctgaaggagatggtcgcccacaactacgaccgcttctcccgctccggatcctcctccgcgtacaccggctacatcgagcgaagcccacgctctgcgtcgacttacagcctggatatcctttactcggggtcgggaatcctcagaagatcaaatctcaatatcttccagtacatcggaaaggctggcctccacggttcacaggttgtgatagaggctcagggcctggaggcccttatcgccgcgacccccgatgagggagaggaaaatctggacagctacgctggcatgtcggctatcctgtttgacgtgcagctgcgtccagtgaccttcttcaacggatactcggacctcatgagcaagatgctcagcgcctcaggtgaccccatttctgtcgtgaaaggactgattctgctgatcgaccactcgcaagaactccagctgcagtcgggactcaaagcgaacatcgaggtgcaaggcggcctggcgatcgatatcagcggtgcgatggaattctcactctggtacagagagtcaaagacccgggttaagaatcgggtgactgtcgtgatcaccactgacatcaccgtcgactcctccttcgtgaaggccgggctggaaacctcaactgaaaccgaggcagggctggaattcatctcaaccgtccagttttcccagtatcctttcctggtctgtatgcagatggacaaggacgaagcgccctttcggcagttcgagaagaaatatgaaagattgtcgaccggccggggctacgtgagccaaaagcgcaaagagagcgtcttggccggatgcgagttccctctgcatcaggagaacagcgaaatgtgcaaggtggtattcgctccgcaaccagactcgacgtcgtccggctggttt

SEQ ID NO: 16786 - DNA, 2682 bp, Artificial Sequence
  Description of Artificial Sequence: Synthetic coding sequence
atgatactgctggccgtcttatttctgtgttttatcagctcttactccgcatccgtgaaggggcacaccactgggctctcccttaacaacgaccgcctgtataaactgacatatagtaccgaagtgttacttgaccggggtaaggggaaactacaggacagtgtggggtaccggatatcctctaacgttgatgtggcactgctctggaggaacccagacggtgacgacgatcagctaattcagataaccatgaaggatgttaatgtggagaatgtcaatcaacagcgcggcgaaaaatcaattttcaaaggtaagtctccaagtaagataatggggaaggagaatctcgaagccctgcagcggccaacattactgcaccttatacatggcaaagtaaaagagttctatagttaccagaatgaggctgtggctattgaaaacataaaacggggcctggctagtctgttccaaacccagctgtcctcaggaaccaccaacgaagttgatatatccggcaattgtaaggtgacctatcaagcccaccaagataaggtcattaaaataaaagccctcgacagctgtaaaatcgctcgatctggatttacaaccccaaatcaggtgcttggggtgagtagcaaagctacttccgtgacaacatacaagattgaagatagcttcgtgatcgccgtgttggctgaggagactcacaatttcgggctgaacttcctgcagaccattaagggcaaaattgtgagcaaacagaagctcgaattaaagactactgaggcagggccaagactgatgtccggcaaacaggctgcagcaatcatcaaagctgtggactctaaatacaccgccataccaatcgtgggacaagtgtttcaatcccactgcaaaggctgtcccagtctgagcgagttatggcgttctacaaggaaatacctgcagccagataacctgagcaaagctgaggcagtgagaaattttctggcttttatccagcatttacgcactgccaaaaaagaagaaatactgcagatcttaaaaatggaaaataaggaggtgctgccacagctggttgacgccgtgaccagcgctcaaaccagtgactcactggaggcaatcttggattttctggatttcaagtcagatagcagtattatcttgcaggaacgctttttatacgcctgtggctttgcaagtcatcctaacgaagagctgttacgcgctctgatctccaaatttaaagggtccataggcagttccgatattcgggagacagtgatgattataaccggcactctggtgcgcaagctgtgccagaatgagggatgcaagttgaaggcagttgtggaagcaaagaagctgattctgggtggcttagaaaaagcagaaaagaaagaggatacccggatgtacctactggcactgaagaacgcactgctgccagagggaatccctagcctactcaagtacgcagaggccggagaagggcctatctcccaccttgcaaccaccgctctccagcgctacgatttaccatttatcactgatgaagttaaaaagacactgaatcggatataccaccagaaccgcaaggtgcacgagaaaactgtacgcacagcagctgctgctattattttaaataataatccatcctatatggacgtgaagaatatactgctcagtattggcgagctgcctcaggagatgaataaatatatgctggctatagtgcaggatatactgaggttcgaaatgccagcttctaagattgttcgaagggtgttaaaagaaatggtggcacataactacgaccggttctcccgctccggctcttcctctgcttacaccgggtatatcgagcgttccccccgctctgccagcacctacagtctggacatactgtactcagggagcggcatactcaggaggtctaatcttaatatttttcaatacattggcaaggccgggctgcacgggagccaggttgttattgaggcccagggattagaagccctgattgctgcaacccccgacgaaggagaagaaaatctggacagctacgcaggaatgagcgccatcttattcgacgtgcagctgaggcctgtgactttttttaatggctatagcgatctgatgtcaaaaatgctgagcgcaagcggcgacccaatcagtgttgttaaaggcctgatcctgctgatagatcacagtcaggagctgcagctgcagagcggcctaaaggctaacatcgaagtccagggcggtctggcaatagatataagcggcgccatggagttctccctgtggtaccgagaatcaaaaacacgcgtgaaaaatcgagttaccgtagtgatcacaactgatatcactgtggactctagcttcgtgaaggctgggctagagacatccaccgagacagaggctgggcttgagttcattagtaccgtgcaattctctcagtacccatttttggtgtgcatgcaaatggataaagatgaggcacctttcaggcaattcgagaagaagtacgagcgactgagtactgggaggggctacgtgtctcaaaagaggaaggagtccgtgctcgccggctgcgaattccccttgcaccaggaaaattcagaaatgtgcaaggttgtgtttgcccctcagcctgactccacttcctcagggtggttc

SEQ ID NO: 16787 - DNA, 2682 bp, Artificial Sequence
  Description of Artificial Sequence: Synthetic coding sequence
atgatccttttggccgtgctgttcctctgttttatctcttcttactcagcatcagtgaaaggccatacgactggactctcactgaacaacgaccggctgtacaaactcacttactcgaccgaggtgttgctggaccgtggtaaaggaaagctgcaggactcggtcggatacagaatcagctcaaatgtggacgtcgcgctgctttggaggaacccagacggtgacgatgaccagcttattcaaattaccatgaaagatgttaacgtggaaaacgtcaatcaacaacgcggagagaaatctattttcaaaggtaaatccccgtcaaagattatgggaaaggaaaacctcgaagcccttcaacggcctactctcctgcacctgattcatggaaaggtgaaagaattctatagctaccaaaacgaagcagtggccatcgaaaacattaagcgtggactggcatccctttttcaaactcaactctccagcggaaccactaatgaagtggacatttcaggcaattgtaaagtgacttaccaggcacatcaagacaaagtgatcaagattaaggcactcgattcctgtaagatcgcacgatccgggttcacgaccccgaaccaagtcctcggagtgagctcgaaggcaacctcagtgactacttacaaaattgaggatagctttgttatcgcagttctcgccgaagaaactcacaattttgggctcaatttccttcaaacgataaaaggcaagattgtgtcgaaacagaagttggaacttaagaccactgaggcaggaccccgtcttatgtcgggaaagcaagcagctgcaattatcaaggctgtggacagcaagtataccgctattcctattgtcggccaggtgttccaatcccactgtaagggttgtccctcgctttccgaactctggagaagcactaggaagtaccttcagccagataacctgtctaaggcagaagcagtcagaaactttctggcattcattcaacatctgcgtaccgccaagaaggaagaaatcttgcaaatccttaagatggaaaacaaggaggtgcttccccaactggtggacgcagtcacttcggcccaaacttcggactccctggaagccattctcgattttctggatttcaaatccgattcgtcgattatcctccaggaaagatttctgtacgcgtgcggatttgcatctcatcctaatgaagaactgctccgcgcccttatatccaagtttaagggctcgattggttcgtccgacattcgtgaaaccgtaatgataatcacgggaaccctggtgagaaaactttgccaaaacgaaggctgcaagctgaaggcggtggtggaagcaaaaaagctgattctgggaggtcttgaaaaggccgagaaaaaagaagataccagaatgtaccttttggcactcaagaatgcactgcttccggagggcatcccttcacttctcaagtacgcagaggccggggaagggcctatttcccatcttgccaccactgctctgcaacggtatgaccttcctttcattactgatgaagtgaaaaagaccttgaaccgcatttaccatcaaaatagaaaagtgcatgaaaagaccgtgaggaccgcagcagcagcgattattctgaacaataatccaagctacatggatgtgaagaacattttgctgagcattggtgaacttccacaggaaatgaacaaatacatgcttgcaattgtgcaggatatactgagatttgaaatgcctgcatcaaaaatcgtgcggcgggtccttaaggaaatggtggcacataactacgacagattttcaagatccggttcgagctcagcatacactgggtacattgaaagaagcccacgctctgcctcaacctattcactggacattctctattcgggatccggtatcctgcgccgttcaaatctgaacatctttcagtatattggaaaggcaggtctgcatgggagccaagtcgtgattgaagcccagggccttgaggcgcttatcgccgccactcctgatgaaggagaagaaaacctggatagctacgccggtatgagcgccatcctctttgatgtgcagcttagaccagtgaccttcttcaacggctacagtgatctgatgtctaagatgctttccgcgagcggagatcccatttcagttgtcaaaggtttgattcttcttatcgatcattcgcaggagcttcaactgcagtccggtcttaaggctaatatcgaggtgcagggtggcttggcgatcgacatttcgggtgccatggaattttcgctgtggtacagggaaagcaagaccagagttaagaatcgggtgaccgttgtcattactacggatataactgtggattcctcgtttgtgaaagcaggactggaaacctcgaccgaaaccgaggcgggacttgaattcatttctactgtgcaattcagccagtacccatttctggtctgtatgcagatggacaaagatgaagctccttttcgccagttcgagaagaagtacgagcgcctgagcaccggacgcggatacgtgtcacaaaagagaaaggaatccgtcctggcaggatgtgagttccctctgcatcaagagaactcggaaatgtgcaaggttgtgtttgccccccagcccgactcgacttcgtcaggatggttc

SEQ ID NO: 16788 - DNA, 2682 bp, Artificial Sequence
  Description of Artificial Sequence: Synthetic coding sequence
atgatcctcctggcggtgctctttctgtgcttcatttcctcctactcggcgtcggttaaggggcacactactgggctgagcctcaacaacgatagactctataagctcacttactcaactgaggttctgctggaccgcgggaaaggaaagctgcaggactccgttggatacagaatctcgtcgaacgtggatgtggcacttctgtggcgtaatccggatggtgacgacgaccaactgatccagatcacgatgaaggatgtgaatgtcgaaaatgtgaaccagcaacgcggagagaaatcgatcttcaaggggaagtcgccttccaaaatcatgggaaaagaaaaccttgaagcactgcagaggccaactctcctgcacctcatccacggaaaggtgaaagaattctattcgtaccagaatgaggcggtggcgatcgagaacatcaaacggggactggctagcctgttccagacccagctgtcatcaggcaccaccaatgaggtggacatctcagggaactgcaaggtgacttaccaggcccaccaagataaagtgatcaagatcaaggcgctcgattcgtgcaagattgcgagatctggattcacgacgcccaaccaggtccttggcgtttcctcaaaggccacctccgtgacgacttacaaaatcgaagatagcttcgtaattgctgttctggccgaagaaacccacaacttcggactgaacttccttcaaaccattaagggaaagatcgtgtcaaagcaaaagctcgagttgaaaaccaccgaagccggtcctcgtcttatgagcggaaagcaggccgccgcaatcatcaaggctgtggatagcaagtacactgccatcccgatcgtgggccaggttttccaaagccattgcaaggggtgcccgtcattgagcgagctctggcgctcgacccggaagtacctgcagccagataacctcagcaaagcagaagcggtccggaacttcctggcattcatacaacatctccgcactgccaagaaagaagaaattctgcagattttgaagatggagaacaaggaggtgcttcctcagctcgtggatgcggtgacctcggcccagacctcagactcattggaggcaatccttgactttttggatttcaagtcagactcgtccattatccttcaagagcggttcctgtacgcctgcggattcgcatcgcatccgaacgaagagcttctccgggcgctcatctcgaaattcaagggttcgattggttcctcggacatccgggagactgtcatgatcatcactggaactcttgtgcggaagctctgccagaatgaaggctgcaagctcaaggccgtagtcgaagcgaaaaaactgatcctcggaggactcgaaaaggccgaaaagaaagaggacactcggatgtacctgctggccctgaagaatgctctcctgccggagggaatcccatctctgctcaagtacgccgaggctggagagggacccatctcccatctggcaaccaccgctctgcagcggtacgatctgcccttcatcaccgatgaggtgaagaaaactttgaacagaatctaccatcagaaccggaaggtgcatgaaaagactgtgcgcacggctgccgcagccatcatcctgaacaacaatccgagctatatggacgtcaagaatatcttgttgtcaatcggcgaactcccgcaagagatgaacaagtacatgctggcgatcgtgcaagacatcctgaggtttgagatgccggcctccaaaatcgtccgtcgcgtactgaaggaaatggtcgcgcacaattacgaccgatttagccggtcaggctcaagctccgcctacaccggttacattgaacgctcgccgcgcagcgcctcaacctactcgctggacatcctctactcaggttccggaatactcagaagaagcaatctgaacatctttcaatacatcggcaaagccgggctgcacgggtcacaggtggtgattgaagctcagggcctggaggccctgatcgccgcgacgccagatgaaggagaagagaacctggactcctacgctgggatgtctgctatcctcttcgacgtgcagctgcgcccggtgaccttctttaacgggtactccgacctgatgagtaagatgctgtccgcaagcggcgatcctatttccgtggtgaaggggctgatcctgctgatcgaccactcgcaggaactgcagctgcaatcaggcctcaaggcgaatatcgaagtgcaaggggggctggcaatcgatatttctggcgcgatggaattcagcttgtggtaccgcgaatccaagaccagagtgaagaatcgggtgaccgtcgtgatcactacggacatcaccgtggactcgagcttcgtgaaggcagggctggagacttccactgagactgaggcgggactggagttcattagcaccgttcagttcagccagtacccattcctggtctgtatgcagatggataaggacgaagccccgttcagacaatttgagaagaagtacgaacgtctcagcactggaaggggctatgtcagccaaaagaggaaggaatccgtgctcgctggctgcgaatttccactgcaccaagaaaactccgagatgtgtaaggtcgtgttcgcacctcagccggacagcacgtcctcgggctggttt

SEQ ID NO: 16789 - DNA, 2682 bp, Artificial Sequence
  Description of Artificial Sequence: Synthetic coding sequence
atgatcctcctggccgtactcttcctgtgtttcatctcgtcgtattcagcctccgtcaagggacatactaccggactctccctgaataacgacagactctataaacttacttacagcacggaggtcctcctcgacagaggaaagggcaaactgcaggattccgtgggatacagaatatcttccaatgtggacgtggccctgttgtggagaaatccggatggtgacgacgatcagttgatccagatcacgatgaaggacgtgaatgtcgagaacgtgaatcagcagcggggcgaaaagtccatctttaagggaaagtcaccctcgaagataatgggaaaagagaacctggaagccctgcagaggccaactctgctccacctgatccacggaaaggtgaaagagttctacagctaccagaacgaagcggtcgccattgagaatatcaagaggggactggcatcacttttccagacgcagttgtcgtcaggcaccactaacgaagtggacatctcaggcaactgcaaagtgacttatcaggctcaccaggacaaggtgatcaagatcaaggccctggactcttgcaagattgcaagatcgggattcactaccccgaatcaggtgctgggagtgtcaagcaaagcgactagcgtgactacgtacaagatagaggattcatttgtgatcgccgtgctcgctgaagaaacccataacttcggcctgaacttcctgcagaccatcaaagggaagattgtgtccaagcagaagctcgaactgaaaaccaccgaagcgggcccgcgcctcatgtcaggaaagcaagctgccgccatcattaaggctgtcgactcaaagtacactgcgatcccaattgtgggccaggtgttccagagccactgtaaggggtgcccgagcctctccgaactgtggcggtcgacccggaagtacctccaacccgacaatctttcgaaggctgaggctgtcaggaattttctggcattcattcaacacctcaggactgcgaagaaagaggaaatccttcaaatactcaagatggaaaacaaagaggtgctgcctcaacttgtcgatgcagtgactagcgcacagacctcagactcgctcgaggcgatccttgacttcttggactttaagtctgactcatcgatcatcctccaagaacgttttctttacgcctgcggattcgcaagccatccgaacgaggagctcctgagagctcttatcagcaaattcaagggatcaatcggctcctcagatatccgcgaaactgtgatgattatcactggaacccttgtacgcaagctctgccaaaacgaggggtgcaaattgaaggcagttgtggaagccaagaaactcatcttgggaggactcgaaaaggcagaaaagaaagaagatactcggatgtatctgcttgcattgaagaatgccctcctgccggagggaatcccaagtttgcttaagtacgcggaagccggtgaaggtcctatctcccacctggctaccacggctctccaacgatacgacctcccgttcatcaccgacgaggtgaaaaagaccctcaatcgcatctatcaccagaacagaaaagttcacgagaaaaccgtccgcaccgccgccgcggccattattctgaacaacaacccgagctacatggacgtgaagaacatcctcctgtccattggagagctgccacaggaaatgaataagtacatgctggccatcgtgcaagatatcctgcggtttgaaatgcctgcgtccaagattgtacgccgcgtcctgaaagagatggtcgctcataactacgaccgatttagccggtcgggtagctcctcggcgtacaccgggtatatcgaacgatccccgcgtagcgcatcgacttactccctcgacatcctttactccgggagcggtattctgcgtagatcaaacctgaacattttccaatacatcggcaaggcagggctgcatgggtcgcaagtcgtcatcgaagcgcaaggcttggaagcactgatcgctgccacgccagacgaaggtgaagaaaacttggattcttacgcaggaatgtcagcgatcctgttcgacgtccagctgaggccggtcacgttcttcaacggctacagcgacctgatgtcaaagatgttgagcgcctctggagatccaatctccgtggtgaaaggattgatcttgctgatcgatcattcacaggagctgcaactccagagcggcctcaaggccaatatcgaggttcagggaggactcgccatcgatatctcgggcgcaatggagttttctctctggtaccgcgagtcaaagactcgcgtcaaaaatcgcgtcactgtggttattaccaccgatatcaccgtggattcatcgtttgtgaaggcgggcctggagacttcgaccgaaaccgaggcgggtctggagttcattagcacggtccagttctcgcaataccctttcctggtgtgtatgcagatggacaaggacgaggcgccctttcggcaattcgaaaagaagtacgaacgcctgtcgaccggaagggggtacgtgtcccaaaagaggaaggaatcggtcctcgctggatgcgaattcccactgcaccaggaaaacagcgaaatgtgcaaagtggttttcgctccacagccggattccacttccagtggctggttc

SEQ ID NO: 16790 - DNA, 2682 bp, Artificial Sequence
  Description of Artificial Sequence: Synthetic coding sequence
atgatactgcttgcagtgctgtttctgtgttttatcagttcttattccgcctcagtgaaggggcatacaaccggtctgtctttgaataatgatagattgtataagctcacatattccacggaggttcttctggatcgaggaaaaggcaagttacaggatagcgtaggttaccgaatcagttcaaatgtggacgtggctttgctttggaggaatcctgatggcgacgacgaccagctgattcaaataaccatgaaggatgtgaatgtggaaaacgtcaatcagcagcgcggggaaaaaagcattttcaaaggaaagtcccccagcaaaattatggggaaggaaaatctggaagctttacagcgtcccaccctgttgcacctgattcatggtaaggtgaaggagttttatagttatcagaacgaagcggtcgctatcgaaaacatcaagcggggcctggcctctctatttcagacacagctctcttctggtactacgaatgaggtggacatctcgggcaactgcaaggttacataccaagcccatcaggataaagtcattaagattaaagccctggattcctgtaagattgcgaggtctgggtttactaccccaaaccaggtgctgggcgtgtcatcaaaggcaaccagcgtgaccacttataagatcgaggacagctttgtgatagccgtgctggcggaggagacacacaattttggcctcaacttcctgcaaacgatcaagggaaaaattgtatcgaagcaaaaactggagctgaagacaacagaggccggtcctcgcctgatgagcggtaagcaagcagctgcaattattaaagctgtcgatagtaagtacaccgcgatccccattgtcggtcaggtgttccagtcacattgcaaggggtgtccctcactatcagagctatggcgctcgacacgtaagtacctgcaaccagacaatttgtctaaagccgaggccgtcagaaactttttggcatttatacagcatctgcggaccgccaagaaggaggagatcctgcagattctgaaaatggagaacaaggaggtcctgccacagttagtggacgcggtaaccagcgcccaaacatctgactctttggaggctattctggatttcttggattttaagagtgatagcagtatcattctccaggaacggtttctatatgcgtgcggcttcgcctctcatccaaacgaagaactgctccgagcactcatctcaaaattcaagggatctataggatcctctgacatcagagaaacagtcatgataatcacaggtacccttgtgagaaagctgtgtcagaatgaaggatgcaagctgaaggccgtggtggaggcgaagaaactaatcctcggtgggctggagaaagctgagaagaaggaggatacgcgcatgtacctactggccctcaagaatgccctcctccccgaaggtatacccagcctcctgaagtacgcagaggccggcgagggccctatatcgcaccttgccaccactgccttacagcgatacgatttgcctttcatcacagatgaggttaaaaagacactgaaccgcatatatcaccagaatagaaaggtgcatgagaaaaccgttcgcaccgcggcggcggccattatcctcaacaataatccttcatatatggatgttaaaaatattcttctgagtatcggcgagctgccacaagagatgaacaaatatatgctggccattgtgcaagatattctcagatttgagatgccagcgagtaagatagtgcgacgcgtgttgaaggagatggtcgctcataattacgatcggttcagccggagcggctctagctccgcttacacaggctacattgagcggtcacccaggtctgcctccacttattcactcgatattctctactcgggcagcggcattctccgaaggtcaaatctgaatattttccagtatatagggaaagccggactgcacggatcccaggtggtcatcgaagctcaggggttggaagcactaatagccgccacccctgacgagggcgaagagaatctggactcttacgcaggtatgagtgctatcttgtttgatgtgcaattgaggcctgtcactttcttcaatggctactcggatttgatgtcaaaaatgctgtctgcaagtggcgacccgatctcagtggtgaaagggctgattctgctcatagatcattcacaagagttgcagctgcaaagcggcttgaaggctaacatcgaggttcagggcgggctggcaatcgacattagtggtgctatggaattctctttgtggtatcgggagagtaaaacacgggtcaagaatagagtgactgttgtcatcaccacagatatcaccgtggattcttccttcgtcaaggccggactggaaacatccactgagactgaggccggtctggagttcatctcaaccgttcaattctcccaatatccttttctcgtgtgtatgcagatggacaaggacgaagctcctttcaggcaattcgagaagaagtacgaacgcctcagcacgggtagaggatacgtttcccagaagagaaaggagtctgtgctcgcagggtgtgagtttccattgcatcaggaaaactctgagatgtgcaaggtcgtttttgccccacaaccagattcaactagctccgggtggttt

SEQ ID NO: 16791 - DNA, 2682 bp, Artificial Sequence
  Description of Artificial Sequence: Synthetic coding sequence
atgatcctgctggcagtcctgtttctttgtttcatatcttcctactccgctagcgttaagggacacacgactggcctgagcctcaataatgatagactgtacaaacttacttactcgactgaagtgctgttggacaggggaaagggaaaactgcaagatagcgtggggtacagaatttcgtcaaacgtggatgtcgccctgttgtggcgtaatccagatggtgatgacgatcaactgattcaaatcaccatgaaagacgttaacgtggaaaatgtgaatcaacagcggggggagaagtccatctttaagggcaagtcgccatcaaagatcatgggaaaagaaaacctcgaagcattgcaacgacctactctgttgcatctgatacatgggaaggtgaaggagttctactcctaccagaacgaagcggtcgcaattgagaacataaaacgaggtctggcatccctttttcagacccaattgtcgtcaggaactaccaatgaggtggacatatccggtaactgtaaagtgacttaccaggcccatcaagacaaggtgatcaagattaaggcgctggactcgtgtaagattgcacggtccggattcactacccctaatcaggttctgggggtgtcatcaaaggcaacctccgtcactacctacaagatcgaagattcgttcgtgattgccgtgctcgcggaggaaacccacaactttggactcaacttcctccagactataaagggaaagatcgtgagtaagcaaaagctggaactgaaaactacggaggcaggtccgcgtctgatgtccggcaagcaggctgccgcgataatcaaggcagtggactctaagtacacggccattcctattgtcggccaggtctttcaatcacattgcaaagggtgcccatccctttcggaactgtggcgctcgacgagaaagtatttgcaacctgacaatctgtcgaaggccgaagcagtgcggaactttctcgcattcattcagcacctgcgcaccgcaaagaaagaggagatcctccaaatccttaagatggaaaacaaagaagtgctgccccaactggtggatgcagtcaccagcgcacaaacctccgactcccttgaagcaattctggattttctggactttaagtcggactcctccatcatccttcaggaaagattcctgtacgcctgcggatttgcttcgcacccgaacgaagagctcttgagggcactgatttcgaagttcaagggttccattggttccagcgatattagggaaactgtcatgattatcaccggtaccttggtgcgtaagctctgtcagaacgaaggctgtaagctcaaagctgtcgtggaagcaaaaaagctgattctcggcggccttgaaaaggcagaaaagaaggaggacactaggatgtaccttcttgcccttaagaacgccctgcttcccgagggaatccctagcctgctcaaatacgcagaagcgggtgaagggccaatttcccatctggcaacgaccgcactccagagatatgacctgcctttcattaccgacgaagtgaagaaaactctgaacagaatttaccatcaaaaccgtaaggtgcatgaaaagaccgtgaggaccgcggctgccgccattattctgaacaacaacccatcctacatggatgtaaagaatattctgctctcgatcggagagctcccgcaagaaatgaacaagtacatgcttgcaattgtgcaagatattcttcgctttgagatgcccgcgagcaagatcgtgcggcgcgtgctgaaggagatggtggcacacaactatgacagatttagcagaagcggatcctcgtcggcctacaccggttacatcgaaaggtcacctagaagcgcctcaacctacagccttgatatcctctacagcgggtccggcatccttagaagatccaacttgaacattttccaatacattggtaaagcaggtctgcatggttctcaggtcgtaattgaagcacagggactggaagcacttatcgcagccactcctgacgaaggggaagagaacctggattcctacgccggcatgtcggccattctttttgatgttcagctccggccagtgaccttcttcaatggatactcggacttgatgtccaaaatgctgtcagcatcgggcgaccctatttcggttgtcaaaggtctgattctccttatagaccactcgcaagaacttcaactgcagtccggtcttaaagcgaacatagaagtgcaaggaggacttgccattgatatttccggtgcgatggaattctccctgtggtacagagagtccaagactagagtgaaaaatcgtgtcactgtcgtcatcacgacggatattactgtggactcctcgtttgtgaaggctggactcgaaacctctactgaaactgaggcgggcctcgagttcataagcaccgtccagttttcgcaatacccatttcttgtctgtatgcagatggataaggacgaggcaccatttagacagttcgaaaagaaatacgaacggctttcaactggtaggggctacgtgtcgcaaaagcgaaaggagtcggtgctggctggatgtgaatttcccctgcaccaggaaaatagcgaaatgtgcaaggtcgtgtttgccccacaaccagattctacgtcctcagggtggttc

SEQ ID NO: 16792 - DNA, 2682 bp, Artificial Sequence
  Description of Artificial Sequence: Synthetic coding sequence
atgattcttctggcggtgcttttcttgtgcttcatctcaagctactcagcatctgtcaaaggtcacacaactggactgtctctcaacaacgaccggctgtacaaactgacctattccactgaagtgctcctggatcgcggaaagggaaagcttcaggattccgtgggatacagaatctcttccaacgtagatgtggccctcctgtggcgaaatcctgatggggatgatgaccagctcatccagatcaccatgaaagatgtcaacgtggagaacgtgaaccagcagcggggcgagaaatcaatcttcaagggaaagtcaccctctaaaataatggggaaggaaaatctggaggcccttcagcggcctacccttctgcatctgattcatggcaaagtgaaggaattttatagctaccagaatgaagccgtcgccattgaaaacatcaaacgcgggctggcttcccttttccagactcaactgtctagcggcaccacgaacgaggtcgacatatccggcaactgcaaagtcacttaccaggcacatcaggataaggtaataaaaatcaaggccctcgactcttgcaaaattgcgagatctggtttcaccactccaaaccaggttctcggcgtgtccagcaaagccactagcgtgaccacatacaaaatcgaagattccttcgtaatagctgtgctggcagaagagacccataatttcggactgaacttcctgcaaactatcaaagggaaaattgtaagcaagcaaaaattggaactcaagacaacagaagctggaccacgactgatgtcaggaaagcaagctgccgccatcattaaagccgtggactccaagtacactgccatcccaatagtcggccaggtcttccaatcccattgcaaaggttgccccagcctgtcagaactgtggagatccacaagaaaatatctccagccagataacttgtccaaagccgaggccgtgcgcaatttcctggctttcattcagcacctccgcactgccaaaaaagaggagatactgcagatcctgaagatggagaacaaagaggttctgccccaactggtggacgccgtgactagcgcccagacatccgacagcttggaggccattctggactttcttgactttaaatcagattcatctattatcctccaggaacggttcctgtatgcttgtgggttcgcgtctcatccaaatgaggaactgctgagggctctgatctcaaagttcaaagggagtatcggttcaagtgatatacgagagacagtaatgatcataactggtacacttgttcgaaagctgtgccagaatgagggctgtaaattgaaagccgtcgtggaggctaagaagctcattctgggcggattggagaaggctgagaagaaagaggatacaaggatgtatcttctcgcactgaagaacgctctcttgcccgagggaatcccatcactcctgaagtacgcggaagccggagagggacccatctcacatctcgctactaccgcgcttcaacggtacgacctgcccttcatcacggacgaggtgaagaagactctgaataggatctaccatcaaaaccgaaaagtgcatgagaaaaccgtgaggacggcagccgccgccatcatactgaacaacaacccgtcctacatggacgtcaaaaatattttgctgtctatcggggagctgccccaagaaatgaataaatacatgctcgctattgtacaggacattcttagatttgaaatgccagcgtccaagatagtccgaagggtgcttaaggaaatggtcgcccataactatgaccgattttccaggagcggctctagctccgcctacaccggctacattgagcgctctccacggtccgcatctacctattccctggacatcctttactctggtagtggaatcctgaggcgcagtaacctgaacattttccagtatattggtaaggccggactccacggcagccaggtcgtgattgaagctcagggcctggaggctctcattgcagccacccccgatgaaggtgaggaaaaccttgacagttacgcaggcatgtctgcgatcctgtttgacgtgcagctgcgccccgtaactttctttaatggatactccgacctgatgagcaaaatgttgtctgcatccggcgatcccattagcgtagtgaagggcttgattctcctgatcgaccacagccaagaattgcaactgcaatcaggcttgaaagccaacattgaagtgcagggaggcctggcaatcgacatatccggcgcaatggaattcagcctgtggtatcgggaaagcaagacccgcgttaaaaaccgcgtaaccgtcgtaattacaactgatatcacggtagacagctcatttgtcaaagcaggcctggaaactagtaccgaaaccgaggctgggctcgaattcatttctacagtccagttctctcagtacccattcctcgtttgtatgcagatggataaggatgaggcccctttccgacagtttgaaaagaagtacgagcggctgagtactggaagggggtacgtgagccagaagcgaaaggagagtgtgctcgcaggatgcgagttcccacttcatcaagaaaacagtgagatgtgtaaagttgttttcgccccccagccagacagtaccagctccgggtggttc

SEQ ID NO: 16793 - DNA, 2682 bp, Artificial Sequence
  Description of Artificial Sequence: Synthetic coding sequence
atgatccttctggctgtgctattcctttgcttcatatcatcatattcagcctcagtcaaggggcacacaacaggactctcactcaacaatgatcggctctacaaactgacttattcaacagaagtgcttttagatagagggaaaggaaaactccaggatagtgtcggatatagaatatcctctaatgtcgatgtcgcgcttctctggcggaaccccgatggggatgatgatcaattaattcaaatcacaatgaaagatgtgaacgtagaaaacgttaaccagcagaggggagaaaagtcaattttcaaagggaaaagtccatccaagatcatgggaaaagagaacctggaggcgctccagcggccaactctcctccatctcatccatgggaaggttaaggaattctacagttatcagaacgaagcagtcgccatcgaaaatattaagcgggggctcgcttctctctttcagactcagctgtcctctgggactactaatgaagtagatatatccgggaactgcaaagtcacatatcaggctcaccaggataaagtgatcaaaattaaagcccttgactcatgtaagatagcccggagtggatttacaactcctaaccaggtcctcggggtttcttctaaggctacttccgtaacaacttacaaaatcgaagattcttttgtgatcgcagtgttagcagaagaaactcacaactttgggctaaacttcctccagacaataaaagggaaaatcgtgtccaaacagaaactggagctcaaaacaactgaagctggaccacggctcatgagtgggaaacaggcagctgctataataaaagcggttgattcaaaatacactgcaatcccaatcgtgggacaggttttccagtcacactgtaagggatgcccttccctgagtgaattatggagaagtacaagaaaatatctgcagcccgataacctttctaaagccgaggccgtgcgcaatttccttgcttttatccagcacctgcgaactgccaaaaaagaagaaatacttcagatactaaaaatggaaaataaggaagttcttccgcagcttgtagatgcagtgacatcagctcagacatctgattcattagaggctattctcgattttttagattttaaatccgattcgtccattatcctgcaggaacggtttttatatgcttgtgggtttgcatcccatccaaacgaagaattactacgggctctaatatccaaatttaaagggtctatcgggtcttctgatatccgggaaacagtcatgattatcacaggaacactcgtcaggaaactgtgtcagaatgaagggtgcaaattgaaagccgttgtcgaagcaaaaaaactcatactcggagggcttgaaaaggccgagaaaaaagaagacacaagaatgtatctcctggccctaaaaaatgctctcttgccagaagggattcctagtctgcttaaatatgctgaagcaggagaagggcctatttcccacctggcaactacagcactccagcggtacgatctcccatttataacagatgaagttaaaaaaacattaaaccgcatctaccaccaaaaccgtaaagtgcacgaaaagacagtgagaactgctgcagctgctataattctgaataacaatccttcctatatggatgtgaaaaatatcctgttaagtatcggggaattacctcaggaaatgaacaagtatatgctagctatagtacaggatatacttagatttgaaatgcctgccagtaaaattgtcaggcgggttttaaaagaaatggtggctcataattacgatcggttcagtcggtccgggtcatcatccgcctatacaggatatatcgagcggtcaccacgctccgcttccacttattccctagatattctatatagtggatccggaatcctccgccggtccaatttaaacatctttcagtatatcgggaaagcaggactgcacggatcccaggtggtaattgaagcccaagggctggaagccctaatagctgcaacacctgatgaaggggaagaaaacctggactcttacgctggaatgtcagctattctcttcgacgtgcagctgcggcccgtaactttttttaacgggtattccgatctgatgtcaaaaatgctttccgcttctggagatccaatctccgtggtcaagggacttatcctgctcatcgatcattcccaggaactgcagctccagtctggactgaaagctaacatcgaagtgcagggaggattagccatcgatatttctggggctatggaattttctctttggtaccgcgagagtaaaacacgagtaaaaaaccgtgtgactgtcgttattacaacagatatcactgttgattcctcctttgttaaagcagggctcgaaacttctactgaaacagaagcaggactcgagtttatttctacagtgcagttctcgcagtatccctttctcgtatgcatgcagatggataaagatgaagcccccttccggcagtttgaaaaaaagtacgaacgcttatcaactggacgcgggtatgtttctcagaaaaggaaagagtccgtcctggccggatgtgaatttcctctgcatcaggagaattccgaaatgtgtaaagttgtgttcgctcctcagcctgattccacttcttccggatggttc

SEQ ID NO: 16794 - DNA, 2682 bp, Artificial Sequence
  Description of Artificial Sequence: Synthetic coding sequence
atgatcctcctcgcagtcctgtttctttgcttcatctcctcctacagcgcatctgtgaagggacacaccacaggcctatccctgaataatgatagactgtataagttaacctatagtaccgaggtcctgctggacaggggcaaaggaaagctgcaggactcagtggggtacagaatctctagtaacgtggatgtagcgctgctgtggcggaatcccgacggcgatgacgaccagctcattcaaattacaatgaaggacgtgaatgttgagaatgtgaatcagcagcgaggagagaagtccatctttaagggcaaatctccttccaagataatgggaaaggaaaacctggaggcattgcagagacctactctgcttcatttaatccacgggaaggttaaggagttctacagttaccagaacgaggcagttgcaatagaaaacattaaacggggactcgcatccctgtttcagacccaactaagctctggtacaacaaatgaggtagacatttctggtaactgcaaggttacatatcaggcacaccaggataaagtgattaagattaaagcacttgacagttgtaaaattgccagatccggctttacaactccgaaccaagtcctaggcgtcagctctaaggccacttctgtgaccacttataaaatcgaggattcgtttgtaatcgccgtgttggcagaagagactcataactttggtctgaattttctgcagactatcaaagggaaaattgttagtaagcagaaactagagctgaaaactaccgaggccggccctagattgatgagcggaaaacaggccgccgcgataataaaggctgttgattccaagtacactgccattccaatcgtaggacaggtgtttcagagccattgtaagggatgcccatcattaagcgagctctggcgttctactaggaaatatctgcagccggataacttgtctaaggctgaggcagtcaggaacttcctagcatttattcagcacctccgaacggctaagaaggaggaaatcctccagattctgaaaatggagaacaaagaagtcctgccccagctggtggacgcagtgaccagcgcccaaaccagtgatagtctggaggcaatcctcgattttctggattttaagtcagattcctcaataattcttcaggagcgctttctgtacgcgtgcggattcgcgtcacatcctaatgaggagctgctgcgcgctctcatcagtaagttcaagggctcaattggttcctccgacatccgggagacagtgatgataattacaggtactttagtgagaaagctgtgccagaacgaaggatgtaagctcaaagccgtagttgaggctaagaaattgatccttggggggctagagaaagcagagaaaaaggaggatacacgcatgtatttgcttgcccttaagaacgcactgttgcctgagggaattccttcactcctgaagtacgctgaggcaggcgaggggccaatatcccatttagctacgactgctttacagagatacgacctcccctttatcacagacgaggtgaaaaagacactgaatcggatttatcaccagaaccgcaaagtgcacgagaagactgtgcgaaccgcagccgcagctataatcctgaacaataatcccagctacatggatgtgaagaatatattgctgagtattggcgaactccctcaggaaatgaacaaatatatgctggcgatcgtccaggatatactcagattcgaaatgcccgccagtaaaatcgttaggcgcgtacttaaggaaatggttgcacacaattacgaccggttcagcaggagcggatcttcaagcgcttatactggctatatagagaggtcgccgagatccgcttctacctacagcctggacattctgtatagcggatccggcatcctcaggcgctccaacctgaatattttccagtacattgggaaggcgggcctccatggaagccaggtagtaatcgaagctcagggcctggaggcactgatcgcagccacgcccgacgagggagaagagaatttggacagctacgctggcatgtcggcaatcctgtttgacgtacagcttcgtccagtgactttctttaatggatactctgacctcatgtccaagatgctcagtgcctcaggagatccaatttccgtggtgaaagggctcattcttctgatcgaccatagccaggagctgcagctgcaaagcggacttaaggctaatattgaagtgcagggagggctggccatcgacatctccggcgccatggagttttcgctgtggtatcgggaaagtaaaacaagagtgaaaaaccgggtgactgtggtgataactaccgatatcacagttgactccagttttgtgaaagccggattggagacatccaccgagaccgaagccggtcttgagttcatcagtactgtgcaattctcccagtaccccttccttgtgtgtatgcagatggataaggacgaagcgcctttccgacaatttgaaaagaagtatgagcggctttccacaggacggggatacgtttctcagaaacgcaaagagtccgttctggctggctgtgagttccccctccaccaagagaattccgagatgtgtaaagtggtgttcgcaccgcagcctgattccacctcctcaggctggttc

SEQ ID NO: 16795 - DNA, 2682 bp, Artificial Sequence
  Description of Artificial Sequence: Synthetic coding sequence
atgattctgctggccgtgttgtttctgtgttttatttcatcctactccgccagcgtgaagggacacaccacggggctgtctctcaataacgacaggctgtacaaactgacgtacagcactgaggtgctgctggaccgggggaagggtaaactgcaggatagtgttggctataggatttcctccaatgtggatgtggccttgttgtggagaaaccccgatggtgatgacgaccagctgatacagatcaccatgaaggacgtaaacgtggagaacgtgaatcagcagcggggggaaaagtccatctttaagggaaagagtcccagcaaaatcatgggcaaggaaaatcttgaggctctccagcggcccaccctgctgcatctgattcacgggaaagtgaaggaattttactcctaccagaacgaagctgtggccatcgaaaatatcaaacgggggctggcctccctgtttcaaactcaacttagctcaggaaccactaacgaggtcgacattagtggaaattgcaaggtgacttaccaggcacaccaggacaaggtgatcaagatcaaggcactcgactcttgcaagattgcacggtccggcttcaccactcccaatcaggtgctgggtgtctcttctaaggccacttccgtgacaacttacaagatcgaggactcctttgtaatcgccgtactggctgaggagacccacaatttcggactcaatttcctccagaccataaaggggaagattgtctctaagcagaaattggagctcaagaccacggaagctggccccaggctcatgtctggcaaacaggccgctgccattattaaagctgtggacagtaaatacacagctatcccgattgtgggccaggtgttccagagccattgtaaggggtgcccctcactgtctgagctttggcgctccaccagaaaatacctccagcctgataatctgtctaaagcggaggctgtgcgcaattttctggccttcatccagcatctgcgcacagccaaaaaagaggagatcctgcagatactcaagatggaaaacaaggaggtgttgccccagctggtcgacgctgtcacaagcgcacaaactagtgatagccttgaggcgatactggatttcctggactttaaaagcgactcctcaataatcctgcaggaacggtttctgtacgcgtgcggttttgctagtcacccaaacgaggagctcctgagggcgctgatttccaagtttaaggggtccatcggatccagcgacatcagggaaactgttatgattatcacgggtacgctcgtgcggaagttgtgccagaacgaaggctgcaagctgaaggccgtcgtggaagctaagaaactgatcctgggcggactggagaaggctgaaaagaaggaggatactcggatgtacctgctcgccttgaagaatgccttgctgccagagggtatcccgtccttgctcaagtatgccgaagcgggcgaaggtcccataagccatcttgctacaactgccctgcaaaggtatgatctcccgtttataacagatgaggtcaagaagaccctgaaccgcatttatcatcagaacagaaaagtgcatgagaagacagttcgcacagctgccgctgcgatcatcctcaacaataatccttcctatatggatgtaaagaatattctgctgagcatcggggagctcccgcaagagatgaataaatacatgttggctatcgtgcaggatatcttgagatttgagatgccagccagcaagatcgtaaggcgggttctgaaagagatggtggcgcacaattacgataggtttagtaggtctggcagttccagcgcctatactggttatatcgaaagatctccacgatccgcttcaacttatagcctggacatcctgtacagcgggagcggcatcctgcggagaagcaatttgaacatttttcaatatatcggaaaggcagggctgcatggatcacaggtggtgatcgaggcccaggggctcgaggcactgatcgcggccacacctgacgagggagaggagaacctcgattcctacgctggcatgtccgcgattcttttcgacgtgcagctgcgccccgtaaccttttttaatgggtactctgatctgatgagcaaaatgttgtcagcaagcggggacccaatatctgttgtcaagggactgattctgctgatcgatcacagtcaggaactgcagctgcagtccggtctgaaagctaacatcgaagtgcagggcggacttgcaattgacatttccggggccatggagttcagtctgtggtatcgcgagtcaaagacaagagttaaaaaccgcgtgacggttgtgatcacaaccgatattaccgttgactcatctttcgtaaaagctggtctggagacaagtactgagactgaagccggcctcgagttcatcagcacagtgcagttctctcagtatccattcctcgtgtgtatgcagatggataaggacgaagcccctttcagacagttcgagaagaaatacgaaaggctcagtacgggccgcgggtacgtgagtcaaaagagaaaggagagcgtgctggctggttgtgagttcccattgcaccaggagaatagcgagatgtgcaaggttgttttcgccccccagccagattctacctcctccggctggttt

SEQ ID NO: 16796 - DNA, 2682 bp, Artificial Sequence
  Description of Artificial Sequence: Synthetic coding sequence
atgatactgcttgccgtgttgtttctgtgctttatctcgtcgtactcggcctcggtcaagggccacaccactggactgtctcttaacaacgatcggctttacaagctgacctacagcactgaagtgctgctcgatagggggaaaggtaaactgcaagattccgtgggctaccgcatatcctccaatgtggacgtcgcattgctgtggcggaacccagatggcgatgatgatcagctcattcagattacgatgaaggatgtcaacgtggaaaatgtgaatcaacagcgcggagagaagtccatctttaagggaaagtcaccatctaagataatgggaaaggagaacctggaggcgcttcaaagaccaactcttcttcatcttatccacggtaaggtgaaggaattctactcctaccaaaacgaagcagtggcgattgaaaacattaaacgcggccttgcgtctctgtttcaaacccagctttcctccggaacgactaacgaggtcgatattagcggtaactgcaaagtgacttaccaagcacaccaggataaggtgatcaaaatcaaggcactggactcatgcaagattgcacggtccggtttcactacgccaaatcaagtcttgggggtgtcgtcgaaagccacttcagtgaccacctataagatcgaggacagcttcgtcattgcggttcttgccgaggaaactcataactttgggctgaacttccttcagaccataaagggcaagatcgtgtcgaagcaaaagctggaactcaagaccacggaagccggacctcgcctgatgtccggtaagcaagcagcggcaatcataaaagcagtggactcgaaatacactgcaattcctatcgtgggacaggtctttcagtcgcactgtaagggctgtcctagcttgtccgagctttggaggtccactaggaagtacctgcagccagataatctgtccaaggccgaggcagtgaggaactttcttgcatttatccaacatcttcggactgctaaaaaggaagaaattctgcaaattcttaagatggagaataaggaagtgcttccgcagctggtcgatgccgtgacctccgcgcaaacttcggactctctcgaagcaatcctggatttcctggatttcaagtcggattcatcgataatcctccaggaacggtttctgtacgcctgtggattcgcatctcatccaaacgaggaacttctccgcgcactgatatccaagtttaaaggatcaattggttcatcggatattagggaaaccgtcatgatcattactggaaccctggtcagaaaactgtgtcagaatgagggttgcaagctcaaggcagtggtcgaagcaaagaagttgatccttggaggactcgaaaaagctgagaagaaggaagatacccggatgtacttgcttgcactgaagaacgcactgctgcctgaagggataccttccctgctgaagtacgctgaagcaggcgaaggacctatttcgcatcttgcgacgaccgcgcttcagcggtacgacctcccgttcattactgatgaagtcaagaaaactctcaaccggatctaccaccaaaaccgcaaagtgcatgaaaagacggtccgaacggctgctgcagcaatcattcttaacaataaccccagctacatggacgtaaagaacattctcctctcgatcggcgaacttcctcaagaaatgaataagtacatgctggccattgttcaggacatcctgcgattcgaaatgccggcctcgaagattgtgcggcgtgtcctgaaggaaatggtggcgcataactacgaccgattttcccggagcggaagttcgtcggcttacactggatacattgaaagatccccaagatcggcatcaacctactcgctggacattctgtatagcgggtcgggtattctcaggcgatctaacttgaacatttttcaatacatcggcaaagcaggcctgcatggatcccaggtggtgatagaagcccagggccttgaggctctcatagcagcaactcctgatgagggagaagaaaatcttgactcatatgcaggaatgtcagcaattctgtttgacgtgcaactgcgtcctgtcacgttctttaatggttactcagacctgatgagcaaaatgctgtctgcgtcgggtgaccctatttcagtggtgaaggggctcatcctgctgatcgatcattcgcaagaattgcaactgcagagcggtctgaaagcaaatatcgaagtgcaagggggactcgcaatcgatatttcgggggcaatggagttttcgctttggtaccgagaatcaaagaccagagtgaagaatcgggtcaccgtcgtgattactaccgatatcactgtcgactcctcattcgtgaaggctggactcgaaacctcgactgaaactgaggcgggacttgaattcattagcacggtgcaattcagccaatacccattcctggtgtgcatgcaaatggacaaagatgaggcaccatttagacaattcgagaagaagtacgaacgcctgtcaaccggacggggttacgtgtcgcagaagcgcaaggaatcagttctggctggttgtgaatttccactgcaccaggagaactcagaaatgtgtaaagtcgtgttcgcaccacagccggattcgacttcatcggggtggttt

SEQ ID NO: 16797 - DNA, 2682 bp, Artificial Sequence
  Description of Artificial Sequence: Synthetic coding sequence
atgattctgctggccgtcctgtttctgtgtttcatctcgtcatattcggcctcggtgaagggacatacgaccggactcagccttaacaacgatagactctataagctgacctactcaacggaagtgctgctggataggggaaagggaaaacttcaagattcggttggataccgcatctcgtctaacgtggatgtggcgcttttgtggcgtaatccagatggagacgacgaccaactgatccagattaccatgaaagatgtgaacgtcgagaatgtcaatcaacagaggggagaaaagtcaatattcaaggggaagtcccccagcaagattatgggtaaggagaatcttgaagcacttcagaggcccacccttctgcacctgatacacgggaaagtcaaggagttttactcataccagaatgaagctgtggcgatagaaaacattaaacggggacttgcgtccctctttcaaactcaactgtcaagcgggactactaacgaagtggacatttcaggcaactgtaaagtgacttaccaggcccaccaagataaggtcattaagattaaggctcttgactcctgcaagattgcaagatccggatttaccacccccaaccaagtgcttggagtgagctcaaaagcaacctcagtgactacctacaaaatcgaagattcgttcgtgattgccgtccttgcagaagaaactcataacttcggtttgaatttcctccaaaccatcaaaggcaagatcgtgtccaagcaaaagctcgagctgaaaactactgaggcaggacctcgcctcatgtcaggcaaacaggcagcagccatcataaaagccgtggacagcaagtacaccgcaattcctatcgtgggacaggtctttcaatcgcactgtaagggctgtccttcgctgtcggaactgtggcgctcgacccgcaagtacctccagcctgataacctgtccaaggcagaagccgtgcggaactttctggcatttatccaacacctccggaccgcaaaaaaggaggagatactccagatactgaaaatggaaaacaaggaagtgctgcctcagctggtggatgcagtgacctccgcacagacctcggactcgcttgaagcaattctggactttctggactttaagagcgattcgagcattattcttcaggaaagatttctctacgcatgtggcttcgcatcgcaccctaacgaagaacttctgagggcacttattagcaagttcaagggatcaattggttcgtccgacattcgggaaactgtgatgataatcactggaaccctggtgcggaaactctgtcaaaatgagggatgcaagttgaaagcagtggtcgaagcaaagaagctgattctgggtggcctcgaaaaggcagagaaaaaagaggacacccgcatgtacctgttggctcttaagaatgcgcttctgcctgaaggtatcccctcactcctgaagtacgcagaggctggcgagggcccaatatcccacctcgcaactacggccctccagagatacgatctgccgttcattaccgatgaggtaaagaaaaccctgaaccgcatttaccaccaaaaccgcaaggtccatgaaaagactgtgcgtactgccgccgcagcaattatcttgaataacaatccatcgtacatggatgtgaagaacattcttttgagcataggagagctccctcaggaaatgaacaaatacatgttggcaatagtacaagatattcttagatttgaaatgccagcgtccaagattgtgaggagagtgcttaaagaaatggtggcgcacaactacgatcgctttagccggagcggatccagctccgcatataccggctacatcgaacggagcccaagatcggccagcacctactcgctggatatcctctacagcggctccggtatcttgaggcggtccaaccttaacatctttcaatacattggcaaagcgggacttcatgggtcccaggtcgtcattgaagcacaggggcttgaagcactcattgccgcaacccctgatgaaggtgaggaaaacctggacagctatgcaggaatgagcgccattctgtttgatgtgcagctgcgcccagtgacttttttcaatggctactcggatctgatgtcgaagatgctgagcgcatcaggagatcctataagcgtcgtgaaagggctcattctgctgatcgaccactctcaagagctccaactgcaatcaggattgaaggcgaacattgaagtccaagggggacttgcaatcgatatttcgggggccatggaattcagcctttggtaccgagaatccaagactagggtgaaaaatcgagtgactgtggtcatcaccaccgatattaccgtggattcgtccttcgtcaaagcagggcttgaaacgtcgactgaaaccgaagcaggtctggagttcatctccaccgtgcaattttcgcaatatccatttctggtgtgcatgcaaatggacaaggatgaggcaccttttcggcagtttgagaagaaatacgaacggctgtccacgggccgtggatacgtctcccagaagagaaaagaatccgtgctcgcaggatgtgaattccctctccaccaagaaaattcagaaatgtgcaaggtcgtgtttgcgcctcaacctgactcgactagctccggttggttc

SEQ ID NO: 16798 - DNA, 2682 bp, Artificial Sequence
  Description of Artificial Sequence: Synthetic coding sequence
atgattctcctggcagtgctctttctctgtttcatctctagttactctgccagcgtaaaaggacacacaaccggtcttagcttgaacaatgaccgtctttataagctgacctacagtacagaagtcctcctcgaccgcggtaagggtaaactgcaggactccgttggctaccgtattagttccaacgtggacgttgcactcttgtggcgcaaccccgatggcgacgacgatcagctcatccagatcacaatgaaggatgtcaacgtggagaatgtgaaccagcagagaggagagaaatccatatttaagggcaaatccccctccaaaatcatgggaaaggagaatctggaagcactgcagcgtccaactctgctgcacttgatacatggaaaggtgaaagagttctacagctatcagaacgaggccgttgccatcgagaatatcaaaaggggcctggcctccctcttccagacccagctttcttctggaactactaacgaggtcgacatttctggaaactgtaaggtgacctatcaagcccaccaagataaggtgatcaaaatcaaagctctggactcttgtaagatcgctaggtccggattcacaactcctaaccaggttttgggagtttcttccaaggccacctctgtaactacttataagatcgaagactcctttgttatcgccgtcctggccgaagaaacacacaattttggtcttaattttctccagactatcaagggtaagatcgtaagtaagcaaaagctggagcttaaaacaactgaagccggtccacgtctcatgagcggcaaacaggccgccgccatcatcaaggctgtggattccaagtatacagccatccctatcgtcggccaggtctttcagtcacactgtaagggctgccctagtttgagcgaattgtggcgtagtacaaggaagtatcttcaaccagacaacctgtccaaggccgaagctgtacgtaacttcctggcttttatccaacatcttcgcaccgccaagaaagaggagattctccagattctgaagatggagaacaaagaagtcctgcctcagcttgttgatgcagttaccagtgctcagactagcgattcattggaggcaatcttggattttcttgacttcaaatctgattccagtatcatcttgcaggaacgtttcctgtacgcttgcggttttgcaagccatccaaacgaagaacttcttagggcattgatctcaaagttcaagggttctatcggctcctctgatattcgtgaaaccgtcatgattatcactggtactctggttcgtaagctttgtcagaatgaaggttgtaagctgaaggcagtggttgaagccaagaagctgatcctgggcggactggaaaaagcagagaagaaagaggacacacgtatgtacctgctggcattgaagaacgccctcctccccgaaggaatccccagcctcctcaagtacgcagaagctggagaaggcccaatcagtcaccttgctaccaccgccctgcaacgctatgatttgccatttatcaccgatgaagtcaagaagacattgaaccgcatctaccaccagaatagaaaagttcatgaaaagacagttaggactgcagctgctgccatcattcttaacaacaacccctcatacatggacgttaagaacatcctcctgagcattggtgaactgccccaagagatgaataaatacatgctcgccattgtccaggacatattgcgtttcgagatgcctgcaagcaagattgtgcgtcgtgttctgaaagagatggtagcccacaactacgatcgcttcagcaggtccggttcaagcagtgcttacactggctacattgaacgttccccccgtagcgcatctacctattccctggacatcctttactcaggttcaggtatacttcgtcgttccaaccttaacatttttcagtatatcggtaaggctggcctccacggcagtcaggtggtcatagaggctcagggtttggaagccctgatcgcagccactccagatgagggcgaggagaacttggactcctacgccggtatgagcgccatcctgttcgacgtgcaactcagaccagtcaccttcttcaacggatactcagacctcatgagcaagatgctgagtgccagcggtgatcccatctccgtagtcaagggcctgattttgttgatcgaccattcacaggagctccagcttcagtctggactgaaggctaatattgaggttcaaggaggtctcgctattgatatcagcggcgcaatggagttttctttgtggtacagggagtctaaaactcgtgtgaagaaccgcgtcacagttgttattacaactgacatcaccgtcgattcatcttttgtgaaggccggtctggagaccagcacagagactgaggccggtcttgagtttatctccactgtccagtttagccaataccccttcttggtctgtatgcagatggacaaggatgaagctcctttcaggcagttcgagaagaaatacgagaggttgtccaccggaaggggatacgtgtctcagaaaaggaaagaaagtgtccttgccggctgtgaatttcccctgcatcaggaaaattctgagatgtgcaaggtggtgtttgcccctcagcccgactccactagcagcggatggttc

SEQ ID NO: 16799 - DNA, 2682 bp, Artificial Sequence
  Description of Artificial Sequence: Synthetic coding sequence
atgatactgcttgccgtgctttttctgtgcttcataagcagctactccgcctcagtcaagggacacacgactgggctgtcgcttaacaacgatcggctgtacaagctgacctactccaccgaagtgttgctcgaccgaggaaagggcaagctgcaagattcagtcggctacaggatttcgtccaacgtggacgtggctcttctttggagaaacccagacggcgatgatgaccagcttatacagatcaccatgaaggatgtcaacgtggaaaatgtcaatcagcagcggggagagaaatccatctttaagggtaagtcaccgagcaagatcatggggaaggagaacctcgaggcactgcaaagacctactctgctgcaccttatacacggtaaagtgaaggagttttactcgtaccaaaacgaggccgtggccattgagaacattaagaggggtctggcatcgctttttcagacccagctgtcgtccggaacgaccaacgaggtcgatatctcaggaaactgtaaggtgacctaccaagcgcatcaggataaggtgattaagattaaggcactggattcgtgtaagattgcgcgcagcggttttaccactccaaaccaagtgcttggagtgtcgtccaaggcaaccagcgttactacttacaagattgaggactcgtttgtgatcgcagtccttgcggaggagactcacaattttggattgaacttccttcagaccatcaaaggcaaaattgtctccaagcagaagctggagctgaaaacgacggaggcaggcccaagactcatgagcgggaagcaagcagccgcgattatcaaggcagtggattccaaatacacggcaattcctatcgtcggacaggtctttcagagccactgtaagggatgtccttcgctgtcggaactttggaggtcaacgcgaaagtacttgcagccggacaatctgtcaaaggcggaggcagtgagaaacttccttgcatttatccaacatcttagaaccgctaagaaagaagaaatacttcaaatcctgaaaatggagaacaaagaagtgctgccacaactggtggacgcagtgacttcggcgcagacttcggattctctcgaagcaattctggatttcctggacttcaagagcgactcgtcgattatccttcaggaacgctttctctacgcatgtggcttcgcatcgcatcccaatgaagagctcctgcgagcattgatatccaagttcaagggttccattggatcctccgatatccgggaaacggtgatgattatcactggcaccctggtcagaaagctctgccaaaacgaaggatgtaagctcaaggcggtggtcgaggcaaagaaacttatccttggcggactggagaaggcagagaaaaaagaagatacgagaatgtacctccttgcgcttaagaatgccctccttcctgaggggattccttccctcctgaagtacgccgaggcaggggaaggacccatctcacacctcgccacgaccgcacttcaacgatacgaccttccttttatcactgatgaggtgaaaaagactctgaaccggatttaccatcagaaccggaaggtgcacgaaaaaaccgtccggaccgcagccgcagccattattctcaacaacaacccctcctacatggatgtcaagaatattctcctttcaatcggtgaactccctcaagaaatgaataagtacatgctggcaatagtgcaggacattcttcgctttgaaatgcctgcatccaaaatcgtgcggagggtgttgaaggaaatggtggcccataactacgatcggttttcaagaagcggttcctcatcggcatatactggatacattgaacggtcccccaggtcggcctccacttacagcctggatattctttactcaggatcaggcatcctcagaagatcgaacctgaacatctttcaatacatcggaaaggcaggccttcatggtagccaggtcgtgattgaagcccagggtctggaagctcttattgccgcaactcctgatgaaggcgaagaaaaccttgattcatacgctggaatgagcgcgatcctgtttgatgttcaactcagacctgtgactttctttaacggatactccgacctgatgtcgaagatgctgtcggcatcgggagatcctatctctgtcgtgaagggactcatactgctcattgaccattctcaggagttgcaactgcaatccggactgaaagcaaacatagaagtgcaaggaggacttgcaattgatatttcgggtgccatggaattttcgctctggtaccgcgagtccaagactcgggtcaaaaacagagtcactgtggtgataaccactgacattaccgtggactcatcatttgtgaaagctgggctggaaacttcgactgaaactgaggccggcttggaattcatttccaccgtccagttctcacaatacccttttcttgtgtgtatgcagatggataaggatgaagcaccgttcagacaattcgagaaaaagtacgaaagactctccacgggcaggggttacgtgagccaaaagcggaaggaatcagtgctggcagggtgtgagtttccgcttcatcaagaaaattccgagatgtgtaaagtggtctttgcacctcagccagactcaacttcttcgggttggttt

SEQ ID NO: 16800 - DNA, 2682 bp, Artificial Sequence
  Description of Artificial Sequence: Synthetic coding sequence
atgatactgctggcggttctgttcctgtgtttcattagcagctactccgccagcgtgaagggacatacaactggcctgtctctaaacaacgaccgcctctataaactgacctactcaacggaagtcttgctggacagaggaaagggtaagctccaagatagcgtaggctatcggatttcttcaaatgtcgatgtggccctgctgtggaggaacccagacggcgatgacgaccagttaatacagatcacaatgaaggacgtgaacgtagaaaatgtcaatcagcagagaggtgaaaaatcaatcttcaagggcaagagcccaagcaaaatcatgggaaaggaaaacctggaagccctgcaacgtcctactctgctgcacttgatccatggtaaagttaaggagttctattcttatcagaacgaagcagtcgcgattgagaatataaaaaggggactggcctccctgttccagacacaactgagtagcggaacgaccaacgaagtggatattagcggtaactgcaaagttacctaccaggcacatcaggataaggtgatcaagatcaaagctctggactcatgtaagatcgcgagaagcggcttcactacacctaaccaggtcctcggtgtgtccagcaaagccactagtgtcactacctacaagattgaagatagcttcgtgatcgccgtgctcgcggaggaaacgcacaatttcggcctaaatttcctgcagacgattaagggtaaaatcgtaagtaagcagaaactggaacttaagaccaccgaggccggcccgagattgatgagcgggaagcaggccgccgcaattatcaaagccgttgacagcaagtacactgcaatccccatcgttggacaggttttccagagtcactgtaagggatgcccttccctgagcgaactgtggcgatctacccggaagtatttgcagcccgacaacctttctaaggctgaggccgtgcgcaatttcctggcttttatccaacatctgcgtacagctaaaaaggaggaaatccttcagattttgaagatggaaaacaaggaagtgctgccgcagctggtggatgctgtcacatccgcacagacttcggattctctggaagccatcctggactttctggacttcaagtccgattcatcaatcattctccaggagaggttcctctatgcctgtggcttcgcctctcatccaaatgaagaactcctgagagcattgatcagcaaatttaaggggagtataggaagctcagacatccgggagacggtgatgattatcaccgggacgcttgtaagaaagttgtgccagaatgagggttgtaaactgaaagccgtggttgaggccaagaaattaatattagggggtttggagaaggcagagaaaaaagaggataccagaatgtacctcctggcgctcaagaatgctctactccctgagggtatcccatctctcctcaagtatgccgaggccggggaaggcccaatttcacatctggccacaacagcgctacagagatacgacctcccctttatcacagatgaggtgaaaaagacgcttaacaggatatatcaccagaaccgaaaggtacatgaaaagactgtgaggaccgcagcggctgctattatcttgaacaataacccttcatacatggatgtaaaaaacattcttctcagtattggagaactgccacaagagatgaataagtacatgctggctattgttcaggacatcctgcgtttcgaaatgccagctagcaaaatcgtcaggcgggtgttgaaggagatggtcgctcataattatgaccggttcagtaggtcaggctcgagcagcgcatatactgggtacatcgaacgctcccctcgatctgctagcacatactcgctggatatcctttactccggctctggaatcttgcggaggtccaacctgaacatctttcagtacattggaaaggcaggacttcatggtagccaggtggtcatagaagctcagggcctggaggctctaatcgcggctaccccagacgaaggtgaagagaatctggactcttacgcaggcatgtcagccatactgttcgacgtccaattacggccagtcaccttcttcaatggctattccgacctgatgtcgaaaatgctcagcgccagtggggatccaatctcagtcgttaagggactgatccttctgattgaccattcacaggagttgcagctgcagtccggcctgaaagcaaatattgaggtgcagggagggctagccattgacattagcggcgccatggagttcagtttatggtaccgtgaatctaagacccgggtgaaaaacagagtgacggtggtgatcacaaccgacattacagtggactcatcctttgtcaaagcaggactggagacatcaacagagaccgaggccggtctcgagtttatatctactgtccagttctcacagtacccattcctggtgtgcatgcagatggacaaagatgaagccccctttaggcagtttgagaagaagtacgagcgcctttcaaccgggaggggctacgtcagccagaagagaaaagagtcagtgcttgctggctgcgagtttcctcttcaccaagaaaactcagaaatgtgtaaagtggttttcgcaccccagccagatagtacatcttctggctggttc

SEQ ID NO: 16801 - DNA, 2682 bp, Artificial Sequence
  Description of Artificial Sequence: Synthetic coding sequence
atgattttattagctgttttattcctttgtttcattagttcatattcagcatcagttaaaggacatactacaggacttagtttaaacaatgatcgtctttataaattgacctattcaactgaagttttattagatagaggaaagggaaaattacaagactctgttggttatcgtatctcatcaaatgtagatgtcgctcttttatggagaaatcctgatggagatgatgatcaattaattcaaattaccatgaaggatgttaacgttgaaaacgttaatcaacaaagaggagaaaaaagtatttttaaaggtaaaagtccatcaaaaataatgggtaaagagaatttagaagcacttcaaagaccaactttattacatcttatacatggaaaagttaaagaattctattcatatcaaaatgaagctgttgcaattgaaaatattaagagaggactagctagtttatttcaaactcaacttagttctggaacaactaatgaggttgacattagtggaaactgtaaggttacatatcaagctcatcaagataaggttattaaaattaaggcattagactcttgcaaaatagcaagatcaggttttacaacaccaaatcaagtacttggagtttcttcaaaggcaactagtgttactacttataaaattgaagattcttttgttattgctgttttggcagaggaaactcataatttcggattaaattttttacaaacaattaagggtaagattgtgtcaaaacaaaaattagaattaaaaactacagaagctggaccacgtcttatgtcaggaaaacaagctgcagcaatcattaaagctgttgattcaaaatatacagcaattccaatagtaggacaagtttttcaatctcattgtaagggttgtccatcactttctgaattatggaggtccacaaggaaatatttacaaccagataatttaagtaaagcagaagctgtacgtaattttcttgcatttatacaacatttgagaacagcaaaaaaagaagaaattttacaaatacttaaaatggaaaataaagaggttttaccacaattagttgatgcagttacctcagctcaaacttctgatagtcttgaagcaatattagattttttagatttcaagtctgattcatctataattctacaagaaagatttttatatgcatgtggatttgcatcccatccaaatgaagaattgttaagagctttaattagtaagtttaagggatctattggttcatcagatattagagaaactgttatgataattacaggaactcttgtaagaaaattatgtcaaaatgaaggatgtaaattaaaagctgtagttgaagctaaaaagttaatccttggtggattggaaaaagcagaaaagaaagaagatacaagaatgtatttattggcattaaaaaatgcattacttccagaaggaattccttctcttttaaaatatgcagaagctggagaaggaccaatttctcatctagctactaccgcattacaaagatatgatcttccatttataacggatgaagttaaaaaaactcttaatcgaatttatcatcaaaatcgtaaagtacatgaaaagacagttcgtacagcagccgcagcaattatccttaataataatccttcatatatggatgttaaaaatattttattatcaattggtgaattgccacaagaaatgaataagtatatgttggctattgtacaagacattttaagatttgaaatgcctgcaagtaaaattgttagaagagttttgaaagaaatggtagcacataactatgatagattttctcgttcagggtctagtagtgcctatacaggatatattgaaaggtcaccaagaagtgcatcaacttatagtcttgacattttatatagtggatcaggaatattaagacgttcaaatttaaatatttttcaatatattggaaaagctggacttcatggaagtcaagtggttattgaagctcaaggacttgaagcacttattgctgcaactcctgatgaaggagaagaaaaccttgattcatatgcaggaatgtctgctattctttttgatgttcaattacgtcctgtaacattctttaatggatattcagaccttatgtctaaaatgttatcagcatctggggacccaatctctgttgttaaaggattaattttacttattgatcatagtcaagaattgcaattacaatcaggacttaaagcaaatattgaagttcaaggaggacttgctattgacattagtggggctatggaattttcattatggtatagagaatcaaaaacaagagttaaaaatagagttactgttgttataactactgatattactgttgattcaagtttcgttaaggctggacttgaaactagtactgaaacagaagcaggattagaatttattagtacagttcaattttcacaatatccatttttagtttgtatgcaaatggataaagatgaagctccatttagacaatttgaaaaaaaatatgaaagattaagtactggtagaggatatgtatcacaaaaacgaaaagaatcagtacttgctggatgtgaatttccattacatcaagaaaattcagaaatgtgtaaagttgtgtttgctccacaaccagattcaacaagttcaggatggttc

SEQ ID NO: 16802 - DNA, 2682 bp, Artificial Sequence
  Description of Artificial Sequence: Synthetic coding sequence
atgatcttgttggctgtgctgtttttgtgcttcatttcatcctattctgcaagtgtgaaaggccataccacgggacttagtttgaacaatgatcgcctgtacaagctcacgtattctaccgaagtgctactggaccgcggtaaaggtaagctgcaggacagcgtaggataccgcatcagctcaaatgtggatgtggcccttttgtggcgcaatcccgacggcgatgatgatcagctgatccaaataactatgaaggatgtaaatgtggagaacgtgaaccagcagcgcggcgagaagtctatctttaaaggaaagtccccgtctaagataatgggcaaggagaacctggaagccctgcagcgaccgacgctgctacacttaattcatggtaaggtcaaggaattctactcctatcaaaacgaggcagtagctatagagaacatcaagagagggctggcgagcctgtttcagacacaattgagctcgggtaccacaaacgaggttgatattagtggcaactgcaaagtaacgtatcaagctcaccaggataaggtgataaagatcaaggcgctcgattcttgtaagatagctcggtctggatttactactccgaaccaagtgcttggagtgagttctaaagcaacctcagtgactacgtataaaatcgaagacagtttcgtgatagccgtactggccgaggagacgcataactttggactgaattttctgcagaccattaagggcaagatcgtcagtaagcagaagctggagctcaagacaacggaggcaggaccgcgtttgatgtcgggtaagcaggccgccgccattatcaaagccgtcgactccaagtacaccgccatccccatcgtgggtcaggtttttcagtcgcactgtaagggttgcccatcattgtcggagctgtggcgctctacacggaaatacctgcagccggacaatctatcaaaggcagaggccgtccgtaactttctggcattcatccagcatctgagaaccgccaagaaggaagaaatcttacaaattctgaaaatggagaacaaggaggtcctcccccagctggtggatgcagtgacgtcggcgcagacttcagatagcctggaggcaatcctggacttcctagacttcaagtcggacagtagtataattttacaagagcggtttctgtacgcgtgtggcttcgcatcgcacccaaatgaagaacttctacgcgctttgatctccaagtttaagggtagcattggctcatctgatatccgcgagacggttatgattatcacgggaacgctggtgagaaagctgtgccagaatgagggatgcaaactgaaagctgtcgttgaggccaagaagctgatcctaggaggactggagaaagctgagaagaaagaagatacccgaatgtacctattggcgttgaagaatgccctgctgccggagggcattccgagcctgctgaagtatgccgaggcgggtgagggaccaattagccatctcgccacaacggcgctacagagatacgatctccccttcataacggacgaagtcaagaaaacgttgaaccgcatttatcatcagaatcgcaaggtccacgaaaagaccgtaaggacagcagccgctgcaatcatcttgaataataatccgagttatatggacgtcaaaaacatacttctctcaatcggcgagctgcctcaggagatgaataagtatatgctagcaatcgtccaagatatcctacgctttgaaatgcccgcctccaagatagtgcgtagggtgttgaaggagatggtggcacacaattatgatcgattctcacgctcgggctcgagcagcgcgtataccggctacattgaaagaagcccgcggagcgcctccacttactctttggatatcttgtattctggaagcggaatactgcgaagaagtaatttgaatatcttccagtatatcggcaaggctggcctgcatggttcccaggtggtcatagaggcccagggccttgaggctttaattgccgctacccctgacgaaggcgaggagaatttggactcctacgccgggatgagtgccatcctgtttgatgtgcagctgcgcccggtcacttttttcaacgggtactctgatttgatgtccaagatgctgagtgccagtggtgatccgatctctgtggtgaaaggcctgatcctcctgattgatcactcgcaggaactgcagctccagagtggcctcaaggcgaacatcgaggtgcagggaggtctggcaatagacatttcgggagcaatggaattttccctgtggtaccgtgagtcgaaaacgcgggtgaagaatcgcgtgacggtggttattacaactgacatcaccgttgattcttcgtttgtgaaggccggtctggagacctcgacggagactgaagcgggtcttgagttcatctcgactgtgcaattcagccagtaccccttcttggtgtgcatgcagatggataaggatgaggcccccttccgtcagtttgagaagaagtacgagagactgtccaccggcagggggtacgtttcccagaagagaaaggagtcggttctggccggatgcgagttcccgctgcaccaggaaaactccgagatgtgcaaggtcgtatttgcgccgcagccggactcgaccagcagcggatggttt

SEQ ID NO: 16803 - DNA, 2682 bp, Artificial Sequence
  Description of Artificial Sequence: Synthetic coding sequence
atgattctgctggctgtcctgtttctctgctttatctcgtcgtactcagcgtcagtgaagggtcacaccaccggcctgtcactgaataatgacaggctctataagctgacttacagcaccgaagtcctgcttgaccgcggtaaaggaaaattgcaggactcagtgggctaccgcatttcgtcaaacgtagacgtggctctgctctggcgcaatcccgacggcgacgatgaccaactcatccagatcacgatgaaggatgtaaacgtggaaaatgtgaaccaacagcgcggagagaagtccatcttcaaagggaaatcgccttcaaagattatgggaaaggagaacctggaggccttgcagcggccgactcttctgcatctgatccatggcaaggtgaaggaattctactcgtaccagaacgaagccgtggccattgagaatatcaaacgcggactggcctcgctctttcagacccaattgtcctcagggaccactaacgaggttgatatcagcggaaattgcaaggtgacgtatcaggctcaccaagacaaggtgatcaagatcaaggccctggacagctgcaagattgcccggtcaggattcaccactccaaaccaggtgctgggggtgagttctaaggcaacctcagtcaccacctacaagatcgaagattccttcgtgatcgcagtcctggctgaagaaacccacaactttggacttaacttccttcagaccatcaagggcaagatcgtgagcaagcagaagctcgaactcaaaaccactgaggcaggaccaagacttatgtcgggcaagcaggccgcggcaatcatcaaggcggtcgatagtaagtacaccgctatccctatcgtcgggcaggttttccagtcacattgtaagggttgcccttccctgagcgaactgtggcggtccacccgcaagtacctgcaaccagataacctgagcaaagctgaggcggtccggaactttctcgccttcatccaacatctgcggactgccaaaaaggaggaaattctgcaaatcctgaaaatggagaacaaggaagtgctgccacagctggtggatgctgtaacttctgcccagacctccgactcactggaagcgatcctggacttcttggatttcaagagcgactcctccatcattctgcaagagcggttcctctacgcctgcggatttgcatcccatccgaatgaagaactcctccgtgcactgatctccaagttcaagggatccatcggatcgtccgacatccgggagactgtcatgatcatcaccggaaccctggtgagaaagttgtgtcaaaacgaaggatgcaagctcaaagcagtggtggaggccaaaaaacttatcctggggggtcttgaaaaagccgagaaaaaagaagatactaggatgtacctcctggcattgaagaatgcgctcctccctgagggtatcccgtcgctgcttaagtacgccgaggccggcgaaggtccgatcagtcacctggccactactgccctgcagaggtatgatctgccattcatcacggacgaagtgaagaaaacgctcaaccgcatctaccaccagaaccgtaaggtgcacgaaaagactgtgaggactgctgcagctgccatcatcctcaataacaacccctcgtacatggatgtaaagaatattctgctgtcaataggagaactcccgcaggaaatgaacaagtacatgctggccattgtgcaggacatcctgaggttcgagatgcctgcgtccaagattgtgagacgcgtgctgaaggaaatggtcgcgcacaactacgatcgcttctcgagatcgggaagctccagcgcatacactggatacatagaacggagcccgcgatcagcgtccacttactcgctggacatcctctacagcggttcgggcatcttgcgccgctcgaatctgaatatctttcaatacataggaaaggcgggactgcacgggtcgcaagtcgtgatcgaggcccagggactggaggccctgatcgcggcgactcccgatgaaggcgaagaaaacctcgactcctacgcgggaatgtccgccattcttttcgacgtccagctgcggccggtcaccttcttcaacggctacagcgacttgatgagtaaaatgctgagcgcctcaggcgaccccatttctgtggtgaagggactcattctccttattgatcatagccaagagctccaattgcaatcgggtttgaaagctaatatcgaagtgcagggagggctcgccatcgacatctccggggctatggaattctctctctggtaccgcgagagcaaaactagagtgaagaaccgggtgactgtggtcatcacgaccgacataactgtcgactcgtcattcgtgaaggcaggactggaaacctcgaccgagacggaagccggactcgagttcatcagcaccgtccagttctcacagtatccgttccttgtgtgtatgcaaatggacaaagatgaggcaccgttccggcagtttgagaagaagtacgaacgactgagtaccgggagaggctacgtgtcccaaaagcggaaggagtcggttcttgcgggctgcgagtttccgcttcaccaggagaactccgagatgtgcaaagtcgtgttcgcgccacagccggatagcacctcgtccggatggttt

SEQ ID NO: 16804 - DNA, 2682 bp, Artificial Sequence
  Description of Artificial Sequence: Synthetic coding sequence
atgatactgctggccgtcttatttctctgtttcattagctcatacagtgcctcagtcaagggccacacaacggggctgtctctgaacaatgacagactctacaaactgacctattcgacagaggtcttgctcgatcgaggtaaaggtaaacttcaggattcggtggggtatagaatttcctccaacgtggacgtcgcactcttatggaggaatccagatggggacgacgatcaactgattcagatcaccatgaaggacgtcaacgtggagaatgtgaaccagcagagaggagaaaagagcatctttaagggaaagtcaccatcaaaaatcatgggaaaagagaaccttgaagcccttcagcgtccaacactgttgcatctcattcacggaaaggttaaagagttttacagttaccagaacgaggccgttgctatcgagaacattaagcgaggcctggcttccctgtttcaaacccagttgagtagcggaaccactaacgaagttgacatctccggcaattgcaaggttacttaccaggcccatcaggacaaagtcattaagatcaaagcactagatagctgcaaaattgctagatcaggctttaccacacctaatcaggtactcggtgtttcatctaaagccacttctgtgaccacctataaaatcgaggatagtttcgtgattgcagtgctggcggaagagacccacaacttcggcctcaattttctgcagacaattaagggcaaaatagtgagcaagcagaagctggagttgaagactactgaagcgggaccaaggctaatgtctggcaagcaggccgctgccatcattaaggccgtggattcaaagtatacagccattcctatcgtcggacaggtcttccaatcccattgcaaaggatgcccgtccctttcagaactgtggagatcaaccagaaaatacctccagccagacaatctttcaaaagccgaggccgtccgaaatttccttgcctttatacagcacctccgaacggcgaagaaggaagagatcctgcagattctgaagatggagaataaagaggtgttgcctcaactcgtagacgcggtcacctctgcccagacgtccgattccttggaagctatcctggatttcctggatttcaaatctgactcctctattattctgcaggaaagatttctttatgcctgtgggttcgctagccaccctaacgaagaactattgagagcccttatttctaagttcaagggcagtattgggtcctctgatatccgagaaaccgttatgatcattactggaacccttgttagaaagctgtgccaaaatgaaggctgcaaactgaaggcagtggtggaggccaaaaaactgatcctcggcggtctggaaaaggccgaaaagaaggaggatacccgtatgtacctattggcactgaagaacgccctgctgcccgaaggtatcccctccttgcttaaatatgccgaagcaggcgaagggcctatttcccacctagcgaccacagccttgcagaggtatgatctccccttcattaccgatgaagtgaaaaagactctgaaccgaatttatcaccaaaatcgaaaagttcatgaaaagacagtccgaaccgctgcagccgccatcattctgaataataatccgagctacatggacgtgaagaatattctgctgtccattggggaactgccacaagagatgaacaagtacatgcttgccatcgtccaggacatcctgcggttcgaaatgcccgcctcgaagatcgtcagaagggtattgaaggaaatggtagcacataactatgataggttttctcgaagcggcagttcctctgcatatactggatacattgaaagaagcccgcgttctgccagcacttacagcttagacatactttactccggctccgggatcctgagacgatcgaacctgaacattttccagtacatcggcaaggcaggcctgcatggcagccaggttgttatcgaagcccaggggctcgaagcccttattgccgccacacccgatgagggagaagagaatctggatagttacgccgggatgtccgcaatcctgtttgacgtgcagctccggcccgtgacattcttcaacggttatagtgacctgatgtccaagatgctttcagcatccggagaccccatatccgttgtgaagggcctaatcttgcttatcgaccactcacaggaacttcagctacagtctgggctgaaggcaaatatcgaagtgcagggaggactggcaattgatatttctggcgccatggagttttcattgtggtatcgagaaagcaagaccagggttaagaatagggtcacggtggtaattacaacagatatcactgtagattcttcttttgtaaaggcgggactcgagacatcgacggaaaccgaggccgggctggagtttatttccactgttcagttttctcagtaccctttccttgtgtgcatgcagatggacaaagacgaggccccttttagacagtttgaaaagaagtacgagcgtctgagcacagggcgaggatacgtgagccagaaaaggaaggagtcagtgctggctggttgtgaattccccttgcatcaggaaaattccgagatgtgtaaagtcgtattcgccccacagcctgactccactagctccggatggttc

SEQ ID NO: 16805 - DNA, 2682 bp, Artificial Sequence
  Description of Artificial Sequence: Synthetic coding sequence
atgatcttgctcgccgtgctgtttctgtgtttcatttcaagctactcggcatcggtcaaaggacacactaccggtctttcgttgaacaacgaccggctgtacaagctgacctacagcactgaggtcctgctggaccgcggaaagggcaagctccaggactcagtgggatatagaatctccagcaatgttgatgtggccctgctgtggagaaatccggatggagatgacgatcaactcatccagattaccatgaaggacgtgaacgtggaaaacgtgaaccaacagagaggagagaagtcgatcttcaagggaaagtcgccatctaagatcatgggcaaagagaacctggaggcgctgcaaagaccaactttgctccatctgatccacggaaaggtgaaggaattctacagctaccaaaacgaagcggtggccattgagaacattaagcgcggcctcgcgtcgctgttccagacccaactctcctccggaaccaccaacgaggtggacatcagcggaaactgtaaggtcacttaccaggcgcaccaagataaggttatcaagattaaggcgctcgactcatgcaaaatcgctaggtccggtttcacgactccgaatcaggtcctcggggtcagctccaaggccacttcagtcactacctacaagatcgaggactccttcgtcattgccgtcctggcggaggaaacccacaacttcgggctgaatttcctgcaaaccattaaagggaaaatcgtctccaagcagaagctcgaactgaaaactacggaggccgggccgcgcctgatgtcaggcaaacaggctgccgccatcatcaaggcggtggattcaaagtatactgctatccctatcgtcggacaagtgttccaatcgcattgcaagggttgtccgtcgctgtccgagctgtggcgatcgacccggaagtacttgcaaccagacaacctctccaaggcagaggccgtgcgcaatttcctggcgttcatccagcacctccggactgctaagaaggaagagatcttgcagatcctcaaaatggaaaacaaagaagtgctgcctcagctggtggacgccgtgacctcggcccaaacttcggacagcctggaagccatcctggacttcctggacttcaagtccgacagcagcatcatcctccaggaaagatttctgtacgcctgcggattcgcgagccatccaaacgaagagttgctgcgcgctcttatctcaaagtttaagggatccatcggaagctcagacattcgagaaacggttatgatcatcaccggtaccctggtgcgcaaactttgccagaatgaaggctgtaagttgaaagccgtcgtggaagcaaagaagctcattttgggaggactcgaaaaggccgagaagaaggaagatacccggatgtacctgctggcgttgaagaacgccttgttgcctgaaggaatcccttccctgctgaaatacgcggaggctggagagggaccaatctcccacttggccaccactgcccttcaaaggtacgatctccctttcatcacggatgaggtgaagaaaaccctgaatcggatctatcaccaaaatcgcaaggtgcatgaaaagactgtgcggaccgccgccgctgcaatcattttgaacaacaatccgagctacatggacgtgaagaatatcctgctctccattggagaattgcctcaagagatgaacaaatacatgctggcgatcgtccaggatatcttgcgcttcgagatgcccgcgtctaagatcgttcggagagtgctgaaagaaatggtggcccacaattacgaccgcttctcccgcagcggttcgtcctcagcttacactggttacattgagcgctcaccgcggtccgcatcgacgtactcattggatatcctctactccggctcaggcatcctgaggagatccaacctcaacatcttccaatacataggtaaagcgggtctgcacggctcacaggtggtgatcgaggcgcaagggttggaggcattgattgcggccaccccggacgagggggaggagaacctggattcatacgcgggcatgtccgcaatcctgttcgatgtgcagttgcggccagtgacgttctttaacggatactcggatctgatgtcgaagatgctgtcagcttcgggagatcctatctcggtggtcaaaggcctcatcctgctcattgatcacagccaggaactgcaacttcagtcaggcctgaaagcaaacatcgaggtccaagggggcctcgccattgacatttccggagctatggaattctcgctctggtacagggaaagcaaaacccgcgtcaaaaacagggtgaccgtcgtcattactaccgacattactgtggatagcagctttgtgaaggcaggacttgaaacctcaactgagactgaggccggtcttgaattcatcagcactgtgcaattttcgcagtacccattcctggtgtgcatgcaaatggacaaggatgaggccccgttccggcagtttgagaagaaatatgaaaggttgtcaactggaaggggttacgtgtcccaaaaacggaaggaatcagtgctggcagggtgcgaattcccactgcaccaagagaactcagaaatgtgcaaagtcgtctttgctccacaaccggattcgacgtccagcggatggttc

SEQ ID NO: 16806 - DNA, 2682 bp, Artificial Sequence
  Description of Artificial Sequence: Synthetic coding sequence
atgattctgctggcagtactctttctatgttttataagcagttactctgctagtgtcaaggggcatacgaccggactgagtctgaacaacgaccgactttacaaactgacatattcaaccgaagttctgctggacagagggaagggtaagcttcaggattctgtcggctaccggatctcctcgaatgtggacgtagcactgttatggcggaacccagatggcgacgatgaccagcttattcagataacaatgaaggatgtcaatgtagaaaatgtgaaccaacagcgaggcgaaaagtccatcttcaaaggaaagagcccctctaagatcatgggaaaagaaaatttggaggccctccaaaggccgaccctcctgcatctaatccacggaaaggtgaaggagttctactcatatcagaatgaggccgtggcaatcgagaacattaagaggggacttgctagtctgttccagacccaattgtcaagcggaactacgaacgaggtcgacataagtggaaattgcaaagtgacataccaggcccaccaagacaaggtgattaaaatcaaagcgctggacagctgcaagatcgcccgctctggattcacaaccccaaatcaggtactgggcgtcagcagcaaggccacgtccgtaaccacgtacaaaatcgaggattccttcgtcatagccgtgctcgctgaggaaacacacaattttgggctgaattttctgcagacgattaagggaaagattgtgtcaaagcaaaagctggagctaaagactactgaagccgggccccgactaatgtctggaaagcaggccgctgcaatcattaaagccgttgactccaagtatactgcgatccctatcgtgggccaggtattccagtcccactgtaaaggctgtccgtctctctccgaattatggaggagcactcgcaaatacctgcaacctgacaatctgtctaaagcagaggcagtgagaaacttccttgctttcatccagcatctgcgcaccgccaagaaagaggaaattttgcagatcctgaagatggaaaacaaggaggtgctgcctcagctggttgatgcagtcacttccgcacagacctctgactcactggaggcgattttggattttcttgactttaaatctgattccagtataatactgcaggagcgattcctatacgcctgtggatttgcctcccaccctaatgaagaacttctccgggcccttatttctaagtttaaaggttctatcgggtcatcggatataagagagaccgtgatgattataacggggacactcgtcaggaaactgtgccagaatgaaggctgcaaattgaaggccgttgtggaagctaagaaactgatcctggggggtctggaaaaggcggaaaaaaaagaggacacccgaatgtatctgcttgctctcaagaacgcactcctgccagagggtataccttcattgctcaagtacgctgaggccggtgagggcccgatttctcatctcgcgaccaccgccctacagcggtacgatttgcctttcattaccgatgaagttaaaaagactctgaatcgtatctatcatcagaatcgcaaagttcacgagaaaactgtaagaactgctgctgctgcaatcattcttaataataacccatcttatatggacgtgaagaacatactgctctcaattggcgagctgccacaagagatgaacaagtacatgctcgcaatcgtgcaggatattttgcggttcgagatgccagcatccaagatagtacggagagtattgaaagaaatggttgcgcataactacgaccggttcagtcgaagcggaagttctagcgcatacactggctacattgaacggtcacctcgaagcgcgtcgacctactcactggatatcctctattcggggagtggtattctaagaaggtcaaacctgaatatttttcagtacatcggcaaagcagggctgcatggtagccaggtagtgatcgaggcacagggtttggaggctctgatagcagcaacaccagatgaaggggaagagaatctggactcttacgccggcatgtcggctatactgtttgacgtgcagttgaggccagttacctttttcaacggatacagcgatcttatgagcaagatgctgtcagcgtccggagaccctatatccgttgttaagggcctcatacttctcatcgaccattcccaggagctacaacttcagagtgggctgaaagcaaatatcgaagtacaggggggcttggcgatagatatatctggggccatggaattctcgttgtggtaccgagagagcaaaactagagtgaagaatagagtaactgtggttattaccactgatataaccgtcgacagctctttcgtaaaagctgggcttgagacgtctaccgaaaccgaagccggactagagtttatatcaaccgtgcaattttcgcagtatcctttcttggtatgcatgcagatggataaagacgaagctccgtttcggcagtttgagaaaaagtacgagagactaagcactggacgcggttacgttagccagaagcgaaaagagagtgtgttggccggatgtgaattcccgctgcatcaggaaaatagtgagatgtgtaaagttgtgttcgctcctcagcctgactctacctctagtggatggttc

SEQ ID NO: 16807 - DNA, 2682 bp, Artificial Sequence
  Description of Artificial Sequence: Synthetic coding sequence
atgattttgctggcagtattgttcctttgcttcatttcaagctacagcgcaagcgttaaggggcacactacagggctctccttgaataacgatagattgtacaaactgacatattccactgaagtactgctggatagagggaagggaaagttgcaagactcagtgggatatagaatctcgagtaatgtggatgttgccttactgtggcgcaatccggacggagacgatgaccagctgatccaaatcacgatgaaggacgtcaacgtcgaaaacgtcaaccaacagcggggagagaaaagcatcttcaagggaaagagccctagcaagataatgggaaaagaaaacctggaggctctccaaaggcctacccttctccatctgatccacgggaaagtgaaagagttttactcctatcagaacgaggctgttgctattgagaacatcaaacgcggacttgcctcgctcttccagacccagctgagcagtggaaccactaatgaggtggatatctctgggaactgtaaagtgacttaccaggcacatcaagataaagtgatcaaaatcaaagcacttgactcatgcaaaattgcacgatccgggttcaccacccccaatcaggttctgggcgtgagttctaaggccaccagcgtaaccacttacaagatcgaggactcattcgttatagcggtactcgcggaagaaactcacaattttgggctcaactttctccagacaatcaagggtaagatcgtctcgaaacaaaagcttgaattgaagaccaccgaggccgggcccagactgatgagcggtaaacaagccgccgctattattaaggctgtggacagcaaatatacagcaatcccaatcgttggacaggtgttccagagccactgcaagggctgcccatccctgtctgaactttggcgttcaactcggaaataccttcagcccgacaacctgtctaaagccgaggccgtcaggaactttctggcctttatccagcacctgcgcacagccaagaaggaagaaatactccagatccttaaaatggaaaataaggaggtgttgcctcaactggtcgacgccgtgacttcagctcagacatccgactcactggaagccattctggattttttggatttcaaaagcgatagcagtatcatacttcaggaacgctttctttacgcttgcggattcgcgagtcatccgaacgaagaactgcttagagctctcatctcaaagtttaagggatccataggcagcagcgacataagggaaaccgtaatgatcatcaccgggactctggtcaggaaactctgccaaaatgaaggctgcaaactcaaagccgtcgtggaagctaagaagctcatcctgggcggcctcgagaaagcagaaaaaaaggaggatacaagaatgtacctgcttgcactcaaaaatgcactgctccctgaggggattcctagcctccttaagtacgctgaggcaggagagggcccaattagccacctagccactactgccctgcagcgatatgatctgccttttataaccgatgaagtgaagaaaacccttaaccgaatttaccatcagaacagaaaagtgcacgagaagaccgtgagaaccgctgccgcagccatcatcctgaacaataacccgtcgtacatggatgtgaaaaacatcctgctcagtatcggggaactcccacaagagatgaacaaatatatgttagccatcgtccaagatatccttcgcttcgaaatgccagcttcgaagatcgttcgccgagtgcttaaagaaatggtcgcccacaattacgatcgcttttccaggagcggcagctcatcagcttacactggctatattgaacgttcgcctagatcagcaagcacgtacagtcttgatatcctgtattctggcagtggtatacttagaaggagcaacctgaacatctttcagtatataggcaaggcagggctgcatggatcccaggtggttatcgaggcccagggactcgaggcactgattgctgctaccccagatgagggggaagagaacctggactcttatgctggcatgtcagcgatcctgttcgatgttcagctcagacccgttacattctttaacggatatagcgatctgatgagtaagatgctgagcgcctccggggatcctatctcggtcgtcaagggattgattcttctcatcgaccattcacaagaattgcagttgcagtccggcctgaaggcaaacatcgaggtccagggcggacttgccatagacataagcggcgctatggagttttcactgtggtaccgcgagagcaagaccagggtgaaaaacagagtcaccgttgtgatcaccactgatatcacagtggactctagctttgtcaaggcaggattggagacctcgacagagaccgaagcagggctcgagtttatttccactgtccagttttcccagtatccattcctcgtgtgcatgcagatggacaaagatgaagccccgtttaggcaatttgagaagaaatacgagaggctgtcaacaggaaggggctatgtgagccaaaaacggaaggaaagtgtcctggccggctgcgagtttccacttcatcaggaaaactccgagatgtgcaaagtggtattcgctcctcagcccgacagcacttcctcaggatggttc

SEQ ID NO: 16808 - DNA, 2682 bp, Artificial Sequence
  Description of Artificial Sequence: Synthetic coding sequence
atgattctgctggccgtgcttttcctctgttttatcagctcgtattcggctagcgtgaagggacataccaccggcctgtccctcaacaatgatcggctgtacaagctgacttacagcaccgaggttctgctggaccgcggaaaaggcaagctgcaagattcggtgggctacagaatctcgtccaatgtagatgtcgcgttgctctggaggaacccggatggagacgacgaccagctcattcaaatcactatgaaagatgtcaatgtagaaaacgtcaaccagcagcgcggtgaaaagtccatctttaagggaaagtctccatcgaagattatggggaaggagaacctggaagccctgcagcgcccgactctccttcacctgatccatggaaaggtgaaggaattctattcataccagaatgaagccgtggccatcgaaaacatcaaacggggtctggcctcgttgttccagactcaactctcatcggggactaccaacgaggtcgatatctccggaaattgtaaagtgacctaccaggctcatcaggacaaagtgatcaaaatcaaggcattggactcgtgcaagatcgcccgcagtggttttaccaccccgaatcaggtgttgggagtctcaagcaaggccactagcgtgaccacctacaagatcgaggactcatttgtgattgccgtgctggccgaggaaactcacaattttggactgaacttcctgcagactatcaagggtaagatcgtgtcaaagcaaaaacttgagttgaaaaccacggaggcggggccaagactgatgtcgggaaagcaggcggcggccatcatcaaagcggtggactccaagtacactgcgatccccatcgtgggccaagtgttccagtcgcattgcaagggatgcccgagcctgtcggagctgtggcgtagtaccaggaagtacctgcagcctgacaacctctccaaagcagaggccgtgagaaatttcctcgctttcatccaacacttgaggacggccaagaaggaagagattctccagatcctgaaaatggagaacaaagaagtgctccctcagctggtggacgcggtgacttccgcgcagacgagcgactcacttgaagccatcctcgatttcctcgacttcaaatcagacagctcgattatcctgcaggagcgattcctctacgcgtgcggattcgcgtcgcacccaaacgaagagctgctgagggctcttatctccaaattcaagggcagcatcggttccagcgatatccgcgaaacggtcatgatcatcacggggacgctcgtgcggaagctgtgccagaatgagggctgcaagctgaaagcagtggtcgaggcaaagaaattgatcttgggcggactggaaaaggcggaaaagaaggaggacaccaggatgtacctgcttgccctgaagaatgcgctccttccagaaggaattccaagcctgttgaagtacgctgaagctggcgaggggcctatctcgcatctcgcaaccactgcccttcaaagatacgatctgccgttcatcactgatgaagtgaaaaagaccttgaacagaatctaccaccaaaaccggaaggtgcatgaaaaaactgtgagaactgccgcagcagcaataatcctcaacaacaatccgtcctacatggatgtaaagaacatacttttgtcaatcggagagctccctcaagagatgaacaagtatatgcttgcgatcgtacaagatatactccgcttcgaaatgcccgcctcgaagattgtccgcagagtattgaaagagatggtcgcacacaattatgacagatttagccgctcggggtcctcatcagcctacaccgggtacatcgaacggtccccacgctcagcatccacttactcgttggacatcctgtactccgggtccggcattctgagacggagcaacctgaacatcttccagtacattggcaaggcgggtctgcacggatcccaggtcgtgatcgaagcacaagggctggaagcgctcatcgcggctaccccagatgaaggagaagagaacctcgactcgtacgcgggcatgagcgcaatcctgttcgacgtccagctgcgccccgtgactttcttcaatggttactcagacctgatgtcgaagatgctgagcgcctcaggagatccgatctctgtggttaaggggctgatccttctcatcgaccactcccaggaactccagctccagtcaggactcaaagccaacattgaggtccaaggaggtctggctatagacatttccggagccatggaattctcactttggtacagggaaagcaagacccgcgtgaagaacagagtcactgtggtgattaccactgatatcaccgtcgacagcagctttgtcaaggctggactcgaaacctccaccgaaaccgaggccggactggagttcatctctactgttcagttcagccaatacccgttcctggtgtgcatgcagatggataaggacgaagccccctttcggcaattcgagaagaagtatgagcggctctccaccgggcggggatacgtgtcccaaaaacggaaagaatcagtgctcgctggatgcgagtttcctttgcaccaggaaaattcagaaatgtgtaaggttgtctttgccccgcaaccggattcgaccagctcaggatggttt

SEQ ID NO: 16809 - DNA, 2682 bp, Artificial Sequence
  Description of Artificial Sequence: Synthetic coding sequence
atgatactcctggcagtcctgtttctgtgtttcatctcctcttactctgcatctgtaaagggacacaccactggcctgagcctgaataacgatcggctctataagttaacatactccacagaagtgttgctcgacagaggaaagggcaagctgcaggacagcgtcggttatcgcatctctagcaacgtggacgtggccttgctctggcgaaatcccgacggcgatgacgatcagctcatacaaatcacaatgaaggacgtgaacgttgagaatgtgaatcagcagagaggggaaaagtccattttcaaagggaagtccccctccaagattatgggaaaagagaatcttgaggctctgcagaggcccaccctccttcatttaatacatgggaaggtgaaggagttttactcctatcagaacgaggccgtggcaatcgagaacatcaaaaggggactagcctccctatttcagacccagctgtccagtggcactaccaacgaggtggacatcagtgggaattgtaaggtcacatatcaggcacaccaagacaaggtgatcaagatcaaagccctggattcttgcaagatcgcccggagtggcttcaccacgcctaaccaggtgctgggagtctcttccaaggccacttcggtgaccacttacaaaatcgaagatagcttcgtcatcgctgtgctggcagaggagacccacaatttcggtttgaatttcctccaaacaataaaaggaaaaattgtgtcaaaacagaagctggagttgaagacgaccgaggcgggccccagactcatgagcggaaagcaggccgccgcgatcatcaaagccgtggacagtaagtataccgccatccccatcgtcgggcaggtgtttcagtctcattgcaagggctgcccctcactttccgaactgtggcgctctacaagaaaataccttcagcctgacaacctgtcgaaggccgaggcggttcgcaacttcttggctttcatacagcatctgcggacggccaagaaggaagaaatcttacagatccttaagatggagaacaaggaagtgttgcctcagcttgttgatgcggtgactagtgcccagacatccgattcgctcgaagccatattggatttcctcgatttcaagtcagactcctccattattctgcaggaaaggttcctttatgcgtgcgggtttgcgtcccacccaaacgaggagctcctgcgtgctctgatctcaaaatttaaaggctccattggatcatccgacatccgcgagaccgttatgattataacagggacactagtgaggaagctatgccagaatgaaggctgcaaactgaaggctgtggtagaggctaagaaactgatacttggagggctggaaaaggcggagaagaaggaggacacgagaatgtatcttctggctctgaagaacgctttgctacctgaagggattccaagcctgctcaaatatgccgaggcaggcgaagggcccatcagtcacctcgccacaactgccctccaaagatacgatctcccattcatcacggatgaggtaaagaaaaccttgaatcggatctaccatcagaaccggaaggttcacgaaaagactgtgcggacggccgctgccgcaataattctgaataataacccctcctacatggatgttaagaacatacttctgtcaatcggtgagttaccccaggaaatgaataaatacatgctcgccattgtccaggacatattgaggtttgagatgccagcgtcaaagattgtgaggagggtgctcaaagagatggtagctcataactacgacagattttctagatctggcagttctagcgcttacaccgggtacattgagcggagtccacgatccgcctctacatacagtctcgatatcctgtacagcgggtcaggtatcctgaggcggagcaacctgaatattttccagtatatcgggaaggcagggctccatgggagtcaagtggtcatcgaagcccaggggctggaggccctaatcgccgccacccccgacgagggtgaagagaacctcgacagctacgcaggcatgtcggctatccttttcgatgtgcaactgcgacctgtcacttttttcaatggttactctgacctcatgtctaagatgctgtcggccagcggtgatcccataagtgtcgttaagggccttatattgctaatcgaccattcccaggagcttcagctgcagagcggcctgaaagccaacatcgaggttcagggcggactagctatcgacatttcaggcgccatggaattcagcctgtggtacagagaatccaagacacgcgtgaaaaatcgcgtcaccgtggttatcaccaccgatattacagtggattcctcattcgtgaaggctgggctcgagacctccacagagacggaggctggtcttgaatttatcagtacagtccagttcagtcagtatccattcttagtttgcatgcagatggacaaagatgaggccccttttagacagtttgaaaagaagtatgagcgcctgtctactggcaggggctacgtatcgcaaaagcgcaaggaaagcgtgctggcaggctgcgaatttccactgcaccaagaaaactcagaaatgtgcaaagttgttttcgctcctcagccggacagcacctccagtggctggttt

SEQ ID NO: 16810 - DNA, 2682 bp, Artificial Sequence
  Description of Artificial Sequence: Synthetic coding sequence
atgattctgctcgcagtactcttcctgtgctttatcagctcctattccgcatccgttaaagggcacaccaccggattatcactgaataatgaccggctttacaagctaacttatagcacagaggtcctgttggacagaggcaaggggaagttgcaagattccgtgggctaccggatctcctcaaacgtggacgtcgctctgctctggcgcaatccagacggagatgacgatcagcttatccagataactatgaaagacgtgaacgtggaaaatgtaaaccaacagcgaggtgagaagtctattttcaaggggaagagcccatctaagattatggggaaggagaacctcgaggctttacagaggcccacgctgctgcatctgatccatggcaaagtgaaggagttctactcctatcaaaacgaggctgtcgccattgaaaatataaaacgggggctagcatctttattccagacccagctgagcagtggtactaccaacgaagtggacatttctggtaattgcaaagtgacttaccaggcacaccaggacaaagtaataaagattaaggcgttggattcttgtaagatcgccagatccgggttcacaactccaaaccaggtgttgggagtgtcatcgaaggcaactagcgtaaccacttacaagatagaagactcctttgtgattgctgtgttggcagaggagacccacaatttcgggctaaatttcctgcagacgatcaagggcaagatcgtatcgaagcagaaactggagttgaaaacaaccgaggctgggcccaggctcatgtccgggaagcaagctgctgctatcattaaagccgtagatagcaagtataccgcaatcccaattgtgggccaggtttttcagtcacattgcaagggctgtccgagcctttctgagctatggcgttcaacacgcaagtacctgcagcccgataatctgtctaaggcggaggctgtacggaatttcctagccttcatccaacacctgcggactgccaaaaaggaggagatcctacaaattctgaagatggaaaacaaggaggtccttccccagttggtggatgcagtgacctccgcccaaacctcagacagccttgaggccattctagattttctcgatttcaaaagcgactcctcaatcattctgcaggagcggtttctgtatgcctgtgggttcgctagccacccgaatgaagagctgctgcgggcgttgattagtaagttcaaagggtctattggctcatcagacattcgggagacagtaatgatcatcaccggcaccctcgtccggaaactctgtcaaaatgagggctgcaagctgaaggcagtggtcgaagctaagaagctcatcttgggcggcttggagaaagcggagaaaaaagaagataccaggatgtacctgctcgctcttaagaatgccctcctcccggagggaataccatccctgctaaagtatgccgaagccggcgagggcccaatatctcatctggctaccacagccttgcagcggtacgatctgcccttcattactgatgaagtgaaaaagactttaaataggatctatcatcagaatcggaaagtgcatgagaagacagtgaggacagccgcagctgcaattattttaaataacaacccttcctatatggacgtgaaaaatatccttctgagtattggggagctacctcaggagatgaacaaatacatgctcgcaatagtgcaggacattttgcgtttcgagatgccggcctccaaaattgtgagacgcgtcctgaaagagatggtcgcacacaactatgatcgcttctcgaggagcggctcatccagtgcctataccgggtacattgagcgctcgccaaggagcgcatccacctacagcttagatatcctgtatagtggcagcggcatcctgcgcagaagtaaccttaacatcttccagtacataggcaaagccggacttcatggcagtcaagtggtgatcgaggcccaaggtttggaagctttgatcgctgcaactccagacgaaggagaggagaacctggatagttatgctggaatgagtgccatactgtttgacgtgcagctcagacccgtaacattttttaatgggtacagtgacctcatgtctaagatgctaagtgcttcaggcgacccaatctcggtcgtgaaaggccttatcttgttaatcgatcattcccaggagctccagctacaatcgggcctcaaggcaaatattgaagttcagggcgggctggcaatcgatatctctggagccatggagttttcattatggtatcgagaatccaagacacgggtcaagaaccgtgtcactgttgttatcactactgatattactgtcgattcatcattcgttaaggcgggcctggagacttctaccgagaccgaggcaggcctggagtttatttctaccgttcagttttctcagtatccctttctcgtatgtatgcagatggacaaggacgaggccccttttcgtcaatttgaaaagaaatacgagcgactttcgactggccgtggttacgtcagccaaaagagaaaggagtccgtgctggctggctgcgagttccctctccatcaggaaaacagtgagatgtgtaaagtcgtgttcgctcctcagcccgatagcacgtcttctggatggttt

SEQ ID NO: 16811 - DNA, 2682 bp, Artificial Sequence
  Description of Artificial Sequence: Synthetic coding sequence
atgatcctcctcgcggtgctgtttctgtgctttatctcgtcatacagtgcttcagtgaaaggacacaccacgggactctccctcaataacgatagactttacaaactcacctactcaactgaggtcctgttggacagaggaaagggcaagctgcaggatagcgtcggataccgcatctcgtcaaatgtggacgtggcccttctgtggcggaatcctgacggagacgacgatcagctgattcaaatcactatgaaagacgtcaatgtggaaaatgttaatcagcagaggggtgaaaaaagcatcttcaagggaaaatcgccatctaagatcatggggaaagaaaacctggaagcattgcaacgcccaaccctcctgcatctgatccatggaaaagtgaaggaattctactcgtaccagaacgaagcagtggccattgagaacatcaagcgcggactggcttccctgttccagactcaactttcctccggaactaccaacgaagtcgatatctccggaaactgcaaggtgacctaccaggcacaccaggacaaggtgatcaagatcaaagccctggactcgtgtaagatcgcccggtcgggctttacgactccgaaccaagtgctgggcgtgtcgtctaaggcgacttccgtgactacctacaagatcgaggactctttcgtgatcgcggtccttgcagaagaaacccacaacttcggactcaatttccttcagaccatcaaaggaaagattgtgtccaaacaaaaacttgagctgaaaactactgaagctggcccgcgcctgatgagcggaaaacaagcggcagccatcatcaaggccgtggattccaagtataccgcaattccaatcgtgggacaggtgttccagtcacactgtaagggttgcccgtccttgtcggagctctggagatccacccgcaagtacctgcaaccggacaacctctcgaaggcagaggcggttagaaacttcctggccttcattcagcacctgcgtactgctaaaaaggaggagatcttgcagatcttgaaaatggagaacaaagaagtgcttccacagttggtggacgccgtcacttcggcccagacctccgacagccttgaggctatcctggattttctggactttaagtcggattccagcattatcttgcaagaacggttcctgtatgcctgcggattcgccagccatcccaacgaagagttgttgagagccctcatctccaaattcaagggaagtataggttcgtccgacatccgggaaaccgtgatgataatcaccgggacccttgtccggaaactgtgccagaacgaaggctgcaagctcaaagcagtggtcgaggcaaagaaattgatcctcggcgggctggaaaaggcggaaaagaaggaggacaccagaatgtacctcctggcactgaagaatgcgctgctgccggagggaatcccgtccctgttgaaatacgcggaagccggggagggacctatctcccatctggctactaccgccttgcagagatacgacctgccgttcatcaccgacgaggtcaaaaagactctgaaccggatctaccatcaaaaccgcaaggttcatgaaaagactgtgcggactgccgcggcggcgatcatccttaacaataacccctcgtacatggatgtgaagaatattctgctgtcaatcggcgagttgccgcaggaaatgaacaagtatatgctggctatcgtgcaggacattctcagattcgaaatgccggcatcaaagatcgtgcgaagagtcctgaaagaaatggtcgctcacaactacgaccggttctcgagatcagggtccagctcagcatacaccgggtacatcgagcggtcgcctcgctccgcgtcaacctactccctggatatcttgtactcgggctcagggatcctgcggagatcgaacttgaacatcttccaatacattggaaaggccggcctgcacggatctcaggtggtgatcgaggcccagggtctggaggccctgatcgccgccaccccggatgaaggagaggagaacctcgatagctacgcgggaatgtccgcaatccttttcgatgttcagcttcgcccagtgactttcttcaatggatattcggacctgatgagcaagatgcttagcgcttcgggcgatcctatcagcgtggtgaagggactgatccttcttattgaccactctcaagaacttcagctccagtcaggactcaaggcgaacatcgaagtgcagggcggactcgcaatcgatatctcgggtgctatggaattctccctgtggtaccgcgaaagcaagactcgggtgaaaaacagggtcaccgtcgtgatcaccactgatatcaccgtggacagttctttcgtcaaggccggcctcgaaacctcaactgaaaccgaagcaggtctggagttcatctcaacggtgcagttctcgcaatatcccttcctcgtgtgcatgcagatggacaaagacgaggcccctttcagacagttcgagaaaaagtatgaaaggttgtcaactggacgcggatacgtctcccagaagcggaaggagtcggtgctggccggctgcgaatttccacttcaccaagagaactcggagatgtgtaaggttgttttcgcgccgcagccagactccacctcatctggatggttt

SEQ ID NO: 16812 - DNA, 2682 bp, Artificial Sequence
  Description of Artificial Sequence: Synthetic coding sequence
atgattctgctggccgtgctgttcctttgcttcataagctcatactcggcctcagtgaaaggtcatactaccggactgtcgctgaataatgaccgactgtacaaactgacttactcgactgaagtcctgctggaccgggggaaagggaaacttcaagactccgttggatacagaatttcgtcaaatgtggatgtggcactgctgtggcgcaaccctgatggagatgatgatcagctcattcaaatcacgatgaaagacgtgaacgtggaaaatgtgaatcagcaaaggggagaaaagtctatctttaagggaaagtcgccttcgaagatcatggggaaagagaaccttgaggctctccaaagacccaccctgcttcatctgatccatggcaaagtgaaggaattctatagctaccaaaatgaggctgtcgcaattgaaaacataaaacgcggtctggcctccctgtttcagacccagctctcatccgggaccaccaacgaggtggacataagcggaaattgtaaggtcacctaccaggcccatcaagataaggtgattaagatcaaggcactcgactcgtgtaagatcgcacgcagcggtttcactaccccaaaccaagtgctgggcgtgtcctccaaggccacgtccgtgaccacgtacaagattgaggactcgttcgtcattgcagtgctggctgaagaaactcacaatttcggactgaacttcctgcaaacgattaagggaaagatcgtcagcaaacaaaagctggaactgaaaaccactgaagcaggaccacgactgatgtccggaaagcaagctgcagcgatcattaaggcagtcgactccaagtacacggcgattccgattgttggacaagtctttcagtcccactgtaaggggtgtccaagcctgtcggaactctggagatcaactcgaaagtacctccaaccagacaacctgtcaaaggcagaagccgtgcgtaacttcttggcctttattcaacaccttcggaccgccaagaaggaggaaatcctgcagattttgaaaatggaaaacaaggaagtgcttccgcagctcgtggacgcggtgacttcagcacagacctcagattctctggaggcgattctcgatttccttgatttcaaatcggattcctccattatactgcaggaacggtttctctacgcttgcggattcgcctctcatcccaacgaggaattgctccgggcacttatctccaagttcaagggttcgatcggatcgtccgatatcagagaaaccgtgatgatcattactggtacgctcgtgcgtaaactttgtcagaacgagggctgtaaactgaaggccgtggtggaagcgaaaaagctgatccttggcggactggagaaggccgagaaaaaggaagataccagaatgtacctgcttgcgctcaaaaacgcactgctcccggaaggaatcccatcgctgctgaagtacgccgaggcaggtgagggacctatttcccacctggcaaccaccgccttgcagcgatatgatcttccttttatcactgacgaggtgaagaaaaccctgaatcggatctaccatcaaaaccggaaagtccatgagaaaaccgtgagaactgctgcggcggcaatcattctgaacaataacccatcatacatggatgtgaagaacattttgcttagcattggcgaactgcctcaggagatgaacaagtacatgcttgcaatagtgcaggatatcctcagatttgagatgccagcatccaaaattgtgcgccgtgtccttaaagaaatggtggctcacaattatgataggtttagccggtcaggcagcagctcggcatacactggctacatcgagagatcgccacggagcgcatccacttacagccttgatatcctgtacagcggttccgggatacttcggagaagcaatctgaacatatttcagtacatcggaaaagctgggctgcatggaagccaagttgtcatcgaagcccaaggcttggaagcacttatcgccgcaactcctgatgagggagaagaaaatcttgactcctacgcaggcatgtcggcaatcctgtttgacgtccaacttcggcctgtgactttctttaacggatactccgacttgatgtcaaaaatgctgtccgccagcggggatccaatttccgttgtcaaggggctgattctgcttatcgaccattcgcaagaactccagctccagtccgggctgaaggccaacattgaagtccaaggtggacttgccatcgacatctcgggcgcaatggaattctcactttggtaccgcgaatccaagacccgagtcaaaaaccgcgtcacggtggtgattactaccgacattaccgtcgatagctcctttgtcaaggcaggactcgaaaccagcaccgagactgaagcaggtcttgagtttatctcgaccgtgcaattctcccagtacccatttcttgtttgtatgcagatggacaaggatgaagctccctttcgccaattcgagaagaagtacgagcggttgtcaaccggacgcggatacgtctcccagaagagaaaggagagcgtgctggcaggttgcgagtttcccctccatcaagaaaattcggaaatgtgcaaagtggtgtttgcccctcaaccagacagcacgtcatccggttggttt

SEQ ID NO: 16813 - DNA, 2682 bp, Artificial Sequence
  Description of Artificial Sequence: Synthetic coding sequence
atgattctccttgcagtgctttttctgtgtttcatttcctcatactccgcgagcgtcaagggccatactactggactgtcgctgaataacgatcgcctgtacaaactgacgtacagcaccgaagtgcttctggataggggaaaaggaaagttgcaggactcggtgggttatagaatatccagcaacgtggacgtggcactgctttggagaaatccagacggtgatgatgatcagctgattcagattactatgaaggatgtcaacgtggaaaatgtgaatcaacagcgcggcgaaaaatcaatctttaaaggcaagagcccgtcgaagattatgggtaaggaaaatcttgaagccctgcaaagacccactttgctccatctgatccatggcaaagttaaggagttttactcataccagaatgaagcagtggcaattgaaaacattaaacgggggcttgcatccctttttcagactcaactgtcgtccggaaccactaacgaggtcgatatttcaggtaactgcaaggtgacctaccaggcccatcaggataaagtcataaagataaaagcactggattcatgcaagatcgcacgcagcggcttcacgacgccaaaccaggtgcttggagtctcatcgaaggccacctccgtaaccacctacaagattgaggactcctttgtcatcgccgtgcttgccgaagaaacccacaattttggtctgaactttcttcagaccattaagggaaagattgtgagcaaacagaaactcgaattgaaaacgactgaggccggacccagactcatgtctggtaagcaagccgccgctatcattaaggccgtcgattcgaagtacaccgcaatccctatcgttggacaggtttttcaatctcattgtaaagggtgtcccagcctttcagaactctggcgatcaacccgtaagtacttgcagccggataacctgtcaaaggcggaggctgtgcgcaacttccttgctttcatccaacacctcagaaccgcaaaaaaggaagagattctgcagattttgaagatggaaaacaaggaggtgctgccacaactcgtggatgctgtcacttcggcacaaacctcggactctctcgaggcaatcctggacttcctggacttcaaatcggacagttctatcattcttcaagaacgttttctctatgcttgtggctttgcctcgcatcctaacgaggagctcctgcgggcacttattagtaagtttaagggaagcattggctcctccgatatcagggaaactgtcatgatcataactggtaccctggtgagaaagctgtgccagaatgagggatgtaagctcaaggcagtggtcgaagcaaagaaactgatcctgggaggattggaaaaagccgagaagaaagaggacaccaggatgtacctgctggcactgaagaacgcactgctgccagagggtattccttcgttgctgaagtacgcggaagcgggagaaggacctattagccatctcgccaccaccgcgcttcaaagatacgatctgccattcattactgacgaagttaagaaaacccttaatagaatctaccatcagaaccgtaaggtgcacgagaaaacggtcaggaccgcagccgcagctataatcctgaacaacaacccaagttacatggacgtcaagaacatattgctgtcaattggggaactgccgcaagagatgaacaaatacatgctggcaatagtgcaagatatacttagattcgaaatgcctgcttcaaagatcgtgcgtcgtgtgttgaaggaaatggtcgcacacaactacgacagattctcgaggtcgggctcctctagtgcgtatactgggtacatcgaacgctcccctcggagcgcatccacttactctcttgatatcctgtactcgggcagcggaattctccgccggtccaaccttaacatctttcaatacatcggcaaggctggtctgcacggttcgcaagtcgtcatcgaagcgcagggtcttgaagcacttatcgcagccacccccgatgaaggcgaagaaaatcttgattcatacgcaggaatgtccgcaatactgttcgacgtgcagctccgccctgtcacttttttcaatggctattccgatcttatgtctaagatgcttagcgcatccggcgatcctatatccgtggtcaagggtcttatccttctcatcgatcattcccaagaacttcaactgcagtccgggctgaaggcaaacatcgaagtgcagggcggacttgcgatagatatttcgggggctatggagttttccctttggtaccgggagtccaagacccgagtgaagaatagggtcaccgtcgtgataactactgatattactgtcgactcgtcgtttgtgaaggccggacttgaaacttcaaccgagactgaagccggactcgaattcatctcgaccgtgcaattctcgcaatatccttttctcgtctgtatgcaaatggacaaggacgaggcaccctttcggcaatttgaaaagaaatacgaacggctttcgaccgggcggggttatgtgtcacagaagcgcaaggagtcagtcctcgcagggtgtgagttcccactccaccaagaaaattcagagatgtgcaaagtggtatttgcgcctcaacccgactctacttcttcgggatggttt

SEQ ID NO: 16814 - DNA, 2682 bp, Artificial Sequence
  Description of Artificial Sequence: Synthetic coding sequence
atgatcctgctagcagttttatttctgtgcttcatctcatcttacagcgccagcgttaagggtcacaccactggtctgtccctgaataatgacaggctttataagctgacttacagcacggaggtcctgcttgacaggggtaaagggaaactgcaggattctgtgggctatcggatctcttctaacgtggatgtagccctgttgtggcggaatcctgatggcgacgacgaccagctgattcagattacaatgaaagatgttaatgtggagaacgtcaatcagcaaaggggcgagaagagcatttttaagggcaaaagcccaagcaaaatcatgggcaaagaaaacttggaagccctgcagcgccctaccctgctgcacctgattcacggtaaagtgaaggagttctacagctaccagaacgaagccgtcgcgatcgaaaacatcaaacgaggtctcgcatctctttttcaaacccaactgtccagcggtacgaccaacgaggtcgatatttcgggtaattgtaaagtcacctaccaagcacaccaagataaggtgattaagatcaaggcgctggatagctgtaaaatcgcgagaagcggttttacgacaccgaaccaggtcctgggcgtgagctccaaagcgacctcagttaccacgtataaaatcgaagactcatttgtcattgccgttttagcagaagagacgcacaactttggtctgaactttctccagacaatcaagggcaagattgtttcaaaacagaaactggagctgaagaccactgaggctggtcctcgtctgatgtccggcaaacaggcagcagccataataaaggcagtggatagcaaatacaccgcaattcccatcgtgggtcaggtgtttcaaagccattgtaagggctgtccaagcctgagcgaattgtggaggagcactagaaaataccttcaacctgacaacctgagcaaggctgaggcggtgaggaacttcctggccttcattcagcatttgcgtacagccaagaaggaagagatcttgcagattctgaaaatggagaataaagaagtcctgccccagctggtggatgcagtaaccagcgcacaaaccagcgacagcctggaggctatcctggacttccttgatttcaagtcagatagcagcataattctgcaggagcgcttcctgtacgcctgcggctttgcctcccatccaaacgaagaactgctgcgtgccctgatatctaagtttaagggaagtatcggcagcagtgatattcgcgagactgttatgatcattacgggaacgctggttcgcaagctttgtcagaatgagggctgtaaactcaaggcggtcgttgaagctaagaaattaatcctgggcgggttggagaaagcagaaaagaaggaggatacccgcatgtacttgctggctctgaagaacgcactgctcccggaaggaatacccagcttgctgaagtatgccgaggcgggagagggcccaatcagtcatctggccaccaccgctttgcaacgctatgacctgccgttcatcactgacgaggtgaagaaaacactgaacagaatataccatcaaaaccgaaaagtgcacgagaaaactgttcgcacagccgcggcagcaattatcctgaataacaacccgtcctacatggacgtgaaaaatatcctgctgagcataggcgagcttccacaggagatgaacaaatacatgttggctatcgtccaagacattctgcgctttgagatgccagcctctaaaatcgtgcgcagggtgctgaaggaaatggtggcacataactatgaccgcttttcccggagcggctctagcagcgcgtatacaggttatattgaacgctcacctagatccgctagcacctattctctggacatcctgtactccgggagtggaatcttacgccgtagcaacctcaacattttccagtacatcggcaaagcggggctgcatggctcccaggttgttattgaggcgcaaggcctcgaagcgctgatcgcggcgacccctgatgaaggtgaggaaaatctcgactcctatgcggggatgagcgcaatcctgtttgacgtgcaacttcgtcccgttacttttttcaacggctacagcgatttgatgagcaaaatgctctctgcgtctggcgatccgattagcgtggttaagggattgatcctactgatcgaccattcacaggaactgcaactacagtctggcctgaaagcgaacattgaggttcagggtgggctggcgattgacattagcggcgctatggagttttcgctctggtatcgcgagtccaagacaagggtgaaaaaccgcgtcaccgttgttattactacagatatcaccgtggactcttcgttcgttaaagccggcctggaaacctctactgagactgaggcagggctggagtttatttccactgtgcagttttctcaatacccattcctcgtttgcatgcagatggataaggatgaggcgccatttcgtcaattcgaaaagaaatacgagcgtctgagcacaggtcggggctacgtgagtcaaaagagaaaggagagcgttctggcgggatgcgagttccctcttcatcaagaaaattcagaaatgtgtaaagtcgtcttcgccccacaaccagactctaccagttcgggctggttt

SEQ ID NO: 16815 - DNA, 2682 bp, Artificial Sequence
  Description of Artificial Sequence: Synthetic coding sequence
atgattttgctcgcggttttgtttctttgctttattagttcgtatagtgcctctgttaagggtcacactacaggtctctcgctcaataatgatcgactatacaaacttacatattctactgaagtgttgttggacagaggaaagggaaaactccaagactcggttggttatagaatcagttccaatgttgatgtagctcttctatggaggaatcccgatggtgacgatgaccagcttattcaaattacaatgaaagacgtgaacgttgaaaatgtcaaccaacaacgtggtgaaaaatcgatattcaaagggaaatcaccatcaaagattatgggaaaagagaatcttgaagctcttcaaagaccaactttgctgcacctcatacatggaaaggtcaaagagttttactcctaccaaaacgaagcagttgccattgagaacattaaacggggattagcgtccctattccaaactcagttatcttctggcactacaaatgaagttgatatatcaggaaattgtaaagtaacataccaggcccaccaagacaaggttatcaagataaaggccttggattcgtgtaaaatcgcacgatcgggatttactactcctaatcaggtccttggtgtttcatcaaaggccacttccgtcacaacatataagattgaagatagcttcgtcatcgcggtactagccgaagagacacacaacttcggacttaatttcctccaaacaataaagggcaaaattgtcagtaaacaaaaattggaactcaaaaccacggaagctggtccccgcttgatgtctggaaaacaagcagcggctattatcaaagcagtggactccaagtatacagcaattcctatcgtcggtcaagtatttcagagtcattgtaaaggatgcccaagtttatctgaactctggcgtagcacgagaaaatacctacagccagataatctttctaaagcagaagctgttcgaaattttcttgcttttatccaacatttacgaactgctaaaaaagaagaaattctgcaaatccttaaaatggaaaataaagaagttctcccacagctcgtagatgctgttactagcgcacaaacatccgattcactggaagctattttggattttctcgatttcaagtccgactcgagtattattctgcaggaaaggtttctatatgcttgcggttttgcgtctcacccaaatgaggaactcttacgtgcactaatttctaagtttaaaggatccatcggttcttctgatatcagagaaacagtcatgattataaccggcacgttggtgagaaaattgtgtcaaaacgagggatgtaaacttaaagcagtcgtcgaggctaagaagctaattctcggaggacttgaaaaagcagaaaagaaggaggacacacgaatgtacctcttagcattgaaaaatgctcttcttcctgaaggaatcccttctcttctgaaatatgctgaggcaggagagggcccgatcagtcatttggctaccacagcactacaacgttatgacctgccatttattaccgatgaagtaaagaagactttgaacagaatctatcatcagaaccgtaaggtgcacgaaaagacagtgagaactgcagccgccgctatcatcttgaataataatccatcatatatggatgtgaaaaatatactcttaagtataggtgaattacctcaggagatgaataagtatatgttggcaatagtgcaagatattcttcgattcgaaatgcctgcatctaagatcgtgcgaagggtccttaaggaaatggttgctcataattacgatcgtttctctagatcaggaagctctagtgcatacacgggctacatagagagatcacctcgttctgcaagtacatactcattggatatcctttactcgggaagtggaattttaagaagatccaacctcaatatttttcaatacatcggtaaagctggattgcatggatcccaggttgtgattgaggcgcaaggattggaagcacttatcgccgccacgccggatgaaggcgaggagaacctcgactcttatgctggaatgagcgccatcttgttcgatgtgcaactacgaccagttactttcttcaatggttatagtgatttaatgtcgaagatgcttagcgcctcaggagatccaatctcagttgttaaggggttaatacttttaattgatcattcacaggaactccaattgcaatccggacttaaagcaaatattgaagttcaaggaggactagcaatagatatctcgggggccatggaattcagcttgtggtacagagagtctaagactagagtcaaaaacagagttaccgtcgtcatcactaccgacatcacagtggatagttcatttgtgaaggcgggacttgagacgagcactgaaacagaggctggacttgaatttatcagtactgttcagtttagccagtacccttttttggtatgcatgcaaatggacaaggatgaagcgcccttccggcaatttgaaaagaagtatgagaggctttccacagggagaggatacgtatcccaaaagagaaaagaatcggttctggcgggatgtgaattccctctgcatcaagagaatagtgaaatgtgcaaagtggtttttgctccacagcctgattccacgagctctggatggttt

SEQ ID NO: 16816 - DNA, 2682 bp, Artificial Sequence
  Description of Artificial Sequence: Synthetic coding sequence
atgatcctacttgcagtgctgttcctgtgcttcatttcctcttatagtgccagcgtgaaagggcacacaactggtctctcgctgaacaacgaccgattgtacaagctgacatacagcactgaagtgctgctcgatcgtggaaaaggcaagctccaagactctgtgggatacagaatctcctccaatgtggacgtcgctctgctctggagaaatccagacggcgatgacgaccagctgatccagatcacaatgaaagacgtaaacgtggagaatgttaatcagcagcgaggagaaaaatctatattcaagggtaagagcccctcaaagataatggggaaggagaacctagaagccttacagaggccaacgttactccacctcatacacggtaaagtgaaggaattctactcctaccagaatgaagccgtagccattgaaaatattaagcggggcttagcttccctgttccaaacccagctgtcatcaggtaccacgaatgaagtggacatctctggaaattgcaaagtgacttaccaagcacatcaagacaaggtcatcaagataaaggccttagatagttgtaagattgcgcgatccggctttacaacgcctaatcaggtgctgggagtctcttctaaagcaacaagcgtcaccacttataagatcgaggattcctttgttatcgcagtccttgcagaagaaacacacaatttcgggctaaatttcctgcagacgatcaagggtaaaattgtaagcaagcaaaaacttgagctgaaaaccactgaggctggaccaagactgatgagcggcaagcaggcagctgctattattaaagcagtggattcaaaatatacagcgatccccattgttggccaggtgtttcaatcccactgtaagggctgccctagtctgtctgagctttggagatctactaggaagtatttacagcctgacaatctgtctaaggccgaggctgtgaggaacttccttgccttcatacagcatttgcggacagctaagaaggaggagatcttgcagatccttaagatggaaaacaaggaggtgctgccgcagctggtagatgcagtgacctctgcacagacatccgacagcctggaagcgatcttggactttctggacttcaagtcagattcttccattatcctgcaggaacgattcctttatgcctgtggtttcgctagccaccccaatgaagaactcctgagagccctgattagtaagtttaagggaagcataggatctagcgacattagagaaacagtgatgattatcacagggaccttggtgcgaaaattgtgtcagaatgagggctgtaaactcaaggcagtggtagaagcgaaaaagttgatcctgggggggctcgaaaaggccgagaaaaaagaagacacccggatgtatctacttgcccttaaaaatgccctcctcccggagggcattcctagcctacttaagtatgcagaggccggcgaaggtccaatttctcacctggccacaacagctctgcagagatatgatcttccattcattaccgatgaagtcaaaaaaaccctgaatagaatatatcatcagaaccgtaaagtgcacgaaaaaacagtaagaaccgcagccgctgccattatcctgaacaataacccgagctacatggacgttaagaatattcttctatcgatcggagagttaccacaggaaatgaacaaatacatgctagccatcgtgcaggatatcctgaggttcgaaatgccagcctctaagatagtgaggagggtgctaaaagaaatggtggcccacaattacgatcgattcagtagatcagggtcctcctcagcctatacgggctacatcgaaagatctccgcgatccgcaagcacatactctttggacatcctgtatagtggatccgggatccttaggaggagcaaccttaacatctttcagtacatcggcaaagccgggctgcatggaagccaggtagtgattgaagctcagggcctggaagcgctgatcgctgccactcccgacgagggcgaggaaaacctggatagctacgccggaatgagtgcaatactgttcgacgtgcagttaagacccgtaaccttttttaacggctattccgatcttatgtcgaaaatgctgtctgccagcggggacccaatttcagtcgtgaaaggacttatcctcctgatcgaccactctcaggagctgcagttgcagagtggtcttaaggccaacattgaagtgcagggaggcttagctattgacatttccggggccatggaattcagcctctggtaccgggagtccaagactagggtaaagaacagggtgaccgtcgtcatcacgactgatataacagtggatagttccttcgtaaaagcaggcctggagacatctacggaaactgaggccggtttggagtttatctctactgtgcagttttcgcagtatccttttctggtctgtatgcagatggacaaggatgaggctccattccgacagtttgaaaagaaatacgaaagactcagtaccggaaggggatatgtcagccagaagcgcaaagagtctgtgttggctgggtgcgagttccccctgcaccaggaaaactcagagatgtgcaaggtggtttttgcccctcagccggattccactagtagtggatggttt

SEQ ID NO: 16817 - DNA, 2682 bp, Artificial Sequence
  Description of Artificial Sequence: Synthetic coding sequence
atgatcttgctcgccgttctattcttgtgctttatctcaagctactctgcgtccgtgaagggccacactaccgggctatctttgaacaacgatcggttgtataagttgacctacagcaccgaagttctcttggatcgtgggaagggtaaattgcaggatagtgtgggttataggatctcaagcaacgttgatgttgcattgctgtggcggaaccctgatggcgatgatgaccaattgatccaaatcaccatgaaggacgtaaacgttgagaatgttaaccaacagcgcggcgagaaaagcatcttcaagggaaagtccccctcgaaaatcatggggaaagaaaacttagaggccttgcagcgtcctacccttttgcatttgatacacggcaaggtcaaggagttttacagctatcaaaatgaggcagtggctattgagaatatcaagaggggtctggcgagcttattccaaacccagctttcatcgggaactacgaacgaagtggacatatccgggaactgtaaagtcacataccaggcccatcaagataaagtaatcaaaattaaagctctggacagctgtaaaatcgccagaagcggattcaccacccctaaccaggtgttaggagtcagttcgaaggcaacgagcgtgacgacatataagatcgaggacagcttcgttattgctgtcctcgcagaagaaacccataacttcggtctcaacttcttgcaaacgataaagggcaagatcgtttccaaacagaaactcgagctgaagacgacggaagcgggcccccgccttatgtcaggtaaacaggcggctgcgatcataaaagcggttgattcgaagtacaccgccatccccatcgttgggcaggtgttccaatcacattgtaagggctgtccctccctgtcggaactttggcgaagcaccagaaagtatttgcaacccgataatttgtcaaaggcagaggctgtacgaaatttcctggccttcattcagcacttgcgtactgctaagaaggaagagatcctccagatattgaagatggaaaacaaagaggttttgccgcaacttgttgatgctgtgacatcagcccagacatcggattcccttgaggctatactcgatttcctggacttcaagtctgactcttctattatcttgcaagagcgctttctttatgcctgcggcttcgcttcccatcctaacgaggaactgctcagggctcttatctccaagttcaagggcagcatcggaagtagcgacataagggagactgttatgatcattactggtactctggtccgcaaactctgtcagaacgagggctgcaagcttaaagcggtagtggaagcgaagaaacttatcctgggaggtttggaaaaagctgaaaaaaaggaggatacgcgtatgtatctccttgcgctcaagaacgcgctccttcccgagggtattccctcgctgttgaagtatgctgaggcgggtgagggccccatttcacatttggctacaacagccctccaacggtatgatcttcccttcattacagacgaagtcaaaaaaacgctcaatcgaatttaccatcaaaacagaaaagtccatgaaaagacggtgcgcactgctgccgcagcaatcatcttgaacaacaatccaagctatatggatgtcaaaaacattcttctctcgatcggagagctgcctcaggagatgaataaatatatgttggcaatcgtgcaggatattctgcgctttgagatgcccgcttccaagattgtgagacgggttcttaaggaaatggtcgcgcataactatgaccggttctctagatctggttccagcagtgcgtacacaggctacattgaacggagccctagaagtgcttcgacctactcactggacatcctgtactcgggtagtggaattctgcgccgcagcaacctcaacatttttcagtacattgggaaggccggccttcacgggtctcaggtcgttatcgaagcacaggggctcgaagcactcatcgcggccactcctgacgaaggcgaagagaatctagattcatatgcggggatgtctgccattcttttcgatgttcagctccgccctgtcacctttttcaacgggtacagcgatctgatgtctaaaatgttgtcagccagcggtgaccccatcagtgttgtaaaaggactcatccttttgatcgatcatagccaggagcttcaactgcaatcaggacttaaggccaacattgaggtgcagggaggcttggcaatagacatttccggcgccatggagttctctctgtggtatcgagagtcaaagacgcgtgtcaaaaaccgagtcacagttgtaatcactaccgatattacggtggatagcagcttcgttaaggcgggtctcgagacatccaccgaaacagaagcaggcttggaattcatctcgacagtgcagtttagccagtatccttttctggtctgtatgcagatggataaagatgaggccccattccgccagttcgagaagaagtatgaacgattgtctacaggcaggggctatgtcagccaaaagaggaaggagtctgtgctcgctggttgtgaattccctttgcaccaggagaactcggagatgtgcaaggttgtcttcgccccccagcctgacagtacaagctcggggtggttc

SEQ ID NO: 16818 - DNA, 2682 bp, Artificial Sequence
  Description of Artificial Sequence: Synthetic coding sequence
atgattctccttgcagtgctgttcctctgcttcataagttcatactcggcaagcgtgaagggacatactactggactttcactcaataacgatcggctttacaagttgacttactccacggaggtgcttctggatagaggtaaaggcaaactgcaggactccgttggatacagaatctccagcaatgtcgatgttgcccttctgtggcgaaaccctgatggtgacgacgaccagctcatacagatcactatgaaggatgtcaacgtggaaaacgtgaaccaacagagaggggaaaagagtattttcaagggaaaatcccccagcaaaatcatgggaaaggaaaacctggaagcgctgcagcgtcccactcttctccatctgattcatggaaaggttaaggagttctattcttaccagaacgaagcagtggcgatcgaaaacataaaacgcgggctggcttcgctgtttcagacccagttgtcctccggtaccactaatgaggtggatatttcaggcaactgcaaggtcacctaccaggctcatcaggataaggtgatcaagattaaagccctcgattcttgcaaaatcgcaaggtccggcttcaccaccccaaaccaggtcctgggtgtgtcatcgaaagccacttcggtcaccacctacaagattgaggacagcttcgttatagccgttctggcagaagagactcataacttcggacttaacttcctccaaaccatcaaaggtaaaatcgtctctaagcaaaagctcgaactgaaaacgactgaagcaggaccaagacttatgtcgggcaagcaggccgcagcgattatcaaggcggtggattcgaagtacactgcaatccccatagtgggtcaggtgtttcaatcgcactgtaagggatgcccttccctgtccgagctgtggagatccacccggaagtacctccaaccggacaatctgtccaaagcagaagcagtgcgcaattttctggcttttatccaacatcttcgaactgcgaaaaaagaggaaatccttcaaatccttaagatggagaacaaggaagtgcttcctcagctggtggacgcagtcacgtcagcacagacttcagatagccttgaagccattctggatttcttggatttcaaatctgattcctccatcatattgcaagaaagatttctgtacgcctgtggttttgcctcccatcccaatgaggaactgctgcgtgcactgatatcgaaattcaagggatcgattggttcgtcagacatacgtgaaactgtgatgattatcaccggcactcttgtccgcaagctctgtcaaaatgaaggttgcaagttgaaggcggtggtcgaagcgaagaagctcattcttggtggactcgaaaaggccgaaaagaaggaggacaccaggatgtaccttcttgcccttaagaatgcccttctcccggaaggcataccgtcccttctcaagtacgccgaggcaggggagggtcccatttcccatctcgccaccaccgcactccaaaggtatgatctccccttcatcacggatgaggtcaagaaaacccttaaccgcatctaccatcaaaacagaaaagtgcatgagaaaacggtacgaaccgccgcagccgcaattatccttaacaacaacccttcatacatggacgtgaagaatatccttctgtcaattggagaactgcctcaggagatgaataagtatatgttggctattgtgcaggatatcttgcgcttcgaaatgccagcctccaagatagtcagacgtgtgcttaaagaaatggtggcccacaactacgaccgctttagccgatctggaagctcaagcgcatacaccgggtacatcgaaagatcgccccgaagcgcatcaacttattcgctggatatcctgtactcaggatccggaatcctccgtcggagcaacctgaacatttttcagtacattggaaaggcaggactgcacggatcacaagtggttatcgaggcacaggggcttgaagcactcattgcagcaactccagatgagggtgaagaaaatcttgattcatacgccgggatgtcagcgattctgttcgacgtgcaacttcgcccagtgaccttctttaacggatactccgatcttatgtcgaagatgctgtccgcatccggagatccaatctccgtggtgaagggactgattctcctcattgaccattcgcaagaactgcagcttcaatcaggactgaaggcgaatattgaggttcaaggaggcctcgccattgatatcagcggcgcaatggagttttcactgtggtaccgcgagtccaagactcgggtgaagaatcgcgtgaccgttgtgattactactgatattaccgtcgactcgtcctttgtgaaggcgggtcttgaaaccagcaccgaaactgaagcaggtcttgaattcattagcactgtgcaattttcgcagtacccattcctggtttgtatgcaaatggacaaagatgaagcaccattccgtcaattcgagaagaagtacgaacgattgtcgaccggaaggggttacgtctcgcaaaagcgtaaagagtcggtgctggccggttgtgagttccctctgcatcaagaaaatagcgagatgtgcaaggtggtgtttgcccctcaacctgattcgacttcctcggggtggttt

SEQ ID NO: 16819 - DNA, 2682 bp, Artificial Sequence
  Description of Artificial Sequence: Synthetic coding sequence
atgatcttgctcgccgtgctcttcctgtgcttcatctccagctacagtgcctctgttaaaggtcacaccacaggactgtccctgaataacgatcggttgtacaagctgacctattctacagaggtgttgcttgaccgggggaaggggaagctccaggatagcgtggggtatcgaatctccagcaacgtcgacgtggccctgctgtggcgaaacccagacggagacgatgaccaactgatccagatcaccatgaaggacgttaacgttgaaaatgttaaccagcagaggggtgagaagtctattttcaagggtaagtcaccgtccaagatcatgggcaaggagaacttggaagcactgcagcggccaacactgctgcatctgatccacggaaaagttaaggaattctacagctaccaaaacgaagctgtggccattgagaatatcaagcggggactggccagtctgtttcagacccagttgagctctggtaccaccaatgaagtggatatctctggcaattgcaaggtgacctaccaggcccatcaggataaggtgatcaagatcaaggccctggactcctgcaaaattgctagatctggtttcaccacgccgaaccaggtacttggcgtgagcagtaaggccacttctgtgaccacctataagatcgaggatagtttcgtgattgcggtccttgccgaggaaacccacaattttggactcaattttctgcaaaccataaagggaaaaatcgtgtccaagcagaaactggaacttaagactacagaggccgggccccggctgatgagtggaaaacaggctgccgccattatcaaggcagtagactcaaagtacaccgccatccccatcgtgggtcaggtctttcagagtcattgcaaaggttgcccttcactcagcgagctctggagaagcacaaggaaatacttgcaaccagacaatctgagcaaggccgaggccgtgagaaactttctggccttcattcagcacctgagaacagctaagaaggaggaaatcctgcaaattctgaagatggagaataaggaagtcctgccccagctggttgatgccgtgacctctgcgcagaccagcgactccctcgaggccatcctcgactttctggattttaagtcagattctagcatcatcctccaggaaagattcctctatgcctgtgggttcgcgtctcatcctaatgaagagctgctgcgggcgcttatcagcaaattcaaaggcagtatcggcagctccgacatcagggagactgtgatgatcattacaggtacactggtaagaaaactgtgtcagaacgaaggttgcaagcttaaagccgtcgtggaggcaaagaagctgatcctgggggggcttgagaaagctgagaaaaaagaggatactcgcatgtacttgctggcattgaagaatgcccttctccccgaaggaattccatcactgctgaagtatgcggaggcgggggaaggtccaattagccatctcgccactaccgcgctgcaacggtatgatcttcccttcataactgacgaggtaaagaaaacactgaaccggatttaccaccagaaccggaaggtccacgagaagacagtcagaaccgcagccgcagccatcatacttaacaacaatccgagttatatggatgtcaaaaatatcttgctctctattggtgaactgccgcaggagatgaacaagtatatgttggcgatcgtgcaggacatactgcggttcgagatgcccgctagcaagatagtacgacgcgtgctgaaagagatggttgctcataattatgaccggttttctaggtctgggtcatctagcgcctacacagggtatattgaaagatccccgcgatctgcgagcacttatagtctggacattctgtactcagggtccggaatcctgagacgatctaacctgaacatctttcaatatataggtaaggcagggctgcacgggagtcaagtcgtcatcgaagcgcaagggctggaggcattgatcgctgcaacgcccgacgagggggaagagaacttggattcatacgccggaatgtccgccatcctgtttgatgtgcagctccgacctgttacttttttcaatggctacagcgacctgatgtcaaagatgctcagcgcctccggtgaccccattagcgtggtgaagggactcattctgcttattgatcattcccaagaactgcagctccagtctgggttgaaagctaacatagaggttcagggcggactggcgatagacatcagcggagccatggaattttccctgtggtacagagagtccaaaacacgcgtcaaaaatcgggtgactgtcgtgattaccaccgatatcaccgttgattcctcattcgtgaaagcaggcctggagacctccactgagacggaagcgggactcgaatttataagtacggtccagttcagccagtatccatttctggtgtgtatgcaaatggataaggacgaggcaccctttaggcagttcgagaagaagtacgaacggctttccacagggcgcgggtacgtgtcccagaagcgcaaggagagtgttctcgctgggtgcgagtttccattgcatcaagaaaactcagagatgtgtaaagttgtattcgccccacagcccgactccacctcctccggatggttt

SEQ ID NO: 16820 - DNA, 2682 bp, Artificial Sequence
  Description of Artificial Sequence: Synthetic coding sequence
atgatcctgctcgccgtgctctttctctgtttcatctcgtcctactccgcctcggtgaagggccacaccaccggactctccctcaacaacgaccgcctgtacaaactcacttattcgaccgaggtgttgcttgatcgtggtaaggggaaacttcaggactcggtggggtatcggatctcgtccaatgtggacgttgcgctgctgtggcgcaacccggatggagatgacgaccagctcatccagatcactatgaaggatgtcaatgtggaaaacgtgaaccagcaacgaggcgagaagtcgattttcaaaggaaagtccccgagcaaaatcatgggaaaggagaatctcgaagcactgcagcggccaaccttgctgcatctgattcatgggaaagtgaaagagttctacagctaccaaaacgaggccgtggcgatcgagaatatcaagcggggactcgcctccctttttcagacccagctgtccagtggcaccaccaacgaggtcgacatctcaggcaattgcaaggtgacttatcaggcccatcaagataaagtgattaagattaaagccctggactcctgcaaaatcgccaggtcgggtttcactactccgaaccaggtgttgggagtgtcgagcaaggctacttcagtgaccacgtacaaaatcgaggactccttcgtcatcgcagtgctggccgaagaaacgcacaacttcggactgaacttcctgcagaccatcaagggaaagattgtgtccaagcaaaaactcgaactcaagactactgaagctggcccaagactgatgtcgggaaagcaggccgccgcaatcattaaggctgtggattccaagtacaccgcgattccgatcgtggggcaggttttccagagccactgtaaagggtgcccctcgctgtcggagctctggagatcgacccgcaagtacctgcagccggataacctctcgaaggctgaagccgtgagaaactttctggctttcatccaacacttgaggactgccaagaaggaggagatcctgcagattcttaagatggaaaacaaggaggtccttccacagctggtggacgctgtgacctccgcgcaaacttcggacagcctcgaggccatcctggacttcctcgatttcaagtccgattcgagcataatcctccaagagcgattcctttacgcctgcggcttcgcgtcccacccgaatgaggaattgctgagggcgctcatcagcaagttcaaaggatccatcggatcctcagacatcagggaaactgtcatgatcatcaccggcaccctggtgcgaaagctgtgccaaaacgaaggctgtaaacttaaagctgtggtcgaagcgaagaagctgatcctcggagggttggaaaaggccgaaaagaaagaggacacgcgcatgtacctgctggccttgaagaatgcgctgctccctgaaggaatcccttcgctgctcaagtacgcggaagcgggcgagggaccaatctcccatctggccaccaccgctctgcaaagatacgatctgccatttatcacggatgaggtcaaaaagaccctcaaccgcatctaccaccagaaccgcaaggtgcacgaaaaaaccgtgcgcaccgctgccgcagcgatcatcctcaataacaacccgtcatacatggatgtgaaaaacatcctcttgagcatcggagaactgccgcaagagatgaacaaatacatgcttgcaatcgttcaagatatactgcgatttgagatgccggcgtcaaagatcgtgcggagagtgttgaaagaaatggtcgcacataactatgataggttctcgcggtcaggatcgtcaagcgcgtacactggatacatcgaacggagcccccggtccgccagcacttattccctggatatcctgtactccggttcaggcattctccgacgctccaaccttaacatcttccagtacattggcaaggcgggactgcatggctcgcaggtcgtgattgaagcccaaggactcgaggccctgatcgcggctacgccggatgaaggtgaagaaaacttggattcctacgcgggtatgagcgcgatcctcttcgatgtccagctcaggccagtgaccttcttcaacggatacagcgacctgatgtcaaagatgctgagcgcctccggagatccaatcagcgtggtgaaagggctcatcctcctgatagaccactcacaagagctgcaacttcaatcggggctgaaagcgaatatcgaggtgcaaggaggcctggcgattgacatctcaggggccatggaattcagcctctggtacagggagagcaagactcgcgtaaagaaccgggtcactgtcgtgatcaccaccgacatcaccgtggattcatcgttcgtcaaggccggactggaaacttcaactgaaaccgaggctggcctggagtttatctcgacggttcaattttcgcaatacccgttcctggtttgcatgcagatggacaaggacgaggctccgttccgccaatttgaaaagaagtacgaacgcctgtcaaccggacggggatacgtgtcccagaaaagaaaggaatcggtgctggcgggatgcgaattcccgctccatcaggagaactccgaaatgtgcaaggtggtgttcgctccccagccggatagcacgagctcgggctggttc

SEQ ID NO: 16821 - DNA, 2682 bp, Artificial Sequence
  Description of Artificial Sequence: Synthetic coding sequence
atgatactcttagccgtgctcttcctgtgcttcatctcgagctacagcgcttcggtgaaaggtcataccacaggcctgagcctcaacaacgacagattgtacaagctgacatattcaacagaagtcctgcttgatagagggaaaggaaagcttcaagattcagtggggtatcgaatatcgagcaacgtggatgtcgcgctgctgtggcggaacccagacggcgacgatgatcaactcatccaaatcaccatgaaagatgtgaatgtcgagaacgtcaaccaacagcgaggagaaaaatctatattcaagggaaagtcccccagcaagataatgggcaaagagaaccttgaggccctgcagagacccactttgctgcaccttattcatggaaaagtgaaagagttctactcttaccagaacgaagcagtggctatcgagaacataaagcgcgggttggcttccctgttccaaacccaactctcctcaggcaccactaacgaggtggatatttctggcaactgtaaagtaacctatcaagcccatcaggacaaggtaatcaaaataaaagcactggactcgtgtaagattgcaaggtcgggctttaccacacccaaccaggtgctgggagttagcagcaaggccacctctgtgacaacatacaaaatcgaggatagttttgtgatcgcagtactggctgaagagactcacaactttggactgaatttcttgcaaacaatcaaaggaaagatagtcagcaagcagaagctcgaacttaaaaccaccgaagctggcccacgcttaatgtcaggaaagcaagccgctgctataatcaaagcagtcgatagcaagtacacagcaattccaatcgttggccaggtatttcaaagtcactgtaagggctgtccatcacttagtgagctttggagaagcacgcggaaatacttgcagcccgataacctgagcaaagctgaagctgtgcgcaacttcctcgcgtttattcagcacctgcggaccgccaaaaaggaagaaatccttcaaattctgaagatggaaaataaggaagttttgccacagctggtcgatgcagtgacctcagctcaaaccagcgactcgctggaggctatactagactttctggactttaaatcagactccagcatcatactgcaggaaagatttctttacgcatgcggattcgctagccaccccaacgaagagctgcttagggccttaatttcaaagttcaaaggatctattgggtcctcagatataagagagacagttatgattataactggcacactggtgaggaaactgtgtcagaatgaggggtgcaaacttaaagctgtggtagaagctaagaaacttatcctgggagggctggagaaagcagaaaagaaggaggacaccaggatgtatctgctggcattaaagaacgcgctcctgcccgaaggcatcccttcgctcctgaaatacgccgaagctggagaagggcccatctcccatttggccacaaccgcattgcagcgctacgatctgccatttattaccgacgaagtgaaaaaaacgttgaacagaatctaccatcagaaccgcaaagtgcacgagaaaactgtccggacggctgccgcagccataattctgaacaacaacccctcctacatggacgttaaaaacatcttgctctcgatcggagagctgccacaggagatgaacaagtacatgctggctattgtgcaagacatcctccggttcgaaatgcctgcaagcaaaattgtgcgccgggtactcaaggagatggttgcacacaactacgatcgatttagccgcagcggcagtagcagcgcctatacgggctacattgaaaggtctccgagatcagcatctacttatagcctggatatactgtactccggctcgggaatcctcaggaggagcaacctgaacatcttccaatacataggtaaggctggactgcatggcagtcaggtcgtgatcgaagctcaaggtctggaagctctcattgctgccactccagacgagggtgaagaaaacctggattcttatgcaggcatgagtgccatcctctttgacgtccaactgaggcccgtcacatttttcaatggttactctgatctgatgagtaaaatgctttccgcttcaggtgaccctatatcggtcgttaagggcctcatcctcctcatcgaccactcacaggaattgcagcttcaatccggactgaaggcaaatattgaagtgcaaggaggcctggcaatcgacatcagcggcgctatggagttttctctgtggtatcgggaatcaaagaccagggttaagaaccgggtgacggtggtaattaccaccgacatcacagtggatagcagctttgtaaaagctggattagaaacgagcactgagacagaagcaggacttgaattcatcagtacagtgcagttttctcaatatcccttcctggtgtgcatgcaaatggacaaggatgaagcgccattcaggcaattcgagaaaaagtacgagaggctcagcacaggacgcgggtacgtaagccagaagagaaaagaaagtgttctggctgggtgcgagtttccacttcatcaggagaactcagagatgtgtaaggttgtttttgccccccagcccgacagcacatcctccggctggttc

SEQ ID NO: 16822 - DNA, 2682 bp, Artificial Sequence
  Description of Artificial Sequence: Synthetic coding sequence
atgattcttctggcagttttgttcctgtgtttcatctcctcttactctgcttcagtgaagggtcataccaccggcttgagccttaataacgacagactctacaagctgacatattccaccgaggtgctcttggaccgcggaaaaggtaagttgcaggatagcgtaggctatagaatcagctcaaacgtagatgtggctctcctgtggaggaatcccgacggagatgacgatcaacttattcagatcaccatgaaggacgtcaacgtcgagaacgtgaatcaacaaagaggcgagaaatctatcttcaagggtaaatcacctagtaagattatgggtaaggaaaacttggaggccctgcagaggccgaccctgctgcatcttattcatggaaaggtgaaggagttctactcctaccaaaatgaggccgtagcaatcgagaatatcaagaggggtctggcctctctcttccagacccagctgtcaagtggaactactaatgaggtggacatcagcggaaactgcaaagttacctaccaggcccatcaagacaaggtcattaaaattaaggccttggactcctgcaaaatcgctagatcaggttttacaactcctaaccaggtgctgggcgtcagtagcaaagctacaagcgtgactacatacaaaatcgaggatagcttcgtgatagccgttctggccgaggagactcacaatttcggattgaacttccttcagaccattaagggcaagatcgtaagcaagcagaagctggagctgaagaccactgaagccggcccaaggctgatgtctggcaagcaggctgctgccattattaaggctgtcgactcaaaatataccgcgattccaattgtgggccaggttttccagagccattgcaagggatgcccgtccttgagcgagctctggaggagcactagaaagtaccttcaaccagacaacctgtctaaagctgaggcggttaggaactttctggctttcatccagcatctcaggactgccaagaaggaagagatcctgcagatcctcaagatggaaaacaaagaggtgttgcctcagctcgtcgacgcagttaccagcgcccagacttctgactctctcgaggctattctcgatttcctcgacttcaaatctgatagtagtataatcttgcaggaaaggttcttgtacgcctgcggattcgcttctcaccctaacgaagaactgctccgcgcactcatcagtaaattcaaaggttccattggctcaagtgacatcagagagacagtcatgatcattacgggaacgctggtgaggaaactctgccagaatgaaggttgcaagctgaaggcagtcgtggaggcgaagaagctgatcctgggtggtctggaaaaggcggaaaagaaggaggataccaggatgtatttgctggcgctgaagaacgcattgttgccagaaggtatcccaagcctgctcaagtacgcggaggccggagagggccctatttctcaccttgcgaccaccgcgctccagcgctatgatttgccattcatcaccgacgaggttaagaagacactgaatagaatctaccaccaaaacagaaaggtccacgaaaagactgtgcgcacagccgccgcagctattatcttgaataacaaccctagctacatggatgtgaaaaatatcctcctctccatcggtgaattgccccaggagatgaataaatacatgctggcaattgtgcaggatattcttaggttcgagatgcctgcttctaagatcgtacgcagggtccttaaggaaatggtggcccacaactacgatagattctcaagatcaggaagttcatccgcgtacaccggttacattgagcgctctccaagaagtgcaagcacatatagcctggacatactttacagcggctccggaattctgagaaggtctaaccttaacatatttcagtacattggcaaggctggcctgcacggcagccaggttgtgatcgaagcgcagggactggaagccttgatcgcagctactcccgacgagggagaagagaaccttgactcctacgccggtatgtccgccatcctgtttgacgttcagctcagacctgtcaccttctttaacggttattccgacctgatgagcaaaatgctgagcgcctcaggtgatccgatcagtgtggttaagggtctgattctgctgatcgatcactcacaggagctccagctgcaatccggtctcaaggcaaatatcgaagttcagggcggcttggccatagatatctcaggcgctatggagttttctctctggtaccgcgaatccaagactagggtgaagaacagggtcaccgtggtgatcaccacagacatcacggtggattcctcattcgtaaaagctggactggagacctcaacagagaccgaggccggcctggaattcatttccactgtgcagttcagccaatacccattcctggtatgtatgcagatggacaaggatgaggcacctttccgccaatttgagaagaaatacgagcgcctgtcaactggacgcggatatgtttcacagaaaagaaaggaaagtgtgctggcaggatgtgaattccccctccatcaggagaactccgagatgtgcaaggtggtgttcgcacctcaacctgacagcacctcctccggctggttt

SEQ ID NO: 16823 - DNA, 2682 bp, Artificial Sequence
  Description of Artificial Sequence: Synthetic coding sequence
atgatattgctggcagtgctttttctctgcttcatatcctcttattccgcatcagtgaagggccacactacggggttgtccttgaacaacgacaggctgtacaagcttacatattccactgaggtacttctggatagaggtaagggcaagctacaagacagtgtagggtatcgcatcagttcgaatgtggatgtagccctgctgtggcggaacccggatggggatgatgaccagttgatccagatcacaatgaaagatgttaacgttgaaaatgtgaatcagcagaggggtgaaaaatcaatttttaagggcaagtctccctccaagatcatgggcaaagagaacctggaggcgttgcaaaggcctactctcctgcacttaatccacggaaaggtcaaggagttctactcttatcagaacgaggcagtggcaattgagaacattaaaagaggcctagcatctttatttcagacccagctctcaagcggcactaccaatgaggtggatattagcgggaactgcaaggtgacttaccaggcacatcaggacaaggttataaaaattaaagcactggatagctgtaagatcgccaggtctggcttcaccacccccaatcaggttctcggcgtgtccagcaaagcgacttctgttactacatacaaaatcgaggacagcttcgtcatcgcggtactggctgaggaaacccataacttcggcctaaattttctccaaaccatcaaggggaagattgtgagcaaacagaagcttgagttgaagaccactgaggcgggaccccggctgatgagtgggaaacaggcagctgccataatcaaagctgtggactccaagtataccgccatccccatcgtcggtcaggtctttcaatctcactgcaaaggatgcccctccctgtcggaattgtggcgctccacaagaaaatacttgcagcccgataacctatctaaagcggaggccgtgaggaattttttagccttcattcagcacttgagaacggctaagaaagaggagatattgcagatcctaaagatggagaataaagaggtcctgcctcagttggtcgacgccgttactagcgcccagacctcagactccctcgaggcaatcctagatttcctcgatttcaagagcgactccagcatcatcttacaggagcgatttctgtacgcttgcggctttgcttctcaccccaatgaggagctgcttagagccttaatttcaaagtttaaaggctcaatcggctcatcagacattcgcgaaaccgtcatgatcattaccgggaccctggtccgtaagctttgtcagaacgaaggctgcaagcttaaggctgtggtggaagctaaaaaactgatcctgggggggctcgagaaagccgagaaaaaggaggatacacgcatgtacctgttggccctcaaaaacgccctgcttcctgaagggattccaagcctcctcaagtacgccgaagcaggcgagggccccatctcacatctggcgacaaccgctctgcaacgctacgacctaccctttatcactgacgaggtcaaaaaaactttgaatagaatctatcatcaaaatagaaaagtccacgaaaagactgtgcggaccgccgccgcagccattatactgaataacaatccttcttatatggacgtgaagaatatcctgctgtccataggtgagctgcctcaggagatgaataagtacatgctggcaattgtgcaagatattctgaggttcgagatgcctgcgagcaaaattgtgaggcgggtgctgaaagagatggtcgcgcacaattatgataggttctcacgttccgggagcagctccgcctacaccggatacatcgagaggagtccacgaagcgcctctacctattcgttggatatcctttatagtgggtcagggatcctaaggcggagtaacctgaatatcttccagtatatcggaaaggcaggtctccatggttcccaagttgtcatcgaggctcagggcctagaggcacttatcgcggcgaccccggatgagggcgaggaaaacctcgactcttatgctgggatgtccgcaattctgtttgatgtacaacttagaccagtcacatttttcaatggctactcagacctgatgtctaagatgctctctgcgagcggcgaccccattagtgtcgtgaaagggcttattttgttgatcgatcatagccaagagctgcagttgcagagtggcctcaaggcaaatatcgaggtgcagggcgggctggccatcgacattagcggcgcgatggagttcagcctctggtaccgggaatccaagaccagagtaaaaaatcgagttacagtggtcatcacgaccgacattactgtggacagtagttttgtgaaagccgggcttgagacctctacagaaaccgaggcgggcctcgagtttattagcaccgtgcagttcagccagtaccctttcctggtgtgcatgcagatggacaaggacgaggccccatttagacaattcgagaagaaatatgagagactgtccacaggtcgaggctatgtgtcacagaagagaaaggagtccgtcctcgctgggtgtgaatttccccttcatcaggagaactccgaaatgtgcaaagtggtttttgcaccacagccggattctacttcctctggttggttt

SEQ ID NO: 16824 - DNA, 2682 bp, Artificial Sequence
  Description of Artificial Sequence: Synthetic coding sequence
atgatcttgctcgcagtgctctttctgtgttttatttcatcctattcagcatctgttaaagggcataccaccgggttaagcctcaacaacgacaggctttataaactgacttattccactgaagtgcttctggatcgcggcaaaggtaaactgcaggattccgttggctaccgcataagctcaaacgtcgacgttgcactcctgtggcgcaatcccgacggggacgatgatcagctgattcagattaccatgaaagacgtcaatgtggagaacgtgaatcaacagcggggcgaaaagagtatcttcaaaggtaagtccccatcaaaaatcatggggaaggagaatcttgaggctctacagcggccaacactccttcacctcattcacgggaaggtaaaggagttttattcctaccagaacgaggcggtggctatagagaacattaaacgaggcctagcttccctgtttcagacacagctgtccagcggaactaccaacgaagttgacatctccggcaattgcaaggtaacctatcaagctcaccaagataaggttattaaaatcaaggctttggatagctgcaaaatagctcgtagtggctttacgacgcccaaccaggtgctgggtgtgtcctcaaaggcaacatctgttactacatataaaattgaagactcatttgtaattgccgtactagctgaagagacacataacttcggattaaattttctccaaactataaagggaaagatcgtgtccaaacagaagctggagctgaaaaccaccgaggctggtcccagacttatgtctggaaaacaggcggctgccatcatcaaagccgtcgactcaaaatatactgcaattccaatcgttggccaggtatttcagtctcactgcaaaggatgcccctcactgtcggagctgtggcgcagcactcgcaaatatttgcagccggataacttgagtaaagcagaggccgtgcgtaatttcttggctttcatccaacacctgaggaccgctaaaaaggaggagatcctccagatcctgaaaatggagaacaaggaagtgcttccccagttagtcgacgcggtgacttctgctcagacgtcggacagtttggaggccatcctggactttctggatttcaaatccgattccagcatcattctgcaggaacgttttttgtatgcctgcgggtttgcctcgcacccgaacgaggaacttttacgggcccttattagcaagtttaaaggaagtatcgggagctccgatattcgcgagactgtgatgattatcacaggtacactggtacgcaagctgtgtcagaatgaaggatgcaagcttaaggccgtagtggaggcaaaaaagctgattctgggaggactggagaaggccgaaaaaaaagaagacacacgcatgtacttactggctcttaagaacgctctcttacccgaaggtatcccctcgctcctcaagtatgccgaggcaggcgagggccctattagccatctggcaacaactgccttacagcgctatgacctgccatttattactgatgaagtgaaaaagactctgaacaggatttatcaccagaatcgcaaagtgcacgagaagactgttcgcacagcagccgccgcgattattctgaacaacaacccgtcctacatggatgtgaaaaatatactgctatccatcggcgaactgccacaggagatgaacaagtatatgctggctatcgtgcaagacatcctccggttcgaaatgcccgccagtaaaatcgtgcggagggttctgaaggaaatggtggcgcataattacgaccgcttcagccgcagcggtagcagtagtgcctacactggatacatcgagaggtcaccccggtccgcaagtacttacagcctggacatactgtattcgggctcgggtattctgcggagaagcaaccttaacatttttcagtatataggcaaagccggtctgcacgggagccaggtggtgattgaagcacagggtctcgaagcgttaattgcggcaactccggatgagggagaggaaaacctagattcttacgcggggatgtccgccattctcttcgatgtgcagctcaggccagtgactttcttcaatggctactctgatttgatgtcgaaaatgcttagcgcaagcggcgatcccatctccgtggtgaaggggctgatccttctcattgatcattcacaggagctgcagctccagtcaggcctaaaggcgaatattgaagtccaggggggccttgcgattgacatttcaggggccatggaattctctctctggtatcgggaatccaagacacgcgtaaaaaacagggtgacagtcgtgattacaaccgacatcaccgtggatagcagctttgttaaggcgggcctggagacgtcgacggaaaccgaggccggccttgaattcatttcaactgtacagttttcccagtacccttttctggtttgtatgcagatggacaaggacgaggctccatttagacaatttgaaaagaagtacgagaggctctctacaggacgcggctatgtgagccagaaacgcaaagagtccgtactggctggatgcgaattccccttgcaccaggaaaacagcgagatgtgcaaggttgtattcgccccgcagcccgattccacgtcttcagggtggttt

SEQ ID NO: 16825 - DNA, 2682 bp, Artificial Sequence
  Description of Artificial Sequence: Synthetic coding sequence
atgatcctcctcgcggtgttgttcctctgtttcatcagctcttattcggcatctgtcaagggacacactaccggactctcattgaacaacgaccggctgtacaaactgacttactccacggaagtgctgctggacagaggaaaggggaagctgcaagactccgtgggctaccggatttcctccaatgtcgacgtggcgcttctgtggagaaatcccgacggggacgacgaccaacttattcagatcactatgaaggatgtcaacgtggaaaacgtgaaccaacagcgcggcgaaaagtccatcttcaagggtaagtcgccgagcaagatcatgggaaaggagaacctcgaagcgctgcaacggccgactttgctgcatctcatccatgggaaggtgaaggaattctactcgtaccagaacgaggcggtggccatagagaacatcaagagagggctggcgagcctgttccagacccagctgagctccggtactacgaacgaggtggacatctcaggcaactgcaaagtgacttaccaggctcatcaagacaaagtcatcaagatcaaggccctggattcttgcaagatcgctaggagcggatttactaccccgaatcaagtgctcggcgtgagctcaaaagctacctccgtgaccacctacaagatcgaggactcatttgttattgccgtactggccgaggagactcacaatttcggactgaactttttgcagactatcaaaggcaagatagtgtcgaaacaaaagctcgagctgaaaaccaccgaggcaggccccaggttgatgtcgggaaagcaagccgccgccatcatcaaagcagtggactccaaatacactgcgatcccgatcgtggggcaggtgtttcagtcccactgtaaaggctgcccgtcgctgtcagagctctggcgctcaactaggaagtacctccagccagacaacctcagtaaggccgaggccgtccggaatttccttgcgtttatacagcacctcagaacggcgaaaaaagaggaaatcttgcaaatcctcaaaatggaaaacaaagaagttctgccgcagctcgtggacgccgtgacgtcggctcagacctcggacagccttgaagcaatcctcgacttcctggatttcaagtcggactcctccatcatcctgcaggaaaggttcctgtacgcctgcggtttcgcatcgcacccaaatgaggaacttctccgtgcgctgatcagcaagttcaagggctcgatcggctcgtccgacattagagaaactgtcatgatcatcaccggaaccttggtccgcaaactctgccagaacgaaggctgtaagctgaaggcagtcgtcgaggctaagaagctgattctcggaggcctggagaaggcagagaagaaggaagatactcgcatgtatctgttggcgctgaagaatgccctgcttccagaaggaatcccctcattgctgaaatatgcggaagctggggaaggtccaatctcccacctggccaccaccgcccttcagcggtacgatctcccgtttatcaccgatgaggtgaagaaaacccttaatcggatttaccatcagaatcgcaaggttcacgaaaaaaccgttcgcactgcggccgcggcaatcatcttgaacaataatccttcatacatggatgtgaagaacattctcctttccatcggcgagctgccacaggagatgaacaagtacatgttggcaatcgtgcaagacattctcagattcgaaatgccggcatccaagatcgtgcgcagagtgctgaaggagatggtggctcacaattatgatcggttctcacggtccggaagctcttccgcctacaccggatacatcgaacggtcgccaagaagcgcttcaacctactccttggatattctgtactcgggatccggaatccttcggagatccaatttgaacatcttccagtacataggaaaggcaggactgcatgggtcccaggtcgttattgaggctcagggattggaagccctcatcgccgccaccccagacgagggcgaggagaatctcgattcctatgccggaatgtccgctattctgttcgacgtgcaactccgccccgtgaccttctttaacggatatagcgatttgatgagcaaaatgctctccgcctctggagatcctatctcggtggtcaaggggcttatcctgctgatcgaccattcccaggagctccaactccagagcgggcttaaggcaaatatcgaagtccaaggcggcctggccattgatatctccggagctatggaattttcgctctggtaccgcgagtcaaagaccagggtcaaaaaccgggtcactgtggttatcactacggatatcacggttgactcctccttcgtcaaagctggactggagacgtctactgaaaccgaagccggcctggagttcatctcgaccgtccagttctcacagtacccattcttggtgtgcatgcaaatggataaagatgaagccccgttccggcaatttgaaaagaagtacgaacggctgagcaccggccgcggatacgtgtcacagaagcggaaggaatcggtgctcgcaggctgtgagttccctctccaccaggaaaattcagagatgtgcaaggtcgtgttcgcgccgcagccggactcgacctcttcaggttggttt

SEQ ID NO: 16826 - DNA, 2682 bp, Artificial Sequence
  Description of Artificial Sequence: Synthetic coding sequence
atgatcttgctggctgtcctgtttctttgctttatcagttcctattccgcttctgtgaaaggacacacaactggactaagtctcaataatgacagactgtataaactgacttatagtactgaagttcttctggatcggggaaagggaaagctccaggattcagtagggtataggatcagttccaatgtggatgtagctctactttggagaaatcctgatggagatgatgatcagttaattcagattacaatgaaagatgtaaacgtcgaaaacgtgaatcaacagcggggggaaaaatctatctttaaaggaaaaagtccatcaaaaataatgggaaaagaaaatttagaggcgctccagcggccaacactactccatctgatccatgggaaagtaaaagaattttattcttaccagaacgaggcagtggctatcgaaaatattaaaagaggacttgcatctctcttccagacacagctctcttctggaacaactaacgaagtcgacatatctggaaattgtaaagtgacatatcaggcccaccaggataaagtgataaaaataaaagcacttgatagttgtaaaatagcacggtccggatttactactccaaaccaggtgttgggagtttcctctaaggccacaagtgtcactacttacaaaatcgaagattcctttgtgatcgccgtgctggcggaagaaactcataacttcggactgaactttctccagacaatcaaagggaaaatcgttagtaaacagaaactcgagctcaaaactactgaagctggaccaagactgatgtccggaaaacaggcggctgctatcatcaaagctgtagatagtaaatatacagcgattcctatcgtagggcaggtgttccaatctcattgtaaagggtgtccatctctttccgagctttggcggtccactcgcaaatatctacagcctgataacctctccaaagccgaagctgtgagaaactttctcgcctttatccagcacttacggacagctaagaaagaagaaattttacagatcctgaaaatggaaaacaaagaagtgttaccacagctggtggatgccgtgacgtccgcacagacatcggatagtttagaagctatcctggactttttagactttaaaagtgattcctccattattctacaggaacggttcttatatgcctgtggattcgcttcacatccaaatgaagaacttctgagggcactcataagtaaatttaaagggtccatcgggtcttcagatataagggaaacagttatgataattactgggactctggtgcggaaattgtgccagaatgaggggtgtaagctgaaagcagtcgtggaagctaaaaaactaatcctggggggactggaaaaagccgaaaagaaagaagatactcggatgtatctacttgctctcaagaacgcactcctgccagagggaatcccatcactcttaaagtacgccgaagcaggggaaggaccaatctcacaccttgcaacaacagcccttcagagatatgatctgcctttcattacagacgaagttaaaaaaacactcaatcggatctatcatcagaacaggaaagtacatgaaaaaactgtgcggacagccgcagccgccataatattaaacaataacccttcttacatggatgtgaagaatatcctgttatcaataggggaactccctcaggaaatgaataaatatatgttggcgattgtgcaggatattcttcggttcgagatgccagcctctaaaattgtcaggcgggtgctcaaagaaatggtagcccacaattatgatagattctctcgatctgggtcctcgtccgcctatacaggatacatagaacgcagtcctcggtcagcttctacatattccctcgacatactctattccggatccgggatactgagacggtctaatctaaacatctttcaatatatagggaaagcagggcttcacgggtcacaagtcgtgatagaggcccaaggattggaagctctaatcgcagcaacacccgatgagggagaggaaaacctcgatagttacgccggaatgtctgctatacttttcgatgtccagctaagacccgtgacttttttcaacgggtattctgatctcatgagtaaaatgctaagtgcttcaggggatccaatatccgtggtaaaaggactgattctactgatcgaccattcccaagagctgcagctgcaatctggactcaaagcaaacatcgaagtgcagggagggctcgcaatcgatatcagtggggcaatggaattttcactctggtatcgcgagtccaaaactcgggtgaaaaacagagttacagtcgtaattactactgatatcacagtggattcttcgttcgtgaaagctgggctggaaacttcgacagaaacagaagccggactcgaattcatatccacagtacagttttcccagtaccctttcttagtgtgtatgcagatggataaagatgaagctcccttccgccagtttgagaaaaagtatgaaaggctttccacagggcgcgggtatgtgtcacagaaacgtaaagagtctgttctcgcagggtgcgagtttcccctgcaccaggaaaattcagaaatgtgtaaagtcgtctttgcgccacagcccgattctacatccagtgggtggttc

SEQ ID NO: 16827 - DNA, 2682 bp, Artificial Sequence
  Description of Artificial Sequence: Synthetic coding sequence
atgattctgctggcagtgttgttcttgtgctttattagttcttattccgcctctgtgaaaggccacaccaccgggctgagcctgaacaacgacagactctacaagctaacatattcaactgaggtcctgctggaccggggaaaggggaaactacaggacagcgtgggataccgaataagcagtaatgtagacgtcgcattactgtggcgcaatccagacggagacgacgaccagcttatccagattaccatgaaggatgtaaatgtcgaaaatgtgaatcagcagaggggcgaaaagtctatcttcaaagggaaatctcccagcaaaatcatgggtaaggaaaatctggaagcgctccagagacctacccttctgcacctgatccacggtaaggtcaaggagttttactcataccagaacgaagcggtcgccatcgagaatattaaacgaggtctggcttcactattccaaactcagttgagttccggaacaaccaacgaagtggacatcagtgggaactgcaaagtcacgtaccaggcccaccaagacaaggtgatcaagataaaagctctggacagttgcaaaattgccagaagcggatttaccactccaaatcaggtcttgggcgtaagtagcaaagcgacctccgtaaccacctataagatcgaagattcctttgttatcgccgtgttggctgaggagacccacaactttggactgaatttccttcagacaatcaagggcaaaattgtatccaagcagaagctggagttaaaaactaccgaggccggaccccgccttatgtccggcaaacaagccgctgccatcataaaggccgtggattccaaatacacagcaatccctattgttggtcaagtgttccaaagtcattgcaagggttgtccatccctgtccgagctatggcgcagtacaagaaagtatctgcagccagacaatctctcgaaagccgaagccgtgagaaatttcttggcgttcatccagcatcttagaacagccaagaaggaagaaattctccagatcttaaagatggaaaacaaagaggtgctgcctcagctggttgatgccgtgacttctgcacagacatctgacagcctggaggcaattttggatttcctggacttcaagtctgactcatcgatcatcttacaggagcgatttttatacgcctgcggattcgcttcccatcctaacgaagagctccttcgggcattaataagcaagtttaaggggagcattggttcatcagacatccgtgaaacggtgatgattatcaccgggacactcgtccgaaagctatgccaaaatgagggttgtaaattgaaagccgtggtggaagcaaaaaagctcattctgggcggcctcgagaaggcagagaagaaggaagatacccgaatgtacctgctggccctgaagaatgccctactgcctgaagggatcccatctctccttaagtacgccgaggccggggaaggaccaattagtcatttggctacaacagctctgcagagatatgatcttccatttataacagatgaagtgaaaaagaccctcaaccgaatctatcaccagaacaggaaggtgcacgagaagacagtgaggacagccgcagccgcgattattctgaataacaacccaagctatatggatgttaaaaatattctgctgtccatcggagagctccctcaggagatgaacaaatacatgctagcaatagttcaggatatcctgcgcttcgaaatgcctgcatctaaaatcgttaggagggtgcttaaggagatggtcgcccacaactacgatagattcagcagatctggctccagctccgcctataccggctacattgaaaggtcccctaggtcagcatccacatacagcttagacatcctctacagcgggtcgggcattttgaggagaagcaacctcaacattttccagtatataggaaaggccgggctacacggcagtcaggtcgtaattgaagcacagggattggaggccctgattgcggctactccggacgagggcgaagagaatttggactcttatgccggtatgtctgccatccttttcgatgtgcagctacgacctgtaaccttcttcaatggctattccgacctcatgagtaagatgttgagcgccagcggcgatcctatatcagtggtgaaaggcctaatactcctcattgatcactcccaggagttgcagctccagagcggcttaaaggccaatatcgaggtccaggggggcttggccatcgacatatccggggccatggaatttagcttgtggtatagggaatccaagacacgggttaaaaacagggtcactgtggtcatcacaacggacattaccgtggattcttctttcgtcaaagccgggctggagaccagcaccgaaaccgaggcggggttggaattcatttctactgtccagtttagtcagtatccatttctggtttgcatgcagatggacaaggacgaggcgcctttccgccagtttgagaagaaatatgaaagattgtccacagggaggggatatgtaagtcagaaacgaaaagagtcggtgctcgctggctgtgaattccctctccaccaggagaactccgagatgtgtaaagtggttttcgcaccacagcctgacagcacttcttctgggtggttc

SEQ ID NO: 16828 - DNA, 2682 bp, Artificial Sequence
  Description of Artificial Sequence: Synthetic coding sequence
atgattctacttgcagttctgttcctctgtttcattagctcatattctgcgagcgtgaaaggacacacaaccggtctgtccttgaacaatgatcgcctctataagctcacctacagcactgaggttctgctagataggggcaagggcaagctacaggactcagtggggtacaggatctccagcaatgtcgatgtcgcgcttttgtggaggaacccggatggagacgatgatcaactcattcagattaccatgaaggacgtcaatgtggagaatgtaaaccagcagagaggggaaaaaagcatctttaaagggaagagcccgagcaagatcatgggcaaggagaacctagaagcgttgcagaggcctaccctgctccaccttatacacggcaaggttaaggaattttacagttaccaaaatgaagcagttgcgatagaaaacatcaaacgaggcttggccagtttgttccagacgcagttatcgtcgggcacgacaaatgaggtggatatcagcggtaactgcaaagtcacttatcaagcccatcaggataaggtgattaagattaaggctcttgactcttgcaagatagctcggagtggctttaccacacctaaccaagtgctgggcgtgtcaagtaaggccacttctgtgactacctataaaattgaggacagttttgtcattgcggtgctggctgaagagactcacaattttgggttaaattttcttcaaactatcaaaggcaagatagtgtctaaacaaaaactggagctgaagaccacagaggcagggccgcgcctgatgtccggtaaacaggccgccgccatcatcaaggccgtggactctaaatacacagccattcctatcgtgggtcaggtttttcaatcacactgcaaaggctgccctagcttgagtgaactgtggagaagcacaagaaaatacctgcagccagacaacttgagcaaggcagaggcggtacgaaactttttggcattcattcagcacttgcgcactgccaaaaaagaggaaattctgcaaatcctgaagatggagaataaagaggttctgccccagctggtggatgctgtaacttcagcccagacatccgattcccttgaggccatactggatttcctagattttaaaagtgactcctccataattcttcaggagcgcttcctgtatgcttgtggcttcgccagtcaccccaacgaagaactgctacgcgctctgatctcaaagtttaagggctctatcggctcatcagacattagggaaaccgttatgataatcaccggaactcttgtgaggaaactctgccagaacgaagggtgtaagctgaaagcagttgtagaagccaaaaagctcatcctgggcggtctggagaaggccgaaaaaaaggaggacactcggatgtatttgttagccctgaagaacgcgttacttcccgaaggcataccgtcccttctgaagtatgccgaagccggcgaaggacccatctcgcatttagcgaccacggccctccagagatacgatcttccctttatcacggatgaagtgaagaaaacactaaataggatttatcaccagaaccgcaaggtgcacgagaaaacggtacgaacagccgctgcagcaatcattctcaataataatccttcatacatggacgtaaagaacatcttgttatccattggagagctgccccaggagatgaacaagtacatgctggccatcgtacaggatatcttacgcttcgaaatgccggcgagcaagatcgtgcgcagggtactgaaagaaatggtggcccacaactatgatcgttttagtcgcagcgggagtagctcagcctacaccggctacatagagcgttctccacgcagtgcctcaacttactccctggacattttgtattctggttctgggattctgcgtaggtcaaatctgaacatcttccagtacatagggaaggccggattacacgggtcacaagttgtaattgaggcgcaaggtctggaggcgttaattgccgcaacgcccgatgagggtgaagagaatctcgactcctacgcaggaatgtcagccatcctgtttgatgtgcaacttcggcccgtgaccttttttaacggttacagcgacttaatgagcaaaatgttgtcagcatctggagacccaatctcagttgttaagggtctgatcctgctcatagatcacagccaggagttgcaacttcagagtggtctgaaagcgaatattgaggtgcagggtggcctggccattgacatttccggcgctatggaattctcactgtggtaccgggagtcaaagacgagggtcaagaatcgagtgacggtggttattacaaccgatattacagttgactcctcattcgtgaaagccggtttagaaacttccacagagactgaagcgggcctggaattcatcagcaccgtgcaattcagccagtaccctttcctggtttgtatgcagatggacaaagatgaggccccattccgccagttcgagaaaaaatatgagcgactcagcacggggcgggggtatgtgtcacagaagcgaaaagaatcagtcctggccggatgcgaattcccactgcaccaggaaaactctgagatgtgcaaggttgttttcgccccccagccagacagcacaagctctgggtggttt

SEQ ID NO: 16829 - DNA, 2682 bp, Artificial Sequence
  Description of Artificial Sequence: Synthetic coding sequence
atgatactcctggcggtattgtttctctgcttcatcagcagttattccgcctctgtgaagggacatacgacaggcctctccctcaataatgatcgactgtacaagttgacctacagcaccgaggtgttattggaccgcggcaaagggaaattgcaggattccgtgggttatagaatctcaagtaatgtcgatgttgccctgttgtggcgcaacccagacggcgatgatgaccagttaatccaaattactatgaaagatgtgaatgtagagaatgttaaccagcaaaggggggagaagtctatctttaaaggcaagtccccatccaaaatcatgggcaaagaaaacctagaagccctgcaacgtccaaccttgttgcatttaattcacggtaaagtcaaagagttttattcttatcagaacgaagcggttgccatagagaatatcaagaggggcctggcgtcccttttccagacacaactctcgtctggtacgaccaatgaagtggacatctccgggaactgcaaagtgacgtatcaggctcatcaggataaggtgattaaaattaaagccttggacagttgcaagatcgccagaagcgggttcacaacaccaaaccaagtcctgggtgtgtcctccaaagcaacatcggttactacctacaagattgaggatagtttcgtcattgccgtcctagccgaggaaacccacaattttggcctgaatttcctgcagactattaaaggaaaaattgtgtcaaagcagaagctcgagctaaagactaccgaagcgggaccgcgactgatgtcagggaaacaggctgctgctatcatcaaagccgtggattccaagtacacagccatccccatagtcggacaggtgtttcagtcccactgcaagggttgccccagtcttagcgagctgtggcgctccacaaggaaatacctgcaaccagataacctgagcaaggccgaagccgttaggaattttttggcctttatacagcatcttcgcaccgcaaagaaggaggagatcctccaaatcttaaagatggaaaacaaggaggtgctgccgcaattggttgacgccgtgacctctgcccagactagcgacagcctggaagctatccttgacttcttagacttcaagtcggactcttccatcatccttcaggagagattcctgtatgcctgcggattcgcgtcccaccctaatgaagagctactgcgggctctcatctcgaagttcaagggtagtatcggctccagtgacatccgagagactgttatgatcattacagggactctcgtgcggaaactttgccaaaacgagggctgcaaattgaaggccgtggttgaggcaaagaaacttatattagggggccttgaaaaggcagaaaagaaagaagacactaggatgtacctgctggcactgaaaaacgccttgctgccagaagggattcctagtctgctgaagtatgccgaggctggtgaggggcctatctcccaccttgcaacaaccgcactccagaggtatgacctgccgttcattaccgacgaggtcaaaaagacccttaatagaatttaccatcagaaccggaaggtccacgagaaaactgtccgaacagctgctgcagccataattctaaacaataacccatcgtacatggacgtgaaaaacattttactgagcatcggagagttacctcaggaaatgaacaagtatatgctggccattgtgcaggatatcctgaggtttgagatgcccgctagcaagatcgttagacgagtgctgaaggagatggtggcacataactacgatcgcttctctcggtccgggagctcatctgcgtacactggctatattgaacgctcaccaagatctgcctccacttactcgctagatatcttgtattccgggtccggaattctgagaaggagcaatttgaacattttccagtacattggcaaggcaggactacatgggagccaggtcgtcatcgaggctcagggcctggaagctctgatcgcagccacccctgatgaaggtgaggagaatttggatagttatgcaggtatgtctgcaattctcttcgatgtgcagctgcggccggttacgttttttaatgggtattcagacctcatgagtaagatgttgtcagcctcaggggaccccatttcagtggtgaaaggtctcattctgcttattgaccattctcaggaattacagttgcagagcggcctgaaggcaaacattgaagtgcaggggggcctggctattgacattagtggagctatggagttcagcctttggtatagggagagtaaaacacgggtgaagaatagagtgacagtggtaattaccactgatatcacggtagattcttctttcgtcaaggctggactggagacaagcaccgagactgaggccggtctcgaatttatttcaaccgtgcaatttagccagtatcccttcctggtatgtatgcaaatggacaaggatgaagcccctttccgtcagtttgaaaaaaagtatgagcgcctgtcaacagggagaggctatgtaagtcagaagcggaaggagtcagtgttggcgggttgtgaattcccgttgcaccaggaaaacagcgaaatgtgcaaggtagtttttgcaccccagcccgactccactagctccgggtggttc

SEQ ID NO: 16830 - DNA, 2682 bp, Artificial Sequence
  Description of Artificial Sequence: Synthetic coding sequence
atgatcctgctggccgtgttgtttctctgcttcatttcgagctactccgccagcgtgaagggccacaccacaggtctgagtcttaataacgaccggctttacaagctcacatactcgacggaagtacttctggataggggaaagggcaagctgcaggacagcgtaggttaccgcatctccagtaacgtggatgtggccttgttgtggcgcaacccagacggcgacgacgaccagttgatccagataaccatgaaggatgtgaacgttgagaacgtgaaccagcagagaggagaaaagagcatcttcaaaggaaagagcccgtccaagataatgggcaaggaaaacttagaggcccttcagcggcccacactgctacaccttatccacggaaaagtgaaggaattttactcttaccagaatgaagccgtggccatcgagaatattaaacgcggcctggccagcctttttcaaacacagttgtcgagcggaaccaccaacgaggtggatattagcggcaattgcaaggtcacgtatcaggcccatcaggacaaggtgataaagattaaggcactagactcctgcaagatagccagatccggcttcacaacccctaatcaagtcttgggcgtatcgtcgaaagcaacctcagtgacgacatacaaaatcgaagattccttcgtcattgccgtgctcgcggaagagacacataacttcggattgaacttcctgcagacgattaagggtaagatcgtgagcaagcagaagctggagctgaagactacagaagccggcccgcgactcatgtccggaaagcaggcagcggccattataaaagccgtggattccaagtacacggctatcccaattgtaggccaggtgttccaaagccactgtaagggctgcccctcactgagcgaactgtggcggagcactaggaagtaccttcaaccggacaacttgagcaaagccgaggctgtccgcaattttctggctttcatccagcatttgcgtactgccaagaaagaggagatcctgcagatcttaaaaatggagaacaaggaggttctaccacaacttgtggatgccgtgacatccgcccaaacctccgacagccttgaggcaatcctggatttcctggactttaagtccgactcgagtattatactccaggagcgctttctgtacgcttgcggcttcgcgtcccatccgaatgaggaactgctacgggccctcatcagtaagttcaagggcagcattggcagctcggatatacgtgagaccgtgatgatcattaccggcaccttggttcgcaagctctgtcagaacgaaggctgtaaactgaaggctgtcgtagaagcgaagaaactgatactgggcggcctcgagaaggctgagaagaaagaagatacccgtatgtacctgttggctttgaagaacgccctgctgccggagggaatcccctcactgcttaagtatgccgaggcaggcgaaggcccaatctcgcatcttgccaccacggcgctgcaacggtacgatttgccttttattacagacgaggtaaagaagacgttgaaccggatctaccaccagaaccgtaaagtacatgagaagactgtacgcactgccgccgcagccatcattttgaataacaatcccagctacatggacgtcaagaatatcctattgagcataggagagttgccgcaagaaatgaataagtacatgttagccatcgtgcaagatatcctgcgatttgagatgcccgcgagtaagatcgttcgtcgtgtgttgaaggagatggtggcccacaattacgataggttcagccgcagtggttcgtcttcggcctacaccggttacatcgaacgctcgccccgcagtgcctcgacttactccctggatattctctatagcggaagcgggattctgcggaggtctaacctgaacatcttccagtacatcggtaaggccggactgcacggatcccaggtggtgattgaggcccaagggttggaggctctcattgcggctactccggacgaaggcgaggagaatttggattcgtacgctggtatgagtgccatactgttcgatgtgcagttgcgaccggttactttcttcaacggctatagcgatctgatgtcgaagatgctgagcgcgagcggcgatccgatttcggtagtcaagggcctgatactgctgatagaccatagccaggagttacagctgcaaagtggactaaaggctaatatcgaagtccagggcggcctggccattgatataagtggagccatggagttcagtctgtggtaccgcgaaagcaagactagggtcaaaaaccgtgtaaccgtagtgattactaccgatattactgtggactccagcttcgtgaaagctggcctggagacctctacggagaccgaggcaggattggagttcattagcaccgtccagttttcccagtacccgttccttgtctgcatgcagatggataaggacgaagcaccgttccggcaatttgagaagaagtatgagcgtctcagcaccggtcgcggctacgtttcccagaaacgcaaggagtcggtcctagccggctgtgagttcccactccaccaggagaattccgagatgtgcaaagtggtctttgcaccgcagccggactcgacaagtagtggctggttt

SEQ ID NO: 16831 - DNA, 2682 bp, Artificial Sequence
  Description of Artificial Sequence: Synthetic coding sequence
atgatattgctcgcagtcctcttcctctgcttcatttccagttatagcgcttctgttaaaggacatacaacaggactctccttgaataatgatagactgtataagctgacctattccactgaagtcctgttggaccgcggaaagggcaaacttcaggattccgtgggctaccgcatcagctctaatgttgatgttgcactactgtggcgaaaccccgacggagatgacgaccagcttatccagatcactatgaaggatgttaacgtcgagaacgtcaatcagcaaagaggcgagaaaagcatatttaaggggaagtccccttcgaagattatgggaaaagagaacctggaggccctgcaacgtccaactctgcttcacctcatacacgggaaagtgaaagaattctacagctatcaaaacgaggccgtggccattgagaatataaaacgggggctggcctctttgtttcaaacacagctgagctctggaacaacaaatgaggtcgacatctcaggtaattgcaaagtcacgtaccaagcacaccaggataaagttataaagattaaggcactggatagctgtaaaatagcccgctccggcttcacgaccccaaaccaggtgctgggggtatccagcaaagctacatccgtgaccacctataagatcgaggatagcttcgtaattgctgtgctggccgaggaaacccataactttgggctgaactttctgcagactatcaagggaaaaatcgtctcaaagcaaaagttggagttaaaaactactgaggctggtcctaggctcatgtcaggtaaacaggcagccgcgataatcaaagctgtagattctaagtatacagccatacccatcgtgggacaggtgttccagtcccattgcaaaggatgcccatcactgagcgaactgtggcgcagcacacgcaaataccttcaacccgataatctgagcaaggctgaagctgtgcgcaattttttagcctttatccaacatttgcgtaccgccaagaaggaggaaattctgcaaatactgaagatggagaacaaggaagtgctgcctcagctagtggacgccgtgacatccgcacagacatccgactcgctggaggctattttggacttcctggatttcaaaagcgactcatccattatcctacaagaaaggttcctatatgcttgtgggttcgccagccatccaaatgaagaactcctcagagctttaatatcgaagtttaaaggctccataggcagcagcgatatccgggagaccgttatgatcataacaggtacgctggttaggaagttgtgccagaatgagggctgcaaactgaaagctgtggttgaggccaaaaaactgatcctaggcgggctggaaaaggctgagaaaaaggaggacacacgcatgtatctgttagccctcaaaaacgctctccttcccgaggggattcccagcctccttaaatatgcagaagccggcgaggggccaatttctcacctggccactaccgcattgcaaaggtacgacctcccctttataaccgatgaggtgaaaaagacgctaaaccgcatttatcatcagaatcgaaaagtgcacgagaagacagtcaggactgccgctgccgccattattctaaacaacaacccctcctatatggacgtaaagaatattttattatccattggcgaactgccgcaggaaatgaataaatacatgcttgcaatagtgcaggatatactcaggttcgagatgccagcctccaagattgtaagaagggttttgaaagagatggtagcccacaactatgaccggtttagtcggtccgggtcttcgtccgcttacactggctacatagaaaggtctcctcgctcagcgagtacatattccctggatatcctctatagtggttctggaatccttaggcggtctaacttgaacatctttcaatacatcggcaaggcggggcttcacggtagtcaggttgtcatcgaagcccaggggctagaagcactcattgcagcaaccccagatgaaggagaagagaatcttgattcatacgccggaatgagcgctatcctgttcgacgtccagttgcgtcctgtgaccttctttaacggctactctgatctgatgtctaagatgctgagtgcttctggcgatcccatttctgttgtcaagggattgatcctgctgatcgatcattcacaagagctccagcttcagtcaggccttaaagcgaatatcgaggttcaggggggtctggcgatcgatatcagtggcgctatggagttctccctgtggtacagggagtctaaaactagggttaagaaccgggtgacggtggtcattaccacagacattacagtggactcgtcttttgttaaggcagggctcgagacaagcactgaaaccgaggccggtctggaatttattagtaccgtgcagttcagtcagtaccctttcctggtgtgcatgcagatggataaagatgaggctccctttaggcagtttgaaaaaaagtatgagcgcctgtctaccgggcgggggtatgtgtcccagaaacgtaaagaatctgtgctggccgggtgtgaattccctcttcatcaggaaaattccgagatgtgtaaggtggtgttcgctccccagccagactccactagcagcgggtggttc

SEQ ID NO: 16832 - DNA, 2682 bp, Artificial Sequence
  Description of Artificial Sequence: Synthetic coding sequence
atgatcctgttggctgtgcttttcctgtgcttcataagttcatattccgccagtgtcaagggccatactaccggccttagccttaataatgaccgcttgtataaactgacctattccaccgaggtcctgcttgatagggggaagggaaagctgcaggactctgtcggttaccgcattagcagtaacgtggacgtggcactgctgtggagaaatcccgatggggatgacgatcagcttatacaaatcaccatgaaggatgttaacgtggaaaacgtcaatcagcagcggggcgaaaagtccatatttaaaggcaaatcccccagcaaaattatgggcaaggaaaatctggaggcactccagaggccgacattgttgcacctgatccacggaaaggtcaaagagttttactcctaccagaacgaggcggtggctatcgaaaacatcaagaggggcctggcctcactgtttcagacacagctcagctctgggaccactaacgaggtagatatttctgggaactgtaaagtcacatatcaagctcatcaggacaaagtgatcaagattaaagctctcgattcatgcaagatagccagatctggatttactactcctaatcaggtcctgggggtatccagcaaggcgacaagcgtaacgacctacaaaatagaagatagcttcgtaattgcagtactcgcggaggagacacataactttggattgaactttctgcagaccatcaaaggtaagatcgtgtccaagcagaagctggaactgaaaaccacggaagcagggcctcgcctcatgagcggcaaacaagcggccgctattatcaaggccgtggacagcaagtacacggctatacccatcgtgggtcaggtattccagtctcactgtaaggggtgcccctccctgtccgagctgtggaggtccactaggaaatacctgcagccagacaatctgagcaaagcagaggcagtcagaaacttccttgcattcattcagcatttgaggaccgccaagaaggaggaaatactgcaaatcctcaagatggaaaacaaggaggttctcccccagttggtggatgccgtgacatccgcccaaacctctgatagcttggaggcaatccttgactttctggattttaaatccgactcttctatcatcctccaagaacggttcctgtacgcctgtggatttgcgtcccatcccaacgaagagctgctgcgggctctgatcagtaagtttaaaggcagcatcgggtcatccgatatcagggaaacagtaatgatcattaccggcacgctcgtgagaaaactctgtcaaaatgagggatgcaagctgaaggccgtcgtcgaagcgaaaaagctcatcctgggagggctcgaaaaggctgaaaaaaaagaggacacgcgaatgtacctccttgctctgaaaaatgcgcttctgcctgaaggcattccgtcacttttgaaatatgccgaggctggggaagggccaatttcacacctcgcgacaacagccctgcagcgctacgacctgccattcattactgatgaggtgaagaagacattgaatagaatataccaccagaacagaaaggtacacgagaagacagtccgaaccgccgctgccgctattatcctgaacaataacccctcctatatggacgtgaaaaacattcttctgtccattggggagttgcctcaggagatgaacaagtacatgctggctattgtccaggatatactgcggtttgagatgccagcctcaaagatcgtacggcgggtcctcaaggagatggtcgctcataactacgacaggttcagccgctccggttcatcatcagcctatacaggctatatcgagcggtcacccagatccgcaagtacttatagcttggatatactgtattccggaagtggaatcttgaggaggtctaacctgaatatctttcagtatatcggcaaggccgggttgcatggctctcaggtcgtgatcgaggcccaggggctcgaggccctcattgccgccacccccgatgagggtgaagaaaacttggactcatacgccgggatgtccgctatcctgtttgacgttcaattgaggcccgtcacgttctttaatggttacagcgatctgatgagcaaaatgctttcagcctctggagatccaatcagtgtggtcaagggtttgatcctgcttatagatcattctcaagagctccagctgcaaagcggactgaaggcaaacattgaggtacaaggcggactggcgattgatataagtggggccatggaattttcactgtggtacagagaaagcaaaacacgcgtaaagaaccgcgtgaccgtggtcatcacgacagacatcactgtggatagcagcttcgtgaaggcgggtcttgagacatctactgagaccgaggctggcctggagtttatcagtactgtgcagttctcacaataccccttcctggtctgtatgcaaatggacaaggatgaagcaccctttagacagttcgagaagaagtatgagcgactctctactggccgcggctacgtgtctcagaaacgaaaagagagcgtcttggccggctgtgagttccctctgcaccaggaaaattccgagatgtgcaaagtcgtcttcgcacctcaacccgatagtacgtcctctgggtggttt

SEQ ID NO: 16833 - DNA, 2682 bp, Artificial Sequence
  Description of Artificial Sequence: Synthetic coding sequence
atgatactgttggcggtcctgttcctctgcttcatcagtagttactcggcttccgtgaagggacacactaccggcctgtcactcaacaatgatagactgtataagttgacttactccactgaggtgcttcttgatcgcggcaagggtaaactgcaggattctgttggctatcgaatttcatccaatgtcgacgtggccttgttatggcggaacccggacggggacgatgaccagttgatccagattactatgaaggacgtgaatgtcgaaaacgtcaaccagcagcgtggtgagaagtcgatattcaagggcaagtcaccttccaagatcatgggcaaagagaaccttgaggcccttcagcgcccaaccttgctccatttgatccatggcaaggtgaaggagttctactcttaccagaacgaggcggtcgcaattgagaatatcaaaaggggtcttgcatctctgttccaaacccagctgtctagtggcaccacaaacgaagtggacatttccggcaactgcaaggtaacttaccaagctcatcaagacaaggttataaagatcaaggcactggactcgtgcaagattgcccgtagtggctttaccacacccaaccaggtcctcggcgtgagctccaaagcgacctcggttacgacctataagattgaggatagcttcgtgatcgccgtcctggctgaggagacccacaacttcgggctgaatttcctgcagacgatcaaggggaagatcgtgagcaagcaaaagctcgagttgaagaccaccgaggcgggcccccgcctgatgtccggtaagcaggccgccgccattatcaaagccgttgactccaagtatacggccatcccgatcgttggtcaggtgttccagtctcactgcaaaggttgtccctctttgagcgagttgtggcgttccaccagaaagtacttgcaaccagacaacctctctaaggctgaggccgtccgcaattttcttgcgtttatccagcatctgcgtactgcaaagaaggaggagatccttcagatactgaagatggagaacaaggaggtgctacctcagctggttgatgccgtcaccagcgctcagacttcagattccttggaggctatcctggatttcctcgattttaagagtgactcctcgataatcttgcaggaacgcttcttgtacgcctgtggattcgcgagtcaccctaatgaggaacttctccgcgccctgatttcgaagtttaagggcagcataggcagttccgacatccgcgagaccgtcatgattattacaggaaccctggtacgtaagttgtgccaaaacgagggttgtaagcttaaggctgtcgtagaggccaagaagttgattctcggtgggctggagaaggcggagaagaaagaagacactcgtatgtatctcctcgcccttaagaacgccctgctgcctgaaggtatcccctctctcctgaaatacgccgaggctggcgaaggccctatcagtcacttggctacgacggcactccagagatacgacctgcccttcatcaccgacgaggtgaagaagacccttaaccgtatttaccatcagaatcgcaaggtgcacgagaaaactgtgaggactgcggccgcagccataatcctcaacaacaatccctcttacatggatgtgaagaacatccttttgtcgatcggggagctacctcaggagatgaacaagtacatgctcgccatcgtgcaggatatcctccgcttcgaaatgcccgcctctaagatcgtcagacgcgtcttgaaggagatggtcgcacataactacgatcgtttcagcaggtctggttcatcgtccgcttatacggggtatattgaacgtagtccccgtagtgcctccacctactctcttgacatcctctactccggaagtggtatcctgcgccgttcgaaccttaacatctttcaatacatcgggaaggccggcctccacggttcgcaagttgtgatcgaagctcagggtcttgaggccctgatcgccgctacccccgacgagggggaggagaaccttgatagctacgccggaatgtcggcgatcctcttcgatgtgcaactgcggccagtgaccttcttcaacggctactcggacttgatgtctaagatgctctccgcgtccggggatcccatctctgtggtgaaggggctcatactgctgattgatcactctcaggagctgcaactgcagagcggcctcaaggccaacattgaagtccaggggggtctcgctatcgacatttctggggctatggagttcagcttgtggtaccgtgagtcgaagacaagagttaagaatcgcgtcacagtggttatcacaactgacatcaccgtcgacagctccttcgtgaaggcgggattagagacctctactgagaccgaggcaggcctggaatttatttccaccgtccagttctcccagtaccccttcctcgtctgcatgcagatggacaaggacgaagctcctttccgccagttcgagaagaaatatgaacgcctctccaccggacgcggatacgtctcccagaagcgaaaggagtctgtgctcgcaggctgcgagttcccgctgcatcaagagaactccgagatgtgcaaggtggtcttcgctccccaacccgattctacctctagtggatggttc

SEQ ID NO: 16834 - DNA, 2682 bp, Artificial Sequence
  Description of Artificial Sequence: Synthetic coding sequence
atgatactcctggccgtcttgttcctatgcttcatttcttcatactccgcaagtgttaagggacatactaccggactctctcttaacaacgacaggctttacaagctcacatactccaccgaggtgcttttggacaggggcaaggggaaactgcaggactccgttggctaccgtatctccagtaacgtggatgtggcgttactgtggagaaatcccgatggagacgacgaccagctcatccagatcaccatgaaggatgtgaacgtggagaacgtcaaccagcagcgaggggagaagagtatcttcaaaggtaaatccccaagcaaaatcatgggaaaggaaaacctggaggcacttcagcgccccacactcttgcacctcatacacggcaaagtgaaggaattctactcctaccagaatgaagcagttgcaattgaaaatattaagagaggcttagccagcctgtttcaaacccaactgtctagcggcacaacaaacgaggtcgacatctccgggaactgcaaggtcacctatcaggcccaccaggataaggtgatcaagatcaaagctctggatagttgcaagatcgccagatctggtttcacaacacccaatcaggtcctgggggtgtcgagcaaagctacatcagtcaccacttacaaaatcgaagatagcttcgtgatcgccgttctggctgaggagacccacaattttggactgaactttctgcaaaccatcaaaggaaaaattgtctccaaacaaaaactggagttgaaaacgacagaagccggcccccgtcttatgagtggcaagcaagctgctgcgatcattaaagccgtggatagcaagtacactgccataccaatcgtcggtcaggttttccaatcacactgcaaaggttgcccctccctcagcgagctgtggaggtctacacgcaagtacctgcagcctgacaacctttctaaagcagaggctgtccgcaattttctcgcatttatccagcacttgaggaccgcgaagaaagaggaaattctgcagatcctgaagatggagaacaaagaggtgctgccccagctggtagacgcggtcacctcagcacagaccagcgattcgctggaagctattctggattttctcgattttaaatccgattctagcataatcttacaggaacggttcctgtacgcctgtggctttgccagccacccaaatgaagaactgcttcgggccctgataagtaaattcaagggaagtattggtagtagcgacattcgggagacagtcatgatcatcacaggcactcttgtccgcaaactgtgtcagaatgagggctgcaagctgaaggccgtggtggaggccaaaaaactgatactggggggccttgagaaggctgagaagaaagaggatacccgtatgtacctattggccctgaagaatgccctactcccagagggcattcctagccttctcaagtatgctgaggctggggaaggaccgatcagccatcttgctacaacagccctccagcgatacgatctgcccttcatcactgacgaggtcaagaagactctaaatcggatttaccaccagaaccggaaagttcatgaaaaaacagtgcgtactgccgccgccgccatcatcttgaataataaccccagctacatggatgtcaagaatattttgctatcaatcggcgagctgcctcaagagatgaacaaatacatgcttgcaatagtccaggatatcctgaggtttgagatgcctgcctcgaagatcgtgcggcgtgttctcaaagagatggtcgcccataattacgaccgctttagtcgatccggctcctcctccgcatatacggggtatatcgagagatcgccccgctcggcatcaacttactcccttgatatactatatagcgggtctggcatcttgcgtagatctaacctgaatatctttcaatatattggaaaggctgggcttcacggatcccaggtcgttatcgaagcgcagggcctggaagcactcatcgcagcgactcctgacgaaggagaggagaatttggacagttacgctgggatgtccgctatcctcttcgatgtgcagctgcggccagtgactttctttaacggctacagcgatctgatgagcaaaatgctatcagccagtggcgacccaatttcggtggttaagggtctgatactgctcatcgaccacagccaggagttgcagctgcagtctggcctgaaggccaatattgaagtacagggcggattggccattgacatcagtggcgccatggaattttccctttggtatcgcgagtccaagactagagtcaagaaccgagtcactgtggtgatcactaccgatattacagtggattccagtttcgtgaaagcaggactggaaacgagtacagaaaccgaggccggcctcgagtttatcagtacggtgcagttctcacagtacccttttttggtgtgcatgcagatggacaaagatgaggctcccttccgacagtttgagaagaaatatgagcgtttaagcactggaagaggatacgtatcgcagaaaagaaaagagtccgtgctggcaggctgtgaattccctctacaccaggaaaactccgaaatgtgtaaagtcgtcttcgccccacagcccgactccactagttctgggtggttt

SEQ ID NO: 16835 - DNA, 2682 bp, Artificial Sequence
  Description of Artificial Sequence: Synthetic coding sequence
atgattcttctggctgtcttgttcctatgttttatctccagctactcagcttccgtcaaggggcatactaccgggctctccctcaataatgatagactgtacaagctcacctatagcaccgaggtgctactggacaggggcaaggggaagttgcaggattcagtgggatataggatctcctccaacgtggacgttgctctgctctggagaaatcccgatggggacgatgaccaacttatccaaatcactatgaaggacgtgaacgtggaaaacgttaatcagcagcggggggaaaagtccatttttaaaggcaagagtccgtcaaaaattatgggcaaggaaaatttggaagcactgcagcgccctaccctgctgcacctaatccacggaaaggtgaaggagttctacagctaccagaatgaggcggtggctattgaaaacattaagcggggactcgcctcccttttccagactcagctgtcctccggaaccacgaacgaggtggatataagtggcaactgtaaagtgacttaccaagcacaccaagacaaggttataaagatcaaagcgctggattcatgcaaaatcgctaggagcgggtttacgacgcccaatcaggtgctcggggtgtccagcaaagcaacaagcgtaacaacatacaaaatagaggattccttcgttatagctgtgctggcagaagaaacccataacttcggcctaaacttcctacaaacaattaagggcaagatcgtttctaagcagaagcttgagctgaagaccaccgaggccggacctagactgatgtccggaaagcaagctgctgcgattattaaggctgtggattctaagtacacagccatccccattgtgggccaggtgtttcagtcccattgtaaaggatgtccttctctttcagagctttggaggtctacacgaaaatatctgcagccagacaatttgtcgaaagccgaggccgtgagaaacttcctggcgttcatccagcacttgagaactgctaaaaaggaggaaattctgcagatcctcaagatggagaataaagaggtgttgcctcaacttgtcgatgcggtgacatcagcccagacttccgactcactggaagctattctggatttcctagacttcaagtccgattccagcatcattttgcaagagcggtttctctacgcctgcgggtttgcaagccatccaaacgaggagttgctgcgagcactgatctcgaagttcaagggcagtatcggctcaagcgatattcgggagacggtgatgattatcacaggaactctggtgcgtaaactgtgtcagaatgaggggtgcaagttgaaagccgtggttgaagcgaaaaagctgatcctcggcggactggaaaaggccgaaaagaaggaggacacgaggatgtacctcctagccttgaagaatgcactgttgcccgaaggaatcccaagtctcctaaagtacgctgaggcgggcgagggtccgatcagccatctggcaacgacagcactgcagcgttacgatttaccattcattacagacgaagtgaagaagacccttaacaggatttatcatcagaataggaaggttcacgaaaagacagtgcgcacagcggcagcagctattatcctgaataataacccaagctatatggatgttaaaaatattctgctgtctattggggaactacctcaagagatgaataagtatatgctcgctatcgtccaggacattctgcgttttgaaatgccggcctcgaaaatcgtacgaagggtgttaaaggaaatggtggctcataactatgacagattctccagatcgggttcctcttccgcctatactggatatatcgaaagatcccctcggtccgccagcacttactctctagatatcctctactctggctccggcatcctccgccggtcaaaccttaacatcttccagtacatcggcaaggcgggcttgcacggctctcaggtcgtaattgaggcccaggggctggaagctctgattgcggccacgccagacgagggagaggaaaacctcgactcctacgccggcatgagcgcaattctgttcgacgtacagctgcgccccgtgaccttctttaatggatactcagatcttatgtctaaaatgttgagcgcctctggggatccaatctctgtcgtcaagggcttgattctcctgatcgatcacagtcaagagctgcagcttcagagcggcctgaaagccaatatcgaggtgcagggcggactggccattgatatctcgggagctatggaatttagcctgtggtaccgagagtccaaaacgagggttaaaaacagagtgacagtggttatcaccactgatattactgtggatagttcattcgtgaaggctggactggagacgagcaccgaaaccgaggccggccttgaatttataagcaccgtccagttttctcagtacccattcttggtatgtatgcagatggacaaggatgaagccccattcaggcagttcgagaagaaatatgagcgactctctactgggcggggttacgtcagtcagaaacgcaaggagagcgtgcttgcaggatgtgaatttcctcttcaccaggagaactctgagatgtgcaaggtggtctttgcaccacagccggatagtacgagctcaggatggttc

SEQ ID NO: 16836 - DNA, 2682 bp, Artificial Sequence
  Description of Artificial Sequence: Synthetic coding sequence
atgatcctgctcgctgttctgttcctgtgcttcattagctcatactcggcaagcgtcaagggacacacaacagggctgagtttgaacaatgatcggttgtacaagctcacatactccaccgaggtacttctggatcgaggcaaggggaaactccaagattcagttggttatcggatatcctcgaacgtggatgtggctcttctgtggcgcaacccagacggtgatgatgaccaattgatccagatcaccatgaaggacgttaatgtcgaaaacgttaaccagcaaagaggcgagaagtctatattcaagggtaagagcccctctaaaatcatgggcaaggaaaacctcgaggcattgcagcgacccaccctcttgcacttaatacatggaaaagtcaaggagttttatagctaccagaacgaggcagtggcaatcgagaatatcaaaagaggactagcttcgctgtttcagacccaactttccagcggtaccacgaatgaagtcgatatcagtgggaactgtaaggttacgtatcaagcgcaccaggataaggttataaaaatcaaagcgctggattcatgcaagattgcaagatcgggcttcacaacaccaaaccaggttctcggtgtttctagcaaggccacgagcgttactacatacaagatcgaggactcgttcgtaatagccgttctcgcagaggagacgcataacttcggacttaacttcctgcagactatcaagggaaagattgtgagtaagcaaaaacttgagttgaagacgactgaagccggcccgcgcttaatgagtggtaagcaagctgcagcgattataaaggcagtggactccaagtacaccgccattcctatcgtgggacaggtcttccagtctcattgtaaagggtgcccttctctctctgagctgtggcgaagcacacgaaagtacttgcagccagataatctctcgaaggctgaggcagtccgaaatttcttagcattcatccagcatttgcgcacagcgaaaaaagaggaaattctgcagattttgaaaatggagaacaaagaagttcttccgcagcttgtggacgcggtcacctcggctcaaacctccgacagtctggaagccatccttgattttctagactttaagagcgattctagcatcatcctgcaggaacgctttctgtatgcttgcggcttcgcgtcccatccgaacgaggagcttttgagagcccttatcagtaagttcaaaggttccataggatcatcagacatccgagagactgtcatgattatcaccggcacccttgtacggaagctgtgtcaaaacgagggatgcaagctcaaggccgtcgttgaggccaagaaacttatcctcggaggtctcgagaaagccgagaaaaaggaagatactcgtatgtatctacttgccctcaaaaacgctcttcttcctgaaggcataccttctctgcttaagtacgctgaggcgggggagggtcctatcagccatcttgctactacagccttgcagcgatacgatctccccttcatcacggatgaggtcaaaaaaacactgaatcggatttaccaccagaaccgcaaggtccacgagaagaccgtccgtacagcagccgcggcaatcatcttgaacaataacccatcttacatggacgtcaagaatatccttttatctatcggtgagctcccgcaggagatgaacaaatacatgctcgcaatcgtgcaggatattttgcgttttgaaatgcctgcatcaaagatagtccgccgcgttttgaaggagatggttgcacataattacgatcgattttcgaggtccggtagcagctctgcctataccggctacattgaacgaagtcctcggtctgctagcacttactccttagacatcctctacagcggttcaggcatcttaaggaggtcgaatcttaatatattccagtacataggtaaggctggcctccatgggtctcaggtcgtaatcgaagcgcaaggcctcgaagccctgattgctgctaccccagacgaaggggaagagaacctcgattcttatgctggcatgtctgctattctcttcgatgttcagctgcgacctgtgacctttttcaatggttattcggatctgatgtctaagatgctctctgcctccggcgatccgatttcagttgtaaaaggtctgattcttctaatcgatcattcccaagaattacaactgcagagtggcctcaaggcaaacatcgaggtacagggcggccttgcaatcgatatcagcggcgctatggagttctctctctggtatcgtgaatcaaagacccgagttaagaacagagttactgttgtcatcaccaccgacattactgttgactcgtcctttgttaaggcgggtttggagacctctactgaaacagaagcgggcctcgaattcatatcgacagtccagttctctcaatacccatttctcgtctgtatgcaaatggataaagatgaggctcctttccgccaatttgaaaaaaagtacgaacgcttgagcaccgggcgcgggtacgtttcacagaagcgcaaggagagcgtgctcgccggttgtgaattcccattacaccaggagaactcggagatgtgcaaggtcgtgttcgccccgcaaccggactcaacctctagtggttggttt

SEQ ID NO: 16837 - DNA, 2682 bp, Artificial Sequence
  Description of Artificial Sequence: Synthetic coding sequence
atgatcttgttggcggttctgttcttgtgcttcatcagttcatactcagcctcggtcaaaggtcataccacaggtcttagcctaaacaatgaccgcctgtataaactaacctacagtaccgaggtactattggacaggggtaaaggcaagcttcaagatagtgtggggtatcggatttcaagtaatgtcgacgttgccctgctgtggcggaatcctgacggcgacgacgaccagctcatccagatcaccatgaaggacgtgaatgtggagaatgtgaatcagcaaagaggcgagaaatccatcttcaaaggcaagtcaccttcaaagatcatgggcaaggagaacctggaagctctgcagagaccaacgctactgcatctgatacacgggaaggtcaaggagttctactcttaccagaatgaggcagtggctattgagaatattaaaagaggactcgccagcctctttcaaacacagctctcatctggaaccactaacgaagtggacatatctggtaactgtaaagtcacatatcaggctcatcaggataaggtaatcaaaatcaaggcattggactcttgtaagatcgctcgctcgggatttactacccccaatcaagtcctcggcgtgtctagcaaggccacgagcgttacaacttataaaatcgaagattccttcgtgatcgctgttctggctgaggaaacacataattttggtctcaattttctgcagactattaaaggcaaaattgtgtctaaacagaaactggagttgaaaacaacagaagccggtccccgtttgatgtccggcaaacaggcagcggcaataataaaagccgtcgactcgaagtacacagccattcctattgtgggccaagttttccagtcacactgtaaaggctgtccctctttatctgagctgtggagaagcaccagaaaatacctacagcccgataatctgtcaaaggcggaggcagtaaggaacttcctcgcatttatccagcaccttcgcacagcgaagaaggaggaaatccttcagatcctgaagatggaaaacaaggaagtgcttcctcaattagtcgatgccgtgacgagcgcacaaacctctgactcgctggaggctatcctggactttctcgacttcaaatcagattcttctattatcctgcaggagaggtttttatacgcctgcgggttcgcatcacaccccaatgaggaactccttcgagccctcatcagcaaattcaagggttctatcggcagctctgacatccgcgagaccgtcatgatcattacgggaacgctggtgcgcaagctgtgccagaatgaaggatgcaaactgaaggccgttgtagaggccaagaagcttatcctggggggccttgagaaagccgagaaaaaagaagacacacgcatgtacttgctggcccttaaaaatgctcttctgccagaaggtatcccctctttgcttaagtacgcagaggctggcgagggccctataagccaccttgctacgacagcgcttcagaggtacgacctccctttcataactgatgaagtcaagaagaccctcaatcgcatatatcaccagaatcgaaaggtgcatgagaaaaccgtaaggaccgcagcggctgcaataatcctaaataacaaccctagttatatggacgtcaaaaatatactgctgagcattggcgaacttcctcaggagatgaataaatatatgttggccatagtacaggatattttacgctttgaaatgcccgcttccaagatcgtgcggcgcgtgcttaaagaaatggtggctcataactacgaccgctttagtagatccggctccagtagtgcctataccggttatatagagcgttccccccgaagtgcttccacctattctctcgacattttatacagcggttcaggcatccttaggcggagtaacttgaacatattccagtacatcgggaaggcaggcttgcacggatcgcaggttgttattgaagcacaaggcctggaggccttgattgcggccacccccgatgagggggaggagaatctggacagctacgctggaatgagcgctatcctgtttgatgtccaactcaggcccgtcaccttcttcaatggatattcagacctaatgagtaaaatgctctccgcatcaggcgacccaatcagtgtcgtgaaaggacttatcctgctcatcgaccatagccaggagctccagctgcaaagtggcctgaaagcaaatatcgaggtgcagggaggcctggccattgacatcagcggtgcaatggaatttagcctatggtaccgggagtccaaaactagggttaaaaacagagtcactgtagtaatcaccaccgatatcacagttgattcatccttcgtgaaagccggcctcgagacctccactgagacggaagctggtcttgagttcatctcaacagtgcaattttcccaatacccgtttttagtgtgtatgcagatggataaagatgaggctccttttcgccaattcgagaagaagtatgaaagactgtctaccggtagagggtatgtgtcgcaaaagagaaaagaaagtgtcctagctgggtgtgagtttccactacatcaggaaaacagcgaaatgtgtaaggtggtttttgcgccccaaccagatagcacgagttcaggatggttt

SEQ ID NO: 16838 - DNA, 2682 bp, Artificial Sequence
  Description of Artificial Sequence: Synthetic coding sequence
atgattctgctggccgtcctcttcctgtgcttcattagcagttattcagcctcagtgaaagggcataccacaggcctctcattgaacaacgaccggctatacaaacttacatactctacagaggtactgctcgacagggggaagggaaagctgcaggactcggtgggataccgtatttcctccaatgtggatgtcgccctactgtggaggaatcccgacggagacgatgatcagttaatccaaataacgatgaaggatgtgaacgtagaaaatgtgaaccagcagcgcggcgaaaagtctatcttcaaaggaaagtcaccatctaagataatgggaaaggagaatttggaagcactgcagaggccgaccctcctgcaccttattcacggtaaggtcaaagaattctattcttaccagaacgaagcggtcgcaatcgagaatattaaaagaggactggctagcttatttcagacacagctttcctctggcaccactaacgaagtagacatatctggaaattgtaaagtgacataccaagcgcatcaggataaggttatcaaaattaaagccctcgattcgtgtaagatcgctagatctggcttcacaacccctaaccaggtattgggagtaagctcgaaggctacctcagtcaccacatacaaaattgaagacagtttcgtcatagcagtcctcgcagaggaaacacacaactttggactgaacttcctacagacgattaaggggaaaatcgtctccaaacaaaagctggaacttaagactaccgaggccggcccacgactgatgtctgggaagcaggctgcagctataattaaagccgttgatagcaagtacacggccatccctatcgtgggtcaggtgtttcagtcccactgcaaggggtgtccttctctgtctgagctatggcgatctacacgcaaatatctgcagccggataatttaagtaaggccgaggctgtcaggaactttctggcattcatccagcatcttcgtactgcaaagaaggaagagatacttcagatcttgaagatggaaaacaaagaagtgctccctcagctcgtggacgcagtgacttctgcccagactagtgactccctcgaggccatcctcgatttcttagactttaaaagcgattcaagtataattctccaagaaagatttctgtacgcttgtgggttcgcctcccacccaaacgaggaactgttgcgagcattaattagtaagttcaaggggagcattgggagctccgacattcgcgagaccgtcatgataatcactggtacactggtgcgtaaactctgccaaaatgaaggatgcaaattgaaggctgtcgtcgaagcgaagaagctgatactgggcggcttggagaaagccgagaagaaagaagatactcgtatgtatctactcgctctcaagaatgcactgctgcctgagggaatcccatctttgctgaaatatgctgaagccggagaggggcccattagtcacttggccacgactgctctccagcgttatgaccttccgttcataactgatgaagtgaaaaaaacgctgaatcgaatctaccaccagaatagaaaggtacacgaaaagactgtaagaacagcagccgcagctataatcctgaacaataatcctagttacatggatgtgaaaaacatactcttgagtatcggcgagctgccccaggagatgaacaagtacatgcttgcgattgtacaggacatcctccggtttgagatgcccgctagtaagattgttagacgtgtactgaaggagatggtggcacacaactacgatagattctcccggagtggttcttcatcggcctacactggctatatcgaacgttctcctagatccgccagcacctactccctcgatatcttgtattctgggtccgggatccttcgcagatccaatctcaatatattccagtatatcggtaaagcgggcctgcatggaagccaagtggtgatagaggctcaggggcttgaggcactcattgccgcaactcccgacgagggggaggagaacctcgactcttacgccggcatgtcggccatcttatttgacgtacaactgaggcccgtcacttttttcaacggatactctgacctcatgtctaaaatgttatccgcttccggagacccaattagcgtggtgaagggtctgatactactaattgatcatagccaagagcttcaattacagagcggcctcaaggcaaatattgaggtgcaagggggcctggccatcgatatatctggggccatggagttctctctgtggtacagggaaagcaaaacaagagtgaagaacagggtgaccgtcgtaatcaccacggacattaccgttgattcctcgttcgtcaaggctggcctcgagacctccacagaaacagaagccggtttggagttcatttcaacagtccagttttcacagtatcccttccttgtgtgcatgcagatggacaaggatgaagcacccttcaggcaatttgaaaagaagtatgagcgtttgtcaaccggtaggggatacgtgtcgcagaagcgcaaggaatcggtgctggccggctgcgagtttccacttcaccaggaaaacagcgaaatgtgcaaggtggtgttcgccccacagccagactcaacatcctccggttggttt

SEQ ID NO: 16839 - DNA, 2682 bp, Artificial Sequence
  Description of Artificial Sequence: Synthetic coding sequence
atgattctccttgccgtgctgttcctgtgcttcatttcctcatattccgctagtgtgaaaggtcataccacgggcctttccctgaataatgacaggctgtacaagctgacatacagcacagaggtactactggaccggggaaagggaaaactacaagatagcgttggctatcggatttcgtcaaatgtggatgtcgctttactttggaggaaccccgacggcgatgatgaccagctaatccagatcacaatgaaggacgtgaacgtggaaaacgtgaatcagcagcgaggagagaagtccattttcaaaggaaaaagcccatcaaagattatgggaaaggagaatttggaggctctgcagcgacccaccctgcttcacctgatccacggtaaggtaaaggaattctacagttatcagaatgaggccgtggccatcgaaaatatcaagcgagggctcgcctcgctcttccaaacgcagctcagtagtggtactaccaacgaggtggacatttccgggaactgcaaagtgacataccaggcacaccaggataaagtcattaagataaaagcattggattcttgcaaaatcgcacggagtgggtttactacccctaatcaggttttaggagtaagctctaaggctacgtctgtcaccacttacaagattgaggatagcttcgtcatagccgtgctggccgaagagacacacaacttcgggctgaacttcctgcagacgattaagggtaagattgtgagcaaacagaagctcgagttgaagaccacagaagcagggcccagactgatgtccggaaaacaagcggccgccataatcaaagctgtggacagtaagtacactgccatccctatcgttgggcaggtatttcagtcacattgtaagggttgcccctccctgtccgagttgtggaggagcacgcggaagtatcttcagccagacaatctgagcaaagctgaagctgtcaggaactttcttgccttcatacagcatttgcggacggcgaaaaaagaggagatactgcagatcctgaagatggagaacaaggaagtcctgccacagctcgtggatgctgtgaccagcgctcagacctctgactctttagaggcgatactggatttcctggacttcaaatctgacagctcgataatcttacaggagcggtttctctacgcgtgcggattcgcatcgcaccctaatgaagagctgttaagagcactgattagtaagtttaagggcagtatcggcagcagcgatatcagagagacagtgatgataatcaccgggaccttggtccgaaaattatgtcagaacgaagggtgtaagttgaaggctgtcgttgaggccaaaaagctcatcctggggggtctggagaaggctgaaaaaaaagaggatactcggatgtacctgctcgccctgaagaacgctcttctacccgaggggataccgtctctcctgaagtatgcggaggccggggagggtcccatcagtcatctagcgaccactgctttacagagatatgacttgccctttataactgacgaggtaaagaaaactctaaatcgaatttaccaccagaaccggaaagttcacgaaaagactgttaggacagcggcagctgcaatcatcctgaataacaaccccagctatatggatgtgaagaacatcctgttgtctattggcgagctgccacaggagatgaacaagtatatgctggcaatagtgcaggacattttacgcttcgagatgccagcaagtaagatagtgcgtagagtgctgaaagaaatggttgcccacaattatgacaggttctctcggtccggtagctcttcagcgtacaccggctacattgagcgctcaccgaggtcagccagcacatattctcttgatatcctgtattccggctccgggatcctcagacgatccaacctgaatatcttccagtatataggtaaggccggactacacggcagccaggtcgtcatcgaggcacagggacttgaggctttaatcgcagccacccctgacgagggggaagagaatttggactcttatgccggaatgtcagccatactttttgatgtgcagttgaggccagtaaccttctttaatggctattccgacttgatgagcaagatgttatctgcctccggggatcccatttccgtcgtcaagggactgattctgctaattgaccattcccaggagctccagttgcagtccgggctcaaggctaatatcgaggtgcagggaggtctggctatagatatctccggagccatggaattctccctctggtatcgagagtccaagactagagtcaaaaaccgcgtaactgtggtcatcactaccgacattacggtggattctagtttcgtgaaagccggcctggagacttcaaccgagactgaagctggtctggaatttattagcactgtccagttctctcagtatcccttcctcgtttgtatgcagatggacaaggatgaagctccttttcgccagttcgagaagaaatacgaacggttgtccaccggcaggggctatgtgtcccaaaagaggaaggagtcagtactggccgggtgtgaattcccgctgcaccaagaaaactcagaaatgtgcaaggtggtgttcgctccacagcccgactccactagctcaggctggttt

SEQ ID NO: 16840 - DNA, 2682 bp, Artificial Sequence
  Description of Artificial Sequence: Synthetic coding sequence
atgatcctgctggctgtgctcttcctgtgttttatctccagctactcagcatctgttaaggggcatacgaccgggctatccctgaataacgaccgattgtataagctcacgtacagtactgaggtactccttgacagagggaagggtaaactgcaggacagcgtcggctaccgaatttcatccaatgtggatgtagccctgctgtggagaaaccctgatggggatgatgatcaactcattcaaataactatgaaggatgttaacgtagagaatgtgaaccagcagcgaggggaaaagagtatctttaagggcaagtccccatctaagatcatggggaaagaaaacttggaggcgctgcagcgacctaccctgttacatctcatccacgggaaggttaaagagttctactcgtaccagaatgaggccgtcgcgatcgagaacatcaaacgtgggcttgcttcgctgttccagacccagcttagcagcggcacaaccaacgaagttgatatcagtggaaattgtaaagttacctaccaggcccatcaggacaaagtcattaaaatcaaggccctggacagctgtaagatcgcccgttcaggtttcacaacccccaatcaggtgctgggggtgtcttcgaaagccaccagcgtaacaacctataaaattgaagattcgttcgttatcgccgtactggccgaggaaacccacaactttgggctgaacttcctacagactatcaagggaaaaatcgtttctaaacagaagcttgagcttaagactaccgaagctggcccccgactgatgtcgggtaagcaggctgcggccatcattaaggcagtggattcaaagtacactgccattccgattgttggacaagttttccagtcgcattgcaagggttgtcctagcctcagtgaactgtggcgatccacccggaagtacttgcaaccagacaatctgagcaaggccgaggccgttcgtaacttcctagcgtttattcagcatctgaggacagcaaagaaggaggagattctgcaaattctgaagatggaaaataaagaggtgctccctcaattggtggatgccgtgacatctgcccagacaagcgatagtctggaggctatcctcgacttcctggatttcaagtcagattcctctatcatacttcaggagaggttcctttacgcctgcggctttgcctcgcatccaaatgaggagctgttaagagccctgatctcgaagtttaaggggagcattggcagctcggatattagggagaccgtaatgataatcacgggcactctcgttagaaagctatgtcagaatgaaggttgcaaactgaaagccgtggttgaggctaaaaaacttattctggggggtctggagaaggcagaaaagaaggaagacacacgaatgtatcttctagcacttaaaaatgccctactaccagagggcatcccgtctttattgaaatacgcagaggcaggagaaggccctatctcccatctcgctactaccgccctgcaacggtatgacctcccttttattaccgacgaagtgaagaagactcttaaccgaatttatcaccaaaaccgcaaagtccacgagaagacggttcgaaccgcagctgccgccataatactgaataacaacccaagttatatggatgtgaagaatattcttttgagtatcggcgaactcccacaggaaatgaacaaatacatgctggcaatcgtccaggacatcctgagatttgaaatgcccgcaagcaagatagttaggagggtgctgaaagagatggtagcccacaattatgacagattttctaggtcagggagctcatcagcctacaccggctatattgaaagatctccccgatcggcctctacctattccctggacatcctgtactcgggaagcggcattctaagaaggtcgaacctgaatatcttccaatacatcggcaaagcaggtctgcatggttcacaagtggtcatagaggcacagggtctcgaggctctgattgccgctacccccgacgaaggggaagagaacttggatagctatgcaggaatgtccgccatcctgtttgacgtgcaactgcggcctgttacgttctttaacggctattccgacctcatgagtaaaatgctttctgcctcgggtgatcctatcagcgtagttaaaggactgatactacttatcgatcactcacaggaactccaattgcagtcagggttgaaggccaacattgaggtgcagggcggcctggccatcgacattagtggagctatggagttttccctgtggtacagggaatcaaagacaagggtgaagaacagagtgacagtggtgatcaccacagatatcaccgtagacagcagttttgttaaagccggcctggaaacatctaccgaaaccgaagccgggctggagtttattagcaccgtacaattctctcagtatccatttctcgtgtgcatgcaaatggataaggacgaagcgccctttagacagtttgagaaaaagtacgaaaggttgtctacaggaaggggctacgtgtctcaaaaaaggaaagaaagcgtgcttgccggatgcgagttcccactgcaccaggaaaactccgaaatgtgtaaagtggtgtttgccccacaacccgattcaacatcgtctggctggttt

SEQ ID NO: 16841 - DNA, 2682 bp, Artificial Sequence
  Description of Artificial Sequence: Synthetic coding sequence
atgatccttctggctgtgctgttcctgtgtttcatcagctcctactccgcctccgtgaagggtcacactacaggcctgtcccttaataatgacagactatataagttgacttactcaaccgaggtattgcttgataggggcaagggaaaactgcaggactcagtcggctacagaattagctcaaacgttgacgtggccctgctctggagaaatcccgacggtgatgatgatcagttaatccagattaccatgaaggacgtaaacgtcgaaaacgtaaaccagcagcgcggagagaaatcaattttcaaaggaaaaagcccaagtaagattatgggtaaggagaaccttgaagccctgcagagacccacgctgcttcatctgattcacggtaaggtcaaagagttctattcctatcagaatgaagctgtggccatcgaaaacatcaagcgcgggctggcctccctctttcaaactcagctctcatccgggaccaccaacgaggtcgacattagcgggaattgtaaagtcacgtatcaggcccaccaggacaaagttatcaaaataaaagcactggatagttgcaagatcgctcgctctggctttacgacgcccaatcaggtactgggcgtctcatccaaggccacctccgtgaccacgtacaaaattgaggattcttttgtaatagctgtcctggccgaggaaacacacaatttcggcctaaatttccttcagaccattaaagggaaaattgtgtccaaacaaaagctagagctcaaaaccaccgaggcgggaccccggttgatgtcgggcaagcaggccgctgcgattatcaaggccgtcgactcgaagtataccgcaatccccatcgtgggtcaggtatttcagagtcattgcaagggatgcccaagcctgtctgagctctggagaagcacaagaaaatacttgcagcccgacaatctgagcaaagccgaggcggtgcggaactttctggcattcatacagcacctcagaacagcaaaaaaggaagagatcttacagatactgaagatggagaacaaagaggtcttaccacaattagtggacgcagtaacttcagctcagacaagcgattccctggaagccatcttggactttctggatttcaagagcgacagcagcataatcctgcaggagcgtttcctctatgcctgcgggttcgcttcgcaccctaacgaggaactgctccgggcattgatctctaaatttaaaggatctattggttctagcgacatccgggaaacagtcatgattattacaggcaccctcgtgagaaagctgtgccagaatgaaggttgtaagctgaaagctgtggtggaggccaaaaagctcatacttggcggactcgaaaaagcagagaagaaggaagatacccgcatgtatctccttgccttgaagaacgccctgttgcccgaggggattccctctctcctaaagtacgccgaagcaggcgaagggccaatcagccatctcgcaaccaccgctctgcagcgttatgacctgccattcatcactgatgaagtgaaaaagaccctgaacaggatctaccatcagaatcgtaaggtccatgagaaaacggtccgcactgccgcagctgctatcatcctaaataacaacccctcgtacatggacgtaaagaatatcttgctctcgatcggtgagctgccgcaggagatgaacaagtacatgctggcgatcgtgcaggatatactgcggttcgagatgcccgccagtaagattgtgagacgtgtgctgaaggagatggtggcccacaattacgatcgcttctcacgctcagggtctagctcagcgtacaccgggtacattgagagaagccccagaagcgcctcaacctactccctggatatattatactccggctcaggtatcctgcggaggtctaatctaaacatttttcagtacatcggcaaggctggcttgcacggctcacaagtagtaatagaggctcagggtttggaggccctgattgccgccacaccggacgagggggaagaaaatctggactcttacgccggcatgtctgccattctcttcgatgtgcaattgaggcccgtcacttttttcaacggttactccgatcttatgagcaagatgctttcagctagcggggaccctatctctgtagtgaaggggctgatcctcctgatagaccatagtcaggagctgcagctgcagagtgggctaaaggcaaacatagaggttcagggtggactggccattgacatctccggcgctatggaattttcgctgtggtacagagagagtaagacccgagtaaaaaatcgggtaactgtagtaattaccaccgatatcactgtggactcaagtttcgttaaggcagggctggagacatctacagagacagaggccgggctggagtttatctcaacggtccagtttagtcagtatccattcctggtctgcatgcagatggataaagacgaggctcctttccggcagtttgaaaagaagtacgagcgactcagtaccggcaggggctatgtgtctcaaaaacgcaaagaatcagtccttgcagggtgcgagttccctctccaccaagagaacagcgaaatgtgtaaggtggtattcgctcctcagcccgactccacgtcttcaggctggttc

SEQ ID NO: 16842 - DNA, 2682 bp, Artificial Sequence
  Description of Artificial Sequence: Synthetic coding sequence
atgatcctgctggctgtgcttttcctgtgcttcatctcaagctactctgctagcgttaaagggcacacgactggcttgtccctgaataatgatcgcctctacaagcttacctatagcactgaggtcttactggaccgagggaaaggcaagctgcaggatagcgtcgggtacaggatttccagtaacgttgatgttgctctgctttggaggaatcccgatggtgacgatgatcagctgatccaaatcaccatgaaggacgtgaatgtggagaacgtgaaccagcagcgaggcgaaaagagtatcttcaaagggaaatctccctccaagattatgggaaaggagaacttggaggctctacaaaggccgacactgctgcaccttattcatgggaaagtcaaggaattttacagttaccagaatgaggccgtggcgattgaaaatatcaaaagaggcctggccagcctgttccagacccagcttagctccggcacaaccaacgaggttgatatttctggcaattgtaaagtcacataccaggcccaccaagacaaggtaatcaagattaaggctctggattcatgtaaaattgccagatcgggattcacaacccccaaccaggttttaggagtctcgtccaaagccacgtctgtgacgacctacaaaatagaggactctttcgtaattgccgtgttggccgaagaaacgcacaacttcggactgaatttcctgcagaccattaaaggcaaaatcgtgtcgaagcagaaactggagctcaagactaccgaggctgggccccgactgatgagcggtaagcaggcggccgccataataaaggccgtggacagcaagtacactgcgattccgatcgttggacaagtgttccagagccactgtaaggggtgccctagcctgagtgaactctggcggtcaactcggaagtaccttcaaccagacaatctgagtaaagcagaggccgtccgcaactttctggcctttattcagcatcttcggacagccaagaaggaagaaatcttacagattctaaagatggagaataaagaagtgctaccgcagttggtcgacgcagtgaccagcgcccaaacctctgattctctcgaggcaatcctcgatttcctggactttaaatccgattctagtataatactccaggagcgttttctttacgcctgcggcttcgcatcacaccctaacgaggaactgcttcgggcattaatctcaaaatttaaaggcagcattgggagttccgacattcgggagaccgtgatgattatcaccgggaccttagttcgcaagctatgccaaaacgaagggtgcaaacttaaagctgtagtggaagcgaagaagctaatcctaggcggcctcgaaaaggctgagaagaaagaagataccagaatgtatctgctggccctgaaaaacgctctgcttccagagggtattccatctttactgaaatatgccgaagctggagaagggcctataagccatttggcgacgaccgctctccagagatacgacctcccctttatcaccgatgaagtgaagaagacactgaatcgcatatatcaccaaaatcgcaaggtccacgagaagacggttagaaccgctgcggccgccatcatattgaacaacaaccctagctacatggacgtcaaaaatatccttctatctataggagagttgccacaggagatgaataaatatatgttagccattgtgcaggacatactacgattcgaaatgcctgcatcaaaaattgtgcgcagagtgctgaaggaaatggtagcccacaattatgataggttctccagatctggttccagctcagcctatactgggtatattgagagaagccccaggagtgcgagcacctacagccttgacatcttatacagtggatcaggtattcttagacgatccaacctgaatatcttccagtatatagggaaggccgggctgcacggctcccaagtagtcatcgaagcccaaggcctagaagcccttatagcagctactccagacgaaggggaagagaatctcgattcttatgctggaatgagcgctatactgtttgacgttcagctcagacctgttaccttctttaatggatatagcgatctcatgagtaagatgctttccgcatcgggggatccaatcagcgtagtcaagggccttatactcctaatcgatcactcccaggagctccagcttcaatcgggtctgaaggctaatatcgaggtgcagggaggtttggcgatagacatctcaggggccatggagttctccctctggtatcgggagtccaaaacaagggtgaagaacagggtgaccgtggttatcaccaccgatatcacagtggatagcagtttcgttaaggcgggcttggagacatcaaccgaaacagaagccggcttggagtttatttctacagtccaattttctcagtacccttttctggtttgcatgcagatggataaggacgaagctccctttcgccagtttgagaaaaaatatgagagactgtcgactggcagagggtacgtgtcgcagaagcggaaagagagcgttctggccggctgcgagttccctctgcatcaggagaattcagagatgtgcaaggttgtgtttgcgccacagcctgatagcacctcttcaggttggttc

SEQ ID NO: 16843 - DNA, 2682 bp, Artificial Sequence
  Description of Artificial Sequence: Synthetic coding sequence
atgattttactggcggtgctctttctgtgctttatctcttcctactcagcctcggtcaagggccataccaccggactctcgttgaacaacgataggttgtacaagctgacatactccacagaggtactcctggacagaggcaaaggaaaactgcaagactcggtggggtacagaattagctccaatgttgatgtggctctgctgtggcgaaacccagatggcgacgatgatcagttgatccagataaccatgaaagacgtcaacgttgagaacgtcaaccagcagaggggcgagaagagtatctttaagggaaagtcacctagcaaaatcatgggcaaggagaatctggaagctctgcaacgcccaaccctgttacatttgattcatggcaaggtaaaagaattctacagctaccagaacgaagcagtcgccattgaaaacattaaacgtggcctggctagcttgttccagacccaactgtcaagtggcactactaacgaggtggatatatcaggcaactgcaaggtgacctatcaggcgcaccaggacaaagtcattaagatcaaagcactggacagttgcaaaatcgccaggagtggttttactacccccaaccaagtccttggagtttcttctaaagcaacttcagttaccacgtataagattgaagactccttcgttatcgccgttcttgctgaagaaactcacaattttggactgaacttcctgcaaactatcaagggtaagattgtgtcgaagcagaaactggagctgaagacaaccgaagccggcccccggctgatgtctgggaagcaggcagcggcgatcatcaaggctgtggattctaagtacactgcaatccctatcgtgggccaggttttccaatctcattgcaaaggatgcccttccctgagcgaactgtggcgcagcacacgaaagtaccttcaacccgacaacctgtctaaagcagaagccgtccgcaacttcctcgcattcatacagcacctgaggaccgccaagaaggaggagattctccagattttgaagatggagaacaaagaggtcctccctcagctcgtcgatgctgtgactagcgcgcaaactagtgacagtttagaggccatcctggactttctcgattttaagtctgatagctcaatcatcctgcaagagaggtttctttacgcttgcgggttcgcaagccatcctaacgaggaactcctccgggctctgatctccaagttcaagggatcaattggatcgtctgatatccgagagacagtgatgattataacagggacactggtaaggaagctgtgccagaacgaagggtgcaaactgaaagcagtggtagaagcgaagaaactgattttgggcggactcgagaaagctgagaagaaagaggacacaagaatgtacctgcttgctttaaagaacgcacttctcccggagggcataccttcattactgaagtatgcggaggcaggagagggccccatcagccaccttgcaactaccgctctccagcggtatgatctgcctttcattaccgacgaggtgaagaaaaccctgaataggatctatcatcagaaccgcaaggtccatgaaaagacagtaagaaccgctgcagctgcaattatcctgaacaacaacccatcttacatggacgtgaaaaatatcctcctttctatcggggaactgcctcaggagatgaataaatatatgctggcgatcgtgcaagatattctccgtttcgagatgcctgcttcaaaaatcgtcaggagggtgcttaaagagatggtggcccataactacgacaggttctctcggtctggatctagttcagcctacaccgggtacatcgagagatcaccccggtctgcctctacatacagcctggacatcctttactctggtagcggaattctgcgcaggagcaacctcaacattttccagtacattgggaaggctggactgcacggctctcaagtcgtcatcgaggcacagggcttggaagctctgatcgctgccacccctgatgagggggaagaaaaccttgatagctacgccggaatgtctgcgattctgtttgatgtccagctccgccccgtgacgttctttaacggatattcagatctgatgtctaaaatgctgtccgccagcggagatccaattagcgtagtgaaaggcctgatcctgctgatcgatcactctcaggaactgcaacttcagtctggactgaaggccaatatagaagtccagggcggcctggccattgacattagtggagctatggagtttagcctgtggtatcgagagagtaaaacaagggttaagaacagggtcaccgtggtgataaccactgatattaccgttgattcatcgttcgtgaaagccggacttgagaccagtacagaaactgaagcgggactggaattcatctcaacagtgcagttctcacagtacccatttttggtatgcatgcagatggacaaagatgaggcccctttcagacagtttgaaaaaaaatacgaaagactgagcaccgggcgagggtacgtgagccaaaagcggaaagagtccgtcctcgcaggctgcgaattcccccttcatcaggaaaatagcgagatgtgcaaagtggtcttcgcacctcaacccgattctacatccagtggttggttc

SEQ ID NO: 16844 - DNA, 2682 bp, Artificial Sequence
  Description of Artificial Sequence: Synthetic coding sequence
atgatcctactggccgtgctgttcctatgcttcatctcatcatattcagctagcgtgaagggtcataccaccggcctttcactgaacaatgaccgtctttataagttgacttactccactgaggttctcctcgatcgcgggaagggcaaactgcaggattccgtgggctatagaatatcaagtaatgttgatgttgcactcctttggagaaacccagatggagatgacgatcagctgatccagattacaatgaaggacgttaacgtagagaatgtgaatcagcagcgcggagagaaaagcatttttaagggaaagtccccgtctaagataatgggcaaggagaacttggaagcgctgcagcgccctaccctgttacacctaattcacggtaaggtaaaggagttttatagctatcaaaacgaagcggtagccatcgagaatatcaaaagaggtctcgcttccctgttccagacccagctgtcctcagggactactaacgaagtcgacattagcggcaattgcaaagtgacttaccaggcccatcaggacaaagttattaagatcaaggctctcgatagttgcaagattgcgcggtcgggattcacgacacccaaccaggtgctaggagtctcttctaaagccacttctgtgacaacctacaaaatcgaggatagttttgtgatcgcagttctcgcagaggaaacacacaacttcggcctcaactttttgcagacgatcaagggaaagatcgtttcgaaacagaagctggagctgaagacaaccgaagccggtccccggctgatgtccggcaaacaggccgcagccatcataaaagctgttgactcaaagtataccgcgattccaatagtaggccaagtattccagagtcattgcaagggctgccccagcctttctgagttgtggcggtctactcgcaagtacctccagcccgacaatctgagcaaggccgaagccgtaagaaacttcctggccttcatccagcacctgcggactgccaagaaggaggagatactccagattttgaagatggaaaacaaagaggtgcttcctcagcttgtcgacgccgtgactagcgcccaaacatcagactccttggaggcaatactggacttcttagacttcaaatcagactcctcgattattttacaagagaggttcctctacgcgtgtggctttgcctcgcatcccaacgaggagttactccgtgctttgatctcgaaattcaaggggagtattggatcaagtgatattcgagagaccgtgatgattatcaccggtacactcgtaaggaaactgtgccagaatgaggggtgcaaacttaaagcggtggtggaggcaaagaaactgattctcggcggactggagaaagctgaaaagaaggaggacacacggatgtatcttctggccctcaaaaacgcactcctcccagaggggataccctctctcttaaagtacgcggaagctggcgagggcccaatctcacatctcgcaaccactgccctccagcggtacgacctgccttttataactgacgaagtgaaaaaaacattgaatcgcatctaccaccagaaccggaaggtgcatgagaagaccgttagaaccgcggcagctgccattattttgaacaacaacccctcttacatggacgtcaaaaacatcctcctatccattggagaacttcctcaggagatgaacaagtacatgttggctatcgtccaggacattctgcggtttgagatgcccgcttccaaaattgtgaggagagttctgaaggagatggtagctcacaattacgatcgattctcacgttcaggctcgagttctgcctacacgggctacatcgaacggagtccccgaagtgcctcaacctattctctggatattctgtattcagggtctggaattctgaggagaagcaacttgaacatctttcaatacattgggaaagcaggcctccatggttcacaggtggtaattgaggctcagggcctggaggcgcttattgcggcgactccagacgagggcgaggaaaatctggactcctatgctggtatgagcgctattctgtttgatgtgcagctacgccccgttacatttttcaatggatatagcgacctcatgtccaagatgctgtccgcctccggcgacccaattagtgtcgttaaggggctgattctcttgattgaccatagtcaagaattgcagctacaatctggcctgaaggcgaacatcgaagtacaaggcggactggcaatcgacatctcgggcgccatggagttttccctgtggtaccgcgaaagcaagacgcgagtgaagaatagagtgaccgtcgtgatcacaactgacattactgttgacagctcctttgtaaaggcgggtctggaaaccagtactgagaccgaggccggcctggaatttatttccacagtacagttctcgcagtacccattcctggtgtgcatgcagatggacaaagacgaggcgccattccgccaattcgagaagaagtatgagaggcttagcactggtcggggatatgtgtcacagaagcggaaggagagtgtactggctggctgcgaattcccactgcaccaggaaaactctgaaatgtgtaaggttgtattcgcaccccagcctgattccaccagcagtggctggttc

SEQ ID NO: 16845 - DNA, 2682 bp, Artificial Sequence
  Description of Artificial Sequence: Synthetic coding sequence
atgatactgttagcagtgttatttctttgcttcatatcatcatattccgcaagtgttaagggacacacgaccggattatctctcaacaacgaccggttgtacaagctgacatactcaacagaagtcctgctggacaggggcaaaggaaagctgcaagattcggtcggctaccgcatcagcagcaatgtagatgtggccctcctctggagaaaccccgatggggacgacgaccagctcatacagattactatgaaagatgtgaatgtagaaaacgtgaaccagcaacgcggggagaaaagtattttcaagggcaagagtccaagtaagataatgggcaaggagaacctggaggctctacagcgtcctaccctgctccacctcattcatggaaaggtaaaagagttttacagctaccagaatgaggcagtagccatagagaatatcaagagaggtcttgcttctctattccagacccagctcagtagcggcacgaccaatgaagtagatatttccggaaactgtaaagtgacctaccaggctcatcaggacaaagtaattaagatcaaggctctcgactcctgtaagatcgctaggtctggttttacgacacccaatcaagttctaggtgtcagcagtaaggctacatctgttaccacatacaagattgaggattccttcgtgatagccgtcctggcagaagaaacgcacaatttcggcttgaactttctgcagacaattaaggggaaaatcgtgtccaaacagaaactcgagctgaagaccacagaagctgggcctcgcttgatgtccggaaagcaggcggctgcaattataaaggcggtagactccaaatacaccgctataccgatagtgggccaggtgttccaaagccactgcaagggttgccccagcctgagtgagctctggaggagcacccgaaaatatctgcagccggacaacctctctaaagctgaggccgttaggaattttctcgccttcatccaacatctccgaacagcaaaaaaggaagaaattttgcagatccttaagatggaaaataaagaagtgctgccacaactcgtcgacgccgtaactagtgcacaaacctccgactcactggaggcaatcctggacttcctggacttcaagtctgactcctccatcatcctgcaggagcggttcctttatgcctgtggatttgccagccaccccaacgaagaactgctgcgagcgttaatcagcaaattcaaaggttccatcggcagctccgatattcgggaaaccgtgatgattatcactgggaccctcgtcagaaagctttgccagaacgaagggtgtaaattgaaggctgttgtcgaagcaaaaaagctgatccttgggggactcgagaaggcagagaagaaagaggatactcgaatgtaccttctcgctctcaaaaacgcccttcttccggaaggtatcccttcattgttgaagtatgccgaagcaggggagggcccaatttctcatctcgccactaccgcgctgcaacgatacgatctcccattcatcacagatgaggtgaagaagacactgaataggatctaccatcagaatcgtaaagtgcatgagaagactgtgcgcaccgcggccgccgccataatccttaacaataaccctagttacatggatgtgaagaacatcttgctctccatcggcgaactgccccaggaaatgaacaagtatatgctggccatcgtgcaggatattctaaggtttgagatgcctgcctcaaagatcgtgcgaagggtgttgaaggagatggtggcccataactatgaccgattctccaggagtggcagctcctccgcatacaccggttacatcgaacgcagtcctcgatctgctagtacgtactcccttgacattttatattccgggtcagggatcttgaggaggtccaacctgaacatcttccagtatatcggcaaggcaggactccacggatctcaggtggtgattgaggcccaaggccttgaggccctgatagcagccacaccagatgagggggaggagaacctggatagttacgccggcatgagcgccatcctattcgacgttcaactacgaccggtaaccttcttcaatgggtattctgatctgatgtcaaaaatgttgtccgcctctggcgatccgatcagtgttgtcaaaggtttgatacttctgattgatcattcccaggagctgcagttgcagtctgggctgaaagcgaatattgaggtacaggggggattggctattgatatatccggagctatggagttttccctctggtatcgggaaagtaagaccagagttaagaatcgcgtgaccgtcgtgattactaccgacataacagtagattcttcttttgtcaaggccgggttggaaactagtaccgaaacagaagcagggttagagttcattagcaccgttcagttttctcagtacccttttttggtgtgtatgcagatggataaggacgaggcgccttttagacagttcgagaaaaaatacgaacggcttagcactggcagaggttacgtgtcccaaaagagaaaggaaagtgtcctagccggctgtgagtttcccctgcaccaggagaacagtgaaatgtgcaaggtcgtcttcgcgccccagcccgactccacatccagtggctggttt

SEQ ID NO: 16846 - DNA, 2682 bp, Artificial Sequence
  Description of Artificial Sequence: Synthetic coding sequence
atgatcctcttagcagtgctgtttctgtgcttcatctcgtcctactcagcaagcgttaaggggcacaccaccggcttgagcctgaataatgacagactttacaaactcacatattctaccgaagtccttctcgacaggggaaaaggcaagttacaggatagcgttggctaccgtatatctagtaatgtggatgtggctctcctatggaggaaccccgacggagacgacgaccagctgatccaaataacgatgaaagacgtcaacgttgagaacgtaaaccaacagaggggagaaaaatccatttttaagggtaagagccccagtaagatcatgggaaaagaaaatctggaggcattgcaaagacctaccctgctacacctgatacacggtaaagtcaaagaattttacagctaccagaacgaggctgtggcaattgaaaatattaagcgtgggctcgcctccttgtttcagactcagctttcctctggaactacgaacgaagtagatatatcagggaactgcaaagttacatatcaggcccaccaggacaaggtcatcaaaatcaaggctttggactcttgtaagatagcgcgttcgggcttcacaacaccaaatcaggtgctaggtgtctcctccaaggccacatccgttaccacgtataagattgaggattcctttgtcatagccgtactggctgaagaaacccataacttcggcttaaattttctacaaacgatcaagggaaaaatcgtgtctaagcagaaacttgaactcaagactaccgaggcaggaccacgcctgatgagtggcaaacaagcggcagctataattaaagcagtcgattcgaagtatacagcaatccccatcgtaggccaggtgttccagtctcattgcaaaggctgtcccagcctgtctgaactgtggagatctacccggaaatatcttcagcctgacaacctatccaaggcggaggcagtaagaaacttcctggcttttatccaacacctgaggacagcaaagaaagaggagattctgcagatcctaaaaatggagaataaggaagtgctgccacagctggtggacgctgtgacaagtgctcagacctccgatagcttggaggcgattttggattttctggatttcaaaagcgattcttctataatactgcaggagcgctttctgtacgcctgtggcttcgccagccatcccaacgaagaactcctcagagcgctgatttccaaatttaagggatctattggctcatccgatatcagagagacagtaatgattataacgggtaccctggttcggaaactttgtcagaacgagggctgtaaactcaaagcggtcgtggaagctaagaaactgattctcggcggcctggaaaaggccgaaaagaaggaagacactcgcatgtatctgctggcactgaaaaatgcgctcctgccggaagggattccctctctcttgaaatacgcggaagcaggcgaaggcccaatcagccacctagccacgactgccttacagagatacgacttgccatttattacggacgaggtgaagaaaacgttaaatcgcatctatcaccagaacaggaaagttcacgaaaagaccgtgcgtaccgctgcagcggcgattatattgaataataacccgtcttatatggacgttaagaacatcctgttaagcatcggagagttgccccaggagatgaacaaatatatgttagcaatagtgcaggatatccttcggttcgaaatgccagcctctaagatcgtgagacgggtcctcaaggagatggtggcccataattacgaccgattctccagatctggtagttcttcggcatacaccggatatatcgaacgctcccctaggagcgcaagcacctactctttagatatcctctactcggggagcggaattctgcgccgcagcaacctcaatatctttcagtatataggcaaagctggtttacacgggtctcaggtcgtgatagaggcacaggggctggaagcgctgattgcagccacaccagacgagggcgaggaaaacctggatagttacgcgggcatgagcgccattctgttcgatgtgcagctgcgccctgtaacgttcttcaatgggtacagcgacctgatgagcaaaatgctgagcgcatccggcgacccaatctctgttgtcaaagggctgatcctactgattgatcacagccaggaactacagttgcagtctggcctcaaagctaacattgaggtccagggaggactcgctatcgacatttccggcgcaatggagttctcgctatggtatagggagtctaagacaagggtgaaaaatcgtgtcaccgtcgtgattactacagatatcacggttgactcctcttttgtgaaagctgggcttgaaaccagtaccgagaccgaagctggcctggagtttatctccactgtacaatttagccagtacccgttcttggtctgcatgcagatggataaggacgaggccccttttaggcaatttgagaaaaagtacgagagactctctacaggacgcgggtacgtgtcacagaagcgcaaggagtccgtgctggccggctgcgaatttccactgcatcaagagaattcggaaatgtgcaaggtggtcttcgccccacagccagactccacaagtagtggctggttc

SEQ ID NO: 16847 - DNA, 2682 bp, Artificial Sequence
  Description of Artificial Sequence: Synthetic coding sequence
atgatccttttggccgtgctctttctctgcttcatcagcagctactccgctagcgtgaaaggccacactactggtctgtccctgaacaacgaccggctgtataagctgacatattccaccgaagtgctgctggacaggggcaagggaaagctgcaggattccgtggggtatcgtatatctagcaatgtggatgtggccctgctgtggagaaaccctgacggcgatgatgaccagctcatacaaatcactatgaaagacgtgaatgtcgagaatgtgaaccagcagagaggggaaaagagtattttcaagggtaaaagcccatccaagattatgggcaaggagaatctggaggccctgcagcggcccactttactgcacctaattcacggcaaggtgaaggagttctacagttaccagaatgaagccgtggccatagagaatattaaacgcggactggccagcctttttcagactcagctgtctagcggaaccactaacgaagttgacatatctggcaattgtaaggttacataccaggcacaccaggacaaggtgatcaagattaaagcactggacagttgcaagattgcccgatcaggctttaccacccccaaccaggtattaggggtgtcctctaaggccacatccgtgaccacctacaaaatagaggatagcttcgtgatcgcagttctggctgaggaaactcacaactttggcctgaatttcctgcagacaataaaaggtaaaatcgtatcaaaacagaagctcgagctgaagaccactgaggctggtcctcgtttaatgagcgggaaacaggccgccgccattattaaggctgtggactctaaatacacagccatacccattgtgggacaggttttccagagtcactgtaagggctgtccaagtcttagcgagctgtggaggtctactaggaaatatctgcaacccgataacctatcaaaagccgaggcagtgcgtaacttcttagcattcatccaacatctaaggaccgccaaaaaagaggagatcctccagattctaaagatggaaaataaagaagtactgccccagctagtggatgccgtgacctctgctcagacctccgattccttggaagccattcttgactttctggactttaaatcagactcaagcataatactgcaagaacgatttttatatgcatgtggcttcgcatctcatcctaacgaagagcttttacgggctctcatttctaagttcaagggcagtataggaagtagcgacatcagagaaactgtcatgatcattaccggcaccctggtgcgtaagctgtgtcagaatgagggctgtaagctgaaagcagtcgtggaggcaaagaaactgatcctgggcgggcttgagaaggctgaaaaaaaggaggacacccggatgtacttattagccctgaaaaatgccctactgccagagggaatcccaagcctgctaaaatacgccgaggcaggggaaggtcctataagtcatcttgccacaactgcactgcagcgttatgacctgccattcatcaccgacgaagtgaagaagactctgaataggatataccaccagaatcggaaagtgcacgagaaaaccgttcgcaccgcagctgctgctatcatcctcaataataatccttcttacatggatgtgaaaaatatacttctgagcataggtgagctgccccaggagatgaacaagtatatgctcgccatcgtacaagatattctccggtttgagatgccagcttctaagatagtgagaagagttttgaaagaaatggtcgcccataattacgaccggttctctagatcagggtcttctagcgcctataccggctacatagagaggagcccacggtctgcttctacctactcactcgacatcctatactccggaagtggcattttacggcgcagcaacttaaacattttccagtatataggaaaggccggcctacatggcagccaggtcgtgattgaagctcagggcctcgaggccctcattgctgctaccccggacgaaggagaggagaacctggattcctatgcaggaatgagcgcaatcctgtttgacgtgcagctgcggccagtcacattcttcaatggatattccgatctgatgagtaagatgctgagtgcttctggagatcctatttccgtggtgaagggcctcatcctcctcattgatcacagtcaagagttacagctgcagagtggattaaaagctaacatcgaagtccagggcggccttgccatagatatctctggtgcaatggagttctctctatggtatcgcgaaagtaagacacgggtcaaaaatcgggtcaccgttgtgataaccactgatatcactgtggacagctcctttgttaaagcaggcttagaaacttccactgagaccgaagccgggctagaatttataagtactgttcagttctcccaatacccatttctggtctgcatgcagatggataaagatgaggcccccttccggcaattcgagaagaagtacgagcgtttgagcaccggccgcggctatgtctctcaaaaaaggaaggaatccgtgctcgctggttgtgaatttccactgcaccaggaaaatagcgagatgtgcaaggtggtgttcgcaccccagccagacagtactagttctggatggttt

SEQ ID NO: 16848 - DNA, 2682 bp, Artificial Sequence
  Description of Artificial Sequence: Synthetic coding sequence
atgatcctgctcgcagtcctcttcctctgtttcatcagttcctatagtgcctctgtaaagggacacactacaggactctccctcaataatgatcggttatacaaactgacatattcaactgaggttctcctcgatcgcgggaaagggaaattgcaggatagtgtggggtaccgaatttcttctaacgtagatgtggcattgctttggcggaatcctgacggggatgatgatcagcttatccagatcactatgaaagatgtcaatgttgagaatgtgaatcagcagcgaggagaaaaatctatatttaaagggaagagtccatcaaagatcatgggaaaagaaaaccttgaagctcttcagcggcctactttactgcatctgatacacggaaaagtgaaggaattctacagttatcagaacgaggccgtggccatcgaaaacattaaaaggggactagcctctctcttccagacacagttatcctctgggactactaacgaagtggatatatcagggaactgtaaagtgacttatcaagcccaccaggataaagttattaagatcaaagccttagattcgtgcaaaatcgcacgctctgggtttacaacaccaaatcaggtactgggggtaagttctaaagcaacatctgtgacaacgtataaaatcgaagattcttttgttatagctgtattagctgaagaaactcacaatttcgggctcaatttcctccagacaatcaaaggaaaaattgtttctaaacagaaactcgaactaaaaactacagaggccggaccccgattgatgagtgggaagcaagccgctgctattattaaagccgtggatagtaaatatacagctataccaatagtagggcaggttttccaatcccactgtaaagggtgtccatctctctctgagctttggaggtctactagaaaatatctgcagcccgataacctgtccaaagccgaagctgtgagaaattttctcgccttcatacagcacctgagaacagctaaaaaagaagaaatactccagatcctcaaaatggaaaacaaggaagtactcccacagctggtagatgccgttacatcagcccagactagtgattccctcgaagcgatactcgatttcctcgatttcaaatccgattcaagtatcatactgcaggagcggttcctctacgcatgcgggtttgcatcccaccccaacgaagaattgctacgagctctcatctcaaaattcaaagggtctatcggatccagtgatatacgcgaaactgtgatgatcataacagggactttagtgcggaaactctgtcaaaatgaaggatgtaaactgaaggccgtcgtggaagccaaaaagctaattctcggggggttggagaaagccgaaaaaaaagaagatactcggatgtatctacttgccctaaagaacgctctcctcccagaagggatcccaagtctgctgaaatacgccgaagcaggagaagggccaatcagtcatctggctactacagcattgcagaggtatgatctcccctttattactgatgaggtgaagaaaactcttaaccggatataccaccaaaaccgcaaagtgcacgaaaagacagtgagaacagcagccgccgctatcatcctcaataataatcccagttatatggatgtcaaaaatatacttttgagtatcggggaactgccccaggaaatgaacaaatacatgttagcgatcgtccaggatatccttcggttcgaaatgcccgcatcaaaaatagtgagaagagttctaaaagaaatggttgcacataactatgatcgattttcccggtctgggtcttcatctgcctatactgggtacattgaacgctcaccaagatcggccagtacttactctcttgacatcctctattctgggagtggaatactcaggaggtctaacctgaatatctttcagtatatagggaaggccggactgcacggatcccaggtggtcatcgaagctcaggggcttgaagccctcatagccgcaactccagacgaaggagaagaaaatctagactcatacgctgggatgagtgctatcctctttgatgttcagctccgccctgtaacttttttcaatggatattcggatctaatgtccaagatgctctcagcatcaggagatcccatcagtgtcgtgaaagggcttatcctgctgattgaccacagtcaggaactgcagctccagtctggacttaaagctaatattgaagttcaggggggattggcaattgacatatcaggggccatggaattcagtttgtggtaccgggagtctaaaactagggtaaaaaatcgggtgacagtcgtcatcacaacagatatcactgtggattcatctttcgtgaaagctggactcgaaacttccactgaaacagaagccggactcgaattcatatccactgtacagttttcacagtatcccttccttgtgtgtatgcagatggataaagatgaagcccctttccggcagtttgaaaagaaatacgaaaggttatctacagggcggggatacgttagtcagaaacgcaaagaatcagtactcgccgggtgtgagttccccctccaccaggaaaacagtgaaatgtgcaaggtagtctttgccccccagcccgattcgacaagttctgggtggttc

SEQ ID NO: 16849 - DNA, 2682 bp, Artificial Sequence
  Description of Artificial Sequence: Synthetic coding sequence
atgatactcctggcggttcttttcctgtgcttcatctcatcttactccgccagcgtcaaaggccacacgactggattaagtcttaataatgacagactctataagctcacctattcaactgaggtcctgctggacagaggtaagggcaaactgcaggattccgtgggctataggatcagctctaacgtcgatgtggctcttctgtggcgtaacccagatggcgatgacgaccagctaatccagatcaccatgaaagatgtcaatgtcgagaacgtcaatcagcagcgcggggaaaagagtatctttaagggaaaatcgcccagcaaaatcatggggaaagagaatcttgaggccctgcagagacctaccttgctgcatcttatccatggaaaagtgaaggagttttacagttatcagaacgaggccgtcgcaattgagaacataaaacgtgggctcgcatctctatttcagacgcaactaagtagcgggaccacgaacgaagtcgacataagcgggaactgcaaggtaacatatcaggcacaccaagataaagtcataaagatcaaagccttggattcatgcaaaattgcccgctccggctttactacccctaaccaggtgctgggggtgagctcaaaagcaacctctgtgactacatacaagattgaggactctttcgtgattgcagtcttggcagaggaaacacacaactttggactcaactttctccagactattaagggcaaaatcgtgagtaagcaaaagctggagctcaagactaccgaggccggcccgcgcctgatgagcggaaagcaggctgctgctatcatcaaagccgttgacagtaagtatactgcaatccctatagtggggcaggtgtttcagtcgcactgcaaaggctgcccgtcactgtcagaattatggcgatcaacacggaagtatctccagccggataatttgtcaaaggctgaagctgtgcgtaattttctcgcgttcatccagcacctgcgaaccgcaaagaaagaggagattctgcagatcttaaagatggagaacaaagaagtgttgcctcagctcgtcgacgccgtgactagtgcacagacttcagacagcctggaagcgatcctagatttcctcgattttaagagcgactcctctattattctacaggaacgatttctgtacgcttgcggctttgcctcccaccccaatgaagaactgctgcgcgctctcatatccaaattcaaaggatccattggctcatctgatattcgagagactgtgatgattatcacgggaaccctcgtgcgcaaattatgccagaacgaaggatgcaaactgaaggctgtcgtggaggccaaaaagttgattctcggcggactggagaaggccgaaaagaaagaggacaccagaatgtatctgctggctttaaaaaatgcactgttaccagaaggaattccgtcgctgctgaagtatgctgaagccggagaaggccccatcagtcacctggccacaactgctctccagcggtatgatctcccatttatcaccgacgaggtgaaaaagacattaaaccgtatctatcaccaaaacaggaaagtccacgagaaaaccgtgagaactgctgcagctgctatcattctgaacaacaacccttcttacatggacgtgaagaacattttgctcagcatcggggagctgccccaggaaatgaataagtatatgctggccatcgtacaggacatactaaggttcgaaatgccagctagcaagatcgtacgtagggtgctaaaggaaatggtagctcataattatgatcggttctccaggagtggttcgagctctgcatatactggttacatagaaaggagccctagaagcgccagcacctactcacttgatatcctgtatagtggttctggcatccttaggagatctaatttaaacattttccaatatattggtaaagctggcttgcatgggtctcaggtggtgatcgaagcacagggactcgaagctctcatagcagctacaccagacgagggagaggagaatctggattcgtacgcggggatgtcagctattttgttcgatgtccagctcaggccagtcacctttttcaacggttattccgaccttatgtcgaagatgttgagtgctagcggcgacccaatttctgttgtcaaaggactgatactgttaatagatcacagccaggagttgcaactccagtctgggctcaaggctaacatcgaagtccagggaggtctggccatcgatatatctggggccatggaattctcactgtggtatcgtgagagcaagacgcgggtgaaaaatcgggtcaccgtggtgatcactacagatataactgtcgactccagcttcgtgaaggctggactcgagacttccaccgagactgaggccgggctggaatttatctctactgttcagttctcccagtatccatttttggtatgtatgcagatggacaaggacgaggccccattccgccagttcgaaaagaagtacgaacgcctttctactggaagggggtatgtctcccagaaacgaaaggaaagcgtgctcgctgggtgtgaatttcctctgcaccaggagaattccgagatgtgtaaggtagtgtttgctcctcagcccgattcaacctcatcaggctggttc

SEQ ID NO: 16850 - DNA, 2682 bp, Artificial Sequence
  Description of Artificial Sequence: Synthetic coding sequence
atgatcctgcttgccgtgctattcctctgtttcatttcatcctatagtgccagcgtcaagggtcataccaccggactgtctctcaacaacgatcgattatacaaactcacatacagcactgaggtgttgttggacagaggcaagggcaagcttcaggatagtgtgggctatcgtatctctagcaatgtggatgtagccctcctatggcgtaaccccgatggcgatgacgatcagctgattcagatcacgatgaaagatgtaaacgtggagaatgtaaatcagcagcggggtgagaaatcaatatttaaaggcaaatccccatctaaaattatgggtaaggagaatctagaagcactgcagaggcctactctgttacacctgattcatggaaaagtgaaagaattctacagctatcagaacgaagctgtagctatagagaacatcaaaagggggctggcctctctgttccagacccagctaagctcaggcactacaaacgaggtcgacatcagtgggaactgcaaagtgacctaccaggcccaccaggacaaggtgattaaaatcaaggcacttgactcttgtaagatcgcaaggtctggcttcaccactcctaatcaggtcctgggcgtctctagtaaggccaccagcgtcacaacatacaaaatcgaggactcttttgtgatcgccgtgttggcagaggaaacacataactttggtctcaattttttgcagacaattaagggcaagattgtcagcaagcaaaaactggagctcaagaccaccgaggccggaccacggctgatgtctgggaagcaggcggctgctattatcaaagctgtggattccaagtacaccgccattccgatcgtgggccaggtcttccagtctcattgtaagggctgtcctagcctgtccgaactgtggcgttcgaccagaaagtacctgcaaccggataacttaagcaaggcagaagcagttagaaattttcttgcatttattcagcacctgagaacggccaaaaaagaggaaatcttgcagattcttaaaatggagaataaagaagtactcccccaactagtcgatgccgtgactagcgctcaaaccagtgacagtctggaagcaatcctcgactttctggacttcaaatctgacagtagcatcatcctccaggagcgcttcctttacgcttgtgggttcgcctcccatcccaatgaagaactcctgcgggcgcttatcagcaaattcaaggggtctatcggctcctccgacattcgggagactgtgatgattataaccggcactcttgtgcgaaaactgtgccagaacgaggggtgcaagcttaaggccgtcgtggaggcaaaaaagcttatcctcggcgggctagaaaaggcagagaaaaaagaagatacccgtatgtatctcctagctctcaaaaatgctctgctgccagagggcatacccagcctgcttaagtatgctgaagccggagaagggcccatcagccatctcgccacgacggcgctccaacggtatgacctgccattcatcaccgatgaagtcaagaagacactgaaccggatctatcaccagaatcgcaaggtgcatgagaagacagtgcgaacggccgctgccgcgattatcttaaacaataaccccagctatatggacgttaagaacatactgctgtctatcggggaacttccccaggagatgaataagtatatgctggccatcgttcaggatattctccgctttgagatgccagctagtaaaatcgtgaggcgggtgctgaaagagatggtggcacacaactacgatcgattctcccgtagcggctcttcttctgcgtataccggttacattgagcgctcaccacggtcagctagcacttactcgctcgacatcctgtattcaggtagtggaatactgcgacgctccaacctcaacatttttcagtacatcgggaaggcaggcctgcacgggtcccaagtggtgattgaagcacagggactcgaggcactgatcgccgcgactccagatgaaggtgaggaaaacctagactcctacgcaggcatgagtgcaattctcttcgatgtccaactgaggcctgtcacgttcttcaacggttattctgacctgatgtcgaaaatgttgtccgcgtccggcgacccaatttctgtggtcaagggcctcatccttctgatcgaccactctcaggagctgcagctgcagagcggcctgaaggcgaatatcgaggtgcaggggggactagccattgacatcagcggcgccatggagttttcactatggtaccgagaatcaaagacaagagtcaaaaatcgggttacggtggtgatcacaacggatattacagtggactcgtcttttgtaaaagccggcctggaaacaagtaccgagacagaagctggcctggagtttatcagcactgtgcagttctcacagtacccctttctggtttgtatgcagatggacaaggatgaagccccttttcgccagttcgagaaaaaatacgaaagattgtctaccggccgcggatatgtcagccagaaacgcaaggagtcagtactggcgggctgtgagtttcccctccatcaagagaacagtgagatgtgcaaggtcgttttcgcacctcagccggactccacatcttccggctggttc

SEQ ID NO: 16851 - DNA, 2682 bp, Artificial Sequence
  Description of Artificial Sequence: Synthetic coding sequence
atgatactcctggccgtcttgttcctctgcttcatcagttcttattctgcctcagttaagggtcacacaacaggcctctcacttaacaacgacagactgtacaagctgacttatagcaccgaggtgttgctcgacagaggcaaaggtaaactgcaggactctgtcggatacaggatcagtagtaacgtcgacgtggctctgctctggaggaaccctgatggtgacgacgaccagcttattcagatcactatgaaggatgtcaacgtcgagaacgtaaaccagcagcgcggtgagaaaagcatctttaagggaaaatctcctagtaaaataatgggtaaggagaatctggaggcactgcagagacctaccttgctccacttgatccatggtaaggtaaaagaattctactcctaccagaacgaagccgtagctattgaaaatatcaagaggggactcgcctccctgttccaaacccagctcagttctggaaccactaacgaggtagacatctcaggcaattgtaaggtgacataccaagctcaccaggataaggtgatcaaaatcaaggcactggatagctgtaaaattgctaggtccggcttcactactcctaatcaggtattgggagtttccagcaaggccacctcagtgactacttacaagattgaagactcttttgttatcgctgttcttgctgaggagacccataacttcggactgaacttccttcaaactatcaagggtaaaatcgtgtcaaagcaaaagctggagcttaagacaaccgaggctggacctcgcctcatgagtggtaagcaggctgcagcgatcatcaaggccgtggacagcaagtatacagctattccaatagtcggtcaagttttccagtcccattgtaagggttgcccaagcctgtctgagctgtggagatcaacaagaaagtacttgcagcccgacaacctttccaaggccgaagccgtgaggaatttccttgctttcatccagcacttgcgcaccgccaaaaaggaggaaatcctccaaatcttgaagatggagaacaaggaggtcctgccgcagttggtggatgcagtgacctctgcccagacgtctgattccttggaagctattcttgactttttggacttcaagagcgatagtagtattatcctgcaggagcgcttcctgtacgcctgcggtttcgcctcacatcctaacgaggaattgttgagagcccttatcagtaagttcaagggttcaattggctccagcgacatccgcgaaaccgtgatgatcatcacaggtacattggtgcgcaaactctgtcagaacgaaggatgcaagttgaaggcagtcgtcgaggcaaagaaactgatcttgggaggccttgaaaaggccgaaaaaaaggaagacaccaggatgtaccttttggccctgaaaaacgccctcctgcctgaaggaatccctagtctgcttaagtatgcggaagctggcgaaggccctatctctcatctggcaaccaccgctttgcagagatatgacctgccatttatcaccgatgaagtcaagaagacgctgaatcgcatataccaccaaaatagaaaagtgcacgaaaagacagtgcgcacagctgctgcggctattatcctcaacaataacccttcctacatggacgtaaagaacatcctgctcagcatcggcgagctgccacaagagatgaacaagtatatgcttgcaattgtgcaggacattctgaggttcgagatgccagcctccaagatcgtgagaagagtgctcaaggagatggtcgcgcacaactatgacaggttttcaaggtctggttcatcttcagcctacaccggttatatcgagaggtcccccagatcagcatcaacttacagcttggacattctgtactccggttctggtatcctgcgccgctcaaacctgaacatctttcagtacatcggcaaagcaggcctgcacggttcacaagtggtgattgaggcacagggcctggaggcgctgatcgcagctacccctgatgagggtgaagaaaacctcgatagctacgccggaatgtccgccatcctgtttgatgttcagctgcgcccggtgacattcttcaatggatacagcgacctgatgtctaagatgctctccgctagtggagaccctatcagcgtggtgaaaggactgatcctcttgattgatcactctcaggaactgcagctccaatcaggccttaaggcgaatatcgaggtccagggcggtttggcaatcgatatcagtggagctatggaattcagcctgtggtacagggagtccaagacccgcgtcaaaaacagggttaccgtcgtgattacgacagacatcacagtcgactccagcttcgtaaaagcaggcctcgaaactagtaccgaaacagaagctggcctggaatttatttcaacagttcagttcagccaatacccgtttctcgtatgtatgcagatggataaggacgaagcaccattccgccaatttgagaaaaaatacgagaggttgagtacgggacgcggttacgtctcccaaaaaagaaaagagtccgttctggccggatgtgagtttccattgcatcaggagaactcagaaatgtgcaaagtggtgtttgccccgcagcctgacagtaccagttctggctggttc

SEQ ID NO: 16852 - DNA, 2682 bp, Artificial Sequence
  Description of Artificial Sequence: Synthetic coding sequence
atgatcctgctggctgttctctttttgtgctttatatcatcgtactccgcttccgttaaggggcataccacaggtctgtccctgaataacgaccggctgtataagttgacttatagtacggaagtcctgttggatcgcggcaagggcaagctgcaagattccgttgggtacaggattagcagtaacgtcgacgtggctctcttgtggaggaacccagatggggacgatgaccaactgatccagattactatgaaagatgtcaatgtagagaacgtcaaccagcagcgaggggaaaaatcaattttcaaagggaaaagcccaagtaaaatcatgggcaaggagaatcttgaagctctgcagcggcccacattgctgcatctgatccatgggaaggtgaaagaattttacagctaccagaacgaggccgtggccatcgagaacattaaacgtggcttagcctcactcttccaaacgcagctgtcaagtggtacaacaaatgaagtcgacatctccggaaactgtaaggtgacttaccaagcccaccaggacaaggtaattaaaatcaaagcactcgattcttgtaagatcgcgcgtagcggattcaccacccccaatcaggttcttggagtgtcttccaaggcaacatctgtgaccacatacaaaatcgaagactcatttgtgattgccgttctggccgaagaaactcataacttcgggctcaactttctccagactatcaaaggcaaaattgtgagtaagcagaaattggagctgaaaaccaccgaagccggccccaggctgatgagcggtaaacaggctgctgccatcattaaagccgtggactccaagtataccgctattcccatagtaggtcaagtgttccagagccactgtaaaggctgcccaagcctcagcgagctgtggcgatctacccgcaagtatctccagccagacaacttaagcaaggctgaggcggtcagaaactttctggcctttatacaacacctgaggacagccaaaaaggaggaaattttgcagatcctgaagatggagaataaagaagtactccctcagctggttgacgctgtgacatccgctcagacctctgattccctcgaggctatactggattttctagatttcaaaagcgattcgtccattattttacaggagagattcctgtatgcctgcggctttgccagtcacccaaatgaggagctcctgcgggcgttgatttccaaatttaagggctccattgggtcctcggacatccgggagaccgtgatgattataaccggcactctggtccgcaagctgtgtcaaaatgagggttgtaaacttaaggcagtagtggaggctaaaaaactgatactcggtggcctggaaaaggcggaaaagaaggaagatactcggatgtacctgcttgccttgaagaatgccctcctgcctgagggcattccctcactgttgaaatacgctgaagcaggggagggcccaatcagtcatctagctaccaccgctttacagcgctacgacctgccattcattacagatgaggtgaaaaaaaccctcaatagaatctatcatcagaaccggaaagttcatgagaaaaccgttagaaccgcagccgccgctataattcttaacaataatccctcatatatggacgtcaaaaatattctcctctccataggtgagctgccacaggagatgaacaaatatatgctcgccatcgtccaagatatcctgaggtttgaaatgccagcatccaaaattgtccgcagagtacttaaggagatggtggcacataactatgacaggttcagcaggtcaggctcaagttcagcctacactggatacatagaaaggagcccccgcagcgcctctacttactcgctggatattctatacagtggaagtggcatcctcagaaggtctaacttgaacatttttcagtacattgggaaagccggactccacggatcgcaggtggttatcgaggcacaaggcctggaagcattaattgccgccactccagacgagggggaagagaacttagactcctatgccggtatgagtgcgatcctctttgacgtgcagttgaggcccgttaccttctttaatgggtacagcgacctcatgagcaaaatgttatctgcctctggggatcctatctctgtggttaagggtttgatcctcctgatcgaccatagccaggaactccagttgcagagtgggctgaaggctaatatcgaggtgcagggtgggttagccatcgatattagcggcgctatggagtttagcctctggtaccgtgaatcaaaaactagggtgaaaaaccgggtgaccgtagtcataactacagatattactgtggacagctctttcgtgaaagcaggcctggaaacctctacagagacagaagcaggactggaattcatctcaacagtgcagttctctcagtacccttttcttgtctgtatgcaaatggacaaggatgaggccccctttcgccagtttgaaaaaaaatacgagcggctgtccactggcagaggatatgtatcccagaaacggaaagaatccgtgctggccggctgcgagttccccctgcaccaagaaaacagcgagatgtgcaaagtagtgtttgcaccccagcccgattctacgtcgagtggctggttt

SEQ ID NO: 16853 - DNA, 2682 bp, Artificial Sequence
  Description of Artificial Sequence: Synthetic coding sequence
atgattctgctcgcggttctcttcctgtgttttatctcatcctacagcgctagcgtaaagggccacactacgggtttatctctgaataacgatcggttgtataagctgacgtactcaacagaggttctactagaccgaggcaaaggcaagctccaggatagtgtgggctataggatcagttccaatgtcgatgtggccttactgtggaggaatccggacggggacgacgatcagttgatccagatcaccatgaaggatgtcaacgttgaaaacgtaaaccagcagagaggcgagaagtccatctttaagggaaagtctccctctaagatcatgggaaaggaaaacctggaggcgttacagaggccaactttgctgcaccttatccatgggaaggttaaagagttttactcttaccaaaacgaggccgtagcaatcgagaacataaaaagaggcctcgccagcctgtttcagacccagctcagctcaggtacgactaacgaggtagacatttccgggaattgtaaagttacctatcaggctcatcaggataaggtgataaagatcaaggcactagactcatgtaagatcgcacggtcaggctttacaacccctaatcaagtcctgggagtgagttcaaaggcaactagtgtgacaacgtacaagatcgaggacagctttgtaatcgcggtcctggcggaggagacccataattttggattgaatttcttacagaccataaagggaaagatagtgagcaaacagaaattggagttaaaaactacggaggccgggcctcggttgatgtcgggaaagcaggccgccgcaatcattaaggccgttgacagtaaatatactgccatccctatagtgggccaggtattccagtcgcactgcaagggttgcccctctctcagtgagctctggcgctccacccgcaagtatctgcagcccgataacttgtcgaaggcagaagccgttaggaactttcttgcatttatccaacacttacgaactgcgaagaaggaagaaattcttcagatcctcaaaatggagaataaagaggtgttgccacagttggtggacgctgtaacatcagcacagaccagcgattccctcgaggcaatcctggacttccttgactttaaaagtgattcgagcattattctgcaggaacgttttttgtatgcatgtggttttgcttctcacccaaatgaggagcttcttcgggcactgataagcaaatttaaaggatcaattggatctagcgatatcagagagactgttatgatcatcaccgggaccctcgtacgaaaattgtgccagaacgaaggctgtaaactcaaggccgtagtggaagccaagaaactgatcctcggcggtcttgagaaagctgaaaaaaaggaagacaccaggatgtatctgcttgccctgaaaaacgcattgctgccagaaggaatccctagcctcctgaagtacgccgaggcaggggagggccctattagccatctcgctactactgccctgcagcgctacgatctaccatttataaccgatgaagttaagaaaaccctgaatcggatctaccaccaaaataggaaggtgcatgagaagacggtgcgaacagccgcagccgccatcattttgaataataatccttcttacatggacgtgaagaatatccttctctctatcggcgagctcccacaggagatgaataaatatatgctggcaatcgtgcaggacatacttcgttttgaaatgccagccagtaaaatcgtccgtagagtgttgaaggaaatggtcgcacacaattacgatagattctcacgttctgggtcctcgtccgcttacacgggctacattgaaagatctccacgctctgcttccacatattctctggatatcttgtactctgggagcggtatcctgcggagatcaaatcttaatatcttccaatatatcggcaaggccgggctgcacggctctcaggtggtcatcgaggctcaggggcttgaggccctaatcgctgccacacccgacgaaggcgaggaaaacctagattcctatgcggggatgagcgcaattctgttcgacgtgcagcttcggccagtgactttcttcaacggctactctgatctgatgagtaagatgctatctgctagcggtgaccccataagcgttgtaaaaggcctcatccttctgattgaccattcccaggagctgcaattgcagagcgggttgaaggccaacattgaggttcagggcggcctggctatcgatatctcaggtgccatggagttctcactatggtaccgggagtctaaaacccgggtgaaaaacagggtgacggtggtaatcacaaccgacatcaccgtggacagtagtttcgtcaaggccgggttggagacttctaccgaaaccgaggcaggacttgaattcatctcaaccgtgcagtttagccagtaccctttcctcgtctgtatgcagatggacaaggacgaggctcctttccgacagttcgagaaaaagtatgaaaggctgagcaccggcagggggtacgtctcccagaagcgcaaggaatcagtccttgctggctgtgagttcccccttcaccaggagaacagtgagatgtgtaaggtggtgttcgccccccagccagacagcacctcatctggctggttt

SEQ ID NO: 16854 - DNA, 2682 bp, Artificial Sequence
  Description of Artificial Sequence: Synthetic coding sequence
atgattctgttggctgtcctgtttctttgtttcatcagttcctattccgcctcagttaagggccacaccaccggccttagcctgaacaacgatcggctttacaagctgacatactctactgaagtcttgcttgataggggcaaaggaaagttgcaggattccgtagggtatcggatctcttccaatgtagacgttgccctgttgtggcggaaccccgacggcgacgacgatcagctcattcagatcactatgaaggatgtcaatgttgaaaacgtcaatcagcaaaggggagagaaaagtatctttaagggcaagtcaccttccaagatcatggggaaggagaatctcgaagcgctccagaggccaacgctgctgcatctgatccacggaaaggtgaaagagttttacagctaccagaacgaagcagtcgccattgagaacatcaaacggggactggccagtttgttccagactcagctctcttccggtacaaccaatgaggttgacatttctggcaactgcaaggtgacttatcaggcccaccaggataaagttatcaagatcaaggccctggactcctgcaaaatcgctcgctcagggttcacgacacccaaccaggtgctcggggtgagctccaaggcaacctcagtaaccacctacaagatagaagactcctttgttatcgctgtcctggccgaggagactcacaatttcggtcttaatttcctgcagaccatcaagggcaagatagtgagcaaacagaaactggaactgaagactaccgaggcaggtcctcgccttatgagcgggaagcaggcggccgctatcattaaggccgttgactctaagtacaccgccatccccatagtgggccaggtcttccagtcccattgtaaggggtgcccctctcttagcgagctctggagatccacgcggaaatatttgcagccagataacttgagtaaagccgaggctgtgagaaactttttggcgtttatccagcatctcaggacagccaagaaggaagaaatactccagatccttaaaatggagaataaggaggtgcttccccagctcgtcgacgctgtcaccagcgctcagacatccgattcccttgaggcaatactggatttccttgacttcaagtcagatagcagcattatcctgcaggaacgcttcctgtatgcatgcgggtttgcttcccacccaaacgaggagctgctgagagccctgatctctaaattcaagggaagtatcggctcttctgacatcagggagacagtgatgattatcactggaaccctggtgcggaagctgtgtcagaacgagggttgtaagctgaaagctgttgtcgaggccaagaagctgatactcggtgggttggagaaggccgagaagaaagaggatactcggatgtaccttctcgccctcaaaaacgcactcctgcctgagggcatcccctcactcctcaaatacgctgaggccggcgaggggccgatcagtcatctcgccaccacggctttgcagcggtacgatctcccctttatcactgacgaggttaaaaaaaccctcaatagaatctatcaccagaaccggaaagtgcatgaaaagaccgtgagaactgctgccgcggctataatcctcaacaacaatcctagttacatggatgtcaaaaacattctgctgtctattggagaactgccacaggagatgaataagtatatgctggctatcgtgcaagatattctcaggtttgagatgccagcttccaaaattgtgagaagggtactgaaggagatggtcgcacataactacgaccggttctctagatccggaagttccagtgcttatacagggtatattgaacgatctccacgctccgctagtacatattctctggacatcctgtattccggatctggaattctccggcggtccaacctgaatatattccagtacatcggaaaagcaggtctccatggctcccaggtcgtgatagaggcccagggtctggaggcactgattgcagctaccccagatgagggcgaggagaacttggacagttatgccggtatgtcagccattctcttcgacgtgcagcttcggccggtgacattcttcaacggctacagcgacttgatgagcaaaatgctctcagcgtccggcgatcctatatccgtcgtgaaaggcttgattctcctgatcgatcatagtcaggaactgcagctgcagtcaggccttaaagctaacattgaggtacagggcggtctggcaatcgatatttctggagctatggaattcagtctgtggtaccgggaaagtaagactagagtgaagaacagggtgaccgtggttataacaactgatatcactgtcgacagctctttcgtgaaagctggcctggaaacgagcaccgagacagaggcaggtctcgagtttatcagcaccgtgcagttctctcagtacccgtttttggtctgtatgcagatggataaagacgaagcccccttccgccagttcgaaaagaagtacgagcggctcagcaccggacgggggtatgtctctcagaagagaaaggagtctgtccttgcaggctgtgaattcccgctgcatcaggagaattcagaaatgtgtaaagttgtgttcgcgcctcagcctgactctacctccagtggctggttc

SEQ ID NO: 16855 - DNA, 2682 bp, Artificial Sequence
  Description of Artificial Sequence: Synthetic coding sequence
atgattctactcgcggttctgttcctgtgctttatctccagttatagcgcgtcggtgaagggacatacaactggtctgagcctcaacaatgatcggctgtacaaactgacctatagcactgaagtccttcttgatcgcggcaaaggtaaattgcaagattccgtcggctaccgaatcagctctaacgtggatgtcgccctgctgtggcggaaccctgacggagacgacgaccagttgattcagatcaccatgaaggacgtgaacgtggagaacgtgaatcaacaacgcggggaaaaaagcatcttcaaggggaaaagccctagcaaaataatgggcaaggaaaacctggaggccctgcagagacctactctgctgcatttgattcacggaaaagtgaaggaattctactcttatcaaaatgaggccgtcgcaatcgaaaacataaagcgaggtctggcgagccttttccagacccagctgagttctggcactaccaacgaagttgacattagcggtaattgcaaggtcacgtatcaagcacaccaggataaagttatcaagatcaaagctctggacagctgtaagatcgctaggagcggattcaccaccccgaaccaggtcctgggcgtttctagcaaggcaacctctgtgacgacctataagattgaagacagcttcgtgattgcggtgctggcggaggaaactcataacttcggtctgaacttcctgcaaactattaagggcaagatcgtgagcaaacagaagctggaattaaaaactaccgaggcgggtccacgcttgatgagcggaaagcaagccgcagctatcatcaaggcggtggactcaaagtataccgctattcccatcgttggccaggttttccagagccactgcaagggctgtccaagcctgagtgagctgtggcgatcaactcgaaagtacctgcagccagacaatttgagtaaggccgaagcggtgcgcaattttctggctttcattcagcacctgcgcacagcaaaaaaggaggagatcctacaaatcctgaagatggagaataaggaggtcctgcctcaactcgtcgatgcggttacctctgcgcaaacgagcgacagcttggaggcaatcctggattttctggatttcaagagcgattcctcgattattctccaggagagatttctgtacgcctgcggttttgcttctcatccgaatgaggaattgctgcgcgcactgattagcaaatttaagggtagtataggctccagcgatattcgagaaacggttatgattatcactggcaccctggttcggaaattgtgtcagaatgaaggctgcaagctgaaagccgtggtggaggcgaagaaactcattcttggtggtctggaaaaggccgaaaagaaagaagacaccagaatgtacctgttggcccttaagaatgcgctgctccctgaaggcatcccgagcctgctgaaatacgcagaagcgggagaaggcccgattagccacttggccacgacggcactacagcgctacgatctgccattcattactgatgaggtaaagaaaactctgaatcgcatttaccatcagaaccgcaaggtgcacgaaaagacggtgcgcaccgcagctgcagccattatcttgaataacaatccttcttacatggacgtcaaaaacatcctcctgtctattggcgagctgccacaggaaatgaataaatacatgcttgcgatcgtgcaggacattctgcgcttcgaaatgccggccagcaagattgtgcgccgtgtgctgaaagaaatggttgcgcacaattatgatcggttttctcgatccggaagcagcagcgcttacacaggctacatcgaacgctctccacgcagcgcaagcacctattccctcgacattctctattctggtagcggcatcctgcgtcgctccaatctgaatattttccagtatatcggaaaggccggcctgcatggcagccaggtcgttatcgaggctcagggcctggaggcattgatcgccgctaccccagatgaaggagaggaaaatctggatagctacgcgggtatgtctgccatactgtttgacgtccagctacgcccggtgacttttttcaatggctattctgacctgatgagcaagatgctgtccgctagcggcgacccaattagcgtggttaagggccttatactgctgatcgaccactctcaagagctacagcttcagagcggacttaaagccaatattgaggtccaagggggactcgcgatcgacatcagcggtgctatggaattcagcctctggtaccgcgaaagcaagactcgcgtgaagaaccgcgtgacagtggtaattaccacggacattaccgtggactcctcctttgtcaaagcgggactggaaacctccaccgagaccgaagctggcttggagttcattagcacagtacagttttcacagtatccgttcctggtttgtatgcaaatggataaagatgaggccccttttcgccagttcgaaaagaagtacgaacgtctttccacgggtcgaggttatgtgagccagaaacgcaaagaatcagttttggcaggttgcgaattcccactgcaccaagagaactcagaaatgtgtaaggtggtcttcgctccacaaccagacagtaccagttctggatggttc

SEQ ID NO: 16856 - DNA, 2682 bp, Artificial Sequence; identical to SEQ ID NO: 16838
  Description of Artificial Sequence: Synthetic coding sequence

SEQ ID NO: 16857 - DNA, 2682 bp, Artificial Sequence
  Description of Artificial Sequence: Synthetic coding sequence
atgattcttctggcggtactctttttgtgcttcatcagctcctactctgcaagcgtgaaagggcacacaaccgggctaagcctcaacaacgatagattgtacaaacttacatactcaacagaagtgttattagaccgaggaaagggcaaactgcaggattcagtgggataccgcatctcatcaaacgtggatgtcgccctcctgtggcggaatcccgacggagatgatgatcagctaattcaaataaccatgaaggatgtcaacgtagaaaatgtgaaccagcaaagaggcgagaaatctatcttcaaaggcaaatctccaagtaagataatgggaaaggaaaacctggaggcattgcagcgaccgaccctgctccacctgatacatggcaaagtcaaagagttctactcttaccagaacgaagcagtggctatagagaacattaagagaggcctcgccagtctctttcagacccagctgagctccggcaccaccaacgaagtagacatttctggcaactgcaaggtgacataccaggcccatcaggacaaggtgattaaaatcaaggccctggactcttgtaagatagcacgatcagggttcactaccccgaaccaagtgctaggtgtttccagtaaggccacctccgtgaccacatataagattgaagactcttttgtgatagctgtactggcggaggagacacacaattttggactaaattttttgcagaccatcaaaggcaagattgtttccaagcaaaaactggagctcaaaacaaccgaggccggcccgcggttgatgagtggaaaacaagccgccgccattattaaagcggtggactcaaaatacactgcaattccaatcgtgggccaggtttttcagagccactgcaaagggtgcccgagtctcagtgaactgtggcgcagcacacggaagtaccttcagcccgataacctgagtaaagccgaagcagtgcggaactttctggcgttcattcaacacctaagaacagccaagaaggaggagattctccagatactgaaaatggagaacaaggaagtactgccacagctggttgacgctgtcacgtcagctcaaacatccgacagcttggaggcgattttagattttctggatttcaaaagtgactcttccattattcttcaggaaagatttttatatgcatgcggctttgcctctcatccaaacgaagaactgctaagggcgctgatcagtaagttcaaggggagcattggcagctcggatatcagagaaaccgtaatgattattaccggaaccttggtgaggaagctgtgtcaaaacgaaggatgcaagttaaaggcagtagtggaagccaagaaacttatccttgggggcctagagaaggcggaaaaaaaggaggacacacgcatgtatctgctcgcgctcaagaacgccctgctgccggaggggatcccgtctttgttgaagtacgcggaggctggcgagggacccatttcccacctggcaactaccgctttgcagcggtacgacctcccctttattactgacgaggtaaagaaaacgttgaataggatctaccatcaaaaccgtaaggttcacgaaaagactgtgaggactgctgccgccgctataatactcaataataatcctagctatatggatgtgaaaaacatcctgctaagtataggcgagctgcctcaggaaatgaacaaatacatgctcgctatcgtgcaggatatactaaggtttgaaatgcctgcctctaagatcgtgaggcgggttcttaaggaaatggtggcacacaattacgatagattttctcgaagtggatcgagctccgcttacaccgggtatattgagagatcgccacgctcagcttctacctacagtcttgatattctctatagcgggagcgggatacttcgtaggtcaaatctgaatatctttcagtatatcgggaaagccgggttgcacggttcccaagtggttatcgaagcccaaggattggaagcccttattgcagcaactcccgacgagggcgaggagaatttagattcatatgctggcatgtcggcaattctttttgacgtgcagctccgcccagttacatttttcaacggttactccgacctgatgtccaaaatgttaagcgccagcggagaccccatcagtgtggtgaaggggctgatcctgttgatcgatcattcccaggaactacagttgcagtccggacttaaggccaatatcgaggtgcaggggggcttagctattgacatctccggagccatggaattttctttgtggtatagagagagtaaaactagagtcaaaaatagagtcactgtggtgataaccaccgacataaccgtggactcgagtttcgtcaaggcaggactagagacgtcgaccgaaactgaagctgggttagagtttatcagcacagtacagttcagccagtacccatttctggtgtgcatgcaaatggataaggacgaggcgcctttcaggcagttcgagaagaaatacgaacggcttagcaccggacgcggttatgtgagccagaaacggaaagaaagcgttttagccgggtgtgagttccccctccaccaggaaaactcagagatgtgcaaggtggtgtttgctccccagccagactcgaccagtagcgggtggttt

SEQ ID NO: 16858 - DNA, 2682 bp, Artificial Sequence
  Description of Artificial Sequence: Synthetic coding sequence
atgattcttcttgcggtactgtttctgtgcttcattagctcctatagcgcttctgtcaagggccatactacaggtctaagcctcaacaacgatcggctgtataaactcacttattctacagaggttctgctcgaccggggaaaggggaaacttcaggactcagtgggttacaggatttcatctaatgtcgatgtcgcccttctctggcgaaacccagatggggacgacgaccagctcattcagattaccatgaaggatgtgaacgttgagaatgttaaccagcagcgaggggagaagagcattttcaaaggcaagagtccgagtaagatcatggggaaggaaaatctggaggccctgcagcggcccactctcctgcacctaatccacggcaaggtgaaggaattttattcttaccaaaatgaagctgttgccatcgaaaatattaagagaggactcgcttctctgtttcagacccaactctcatctggtaccactaatgaggttgacatatcaggaaattgtaaggtcacttaccaggcccatcaagataaagtaataaagattaaggcgttggacagttgtaagatcgctcggagtggcttcaccactcctaaccaggtgctcggcgtcagctcaaaagctacgagcgtaactacctacaagatcgaggatagtttcgtcattgccgtactggcagaggaaacccataattttggccttaatttcttgcaaacaattaagggaaaaatcgtgtcaaaacaaaagctcgaactgaagactacggaggcaggtccccgattgatgagcggcaagcaggccgctgctatcataaaagccgtcgacagcaaatacacagccatacccatcgtgggccaagtctttcagtcacactgtaaaggctgcccttctttgagcgaactctggcgttccacccgaaagtatctacagcccgataacctgagtaaggccgaagcggtgaggaacttcctggcatttatccaacaccttcgcacggcaaagaaagaagagatccttcaaattttgaagatggagaataaagaggtgctccctcagttagtggacgctgtgacaagtgcacaaacgtccgattcccttgaggccattttggatttcctggactttaaatccgatagctccataatcctccaggaacggttcctgtacgcttgcggtttcgctagtcaccctaatgaagagctcctaagggcattaatcagtaaattcaaagggagcatcggctccagcgacatcagggagacggtcatgataatcactgggaccttagttcgaaaattgtgtcaaaacgaagggtgcaagttgaaggccgtggtggaggccaagaagctgatcctgggaggactagagaaggctgagaagaaagaggataccaggatgtatctgttggccctcaaaaatgccctgctgccggaaggcataccttccctactcaagtatgccgaggctggagagggccctataagccacttggcgaccactgccctacaacgatacgatctccccttcataaccgatgaagtcaagaagactctcaatcgtatttatcatcaaaaccggaaagtgcacgagaaaacggttagaacggcagccgctgcaatcatactcaacaacaacccttcctatatggacgtcaaaaacatattgctgtctatcggggagctccctcaagagatgaataagtacatgttagccattgtgcaagacattctgagattcgaaatgcctgcaagtaaaatagtgaggcgcgttctgaaggagatggtggcccacaactacgaccgctttagtagatccggttcatcttcggcatacaccggctatattgagcgcagcccccgaagtgcttcgacatatagtctggacatcctgtacagcggctctggcattttgaggagatcaaatctgaatatttttcagtatatcggaaaggcaggccttcatggatcccaggtggtgattgaggcgcaaggactagaggccctaatcgccgcaactcctgatgaaggggaagaaaacctggacagctacgctggcatgtctgcaattctgttcgatgttcagctacgcccagtaacctttttcaacggctactcagacctaatgagtaagatgttgagtgcctctggcgaccccatcagcgttgtgaaagggctcatcctgctgatagaccatagccaagagctccagctccagtcaggattgaaggccaatatagaggttcagggggggctagctattgacattagtggcgcaatggaattctccctttggtaccgcgaatctaagactagagtgaagaacagagtaaccgtggtgataaccactgatatcaccgtggattcatcattcgttaaggcgggactggagaccagcacagagacggaggccggactggagttcatttccactgtgcagttcagccagtatccattccttgtctgcatgcagatggataaagacgaggcgccattcagacagtttgaaaagaagtacgagagacttagcacagggaggggttacgtaagccaaaaaagaaaggaatctgtgctggccggctgcgaatttcccctccaccaagaaaatagtgagatgtgcaaagtggtgtttgctcctcagcctgactctacttcaagcggctggttc

SEQ ID NO: 16859 - DNA, 2682 bp, Artificial Sequence
  Description of Artificial Sequence: Synthetic coding sequence
atgattctcctggctgtgttattcctgtgctttatttcatcttatagtgctagtgtgaagggacatactactgggctttccctcaacaacgatcggctctacaaactcacatactcaactgaggtgcttctagaccggggaaaagggaaactacaggacagtgtcgggtatcgcatctcatctaatgtggatgttgcactgctttggaggaacccagatggagatgacgatcagctcatccagataacaatgaaagatgtgaatgtggaaaacgttaaccagcagcggggggaaaaatcaatattcaaagggaaatctcctagtaagataatggggaaagaaaatctggaagccctacagaggcccactttgctacatctcatacacgggaaagtgaaagagttctattcttatcagaacgaagctgtggccatcgaaaatataaaacggggactcgcctctctgttccagacacagctttcttctgggacaactaatgaagtcgatatctcaggaaactgtaaagtgacatatcaggctcatcaggataaagttatcaaaataaaagccctcgattcttgcaaaatagcaagatccgggttcacgacacctaatcaagtgctaggggtatcttcaaaagctacttccgttacaacttataaaattgaggattcctttgtcatcgcggtcctcgctgaggaaacacataatttcggactcaactttttacagactatcaaagggaaaatcgtgtctaaacagaagttagaacttaaaacaacagaggcagggccaaggctcatgagtggaaaacaggcagctgctattatcaaagctgtggatagtaagtatactgctatcccaatcgtggggcaggtgtttcaatctcattgtaaggggtgtcccagtctcagtgaactgtggcggagtactagaaagtatcttcagccagataacctgtccaaagccgaagccgttagaaattttcttgcttttatccagcatttacgcacagccaaaaaggaagaaatcctgcaaatacttaaaatggaaaacaaagaagtgctccctcagttagtcgatgctgtcacatccgctcagacttccgattctctcgaggctatactcgattttctggattttaaatctgatagttccatcatcctgcaagaacgtttcctctatgcttgcgggtttgcttcacatcctaatgaggaactccttcgcgccctaataagtaaatttaagggatccatcgggtcttcggatatccgggaaacagttatgataattacagggactctcgtgcgaaagctttgccagaatgaaggatgtaaactcaaagcagtggttgaggctaaaaaactgattctgggggggctagaaaaggcagagaaaaaagaagacacacgcatgtatctcctcgctcttaaaaacgcacttctgcctgaaggaattccctcgctcttgaagtacgcagaggctggagaagggcctatatcgcaccttgctactacagctttacagcggtacgacctcccttttatcactgatgaagtaaaaaaaacactgaaccggatttaccaccagaacagaaaagtgcatgagaaaacagtgagaacagctgccgctgccataatactaaacaataatcccagttacatggatgtaaaaaacatcctgttaagtatcggggaactgccccaggaaatgaataagtatatgctagccattgtgcaggatatactcaggttcgaaatgccagctagtaaaattgtgaggcgagtgctaaaagagatggtggcacataattatgataggttttctcgctcaggatcctcttccgcatatacaggatacattgagcgttctcccagatcggcttcgacttacagtttggacatcctgtattccgggtccggaatccttaggcggagtaatctcaacatcttccagtacataggaaaggccggactacacgggtctcaggtggtgatagaagcccaaggactagaagcacttatagccgctacacctgatgaaggggaagaaaacctggattcctatgcaggaatgagtgccatactgtttgatgtacagttaagacctgttacatttttcaatgggtactcagacctcatgtccaaaatgctgagtgcctcaggagatcccataagtgtcgtgaaaggacttatactcctgatagatcatagtcaggaattacagctccagagtggactcaaagccaatattgaagtccagggagggcttgccattgatatctctggggcaatggaattctcactctggtatcgggaatctaagactcgtgtaaaaaacagggtgactgtggttattacaactgatatcacagtggatagttcttttgtgaaagccgggctcgaaacttccactgagactgaagccggactagaatttatctctacggtgcagttttcccagtacccctttctggtctgcatgcagatggataaggatgaagccccttttagacagtttgaaaagaaatacgagcggttgtcaactggacggggatacgtatctcagaaacggaaagaatccgttctcgcaggatgcgaattcccacttcaccaggagaattctgaaatgtgtaaagtggtttttgctccacaacctgattctacttcctccgggtggttt

SEQ ID NO: 16860 - DNA, 2682 bp, Artificial Sequence
  Description of Artificial Sequence: Synthetic coding sequence
atgattcttctggcagttctgtttttatgctttatcagcagttatagcgcatccgtgaaaggacacacaaccggcctgtccctcaacaacgacagattgtataaacttacctattcaaccgaagtgcttcttgacaggggcaagggcaaattgcaggactccgtgggctacaggatttctagcaacgtggacgtggctcttctatggaggaatcctgatggagacgatgaccagctgattcagatcaccatgaaagacgtgaacgtcgaaaacgtcaaccagcaaaggggggagaagagtatcttcaaaggcaaaagcccttctaagatcatgggaaaggaaaacttggaagcgttgcaaaggcctaccctgctgcacctgatccatggaaaagtcaaagagttctacagctatcaaaacgaggccgtggcgattgagaatataaagcgcgggctggcctcgctcttccagacccagctgtcttcagggacaacaaacgaagtggatattagcggaaactgtaaggtcacctatcaagctcaccaggacaaggtgatcaagatcaaagctctggattcgtgcaaaatcgcaagatctggattcaccacccctaatcaggtgctgggcgttagtagcaaagccacaagcgttacgacctacaaaatcgaagacagctttgtgatcgctgtccttgctgaggaaactcacaattttggcttgaacttccttcagacaatcaaaggaaagatcgttagcaaacaaaagctcgaattaaagaccaccgaggccggacctaggctgatgagtggcaaacaggccgcggctataataaaggctgtggatagtaaatacacagctatccctattgtcggccaggtttttcagtcacactgcaagggatgtccttctctgtctgaactgtggagatcaacaagaaagtatctgcagcctgataacttgtccaaggctgaagctgtccgcaatttcctggcattcatccaacacctaagaactgccaagaaagaagagatactccagatcctcaagatggaaaacaaggaggtgctaccgcaacttgtggatgctgtgacaagcgcacaaacgtcagacagccttgaagcaatcctggatttcctcgacttcaaatctgatagctccataatcctgcaagaaagatttttatatgcctgtggcttcgcttcccatcctaacgaagaactcctgagagccctcatatctaagttcaaggggtctatcggaagctcagacatcagagaaaccgttatgatcatcactggaacactggtcagaaaattatgccaaaacgagggatgcaagctgaaagccgtggttgaggccaaaaaactgatcctcggcggcctcgaaaaggctgagaagaaagaagataccaggatgtacttgttggctttgaaaaatgctcttctgcctgaaggcatcccttccctgcttaagtacgccgaggctggcgagggacctatctcccacttggctaccactgcgttgcagcgctatgacctgccttttatcaccgacgaggtcaagaagacactcaatcgcatttatcatcaaaataggaaggtgcacgagaagacagtgcgtacggctgcagctgctatcatactgaataataacccgagctacatggacgtcaagaacattctgctcagtatcggcgagctgccacaggagatgaacaagtacatgcttgccatcgtccaggacatcctgagattcgaaatgcccgctagcaaaattgtcaggcgtgtgctcaaggaaatggtggctcacaattacgataggttctcccgcagtggcagctcatctgcttacactggatacattgaaagatctcctagatctgcatccacatacagtctcgacatcttgtacagtggcagcgggatacttcggagatcaaatctgaacatctttcaatacattgggaaggccggactgcacggcagccaggttgtgatcgaggcccaaggactggaagcacttattgcggccacacccgacgagggggaagagaacctcgattcttacgctggcatgtctgctatcctgttcgatgtccaactccgaccagtcacatttttcaacgggtatagtgatcttatgagcaaaatgctcagtgccagcggggatcctataagcgtggtaaaaggcctgatccttctgattgatcacagccaagaacttcaattgcagtccgggttaaaagctaatatcgaggtccagggcggcttggcaatcgatataagcggggccatggagttcagcctctggtaccgcgagtctaaaaccagggtgaagaatagagtcactgttgttatcaccaccgatattactgtagacagcagcttcgtgaaggcagggcttgaaacgagcactgagaccgaggctggattggaattcataagcacagttcagttctcacaatatcccttccttgtttgcatgcaaatggacaaagatgaggctccttttcgccaatttgagaaaaaatacgaacggcttagtaccggccgcggatacgtgagccaaaaacgcaaagaaagtgttctggccggatgtgagtttccactccaccaggaaaactctgagatgtgtaaagtcgtattcgctccacagccagatagcactagcagtggctggttt

SEQ ID NO: 16861 - DNA, 2682 bp, Artificial Sequence
  Description of Artificial Sequence: Synthetic coding sequence
atgattctgctcgcggttctcttcttgtgctttatatcaagctatagcgcttcggtgaagggacacaccacgggtctgagcctgaataatgaccgactatacaaactgacgtattcaacagaggttctgctggatcgcgggaagggcaaactacaagatagcgttggctatcgcattagcagcaacgtggatgttgcattactgtggaggaaccccgatggggacgacgaccagctcattcaaattaccatgaaagacgttaatgtagaaaatgtaaatcaacaacgcggtgaaaagtccatctttaagggtaaatcgccatctaagataatggggaaagaaaatttggaggccctacagcggccaactctgctgcatttaatacacggaaaggtgaaagaattttatagctaccaaaacgaagctgtggctattgagaacatcaagcgcgggttggcttccctgtttcagacccagttgtcgagtggaactactaatgaggttgacatttctgggaattgcaaggtcacctatcaggcgcaccaggacaaagttatcaagattaaagctctcgatagttgtaagattgcccgatccggattcaccacgccgaatcaggtcctgggtgtgtctagcaaagctacaagtgtcacaacttacaaaatagaggattcctttgtgatcgcagttctggcagaggagacccacaactttggcctaaacttcctgcagacaattaaaggcaaaatcgtgtctaagcagaagctggagctgaagactaccgaggctggcccacggttgatgagcggcaagcaagccgctgccatcataaaagcagtggattcgaaatacacggccattccgatcgtgggacaggtgttccagtcccattgtaaaggttgtcccagcctatcagaactctggcggtctacacgtaaatacctccagcctgataatttgtccaaggctgaggcagtccgaaacttccttgctttcatccaacacttgaggactgccaagaaagaggaaattctgcagatcctgaaaatggaaaacaaggaagtccttccacaactcgttgacgcggtgacgtctgcccagacatcagatagccttgaggccatactggactttttggacttcaagagcgactcaagtatcatcctgcaggaaagattcctgtatgcttgcggttttgctagccatcccaatgaggagctcctacgggctctgatctctaagttcaagggctctattgggagctctgatataagggagaccgtaatgatcattactggtacactggttagaaagctgtgtcagaatgagggctgtaagctaaaagccgtggtcgaggcaaaaaagctgatactcggcggcctggagaaggccgaaaaaaaagaggacaccaggatgtacctgctggccctgaaaaacgctttgctgcccgagggaatacccagccttttaaaatacgcagaggcgggagagggcccaatctcccacttggctactaccgcgttgcagaggtacgacctgccatttatcaccgacgaggtcaaaaagacccttaaccgcatataccaccagaatcgaaaagtgcatgaaaaaactgtgcggacagccgctgctgcaatcatcctcaacaataacccgagctatatggatgtgaagaacatcctcctatctatcggcgaactgccgcaggaaatgaataagtatatgcttgccattgtgcaggacatcctgcgatttgagatgccagcctccaaaattgtgaggcgagtgctgaaagagatggttgctcacaactatgatcgcttttctagaagtggatcatcctcagcatacacagggtatattgagcggtcaccccgctcagcatccacctatagcctcgacatactctacagtggctctggcatcttgaggcgtagcaacctcaatattttccaatatattggaaaagcgggactgcacggcagtcaggtagtcatcgaagcacaggggctggaggcacttattgccgcaacccctgacgaaggagaggaaaatctggactcttacgcaggcatgtcggcgattctcttcgatgttcagctccgtccagttactttcttcaatggttatagcgatcttatgagtaaaatgctctccgcatcgggagaccctattagtgtagtgaaaggactcatcctactcatcgaccactcccaggagctgcaactgcagtcagggctgaaagctaacattgaggtccaggggggactggctatagatattagtggcgctatggagttcagcctctggtaccgcgagagtaagactagagtcaaaaatcgggtcacagtagtgatcacaactgatattaccgtcgacagttccttcgtgaaggcgggcctggagacatctacagaaactgaagccggcttagaattcatcagcacagttcagttcagccagtacccctttttggtttgtatgcaaatggacaaggacgaggccccatttcgccaatttgaaaaaaaatatgagagactctcaactggaagaggctatgtgagccagaagaggaaggaatccgtcctggccggttgcgaatttccattacaccaagaaaattctgagatgtgcaaggtcgtcttcgctcctcagcctgacagcacttcaagcgggtggttc

SEQ ID NO: 16862 - DNA, 2682 bp, Artificial Sequence
  Description of Artificial Sequence: Synthetic coding sequence
atgatcctgctggctgtattgttcctttgtttcatttcttcatactcagcatctgtaaaaggtcacacaaccggcctgtccctcaacaacgaccgtttgtacaagctgacatactctactgaagtactccttgaccgcggcaagggtaagctccaagattcagtgggctatagaatatcctctaacgtcgacgtcgccctcctctggaggaacccagacggtgatgacgatcagttgattcaaatcaccatgaaggacgtcaatgttgagaacgtaaaccaacaaaggggtgaaaaatccatcttcaaaggcaaaagtccttcaaaaatcatgggcaaagagaacctcgaggccctgcaaaggcccaccctgctgcatctgatccatggaaaggtgaaggaattctacagttaccagaacgaggccgttgccattgagaatattaagagaggactcgcaagcctctttcaaactcaacttagtagcggcactaccaacgaagtggatatttctggaaactgcaaggtgacctaccaagcacatcaagataaggtcatcaagatcaaagctctggattcttgcaaaatcgccaggagcggattcaccacccccaatcaagtcttgggtgtaagctccaaggctacaagcgtcacaacatataagattgaggactctttcgtgatcgccgtgctcgccgaggagacacacaacttcggactgaatttcctgcagacaatcaagggtaagattgtctctaagcaaaagctcgagctgaagaccaccgaggctggcccacgcctcatgtctggcaagcaggcagcagctatcattaaggctgtggactctaagtatactgccatcccaatcgtgggccaagtttttcaatcccactgtaaaggatgcccctcactctccgaattgtggcgctccactcgtaaatacctccaaccagataacctttccaaggctgaagctgtccgcaactttttggccttcattcagcacttgaggactgccaagaaggaggagatcctccaaatattgaagatggaaaacaaggaggtcctgccacagcttgtcgacgctgttacctccgctcaaacttctgactctttggaagcaatacttgacttcttggattttaaatccgacagttccattatactgcaagagagattcctgtatgcctgcggtttcgcttcccacccaaacgaggagctgctgcgtgccctgatttctaagttcaaaggtagtataggatctagcgacatcagagaaaccgtgatgataatcacaggaacacttgtaaggaagctttgccagaacgaaggttgcaagctgaaggctgtggtagaggctaagaagctgattctgggtggtcttgagaaggctgagaagaaagaggatactcgcatgtacttgctggcattgaagaacgctcttctgcctgagggaattccctcattgctgaaatatgctgaagctggagagggtcccattagccatttggccactactgcccttcagagatacgacctcccatttataacagatgaagtaaaaaagacattgaacaggatctaccaccagaaccgcaaggtacacgaaaagacagtgcgcacagccgctgcagctatcatactcaacaacaacccctcatacatggatgtcaagaacattttgctctctattggagagctgccccaggagatgaacaaatatatgctggctatcgtgcaagacatcctccgctttgaaatgcctgctagtaagatcgtacgcagggttcttaaagagatggttgcccataactacgaccgtttctcccgttctggcagctcaagtgcctacactggctacattgagcgcagccctaggtccgccagcacttactccctggacatattgtactccggcagtggaatccttcgccgtagtaatctcaacatatttcaatacataggcaaggccggcctgcacggctcccaagtcgtcatcgaggcccagggacttgaggctcttatagcagccacaccagacgagggtgaagagaacctggactcatatgccggtatgtctgctattctcttcgacgttcagctgagaccagtcaccttctttaatggctattccgatcttatgagcaaaatgttgtcagctagtggtgacccaatatccgtggttaagggcttgatcctccttattgatcactcccaggagcttcagctgcaatcaggcctgaaggcaaatatagaagtccagggcggcttggcaatcgatatcagtggtgccatggagttttccctctggtatcgcgagtctaagaccagagtaaaaaaccgcgtgaccgtggttataactactgatatcaccgttgactcttctttcgtgaaagcaggcttggaaacatctacagaaaccgaggctggcctcgagttcatttccactgttcagtttagtcaatacccctttctcgtatgcatgcagatggacaaggacgaggctccttttcgtcaattcgagaagaagtatgaaagattgtccacaggacgtggctacgtctctcagaagaggaaggagtcagtcctggcaggttgcgaattccctttgcaccaggagaattccgaaatgtgtaaagtagtgttcgctccacagcctgattctactagctcaggatggttc

SEQ ID NO: 16863 - DNA, 2682 bp, Artificial Sequence
  Description of Artificial Sequence: Synthetic coding sequence
atgatactgctcgctgtgctgttcctctgctttattagtagttattcagccagcgtgaagggtcacacgaccggtctgagcctgaacaatgatcggctttacaagctcacctactctacagaagtacttctggaccgaggtaaggggaagcttcaagattcggtggggtaccgaatttcgtcaaacgtagacgtggctctcttgtggcggaacccggatggagacgacgaccaactgatccaaataactatgaaagatgtgaacgtcgagaatgtaaaccagcaaaggggcgagaaatcaattttcaaaggcaagtctcccagcaagattatgggaaaggagaatcttgaagctctccaacggcccactttgctgcacctaatccatgggaaagtgaaggaattctactcttaccagaatgaagccgttgcaatcgaaaatattaaacggggcctagcttccctgtttcaaacccagctcagttcaggcaccacaaatgaagtagatatttccgggaattgcaaggtgacctatcaggcacaccaggataaagtcatcaaaataaaggctttggactcctgtaagatcgcacgctcaggcttcacgactcccaaccaggtgcttggtgtcagcagcaaagcgaccagtgtgactacctataagattgaagactccttcgtcatcgcagtgttggccgaggaaacacataacttcgggttgaactttcttcagaccataaagggaaaaatcgtcagcaaacaaaaattagagctcaaaaccaccgaagctggcccaaggctcatgagcggtaaacaagcggcagctatcataaaagccgtggattcaaaatacacagctatccccatcgtggggcaggtgttccagagtcactgcaaaggatgtccctctctgagcgaactgtggaggtctacgcggaagtacctccagccagacaatctctccaaggctgaagccgtccgtaactttttggcctttatacagcacctacgaacggccaaaaaggaggaaattttgcagatcctgaaaatggagaataaagaggtgctgccgcagctagtggacgccgttacgtcagcccagactagtgattctctggaggctatcttggactttctcgacttcaaatccgatagcagcataatccttcaggagcgtttcctttatgcatgcggcttcgcatctcaccctaatgaagaactgttacgcgccctcatcagtaagttcaaaggttcaattggctcctctgacataagggagaccgtgatgatcataactggaacactcgtgcggaagttgtgccaaaacgagggctgcaagctgaaggccgtagtggaagctaagaagctgattttaggcggcctcgaaaaggccgaaaagaaagaagatactcgaatgtatttactggcactgaaaaacgctctgttgcccgagggcattccatctctgcttaaatacgcagaagccggagagggacctatctctcatctcgccactacagctctccagaggtacgatctcccatttattaccgacgaggtgaaaaagaccttaaacagaatctatcaccagaatcgcaaagttcacgaaaagacagtgagaaccgccgctgccgcgattatcctgaataataacccctcttacatggacgttaagaacattctgcttagcattggtgagctgccacaggagatgaacaagtacatgctggccatcgtgcaggacatcctcaggttcgagatgccggcgtcgaagatagtgagacgtgtgctgaaggagatggtggcgcacaactacgaccggttctcacgctcaggctctagctccgcatacaccggatatatcgagagatcacccaggagcgccagtacatactcactggatatattgtactctggaagcggtatccttcggcgcagcaatctcaacatctttcaatacattggcaaggccggactgcacggctctcaggtagtaatagaggcgcagggcttggaagcgctgattgctgcaacccccgatgagggggaggagaatctggattcctacgctggcatgtctgccattctgtttgatgtgcagctcagaccagtgacatttttcaatggctactccgatcttatgtctaagatgctgagcgcatctggtgatcctatcagcgtggtgaagggactgatactcctgatcgaccactctcaggagcttcagttgcagtcaggcctcaaggcaaacatcgaagtacagggcgggcttgcaatcgacatcagcggtgccatggagttctccctctggtaccgtgaatctaagacacgcgttaagaatcgcgtgacagtggttattacaacagacattaccgttgacagctcctttgtgaaggcaggcttggagacatccaccgaaacagaggcggggctggagtttatatctactgtccagttctcccagtatccgttccttgtatgtatgcaaatggataaagacgaggccccctttcggcagtttgagaagaagtacgaaaggctttctactggtagagggtacgtatcccaaaagagaaaggagagtgtgctggctgggtgcgagttccctttacaccaggagaacagcgagatgtgtaaggtggtgtttgccccacagccagattccactagttctggatggttt

SEQ ID NO: 16864 - DNA, 2682 bp, Artificial Sequence
  Description of Artificial Sequence: Synthetic coding sequence
atgatcctgctggcggtgctgtttctgtgctttatctcatcatactccgcgtcggtcaagggtcatactacgggattgtcgctgaacaatgaccgactctacaagctgacctattcgacggaagttttgctggatcgcgggaagggaaaactgcaagactccgtgggataccgcatttcctccaatgtcgacgtggccctcttgtggcggaatcctgatggagatgacgaccagctcatccagatcaccatgaaggacgtgaacgtggaaaacgtgaatcaacagcggggcgagaagtcgatcttcaaggggaagtcccctagcaaaatcatggggaaggagaacctggaggccctgcaacggccgacgcttctgcatctgatccacggaaaggtaaaagagttttactcgtatcagaatgaggccgtcgcgattgagaatatcaagcgcggacttgcatcactgttccagacccagctgtcgtccggtactaccaacgaggtcgacatctcaggcaattgcaaggtgacctaccaagcccaccaggacaaagttatcaagatcaaggccctcgactcctgcaaaatcgcgaggtctggattcaccacccctaaccaagtgttgggggtgtcgtccaaggcgactagcgtgactacttacaaaatcgaggactcctttgtgattgccgtgctggcggaagaaactcataactttggtttgaacttcctgcaaaccatcaagggaaagattgtctccaagcagaagctggaactcaaaactaccgaagctggaccgcgccttatgtcaggtaagcaggcagccgccattatcaaagctgtggactcgaagtacactgccatcccgatcgtcggtcaggtgttccagtcgcactgcaagggctgcccatccctgtccgaactctggaggtcgacccggaagtacctccagcctgataatctctcgaaggccgaagcggtgagaaacttccttgcgtttatccagcacctgagaaccgcaaagaaagaagagatcctgcagatcctgaagatggagaataaagaagtcctgccacagcttgtcgacgccgtgaccagcgctcagactagcgacagtctcgaagctatattggacttcctggatttcaaatcagatagcagcatcatccttcaggaaaggttcctgtacgcctgtggcttcgcctcacacccaaacgaagaactgcttcgcgccctgatctccaagttcaagggaagcatcggaagctcagacattcgggagactgtgatgataattactggcaccctggttcgcaagctgtgccaaaacgaagggtgtaagctgaaggcagtggtggaagccaagaagctgatcctgggcggcctcgagaaagccgaaaagaaggaagatactcgcatgtacctcctggctctgaagaacgccctgctcccggaaggaatcccgtcattgcttaaatacgccgaagcaggagaaggaccgatctcgcacctcgctaccaccgctctgcaaaggtacgacttgccctttatcactgatgaggtcaaaaagaccctcaaccggatctatcatcagaacagaaaagtccacgaaaagactgtgcgcactgctgcggccgcgatcatcctgaataacaacccgagctacatggacgtgaagaacatcctgctgtcaatcggagagcttccacaagaaatgaacaagtacatgctggcaatcgtccaggacattctcaggtttgagatgccggccagcaagatcgtgcggcgggtgctgaaggagatggtggcccacaactacgaccgattttcaagaagcggatcgtcgtcggcgtacacggggtacatcgagagatcgccgcgctctgcgagcacgtactccctggatatcctctactcgggtagcggcatcctcagaagatccaacctcaacatctttcaatacatcggaaaggcaggcttgcatggatcgcaagtggtcattgaggcgcaagggctcgaggcactcatcgcagcgaccccagatgaaggagaggagaatctcgactcttacgcaggcatgagcgcaatcctgttcgatgtccaactccggcccgtcactttcttcaatggatactccgatctcatgtcgaagatgttgtctgccagcggagatcccatcagcgtggtgaaaggactgattctgctgatcgaccattcacaggaactccagctgcagtcaggcctcaaggctaacattgaagtgcagggaggactggccatcgacatcagcggtgcaatggagttctccctttggtaccgtgaaagcaaaacccgcgtcaagaaccgcgtgaccgtggttattaccaccgatatcactgtcgactcgtcattcgtcaaggcggggctggaaacttcaactgaaaccgaggctggattggaattcatctccaccgtgcagttctcccaataccctttcctggtgtgcatgcagatggacaaagatgaggctccattcagacagttcgaaaagaaatacgaacggctgtcgactggccggggctacgtgtcccagaaacgcaaagagagtgtcctcgccggctgtgaattcccgctccaccaagagaattccgagatgtgcaaggtggtgttcgcaccacaaccggattcaacgtcgagcggatggttc

SEQ ID NO: 16865 - DNA, 2682 bp, Artificial Sequence
  Description of Artificial Sequence: Synthetic coding sequence
atgatactcctggctgtgctctttctctgcttcataagcagttatagcgcgagcgtgaagggccacacaaccggcctctccctgaataacgaccgcctctacaagctgacgtattctactgaagtcctcctggaccggggtaaaggcaagttgcaggacagcgtaggataccgaataagtagcaacgtggacgttgctctcctctggaggaatccagatggcgacgacgatcagttgattcagatcaccatgaaagatgtaaatgtggaaaatgtgaaccagcagcgaggagaaaaatctatttttaagggcaagtccccttctaagattatgggtaaagaaaatctggaggcactgcaaaggccaacactgctacacttaattcatggcaaggtaaaggagttttactcttatcagaatgaagccgttgcgatagagaacatcaagaggggcctggcgtccctgtttcaaacacagttgtcttctggcactacaaatgaggtggatatatcaggaaattgcaaggttacatatcaggcccaccaggataaggttattaagattaaggcattagatagctgcaagatagcaaggtctgggttcacaacaccaaaccaggttcttggggtctcttcaaaagctaccagtgttaccacatataagatagaagattcatttgtgatcgcagttttggccgaggagacccacaacttcggcctgaattttctacagactatcaaaggtaagattgttagcaagcaaaaacttgagctcaaaacaaccgaggctgggcctagactaatgtccgggaaacaggcagctgctatcataaaggccgtggatagcaagtacactgcaatccctattgtagggcaggtatttcagagtcattgcaagggatgccctagcctgtccgagctctggcgatctacccggaaatatttgcagcccgacaacctgagcaaagcagaggctgttcgaaactttcttgcttttatacaacacctgcggactgcgaagaaggaggagattctgcagatccttaagatggaaaacaaggaggtgcttccccagctggtggacgcagtgacatcagcccaaaccagtgactcactcgaggcaatactggacttcctggattttaaatccgacagctctataatcttacaggagaggtttctgtatgcttgcggctttgcaagccaccccaatgaggaactgttacgcgccttaatttctaagtttaagggatcaatcggatcgtcggatataagggagactgttatgattattaccggcaccctggttaggaagctgtgtcagaatgaaggatgcaagctgaaggcggtggttgaggcgaaaaagctaatcctgggggggctggagaaagccgagaagaaagaggatacacgaatgtatcttcttgctctgaagaacgcgctgctgccagaaggcattccaagcctactgaagtatgcggaggctggagagggcccgatctctcacctagccacaacagccctgcagagatacgacctgccttttattacagatgaggtgaagaagaccctcaatcgtatataccaccagaatcgcaaggttcacgaaaaaaccgtgagaaccgctgccgcagctatcatcttgaataacaacccatcttatatggatgtcaagaatattctgctttccatcggagagctgccccaggaaatgaacaagtatatgctcgcaatcgttcaggacatccttcgcttcgaaatgcctgcatcaaaaattgttcgcagggtgctgaaggagatggttgctcacaactatgatcgctttagcagatcaggtagctcatcagcctacactggctatatagagcggtcccctcggtccgctagtacttacagcctagacattctctattccggttccggtatccttcggcggtcaaacttgaacatctttcagtatatcggcaaggccgggctgcatgggagtcaggtggtgattgaggcacagggcctggaagcattgattgccgccactcctgatgaaggcgaagagaacctcgacagctatgctggcatgtctgctattcttttcgacgtccaactgcggccagtaacatttttcaatggctacagtgacttgatgtctaagatgctatccgcgagtggcgaccctattagtgtcgtgaagggactaatcctgctgattgatcatagccaggaactgcagctccagtccggactgaaggctaatatcgaagtgcagggtggtctggcaatagatatttcgggagctatggagttcagcctttggtaccgggagtctaagacacgcgtcaagaaccgcgtgactgtggtgatcacaactgatatcacagtcgacagctcttttgtgaaagctgggctcgaaacatccacagagactgaggcagggttggaatttatttccacagtccaattttcccagtacccatttcttgtgtgtatgcagatggataaagatgaggctcccttccgtcagtttgaaaagaagtacgaacgactcagcaccgggcgcggttacgtgagccagaaacgcaaggaatcagtcctggctgggtgcgagtttccactgcaccaggaaaactctgagatgtgcaaggttgtgtttgccccacaacccgattccacaagtagcgggtggttt

SEQ ID NO: 16866 - DNA, 2682 bp, Artificial Sequence
  Description of Artificial Sequence: Synthetic coding sequence
atgattttgcttgccgttctgttcctgtgttttatcagctcttactctgcgagtgtcaagggccacacgactggtttgtctctgaacaacgatcgcctgtacaagttgacttattccacggaggtgcttctcgaccgcggtaaaggtaaactgcaggatagcgtgggctatcgcatttcttccaacgtcgatgttgctctcctctggcgcaaccctgatggagacgacgaccaactcatccaaattactatgaaggatgttaatgtggagaacgtgaatcagcagagaggtgagaagtccatttttaaagggaagagccccagcaaaatcatgggtaaggaaaatctcgaagctcttcaaaggcccacattgctgcaccttattcacggtaaggtgaaagaattctattcttaccaaaatgaggcagttgctatcgagaacatcaagagaggactggcatcactcttccagacacaactgagctctggtacgacaaatgaagttgatatttcaggcaactgtaaggttacctaccaggcccatcaggacaaagttatcaagatcaaagcacttgacagctgcaagatcgcccgctccgggtttactacacctaaccaggtcctcggtgtctcatccaaagcaaccagcgtgacaacctataaaatcgaggattcattcgtgatcgctgtgctggccgaagagacgcacaattttggactgaactttctccagacaattaaaggaaaaatcgtgagcaagcaaaagttggaattgaagacaaccgaagcaggaccgcggctcatgtcaggtaagcaggccgccgccataattaaagcagtggatagtaaatacacagccatccccatcgttggacaggtctttcagtcacactgcaaaggctgtcccagtctttccgaactgtggcgctccacccgaaagtatctgcagcctgacaacctctcaaaagcggaagcagtgcggaatttcctggccttcattcagcacctccgcacggccaagaaggaggagatcctccagattctcaagatggagaacaaagaggtgttgccccaactggtcgacgctgtcacttctgcacaaacatctgattctctggaggcaatattggactttctggatttcaaaagtgacagttcaataattctgcaagagcgattcctctatgcctgcggttttgccagtcatcctaatgaagagcttcttcgggcactgataagcaagtttaagggtagcatcggctccagtgacatccgagaaactgtcatgatcattacgggtactctggtaaggaaattgtgccagaatgaagggtgcaaactgaaagccgttgtggaagccaaaaaactgatcttgggcggtctcgagaaggcagagaagaaagaagacaccagaatgtatctgttggcgctcaaaaacgcactgcttcctgaagggattcccagcctcctgaaatatgctgaggccggcgaggggccaatctcccaccttgctacaaccgccctccaaaggtacgacctgccatttatcactgatgaagtgaagaaaactctcaatcgaatctatcatcagaacagaaaggtccatgagaaaaccgttaggacagcggcggccgcaatcattttgaacaataatcctagttacatggatgtcaaaaacatactgctttcaatcggcgagctcccccaggagatgaacaagtacatgttggccattgtgcaggatatcctccgcttcgagatgcccgcctctaagatcgttcggagggtgttgaaagagatggtggcacataactatgatcgctttagccgaagtggttcatctagtgcatacactggctatattgagcgatctccgcggagtgcctctacctactccctggatatcctgtatagcggcagcggtattctccggcggtcaaatttgaacattttccagtatataggcaaggccggtttgcacggttcccaggtcgtgattgaagcacagggccttgaagccttgattgcagcgacccctgacgaaggcgaagagaacctggactcatacgccggaatgagtgccatcctcttcgatgtgcaactccgcccggtgactttcttcaatggctatagcgatctgatgtctaagatgctgtctgccagcggagaccccatatctgttgtgaaagggctgatcctgctgatcgatcatagccaggaacttcagctccaaagcggtctgaaggccaatattgaggtgcaggggggcctcgccatagatatatccggtgcgatggaattctccctgtggtacagagagtcaaaaacaagggtaaaaaaccgagtgaccgttgttattaccaccgacatcaccgtcgactccagcttcgtgaaggccgggctggagacatccactgagactgaagctggacttgagtttatttctactgtgcaattttcccaatacccatttctcgtgtgcatgcagatggataaggatgaggccccattcaggcagttcgaaaagaagtacgagcgactgtcaacaggtcgcggttatgtgtcccagaagaggaaagagagtgtcctcgcgggctgcgaattccccctccatcaggagaacagtgaaatgtgcaaagtggtatttgccccacagccagacagcacatcctctgggtggttc

SEQ ID NO: 16867 - DNA, 2682 bp, Artificial Sequence
  Description of Artificial Sequence: Synthetic coding sequence
atgattcttttagccgtcctattcctctgttttatttcgtcctattccgcatcggtcaagggacatactactggtctctcactgaataatgatcgtctgtacaaactgacctattcgacagaagtgttgctagatcggggaaaaggaaaacttcaagattctgttggctaccgtataagttcaaatgtggatgttgctctcctttggagaaatcccgacggtgacgacgatcaactgattcaaattactatgaaagatgttaacgttgagaatgttaatcagcagagaggtgaaaagagtatatttaaaggaaaatcgccaagcaagattatgggaaaagaaaacttagaagcgctgcaaaggcctacgctactccatctaatccatggaaaggttaaagagttctatagctaccaaaacgaagcggtcgcgattgaaaacataaaaagaggattggcatctctctttcagacacagctctcgtccggaacaactaatgaagttgacatcagtggaaactgcaaagtcacatatcaagctcaccaggataaggtaattaaaatcaaagctcttgatagttgcaaaatcgcccgctctggtttcaccacacccaatcaggttctaggagtttcctcgaaagccacgtctgtaacaacatacaagattgaagattcattcgtaattgcagttctagcggaagaaacacataacttcggattgaattttttgcaaacaataaaaggaaaaattgtcagcaaacaaaaattggagctcaaaacaaccgaagcgggtccaaggctgatgagcggcaaacaggcagcggctataattaaagcagttgattcaaaatacaccgctattccaattgttggacaagtttttcagtctcactgtaaaggatgtccttccctatccgaattgtggcgatctacacggaagtatctccagccagataacttgtccaaagcagaggcagttagaaattttctggcattcatccaacacttacgcacagcaaagaaagaggagattttgcaaattctaaagatggagaataaggaagttcttccacagttggtcgatgctgttacatcggcgcaaacctcagattccctcgaagctattttagattttcttgactttaagtcggatagttctataatactccaagagcgtttcctttacgcatgtggttttgctagtcacccgaatgaagaactgcttagagcacttatttcaaagtttaagggatctataggatcgagtgacatccgtgagaccgtcatgatcattacaggaacgctcgttagaaaattgtgtcagaatgagggatgtaagctcaaggccgttgtggaagctaaaaaactaattttaggaggacttgaaaaggcagagaaaaaggaggacacaagaatgtatctgctggcattgaagaatgcgctgttgccagaagggattccaagcttactaaagtacgcggaagcaggtgaagggccaatttcacatcttgccactactgcgcttcagcgctatgacttaccgttcataaccgatgaggtcaaaaaaacacttaatcggatttatcaccaaaatcgcaaggtgcatgaaaaaactgtccggacggctgctgccgccattatattgaataacaatccaagctatatggacgttaaaaacatcttgttgtctattggagagctacctcaggaaatgaataaatacatgctagccattgttcaagatattcttcgttttgagatgcctgcgagtaaaattgttagaagagtcttaaaagaaatggtcgcacataattacgatagattctcgcgatcgggatcttcttcagcgtatactgggtatattgaacgttcaccgcgttcggcttccacttattccttggacattctgtattctggatcaggaatccttcgcagatcaaaccttaacatatttcaatatattggaaaggctggattgcatgggtcccaggtggtcatagaggctcagggactagaagcacttattgctgctaccccagatgaaggagaggaaaatctcgattcatatgctggaatgtcagcaatcctgtttgacgtgcagctcagaccggttactttcttcaatggatacagtgaccttatgtctaaaatgctctcagcctcaggggatccaattagtgttgttaagggattgattcttctgatcgaccactctcaagaacttcagctccaatcgggattgaaggctaatattgaggttcaaggagggctggcgatcgatatcagtggagcaatggaattttcgctgtggtatcgtgagagtaagacaagagtaaagaatcgggttaccgttgttattactaccgacattacagttgattcgagtttcgtcaaggcgggattggaaactagtaccgaaactgaggcaggacttgaattcattagcactgttcagttttctcagtacccatttctcgtatgcatgcagatggataaggatgaagcaccattccgccaattcgagaagaaatacgagaggcttagtacaggacgaggatacgtgtcacagaaacgaaaggagtcggtcttggctggatgcgaatttccactacaccaggaaaactccgaaatgtgtaaagtagtctttgctccacaaccagactcaacatcatcgggatggttc

SEQ ID NO: 16868 - DNA, 2682 bp, Artificial Sequence
  Description of Artificial Sequence: Synthetic coding sequence
atgattttacttgcagttttatttttatgttttattagttcatattccgcctctgtaaaaggtcatactactggattatcattaaataatgatcgactttataaattgacttattctacagaagttttattagatcgtggtaaaggaaaacttcaagattctgtagggtatagaatttcaagtaacgtagatgttgctttactctggagaaatccagatggagatgatgaccaacttatacaaattacaatgaaagacgttaatgttgaaaatgtaaatcaacaaaggggtgaaaaatcaatatttaaaggtaaatctccaagtaaaattatgggaaaggaaaacttagaagctttgcaaaggcctactctattacacttaattcacggaaaggttaaagaattttattcataccaaaacgaagcagttgctatcgagaatattaaaagaggattagcttctctttttcagactcaactttcttctggtactactaatgaggttgatatctcaggaaattgtaaggtaacataccaagcacatcaagataaagtaattaaaattaaagctttagactcatgtaaaatagccagaagtggttttactacaccaaatcaagtattaggagtctcttcaaaagcaacaagtgttacaacttataaaattgaagattcatttgtaatagctgttttagctgaagaaacacataattttggactaaattttttacagactattaaaggaaaaattgtttccaaacaaaaattagaattaaaaacaactgaagcaggaccaagacttatgagtggtaagcaagctgctgcaattattaaagccgtagattcaaaatatacagcaataccaattgttggacaagtatttcaatctcattgtaaaggatgtccttcattatctgaactttggagatctacaagaaagtatttacagccagataatcttagtaaggcagaagcagtaagaaattttcttgcttttattcaacatcttcgtactgcaaaaaaagaagaaattttacaaattcttaaaatggaaaataaagaggtattaccacaattagttgatgctgtaacctcagctcaaacatcagacagtttagaagctattttagatttcttagactttaaaagtgattcatctataattttacaagaacgatttctttatgcttgtggatttgcatcacatccaaatgaagaattactccgtgctttaatttcaaagtttaagggtagtattggtagttctgatattagagaaactgttatgataattactggaacattagtaagaaagttatgtcaaaatgaaggttgtaagttaaaagcagttgttgaagcaaaaaaattaattttaggaggattagaaaaagctgaaaaaaaagaagacactaggatgtatttgcttgcacttaaaaatgctcttcttcctgaagggattccaagcttacttaaatatgcagaagctggagaaggaccaatatcacatttagcaactacagcacttcagagatatgatttaccatttattacagatgaagtgaaaaagactttgaatagaatttatcatcaaaataggaaagttcatgaaaaaacagttagaactgcagcagcagcaattattttaaataataatccaagttatatggatgttaaaaatattttattatctattggagaattaccacaagaaatgaataagtatatgcttgctattgttcaagatattcttagattcgaaatgcctgcatcaaaaattgtaagacgagtcttaaaagaaatggttgctcataattatgatagattttcaagatcaggttcttcctcagcatatacgggatatattgaaagaagtccacgttctgcatcaacttattctttagatatactttattctggaagtggaattttaagacgtagtaatcttaatatatttcaatatattggaaaagcaggacttcatggttcacaagttgttattgaagctcaaggtttagaggctcttattgctgcaacaccagatgaaggagaagaaaatcttgattcatatgctggtatgtcagcaattttatttgatgtacaattaagaccagttactttttttaatggatatagtgatttaatgtcaaaaatgttatcggcatcaggtgatccaattagtgtagttaagggattaattttattaattgatcactcacaagaacttcaacttcaatctggactcaaagctaatattgaggttcaaggaggtctagcaatagatatttcaggtgctatggaattttcattatggtatagagaaagtaaaacaagagttaagaatagagttacagttgttataactacagacattactgttgactcatcatttgttaaagcaggtcttgaaacatcaacagaaacagaagcaggattagaattcatatcaactgttcaatttagtcaatatccattccttgtttgtatgcaaatggacaaagatgaagctccatttagacaatttgaaaagaagtatgaaagattatccactggaagaggttatgtttcacaaaaaagaaaagaatccgttttggcaggatgtgaattcccacttcatcaagaaaattccgaaatgtgtaaagtggtttttgcaccacaaccagattcaactagttctggatggttt

SEQ ID NO: 16869 - DNA, 2682 bp, Artificial Sequence
  Description of Artificial Sequence: Synthetic coding sequence
atgattttactagcggtgcttttcctgtgttttattagttcctatagcgcctctgtcaagggccacactacaggtttaagcctgaataatgatcggctctacaagctgacttactccacggaagttttgctcgatcgagggaaggggaaactccaggactccgtgggttatcgtattagctcaaacgtggacgtagctctgttatggcgcaaccctgacggcgatgatgaccagttgatacagattactatgaaagacgtgaatgtggagaatgtcaaccagcagcgtggagagaaatccattttcaaggggaagagtccgagcaaaattatgggaaaggaaaacctggaggcgcttcagagacctacgctgcttcatttgattcatggaaaggtgaaggaattctacagttatcagaacgaggctgtggccatagaaaatattaagcggggactcgctagcttgtttcagacccaactcagttctgggaccacgaacgaggtggacatttccggaaactgcaaggtaacttaccaggcccaccaagacaaggtaattaaaataaaggcattagactcctgtaaaattgctcggagtggattcaccacaccaaatcaggtcttaggcgtctctagcaaagccaccagcgtaactacttacaagatagaggactcattcgtgattgcagtgctggccgaagagacccacaacttcgggttgaattttctgcaaactatcaagggcaagatagtgagtaagcagaagctagaactgaagaccaccgaggccggaccccgcttaatgtcagggaaacaggccgcagccataatcaaggccgtggactcaaagtacaccgcaatccccatcgtcggacaagtgtttcaatcccattgcaaaggctgtccgtcactgagtgagctctggcggtctaccagaaagtacttgcagccagataacctttccaaagctgaagcagttcgaaacttcctggctttcatccagcacctcaggactgcgaagaaggaggaaatcctacaaatcctgaaaatggagaacaaggaggtattaccccaactggtggatgctgttacatcagcccagacctccgactcgctggaggctatccttgatttcctcgacttcaagtccgattcaagtataatcctccaggagcggttcctctacgcctgtggtttcgccagccatcctaacgaagagctgctcagggcgttgatctctaaatttaaggggagtatcgggtcttcagatattcgcgagacagtcatgattattacagggacacttgttagaaaactctgtcaaaacgagggatgcaaactgaaagctgttgtagaagccaagaaactgatcctcggcggattggagaaagctgaaaagaaagaagatacccggatgtacctgttggccttgaagaatgcactgcttcccgaggggatcccctctttattgaaatatgcagaagccggagaggggcctatctcccacttggctaccactgcactacaacgctacgacctgcccttcattacggacgaggtgaagaaaacactgaataggatttaccatcagaaccgtaaggtgcacgagaagactgttaggaccgccgctgcagctattattttgaacaataacccatcttacatggacgtgaaaaacattctgctgagtatcggcgagttacctcaagagatgaacaaatatatgctcgcaattgtccaggatatattacggtttgaaatgcccgcgagtaaaatcgtgaggcgggtgctgaaagaaatggtcgcgcacaactacgaccgatttagccggtcaggatcttccagcgcatatacaggctatatcgagagatcaccccgatctgcttccacttacagcctcgacatcttgtattctggcagtgggattctacggagaagcaacctcaatatatttcagtacatcgggaaagccggcttacacggatcccaggttgtcatcgaagcccagggcttggaggccctaatcgcagccacgccggacgaaggcgaagagaacttggatagttacgcgggcatgagtgcaatcctgttcgacgtccaactgagacccgttaccttctttaacgggtattccgacctcatgagtaagatgctgtcagcatcaggcgacccaatatcggtggtaaagggcctcattttgttgattgaccacagccaggagctgcaacttcaatccggcttaaaagctaatatagaagttcagggaggactggcgatcgacatttcgggcgccatggaattttcattatggtatcgggagagcaagacgcgtgtgaagaacagagtgaccgtcgtgattactaccgacattaccgtggacagctctttcgtcaaggcaggccttgaaacaagtacagagacagaggctggattggagttcattagcacagtccagttcagccagtacccgtttctggtttgtatgcagatggacaaggacgaagcgcccttccgacagttcgaaaagaaatacgagcgccttagcacgggtcgcggatacgtatcccagaaacgtaaagagtctgtgttggccgggtgtgaatttcccttgcaccaagagaattctgagatgtgtaaagtggttttcgccccacagcccgatagcacaagcagcggatggttt

SEQ ID NO: 16870 - DNA, 2682 bp, Artificial Sequence
  Description of Artificial Sequence: Synthetic coding sequence
atgatcctgttggcagtcctatttctttgcttcatctctagttattcggcatccgttaaaggacatactaccggcctgagtctgaataatgacagactgtacaaattaacatatagtacggaggtgctgctggaccgtgggaagggaaagctgcaggactccgtgggatacagaattagttcaaacgtggacgtggctcttttatggaggaatcctgacggggacgatgatcaattgatccaaattacaatgaaggacgttaatgtcgagaacgtaaatcagcagcgcggagaaaagtccatcttcaaggggaagtcaccgtccaaaataatggggaaggagaacctggaggcattgcagcgccctactcttctgcacctaatacatggaaaggtcaaagaattttacagctaccagaacgaggctgtagccattgaaaatataaaacggggcctggcatcattattccagacccagctgtcttctggcaccaccaatgaggtggatatctcaggtaattgcaaggtgacttaccaagctcatcaggacaaagtcattaagattaaagctctcgacagttgcaagatcgcgcgctccggattcactacccctaatcaggtcttaggggtctcctcaaaggctacatcagtaaccacatacaagattgaagactcttttgtcatcgcagttctcgcagaggaaacacataactttggcctaaatttcttacagaccataaaaggtaagatagtctcaaagcagaagcttgagctaaaaacgacagaggcgggcccgcggctgatgtctggaaagcaggccgccgcgattattaaggctgtcgacagcaaatatacggcaatccctatagtcggccaagtgttccaatcccactgtaaaggatgtccgtccctgtccgaactttggcggtcgactaggaaatacctgcagcccgataatctgtccaaagctgaggctgtgagaaactttcttgcgtttatacaacacctccgcaccgccaagaaggaagagatcctccagatacttaagatggaaaacaaggaggttctcccccagctcgtggatgctgtaacatccgctcagacgtcagatagcctcgaagcaatactcgattttctcgacttcaagagtgattctagcataatcttgcaggagcggtttttgtatgcctgtggtttcgccagccatcctaacgaggagctgctgagggcccttatatcaaaattcaaggggtctataggcagtagtgatattagagaaacggtgatgatcattacagggaccctcgttagaaagctgtgccagaacgaagggtgtaaactcaaagccgtcgtggaggcgaaaaagctcattctcggcggtttggaaaaggcggaaaaaaaagaagacacacgtatgtacctgctggctttgaaaaacgctcttcttcctgaagggatccccagcctgctgaagtatgcggaagccggcgaaggcccaattagccacctagctactactgctcttcagagatacgatcttccatttataactgacgaagtgaaaaaaacgctgaacaggatatatcatcagaataggaaggtgcatgagaagacagtgcgtaccgcggccgccgccattattctgaataataatccttcttacatggacgtgaaaaatattctgctttcaatcggagagctgcctcaggaaatgaataagtatatgctggcaattgtgcaggatatactgaggtttgaaatgcctgcatcaaagatagttcgtcgggtgctcaaggaaatggtggctcacaattacgaccgcttctcccgctcaggatctagcagtgcatatacgggctacattgagcgatccccccgctcagcctccacatattccctagacattctatatagtggatcgggcatactgcgacggagcaacttgaatatctttcagtacatcggaaaggcagggttgcacggctcacaggtggtaattgaggcccaggggctggaagccctcattgctgctaccccagacgaaggggaggagaatttagactcctatgctgggatgagtgctattttgtttgatgttcaactgcggccagttaccttttttaacgggtactctgacctgatgtcaaagatgctgtccgcatccggcgatcctatcagtgttgtgaagggcttgattctactgatcgatcatagccaggagctccagctccagagcggtctaaaagcgaacattgaagtgcaggggggactagccattgatatttctggggccatggagttctcattgtggtacagggaatctaagacccgtgtgaagaaccgcgtgacggtcgtcatcacaaccgatatcactgtggattcgagctttgtcaaggccggcctcgaaaccagcaccgaaacagaagcaggactggaatttatctccacagtgcaattttcacagtaccccttcctcgtgtgcatgcagatggataaggacgaggcgcccttcaggcagttcgagaaaaaatatgaaagactctcaacagggagagggtacgtgtcacagaagcggaaggagagcgtgttagccgggtgcgagtttccattgcaccaggagaatagcgagatgtgcaaagtcgtgttcgcaccgcagcctgactcgacctcctctgggtggttc

SEQ ID NO: 16871 - DNA, 2682 bp, Artificial Sequence
  Description of Artificial Sequence: Synthetic coding sequence
atgattctgctagcagtccttttcttgtgttttatctcttcatacagcgccagtgtgaaaggacataccactggcctctcactgaacaacgaccggctttataaactcacatattcaactgaggtgctgctcgaccgaggcaagggcaagttacaggacagcgttggataccggatttcaagcaatgtagatgtggctctgttgtggaggaaccccgacggggacgacgatcagctgattcagattaccatgaaggacgtgaacgtcgaaaatgttaatcagcagcggggcgagaaaagtattttcaaaggcaaatcaccatcaaagataatgggcaaggaaaatctggaggctctgcagaggccaactctgttgcacctcatccacggaaaggtcaaggaattttattcctatcagaatgaggccgttgcaattgagaatattaaaaggggactggcttctctgttccagacacagttgtcatccgggaccaccaatgaggttgacatctccgggaattgtaaggtcacctatcaggcacaccaggacaaagtgattaagatcaaggcgcttgactcttgtaaaatcgccaggtccggtttcactacaccaaatcaggttcttggcgtatcaagtaaagcgacctcggtgactacttacaagatcgaggattcattcgtgattgcagtacttgctgaagagactcataactttggactcaacttcttgcagactattaaaggcaagattgtgtctaagcagaaactggagctgaagactaccgaggccgggccgaggctcatgtctgggaagcaggctgctgctattattaaggctgtggactccaaatataccgccatccccatcgtggggcaggtgtttcaatctcactgcaaggggtgcccttctctgtctgaactttggagatcgacaaggaaatacctgcaaccagataatctttctaaggcagaagctgtgcgcaatttcttagccttcatccagcatctgcggacggctaaaaaagaggagatactccagatactcaagatggagaacaaggaagttctaccacagcttgtagacgctgtaacctccgctcaaacttccgatagcctagaggccattctggactttctggacttcaaatctgattcctcaataatattacaggaacgctttctctatgcatgcggatttgcttcccaccccaacgaggagctgctgcgtgctctcatttctaaattcaaaggatcgattgggagctctgatattcgggagactgtaatgatcataaccggtacccttgtcaggaagctctgccagaatgagggttgcaagctgaaggccgtcgtggaggctaaaaagttgatactaggagggcttgagaaggccgaaaaaaaagaggacacccggatgtatctgctcgcactgaaaaacgccttacttcccgagggaattccatctctactcaaatacgctgaggcaggggagggcccaatcagccatctggcaaccacggcactgcaaagatacgatctccctttcattaccgatgaagttaaaaagactcttaacagaatctatcatcagaatcggaaggtacacgaaaagactgtgagaacagccgcggcagccattatcttgaacaacaacccaagctacatggacgttaaaaacatactgcttagcatcggtgagttgccccaggagatgaacaagtacatgcttgctattgtccaggatattttgcggtttgaaatgcccgctagcaaaattgtgcgcagagtcttgaaggagatggttgcacacaattacgatagattcagcagatctgggagctcctcagcctacaccggttatatcgaaaggtcccctagatctgcttctacttactctctagatatcctgtattccggctctgggattctccgacggtccaacctaaatattttccagtacattggcaaagcggggctgcacggttctcaggttgtgatcgaagcgcaaggcctcgaagccctgattgcagccactcccgacgagggagaagaaaatctggactcatatgcagggatgtcggcaatcctcttcgacgttcagctgcggcccgtgacattttttaacggttactccgacttgatgtccaagatgctgtctgcctcgggagaccccatttccgtggtgaaggggttgattctgctaattgatcatagccaagaacttcagttgcagtcaggactgaaagccaacattgaggtgcagggcggccttgccatcgacatctcaggcgccatggagttttcgttgtggtaccgtgaatccaaaacccgagtgaagaatcgggtaacggtagtaataactacggatattaccgttgatagctcttttgttaaagccggcctggaaacatcaaccgagaccgaggccggcttggagttcatttctaccgtccagttttcgcagtacccatttctggtctgtatgcagatggacaaagatgaggcgccattccgtcagttcgaaaaaaagtatgagcggcttagtactggcaggggctacgtgtctcaaaaaagaaaggagtctgttctggctggatgtgagtttcccctgcatcaggagaatagcgagatgtgcaaggtcgtctttgctccgcaaccagactcaactagctctgggtggttc

SEQ ID NO: 16872 - DNA, 2682 bp, Artificial Sequence
  Description of Artificial Sequence: Synthetic coding sequence
atgatcctcctggcagtcctttttctgtgcttcatttcgtcctatagtgccagtgtcaaggggcataccacaggcctctcactgaacaacgacagactgtataagttgacctacagcactgaggtgctcctagatagagggaaaggcaagcttcaggacagcgtgggatatcgaatttcctctaatgtagatgtggcccttttgtggaggaacccagacggcgatgatgatcagctcattcaaattacgatgaaagacgtcaacgtggagaatgtcaaccagcaacgtggggagaagagcattttcaaaggtaagtctccctcgaaaatcatgggaaaagaaaatttggaggcgctgcagagacctacgctgttacacctgatccacgggaaagtaaaggaattttatagttaccagaatgaagctgttgccatcgagaacataaagcggggcctcgcttcgctattccaaactcagctgtcttcaggtaccaccaacgaggtcgacatatcaggaaactgtaaggtaacttatcaagcccatcaggacaaagtgattaagatcaaagcactcgacagttgcaaaattgctcggtcagggttcaccacccctaatcaggtgctgggcgtcagttccaaagccacatccgtgaccacttacaaaatcgaagactccttcgtcatcgccgtgttagctgaggagacccacaactttgggctcaatttcctgcagaccattaaaggaaagattgtgtcaaagcagaagttggagctcaagacaacagaggccggccctaggcttatgtccgggaaacaggccgccgcaatcattaaggccgttgactcaaaatacacggccattcccattgttgggcaggtattccagtctcactgcaaggggtgtccgagccttagcgagctgtggagaagcacccggaagtatctgcagccagataatctctcaaaggcggaggctgtccggaactttttggcatttatacagcatctgaggacggccaaaaaagaggagatcctgcagatcctgaaaatggagaacaaggaggtgttacctcagctggtcgacgccgtaaccagcgctcagacctccgattccctagaggccatcctggattttctcgatttcaaaagcgacagcagcataattttgcaggaacgctttctatacgcctgcgggttcgccagccaccctaatgaggaactgctgagagctctgatatccaaattcaagggatcaatcggctcctccgatatccgggagactgtgatgatcatcacaggaacgttggtcagaaagttgtgccaaaacgagggctgtaagctgaaggcagtggtggaagcgaaaaaactgatcctgggcggcctggagaaggcagaaaaaaaggaagatacacgcatgtatctgctcgccctcaaaaatgctttgttgcccgaaggcatcccctcactcttgaaatatgccgaggcgggagagggccccatctcgcacttggccaccaccgccctgcagaggtatgacctgccttttatcaccgatgaggtcaaaaaaactcttaacaggatttatcatcagaaccgcaaggttcatgagaagacggtccgcactgcagccgctgcaatcattctgaataacaatccgagttatatggatgttaagaatattctcctgtcgatcggggagttaccgcaagagatgaacaaatatatgctggctattgtacaagatatcctgcggttcgagatgcccgcatcaaaaatcgttcgtcgagttctgaaggagatggtcgctcacaattacgataggttctcacggagcggcagcagcagcgcttacaccggctatatagagcgatccccacggagcgctagcacatattccctggatatcctgtattctgggtctgggatcctgagaaggagtaatcttaatatcttccagtacatcggaaaagccggcctgcacggctcccaggttgttattgaagcacagggactggaggcactgattgccgctaccccggatgagggcgaagagaatttggactcatacgccggcatgtctgctattctcttcgacgtccagctgcggccagttacattcttcaatgggtactcagatctaatgagcaagatgttgagtgcttccggagacccgatctctgttgtaaaggggttgatcctcctgattgaccattcgcaggagttgcaacttcagtcaggcctgaaggctaatatcgaggtgcagggaggcctagctattgatatctcaggagcgatggaattcagcctatggtaccgggagagtaagacgagagtcaagaacagggtgactgtggttattacaacagatataacggtggatagttcttttgtaaaggccggactggaaacctctactgagacagaggccgggcttgagtttatttccaccgtgcagttctctcaataccctttccttgtttgcatgcagatggataaagacgaagccccttttcggcaattcgagaaaaaatacgagcggctgtcgactgggcggggttacgtgagtcagaagcggaaggagagcgtgctggctgggtgtgaatttccactgcaccaagaaaacagcgagatgtgtaaagtggttttcgccccccaacctgatagcacctcaagtggctggttt

SEQ ID NO: 16873 - DNA, 2682 bp, Artificial Sequence
  Description of Artificial Sequence: Synthetic coding sequence
atgatcttactggctgtcttatttctttgttttataagctcgtattctgcatctgtgaagggccatactaccggcttgtctctgaacaatgataggctatacaagttgacttactcaacggaagtgcttctggatcggggcaagggcaaactgcaggattctgtggggtatagaatttcttctaatgtggatgtggctctgctgtggcgaaaccccgatggcgacgacgaccaattaattcaaatcactatgaaagacgtaaacgtcgaaaacgtcaaccaacagaggggagagaaatctattttcaaagggaagtccccaagcaagattatgggaaaagaaaatctcgaggcactccagaggccgacccttctccacctcatccacggcaaagtaaaggaattttattcttatcagaacgaagccgtggccattgaaaacattaaaaggggtctggcaagtctcttccagacacagctgagctccggcacgaccaatgaggtcgatatttccggaaactgtaaagtgacatatcaggcgcaccaggataaggtcattaagatcaaagccttggactcttgtaaaatagccaggtccggctttaccacacccaatcaggtgctgggcgtgagcagtaaggcgacctccgtaaccacctacaagatcgaggactccttcgtaattgcagtgctggcggaggagactcacaattttggtttaaactttctgcaaacgattaaaggaaagatcgtttctaaacagaagctggagctgaaaactactgaggctgggcctagattaatgagcggcaaacaggccgctgctatcatcaaggccgttgattctaagtataccgctatacccatcgtgggccaggtttttcagtcacactgcaagggctgcccttccctgtcggagctgtggcggagtactcgtaaatatctgcagcctgacaatctgtcaaaagctgaggcggtacgcaattttcttgcctttattcagcatctccgtacggccaagaaagaggagatactccagatcctgaaaatggaaaataaggaggtcctgcctcagttagtcgatgctgttacatcagcacaaacatcagactcgctcgaagcaatcttagatttccttgattttaaaagcgacagctccattattctccaggaaagatttctctatgcgtgtggtttcgcatcacaccccaatgaggaattacttcgggccctgatctcaaagtttaagggctccatcggatcgtccgatatccgggaaacggtgatgatcatcacaggcaccctggttcgtaaactgtgtcagaacgaaggatgtaaactgaaggcagtggtcgaggccaaaaagctgatcctcggggggctggagaaagccgagaagaaagaggacaccagaatgtaccttttggccctcaaaaacgcactactgcccgagggaatcccttccctgctcaagtacgcggaagccggtgagggccctatctcacatctggcaacaacggccctccagaggtacgacctgcctttcattacggatgaggtcaagaagacacttaaccgtatctaccatcaaaaccgcaaagttcatgagaagactgtacgaactgccgccgctgcaattatccttaacaacaacccgtcctatatggatgttaagaatatcctcttgtctatcggtgaactgccgcaagagatgaacaagtacatgctcgctatcgtgcaggacatcctgcggtttgaaatgcccgcctccaaaatcgttcgcagagtgcttaaggaaatggtggcgcacaattacgataggttctctcggagcggcagcagcagcgcttataccggatacatcgaacgttctccacgcagtgcgtcaacatattctttagacattctgtattccgggagtggcatcctccgccgaagcaatctgaacatctttcagtatattgggaaggcaggactgcatggctctcaggttgtcatcgaagcgcaagggttggaggcgctaatcgccgcaacgcccgacgagggtgaagaaaacctcgattcatacgccgggatgtccgccattctttttgacgtgcaactgagacctgtcacattctttaatggctactctgacctaatgtctaaaatgctgagcgccagcggggaccctatatctgtagtcaaggggctgatcctgttaattgaccactcccaggaattacagttacaatctggactaaaagccaatattgaggttcagggcggactcgctatcgacattagtggggccatggaattcagcctatggtatcgcgagagcaaaacacgcgtcaaaaaccgcgtgaccgtcgtgatcactaccgacatcaccgtcgattcaagcttcgtcaaggcgggtctggagacctcaacagagacagaagccggactcgagttcatctccacagtgcagttcagccagtatccctttttggtgtgtatgcaaatggacaaagatgaggcaccattcaggcagttcgaaaaaaaatatgagaggctttctaccgggagaggctacgtttcacagaaacgaaaggagtccgtcttggcagggtgtgagtttccgttgcatcaggagaacagtgaaatgtgcaaggtggtcttcgctccacaacccgatagcactagtagtgggtggttt

SEQ ID NO: 16874 - DNA, 2682 bp, Artificial Sequence
  Description of Artificial Sequence: Synthetic coding sequence
atgattctattggcagttttgtttttatgctttatctcgagctattccgctagtgtcaagggtcacacaacgggtctttcgttaaataacgatcgcctctataagctgacttattcgactgaggttctgctagatagaggtaagggcaaactgcaggattcagtgggataccgcatatctagtaatgtcgatgttgcgttgctgtggagaaatccggacggagatgacgaccaattgatccaaatcactatgaaggatgttaatgttgaaaatgttaatcagcagagaggcgaaaaatcaatttttaaaggaaaaagcccctcgaagataatgggtaaagagaatctagaagccctccaacgtccaacgttgttacatcttatacacggaaaggtaaaggaattttatagctaccagaacgaggctgtggcaatcgagaacataaaacggggcttagcttcactgtttcaaacccaattatcaagtggtactacaaatgaagtggatatctctggcaactgcaaggtcacgtaccaagctcatcaggataaagttatcaaaattaaggcacttgattcatgtaagattgccagatcagggttcactactcctaatcaggttcttggagtgtcctccaaggcaacaagcgttacaacatataagatagaagatagttttgtgatcgcagtgctggctgaggagactcataattttggactaaatttcttgcagacgattaaagggaagattgtttccaaacagaaacttgaactcaaaactacggaagccggtccaaggctcatgagcggtaagcaagctgctgcaatcataaaagccgtcgatagtaagtacacagccatcccgatcgtaggtcaagtttttcagagccactgtaaaggatgcccttcactctctgagctttggaggtctaccagaaagtacctccagcctgacaacctttctaaggccgaggctgttcgtaacttcttggcgttcatccagcacttgaggactgctaagaaagaagaaattttgcaaatattgaagatggaaaataaggaagtgttgcctcagctggtagatgcggtcacgtccgcgcagacatcagactcacttgaggcaattcttgatttcttggattttaaatctgacagctccattattcttcaggagcgtttcttatacgcttgtggttttgctagccacccgaatgaggaactgcttagggccctgatctcaaagttcaagggttctataggctcctctgatataagagaaactgtaatgattataaccgggaccttggttagaaaattgtgtcaaaatgaaggttgcaaattgaaggctgttgttgaggctaagaagctcattctcggcggacttgaaaaagcagagaagaaggaggatacccgaatgtatcttctcgcactcaaaaacgcattacttccagagggaataccttcgttgctcaaatatgcagaagctggtgaggggccaatatcacatcttgctactaccgctctgcaaaggtacgatctgcccttcatcaccgacgaggttaaaaaaactcttaaccgtatttatcatcagaatcggaaggttcatgaaaagacagtgaggactgctgccgctgctatcattttgaataataatccatcatatatggatgtgaagaacatcttgttgtccattggtgagctgcctcaagaaatgaataagtacatgcttgcaattgttcaagatattcttcgtttcgagatgccagctagcaagatagtcagaagggtgctaaaagaaatggttgctcacaactatgacaggtttagccggtcaggatcttcctcggcttatacgggatatatcgaacgaagccctaggtcagcctctacatactctcttgatatcctgtactccgggtctggcattttgcggaggagtaacttgaacatcttccaatatattggtaaagccggactgcatgggtctcaggtggttattgaagctcaaggcctcgaggccttgatagcagccactcccgacgagggcgaggaaaaccttgacagttatgccggtatgtcagccattttgttcgatgtacagctaagaccagttacattctttaatggatattccgacttaatgtctaaaatgttaagcgccagtggagatcctattagcgtagttaagggtttaattcttcttattgatcactcacaggaacttcaattgcaaagcggtctgaaggctaacattgaagtgcagggagggttggcgattgacatttcaggtgcaatggaattctctttgtggtaccgcgagagtaagacaagggttaagaatcgggttaccgtggttataaccacagacattaccgttgactcttcttttgtcaaggctggactcgagactagtaccgagaccgaagctggcttagaatttatcagtaccgtccaattcagccaatatccattcttagtctgtatgcagatggataaggatgaagccccattccgtcaatttgaaaagaagtatgagcgtctctccacaggtcgagggtacgtgtctcagaaacggaaagaaagcgtgctcgctggatgcgaattcccgctccatcaagagaattccgaaatgtgtaaggttgtttttgcgccccagccggattcgacttcgtccggttggttt

SEQ ID NO: 16875 - DNA, 2682 bp, Artificial Sequence
  Description of Artificial Sequence: Synthetic coding sequence
atgattctgcttgcagtgctgtttctgtgcttcattagctcatattccgcctcagtgaaagggcacactacaggacttagcctgaataacgatcgcttgtataagctgacctattctacagaagttctcctcgacagggggaagggcaagttgcaggatagtgttgggtataggatttcatcaaacgtggacgttgcactgctctggcggaacccagacggcgatgacgaccagctcattcagataaccatgaaggacgtcaacgtcgagaatgtgaaccagcaacggggcgaaaagtcaattttcaagggaaagtctcccagcaagattatgggtaaggagaatcttgaggccctgcagcgccccaccttattacacctgattcacggtaaagtgaaagaattctattcgtatcagaacgaagccgttgccattgaaaatataaaacgcggcctggccagcctcttccagacccagctttcttccggcacaactaatgaggtggatatctcaggtaattgcaaggtgacgtatcaagctcaccaggataaggtgattaaaatcaaggcactcgatagctgcaaaattgccaggtcgggctttacaacccccaatcaggtgctaggagtaagctccaaggcaacctctgtgactacatataagatagaagattcatttgttattgcggttcttgccgaagaaacacacaatttcggcctaaattttctgcagaccatcaagggcaagattgtgagcaagcagaagctcgaactgaagactacggaagctggcccacgtctgatgtctggcaagcaagcagcagcaatcatcaaagctgtggacagcaagtacaccgcgatacctatagttggccaggtctttcagtctcactgtaagggttgtccctccctatccgagttatggcggtctacacggaagtacctacaacctgataatctgtctaaagccgaagcggttcgcaactttctcgcctttattcagcatttaaggactgcaaagaaggaggagatactgcagatccttaagatggaaaataaagaagtgctgccacagctcgtggacgccgtcaccagcgctcagacgtctgactcgctcgaggccatcctggattttctggattttaagagcgactccagtatcatcctgcaggagcgctttttatatgcttgcggattcgcctcccatccaaatgaagaactgctcagagcgctgatctcaaaattcaagggcagtatcggctcgtccgatatacgagaaaccgtgatgatcatcacaggaactctcgtgcgcaagctttgtcaaaacgagggttgtaaattgaaggcagtcgtggaggctaagaagttgattctggggggactagaaaaggcggagaagaaggaggatacccgcatgtacctccttgctctgaagaatgccctcctgcctgaggggattccttctttgctcaagtacgcagaggccggcgaggggccaatctctcacctggctactacagccctgcaacgctacgatctccccttcatcactgacgaagtaaagaagactctgaaccggatctatcatcagaacagaaaggtgcatgaaaagacggttcggactgctgctgcggcaattattttgaacaacaatcccagctatatggatgtgaagaacatccttctcagtatcggcgaactccctcaggaaatgaacaagtacatgcttgccatcgtccaagatatccttagatttgaaatgcccgcttctaagatcgtacggcgcgtgctgaaggaaatggtcgcgcacaattacgatagattctcacgctctggcagtagttctgcctacactggatatatagagcgctcacctcgctccgcttctacatacagtctcgacattctatacagcggaagcgggattcttcggaggtctaacctcaacatattccagtatatcggtaaggctggtctgcatggctctcaggtagtgattgaagctcagggcctcgaagccttgatcgctgcaacacccgacgagggagaagagaatctggacagttatgcaggcatgtccgctatcttgttcgacgtgcagctgcgtcccgttacgttctttaatggctattctgatctgatgtctaagatgctcagcgccagcggcgacccgatctcggtagtgaagggtttaatattgctgattgatcacagccaggagctccagctgcaaagcggactgaaggccaatattgaggttcaggggggattggccatagacatcagcggggcaatggagttcagcctgtggtatagggaatcaaagacgagagtgaaaaaccgagtgacggttgtcataaccacggacattaccgttgattcaagctttgtcaaagccggtcttgagacatcaacagagacggaggcaggactggaattcatctctaccgtacaatttagtcagtatcctttcctggtgtgcatgcagatggataaggacgaggcaccctttcggcaattcgaaaaaaaatacgagcggctaagcactggccgtgggtacgtttcccagaagaggaaggagtcggtacttgcaggatgcgagtttccccttcaccaggagaattctgaaatgtgcaaagtggttttcgcacctcagcctgattctacgagcagcggctggttt

SEQ ID NO: 16876 - DNA, 2682 bp, Artificial Sequence
  Description of Artificial Sequence: Synthetic coding sequence
atgatattactagcggtactatttttatgttttatatcgtcgtattcggcgtcggtaaaaggtcatacgacgggtttatcgttaaataatgatcgactatataaattaacgtattcgacggaagtattattagatcgaggtaaaggtaaactacaagattcggttggttatcgtatatcgtcgaatgttgatgttgcgttattatggcgaaatccggatggtgatgatgatcaattaatacaaataacgatgaaagatgttaatgtagaaaatgttaatcaacaacgtggtgaaaaatcgatatttaaaggtaaatcgccgtcgaaaataatgggtaaagaaaatttagaagcgttacaacgtccgacgttactacatctaatacatggtaaagtaaaagaattttattcgtatcaaaatgaagcggtagcgatagaaaatataaaacgaggtctagcgtcgctatttcaaacgcaattatcgtcgggtacgacgaatgaagttgatatatcgggtaattgtaaagttacgtatcaagcgcatcaagataaagtaataaaaataaaagcgttagattcgtgtaaaatagcgcgttcgggttttacgacgccgaatcaagttctaggtgtatcgtcgaaagcgacgtcggtaacgacgtataaaatagaagattcgtttgtaatagcggttctagcggaagaaacgcataattttggtctaaattttctacaaacgataaaaggtaaaatagtatcgaaacaaaaattagaattaaaaacgacggaagcgggtccgcgattaatgtcgggtaaacaagcggcggcgataataaaagcggtagattcgaaatatacggcgataccgatagtaggtcaagtttttcaatcgcattgtaaaggttgtccgtcgctatcggaactatggcgatcgacgcgaaaatatctacaaccggataatctatcgaaagcggaagcggttcgaaattttttagcgtttatacaacatctacgtacggcgaaaaaagaagaaatattacaaatactaaaaatggaaaataaagaagttctaccgcaactagttgatgcggttacgtcggcgcaaacgtcggattcgttagaagcgatactagattttctagattttaaatcggattcgtcgataatattacaagaacgttttttatatgcgtgtggttttgcgtcgcatccgaatgaagaattactacgtgcgttaatatcgaaatttaaaggttcgataggttcgtcggatatacgtgaaacggtaatgataataacgggtacgctagtacgaaaactatgtcaaaatgaaggttgtaaactaaaagcggttgttgaagcgaaaaaattaatattaggtggtctagaaaaagcggaaaaaaaagaagatacgcgaatgtatctactagcgctaaaaaatgcgctactaccggaaggtataccgtcgctattaaaatatgcggaagcgggtgaaggtccgatatcgcatctagcgacgacggcgctacaacgatatgatttaccgtttataacggatgaagtaaaaaaaacgttaaatcgaatatatcatcaaaatcgtaaagttcatgaaaaaacggttcgtacggcggcggcggcgataatattaaataataatccgtcgtatatggatgttaaaaatatactattatcgataggtgaactaccgcaagaaatgaataaatatatgttagcgatagtacaagatatactacgatttgaaatgccggcgtcgaaaatagtacgacgagtattaaaagaaatggtagcgcataattatgatcgattttcgcgttcgggttcgtcgtcggcgtatacgggttatatagaacgatcgccgcgttcggcgtcgacgtattcgctagatatactatattcgggttcgggtatattacgtcgttcgaatttaaatatatttcaatatataggtaaagcgggtttacatggttcgcaagtagttatagaagcgcaaggtttagaagcgctaatagcggcgacgccggatgaaggtgaagaaaatttagattcgtatgcgggtatgtcggcgatactatttgatgtacaattacgaccggttacgttttttaatggttattcggatttaatgtcgaaaatgctatcggcgtcgggtgatccgatatcggtagttaaaggtctaatattactaatagatcattcgcaagaattacaattacaatcgggtttaaaagcgaatatagaagtacaaggtggtctagcgatagatatatcgggtgcgatggaattttcgctatggtatcgtgaatcgaaaacgcgtgtaaaaaatcgtgtaacggttgtaataacgacggatataacggtagattcgtcgtttgttaaagcgggtctagaaacgtcgacggaaacggaagcgggtctagaatttatatcgacggtacaattttcgcaatatccgtttttagtatgtatgcaaatggataaagatgaagcgccgtttcgtcaatttgaaaaaaaatatgaacgtctatcgacgggtcgtggttatgtatcgcaaaaacgaaaagaatcggttttagcgggttgtgaatttccgttacatcaagaaaattcggaaatgtgtaaagtagtatttgcgccgcaaccggattcgacgtcgtcgggttggttt

SEQ ID NO: 16877 - DNA, 2682 bp, Artificial Sequence
  Description of Artificial Sequence: Synthetic coding sequence
atgatcttacttgcagttctttttttgtgcttcattagctcatactcagcatccgtgaagggacacacgaccggattgagcttaaacaatgacagactgtacaagttaacatattcaaccgaggtactgctggatcgcggcaagggaaaactccaagattcagtcggataccgcataagttctaatgtggacgttgcactcctatggaggaatcctgatggcgacgatgatcaacttatccagataaccatgaaagacgtcaatgtggaaaacgtaaatcagcaacgcggcgaaaagagcatctttaagggtaagtctcctagcaaaatcatgggcaaagaaaatttagaagcgcttcagcgcccgacgttgttgcatctgattcatggaaaagtaaaggaattttattcgtaccaaaacgaagctgtagccattgagaacattaaacggggattagcgtcacttttccaaacacaattatcatccgggactactaacgaagttgatatctccggtaactgcaaggttacgtaccaggcccaccaagataaagtgattaagattaaagctctcgacagctgtaagattgcaagatctggctttacgacgccaaaccaggtattaggcgtttcatcgaaagcgacttctgttactacgtacaaaatagaggatagttttgtgatagccgtgttagcggaagaaacacataatttcggattaaactttcttcagactattaagggcaaaatcgtaagcaaacaaaagcttgagcttaaaacgacagaagcaggtcctcggctcatgtcaggcaaacaggcggctgcgattattaaagctgttgacagcaaatatacagccattcctattgttgggcaagtctttcagtctcattgtaaaggttgcccgagtctgtctgaattgtggcgctctacgcgcaagtatctgcagcctgataatctctccaaagctgaggcggtccggaactttcttgcttttatccagcatttacgaacggcaaaaaaagaagagatccttcaaattttaaagatggagaacaaagaagtcttaccgcaacttgttgacgctgttacgtccgcgcaaacttctgactcgcttgaagcgatactggattttcttgacttcaaatcagacagctccataatccttcaagaacgttttctgtacgcgtgtgggttcgctagtcatccaaatgaagaactcttacgtgctctgatttcaaaatttaaagggtcaatcggaagttctgacatccgggaaaccgtaatgattattacaggcacattggttcgtaaattgtgtcagaatgagggttgcaaattaaaggcagttgtcgaagcaaaaaagctgatattgggaggcctggaaaaggccgaaaaaaaagaagatacaagaatgtacttactagcattgaaaaatgcgcttcttccggaaggcattcctagcctcttaaagtatgcagaggcaggagaaggtcctatctcccatttggctactactgcgttacaacgctacgatttaccattcattaccgatgaggtgaaaaaaaccttaaatcggatttatcaccaaaatcgaaaagtacatgaaaaaacagttagaacagcggcggcggccataatccttaataacaacccatcatatatggatgttaaaaatatcctgttatctattggagagttaccgcaggaaatgaataaatatatgttggcaatcgtgcaggacattctcagattcgaaatgccggcatcaaaaattgtgagacgtgttctgaaagagatggtggcgcataattacgataggtttagccgttcgggctcaagttcagcatatactggttatattgaacgttccccaaggtctgcgagcacatattccctcgacattctgtacagcggatcaggtatcctacgaagatctaatttaaatatctttcagtatattggcaaagcaggactgcatggctcacaggttgtcatcgaggcccaaggcttagaggcgttgatcgctgctacaccggacgagggagaagagaatcttgattcgtacgctggaatgtctgcgatactgtttgacgtgcaactccggccggtaaccttctttaatggttattccgatttaatgtctaagatgctttcggcctccggggacccgatctccgtggtaaagggcctgattcttcttatcgaccatagccaggaacttcaattacagtctggacttaaagctaatatagaagtacaggggggcttggccattgacatctccggagcaatggaatttagtttatggtacagagaatcgaaaacacgggttaaaaacagggttacagtggttattacgactgacattacagttgattcctcctttgtaaaagcgggcctggaaacatcaacggaaactgaagcgggattagaatttatctcgacggttcagtttagtcagtatccatttttggtgtgcatgcagatggataaggacgaggccccgtttagacagtttgaaaaaaaatacgaacgattaagcaccgggaggggttacgtgtcacagaagcggaaagagtcagtccttgcaggctgtgagtttccgttacatcaggaaaactccgagatgtgtaaagtagtctttgcgcctcaacctgactcgacgagctcgggatggttc

SEQ ID NO: 16878 - DNA, 2682 bp, Artificial Sequence
  Description of Artificial Sequence: Synthetic coding sequence
atgattcttctggcagtgctttttctgtgttttatttccagctacagcgcctctgttaaggggcatacaaccgggctgtctcttaataacgaccgattgtataagctcacctactcaacggaggtcctactggacaggggcaagggcaaactgcaagactctgtggggtatcgcatctcaagcaacgtggacgtcgccctgctgtggagaaaccccgatggtgatgatgatcagttaatccagatcacgatgaaggacgtgaacgtggagaacgtgaatcagcagcgtggagagaaatccatcttcaagggaaagagcccgtcaaagatcatgggcaaggaaaatttagaagccttgcagaggcccacccttctgcacctgatccacggcaaggttaaggagttttattcttaccaaaatgaggcagtggcaatcgaaaatatcaagcggggactggcctcactctttcagactcaactgtctagtggcaccactaacgaggtcgacatcagtggaaactgcaaagtgacttaccaggcccaccaggataaagtcatcaagattaaggccctagacagctgcaagatagctcggtctgggtttacaacgccaaaccaggtcctcggcgtgtcctcaaaagccaccagtgtgactacctataagatagaggattcctttgtgatcgccgtactggcggaggagacacacaattttgggcttaactttctgcagactattaagggcaaaatagtgagtaagcagaagctggagctgaagaccaccgaggccggtccccggctcatgtccggtaagcaggcagctgccatcattaaagcggtggatagcaagtatacagcaatccccatcgtcgggcaggtgttccagtcacactgtaagggctgtccgtccttgagcgaactttggcgcagcactaggaagtacctccagccggacaatctgagtaaagccgaggcggtgcggaatttcctggctttcatacagcatctgaggaccgctaaaaaagaggagatccttcaaatcctcaagatggagaataaagaggtactgccccaactcgtggatgccgtgacgtccgcgcagaccagcgacagcctggaggcaatactggacttcttagattttaaatctgacagctccatcattttgcaggaacgcttcctgtacgcttgcgggtttgcctctcatcccaacgaggaactactgcgcgccctgatctcgaagtttaagggatccattgggtccagcgatattcgagagacggtcatgatcatcactggcaccctcgtccggaaactgtgtcagaatgaaggatgtaaattaaaggcagtggtggaggctaaaaagctgatccttggcggcctggagaaggcagaaaagaaggaggacacacgtatgtatctattggcactcaaaaacgcactgctgccagaggggattcctagcctcctgaaatatgccgaagccggggaggggcctatttctcatctggccactaccgccctccagaggtatgatttaccatttatcaccgacgaagttaagaagacgctgaaccggatttaccaccagaataggaaagtccatgaaaaaacggttaggacagccgccgcggccatcatcctgaacaataacccttcgtacatggacgtcaagaatatcctgctttccatcggcgagctgcctcaggagatgaacaaatatatgctggcaattgtccaagacattctccggtttgagatgccagcatcaaagattgtccggcgcgtgctgaaggagatggtcgcccataattacgatcgtttctctagatctggatcttcaagcgcatataccggatatatcgagcggtctccacgatctgcgtcgacctactcgctggacatcctgtacagcgggtcgggaattttgaggagatcaaatctgaacattttccaatacatcggaaaggcaggcttgcatggaagccaggtagtgatcgaagcacagggattggaagccttaatcgccgctacgccagatgaaggagaagagaatctggactcttatgctggtatgtctgcaatactattcgacgtacagctgcgacctgtaactttttttaacggatacagtgacttaatgtcgaaaatgctctctgcttcaggtgatccaataagtgttgttaagggcctcattctcctgattgaccactctcaggagctgcaactccagagcggcctgaaggcaaacattgaagtgcagggaggtctcgctatagatatctccggggcgatggaattttctctgtggtatcgagagtctaaaacgagagtcaagaatcgcgtgacagtcgtgataaccaccgacatcactgtcgacagttcatttgtaaaggccggcctggagaccagcacagaaacagaagccggacttgagtttattagcaccgtccagttctcacagtacccgtttctagtatgtatgcagatggacaaggacgaagccccatttcgacagttcgaaaaaaaatacgagaggctctctaccggccgtggttatgtaagtcagaagcggaaagagagtgtgctggccggttgtgaattccctctgcatcaggagaacagtgaaatgtgcaaggttgtgtttgcgcctcagccagactctacgtcttccggctggttc

SEQ ID NO: 16879 - DNA, 3768 bp, Artificial Sequence
  Description of Artificial Sequence: Synthetic coding sequence
atgctgttcaagcttctccagcggcagacgtacacttgcctgtctcatcgttacgggctctacgtttgtttcctaggagtggtcgtgaccattgtgagcgcttttcagtttggtgaagttgtgctggagtggagccgggatcaataccatgttctcttcgactcatatcgagataatatcgccgggaagtctttccagaatcgtttgtgtctgcctatgcctatcgacgtcgtttacacgtgggtgaacggcaccgatctagagttgttgaaagagttgcaacaggttagggaacagatggaagaggagcaaaaagcgatgcgggagatcctgggaaagaatacgactgagcctacgaagaagagcgaaaagcagcttgagtgtctgctcacccattgcattaaggtaccaatgctggtgctggacccagccctccccgctaacatcactctcaaggacctaccaagcttatatccctcttttcattccgcgtccgatatcttcaatgtggcgaagcccaagaatccctctaccaacgtctcagttgttgtctttgacagcactaaggacgtggaagacgctcactcaggtctactgaagggaaatagtagacaaacggtatggaggggatatctgaccactgataaagaggttccaggacttgtgttaatgcaggacctggcattcctgtctggattccctcctacctttaaggagactaatcagctcaagaccaaactacctgagaacctgtcgtcaaaagtgaagttgctgcaactgtatagcgaggcttccgtcgccctcctgaagcttaataaccctaaggactttcaggagctgaacaaacaaacaaagaaaaacatgaccattgacgggaaagagctgactatatctccagcctacctgctttgggatctttccgctatctctcagagtaaacaggatgaagacatcagtgcatcccgattcgaggataacgaagagcttcgctatagcctccgctctatagagaggcatgctccgtgggtaagaaacatattcatcgtgaccaacggacagatccctagttggttgaatctcgacaatccacgcgtgacaattgtcacgcatcaggatgttttccggaatttatcacacctgcctacgtttagcagccccgccatcgaatcacacattcacagaatagagggactttcacaaaaattcatctacttgaatgatgatgtgatgttcgggaaggacgtgtggcccgacgatttttactcccactccaaaggccagaaggtgtacctgacctggcctgtgccaaactgcgccgagggttgtcctggatcatggatcaaagacggatactgcgacaaggcatgtaacaacagcgcctgtgattgggacgggggcgactgctccgggaattcaggcggttcacgatatattgctggtggaggaggcacaggctccatcggagtcgggcaaccctggcagttcggaggcgggattaacagcgtttcgtattgcaatcaaggctgcgccaattcatggcttgcagacaagttctgcgaccaggcttgtaatgtgctgtcttgtggcttcgacgctggcgattgtggtcaggatcatttccacgagctgtacaaagtgatcttgttacccaatcagacacactatattattccgaagggggagtgtctaccctatttttcatttgctgaagttgctaagaggggagtcgagggagcctattccgataaccccataataaggcatgcaagcatcgctaataagtggaaaactatccatttgattatgcatagcggaatgaatgctaccacaatacattttaaccttacttttcagaatactaatgacgaagagttcaaaatgcagattactgtcgaggtcgacacccgggagggacctaaactcaattccaccgcgcaaaagggctatgagaacctggtgtcacctatcacgctcttgcccgaggcagagattctattcgaggacatccccaaggagaaaagatttccaaagttcaagcgccacgacgttaatagcaccaggcgagctcaggaggaggtgaaaattcctctggtgaatatttccctcctgccaaaagacgcacagttgtccctgaacacattggacctccagctagagcacggcgatattaccctcaagggttacaacctgtcaaaaagtgcactactgagaagctttctcatgaattcccagcacgcaaaaataaagaaccaggctattatcactgatgaaaccaatgactccttggtcgcccctcaggaaaagcaagtccacaaatccattctgcccaatagtttaggcgtgagtgagcgcctgcaacgcttgaccttccccgccgtgtccgtgaaagttaacggccacgatcaggggcaaaacccacctctggatctagaaacaactgctagattccgcgtagagacccatacacagaaaaccatcgggggcaatgtaactaaagagaaacctccttcgctcattgtgcccctcgagtcccaaatgaccaaggagaaaaagatcacgggaaaagaaaaagaaaactcacgcatggaagagaacgcagagaatcatatcggtgtgaccgaggtgctgttaggacgcaaattgcagcactatacggactcatacctgggctttctaccttgggagaaaaaaaaatactttcaggatctgctggacgaagaggaaagccttaaaacccagctggcctacttcacggattccaaaaacaccggtaggcagctcaaagacaccttcgccgactctctcagatacgttaataaaatcctgaactctaagtttggttttacttcccgaaaagtgcccgcacatatgcctcacatgatcgatcggattgtgatgcaagagttgcaggacatgtttcccgaggagttcgataaaacttcattccataaggttcgccactccgaggatatgcagttcgcctttagctacttctactatctgatgagcgccgtgcaacccctgaatatctcccaggtgttcgatgaggtagataccgaccagagcggagtcctctctgaccgagaaataagaacgttggccacaaggattcacgaactccccctgagtctgcaggaccttacaggcctagagcacatgctgatcaactgctcaaagatgctgccggccgatattacccaattgaataatatacctcccacccaggagtcatactacgatccaaatttgccccctgtaaccaagagcctggtgacaaattgcaagccggtcaccgataaaatccacaaagcctataaggataagaacaagtataggtttgagatcatgggcgaggaggaaattgccttcaaaatgatacgaactaacgtctcccacgtcgtaggtcaattagatgacattcgtaagaatccccgcaagtttgtctgcctcaacgacaatattgatcataatcataaagacgcccaaaccgtaaaagcagtgctgagggacttctatgagtctatgttccccatccccagccagtttgagctgccacgggagtatcgcaaccgatttctacatatgcatgagctgcaagaatggcgggcctacagggacaaattaaagttttggacacactgtgtccttgccaccctgatcatgttcaccatcttctcatttttcgccgaacagctcattgcgctgaaacgtaagattttccccaggagacggatccataaggaagccagtcctaacaggataagggtc

SEQ ID NO: 16880 - DNA, 3768 bp, Artificial Sequence
  Description of Artificial Sequence: Synthetic coding sequence
atgctcttcaagctgctccagaggcagacatacacctgtttgagccatagatacggtctctacgtgtgctttctgggagtggtggttaccatcgtcagcgctttccagttcggggaggtcgtacttgagtggtccagggatcagtaccatgtgctttttgattcctatagggacaacattgctgggaagagtttccagaacagactgtgtctgcccatgcccatcgacgtggtctatacatgggtcaacggtacggacttggagcttctgaaagaactgcagcaggtaagggagcagatggaagaggagcaaaaggccatgagagagattctggggaagaatacgactgagcctaccaaaaaatcagagaagcagctggagtgtctcctcacccattgcattaaggtgccaatgttggtactggatccagctctccccgctaacattactctgaaggaccttccgtctctctatccgtcttttcatagcgcgtccgacatttttaacgtggctaagcccaagaaccctagtacgaatgtttctgtcgtggtgttcgatagtacaaaagatgtcgaggacgcgcatagcggacttctgaaaggcaacagtagacaaaccgtatggagggggtatctgaccacagataaggaagtgcccggtctcgtgctcatgcaggaccttgccttcttgtctggctttcctccgacttttaaggaaaccaatcagctcaaaaccaaactgccggaaaacctcagtagcaaggtgaagctgctccagttgtactcagaagcgtcagtggcattgttgaaactcaataatcctaaggacttccaggagctcaacaagcagacaaagaagaatatgaccatcgatggcaaggagcttacaatcagccccgcctatctgctgtgggacctgtctgcaatcagtcaatccaaacaggacgaggacatcagcgcgtcccggtttgaagacaacgaagagctgagatatagtctcagaagtattgagaggcacgccccgtgggttcggaatatctttatagtgacaaatgggcagatcccgagctggctgaacctggataatccaagagtgactatcgtgactcaccaggatgtcttccgcaacctctcacacctgcctactttctccagccctgccatagaaagccacatccatagaattgaaggcctgtcacagaagtttatctatctgaacgatgacgtcatgttcgggaaggacgtctggccagacgacttctacagccacagcaagggccagaaagtctacctgacctggcccgtacccaattgtgccgagggatgccccggatcatggattaaggatggttattgcgacaaagcgtgtaataacagcgcctgtgactgggacggtggcgattgcagtggtaactctggaggatctaggtacattgccgggggaggaggaaccgggagcatcggcgtcgggcagccctggcagtttggcgggggtatcaactccgtttcttactgcaatcaggggtgcgccaattcttggctggccgacaaattttgtgaccaggcctgtaacgtgttgagttgtgggtttgatgcaggcgactgtggtcaagatcatttccacgagctctataaggttatcctcctgcccaaccagacccactatataatccccaagggggagtgcctgccatatttctctttcgctgaggtagccaaacgaggggttgagggtgcatacagcgataaccctattatacgacacgcctctatcgctaacaaatggaagactatccatttgatcatgcactccggaatgaatgcgaccactatccactttaacctgacctttcagaatactaatgacgaggagttcaagatgcagatcactgtagaggtggacacacgcgaggggcccaaactgaacagtactgctcaaaagggctacgaaaatcttgtgtctcccattacactgctccccgaggctgagatcctctttgaagatatccctaaagagaagcggttccctaagtttaaacggcacgacgtgaactccacccgaagggcccaagaagaagtaaagattccattggtaaacatcagcctgctgcctaaagatgcacagctgagcctcaacaccctggatctgcagttggagcacggcgacatcacactcaagggatataatctgagcaagagcgcactgctcagatcctttttgatgaattcacagcatgcaaagattaaaaatcaggcaatcatcactgacgagacgaatgactccctcgtggcccctcaggaaaagcaggtgcacaagtccattctgccaaacagcctgggtgtttccgagcgacttcagcgcctgaccttcccagctgtgtctgtgaaggtgaacggacatgatcaggggcaaaatcctcctctggacttggagactacagctcgcttccgggtggagacccatacccagaagaccattggaggtaatgttactaaagagaagcccccctctcttattgtacctctcgaatctcagatgacaaaggagaaaaagatcaccgggaaggagaaggaaaacagccgaatggaagagaacgccgaaaaccatattggagtgacagaagttctgctgggaaggaagctgcagcattacaccgattcctacctggggtttcttccctgggagaagaagaagtacttccaggacttgcttgacgaagaagagtccttgaagacccagcttgcttacttcaccgacagtaagaataccggcaggcagctcaaagacacctttgctgactccttgcgctacgtgaacaagatcctgaacagtaagtttggcttcacatccagaaaggttcccgctcatatgccccatatgatcgatagaatcgtcatgcaggagctccaagacatgttcccggaagagttcgacaagacatcctttcacaaagtgcggcacagcgaagatatgcagtttgcgttcagctatttctactacctgatgagcgccgtgcaacccctgaacatatcccaagtgttcgatgaagttgacacggaccaatccggagttctgtccgaccgcgagatcaggacacttgcaactaggattcacgagctgcctctcagcctgcaggacttgaccggcctggagcatatgctgattaattgttccaagatgctgccagcagatatcactcagcttaataatatcccaccaacacaggagtcctactacgatcctaacctgccccccgtcacgaagagtttggtgacaaactgtaagcccgtaacagacaaaatccataaggcgtataaggataagaataaataccgctttgagatcatgggggaggaggaaatcgcgttcaagatgatacggaccaatgtctcacacgtggtgggtcagctcgacgatatcaggaaaaaccccaggaagtttgtgtgtctcaatgataatatcgaccataaccacaaggatgcacaaactgtgaaggcagtgctccgcgacttctacgagagtatgtttcccattccatcacaattcgaactgccacgggagtaccggaacagatttctccatatgcacgagctgcaagagtggagggcatatagagacaagcttaagttctggacacactgtgtcctcgcgaccctcataatgtttactatctttagcttcttcgctgagcagctcatcgcactcaagcgaaagatatttccccggagacgaatccacaaggaggctagtcctaatagaataagagtg

SEQ ID NO: 16881 - DNA, 3768 bp, Artificial Sequence
  Description of Artificial Sequence: Synthetic coding sequence
atgttattcaaactactgcagaggcagacctacacctgcttgtcccacagatatggcttgtatgtttgcttcctaggggtcgtggtgacaatcgtgagcgcctttcagtttggcgaggtggtcctggagtggtcccgtgatcagtaccacgtccttttcgacagttatcgtgacaatattgctggcaaatctttccagaatcgattatgtttaccgatgcctatcgatgtggtgtatacctgggtaaacggtacggacttggaactgttgaaggaactccagcaagtgcgcgaacaaatggaggaggagcagaaggccatgagggagatactgggcaaaaacacaactgaacccacaaagaagagcgaaaagcagttggaatgcctccttacacactgcatcaaggttccaatgctcgtccttgatcctgcccttccagcgaatataaccttgaaagacctgccttctctttaccctagcttccactctgcatctgacattttcaacgtggctaagcccaaaaacccttccacaaatgtttccgtcgtggtgttcgactctacgaaagacgtcgaggacgctcacagtggcctcttgaagggaaactccagacagactgtgtggaggggctacctcactactgataaagaggttcccggtctcgtgttgatgcaggacttggcctttcttagtgggttcccgcccactttcaaagagactaaccagcttaagactaagctgcctgaaaacttgtcaagcaaggtgaaactcctccagctttacagcgaggcgtccgtggccttacttaagttgaataaccctaaggattttcaggaactgaataagcaaactaagaaaaacatgacgatcgacgggaaagagttaactatatcccccgcttatctcctttgggatctgtctgctatcagtcagtccaaacaggatgaagatatttctgcaagtaggttcgaggataatgaggagttacgctattcattgaggagtattgagcgccatgccccttgggtgaggaacatcttcatcgtaaccaatggacagatcccttcatggctgaacttggataatccccgcgtgacaatcgtgacacaccaggacgtattcaggaatctgtctcatctgccaaccttctcgagcccagcgattgagagtcacatccaccgtatcgagggactgtctcagaagtttatttatctcaacgacgatgtgatgttcggcaaggatgtgtggccggatgacttttacagccatagtaagggccagaaagtgtacctgacatggccagttccaaattgcgctgagggatgcccaggaagttggatcaaagacggctattgtgacaaggcctgtaacaatagtgcatgtgactgggacggaggggactgttccgggaacagcggcggatcaagatacattgccggcggcggcggaaccggctctattggtgtgggccagccctggcagttcggtgggggtatcaacagtgtgtcctattgtaaccagggctgtgcaaatagctggctcgccgacaagttctgcgaccaggcctgcaatgtattgtcctgcggatttgatgcaggtgattgtggccaggaccacttccacgaactgtacaaagtgatcttactcccaaatcagacccattacataattccaaagggagaatgcctaccctacttctccttcgctgaagtcgctaagagaggcgttgaaggcgcatattcagacaaccctataattcgccacgcatccattgcaaacaaatggaagactatccaccttattatgcatagtggaatgaacgccactactatacatttcaatctgacgtttcagaataccaacgacgaggagttcaagatgcagataacagtcgaggttgatactcgcgagggtcccaaacttaattctactgcccaaaagggttacgaaaatcttgtctctcctatcaccctgctgcccgaagctgaaatcttgtttgaggacataccaaaggagaaaaggttccctaaattcaaaagacacgacgtgaacagcacccgccgagctcaggaggaggtcaaaattccactggtaaatatttcgctgcttccaaaggatgcgcagctctcactcaacactcttgacctgcagcttgagcacggagatatcacactgaagggctacaatctttctaaatcagctctgcttaggtcctttctcatgaattcccagcacgccaagattaagaaccaggcaattataaccgacgaaacaaatgactccctggtcgcaccacaggagaaacaagtgcataaaagcatcttgcctaactccttgggtgtgtcggagcggcttcaaaggcttaccttccctgcggtgagtgtgaaggtgaatggacacgatcaggggcaaaacccaccgttggatctggaaaccaccgctaggtttagagtagagacccatactcagaagacaatcggcggaaacgtgaccaaggaaaagccaccttctctgatcgtgccgctggagtcacagatgaccaaggaaaaaaagattacaggcaaagagaaggagaactcccggatggaagaaaacgcagaaaatcacatcggcgtgacggaggtgctgctcggtcggaagctgcagcactacactgattcctacctgggctttctgccttgggaaaagaagaaatatttccaggaccttctggatgaggaggagtcgctgaagacccagctggcatacttcacggattccaagaacacagggcggcagctcaaggataccttcgccgattcacttagatacgtgaataagatccttaatagtaagttcgggtttacttccagaaaggtgcccgctcacatgccccacatgattgaccgaatcgtgatgcaggagcttcaggatatgttccccgaggagtttgataaaacatcgtttcacaaggtgcgacactcagaggatatgcagttcgctttttcttatttctactatctgatgtccgccgtgcagccactcaatattagccaagtttttgacgaggtcgatacagaccaaagtggcgtgctcagtgacagagaaatcaggacactcgctaccagaatccatgagctgccgttaagtttgcaggatttaacaggactggagcatatgctaataaattgttctaaaatgctgcccgccgacatcacccagttaaacaatatacccccaactcaggaatcctactacgatcctaacctgcccccagtcactaagagcctcgtcactaattgtaagccggtgacagataagatccacaaggcctacaaagacaaaaacaagtacagatttgagataatgggagaagaagagatcgcttttaaaatgatcagaactaacgtgtcgcacgtggtgggtcagctcgatgatatcaggaagaatccccggaaatttgtgtgtttaaatgacaacatcgaccataatcacaaagacgcccagacagtcaaagccgtgctgagagatttttatgagagcatgtttcccattccaagtcagtttgagctgcctcgtgagtacaggaacagatttcttcacatgcacgagctccaggaatggcgagcatatcgtgataagttaaagttttggacacactgcgtactggctacactgattatgttcaccattttctcctttttcgcagagcagttaatcgctctgaagcgtaaaatattccctcggcgccggatacacaaggaggcctcccccaatcggatccgtgta

SEQ ID NO: 16882 - DNA, 3768 bp, Artificial Sequence
  Description of Artificial Sequence: Synthetic coding sequence
atgttatttaagcttttacaaagacaaacatatacttgtcttagtcatagatatggactttatgtttgttttttaggtgttgttgtgacaattgtaagtgcttttcaatttggtgaagttgttttagaatggtcaagagaccaatatcatgtattattcgactcttacagagataatattgcaggaaaatcatttcaaaatagattatgccttccaatgccaattgatgtagtatatacttgggttaatggtacagatttggaacttcttaaagaattacaacaagttcgagaacaaatggaagaagaacaaaaagcaatgagagaaattttaggaaaaaatacaactgagccaactaaaaaatcagaaaaacaattagaatgtcttcttacacattgtattaaagttccaatgttagtactagatccagctttaccagctaatattactttaaaagatttgccttctttgtatccttcatttcatagtgctagtgatatttttaatgttgctaagccaaaaaatccatcaacaaatgtatcagtagttgtttttgacagtactaaggatgtcgaagacgctcactctggattactaaaaggaaattcccgacaaacagtttggcgtggttatttaactacagataaagaggtaccaggattagttttaatgcaagatttagcttttttatcgggattcccaccaacttttaaggaaactaatcaacttaagactaagcttcctgaaaatttatcatctaaagttaaattattacaattgtatagtgaagctagtgttgcattacttaagttgaataatccaaaggattttcaagaacttaataaacaaactaaaaaaaatatgactattgacggaaaagaattaacaatttcacctgcatatcttttatgggacctttctgcaatttcacaatctaaacaagatgaagatatttctgcttcaagatttgaagataatgaagaattaagatattcattaagaagtattgaaagacatgctccttgggtgagaaatattttcatcgtaactaatggacaaattccatcatggttaaatttagataatccacgtgttacaatagttactcatcaagatgtttttagaaacttaagtcatttaccaacattttctagtccagctattgaatctcatattcatagaattgaaggattatcacaaaaatttatttatcttaatgacgacgtaatgttcggtaaagatgtttggccagatgatttctattctcattcaaaaggacaaaaagtttatcttacttggccagttcctaattgtgctgaaggttgtccaggttcttggattaaagatggatattgtgataaagcttgtaataatagtgcttgtgattgggatggaggagattgttctggaaacagtggaggatcaagatatatagcaggaggaggaggaaccggatctattggggttggacaaccatggcaatttggaggaggaattaatagtgttagttactgtaatcaaggatgtgcaaattcttggttagctgataaattttgtgatcaagcatgtaatgttctctcatgtggatttgatgcaggagattgtggacaagaccattttcatgaattatataaagttattttacttccaaatcaaacacattatataattcctaaaggtgaatgtttaccttattttagttttgcagaagttgcaaaacgtggtgttgaaggagcttatagtgataatccaattatacgacatgcttcaatagctaataagtggaaaacaattcatttaattatgcattctggaatgaatgctaccacaatccactttaatttaacatttcaaaatactaatgatgaagaatttaaaatgcaaataacagttgaagttgatactagagaaggtccaaagcttaatagtactgcacaaaaaggatacgagaatttagtttctccaataactttattaccagaagcagagattttatttgaagatattcctaaagaaaaaagatttccaaagttcaagagacatgatgttaatagtacacgtagagcccaagaagaagttaaaattccattagtaaatatttcacttttaccaaaagatgcacaattatctctaaatacattagatcttcaattagaacatggagatattactttaaaaggttataatttgtcaaaatctgcacttcttaggtcttttcttatgaatagtcagcatgctaaaataaagaatcaagcaattattacagatgaaacaaatgactctcttgtagctcctcaagaaaaacaagtacataaatctattttacctaattctcttggagtttcagaaagacttcaaagacttacatttccagcagtttcagttaaagttaatggacatgatcaagggcaaaatccacctcttgatttagaaacaactgcaagatttagagttgaaacgcatacacaaaaaacaatagggggaaatgttactaaggaaaaacctccaagtcttattgttcctttagaatcacaaatgacaaaagaaaaaaaaattactggtaaagaaaaagaaaactcaagaatggaagaaaatgcagaaaaccatattggagtaacagaagttttattaggacgtaaattacaacattacacagattcttatcttggttttttaccatgggaaaagaaaaaatattttcaagacttattagatgaagaagaatcattaaagacacaacttgcttattttactgattctaaaaatacaggacgtcagttaaaagatacatttgcagatagtttgagatatgttaataaaattttaaattccaagttcggttttacaagtagaaaagtaccagcacatatgccacatatgattgacagaatagttatgcaagaattgcaagacatgtttccagaagaatttgataagacttcatttcataaagttagacatagtgaagatatgcaatttgctttttcatatttctattatcttatgagtgctgttcaaccacttaatatttctcaagttttcgatgaagttgatactgatcaatcaggagttttatctgatagagagattcgtacattagcaacaagaattcatgaattaccactttcattacaagatcttactggattagaacatatgttaattaattgttctaaaatgttacctgcagatattacacaattaaataatattcctccaactcaagaatcatattatgatccaaatttgcctccagtgactaaatcacttgttactaattgtaaacctgtaactgataaaattcataaagcatataaagataaaaataaataccgattcgaaattatgggagaggaagaaattgcattcaaaatgataagaacaaatgtaagtcatgttgttggacaacttgatgacattagaaaaaatcctagaaaattcgtgtgtttaaatgataatattgatcataaccataaagatgctcaaacagttaaagcagttttaagagatttttatgaaagtatgtttcctattccatcacaatttgaacttccacgtgaatataggaataggtttttacatatgcatgaacttcaagaatggagagcttatcgtgataaattaaaattctggacacattgtgttttagctactcttattatgtttacgatattctcattttttgctgaacaacttattgcacttaaacgtaaaatttttcctcgaagaagaatccataaagaagcttcaccaaatagaattcgagtt

SEQ ID NO: 16883 - DNA, 3768 bp, Artificial Sequence
  Description of Artificial Sequence: Synthetic coding sequence
atgctgtttaagctgttacagcgtcagacgtacacttgcctgtcacacaggtacggtctgtacgtgtgttttctgggcgtcgtagtgaccatcgtgtctgctttccagttcggcgaggttgtcctggagtggagccgcgaccagtatcacgtactcttcgacagttaccgcgacaatatcgccgggaagtccttccagaatcggctgtgtctacccatgccaatagatgtggtctacacatgggtaaacggcacagacctggaactgctcaaggaactccaacaggtgagagaacagatggaggaagagcagaaggccatgcgcgagattctgggcaaaaatactacagagcccaccaaaaaatcagaaaaacaactcgaatgtttactgacacactgtataaaggtacctatgcttgtcctggacccagccctgcctgcaaacatcacattgaaggatctgcccagtttatacccaagtttccactccgccagcgatattttcaacgtggcaaagccaaagaacccctctacgaatgtttcggtcgtggtgtttgacagcaccaaggatgtagaagacgcacacagtggcctacttaaaggaaacagccgccagacagtgtggcgcggttatctgactacagacaaggaggtgccaggcctggtcttgatgcaggacctggcgttcctatccggtttcccgccaacatttaaagagaccaatcaactgaagaccaaacttcctgaaaatctaagcagcaaggtgaagttgctgcagctttactccgaagcgtccgtcgctttgctcaagctgaataacccaaaagattttcaggagctgaacaagcaaaccaaaaaaaacatgaccatagatggaaaggagctgactatttctccagcgtacttattatgggacctgagcgccatcagtcaatcaaagcaggatgaggatatcagcgcatctcggtttgaggacaatgaagaattacgatatagcctgcgttccatcgaacgccatgctccttgggttcgaaatatcttcatcgtaactaacgggcagataccatcatggctgaatctcgataacccccgcgtgactatcgtgacgcatcaagacgtgttcagaaacctgtcacacctgcccaccttttcatcgcctgccatcgagagccacatccaccgcattgagggattgagtcagaaatttatttacttgaacgacgacgtaatgttcggcaaagatgtgtggccagatgacttttacagccattccaaaggccagaaagtctacttgacttggccagtgccaaattgtgcggaaggttgcccaggcagctggataaaggacggatattgcgacaaggcctgcaataactcagcctgcgattgggacggcggggactgttcaggaaactccggaggctcccgctacatcgcgggcgggggtggcacgggctcaatcggagtggggcagccgtggcaattcgggggtgggattaattctgtgagctattgtaatcagggctgcgcaaacagttggctggcagataagttttgtgaccaagcatgtaatgtgctgtcctgcggatttgacgccggcgattgcgggcaggaccacttccacgaattatacaaagttattctcttgccaaatcagactcattacattatcccgaagggtgaatgcctcccatactttagcttcgctgaggtcgcaaagcggggtgtggagggtgcatacagcgataatccgatcatcagacacgctagtatcgccaataagtggaagactatccacctcattatgcactcaggcatgaacgcaaccacaatccactttaacctgaccttccagaacaccaatgacgaggagttcaagatgcagatcacggtggaggtggacactcgggaaggccctaagcttaattcaaccgctcagaaagggtacgagaatctggtatcaccgattaccctgctccctgaagccgagattctgtttgaggatatccccaaggagaagcgtttccctaaattcaaaagacacgatgtgaactccactcgcagagcacaggaagaggtgaaaattccgctggtcaacatttcactcctcccaaaggacgctcagctttctctgaacacccttgatctccaacttgagcatggagatattacactcaaagggtacaacctgagcaaatcggcactgttgcgctcctttctgatgaacagtcagcatgccaagattaagaaccaggccatcattactgatgaaaccaacgatagcctcgttgctcctcaggagaaacaggtccacaaaagtatactgcccaattctttgggtgtcagcgagagattgcagcggttgacctttccagcagtatccgtcaaagtaaacgggcacgatcagggccagaatcccccactggacctggagactaccgccaggttcagagtggagacccacactcagaaaaccatcggaggaaacgtgacaaaggaaaagcctccaagtcttatagtgccactggagagtcagatgactaaagaaaaaaaaattacaggcaaggagaaagaaaatagtcgcatggaggaaaacgccgagaatcacattggcgtcacagaggtgctgctgggccgcaaactgcagcactacacagattcatatctaggtttccttccatgggagaagaagaagtactttcaggacttattggacgaagaggaatcgctgaaaactcagctggcgtatttcactgacagcaagaatacgggtcggcagttaaaagatacttttgctgacagcctgcgttacgtaaataaaatccttaacagcaaattcggatttacatctcgcaaggttccagcacacatgccacatatgattgaccggatagtgatgcaggaactgcaggatatgttcccggaggagtttgacaagacttcatttcataaggtccggcacagcgaagatatgcaatttgcttttagctatttctattacctgatgagcgcagtccagcccttaaatattagccaagtctttgacgaggtggacactgatcaatccggcgtactctccgatcgggagataaggaccttggccactagaatccacgaattgcctcttagtctgcaggaccttaccgggttagagcacatgcttataaactgctccaagatgttgcctgccgacatcacccagctgaataatatcccccctactcaggaatcatactacgaccccaacttgccgcccgtcactaagagcctggtgacaaattgcaagccggtgactgacaaaatccataaggcttataaagataaaaataagtatcgctttgaaattatgggggaggaggaaattgcgtttaagatgatcaggaccaacgtaagtcatgttgtggggcagctagacgacatcaggaaaaacccgcgaaagttcgtgtgcctcaatgacaacattgaccacaaccataaggatgcccagactgtgaaggcggtcctgcgtgatttttatgagtctatgtttcctataccatcacagttcgaactgccacgggagtatcgcaaccggtttctgcatatgcatgagcttcaggagtggagggcttatcgagacaaactgaaattttggacacactgcgtgctcgctacgctgatcatgtttacgatctttagctttttcgccgaacagctaatcgccctcaagcggaagattttcccgcgccggcgaatacataaggaagcttccccaaaccgtattcgtgtg

SEQ ID NO: 16884 - DNA, 3768 bp, Artificial Sequence
  Description of Artificial Sequence: Synthetic coding sequence
atgcttttcaagctcctccagcgacaaacgtatacttgtctgtcgcataggtacggactctacgtgtgttttctgggggtggtggtgaccatagtgtcagcctttcaatttggtgaagtcgtgctggaatggtcgcgcgatcagtatcacgtgctttttgattcttaccgggacaatatcgcaggtaaatccttccagaatagactttgcctgccaatgcctattgatgtcgtctacacctgggtgaacggaaccgatctggaactgctgaaagaactccaacaagtgcgagaacaaatggaggaagagcagaaagcgatgagagagattttgggtaagaataccactgaacccaccaaaaagagcgaaaagcaacttgaatgcctgctgactcattgcataaaggtgcctatgctggtgctcgatccagctcttcctgctaacataactctgaaggatctcccctcgctgtatccctccttccattcggcaagcgacatcttcaacgttgcgaagcccaagaacccttcgaccaacgtgtcggtggtggtgttcgacagcaccaaagacgtcgaagatgcacattcggggctgttgaagggcaactcaagacaaactgtgtggaggggatacttgactacggataaagaggtgcctgggctggtgctgatgcaggatctggcattcctgtcaggctttccgccaacctttaaggaaaccaatcagctcaagaccaaactcccagagaatctctccagcaaggtgaaactgctgcagttgtactcggaggcgtccgtcgcacttcttaagctgaataacccaaaggacttccaagaacttaacaaacaaaccaagaaaaacatgactattgatggcaaagaactgacgatcagccctgcgtacctgctgtgggacctttcagcaatctcacagtcgaagcaggatgaggatattagcgcgtcacgctttgaagataacgaagaacttaggtacagcttgcgcagcattgaaagacacgctccgtgggtccgcaacattttcatcgtgactaatggacaaatcccaagctggctgaacctggacaacccacgggtcacgattgtcacccatcaagacgtctttcggaacctgtcccaccttccaacctttagctcgccagcaatcgaatcccatatccacagaatcgagggactcagccaaaagttcatctacctgaatgatgatgtcatgtttggtaaggatgtgtggcccgatgacttttactctcatagcaaaggtcaaaaggtgtaccttacttggccagtcccaaactgcgctgaaggctgcccaggatcgtggattaaggacggctattgtgataaggcctgtaacaattcggcgtgtgattgggatggaggtgattgttcaggcaacagcggcggttcccgctacatcgcaggagggggtgggaccggaagcatcggggtgggtcagccatggcagttcggaggagggattaacagcgtgtcttactgtaaccagggttgcgcgaactcttggctggcggataagttctgcgaccaggcatgtaacgtcctgtcgtgtggatttgacgcaggggattgcggacaggaccacttccatgagctctacaaggtgattctccttcctaaccagacccattacattataccaaaaggagaatgccttccgtacttttcatttgctgaagtcgccaagagaggtgtggaaggtgcatattccgacaacccgattatacgtcacgcgtccatagccaataagtggaaaacgatacatctgattatgcactcgggaatgaacgcaaccaccattcatttcaatctgacttttcaaaacactaatgatgaggagttcaaaatgcaaatcactgtcgaggtggataccagagaaggcccaaagttgaactcaaccgcacaaaagggatacgaaaacctggtgagcccaatcaccttgcttcctgaagcagaaattctcttcgaagatattcctaaggagaagagatttcctaagtttaagagacatgacgtcaactcgaccagaagagcccaagaggaagtgaaaattcctttggtgaacatttccctccttccgaaggatgctcaacttagcctcaacacccttgatcttcaacttgaacatggtgatattacccttaagggatacaacctgtcgaagagcgcacttctgcgctcgttcttgatgaacagccaacatgcaaagatcaaaaatcaagcaatcattactgatgagacgaacgattccctggtggcgcctcaagaaaagcaggtgcacaaatccattctcccaaactccctgggcgtgtcagagcgacttcaaagactcacgtttcctgcagtgtccgtgaaagtgaacggacatgaccaaggacagaatcccccactcgatctggaaactaccgcgagattccgggtggaaactcacactcagaaaaccatcggcggtaacgtcactaaagaaaaaccgccatcgctgattgtccccctggaatcgcagatgaccaaggaaaagaaaatcactggaaaggagaaggaaaactcacgcatggaggaaaacgctgaaaaccatattggcgtgactgaagtgctgctgggccgcaaactgcagcattacactgatagctaccttggatttctgccttgggagaagaagaagtactttcaggatctccttgatgaagaggaatcgctcaagacgcagctcgcttactttaccgactcaaaaaacaccggccgacagctgaaggacaccttcgcagatagccttcggtacgtgaataagattctgaattcgaagtttggatttaccagccgcaaggtcccagcacatatgccccacatgattgaccggattgtgatgcaggaactgcaagacatgtttccagaagaatttgataagacctcattccacaaggtccggcattcagaggacatgcaatttgcattttcgtacttctactacctgatgtcggcggtgcagcctttgaatatctcgcaggtgttcgatgaggtggacaccgatcaatcaggcgtcctgtcggatagagaaattcgcactctggcaactaggattcatgagctgcctctgtcattgcaagatcttaccggactcgaacacatgttgatcaattgctccaagatgttgcctgcagatattacccaactcaacaatatcccacctacccaggagtcatactacgaccccaatctccctccagtgaccaagtcgcttgtcactaactgcaagccggtgaccgacaaaattcacaaagcatacaaggataagaataagtaccgcttcgagattatgggtgaagaagagattgcatttaagatgatcaggactaacgtcagccatgtggtgggacaacttgacgacataagaaagaaccctcgcaagttcgtctgccttaacgataacattgatcataaccataaagacgcacagactgtcaaggcggtgctccgcgacttttacgagagcatgttccctattccttctcaatttgaactgccaagagaataccggaaccggtttctccatatgcatgagcttcaagaatggagagcataccgagataaactcaaattctggacccattgtgtccttgcaaccctgatcatgtttactattttctcattcttcgccgaacaactgattgcgcttaaacggaagattttcccacgcagacgaatccacaaggaggcctcccccaaccgtattagggtg

SEQ ID NO: 16885 - DNA, 3768 bp, Artificial Sequence
  Description of Artificial Sequence: Synthetic coding sequence
atgctgtttaaacttctgcaaaggcaaacttacacctgtctttcccatcgctacggtctttacgtgtgttttctgggggtggttgtcaccattgtctcggcatttcagttcggagaagtcgtgctggagtggtcgagagatcagtaccacgtgctttttgatagctaccgcgataacatagcaggaaaatcttttcaaaaccgtttgtgtctgcctatgcctattgatgtcgtgtacacctgggtgaacggaacggatcttgagctgctgaaggaactgcagcaggtgcgagagcaaatggaggaagagcaaaaggcaatgagggaaatactgggtaagaacaccactgagccaaccaagaagtccgagaagcagctcgagtgtctgctgacgcactgcataaaagtccccatgctcgtgctggacccagcactgccagcgaatatcaccctgaaggacctgccttcgctttacccgtctttccactcggcaagcgacattttcaatgtggcaaagcctaagaacccgagcactaacgtgagtgtcgtcgtctttgactcgacgaaggatgtggaggatgcccattccggtctgcttaagggcaacagccggcaaactgtgtggcgtggctacctcacgactgataaggaagtgcctggactggtgttgatgcaggatctggcatttctgtcaggattcccacctacttttaaggaaactaaccagctgaaaactaagctcccagagaacctcagctcaaaggtgaagctccttcaactttacagtgaagcgtcggtggcactgctgaagctgaacaaccctaaagattttcaagagcttaacaagcaaaccaagaaaaacatgaccattgatggtaaagaactgaccatatcacctgcttacttgctttgggatctgtccgcaataagccaatcaaagcaagacgaagatatctcagcatcgagatttgaggataacgaagaactccgatactcactgcgctctatagaaaggcatgccccttgggtcagaaacatattcattgttaccaatggacaaattccttcatggctcaacctggacaacccacgagtcactatcgtgactcatcaagatgtctttcgcaatttgtcccacttgccaactttctcgtcgccagccatagaaagccatattcatcgaattgaagggctgtcacagaaattcatatacctgaacgatgatgtgatgttcgggaaagatgtgtggccagacgacttttactcacactcgaagggccaaaaggtgtatctgacttggcctgtgcctaactgtgcagaaggttgtcccggctcgtggattaaggatggttactgtgataaggcctgtaacaattcagcatgtgattgggatggaggcgactgcagcgggaactccggtggatcgcggtacatcgcaggagggggtggtactggatcaatcggtgtcggtcaaccatggcaattcggcggaggcattaactcagtgtcgtactgtaaccagggatgtgccaactcctggctggcagataagttttgtgatcaagcatgtaatgtgctttcgtgtggatttgatgcaggagactgtggtcaagaccactttcatgaactgtacaaagtgatactgctgcctaaccagacccattacattatccccaagggtgagtgtctcccatacttttccttcgcggaagtggcaaaaaggggagtggaaggtgcttattccgacaatccgatcattagacatgcgtccatagcgaataagtggaaaactatccatcttatcatgcatagcggaatgaatgccaccaccattcatttcaatctcacctttcaaaacaccaacgacgaagagttcaagatgcagattaccgtggaagtggatactagagaagggcctaagctcaactccaccgcacagaaggggtacgaaaacctggtgagcccaattactttgctgccagaagcagaaattctctttgaagatatcccgaaagaaaagcgcttccctaagttcaagcggcatgacgtcaactccacccgacgcgcacaggaagaagtgaagataccccttgtgaacatatcactgttgccaaaagatgcacagctttcacttaacacccttgatctgcaacttgaacatggtgatatcacgctgaaaggctacaacctgtcgaagtccgcacttcttagatcgtttcttatgaattcgcaacatgccaagattaagaatcaggcaatcattactgacgagactaacgacagcctggtcgctcctcaagagaagcaagtgcacaaatccattctgcccaactccctgggagtcagcgaacggttgcagagactgacctttccagcggtcagtgtgaaggtgaacggccatgatcaggggcaaaatcctccactggatctggaaaccactgcgagatttagagtggaaactcacactcagaaaaccatcggaggcaatgttaccaaggagaagccaccatctcttattgtgccccttgaatcccaaatgactaaagagaaaaagatcaccggtaaggaaaaagagaacagcagaatggaagaaaacgcggaaaatcatatcggcgtcacggaggtgctccttggtaggaagctccaacattacactgattcgtatcttggattccttccatgggagaaaaagaagtattttcaagatcttctcgatgaggaagaatcgctcaagacgcagttggcatacttcaccgactcgaagaacaccggcagacaactgaaggatacttttgccgactccctcaggtacgtgaataagatcttgaattcgaagtttggatttacctcaagaaaggtgccggctcatatgccacatatgattgatagaatcgtcatgcaggaactgcaagatatgtttcccgaggaatttgataagacttcattccataaagtcagacacagcgaagatatgcagttcgcattttcatacttttactacctcatgtcagcagtgcaaccactgaatatcagtcaagtctttgacgaagtcgacaccgaccaatcgggagtgctcagcgaccgggaaattcgtaccctggccactcgcattcacgaactgccactttcgttgcaagatttgactggcctggagcacatgctgattaactgctcgaaaatgcttccagccgatattacccaactgaataacattccaccaacccaggagtcttactacgacccaaacctgccgcctgtgacgaagtccctcgtcaccaactgcaagccggtgactgataagatccataaggcctacaaggataagaacaagtacagattcgagattatgggtgaagaagaaattgctttcaaaatgatccggaccaacgtctcgcatgtggtcggacagctggatgatatacgaaagaacccccgcaagtttgtgtgcctgaatgacaacatcgaccataaccacaaggatgcacagactgtgaaagcagtcctgcgagacttttacgaatccatgtttcctattccttcgcagtttgaacttcctcgggaataccgcaaccgctttctgcatatgcacgaacttcaagaatggcgcgcctacagagacaagttgaaattctggacccactgcgtgcttgcgacccttatcatgtttaccatcttctccttttttgcagagcagctgatcgcactcaagcgtaagatatttcctcggcgacgcatccacaaggaggcatcaccgaacagaatccgcgtc

SEQ ID NO: 16886 - DNA, 3768 bp, Artificial Sequence
  Description of Artificial Sequence: Synthetic coding sequence
atgcttttcaagttgcttcagagacaaacctacacctgcctgtcgcatcggtatggattgtacgtgtgttttctcggggtcgtcgtgaccattgtctctgcttttcagtttggtgaggtggtgctggagtggtcccgagatcaataccatgtgctttttgattcctatagagacaacatcgcaggcaagagttttcaaaaccgtctttgcttgcctatgcccatagatgtggtgtacacttgggtgaacggtactgaccttgaactgcttaaggagctccaacaggtccgggagcagatggaagaggagcagaaggcgatgagagaaattcttggtaagaatactaccgaacctactaagaagtcggaaaagcaactcgagtgtctccttacccattgtatcaaggttccaatgttggtgcttgaccctgccctcccagcgaatatcaccctgaaagatttgccatcgctgtacccctcgtttcatagcgcatcggacattttcaacgtggcaaaaccaaagaacccttcgactaacgtgtccgtggtggtatttgactcgaccaaagacgtcgaggacgcacactccggacttctcaagggtaactccagacagaccgtgtggagaggatatctgacgaccgataaagaagtcccaggcttggtactcatgcaggatcttgctttcctgagcggcttcccacctacttttaaggaaactaatcagctgaaaactaagttgcctgaaaacctcagctcaaaggtgaaacttctgcaactgtactccgaagcgtcagtcgcactcctcaagctgaacaacccaaaggattttcaagaactgaataaacaaaccaagaagaatatgaccatagatggtaaagagcttaccatctcacctgcttacctgctgtgggatctgtctgctatctcacaatcgaaacaggatgaagatatttcggcatcaagattcgaagataacgaagaactccgatacagccttaggtcaatagaaagacatgcaccctgggtcaggaacatctttattgtgaccaacggccagataccttcatggcttaatctggataatccgagagttactattgtcacccaccaggatgtctttcgcaacctgagccatctgccgaccttcagctccccagccatagaaagccacatccatcgaatcgagggactcagccaaaagttcatatacctcaatgatgatgtgatgtttggcaaggacgtctggcctgacgacttttactcgcattctaaagggcaaaaagtgtacttgacttggcccgtgcccaactgcgcagagggatgccctgggagttggattaaggatggatactgtgacaaagcatgtaacaactcagcatgtgattgggatggaggagattgttcgggaaactccgggggttcccggtacattgctgggggaggcggaaccggttcgatcggagtgggacaaccctggcaattcggaggcggaattaactccgtctcatactgtaaccagggttgtgcaaattcgtggctggctgacaagttctgtgatcaggcctgtaacgtgctgtcttgtgggtttgacgcaggcgattgcggccaggatcattttcacgaactgtacaaggttatactccttccaaaccaaactcattacattattcccaagggggaatgccttccttacttctcatttgctgaggttgcaaagcgcggcgttgaaggggcatactcagataatcccattatacggcatgcgtcgatagcaaacaaatggaaaaccatccatcttatcatgcatagcggaatgaatgccactacgattcatttcaatctgacttttcaaaacactaacgacgaagagttcaaaatgcagatcacggtggaggtggatacccgagaagggcccaaactgaattccactgcacaaaagggctatgaaaatcttgtgagccctattaccctcttgcccgaggccgaaattctgtttgaggacatcccaaaagaaaagcgcttcccaaaattcaagcgccatgatgtaaattcgaccagacgggcacaggaagaggtcaagatacctctggtgaacatcagcctgcttcctaaagatgcccagctctccctcaacacgctggacctgcagctggaacacggagatatcactcttaagggttacaacctttcaaagtcggccctgcttagatcgttcctcatgaactcacagcatgccaagattaagaaccaagccattatcaccgatgaaaccaatgacagcctcgtggcgccccaggagaagcaagtccacaaatcgattcttccaaactccttgggagtgtctgaaaggcttcagcggctcactttccctgccgtgagtgtgaaggtgaacggtcatgaccagggccagaaccctccactggatctggaaactaccgcccgattcagggtggagactcatactcaaaagactataggtggtaacgtgaccaaggagaagcctccatcccttattgtccctctggaatcccagatgacgaaagaaaagaagatcactggaaaagagaaggaaaactcgcgcatggaggaaaatgcagagaaccacattggagtgactgaggtgttgttgggcagaaaactgcaacactacacggattcctacttgggatttttgccttgggagaagaagaagtactttcaggacctcctcgatgaggaagagagccttaagacccagctggcgtactttactgactccaagaataccggaaggcaactgaaggatacctttgcagactcgctgagatacgtgaataagatccttaatagtaagttcgggtttactagccgtaaggtgccagcgcacatgccacacatgattgatcgaattgtcatgcaagagcttcaagatatgtttccagaagaattcgacaaaacgtcgtttcataaggtcaggcatagcgaagatatgcaatttgcattttcctacttttactaccttatgagcgcggtgcaacctctcaacattagtcaggtgtttgatgaagtcgacaccgaccagtcgggtgtcctctctgatagggaaataagaaccctggccacgcgaatccacgaacttcctctgtcgctgcaagatctgaccggcctcgaacatatgctcatcaattgctccaagatgcttcctgcagacatcacgcaactgaacaacatccccccgactcaagaatcatactacgatccaaatcttccccctgtcaccaagtcactggtgaccaactgcaagcctgttaccgataagattcacaaagcgtacaaggacaaaaacaaataccggttcgagattatgggagaagaggaaattgcctttaagatgatccggactaatgtgtcccatgtggtgggccaattggacgacatccggaagaatcccagaaagtttgtttgtcttaacgataacattgatcataaccacaaggacgcacagaccgtgaaagccgtcttgcgcgacttctatgaatcgatgttcccaatcccttcgcaatttgagcttccaagagaataccgcaaccggtttctgcacatgcacgaacttcaagaatggcgagcatacagagataagctcaagttctggacgcactgtgttctggcaactctgatcatgtttactatcttttcctttttcgccgaacaactgattgcacttaagaggaagatctttccacgtcggcgtattcataaggaagctagcccgaatcggatacgcgtg

SEQ ID NO: 16887 - DNA, 3768 bp, Artificial Sequence
  Description of Artificial Sequence: Synthetic coding sequence
atgctcttcaaactgctgcagcggcagacgtacacatgtctgtcccaccgatatggtctgtacgtgtgctttctgggagtggttgtcacaattgtgtctgccttccagttcggggaagtcgtgctggaatggtcccgggatcagtaccatgtgctctttgactcttaccgggacaatatcgcagggaagtccttccaaaacaggctctgcctgcctatgcccatcgatgtcgtttacacctgggtgaacggcaccgacctggagctcctgaaagaattgcagcaggtgagggaacaaatggaggaagagcagaaggcgatgagagagattctggggaagaacaccacagaaccaacaaaaaagtccgaaaaacagctggaatgtcttctcacccactgcataaaagtcccaatgctcgtcctggaccccgcgctgccagccaacatcacgctcaaggatttgccctctctgtacccctccttccattccgcaagcgacatctttaacgtggctaaaccaaagaatccctccactaacgtgagtgtggttgtcttcgactctacaaaggatgttgaggacgcccactctggcctccttaaaggcaattcgcgccagaccgtgtggaggggataccttaccaccgataaggaggtcccggggctcgtgctaatgcaggatctggcatttctgtcaggattccctcctacattcaaggagacgaaccagctgaaaacgaagctgccggagaatctgtcctctaaggttaaattgctccaactttactctgaagccagcgtggctctgttgaagctcaataaccccaaggacttccaggaactcaacaagcaaaccaagaagaacatgactatcgatggcaaggagctgacaatcagcccagcttatcttctgtgggaccttagcgccattagccagtccaaacaggacgaagatatttcagcgtcccggtttgaggataacgaagagctccggtacagcctacggagcatcgagagacatgccccatgggtgaggaacatcttcatcgtaaccaacggccagattccctcctggttgaatttagataatcccagggtcacgatagtcacccaccaggatgtgttccgaaatctgagtcacctccctacttttagttcccctgctatcgaaagccacatccaccggattgaaggtctatctcaaaagttcatatacctaaatgatgacgtcatgtttggtaaagacgtgtggcccgacgatttctactctcacagtaaaggccaaaaagtctacttaacctggcccgttcctaactgcgccgaaggctgcccagggagctggatcaaggatggctactgcgataaggcctgcaataacagtgcctgcgattgggacggcggggactgtagtggaaactctggtgggtcccgctacatcgcagggggtggcggcactgggagcatcggagttgggcaaccatggcagttcggcggcggaataaacagtgtctcgtattgcaaccaagggtgcgccaatagttggctggcagataagttttgtgatcaggcgtgcaatgtcttaagctgcgggttcgatgccggggactgcgggcaggaccacttccatgaactgtataaggtcatcttgctgcctaatcagacgcactacataatcccaaaaggggaatgtctgccttacttttccttcgcggaggtagcaaaacgtggagtggaaggcgcatacagcgataaccctatcatccgccacgccagtattgcaaataagtggaagaccatccacctcataatgcatagtgggatgaacgcaaccacaatccacttcaacctgaccttccagaacaccaacgacgaggaattcaagatgcagatcactgtggaagtcgatacacgcgagggacccaaactcaactccactgcccagaagggttacgaaaacctggtatctcctataactttgctgccagaagccgagattttgttcgaggacatccccaaggaaaagaggtttcccaagtttaaacgtcacgatgtgaatagcacgagaagggcccaggaggaggtgaagattcccttggtcaacatttcacttttacctaaagatgcgcagctgagcctcaacacattggaccttcaactcgaacatggggacattactctgaagggctacaatctttccaagagcgccctactgcgcagctttctgatgaatagccagcatgcgaagatcaagaatcaagccataatcacagatgaaaccaacgactccctagtcgctcctcaggaaaagcaggtgcataagagtatattgccaaatagcctcggagtgagtgagaggcttcagaggttaaccttccccgccgtgtctgttaaggtcaacggtcatgatcaggggcagaatccaccactggacctggagactacagcgaggtttcgcgttgagactcacacccagaagaccatcgggggaaatgtgactaaagagaagcctccctccctgatcgtcccccttgagagccagatgacgaaagagaaaaaaatcactgggaaggagaaagaaaacagtcggatggaggagaatgcagagaaccacattggcgtgaccgaggtgctgctgggccggaagctgcagcactataccgactcttacttggggtttctcccatgggaaaagaagaaatacttccaggatcttctggacgaggaagaatcattgaagacccaacttgcatactttactgattctaaaaacacagggcgacagttgaaggacacttttgctgacagtctgcgctatgtcaacaagatactgaactcaaagtttggcttcaccagccggaaggtgcccgcccatatgcctcacatgatcgacaggatcgtgatgcaggaactacaagatatgtttccagaggagttcgacaagaccagctttcacaaggtccggcacagcgaggatatgcaattcgcattctcttacttttattatttaatgagtgctgtccagcccctcaatatcagccaagtcttcgacgaggtcgataccgatcaatctggcgttttgtcggatcgggaaattagaactctcgcgacaagaatccatgagctaccactgagtttacaggatttaactggactagagcatatgctcatcaattgcagtaagatgctccccgcagatattacccaactcaataacatccctcctacacaggagtcctactatgatcctaacttgccgcctgtcacaaagagcctggtgaccaactgtaaacccgtgacggataagatccacaaagcctacaaggataagaataagtatcgctttgaaattatgggcgaggaggaaatagccttcaagatgattcggactaatgtcagccatgtggtcggccagctggacgacataaggaaaaatccccgcaaatttgtgtgcctcaatgataatatcgaccacaatcacaaagacgcccagactgtgaaagcagtcctgagagatttctatgagtccatgtttcccatcccatcccagtttgaactgcctagggaatataggaacagattcctccatatgcacgaattgcaggagtggagagcttatagggataagctcaaattttggactcactgcgtcctagctaccctgatcatgtttacgatcttctccttcttcgcagaacaactgatcgcactcaaaagaaagatttttccgaggaggagaatacacaaggaggcctcccccaatcgcattcgggtg

SEQ ID NO: 16888 - DNA, 3768 bp, Artificial Sequence
  Description of Artificial Sequence: Synthetic coding sequence
atgctgttcaagctgcttcagcggcagacctacacctgcctttcgcatcgctacgggctctacgtgtgctttctgggagtcgtcgtcactatcgtttccgcgttccaatttggcgaagtcgtgctggagtggtcccgggatcagtaccacgttctcttcgactcgtatagagacaacatcgccggaaagtcatttcagaaccgcttgtgccttcccatgcctatcgatgtcgtgtacacctgggtgaacggaactgatctggaactgctcaaggaactgcaacaggtgcgcgagcagatggaagaggagcaaaaggctatgcgcgaaatcctcggcaagaatacgaccgaacccaccaagaaatccgaaaagcaacttgaatgcctcctgacccattgcatcaaagtcccgatgctggtgctggaccctgcactgccagccaatatcaccctcaaagatctgccatcgctgtacccgtccttccacagcgcctcggatatcttcaacgtggcgaagccgaagaacccgagcactaacgtttcagttgtcgttttcgatagtactaaagacgtggaggacgctcactctggactgctcaagggcaattcaagacagaccgtgtggagaggatacctcaccaccgacaaggaagtccctggcctggtgctcatgcaggacctcgccttcttgtcgggattccctcccacgttcaaagaaaccaatcagctgaaaactaagttgccggaaaatctgtcctcgaaggtcaagctgttgcagctttacagcgaagcgtccgtggcgctcctgaagctgaataaccctaaggattttcaggagctcaacaagcagaccaaaaagaacatgaccattgacggaaaagagctgactatctcccccgcatacctgctctgggacctctcagcaatctcgcaatcaaagcaagacgaagatatcagcgcctcgcgctttgaggacaatgaggagctgagatactccctccggagcatcgaacgccatgccccatgggtgaggaacatcttcatcgtgactaatggacagattccgagctggcttaatcttgataatccgcgcgttacgatcgtgactcatcaggatgtctttcgcaatctgtcccacctgccgaccttctcgtccccggctatcgagtcccatatccaccgaatcgagggcctgtcacaaaagttcatctacctgaatgatgatgtgatgtttggtaaggacgtgtggccggatgatttctactctcactcaaagggccagaaggtgtacctgacctggccagtgccgaactgcgccgagggatgcccgggtagctggatcaaggacggatactgcgataaggcgtgcaacaattcggcctgcgactgggacggaggggactgctccgggaattcaggtggttcccggtacatagctggaggtggcgggaccggatcaatcggggtcggccagccttggcaatttgggggtggcattaactcggtgtcatactgtaaccagggctgtgccaatagctggttggctgacaagttttgcgaccaagcatgcaacgtgctcagctgcggattcgacgcgggagactgcggacaggaccactttcacgagctgtacaaagtgatcctgcttccgaaccaaacgcactacatcatcccaaagggagaatgcctgccgtacttctcattcgccgaagtggcaaagcggggggtcgagggcgcctacagcgacaatccgattatccgccatgcctcaatcgctaacaaatggaaaaccatccatctgattatgcatagcgggatgaatgcaactaccatccactttaacctgacgttccaaaataccaatgacgaggaattcaaaatgcagatcactgtcgaggtggacacgcgggaaggacctaagctgaattccaccgctcagaaggggtacgaaaaccttgtctcgccaatcaccctgctcccggaggcagagattctgttcgaagatattccgaaggaaaaaaggttcccgaaattcaagcggcacgatgtcaattcaactagaagagcacaagaggaagtcaaaatcccattggtcaacatctcgctgctcccaaaagacgcacagctgtcgctgaacactctggatcttcagctcgagcatggagacatcaccttgaagggatacaacctgtcgaaatcggctctgctgagatctttcctgatgaattcccaacacgcgaaaatcaagaaccaggcaatcattactgacgaaaccaacgactcgcttgttgccccgcaagaaaagcaagtgcacaagtccatcttgccgaactcgctcggcgtctcggagcgcctgcaacggctgactttcccggccgtgtccgtgaaggtgaacggacatgaccaggggcagaatccgcctctggacctcgagactaccgcccgcttccgcgtggagactcacactcaaaagaccatcggtggaaacgtgaccaaggagaaacctccttcgctcatcgtgcccctcgaaagccaaatgactaaggagaagaagataactggaaaggagaaagaaaattctcggatggaggaaaacgcggaaaaccatatcggagtgacggaagtgctgctcggaagaaagctgcagcactacactgactcgtacctgggattcctgccgtgggagaaaaagaagtactttcaggacctcctcgatgaagaagaatcgctcaagactcaactggcatactttaccgactcaaaaaacactggccgccagcttaaagacactttcgcggactccctgcggtacgtgaacaaaatcctcaactcaaagttcggcttcacctccaggaaagtgccggcacacatgcctcacatgatcgaccgcatcgtgatgcaggaactccaagatatgttcccggaagagtttgataagacttcgttccataaggtgcgccattcggaggatatgcaattcgctttctcgtacttctactacttgatgtctgccgtgcagccgctcaatatctcccaggtgtttgatgaagtggatactgatcagtcgggcgtgttgtcggaccgggaaatccggactctggccaccagaatccacgagctgccgctgtcgttgcaggacctcacggggctggaacacatgttgatcaactgctcaaagatgctgccagccgacatcacccaactgaacaatatccccccgacccaagaatcgtactacgaccctaacttgccaccggtgaccaagtcccttgtgactaattgcaaaccggtgactgacaagatccacaaggcctacaaggacaagaacaagtaccgcttcgagatcatgggggaagaggagatcgcgtttaagatgattcggaccaacgtctcacatgtggtgggacagctcgacgatatcaggaagaatccacgcaaatttgtgtgcctgaacgacaacatcgaccacaaccataaggatgcccagaccgtgaaggccgtcttgcgggacttttatgaatcgatgttcccgattccctcgcaattcgaactccccagggaataccgaaataggttcttgcatatgcatgagctgcaagaatggagggcctaccgtgacaaactgaaattctggactcactgcgtgctggcaaccctgatcatgttcaccatctttagctttttcgcagagcaactgatcgcgctcaagcgcaagatcttcccgcggcgtcgcatccacaaggaagctagccccaatcgcattcgcgtc

SEQ ID NO: 16889 - DNA, 3768 bp, Artificial Sequence
  Description of Artificial Sequence: Synthetic coding sequence
atgttgttcaagctgctccagcgccaaacctacacttgcctctcccatcggtacggactctacgtgtgtttcctcggggtggtggtgactatcgtgtcggctttccaattcggggaggtcgtgctggaatggtcgcgggaccagtaccatgtgctctttgactcgtaccgcgacaacatcgccggaaagtcattccagaatcggctctgcctgccgatgccgatcgacgtggtctacacttgggtgaacgggaccgatctggagttgctgaaggagctgcagcaagtgcgcgaacagatggaagaagagcagaaggccatgcgggaaatcctgggtaaaaacacgaccgaaccgaccaaaaagagcgaaaaacaattggagtgcctgctgactcactgtatcaaagtgcctatgctggtgctggacccggcgctgccagctaacatcactctcaaagatctcccctcactgtatccttcgttccattcagcgtcagacatctttaatgtggcgaaaccaaagaacccatccacgaacgtctccgttgtcgtgttcgactccaccaaagatgtcgaagatgctcattccggactcctgaagggaaactcgcgccagacggtttggagaggatacctgaccactgacaaagaggtcccgggtctggtgttgatgcaagaccttgccttcctgtccggatttccaccaactttcaaggaaaccaatcagcttaagaccaagctgcccgaaaatctgtcaagcaaggtgaaactcctgcagctttactcagaagcgtcggtcgcgctgctgaagttgaacaacccgaaggatttccaggaactgaacaaacagacgaagaaaaacatgactatcgatggaaaggaactgaccatttccccggcgtacctgctctgggatctgtcagcgatctcacagagcaagcaggacgaggacattagcgcctcgagatttgaagataacgaggaactgcgctactcgttgcggtccatcgaacggcatgccccttgggtgcgcaacatcttcatcgtgactaatgggcaaatcccgtcgtggcttaatctggacaatcctcgggtgaccatcgtgactcaccaggacgtctttaggaatctgagccacctccctaccttctcctcgccagctattgaaagccatatccaccggatcgaaggactctcgcagaagttcatttacttgaatgacgacgtcatgttcggaaaggatgtctggccggacgatttctactcccactcgaaaggacagaaggtgtacctcacctggcctgtgccgaactgcgccgagggctgtcctggatcatggatcaaggacggttactgtgacaaagcctgcaacaactcggcctgtgattgggacggtggagactgctccggcaactcgggtggatcccggtacatcgcgggaggcggagggaccgggagcatcggggtcggacagccgtggcagttcgggggcggcatcaactcggtgtcgtactgcaaccaaggctgcgctaacagctggctggcagacaaattctgcgaccaagcatgcaatgtgctgtcctgcggcttcgatgccggagattgcggccaagaccatttccatgaactctacaaggtgatcctgttgccgaaccagactcattacatcatcccgaagggggaatgtctgccatacttctctttcgcggaagtcgcaaagcgcggggtggaaggagcgtactccgacaacccaatcatccgccatgccagcattgccaataagtggaaaaccattcacctcattatgcattcgggaatgaatgcgactaccatccacttcaacctgacttttcagaacaccaacgatgaagaattcaagatgcagatcactgtggaagtggacaccagagaaggtccgaaactgaactcgaccgctcagaaggggtacgagaacttggtaagccctatcacgttgctcccagaagccgaaatcctgtttgaggatatcccgaaagagaagcggttcccgaaattcaaacggcatgatgtcaactcaactcggagagcacaagaagaagtcaagatcccactggtcaatatctcactgctgccgaaggacgcgcagctctcgctgaacactctcgacctccaactcgagcacggagatatcaccctcaagggatacaacttgtcgaagtcggccttgctcagatcgttcttgatgaattcgcagcacgccaagatcaagaaccaagcaatcatcaccgatgaaaccaacgactcgctggtcgcgcctcaggagaagcaggttcataagtcgatcctgcctaacagcctgggtgtctccgaaaggctgcagaggctgacttttccagcagttagcgtgaaggtgaacggacacgaccagggacaaaaccctcctctcgatttggaaactactgccagattccgcgtagaaacccatactcaaaagaccatcggcggaaatgtgactaaagaaaaacccccatcactcatcgtgcccctcgaatcgcagatgactaaggaaaagaagatcactgggaaggagaaagagaattcacgcatggaggagaatgcagagaaccacatcggcgtgactgaggtgttgctgggacggaagctccagcattacaccgactcgtacctcgggttcctcccatgggaaaagaagaagtacttccaggatctgctggatgaagaggaatcgctgaaaacccaactggcctacttcaccgacagcaagaatacgggccggcagctgaaggacaccttcgccgactccctccgttacgtcaacaagatcctgaattcgaagtttgggttcacttcacgcaaggtccctgctcatatgccgcacatgatcgacaggatcgtcatgcaagagcttcaggacatgtttccagaagagttcgataagacttcgttccacaaagtgagacactcagaggatatgcagtttgccttctcgtacttctactacctgatgtctgcagttcagcctctgaatatctcacaggtgttcgacgaagtcgacaccgatcagtcaggagtcctgtcggaccgggagatcagaacgctggcgaccaggatccatgagctgccactgagtctccaggacctgaccggcctggaacacatgctgattaactgcagcaaaatgcttccagccgacataactcaactgaacaacatcccgccgacgcaggagtcatactacgatccgaatcttccgccggtgactaagtcgcttgtgaccaattgcaagcctgtcactgacaaaattcacaaagcctacaaggacaagaataagtatcggttcgaaatcatgggcgaagaggagatcgcgttcaagatgatcaggaccaacgtgtcgcacgtggtggggcagctcgatgatatccggaagaatcctcgcaaatttgtgtgtctgaacgacaacattgaccacaatcataaagacgcccagaccgtgaaggctgtgctgagagacttctacgagtcgatgtttcctatccctagccagttcgagctgccgcgggaataccgaaaccgcttcctgcacatgcatgaactccaggagtggagagcgtaccgggacaaactgaagttctggactcactgcgtgttggccactctcatcatgtttaccattttctcgttcttcgccgagcagcttatcgctctcaaacgcaagattttcccacggcgcaggatccacaaggaggcatccccgaaccgtatcagggtg

SEQ ID NO: 16890 - DNA, 3768 bp, Artificial Sequence
  Description of Artificial Sequence: Synthetic coding sequence
atgctgttcaagttactgcagaggcagacgtacacctgcctgagccacaggtacggcttatacgtttgcttcctgggtgtggtcgttactatcgtgtctgcctttcagttcggcgaagtcgttcttgaatggtcaagagatcaataccatgtcctgttcgatagttacagggacaacatagccggtaaatccttccagaatcgcctgtgcctgcctatgccaattgatgttgtgtatacttgggtcaacgggactgacctggaactcttaaaggaacttcaacaagtgcgcgaacaaatggaagaagaacagaaagcaatgcgcgaaattcttggcaagaatactacagaacctactaagaagagcgaaaagcaacttgagtgcctgttaacccattgtattaaggttccgatgctggtcctggaccctgcgctccctgcaaacataaccctgaaggatttgcctagcctgtatccaagcttccacagcgcgagcgatatttttaacgttgccaaaccaaagaacccatcaacgaatgttagcgtcgtcgtttttgattcaacgaaggacgtcgaggacgcccactcaggactgctgaagggcaatagccgccaaactgtctggcgtggctatcttacgaccgacaaggaggtaccgggtttggttcttatgcaggatctggcttttctgtctgggttcccacctaccttcaaggaaactaatcagctgaagactaagctgcctgaaaacctgtctagtaaagtcaagctgctgcagctctatagcgaggcttctgtcgccctgttgaaactgaataatccaaaagattttcaagagttgaataagcaaacgaagaagaacatgacaattgacggcaaggagctgaccataagcccggcctatctcttgtgggatctgtccgctatcagtcaatcaaagcaagacgaagatatcagcgccagtcgctttgaggataacgaagaactccgctacagcctgcgcagcatcgagcgccatgctccgtgggtgagaaacatctttatcgtcaccaacggccaaattccttcctggctgaacctggacaatcctcgcgttactatcgtgacccaccaggatgtttttcgtaatctgtcgcatctgcctactttttcgagccccgccattgaatctcatatccaccgcatcgagggtttaagccagaaatttatctatctgaacgacgatgtgatgttcggcaaagacgtgtggccagacgatttctacagtcacagcaaagggcagaaggtttacctgacctggcctgttccgaactgcgccgaaggttgcccgggtagctggatcaaggatggatactgcgataaggcctgcaacaatagcgcctgcgactgggacggaggtgactgttctggaaacagcggcggttcccgctatatcgcaggcggcggcggcacaggaagcatcggcgtgggccaaccttggcagtttggtgggggtataaattccgtttcttattgtaaccaggggtgcgcaaactcttggctggcagacaaattttgtgatcaggcctgcaatgttctcagctgtggcttcgacgcgggggactgtggccaagatcattttcatgagctatacaaagttattctgttgcccaatcaaacccactacatcatccctaaaggcgaatgcttaccttactttagttttgctgaggtcgcaaaacgaggtgtcgagggcgcgtattcggacaaccctattattagacatgccagcatagccaataaatggaaaacgatccatctgatcatgcatagcggtatgaacgcgacgaccatccacttcaatctaacctttcaaaacaccaatgacgaagaattcaagatgcagattacagttgaggtcgatacccgggaaggtccgaagctcaatagcaccgcgcaaaaaggctacgagaatctggtctcaccgattacgctgctgccagaagccgaaattctctttgaagatatcccaaaggagaaacggttcccgaagttcaaaaggcacgacgtcaacagcacccgccgcgcccaggaagaagttaaaatcccgctggtgaacatatctttgctgcctaaagatgcgcagcttagcctgaacactcttgacttacaactcgagcacggagacattacgctcaaaggctacaatttaagcaagtctgcgttgctgcgcagctttctgatgaacagccagcacgcgaaaatcaagaaccaagcgatcataaccgatgaaaccaacgattcccttgttgcacctcaggagaagcaggtgcacaagagcatcctgcctaactctctgggcgtctccgagcgtctgcagcgcctgacatttccagcggtttccgtcaaagttaacggtcacgatcagggccagaatccacccctggatctggagaccaccgctcgctttcgagttgagactcatacccaaaagaccattggaggcaacgtgacaaaggagaagcctccgagtttaatcgtccctctggaaagccagatgactaaggagaagaagatcactggcaaagaaaaggaaaatagcagaatggaggaaaatgccgagaaccacatcggcgttacggaagttctgttgggtcgcaagctgcagcactatacagattcctatctgggcttccttccatgggaaaaaaagaaatacttccaagatctgctggacgaggaagaatcgctgaaaacacagctggcatacttcaccgatagtaagaatacgggccgccagctcaaggataccttcgccgatagccttcggtatgttaacaaaatcttgaacagcaaatttggctttaccagccgtaaagtccctgcacatatgccacacatgatcgatcggatcgtcatgcaggaactgcaggacatgtttccagaagaattcgacaaaaccagcttccataaggttcgccactccgaagatatgcagttcgctttcagctacttttactacctgatgtcagcagttcagccactcaatatctcgcaggtgtttgatgaagtggacacagaccagagcggtgtgctgtccgaccgagaaattagaaccctggcaacccgtatccatgagttgcctctgagccttcaggacctgacaggtctggagcacatgttgatcaactgcagcaagatgctgcctgcagacattacccagctgaacaatatcccgcctacacaggaatcctactacgatccgaatctgccgcctgttaccaagagcctggtcactaactgtaagcccgtgacggataaaatccacaaggcttacaaggacaaaaacaagtatcgttttgaaatcatgggagaagaggagatcgcgttcaagatgattcgcactaacgtcagccatgtggtgggtcagctcgacgacattcgcaagaatccgcggaaatttgtttgtctgaatgacaatattgaccataaccataaagacgcccagaccgtgaaagcagttctgcgcgatttctacgagagcatgttcccgatcccttcccagtttgagctgccgcgcgaatatcgcaatcgcttcctgcatatgcacgagctgcaggaatggcgagcgtaccgagataagctgaagttctggacccattgtgtgttggccacgctgatcatgtttacgatcttctccttcttcgccgaacaattgatcgctctgaagagaaagattttcccgcgccgtcgtatccacaaggaggcgtctcctaatcgcattagagtg

SEQ ID NO: 16891 - DNA, 3768 bp, Artificial Sequence
  Description of Artificial Sequence: Synthetic coding sequence
atgctgttcaagctcctgcagcgccagacgtatacctgcctgtcacacagatatgggctttacgtgtgtttcctcggagttgtcgtgaccatcgtctctgccttccagtttggggaggttgtgttggagtggagcagggaccaataccacgtcctgtttgacagttatagggataacatcgccgggaagtcgttccagaaccgactgtgtctcccgatgcctattgacgtcgtgtatacttgggtgaatggcaccgacttagagttgctcaaggagttacaacaagttcgtgaacagatggaagaggagcagaaagccatgagggaaatccttggcaagaatacaacggagcctactaaaaagagtgagaagcagctggaatgtctactaacacactgcattaaggtgccgatgctggtgctagacccagcattgcccgccaatataactctgaaagatctgccgtccctttatccaagtttccattctgcatctgacatattcaacgttgcaaaaccgaagaatccctccaccaatgtgtccgtagtggtcttcgacagcaccaaagacgtcgaggatgcacacagtggacttctcaagggcaacagccgccagaccgtgtggcggggctacctgactacggataaagaggtacctgggttagttcttatgcaggacctggcttttctgagtggatttcctcctacctttaaggagacaaatcagctcaagaccaagctgcccgaaaacttgagctcgaaggtcaagttgctgcaactgtactccgaggccagtgttgccctgctgaagctcaacaatcccaaggatttccaagaactgaacaagcagacaaaaaaaaacatgacgatagacggaaaggaactcaccattagcccagcctatcttctgtgggatctgtctgctatatcccaatccaaacaggatgaggacatcagtgcctccagattcgaggataacgaggaactgcggtacagcctgaggtctatcgaaaggcatgccccatgggttcgcaatatcttcatagtcactaatggccagatacctagctggctcaaccttgataaccctcgcgtgactatcgtgacccaccaggatgttttcaggaacctttctcacttgcccacattctcatcacctgcaatagagtcgcacattcacaggatcgaaggtctgagccagaaattcatctatctcaatgacgacgtgatgtttggtaaggatgtgtggccagacgacttttatagccacagcaaaggacagaaggtgtacctgacctggcctgtgcccaattgtgcagagggttgccctgggagctggataaaggatggttattgtgataaagcgtgcaacaattcagcatgcgattgggatgggggtgattgttctggtaactctggaggcagccgttacatcgcgggggggggaggcactggatctattggggtcggtcagccttggcagtttgggggcggaattaacagtgtgtcctattgtaatcaaggctgtgcaaactcctggctggccgacaaattctgtgatcaagcatgcaacgtgctctcttgcggctttgacgccggtgactgcgggcaagatcactttcacgaactgtacaaggtgattctgctgcctaatcagacccattacatcattcccaagggcgagtgccttccttacttttccttcgcagaagtcgccaaaaggggcgtggaaggcgcctattcagacaatcccatcataaggcatgcctcaatagccaacaaatggaagacgatacatctgattatgcacagtgggatgaacgccaccacaatccatttcaaccttacatttcagaacaccaatgacgaggaatttaaaatgcaaataactgtcgaggtcgacacaagagaaggaccgaaacttaattcaactgctcagaagggatatgagaatcttgtaagtccaatcactctgttaccggaggcagagatcctgttcgaggacataccaaaggagaagcgctttcccaaattcaaacgccatgatgttaatagcacacgccgagcacaagaggaagttaagatccctctggtgaacatcagtctgttacctaaagatgcccagctgtcattgaataccttggacctgcaactagaacatggcgacattaccctgaaaggatataatctctcgaaaagcgcactgcttcggtctttcttgatgaatagccagcacgcaaaaatcaagaaccaggcgatcattacggatgaaaccaatgactccctggtagctcctcaagagaagcaggttcataagtcgatcctaccgaacagcctgggcgtgtcagaacggctccaaagactcacctttccggcagtcagcgtgaaggtgaacggccatgaccagggccaaaacccccctctcgacctggagacaaccgccaggtttcgggtggagacccacacacagaaaacgattggaggcaacgttaccaaagagaagccaccatcactgattgtaccattggaatcgcagatgactaaagaaaaaaagatcacgggcaaggagaaggagaacagtaggatggaagagaacgcagagaatcacattggagtgacagaggttctcctggggcgcaagttgcagcactacactgactcttatctcgggtttctgccttgggagaagaagaagtactttcaggatctgttggacgaggaggaaagtctgaagactcagctggcctactttacggactcaaagaacaccgggaggcagcttaaggatacctttgctgatagccttcggtacgtaaataagattctgaattccaagtttggcttcacatcaagaaaggtgcctgcccacatgcctcatatgattgatcgcatcgtcatgcaggagttacaggatatgtttcccgaagagtttgacaagacatccttccacaaggtccgacatagcgaggacatgcagttcgccttttcttatttctattatctcatgagtgccgtccagcccctgaatatctcccaagtctttgatgaagtcgacactgatcagtctggggtcctgagcgatcgagagatacgcaccttggccacccgtatccacgagctgccgctatctcttcaagacctaaccgggctggagcacatgctgatcaactgttcgaaaatgctccccgcagatataactcagttgaataacatccctcccactcaggaatcttactatgacccgaatctcccgccagtgacaaagagtctggtaaccaactgcaaacccgtaactgataaaattcacaaggcctacaaggataaaaataagtaccgatttgagattatgggggaagaagaaattgcatttaaaatgatcaggacgaatgtatctcatgttgtcgggcaactcgacgacattcgaaagaacccccggaaatttgtatgcctgaatgacaatattgaccataaccacaaagacgcacaaaccgtcaaggccgtgctgcgggatttttacgagtctatgtttcccattccaagtcaattcgaactgcctcgtgaatacaggaacaggtttttgcatatgcatgaactacaggagtggcgggcctatagggataagcttaagttttggacccactgcgtcttagccacactgatcatgttcaccatatttagcttctttgcagagcagctaattgcactgaaacggaagattttccctcgacggcggattcacaaagaagcctcccctaacagaatccgcgtt

SEQ ID NO: 16892 - DNA, 3768 bp, Artificial Sequence
  Description of Artificial Sequence: Synthetic coding sequence
atgctctttaagctgctgcagaggcagacatatacttgcctctcacacagatatggtttgtacgtatgcttcttgggcgtggtagttaccatcgtgtcagctttccagttcggggaggtggttctggaatggagcagagatcaataccatgtgctgtttgattcctaccgcgacaatattgccggaaaaagcttccagaatagactgtgtctgccaatgcccatcgatgttgtttatacttgggttaatggaacagatttggaactccttaaggaacttcagcaggtacgagaacagatggaggaggagcagaaggcaatgcgcgagatcctgggtaagaacactaccgagcctactaagaagagtgagaaacaactcgaatgccttctcactcattgtattaaggtacccatgctggtgctggatccagcattgcccgcgaacatcaccctgaaagatctcccttctttgtaccctagcttccatagcgcctctgatatcttcaacgttgcaaagccaaagaatccctcaaccaacgtttcagtggtagttttcgacagtactaaggacgtagaggatgcccactcaggcttgctcaagggaaactccagacaaaccgtttggcggggttatctgacaactgataaagaggtgccggggctggtgctcatgcaagacctggcttttctgtcagggttcccaccaacttttaaggaaaccaaccagcttaagactaaactccccgagaacctgtcttctaaggtgaaactcttgcagctttactcagaagctagcgtagcacttttgaagcttaataaccccaaagacttccaggaactgaacaaacagacaaagaaaaatatgacaatcgacggcaaggaactgactataagtccagcctatcttctctgggatcttagcgctatatctcagagcaagcaagatgaggacatctctgcgtcaaggtttgaggacaacgaggaacttaggtattctctcaggagtattgagcggcacgccccttgggtgcgcaacatcttcatcgtgaccaacggccagataccttcctggctgaaccttgataatcctagagttacgattgtgactcaccaagatgtgtttcggaatctgagtcatcttcctaccttctctagccctgccattgaatcccatatccatcgcattgagggactgtcccaaaagtttatctaccttaacgacgatgtaatgttcggtaaggatgtctggccggatgacttctactctcatagcaagggacagaaagtgtatctgacatggccggtaccaaactgcgctgaggggtgccctggctcctggattaaggacggctattgtgataaagcatgcaacaattctgcttgtgactgggacgggggggattgttcaggtaacagcggtggcagtaggtacattgctggcggtgggggtaccggctccatcggagtcgggcagccatggcaattcggggggggaattaattcagtgagttactgcaaccagggttgtgctaacagctggctggccgataagttttgtgatcaagcctgtaatgtccttagctgtggatttgacgccggcgattgtgggcaggaccattttcacgaactgtataaagtgatcctgctccccaatcagacgcattatatcatccctaaaggggagtgtctgccttatttcagtttcgctgaggtggctaagaggggggtcgagggagcctattcagataatcctatcattcggcatgcatcaatcgcaaacaagtggaaaacaatacacttgattatgcattctggaatgaatgcgaccaccattcatttcaacctgacttttcagaacactaacgacgaggagttcaagatgcagattaccgtagaggttgacacacgcgaaggccctaaattgaactccaccgcacagaaaggctatgaaaatctggtatcacctattacgcttctgccagaggctgaaattctgttcgaagacatccccaaagagaaacgctttccgaagtttaagcggcatgacgtgaatagtacaagaagggctcaggaggaggtgaagatccctctggttaatatctctcttctcccaaaggacgcgcagctgtccttgaacacccttgatctgcaactggagcacggggatatcaccttgaagggatacaaccttagtaaatcagcgctgctgagaagcttcctcatgaatagccaacatgccaaaatcaagaaccaggccattatcactgacgagacaaacgatagccttgtggctccacaagaaaaacaggttcacaaatctatactgcccaacagtctgggagttagcgagaggttgcaaaggctgacgtttccagccgtgtcagtgaaggtcaacggccacgaccagggccagaatccaccacttgatctggaaaccaccgccaggtttcgcgtggaaacccacactcagaagactattggcggaaacgtgacgaaagagaagcctccctccctgatcgtccctctggagtcacaaatgaccaaggagaagaaaattaccggaaaggaaaaggagaactcaagaatggaagaaaatgcggagaaccatataggtgtgaccgaggtgcttctgggccgaaagctccagcattataccgattcctatctggggttcctcccgtgggagaaaaaaaagtactttcaggacctgcttgatgaggaagagagcctcaagacacagctggcttactttacggattctaaaaatactggtagacagctgaaggacaccttcgccgactcattgcgatacgtaaataagatcctgaatagcaagttcggttttacctctcggaaagtaccagcccacatgccacacatgatcgaccgaattgttatgcaagaactgcaagacatgttccccgaggaatttgacaaaaccagcttccacaaggtgcggcactctgaggacatgcagtttgctttttcctatttttattacttgatgagcgcagtacagcccctgaatatcagccaagtcttcgatgaggtggacaccgatcagtccggcgtgctgtctgacagggaaatccggacccttgcaacacgaattcacgaactcccgctgtctctgcaggatctgacaggcttggaacatatgctgatcaactgttccaagatgctccccgccgacataacacaactgaataatatccctcccacacaagaatcttactacgatcctaacctgccacctgtgaccaagagtctggttaccaattgcaagccagtcactgataagatacacaaggcatataaggacaagaataaatacaggttcgaaattatgggagaggaggaaatagcgtttaagatgatacggaccaacgttagccacgtcgtcggccagcttgacgacataagaaagaacccaagaaaatttgtgtgcctcaacgacaatatagaccacaaccataaagatgcccaaactgtgaaggcagtgcttcgcgacttctacgagagcatgtttcccattccgtcacagtttgagctccctcgggagtacaggaataggtttctccatatgcacgagttgcaagagtggcgggcatatagagacaagctgaagttctggactcactgtgtcctggccacgctgattatgtttaccattttcagcttttttgctgagcagctcatcgcactcaagagaaaaatctttccacggcgacgaatccacaaggaggcctcccccaaccggataagggtg

SEQ ID NO: 16893 - DNA, 3768 bp, Artificial Sequence
  Description of Artificial Sequence: Synthetic coding sequence
atgctgtttaaattacttcagaggcaaacgtacacctgcctatcacaccgatacggcctgtacgtctgcttcttgggcgtggtagtcaccattgtgagtgcatttcagtttggtgaggttgttcttgagtggtcacgagaccagtaccatgtactgttcgactcttatagggacaacatagcgggaaagagctttcagaacaggctctgcctccccatgcctatagatgtcgtatatacatgggtcaatggtacagatttagagcttttgaaggaactccagcaagtgcgtgagcaaatggaagaagaacaaaaggcaatgcgtgagattcttgggaaaaacacaacagagcccactaagaagagcgaaaagcagctcgagtgcctgctgactcattgtatcaaggtgcccatgctcgtgctggatccagcactgccagccaacataactctgaaggacctgccctccctttacccctctttccattctgcttcagatattttcaacgtggccaagcccaagaacccaagcactaacgttagtgttgtcgtatttgattcaacaaaagacgtcgaggatgcccattctggtctcctgaaaggaaactcacgacaaaccgtctggcgaggatacctgacgacagacaaggaggtgcccggactggttctcatgcaggaccttgcattcctgtctgggtttcccccgacatttaaagaaaccaaccaactcaagactaaactcccggaaaacctatcctcgaaggtgaagttgctccaactgtattcagaagcctcggtggcactgttgaagcttaataatccaaaggactttcaggagctgaacaagcagaccaaaaaaaacatgacaatcgacgggaaggaacttacgattagtcctgcttacttactgtgggacttaagcgccatctctcaatccaagcaggatgaggacatctccgcctctcgcttcgaggataacgaagaacttcggtattcactccggtcgatcgagaggcatgccccttgggttagaaacattttcattgtgacaaatggacaaattccctcatggctgaacctggacaacccccgggttactattgtgacacaccaagacgtgtttcgcaacctgagtcacttgccgactttcagcagtccggctatagagtcccacatccatcgcattgagggccttagtcaaaagttcatttatttgaacgacgatgtgatgtttggcaaggatgtatggccggacgacttttactctcacagcaagggacagaaagtgtatcttacttggcctgtcccaaactgtgcagaaggctgccccggctcatggataaaggacggttactgtgacaaggcatgtaataactcagcttgcgattgggacggcggcgactgttctggaaactctggcggttctaggtatatcgccggtggcggcgggaccgggagtatcggagttggacagccctggcagttcggtggcggcattaattctgtgtcctactgcaaccagggctgcgctaactcttggctggcagataaattctgtgatcaagcttgcaatgtccttagttgcggttttgatgctggggactgtggccaagatcattttcatgagctctataaagttatcctcctgcccaatcagacccactacataattcctaaaggggaatgtctcccatacttcagcttcgccgaggtagcgaagagaggagttgaaggcgcctactctgacaatcctatcattcgccatgcctccattgcaaacaagtggaaaactatacacctgatcatgcacagtgggatgaatgccacaacaattcacttcaacctcacctttcagaacaccaacgatgaggagtttaaaatgcagattacagtggaggtggacaccagagaggggcctaaactgaactctactgcacagaagggctatgagaacctagtatccccaatcacactgctacccgaggccgaaattctgtttgaggatatccccaaagaaaagcgattccccaagttcaaaagacacgatgtcaattctactcgcagggcacaggaggaagttaagattcccttagtcaacatcagcctgctgcccaaggacgctcaactgagtctgaatacacttgacctccagctggaacatggcgacattaccctgaaaggatataaccttagcaaaagtgcactactgcgctcttttttaatgaactcccagcatgccaagattaagaatcaggctataattaccgatgagacaaacgacagcctggtggccccacaagaaaagcaggtccacaaatcaattctgcccaattctcttggcgtatccgagcgtctccagcggctgacctttcctgccgtctctgtgaaagtgaacggccatgaccagggccagaacccaccccttgacctggaaacaaccgcgcgtttcagggttgagacgcacacccagaagacaatcgggggtaatgttaccaaggagaagcctcccagcctcatagtcccactcgagtcacagatgactaaggagaagaaaatcaccggcaaagaaaaggaaaactctcgaatggaggagaatgccgaaaatcacattggggttactgaggtgctccttgggcggaagctgcagcactacaccgacagctacttaggcttcctgccttgggagaaaaagaaatacttccaggacctgttggacgaggaggaaagtctgaaaacacagctggcgtatttcacggattctaagaataccggcaggcagctaaaggacacctttgccgattccctgcgctatgtcaacaaaatcctgaatagtaagttcgggtttacaagtcggaaagttcctgcccacatgccacatatgatcgaccggattgttatgcaagaactgcaagacatgttccctgaagagttcgacaagacttccttccataaggtcaggcacagtgaagacatgcagtttgcattcagttacttctattacttgatgtctgccgtgcagcccctgaacatttcacaggtgttcgatgaggtggatacagaccagtctggggttctgagtgatcgggaaatccgcaccctagccacacgtatacacgagctgccattgtccttgcaggatcttactggacttgaacatatgctgattaactgttccaagatgctgcccgctgatataactcagctcaataacatcccaccaacacaggagtcatattacgacccgaaccttcccccagtgactaagtccttggttacaaactgtaagcccgtgactgataagatccataaagcttacaaagataagaacaagtaccgcttcgaaattatgggcgaggaggaaattgcctttaaaatgatccggacaaacgtgtctcacgtagttggacagctagacgatattcgcaagaatccaagaaagtttgtctgcctcaacgacaatatagaccacaaccacaaggatgctcaaacggtaaaagcggtgcttcgtgacttttatgagtcaatgttcccaatcccatcacagttcgagctaccgagggaatacagaaacaggtttctacacatgcacgaactacaagagtggagggcatatagagataagttgaagttctggacccattgtgtactcgccacactaattatgttcaccatctttagcttttttgcggagcagctgattgctctgaagcgcaaaattttccccagaagaaggatacacaaagaggcaagtcccaatagaattagggtt

SEQ ID NO: 16894 - DNA, 3768 bp, Artificial Sequence
  Description of Artificial Sequence: Synthetic coding sequence
atgctctttaagctgctccaaagacagacctacacgtgtctttcccatcggtacggtctgtacgtgtgctttcttggtgtggtcgtgaccattgtgtcggcatttcaattcggcgaggtcgtgttggagtggtcccgtgatcagtaccatgtgctgtttgattcctacagagacaatatagcaggtaagagctttcaaaacaggttgtgccttccgatgcctatcgacgtggtctacacctgggttaatggtaccgacctggagcttctgaaggagctgcagcaggttcgggaacaaatggaagaagaacaaaaagcaatgcgcgaaattcttggtaaaaacaccaccgaacctacgaagaagtcggaaaagcaactggaatgtctgctgacccattgtatcaaagttcctatgctggtcctggacccagcactccccgccaatatcactcttaaggatcttcctagcctgtacccctcgtttcattccgcgtcagacatcttcaatgtcgcaaagccaaaaaacccctcgaccaatgtctcggtagtggtgtttgattcaaccaaggatgtggaagatgcacattccggtcttttgaaggggaattccagacaaactgtgtggcgaggataccttaccaccgataaagaagtccctggcttggtgctgatgcaagatctggcgtttctgtcgggctttccacctacctttaaagaaactaatcaactcaagactaagttgcctgaaaaccttagcagcaaggtcaaacttctccagctttacagcgaagcaagcgtggcactcctgaagctcaacaaccctaaagattttcaggagctgaacaaacaaacgaaaaagaatatgaccattgacggtaaagagcttactattagccctgcatacctcctgtgggacctctccgccatcagccaatcaaaacaggatgaggatatcagcgcatcccgttttgaagataacgaggaattgcggtattcgcttagatctatagagcgccacgccccttgggtgagaaatatcttcattgtgaccaacggtcaaattccatcgtggctgaacttggataatccacgcgtgactatcgtgacccatcaagatgtgtttagaaacctttcgcaccttccaaccttttcatcaccggcaatcgaaagccacattcatcgaattgaagggctttcccagaagttcatctacctgaacgatgatgtgatgttcggaaaagatgtgtggcctgacgacttttactcgcattccaaaggacagaaggtttaccttacctggcctgtccctaactgcgccgagggttgtcctggatcatggatcaaggatggttactgtgacaaagcctgcaacaattcagcctgcgattgggatgggggagattgtagcggaaattccggaggctcacggtacattgccggcggaggggggaccggaagcattggcgtcggacagccttggcaatttggcggaggtatcaattctgtgtcgtactgcaaccagggctgcgcaaattcctggctggcagataagttctgtgatcaggcgtgtaatgtgctctcgtgtggattcgatgccggcgattgtgggcaggaccattttcacgaactgtacaaggtgattctgctgccgaaccagacccattacatcatcccaaagggggagtgtttgccttacttctcatttgctgaagtcgcaaagcggggtgtggaaggtgcatacagcgataaccccataatacgccatgcatcgattgcaaacaagtggaaaaccattcatcttatcatgcattccggcatgaatgcaacgaccatacactttaatctcacctttcagaacacgaacgatgaggaattcaagatgcagattactgtggaggttgatactagagaggggcccaaactcaactctaccgcccagaagggctacgagaatctggtgtcccccatcacccttctgccagaggctgagattttgttcgaggacatccccaaagaaaagcggtttccaaagtttaaacgccatgatgtcaactcgactagaagggcacaggaggaggtgaagatccctctcgtgaacatttcactgctgccgaaggatgcacagctctcccttaacactctggaccttcagctggaacatggcgatattaccctgaagggctacaatctctcgaaatcggcccttcttaggtcattccttatgaattcccagcatgcaaagattaagaatcaagccatcattacggatgagactaacgactcccttgtggcaccacaggagaaacaagtgcataaatctattctgcctaactctcttggggtgtcggaacggctgcagaggctgacttttcctgcggtgagcgtgaaagtgaacggtcatgatcaaggtcagaatccacctctggacctggagactaccgcacggtttcgagtggaaacccatactcaaaagactattggaggtaacgtgactaaggagaaaccgccatcgttgattgtgcctctggagtcccaaatgactaaagagaaaaagatcaccggaaaggaaaaagagaactcgagaatggaagaaaacgctgagaatcatattggcgtgacggaggtgcttctcggaagaaagctgcagcattacaccgactcctaccttggattcctcccttgggagaagaagaagtacttccaagatctcctggacgaagaagaatcgctgaaaacccaactggcatacttcaccgatagcaaaaacactggcagacaacttaaggatacctttgccgattcgctcagatatgtgaataagatactgaactcaaagttcggatttacgagccggaaagtccccgcacacatgcctcacatgattgaccgcattgtcatgcaggaacttcaagacatgtttcctgaggaattcgataagacttcctttcataaggtgagacactccgaggatatgcagttcgctttttcgtacttttactaccttatgtcagcagtgcagcccctgaacatttcccaagtgttcgatgaggtcgacacggatcagtccggtgtgctgtccgatcgcgaaatccgcacccttgcgaccagaattcacgaacttcctctgagccttcaagatttgacggggttggagcacatgctgatcaattgtagcaaaatgcttcctgcggatatcactcagctgaataacatccctcccacgcaagaatcatactacgatccaaatctgccacctgtcaccaagtcactggtgactaactgcaaacctgtgactgataagattcacaaggcatacaaggataagaataagtacagatttgagatcatgggcgaagaagaaattgcatttaagatgatccgaactaatgtctcgcatgtcgtgggacaacttgatgacattaggaagaacccacgcaagttcgtgtgtcttaacgataacatcgaccataatcacaaggatgcccagaccgtgaaggctgttcttagggacttttacgaatccatgtttccaattccatcccagtttgagctccctcgggaatataggaatagatttctccacatgcacgagcttcaagaatggcgcgcctacagagataagttgaagttctggactcattgtgtgcttgcaaccctgatcatgtttacgattttctcatttttcgcggagcaactcattgcgctgaaacgtaagatttttcctaggagacgaatacataaggaagcatcccctaacagaattagagtg

SEQ ID NO: 16895 - DNA, 3768 bp, Artificial Sequence
  Description of Artificial Sequence: Synthetic coding sequence
atgctgttcaagttactgcagagacaaacttatacatgcctgtcacatagatacggcctgtacgtgtgctttctgggagtggtagtgactatagtgtccgccttccagttcggtgaggtggtgctagaatggtctagggaccagtaccatgtgttattcgactcataccgcgataacattgcagggaaatcctttcagaaccgcctgtgtctcccaatgcccattgatgtcgtgtacacctgggtcaatggcaccgatctggagctactgaaggagctgcagcaggtgcgggaacagatggaagaggagcagaaggccatgagggaaatattaggcaagaacactacagagccgacaaagaaatcagagaagcagctggagtgcctgctgacccactgcatcaaggtgcccatgctcgttctggaccccgcattaccagcaaatatcaccctgaaagacctaccatcattatacccctccttccactccgctagtgatatttttaatgtggccaagcccaaaaacccttcaacaaatgtgtccgtcgtggttttcgactcaacaaaggatgtggaggatgcccacagtggtctgcttaaaggaaattcccgacaaactgtttggcggggatatctgaccacagacaaagaggttccagggctcgtcctgatgcaggatttggccttcctatctggcttcccacctacattcaaagagactaatcagctgaaaactaagctccctgaaaacctgtcaagtaaagttaaactactacagctgtattctgaggcttctgtggcactgttgaagctgaacaatccaaaggactttcaggagctgaataaacagaccaagaagaatatgactatcgatggcaaggaactgaccatttcacccgcttacttactttgggatctgtccgccatatctcagtccaaacaggacgaagacatcagcgcttcaagatttgaggacaatgaggagttgcggtactccctgaggagcattgagaggcatgctccatgggtccggaatatatttatagttaccaatggtcagatccccagctggctgaacttagacaatcctcgcgttaccatcgttacacatcaggatgtcttcagaaatctgagccatctgcccaccttctcatctccagctatcgaatcccatattcaccgcatcgaaggactgtcccagaagtttatttacttgaatgacgatgtcatgttcggtaaggatgtctggccagatgatttctactcacactcaaaaggccaaaaggtgtatctgacatggcccgtcccaaattgtgctgaaggttgccccggttcctggatcaaagacggctactgcgataaagcctgcaacaatagcgcttgtgattgggacggcggggactgcagtggcaactccggcggctcccgatatattgctgggggagggggcactggcagcatcggcgtggggcaaccatggcagttcggcggcggcattaattccgtgagctattgcaatcagggatgcgcaaactcctggcttgccgacaagttctgtgatcaggcctgtaatgtgctgagttgtggctttgatgctggcgactgtggccaggatcatttccacgagctgtacaaggtgatcctgcttccaaaccagacacattacatcatccccaaaggagagtgtctgccttacttcagttttgccgaggtggccaaacgaggagtggaaggcgcatacagcgataatcccataataagacacgcatctatcgccaataaatggaagactatacatctaatcatgcattctggaatgaatgcaactactatccatttcaatctgacattccagaacaccaatgacgaggagtttaagatgcagatcacagtggaagtggatacccgggagggacctaagttgaactcaacagcccagaaagggtacgaaaatttggtgtcaccaattacactactaccagaagccgagatcctgtttgaagatatcccgaaggaaaagaggttcccaaagttcaagcggcatgatgtaaacagtacacgccgggctcaagaggaggttaagataccattggtaaacatctctctactgccaaaagatgctcaactcagcctcaacaccttagatctgcagctggagcacggcgatattaccctgaagggctacaatctgtcaaagagcgcactgctaagaagctttctgatgaactctcagcacgcaaaaattaagaaccaggccatcataaccgatgagaccaacgatagtctagtcgcccctcaggagaagcaggtacataagagcatactgcccaacagcctgggcgtgagtgagagattgcagagactcacattccccgccgtgtcagtgaaggtgaacgggcatgatcagggccagaacccccctctggatcttgagactactgctaggtttcgggtggaaacccatactcagaaaacaattgggggtaatgttaccaaggagaaaccacctagcctaatcgtgcccctggaatctcagatgacaaaggaaaaaaaaataaccggtaaagaaaaggagaacagtaggatggaggagaacgctgaaaatcatataggggtgaccgaggttctgctggggcggaaacttcagcactacaccgatagttacttgggtttcctgccatgggaaaaaaaaaagtattttcaggatctgcttgatgaagaggagtccctcaagacacaactggcatattttaccgactccaagaacactggtcgacaattgaaggacacattcgcagactctctgcgctacgtgaataagatcttgaatagtaagtttggattcacttcaagaaaagtgcctgcccatatgccccatatgatcgatcgaattgtgatgcaggagttacaagatatgtttcccgaggaatttgacaaaacatctttccacaaagttcgccattctgaagacatgcagttcgctttcagctacttttactacttaatgagcgcagtccaacctctgaatatctctcaggtgttcgatgaagtggataccgaccagtctggtgttctaagcgatcgggagataaggacactggccactcggatacatgaactccccctgagcctgcaagacctcactggccttgaacacatgctgattaattgctctaagatgctgcctgcagatattacccagttaaataatatacctcctacccaggagtcctactatgatccaaatcttccacccgttactaaaagcctggttaccaattgcaaaccagtgaccgacaaaatccacaaggcttacaaagataaaaataagtaccgcttcgagataatgggcgaggaagaaatcgccttcaaaatgatccgcaccaacgtgtctcacgtcgtgggacaactggacgacataaggaaaaacccacgcaagtttgtgtgtttaaatgacaatatcgaccacaatcataaggatgcccagacagtcaaggccgtgttacgcgacttttatgagtccatgttccctatccccagccagtttgagctgcctagagagtacaggaacagatttctgcatatgcacgaactgcaagagtggcgggcctaccgggacaagctgaagttttggacccactgcgtgctggctactctgataatgtttacaatattctccttttttgccgaacagctaatagccctaaaacgcaagatttttcctcgaaggcggatccacaaggaggcctctccaaacaggattagggtg

SEQ ID NO: 16896 - DNA, 3768 bp, Artificial Sequence
  Description of Artificial Sequence: Synthetic coding sequence
atgctgtttaaactccttcagaggcagacctacacttgcctcagccacaggtacggcctgtatgtctgttttttgggcgtcgtggtgacaattgtctcagcctttcagtttggcgaggtagtcctcgaatggagtcgcgaccagtaccacgtcctcttcgactcttatagagacaacattgccggaaaatcatttcagaaccggctgtgtctgccaatgcccatagatgtagtatacacatgggtgaacgggaccgacttggaactacttaaagagctgcagcaagttagagagcagatggaagaagagcagaaggcaatgagggagatcctgggtaagaacaccactgagcctacgaagaaatccgagaagcagctcgaatgtttgctaacacactgcatcaaagtccctatgctggtgctggaccctgcgctgcccgccaacattactttgaaggatcttcccagcctgtacccatcattccactccgcaagcgatattttcaatgtcgccaagccaaagaatccatctacaaatgtgtctgtggtcgtctttgactccacaaaggacgtggaagacgctcattctgggctgctgaaggggaactcccgtcagaccgtgtggaggggttacctgacaactgacaaagaggttcctggactggtgctgatgcaagacctagcattcctctcgggattcccgcctacattcaaggagacgaaccaactgaaaacaaagctgccagagaatctgagttctaaggtgaagcttcttcagctttacagcgaggccagcgttgcactcctgaagctcaataacccaaaagatttccaagagttgaacaaacagactaaaaagaatatgacgatcgatggaaaggaattaacaattagtccagcttaccttttgtgggacctctctgccatctcacagtccaagcaagatgaggacatatccgcctcacgatttgaagacaatgaagagctgcgatattcacttaggagcatcgagagacacgctccatgggtgagaaatatctttatagttactaacgggcagatcccttcctggttaaacctcgataatcctagagtgacaattgtaacacaccaagatgtattccgcaatctctctcacttgcctacattctcgagcccagctatagagtcccatatccatcgtattgagggtctgtcccagaagtttatttatcttaacgacgatgtgatgtttggtaaggatgtgtggcctgatgacttctactctcatagtaaaggccagaaggtgtacttgacctggcccgtgcccaactgcgcggagggctgcccaggctcttggatcaaagatggctactgcgacaaagcttgcaacaactcggcgtgcgattgggatggaggtgattgttcggggaacagtggcggttcccgttacatcgctggaggggggggtaccggctctatcggggtaggccaaccctggcagttcggaggcgggatcaactccgtaagctattgtaatcaaggctgtgccaactcctggctggcggacaagttttgtgaccaggcatgtaacgtgctatcttgtggcttcgatgctggagattgcggccaagaccattttcacgagctgtacaaagtgatcctactgccgaaccagacccactacatcatccctaaaggggagtgtctgccatatttcagctttgccgaggtagccaagcgcggtgtggaaggtgcctattcagacaaccctataattcggcacgcaagtatcgcaaataaatggaagaccattcacttaatcatgcattcaggcatgaacgccacgacaatccatttcaatcttacttttcaaaacacaaacgatgaggagtttaagatgcaaataaccgtcgaagtggacaccagagaggggcccaaacttaacagcaccgctcagaaaggctacgagaacctggtgagtcctattactctgcttccagaggcggagatcttgttcgaagatatccccaaggagaagaggtttcccaagttcaagagacatgatgtgaatagtacccggcgggctcaggaagaagttaagatacccctcgtgaacatatccctgctccccaaggacgctcagttgagcctgaacacgctggacctgcagctcgagcacggcgacattaccctgaaaggatacaaccttagtaaaagtgcactgcttaggagctttctcatgaacagtcaacatgcaaaaattaaaaaccaggcgataatcacggatgaaaccaatgactctttggtggctccccaggaaaagcaggtccacaaatccattctccctaactccctcggcgtgtctgagcgcctgcaacgtctaacattccctgcggtgtcagtgaaagtgaatggccatgatcagggacagaaccctccactggatctcgagacaacagcccgatttcgggtggagacacatacccagaagacaatcgggggaaatgtgacaaaagagaagcccccaagcctcatcgtgccactcgagagccagatgacgaaagagaagaagattactggcaaagaaaaggagaatagtcggatggaggaaaacgcagaaaaccacattggggtcacggaggtcctcctaggaagaaaactccaacactatacagactcatacctgggatttttgccatgggagaaaaagaagtactttcaggatttgttggatgaagaggaaagcctaaagacgcagttggcttactttaccgactccaagaatactggtcgtcaacttaaggatacatttgctgactcgttgcgatacgttaataagatattgaacagcaagtttgggtttacatcaagaaaagtgcctgcgcatatgcctcatatgatagataggatagtgatgcaagagctgcaggacatgttccctgaggagttcgacaaaaccagcttccataaggtacggcacagtgaggacatgcagtttgcttttagctacttttattatcttatgagtgccgtgcagccgctgaacatcagtcaggtgttcgatgaggtcgatactgaccaatccggcgtactttcagatcgcgaaattcgtacgctggccactcggatccatgagctaccgttgtcactgcaggacctcaccggcctagagcacatgcttatcaactgctccaagatgctgcccgccgatatcactcagctgaataacatccctccaacccaggagtcctattatgaccccaacttgccacctgtaaccaaatccctagtgaccaactgcaaacctgtgactgataaaatccacaaagcatataaggacaaaaataagtacagattcgagatcatgggcgaggaagagatagcctttaaaatgatacggactaacgtatcccatgtcgtggggcagctggacgatattcgaaaaaatcccaggaaattcgtgtgcctcaatgacaatattgatcacaaccacaaagacgcacagacagtgaaggcagttctaagagatttttatgagtccatgttccctattccttcgcaatttgaactgccccgcgagtataggaaccgcttcttgcatatgcatgaacttcaggaatggcgggcctatagagacaaactaaaattttggacgcattgcgtactggcaacccttattatgtttacaatcttttcgttttttgccgagcagctgatcgccctgaaacgaaagatcttcccgcgcaggaggatccacaaggaggcttcacccaaccggattagagtc

SEQ ID NO: 16897 - DNA, 3768 bp, Artificial Sequence
  Description of Artificial Sequence: Synthetic coding sequence
atgctctttaagctgctccagcggcagacgtacacctgcttatctcatagatatggcctctacgtttgtttcctgggagtggtggttacaatcgtgagcgcattccagttcggcgaggtggtgctcgagtggagcagggatcagtaccacgtgttgttcgacagctaccgggacaacatcgcgggcaaatcgttccagaaccgactgtgcctacccatgcccatcgacgttgtctacacctgggttaatggcacagatcttgaactgctgaaggagttgcagcaggtaagggagcagatggaggaggagcagaaggccatgagagagattctgggtaagaacaccactgagccgactaagaaatcagaaaagcagctggaatgcctgcttacccattgtataaaagtaccaatgctggtactggatccagccttgcctgctaacatcactctgaaggatctgccctccttgtatccttcgttccatagcgccagtgatatcttcaacgttgcaaaacccaaaaatccttccactaacgtcagcgtcgtggttttcgatagtactaaggatgtggaggatgcccactccggactcctgaagggaaattcccgccagaccgtgtggcgtggataccttacaactgacaaagaggtccctggcttagtcctgatgcaggacctcgcgttcctgagcggctttcctccgaccttcaaagaaacaaaccagttgaagacaaaactacccgagaacttatctagcaaagtgaagctgttgcagttgtacagcgaagctagtgtggccctattgaagctgaacaatccaaaagatttccaggagttgaacaagcagaccaagaaaaacatgaccatcgacggtaaggaactcaccatatctcctgcgtatctcttgtgggacctatctgctatctcacagagtaagcaggatgaggacattagtgccagcagattcgaggataacgaggagttgagatactcgctgcggtctatcgagaggcatgcaccctgggtgagaaacatttttatcgtgacaaacggacagataccaagttggcttaacctagataatccccgggtcacaattgttacccatcaagatgtgtttcgtaacctcagccacctgcccacattttctagtccagcaattgaatcccacattcataggatcgagggactgtcccaaaaatttatctacttgaatgacgacgtaatgtttgggaaagacgtctggcctgacgacttctatagtcatagcaagggccaaaaggtctacctgacttggccggtcccaaactgtgccgagggatgccccgggtcgtggattaaggacggatattgtgacaaggcctgcaacaattccgcctgtgactgggatggaggggactgttccggcaattctggtgggagcaggtacatagccggcggaggaggaactgggtccatcggagtcggtcagccttggcagttcggaggaggaatcaactccgtgagctactgtaaccaaggatgcgcgaacagctggctcgcggacaaattctgtgaccaggcctgtaatgtgctgtcatgcggatttgatgccggggactgtggccaggatcactttcatgaactctacaaggtgatactgctccctaatcagacacactacataatcccaaagggcgagtgtcttccctatttttccttcgccgaggtggccaaacggggagttgaaggggcgtattctgataaccctatcattcgtcatgcctccattgctaacaagtggaagactattcacctgatcatgcattcaggtatgaacgccacaactatccatttcaatctcacctttcagaacaccaacgacgaagaatttaagatgcagattaccgtagaggttgacactcgagagggcccgaaactgaacagcaccgctcaaaaaggctatgagaatctggtctcccctatcactctgctgcccgaggccgaaatcctgttcgaggatatcccgaaagaaaagcgatttccaaaattcaagagacatgacgtgaactccactcgccgggcccaagaggaggtgaaaataccccttgtgaatataagtcttctaccaaaagatgctcagctatcactgaacacactcgatctgcagctggaacacggtgatattacccttaagggctacaacctctctaagagcgcactactgcgctcattcctaatgaactctcagcacgccaagattaagaatcaggcaatcatcaccgacgaaactaatgacagccttgtcgccccgcaggagaaacaggtgcacaagtctattctcccaaactctctcggggtcagtgaacgtctgcagagactgactttccccgctgtctcagtcaaagtaaacgggcacgaccagggacaaaacccacccctggatttggaaacgacggcccggtttagagtggagacgcacactcaaaagaccataggcggtaacgtgaccaaggaaaaacctcctagccttattgtgcctctcgagagccagatgacaaaggaaaaaaaaattaccggcaaagaaaaggaaaattcacggatggaagagaatgccgagaatcacatcggcgtgacagaggtgctgctcggccgcaaattacagcactataccgattcttatttgggtttcctgccatgggagaagaaaaaatatttccaagacctcttagacgaggaagagtcactgaaaacacagctggcatacttcaccgatagtaaaaacaccggtaggcagttgaaagacacattcgccgatagtcttcggtatgtgaataaaattctcaactctaaattcgggttcaccagcaggaaggtgcccgcccatatgcctcacatgattgaccggattgtgatgcaggagttacaggatatgttccccgaagaattcgacaagactagcttccataaagtgcgccatagtgaagacatgcaatttgcatttagttatttttattacctgatgagcgccgtccagcccctcaacatttcacaggttttcgacgaggtggatactgatcaaagcggcgtgctctctgatcgggaaattagaacattggccacaagaattcatgaactgcccctctctctgcaggacctcaccgggctggagcacatgctaataaattgttccaagatgctgccagcagatataacccagctgaataatattccacccacacaggagtcgtattacgacccgaacctcccgcctgtgaccaagtccctggtcacgaattgtaaaccggtcaccgataagatacacaaagcctataaggataagaacaagtatcggtttgagatcatgggggaagaagaaattgctttcaaaatgatacgtacaaatgtgagccacgtggttggccagcttgatgacatccgcaagaacccacggaaatttgtctgtctgaacgacaacatcgatcacaatcataaggacgctcaaacggttaaagccgtcctaagagacttctatgagagcatgtttccaattccttctcagttcgaactccctagggagtaccgcaaccggttcctgcacatgcatgagctacaggagtggcgggcctaccgggataagctgaaattctggacccactgtgtcctggcgactcttatcatgttcactatcttctccttcttcgccgaacagctgatcgctctgaagcggaaaatattcccccggcggaggattcacaaggaagctagtcccaaccgcattagggtc

SEQ ID NO: 16898 - DNA, 3768 bp, Artificial Sequence
  Description of Artificial Sequence: Synthetic coding sequence
atgttgtttaagcttttgcagaggcagacatatacctgcctgtctcacagatatggcctgtatgtgtgttttctgggagtagtagtaacaattgtgtctgcttttcaatttggcgaagtcgtgctcgagtggtcgagggatcaataccatgttttgtttgattcatatagggataacatcgctggaaaatcctttcaaaataggctgtgcctgcccatgccaatcgatgttgtgtacacttgggtcaatggaacagacctcgaactcctgaaggagctccaacaggttagggagcagatggaggaggagcaaaaagccatgcgcgagattctgggaaagaacacaaccgagccgaccaagaaaagcgagaagcagctcgaatgcctccttacccattgtattaaggtgccgatgctggtgctcgatcctgctctgccagctaacatcaccctgaaggacctcccctctctctatccctcgttccacagcgccagtgacattttcaacgtggctaagcctaagaacccaagcactaatgtttctgtcgtcgtgtttgatagcaccaaggacgtggaagacgctcatagtggactgttaaaaggcaatagccgccagaccgtttggcgcggctatctgaccaccgacaaggaggtgccaggcctggtcttgatgcaagatctcgccttcctgagcggcttccctccaacatttaaagaaacaaaccaactgaagactaagctccctgaaaacttgagcagcaaggtgaagctgctgcagttgtatagcgaggctagcgtggctctgctgaaacttaataatccaaaagatttccaggaactgaacaagcagaccaagaaaaacatgaccatcgacgggaaggaactgacaatcagtcctgcctatctactttgggatctgtctgcaatctctcagtctaaacaggacgaggatatcagcgcaagcagatttgaggataacgaggagcttcggtacagtctcagatcaatcgagaggcacgccccttgggtgaggaacatctttatcgtgacaaatggccaaatcccttcttggctgaatctggacaatccccgggtgaccatcgtcacacatcaggacgtgtttcgcaacctgtcccacttaccgacattcagcagcccagcgattgagtcgcacatccaccgaattgaaggactctctcagaagttcatatacctcaatgatgacgtaatgtttgggaaagacgtctggcccgacgatttctatagccatagcaagggccagaaggtgtatctgacctggcctgtgcctaattgtgccgagggctgcccaggatcatggattaaagacggttactgcgacaaagcttgcaacaattcagcttgcgattgggacgggggcgattgttctggaaactcaggtggaagccgctatatagccggcggcggaggaaccggttcaattggggtaggccagccctggcaattcggcggcggaatcaattcagtgtcctattgtaaccagggttgcgcaaactcttggttggcagacaaattttgtgatcaggcctgcaatgtgctcagctgcggatttgacgctggcgactgtggccaggatcattttcacgagctgtacaaggtcattttactgcctaatcaaacacactatattatcccgaagggggaatgcctgccttacttctccttcgcggaagtggccaagaggggtgtggaaggtgcttactccgacaacccaatcataaggcacgcctctatcgctaacaaatggaaaacaatccacctgataatgcactcagggatgaacgcaacgaccattcattttaacctgactttccagaataccaacgatgaagaattcaagatgcagatcaccgtggaagtcgatactcgtgagggccccaagttgaactctacagcccagaagggatacgagaatctggtgtctccaatcacactgctgcctgaggcagagatactttttgaagacatcccaaaagagaagagatttcctaagttcaaacgccacgatgtgaatagcactagacgggcacaggaggaagttaaaattcctcttgtgaacatcagtttactgcctaaggacgcacagctgtcgctaaacaccctggatttgcagctggagcacggcgacattacattaaagggctacaatctgagcaagtccgcattgcttaggtctttcctgatgaattcccagcacgcaaagattaaaaaccaagctattataacagacgaaaccaacgacagcctcgtggcccctcaggaaaaacaagttcacaagtctatcctgcctaactcactaggcgtgagcgaacggttgcagaggcttacatttccagctgtatctgtcaaagtcaacggacatgaccaaggacagaatccacctctggatctggagaccacggctagattccgcgtcgaaacacatacccaaaaaaccataggcggcaacgtcaccaaagagaaaccaccctcactgatcgtcccattagaatcacagatgaccaaggaaaagaagattaccggtaaagagaaggaaaatagcagaatggaagaaaacgctgaaaaccatattggggtgacagaagtacttctcggaagaaagctacaacactatacagatagctatctcgggtttctaccttgggagaagaagaagtacttccaagatctgttggatgaggaagagtcactgaagactcagctcgcttattttacagattcaaaaaacaccggtcggcagttaaaggacactttcgcagattctcttcgctatgtgaacaagatcttgaacagcaaatttggcttcacatcccgcaaagtgcctgctcacatgccacacatgatcgacagaatcgtcatgcaagagttgcaggacatgttcccagaggagtttgataagacctcgttccacaaagtcaggcatagtgaggatatgcaatttgcattctcatacttttattatctcatgagcgccgtgcagcccctgaacatcagtcaggtgtttgatgaggtcgacacggaccagagtggggttctctctgaccgggaaatccggacattagcgaccaggatccatgagctgccactgtcgctacaggacctgaccggcctggagcacatgcttatcaactgctctaagatgctgcccgccgacatcacccaactgaacaatataccacctacccaagagtcatactacgacccgaatctacctccagtaactaagagtctcgttaccaactgcaagcctgttaccgataaaattcataaagcatataaggataaaaacaaatataggtttgagataatgggcgaagaggagattgcttttaaaatgattaggacaaacgtgagccatgtggttggacagcttgacgatatcagaaaaaacccacgaaagtttgtgtgcctaaatgataacatcgatcacaatcacaaagacgcacaaaccgttaaggccgtgttgagggatttctacgaaagcatgttccctatccctagtcaattcgaactcccaagagaatatcgcaaccgttttttacatatgcacgagcttcaagaatggagggcttatcgggataagctaaaattttggacccactgtgtcctcgctaccctgatcatgttcacaattttcagcttttttgctgaacaactcatcgcactcaaaagaaagatcttcccaaggaggcggatccacaaggaggcgagcccgaacagaatacgcgtc

SEQ ID NO: 16899 - DNA, 3768 bp, Artificial Sequence
  Description of Artificial Sequence: Synthetic coding sequence
atgttgttcaaattgctgcagcgacagacttatacatgtctatctcaccgatacggcctgtatgtttgtttcctgggcgttgtggtgactatcgtgtcagcctttcagtttggtgaggtggtccttgaatggtcacgagatcagtaccacgttctctttgacagctatcgagacaatatagcgggaaagtcatttcagaacagactctgtctgcccatgcccatcgacgtggtttacacttgggttaacggaaccgatcttgaacttttgaaggagcttcagcaagttagagagcaaatggaggaagagcagaaggcaatgagagagatcctaggtaaaaatacaacagaaccgacaaaaaagtcagagaaacaacttgaatgcctgcttacacactgtattaaagtgccaatgctggtgttggatcctgcattgccagccaatatcaccttaaaagacctgcccagcctgtacccatctttccactctgcttcagacatatttaacgtggccaaaccaaagaacccgtccactaacgtgtcagtggtggtgttcgactccactaaagacgtcgaagacgcccattccggcctgctcaagggtaactcacgacagacagtctggcgggggtatctgaccaccgacaaagaggtccccggcctggttctgatgcaggacctcgcatttttgtcgggatttccgcccaccttcaaagagaccaatcagctgaaaaccaaactgccagaaaacctatcgagcaaagtgaaattgctgcagctatactccgaggcaagcgttgccctactgaagctcaacaaccctaaggactttcaggaattaaacaaacaaacaaaaaaaaacatgaccatcgacggaaaagaactcacgatttctcctgcctacctgctgtgggacctctcggccatcagtcagtctaagcaagacgaagatatctccgctagcagattcgaagacaacgaagaacttaggtattcactgcgaagtatagagcgacacgcaccatgggtgcgaaatatcttcattgtaaccaacgggcagataccttcatggcttaacctggataaccctagagtgaccattgtaactcaccaggacgtgttcaggaacctgtctcacctccccacattcagcagtcctgccatcgagtcgcacattcacagaattgaagggctgagccagaagtttatctatcttaacgatgacgtcatgttcgggaaagacgtgtggcctgatgacttttactcccacagcaagggccagaaggtgtacctaacgtggcccgtgcccaattgtgctgaagggtgtccagggtcttggataaaggacggctactgcgacaaagcctgcaataacagtgcatgtgactgggatggcggagattgcagtggaaattctggcggaagcagatacatcgccggcggggggggcaccggatctatcggcgttggtcagccctggcaattcgggggcggcatcaattctgtgagctactgcaatcagggatgcgccaactcatggctggctgataagttctgcgaccaagcctgtaatgtcctgtcatgcggttttgatgctggcgattgtggacaggatcattttcatgagctgtacaaagtgatactgcttcctaaccaaacccactatatcatccctaaaggggaatgtctcccatatttttcttttgccgaagtcgctaagagaggtgtggagggggcctactccgataatcctataattcgacatgcatctatagctaacaaatggaagacgattcatctcattatgcatagtggcatgaatgctaccacaatccatttcaacctaacctttcagaacacaaacgacgaggagtttaaaatgcagattactgtcgaagttgatacccgggaaggccctaaactcaattcgaccgcccaaaagggctatgaaaatctcgtctctcccatcacactgctgccggaagccgagatcctgttcgaagatataccgaaggagaaacgatttccaaaattcaagaggcacgatgttaactccacgagaagagctcaggaagaagtgaaaatcccactggttaacatttcgctgctgccgaaagacgcgcagctgagcctcaacacactggacctgcagctggagcacggcgatataacattgaaaggttataacctatctaagagtgcattactgcggtcatttctgatgaacagccaacacgcaaagataaagaatcaggcaattatcactgatgagaccaacgatagcctggttgcccctcaagagaaacaggtgcataaaagtatactgccaaactctttgggcgtgtcagaacgactgcagaggctgacctttcccgctgtgtccgttaaagtgaacgggcatgaccagggccaaaatccgccactggacctcgaaacaaccgcgcgttttcgggtggagacccatactcagaaaacaatcggtggcaacgtgacaaaagagaaacctcctagcctcatcgtccctctcgaaagtcagatgaccaaggaaaagaagatcacaggcaaggaaaaggagaattctcggatggaagaaaatgctgagaatcatatcggcgtcaccgaggtgctgctgggacgtaaactgcaacactacacagattcctatctgggattcctgccctgggaaaagaaaaagtactttcaggacttactcgacgaagaggaaagcctaaagacgcagctcgcatacttcaccgatagcaagaataccggcaggcaattaaaggacacattcgccgattcattgcgatatgtcaacaagattttgaactccaagttcggattcacaagtcgcaaggtcccggctcacatgcctcacatgatagaccggatcgtgatgcaagagctgcaggatatgttccccgaagagttcgataagacttcatttcacaaagtgagacacagcgaggacatgcagttcgcgttctcctacttttactacctcatgtctgctgtgcagcctttgaatattagccaagtgttcgatgaggtcgacaccgatcagtctggcgtgctatcagacagggaaatcaggactctggccactcgaatacatgagcttcccctgtcactccaggacttgacaggactagaacacatgctgatcaattgtagtaagatgctgccagcggacatcacgcaacttaacaatattcctcccacacaagaaagctactatgaccccaatctcccacctgtaacaaaaagcctggtgaccaactgcaagcctgtgacggacaaaatccacaaggcctacaaagataagaacaaataccgatttgagatcatgggtgaggaggaaatcgcttttaaaatgattaggactaacgtttcccatgtagtcggtcagcttgacgatatcagaaagaacccgcgaaaattcgtttgccttaatgacaacatcgatcacaatcataaggacgcacagacagttaaagctgtcctgcgagacttttatgagtctatgtttcccatcccatcccaatttgaactcccaagggaatatcgaaaccgttttctgcacatgcatgaacttcaggagtggcgagcctaccgcgataagcttaagttttggacgcattgtgtcctcgcgactctaatcatgttcaccatcttcagcttttttgccgaacagctgatagcactgaagcgtaaaatctttccaagacgacggattcacaaagaagcgagtccgaatcgcatcagagta

SEQ ID NO: 16900 - DNA, 3768 bp, Artificial Sequence
  Description of Artificial Sequence: Synthetic coding sequence
atgcttttcaaattgttgcagaggcagacttatacatgtctctcccaccggtacgggctctatgtatgtttcttgggagtggtggtcactatagtgagtgctttccaattcggagaggtggtattggaatggtctcgagatcagtatcacgtgctttttgattcttaccgggacaatatcgcagggaagtcctttcagaaccggctgtgcctgccaatgcctatcgatgtggtttatacatgggtcaatgggactgacctcgaattgctcaaagaactccagcaggtcagggagcagatggaagaggagcagaaagctatgcgagagatactgggaaaaaacactactgagcccactaaaaaaagtgaaaaacaacttgaatgccttttaacacattgtatcaaagtgcctatgcttgtattagatcccgctttaccagcgaatatcacactgaaggacctaccttctctgtatcccagttttcactcggcttcggatatatttaatgttgcaaagccaaagaatccttcgacaaacgtgagtgtggtcgtttttgatagtactaaagatgtcgaggatgcacattctggactcctgaaaggaaactcaagacagactgtctggcgggggtacctgactactgataaggaagtcccaggattggtcctcatgcaggatctcgcatttttatcagggtttccaccaacattcaaagagacaaatcagctaaaaacgaaacttcctgaaaacctgtcctccaaagtgaaactgctccagctctattccgaggcttcagtcgctttactaaaacttaacaacccaaaagatttccaggaactcaacaagcagacaaaaaagaatatgacaatagatggaaaagaactcacaatttctcctgcatatcttctgtgggatctaagtgccatctcccagtccaaacaggatgaagatatctctgcctctaggttcgaggataacgaagaacttcggtattcactacggtcaatagaaaggcatgccccatgggtgcgcaatatcttcatcgtaacaaatggacagataccctcatggttgaatctggataatcctagggtcactatagtgactcatcaagacgtgttccggaaccttagtcatctgcctactttttcgagtccagccatagagtcacatatacaccgcatagagggactctcccagaaatttatttatcttaacgatgatgtgatgttcggaaaggatgtgtggcctgatgatttctatagtcattcaaaaggacaaaaagtgtacctgacgtggccagttcccaattgtgccgaaggatgtcctggaagttggataaaagatggatattgcgataaagcatgtaataacagtgcctgcgattgggatgggggagactgttcaggaaactccggaggatcacgctatatcgctgggggggggggaacaggatccataggagttggacagccctggcagttcgggggagggataaactctgttagttattgcaatcaaggatgtgctaactcttggctcgctgataaattctgtgatcaggcctgtaatgtcctctcctgtggatttgatgccggagattgcgggcaggatcattttcatgagctgtataaagtgattctcctcccaaatcagacacactatatcatacccaagggggaatgcctgccatacttctccttcgctgaggtcgccaaacgaggagtggaaggagcctatagtgataaccctataatacgccacgcctccatagccaacaaatggaaaactatccaccttatcatgcactccggaatgaacgccactacaatccattttaatttaacttttcagaacacaaacgatgaagaattcaaaatgcagattacagtagaagttgatacaagagaggggcccaaactaaactcaacagcacaaaaaggatatgagaacttggtttctcccattacattattgcctgaggccgagatcctgttcgaagatatacccaaagagaaaaggttccccaaattcaagcgacacgacgtcaactcaacacgacgggcacaggaagaagttaaaatacccctggtcaacatctctctccttccaaaggatgctcagttatcattaaacactctcgatcttcagctggaacatggagatatcactctcaaaggatataatctgtcaaaaagtgcattactgagatcttttctaatgaattcacagcacgccaagattaaaaaccaggcaatcataactgatgaaactaatgatagtctggtggccccccaagaaaaacaggtccataaatccatacttcccaacagtctcggggtatctgaacggctacagcgactaacattcccagccgtatcagttaaagttaatggacacgaccaggggcagaaccctccactggatctggaaactacagcccggtttcgcgtcgaaacacacacacagaaaacaatagggggaaacgtgacaaaagagaaacctccttccctcatagtccccttagagtcccagatgactaaggagaaaaaaattactggaaaagaaaaagagaactccagaatggaagaaaatgccgaaaatcacatcggagttactgaagtgctgctcgggcgcaaattgcagcattacactgattcctatctgggattcctgccttgggagaaaaaaaaatacttccaggatctcttagatgaggaagaatctttaaaaacacagttggcatactttacggattctaaaaacacaggaaggcagcttaaagatacttttgcagattcattaaggtacgtaaacaaaatacttaactcaaaatttgggttcacttctcgcaaagtcccagcccacatgccccatatgatcgatcgaattgtgatgcaggaactccaggatatgttccccgaagagttcgataagacttcgttccacaaagtgcgccattctgaagatatgcagttcgcattttcctatttctattatttaatgagtgcagtccagcccttaaacatatctcaagtgttcgatgaagtcgatactgaccagtctggggtgctttctgatcgagagatccgcacacttgctactcggatccatgaactgcccctatccctgcaggatctaactggactagaacatatgcttattaattgctctaaaatgttgcccgccgatataacacagcttaataatatacccccaacacaggaatcttattatgatcccaacctcccaccagtgacaaaaagtctcgtgacgaattgtaagccagttacagataagatccataaagcatataaagacaaaaataaatatagatttgagatcatgggggaagaagagatagcattcaaaatgatccgaacaaatgtgagtcacgtggttgggcagctcgacgatatcagaaagaaccccagaaaattcgtctgtctaaacgataacatagaccacaatcataaagatgctcagacagtcaaagcggtgctccgcgatttctatgaatcgatgttccctatcccctctcagtttgagctgccccgggaatatcggaacagatttctgcacatgcatgaactgcaggagtggcgcgcatacagagataagctcaaattttggactcattgtgtgctggcaactctgataatgttcacgatattttccttctttgctgagcagctgatagccctgaagcgaaagatctttcctcggcggcggatccataaggaagcaagtccaaatagaattagggtg

SEQ ID NO: 16901 - DNA, 3768 bp, Artificial Sequence
  Description of Artificial Sequence: Synthetic coding sequence
atgcttttcaagttgctgcagcggcagacatacacttgtctgtcgcatagatacgggttgtatgtgtgcttcctcggagttgtcgttaccattgtatccgcctttcagtttggcgaagtagtgctggagtggtctagggaccagtaccacgttctcttcgactcatatcgtgacaacatagctgggaaatcttttcagaaccgactgtgtctccctatgcctattgacgtggtttacacttgggtaaacggtactgatctggagctgctgaaggaattgcagcaggttcgggagcagatggaggaggagcagaaggccatgagggagattctgggtaagaatacgaccgagcccacaaaaaaaagcgagaagcagctggaatgccttctaacccattgtataaaggtgcctatgctggtactggatcccgcgctgcctgcgaatattaccctgaaggatctcccgtccctgtatccctctttccactccgcatcagatattttcaacgtggccaagccgaaaaatccaagcactaacgttagcgttgtcgttttcgacagcaccaaagatgtggaagatgcacactccggcctgttgaaaggaaacagtcgccagactgtgtggaggggctacttaactacagataaagaagtacccggactggtcctgatgcaagacttagccttcctgtccggcttccctcctaccttcaaggaaacaaaccagctcaagaccaagctgccagagaacttgagcagcaaggttaagctcctgcagctctacagcgaggctagtgtggctttgttgaaactgaataacccaaaggattttcaggaactcaataagcagaccaaaaagaacatgacaatcgacggtaaggaactgactataagcccagcttatctcctctgggatctgtccgccatctcacagagcaaacaagatgaagacatcagtgccagcagatttgaagacaatgaggaattgcgatacagtttaaggtccatagagcgccacgctccatgggtgaggaatatatttattgtgacaaatggccagattccgtcatggctcaacttggataaccccagagtcacaatcgtcacacatcaggacgttttccgcaacctcagccacctgccaacattctcgtcccctgctatcgagtcgcacatccatagaatcgagggcctcagccagaaatttatctatcttaatgatgacgtgatgtttgggaaagatgtatggcccgatgatttctactctcacagtaaggggcagaaggtgtatctcacctggcctgtacctaattgcgccgaggggtgtcccggctcttggataaaggacggatactgtgataaggcatgcaacaacagtgcatgcgattgggatgggggcgactgtagtggaaactccgggggtagcagatacattgccggcggcggcgggacgggcagcatcggcgtgggacagccttggcagttcggaggcgggatcaacagcgtgagctattgcaaccagggatgtgccaattcttggctggctgataagttctgcgatcaagcctgtaatgtgctctcctgcggctttgatgcgggtgactgcggccaggaccacttccacgagttatataaagtcatcctccttcctaaccagacccactacatcatcccaaaaggcgaatgtcttccttatttttcttttgccgaagtagccaagagaggggtggaaggcgcctatagtgacaacccgatcatccggcacgcatctatcgcaaacaaatggaagaccatccacctgatcatgcactccggcatgaacgccaccaccattcactttaacttgacattccagaacactaatgacgaagagttcaagatgcagatcaccgtggaggtggacacccgtgagggacctaaactaaactcaacggctcagaagggctatgaaaatctggtgagccctatcaccctgctgcccgaagccgagatcctgttcgaggacatacctaaggaaaaaaggttccctaagtttaaaagacatgatgtgaacagcacaagaagagcccaagaagaggtaaagatccccctcgtcaacatcagtctgttgcccaaagacgcgcagctatcactcaacaccctagacctgcaacttgagcacggtgatattacactcaagggttacaatctctctaaaagtgctcttcttcgttcatttttgatgaacagccagcatgctaagataaaaaaccaggccattatcacagatgaaacaaatgattcattggttgctccccaggagaaacaagttcacaaatccatcctgccaaatagtcttggggtttccgagaggttgcagaggcttacatttcccgccgtgagtgtgaaagttaacggtcacgaccagggacagaatcctccactggacctggagacaactgcaagattcagagtcgagactcatacccaaaagacgattggtggaaacgtgacaaaggaaaagccccctagcctcatcgtgccactagaatcacagatgactaaggagaaaaaaatcaccggaaaggaaaaggagaatagccggatggaagagaatgcggaaaaccatatcggcgtaacagaagtcctgctggggcgaaagctacagcattacaccgactcttacctcgggttcctaccatgggaaaagaaaaaatattttcaggatttgctggacgaggaagagtctctgaaaacccagctagcatactttaccgattccaaaaacactgggcgccagctaaaagacacatttgcggacagcctcaggtacgtcaacaagattctcaatagcaaattcggcttcacttctcggaaggtcccagctcatatgcctcacatgatcgacaggattgttatgcaagaactacaggacatgtttcctgaggaattcgataaaacctcttttcacaaggttcgacacagtgaggacatgcagttcgccttttcgtatttttactacctaatgtcagcggtgcaacccctgaatattagccaggtttttgacgaagtggatacagaccagagtggagttttaagcgatcgcgagattaggaccctggcaaccagaatacacgaactgcccctctctctacaggacctgacagggctggaacacatgctgattaactgttctaagatgcttccggccgacataacccagctgaacaacattccacccacacaggaatcctattatgatcctaatctgccccctgtgacaaaaagtttggtgaccaactgcaagcccgtgaccgacaagatccacaaagcctataaagataagaacaagtaccggtttgaaatcatgggagaagaggagatcgccttcaaaatgatccgcacaaatgtcagccacgttgtcgggcagctggacgatattcgcaagaacccccgaaaattcgtgtgcttgaacgataacattgatcacaatcacaaagacgcacagactgtcaaagctgtgctgcgcgacttttatgagtcaatgttccctataccgagccagttcgagctgcctcgcgagtacagaaaccggtttctgcacatgcatgaactccaggagtggcgcgcttaccgtgataagttaaagttctggacccattgtgtcctggccactttgatcatgtttacgatcttcagttttttcgctgagcagctcatagccttaaagcgaaaaatctttcccaggagacgcattcacaaggaggcctcccctaatcgcattcgtgtc

SEQ ID NO: 16902 - DNA, 3768 bp, Artificial Sequence
  Description of Artificial Sequence: Synthetic coding sequence
atgctgtttaagctcctgcagcggcagacctacacctgcctgagccaccgctacggactttacgtgtgtttcctcggagtcgtggtgaccatcgtcagcgccttccaattcggcgaggtggtgctggagtggtcgcgtgaccagtaccacgtgctcttcgacagctacagggacaacatcgccggaaagagctttcaaaataggctgtgtctgccgatgcccatcgatgtggtgtacacctgggtgaacggaactgatctggagctcctgaaggagctgcaacaagtccgcgaacaaatggaggaggagcagaaggcgatgcgggaaatcctgggaaaaaacactaccgaaccgactaagaagtcagagaaacagctggaatgcctgctgactcactgcattaaggtcccgatgctggtgctggacccagcgctcccggccaatatcaccctgaaggatctgccatcactgtacccctccttccactcggccagcgacatcttcaacgtggccaagccgaagaatcctagcaccaacgtctcggtggtggtctttgactcgaccaaagatgtggaggacgctcactccggactcctgaaaggcaactcgcggcagaccgtttggcggggctatctcactaccgacaaggaagtcccaggactcgtgctgatgcaagatctggcgttcctctccggtttcccacctacgtttaaggagactaatcagttgaaaactaaactgccagagaatctgtcctcgaaggttaaactcctgcagctgtactctgaggcctcggtggccttgcttaagctgaataaccccaaggacttccaggaactcaataagcaaactaaaaagaacatgaccatcgatggaaaagaactgacgatctctccagcgtatctgctgtgggacctctcggctatctcacaatcgaaacaagacgaggacatttcagcgtcacgattcgaggataacgaagaacttcgttactctctgcgctccattgagcgtcacgccccgtgggtccggaacatctttatcgtgaccaatggacagatccctagctggctgaacctggacaaccctcgcgtcactatcgtgacccaccaggacgtctttcggaacctgagccacctgccgactttctcctccccggccatcgagagccatatccatcgcatcgaaggactgtctcaaaagttcatttaccttaatgacgacgttatgtttggaaaggacgtgtggcctgacgatttctacagccactcgaaaggacaaaaggtgtacctgacctggcccgtgccaaattgcgccgaggggtgtccgggttcatggatcaaagacggatactgcgataaggcctgcaataactcggcatgtgattgggacggaggagactgttccgggaactcggggggttcgagatacatcgccggaggcggaggaaccggctcgataggagtgggccaaccgtggcagttcgggggaggcatcaactcggtgagctactgcaaccaaggctgcgcgaactcgtggctggcagacaagttttgcgatcaggcctgcaacgtgctgtcgtgcggattcgacgcaggtgattgcggtcaggatcatttccacgaactctacaaggtgatcctcctgcctaaccagacccactatatcattcctaaaggagaatgcttgccttacttctcgtttgcggaagtcgctaaacgcggtgtcgagggagcgtactccgacaacccgatcatccggcacgcgtcaatcgcaaacaagtggaaaactattcacctgatcatgcactccgggatgaatgccaccaccatccacttcaatctgacgtttcagaatactaacgacgaggagttcaaaatgcagatcaccgtggaggtggacactcgcgagggaccaaaactcaattctactgcccagaagggatacgaaaacctcgtctccccgatcaccctcctcccagaggcggagattctcttcgaggacatcccaaaggaaaagcgcttcccgaagtttaaacgccacgatgtgaattcaaccagaagagcacaggaagaagtgaagatccctctcgtgaacatctcgcttctgcctaaggatgcgcagctttccctcaacactttggacctccagctggaacatggtgacataactctgaaaggctacaatctctcgaagtcggcgctgctgagatctttcctcatgaactcccagcacgcgaagatcaagaaccaggcgatcattactgacgaaaccaatgatagcctggtggcgcctcaggaaaaacaagtgcacaaaagcattctccccaatagcctcggagtgtccgagaggctccagcggcttaccttccctgccgtttcagtcaaggtcaacggacatgaccaaggtcaaaatccgcctttggacctggaaacgaccgccagatttcgcgtggagactcatacccagaaaactatcgggggcaatgtgacgaaagaaaagccaccaagtctgatcgtgccactcgaatcgcaaatgaccaaagagaagaagatcacggggaaggaaaaggagaactcccggatggaagaaaacgcagaaaatcatatcggagtgactgaagtcctgcttggaagaaaactgcagcattacaccgatagctacctcggctttctgccctgggagaagaagaagtactttcaggatctcctcgatgaagaggaatcactgaaaacgcagctggcgtacttcaccgacagcaaaaacaccggacgccaactgaaagacacctttgccgattctctgcggtacgtgaacaaaatcttgaactccaagtttggattcacttcgagaaaggtgccggcgcacatgccccacatgatcgaccgcatcgtcatgcaggagttgcaggacatgtttccggaagagttcgacaagacttcattccataaggtgagacacagcgaagatatgcaattcgcattcagctatttctactacctgatgagcgcggtccagccgctgaatatctcacaggtctttgacgaagtcgatacggatcaatcaggagtcctttcggaccgcgaaatacgcactctcgcaactcgcatccatgaactgccactgtcgctgcaggacctgactggactcgagcacatgctgattaactgcagcaagatgctgccagccgacattacccagctgaataacattccgccaactcaggagtcatactacgacccaaacctgccgccagtcactaagtccctggtgaccaattgcaagccggtgaccgataagatccacaaggcatataaggataagaacaagtaccggtttgaaatcatgggagaggaggaaatcgcattcaaaatgattcggacgaatgtgtcacacgtcgtgggccagctggatgatatccgaaagaatccacgtaagttcgtgtgtttgaatgataacatcgatcataaccacaaggacgcgcaaactgtgaaggcagtgctgagagatttctatgaatcgatgttcccgataccttcccaattcgaactcccaagagaataccggaacaggttcctgcatatgcacgaactccaagagtggcgcgcctaccgcgacaagctgaagttctggacccattgcgtgttggcaactctcatcatgttcaccatcttttcgttctttgccgaacagctgatcgcgctcaagagaaagatcttcccacgccgccgcatccataaggaagcctcgccaaatcgcatccgggtc

SEQ ID NO: 16903 - DNA, 3768 bp, Artificial Sequence
  Description of Artificial Sequence: Synthetic coding sequence
atgctgttcaagctgctgcagagacagacgtacacttgcctgtcgcatcggtacgggctgtacgtctgctttctcggagtggtggtgactatcgtgtcggcctttcaattcggggaggtcgtgctggaatggagccgggaccaataccacgtgctcttcgattcgtatcgcgataacattgctggaaagtcgtttcagaaccgactgtgcttgccaatgccgatcgacgtggtctacacctgggtgaatgggaccgatctggaattgctgaaagagctccagcaagtgagagagcagatggaagaggaacagaaggcaatgcgagaaattctcggtaagaacactaccgaacccaccaaaaagtccgagaagcagctggagtgcctgctcactcactgcatcaaggtgccaatgctggtgctcgacccggccctcccggccaacatcactctcaaagacctcccctcactgtacccctcctttcactcagcctcagatatctttaacgtagccaaacctaaaaacccgagcacgaacgtctcggtcgtcgtctttgattcaaccaaggatgttgaggacgctcatagcggacttctgaaggggaactcgcggcagaccgtctggagaggatacctgaccactgacaaggaagtccccggacttgtgctgatgcaagatctggccttcctgtccggatttccgccaacttttaaggaaaccaaccagctgaaaaccaagctcccagagaacctgtcatccaaggtcaagctgttgcagctctactccgaggcatctgtcgcgctgctgaagctcaacaaccccaaggacttccaggagctcaacaaacagactaagaagaatatgacgatcgatggaaaagaattgactattagcccggcctatctgctgtgggacctttctgcaatttcgcaatcgaaacaagacgaagatatctcggcctcacgcttcgaggacaatgaagagctgcgctactcgctgcgcagcattgaacgccacgccccatgggtgcgcaacattttcatcgtcaccaacggacagatcccatcgtggctgaatctcgacaacccgcgcgtcaccatcgtcactcaccaggacgtgttccggaaccttagccatctgccgacttttagctcgcccgccatcgagagccacatccatcgcatcgagggactgtcacaaaagttcatctacctgaacgatgacgtgatgttcggcaaagacgtgtggccggacgacttctacagtcactccaagggccaaaaggtgtatctcacttggcccgtgcctaattgtgccgaaggatgtccgggatcatggattaaagatggctactgcgataaggcatgtaacaattcggcttgcgattgggatggcggggactgttcggggaattcgggaggaagcagatacattgctggaggaggcggcactggctcgatcggagtggggcagccatggcagttcggcggaggaataaacagcgtctcctactgcaatcaaggatgcgcgaacagttggctcgcggacaagttttgtgaccaggcctgcaacgtgctgtcctgcggattcgacgcaggagactgtggtcaggatcacttccatgaattgtacaaggtgatcttgctgccaaatcaaacccattacatcatcccaaagggagaatgcctgccctacttttccttcgccgaggtggcaaagagaggcgtcgagggagcgtactcagacaacccgattatccggcacgcatccattgcaaacaagtggaaaactatccacctgatcatgcattcgggaatgaatgcgaccaccatccactttaacctgaccttccagaacactaacgacgaagagtttaagatgcagattacggttgaggtcgacacccgcgaaggaccgaaattgaattcgactgcgcagaagggatacgagaacctggtgtccccaatcactctgctgccagaggcggaaatactgttcgaagatatcccgaaggagaagcgttttccgaaattcaagcggcatgacgtgaattcgacccggagggcgcaagaagaggtcaagatcccgctggtgaacatttcccttctgccaaaagacgcccagctctcactgaatacgctcgatctccagcttgagcacggggatattacccttaaaggctacaacttgtccaaaagcgccctgctgcggtcatttcttatgaattcacaacatgcgaaaatcaagaaccaagccattatcaccgacgaaaccaatgactccttggtggcaccacaggagaagcaggtgcacaagtcaattttgccgaattcattgggagtgtccgagcggctgcagcggctgaccttcccagctgtgtccgtgaaggtgaatggccacgaccagggccagaacccgcctctcgacttggagactactgctagattccgggtagaaacccacacccaaaaaactattggcggaaacgtaactaaggagaagcctccgagcctgattgtgcctctcgaatcgcagatgaccaaggagaaaaagataactggaaaagagaaggaaaactcgcgaatggaggaaaatgccgagaaccatatcggagtgaccgaagtgttgctggggcgcaaacttcaacattataccgattcatacctgggttttctgccgtgggaaaagaagaaatacttccaagacctgctggacgaagaggaatcgcttaagacccaacttgcttacttcactgacagcaagaatactggaaggcagctcaaagacacgttcgctgattccctgcggtacgtgaataagatcctcaactcaaagttcgggttcaccagtcgcaaggtcccggcgcacatgcctcatatgatcgacagaattgtgatgcaggaactgcaggacatgttccctgaagaatttgacaagactagctttcacaaagtgcgccatagcgaagatatgcagttcgcattctcatacttttactacctcatgtccgcggtgcagccgctcaacatctctcaagtctttgatgaagtcgataccgatcagtccggcgtgctctcggaccgcgagatcagaactctcgcgacccgcattcacgagctgccgctctccctgcaggacctgactggtctggagcatatgcttatcaactgctccaaaatgctcccggctgacatcacccagctgaataacatcccgccgacccaggagtcgtactatgaccccaatctcccaccggtcaccaagtcactcgtgactaactgcaagcccgtgactgacaagatccacaaggcctacaaggataagaacaagtacagatttgagatcatgggagaggaagaaatcgcgtttaagatgatccgtactaacgtatcacacgtggtgggacagctcgacgatatccggaaaaacccgaggaaattcgtctgcctgaacgacaacatcgatcataaccataaggacgctcagaccgttaaggccgtcctgagagacttttatgagagcatgttcccaatcccttcgcaattcgagctgccgcgggagtaccggaaccggtttctgcatatgcacgaacttcaagaatggcgggcctaccgggataaactgaagttctggactcactgcgtcctggcaaccctcatcatgttcactatcttttccttcttcgccgagcagctgattgcactgaagagaaagatcttcccgcgccgcagaatccacaaagaagcctccccgaacagaatccgggtg

SEQ ID NO: 16904 - DNA, 3768 bp, Artificial Sequence
  Description of Artificial Sequence: Synthetic coding sequence
atgctgttcaaacttctgcaaaggcaaacctacacctgtctttcccacagatacggcctttatgtgtgctttctcggggtggtcgtgactattgtttcggcatttcagtttggagaggtggtgctggagtggtcgcgcgatcagtaccatgtgctgttcgactcctatagggataacattgcaggcaaatccttccagaatcgcctgtgccttccaatgccaatagatgtggtgtacacctgggtgaatggtactgacctcgaactgctgaaggaacttcagcaagtgcgcgaacaaatggaagaggaacaaaaggctatgagggaaattcttggcaaaaacacgactgaaccgaccaaaaagtcggaaaagcaactcgagtgtctcctgacccattgcattaaggtgcctatgttggtgctcgaccctgcccttcccgcaaacatcacccttaaagatctgccctccctctaccctagcttccattccgctagcgatatctttaacgtcgcaaaaccaaagaacccatccaccaacgtgagcgtggtcgtgttcgattcaaccaaggatgtggaagatgcccattcgggactgctgaaaggaaacagccgccaaaccgtgtggcgaggttacctcactactgacaaggaagtgcccgggttggtgcttatgcaggacctggctttcctgtcaggcttcccgccgacctttaaggaaactaaccagttgaaaactaagctgcctgagaacctttcctcgaaggtcaaactgctgcaactgtactcggaagcatccgtggcacttctgaaacttaacaacccaaaggatttccaagagttgaacaaacaaaccaagaaaaacatgaccattgatgggaaggaacttactatttcgcccgcctacctcctttgggatctgtcggcaatttcgcaatccaagcaagatgaggatatatcagctagtcgtttcgaggataacgaagaacttaggtattcactcagaagcatcgaacgtcacgcaccgtgggtgcggaatatctttatagtcacgaatggacaaattcctagctggctcaaccttgacaaccctagagtgacgattgtgacgcatcaagacgtctttcgcaatctttcgcacctgccaaccttttcctcaccagcaattgaatctcatattcaccgcatcgagggactgtcgcagaagttcatttacctgaacgatgacgtgatgttcggtaaggatgtgtggccggatgatttctactcccattcaaaggggcagaaggtgtatttgacctggccagttcccaactgcgcagaaggttgccctggatcgtggatcaaggatggatactgcgacaaggcatgtaacaacagcgcctgtgattgggatggtggtgattgcagcggaaactccggaggaagcaggtatatcgccggtggtggaggcaccggttccataggggtgggccaaccatggcagtttgggggaggcataaactcggtgtcgtactgtaaccaaggttgcgcgaactcatggctcgcagataagttttgtgaccaagcatgtaatgtgttgtcatgtgggtttgacgccggcgattgcggtcaagaccattttcatgaactttacaaggtgattcttctgcccaatcaaacccattacattatccctaagggagagtgtttgccttacttctcgtttgcggaggtggcaaagcggggtgtggaaggtgcctactcggacaaccctatcattcggcatgccagcatcgccaacaagtggaaaacgatacatctgatcatgcactccggaatgaacgcaactaccatccactttaatctcactttccagaacactaatgatgaagaattcaagatgcaaataaccgtcgaagttgataccagggagggtccaaagctcaattcgactgcacagaaaggatacgaaaatctcgtgtccccaataacccttcttccagaagccgagatactgttcgaggatattcctaaagaaaagcgattccccaaattcaagcggcatgatgtgaactcgactcgcagggcacaagaagaagtcaagattccactcgtgaacatctcgcttctgcccaaggatgcacagttgtcacttaacacccttgacctgcagctggaacatggcgatattaccctgaaaggttacaatcttagcaagtcggcgctgctgaggtcatttctgatgaattcccaacatgcgaagatcaaaaatcaagcaatcattaccgatgaaactaacgattccctcgtggctcctcaggagaagcaggttcataagtcaatccttccaaattcgctgggcgtctccgagagacttcagcggcttaccttccctgctgtgtccgtgaaggtgaacggtcacgatcagggtcagaatcctccactggatcttgaaaccacggcacgttttagagtcgaaacccatactcaaaagacgatcggaggaaacgtgacgaaggagaagcctccatcgctgattgtcccacttgaatcccagatgactaaggagaagaagatcaccggtaaggaaaaagagaactcccgtatggaagagaatgcagaaaaccacatcggcgtcactgaagttctcctgggaagaaagctccagcattacaccgactcctatctcggctttctcccatgggaaaagaagaaatactttcaggacctgctggacgaagaagaatcgttgaaaactcagttggcttacttcaccgattctaagaataccggcagacagcttaaggacacgtttgctgactcgttgcgatacgtgaacaagattcttaactccaagtttggtttcacctcccggaaggtccctgctcatatgcctcatatgatcgatcggattgtgatgcaggagcttcaagatatgtttcctgaagagtttgacaagacttcgtttcacaaagtgagacatagcgaagatatgcagtttgcatttagctacttctactacctgatgagcgccgtgcaaccactgaacatttcccaggtgttcgatgaggtggatactgaccagtccggtgtcctgtccgatagagagattcggacccttgctactcgaattcatgaactccccctctcccttcaagacctcaccgggcttgaacatatgctgataaactgctccaaaatgttgcctgccgatattactcaacttaacaacatcccacctacccaagagtcgtactatgacccaaatctgcccccggtgaccaagtcgttggtcaccaattgcaagcctgtgaccgacaagattcataaagcctacaaagataagaacaagtacaggttcgagattatgggagaagaagaaatcgcttttaagatgatcagaaccaacgtgtcccacgtggttggacagctcgatgatatacgcaagaacccaagaaagtttgtctgcctgaacgataacatcgaccataatcataaagacgcgcaaactgtcaaggcagtcttgcgtgacttttacgaatcgatgtttcctattccctcgcaatttgagctccccagagagtatcgcaatagattcctgcatatgcatgagcttcaggagtggcgggcataccgggacaaactcaagttttggacccattgtgtgctcgccaccctgatcatgttcaccattttctcgttcttcgcagaacaacttatagcacttaagagaaagatcttcccaaggcgcagaatccacaaggaggcatcacctaacagaatccgggtg

SEQ ID NO: 16905 - DNA, 3768 bp, Artificial Sequence
  Description of Artificial Sequence: Synthetic coding sequence
atgttattcaaactgctgcagcgacaaacttacacatgcttgtctcaccgctatggcttgtatgtatgttttctaggggtcgtggtaaccatcgtcagcgcatttcagtttggggaagttgttctggagtggagtcgggaccagtaccatgtgctgttcgactcctatcgcgataatatcgccggtaaatcttttcagaacagactttgtttgccgatgcctattgacgtcgtgtatacatgggtgaacggaacagatctggagctgctcaaagagttgcaacaggtaagggaacagatggaggaagagcaaaaggccatgagagaaattttaggcaaaaacactaccgagccaacaaagaaaagtgaaaaacaactcgagtgcctccttacacactgtattaaagtgccaatgctagttctggaccctgccttacccgcaaacattaccctgaaagacctgccctctctgtaccccagcttccatagcgcctcagatattttcaacgtagccaagccaaaaaatccttccaccaacgtttccgtggtggtgttcgactctactaaagatgtggaagacgcacactctggtctattaaaagggaacagcagacagactgtgtggagaggctacctgaccaccgataaggaggtcccgggtctagtcctgatgcaggacttggcctttctttctggctttccacctacattcaaagaaaccaatcagctgaagaccaagctgccagagaatctctcctcaaaagtgaagctcctgcaactctattccgaagcaagcgtggcactcctgaagctgaataatcctaaagattttcaggaacttaacaagcagactaagaaaaatatgaccatcgatggcaaagaactgactatctctccagcctatctgctttgggatctgtcagcgataagtcagtctaagcaagacgaagacatctcagcttcacgcttcgaggataacgaagagttacgttattctctgcggtcaattgagaggcacgctccatgggttcggaatatttttatcgtgaccaacgggcagatcccttcatggttaaacttggacaaccctcgcgtgacgatcgtaacgcaccaagatgtgttccgcaacttgtctcacttgccaacgttcagcagccctgcaatcgagtcgcatatccatcgtattgaaggactgagccagaagtttatatacctgaatgacgacgtgatgtttggcaaagatgtgtggccggatgatttctactctcactccaagggtcaaaaggtttacctgacctggcccgtgcccaactgcgccgagggatgcccaggctcgtggataaaagatggatactgcgataaagcttgtaataactccgcgtgtgattgggacggcggcgactgctctggaaactcgggagggtcgcgatacatcgctggaggaggcggcaccggctccattggggtcggacagccgtggcagttcggcggaggtataaattctgtatcttattgcaaccaggggtgcgccaattcctggctggccgataaattctgcgaccaggcatgtaacgtgctgagctgtggcttcgacgctggggactgtggccaagaccatttccacgagttgtacaaggtaatattactgccaaaccagactcactatataattcctaaaggcgagtgtctaccttattttagcttcgctgaagtcgcaaaaaggggggttgagggagcatactcggacaatccaatcattcggcatgcctcaatcgctaacaagtggaaaactattcaccttattatgcattccggtatgaacgccacgactatccactttaatctgacattccaaaacaccaatgacgaagagtttaagatgcagatcaccgtcgaggtagatacccgcgagggacctaaactgaactccactgcacagaagggttatgaaaaccttgtatcacccattactcttctgccggaagccgaaattttattcgaagatataccaaaggaaaagaggttcccaaaattcaagcgccatgacgtgaactcgacccgtagagcccaggaagaagtgaaaattcccctcgtcaatataagccttttacccaaagacgcgcagttgagtctgaataccttagacctgcagctcgagcatggggatattactcttaagggctataacctgagtaaatccgccctgcttagatcattcctaatgaactcccaacatgccaagattaaaaaccaggctataatcaccgatgagacaaatgactctctggtggcaccacaggagaagcaagtgcataagtccattctcccaaacagcctcggggtgagcgagcggcttcaacgcctgaccttcccagcagtctctgtcaaggtaaacggacacgatcagggccagaaccccccactggacttggaaacaaccgcccgttttcgggtagaaacacacactcaaaagactatcggtggcaacgtgactaaggagaaaccccctagtttgatcgtcccactagaatctcagatgacaaaggagaagaagatcacaggcaaagagaaagagaactcacgaatggaggagaacgccgagaatcatatcggtgtgacggaagttctcctgggccgtaaactgcagcactatactgactcatacctcggttttttaccttgggagaaaaagaagtatttccaagatctgctcgatgaggaggaatcacttaaaactcaactcgcatacttcaccgatagcaagaacacagggcggcagttaaaggatacctttgcagactcactgcggtatgtgaataagatcctaaactctaaatttggattcaccagccgtaaggtaccagcccacatgccccacatgatagatagaattgttatgcaggagctacaggatatgtttcccgaagaatttgataagaccagtttccacaaggtgcgccactctgaggatatgcagttcgccttctcttacttttactacctgatgtccgccgtgcagcctctgaacatctcacaggtgttcgacgaggtagacacagaccaaagcggcgtcttgagcgaccgcgaaatcagaaccctcgcaaccaggattcatgagcttccgctctctctgcaggatctcacgggactcgagcacatgctgattaactgttctaaaatgctccctgccgacatcactcagctaaacaacatccctcccacgcaggaatcttactatgacccgaacctccccccagtgacgaagagcttggttacaaattgcaagccggttaccgacaagatacacaaagcgtataaggataagaataagtacagatttgagatcatgggggaagaggaaatcgccttcaagatgatccgcacaaacgtttctcacgttgttggtcagctcgacgacattcggaagaatccacgcaagttcgtatgccttaatgacaacatcgaccacaatcacaaggatgcacagactgtgaaggccgtgttgcgagacttttatgagagcatgtttccgataccttctcagttcgaattgcccagagaataccggaatcgcttcttgcacatgcatgaactgcaagagtggcgcgcttaccgcgataagctgaaattttggactcactgtgtgctcgccacactgataatgtttaccattttctccttcttcgctgagcagctcattgctctgaagaggaaaatctttccgcgacggcgtatacataaagaggcctctcctaacagaatccgtgtt

SEQ ID NO: 16906 - DNA, 3768 bp, Artificial Sequence
  Description of Artificial Sequence: Synthetic coding sequence
atgctctttaagctgttgcagcgccagacctacacttgtctttcgcatcgttacgggctctacgtgtgctttctgggggtggtggtgactattgtgtcagcctttcaatttggggaagtggtgctggaatggtccagagatcaataccatgtgctgtttgattcataccgagataacattgcaggtaaatcgtttcagaacaggctctgcctgcccatgccaattgatgtagtctacacttgggtgaatggtaccgacctggaactgctgaaggagctccaacaggtgagagaacagatggaagaggaacagaaggccatgagagaaattctcggaaagaataccactgagcctactaagaagagcgagaagcaacttgagtgtctccttacccactgcatcaaggtgccaatgcttgtgctggatcctgcacttccagccaacattacccttaaggatttgccttccctttacccgagcttccattccgcatcggacattttcaacgtggcaaagcctaagaacccttccaccaacgtttcggtggtggtgtttgactcgaccaaggatgtcgaggatgcgcacagcggacttctcaagggtaacagcagacaaactgtgtggcgcggctatctgaccactgataaggaagttccagggctggtcttgatgcaagatttggcgtttctgagcggatttccgcctactttcaaggagactaatcagcttaaaaccaagctcccggaaaacctgagctccaaggttaaacttcttcagctgtactccgaagccagcgtggcactgctcaaacttaacaatcccaaagattttcaagaacttaacaagcaaactaagaagaacatgactattgacggtaaagaattgaccatctccccggcttacctgctgtgggaccttagcgccatttcacaatctaaacaagatgaagatatctccgcgtcgagatttgaggacaacgaggaactgaggtacagcctgcgttcgattgagcgccacgcgccgtgggtgcggaacatcttcatcgtgactaacggacaaatcccatcgtggctgaacctcgataatccgcgggtcaccatcgtgacccatcaggacgtctttaggaacctttcgcatctgcctactttttcgtctccagcaattgaatcccatatccatcgcattgagggactgtcccagaagtttatctacctcaatgacgatgtgatgtttggtaaggatgtgtggccagacgacttttactcgcattccaaaggacaaaaggtgtacctcacgtggccagtgcctaattgcgccgagggttgcccgggatcatggatcaaggacgggtattgtgacaaggcatgcaataacagcgcgtgcgattgggatggaggagattgttcgggaaatagcgggggatcgcgctacatagcgggcggcggcggtacgggttcgatcggtgtgggccagccatggcagtttggcggaggaatcaactcagtgtcctactgtaatcaaggatgtgcgaactcctggctcgcagacaaattctgtgatcaagcctgtaatgtgctctcctgcggttttgacgctggagattgtggccaggatcactttcatgaactctataaggtgattcttttgcctaaccagactcattacattattcccaagggcgaatgccttccctacttctcgttcgcagaagtggctaagcgaggggtcgaaggcgcatactccgacaaccctatcatacgacatgcctccattgccaacaaatggaaaactattcaccttatcatgcactccgggatgaacgcaaccacgattcatttcaatctcacttttcaaaatactaacgatgaggaattcaaaatgcagattactgtcgaagtggatacccgtgagggccccaagctgaactccaccgcgcagaagggatacgaaaacctggtcagccccatcacgttgctccccgaagcagagattctttttgaggatataccgaaggagaaacggtttccaaaattcaagcgacatgatgtgaactccactcgcagagcccaggaggaggtgaagatcccccttgtaaacatctcgctgttgcctaaggacgcgcaactctcactgaacaccctggacctccaactcgagcatggggacattactctgaaaggttacaacctgtcgaagtcggcactgcttcggagctttttgatgaattcccagcatgcaaaaatcaagaaccaagctattatcacggatgaaaccaacgattcactcgtggcaccacaggaaaagcaggtgcataagagcatccttcctaactccctgggagtgtcagaacggctgcagaggctgacttttccagctgtgtccgtgaaggtgaacgggcacgaccagggacaaaaccccccactggatcttgaaaccaccgctcgcttccgggtcgagactcatactcaaaagaccattggcggtaatgtgaccaaagaaaagccgccatcccttatagtccctcttgagtcccagatgaccaaggaaaagaaaatcacgggaaaggaaaaagagaattccaggatggaggaaaacgccgaaaaccatatcggagtcactgaagtcctgctgggaagaaagctgcagcattacactgactcctacctgggattcctgccttgggaaaagaagaagtacttccaggatctgctcgatgaagaagaaagtcttaagacgcagctggcatactttactgattcgaagaatactggtcgtcaactgaaagacacctttgccgactcgctccgctacgttaacaaaatacttaactcgaaatttgggtttacttcgaggaaggttccagcccacatgccacatatgatcgatagaattgtgatgcaagagcttcaagacatgttccctgaagaattcgataagacttcctttcataaggtgcgacattccgaggacatgcaatttgctttttcatacttctattacctcatgtcggcggtgcagcctttgaacattagccaggtgttcgacgaggtcgacaccgatcaatcgggagtgctctccgacagagaaatcagaaccttggcaaccagaatccacgaactcccactttccctgcaagacctgaccggacttgaacacatgctgatcaactgttcgaagatgcttcctgcagacattactcaactgaacaacataccccctacccaggaatcatactatgaccctaatttgcctccggtgactaaaagcctcgtgacgaattgtaagcccgtgactgacaagatccataaggcctacaaagataagaataagtaccggttcgagattatgggcgaggaggaaattgcctttaagatgatccgtactaacgtgagccacgtggtgggtcaacttgatgatatccgcaagaaccctagaaagtttgtgtgcctgaacgataacatcgaccacaaccataaggatgcacagacggtgaaggcagtcctgcgcgatttctacgaatcaatgttcccaattccatcacagttcgaactccctcgtgagtaccgcaatcgatttctgcacatgcatgaattgcaagaatggcgggcctacagggataagctcaagttttggactcattgtgtccttgcaactctgattatgtttaccattttctcgttttttgcggaacagctgattgcccttaagaggaagatttttcctcgtcgtcgtattcataaagaagctagccctaacagaatacgcgtg

SEQ ID NO: 16907 - DNA, 3768 bp, Artificial Sequence
  Description of Artificial Sequence: Synthetic coding sequence
atgttgttcaagctgttgcaaagacaaacttacacttgtctttcgcatagatacgggctgtacgtctgctttctgggagtcgtggtgactatcgtgtccgcattccaattcggcgaagtcgtgctcgaatggagcagagatcagtaccatgtcttgtttgattcttacagagataacatagcaggcaagagcttccaaaaccgcctttgtctgcctatgcctatcgatgtcgtgtacacttgggtgaacggaactgatctcgagcttttgaaggaacttcagcaggtccgtgagcagatggaggaagagcagaaggcaatgagagagattctcggaaaaaacacgactgagccgaccaagaaaagcgaaaaacaactcgaatgtctcttgactcattgtattaaggtccccatgttggtgctggatcctgccctccccgcgaacattactctgaaggaccttccttcgctttaccctagctttcatagcgcgtcggatatcttcaacgtggccaaaccaaagaatccttcgaccaacgtgtcagtggtggtgtttgactcaaccaaggacgtggaagatgcacattccggcttgcttaaaggaaattcaagacaaactgtctggaggggatatctcactaccgataaggaggtgcctggtctggtccttatgcaggacttggcatttctgtcgggatttccaccgacgtttaaggagactaatcaactgaaaaccaagctgcctgagaaccttagctccaaagtgaaacttctccaactttacagcgaagcatctgtcgcgcttcttaaacttaacaaccccaaagatttccaggagctgaataagcaaacgaaaaagaacatgaccattgatggtaaagaactcactatatcgcctgcatacctgctgtgggatctttcggcgatctcccagtcgaaacaggatgaagatatttctgctagcaggttcgaggataacgaagagctcagatactcactcagatccattgaacgacacgcaccctgggtgcgcaacatattcatagttaccaacggacagattccttcctggctgaatctggataacccccgggtgaccatcgtgacccatcaagatgtgttcaggaatctgagccatcttccaacgttttcgtcccctgcaatagagtcacatattcatcgcattgaagggctttcccagaagttcatttaccttaacgacgatgtgatgttcggaaaggatgtgtggccggatgacttctactcacacagcaagggtcaaaaggtgtaccttacttggcccgtgcctaattgtgctgaaggatgtcctggatcttggattaaggacgggtactgtgataaggcatgtaacaactccgcatgcgattgggatggaggagattgctccggaaatagcggaggctcacggtatattgcaggaggagggggcaccggttcgatcggagtgggacaaccttggcaattcggtgggggtataaactcggtttcatactgtaaccaaggttgtgcaaactcctggcttgccgacaagttttgtgatcaagcctgtaacgtgctgtcatgtggtttcgacgctggcgactgcggccaagatcatttccacgaactttacaaggtcattctccttcctaaccagactcactacattattcctaagggcgaatgtttgccatacttttcgtttgccgaggtcgccaagcgcggtgtggaaggagcttacagcgataatcccattattcgtcatgcatcaatcgctaacaaatggaaaaccatccatttgatcatgcacagcggtatgaatgcaaccaccattcatttcaatctgacctttcagaacaccaacgatgaggagttcaaaatgcagattaccgtggaagtggacactagagagggaccgaaacttaactcaaccgcgcagaaggggtacgaaaacctggtgtccccaattaccctgctgcctgaggcagagattctgtttgaagatatacctaaggagaagagatttcctaagtttaagcggcacgacgtgaactcaactaggagagcacaggaagaagtcaaaatccctttggtcaacatttcccttcttccaaaagatgcacagctcagccttaacaccctggatcttcaactggaacatggtgatattactcttaaggggtacaatctgtccaagagcgccctcctgcgatcctttctcatgaactcacaacatgccaaaatcaagaaccaagcaatcattaccgacgagacgaatgatagcctcgtggcaccacaggaaaagcaagtccataaatcgatactcccgaacagcctcggagtttcggaaagactgcagcgactgacgtttcccgcagtgtcggtgaaagtgaacggacatgatcagggtcaaaatccacctttggatttggaaaccaccgccagatttcgcgtggaaacccatacccaaaagactataggcggtaatgttactaaggaaaagcctccatcgttgattgtcccgctcgagtcacaaatgaccaaggaaaagaagattaccggaaaggagaaggagaattccagaatggaagagaacgctgaaaaccacattggagtcacggaagtgctcctgggcagaaagctccagcattacaccgattcgtacctgggatttctgccatgggaaaagaaaaagtacttccaagatctcttggatgaagaagaatcgctcaagactcagctggcttacttcaccgactccaagaatactggaaggcagctcaaggatacctttgccgactcgcttcgatatgtcaataagattctgaactcgaagttcggatttacctcgcggaaagtgcccgcacatatgccccatatgattgaccgtattgtcatgcaagagctccaagacatgtttccagaagagttcgacaaaacttcctttcataaggtcagacactccgaagatatgcagtttgcgttcagctacttctactacctcatgagcgccgtgcaaccactgaacattagccaagtgttcgatgaggtcgatactgaccaatcaggcgtcctctcggacagggaaattagaactctcgcaaccaggatccacgaactgcctctttcgctgcaggaccttactgggcttgaacatatgctgattaactgctccaagatgcttcctgcggatataacccagctgaacaacattccacctacccaagaatcctattatgaccctaatcttccaccagtcaccaaaagtcttgtcaccaactgtaagcccgtcactgacaagattcataaggcctacaaagacaaaaacaagtacagatttgaaatcatgggtgaggaagaaatcgctttcaagatgattcggactaatgtgtcccatgtggttgggcagctcgacgatattcggaaaaatccaaggaaatttgtctgtctgaacgacaatatcgaccataaccacaaagatgcccaaactgtgaaggccgtgctgagggatttctacgaatcgatgtttccgataccaagccagttcgaacttccaagagaatacagaaaccgttttttgcatatgcatgaacttcaagagtggagagcctaccgggataagctgaaattctggacgcattgtgtgctcgccactctcataatgtttaccatcttcagttttttcgcagaacaacttatcgcgctgaaaaggaagatattccctagacgtcgtatccacaaggaggcatcgcctaaccgaattagggtc

SEQ ID NO: 16908 - DNA, 3768 bp, Artificial Sequence
  Description of Artificial Sequence: Synthetic coding sequence
atgctgttcaagctgctgcagaggcagacatatacgtgtctctctcacagatacggtctgtatgtttgctttctcggcgttgtcgtgacgatcgtttcagccttccaatttggagaagtggttctggaatggtcgcgggaccagtaccatgtgctgtttgactcgtatagagataacattgctggcaagtccttccagaaccgactgtgcttacccatgccaatcgacgtcgtgtacacctgggttaatggaaccgacctcgagttgctcaaagagctacagcaagtgcgagagcagatggaggaggagcaaaaagccatgagggaaatcctagggaagaataccacagaaccaaccaaaaagtctgaaaagcagctggaatgtctactgacacattgcattaaagtgcctatgctcgtgctcgacccagctctgccagccaacatcacactgaaagatttgccaagcttatatccctccttccattctgcttccgacatatttaatgtagctaagcccaagaacccatccacaaacgtaagcgtggtggtattcgattccacgaaagacgtggaggacgcccactccggactcttgaaagggaactcgcgacaaactgtctggcgaggatacctgaccactgacaaggaggtgccaggcttggtgctgatgcaggatttggcttttctatctggctttcctcccacgttcaaagagacaaaccagctcaagaccaagctgcccgagaatctgagttctaaggtcaaattactgcagctttacagtgaggcctctgtagcgctgctgaagctgaacaaccctaaggacttccaagaattgaacaaacaaactaagaaaaatatgacgattgacggtaaggagttaaccatcagtcctgcttacctattatgggacctgtccgccatttcacagagcaaacaggacgaggacatttctgcgagccggtttgaggacaatgaggaactcaggtactcactgagatccattgagaggcacgcaccatgggtcaggaacatcttcattgttaccaatggccagatcccctcttggttgaatctcgacaacccccgggtaacgatcgttacccaccaggacgtttttcggaacctcagccatctccccacctttagttccccagcgattgagagccacatccatagaatcgaggggctctcccagaagtttatctatctgaacgatgacgttatgttcggcaaggatgtgtggccagacgatttctattcccacagtaaaggccagaaggtgtatctaacatggccagttccaaactgcgccgaggggtgccctggaagttggatcaaagatgggtactgtgataaggcctgtaacaactccgcctgcgattgggatggcggtgactgcagcggaaattccgggggatcacgctacattgcaggcggaggcggtacgggttctatcggagtcgggcagccatggcagttcggcggcggcatcaactcagtcagctattgcaaccaggggtgcgccaatagctggctcgcagataagttctgcgaccaggcctgtaatgtgctatcttgtggattcgatgctggagactgtggccaggatcacttccacgaattgtataaagtaattctgctcccgaatcagacacactacattattcccaagggtgagtgcctcccttatttctcattcgccgaggtggcaaaaagaggggtagaaggcgcttactctgataatcccattatcaggcatgcatccatagctaacaaatggaagactattcatctcatcatgcattcaggcatgaacgcaacaacaatccatttcaatctgacctttcagaatactaatgatgaagaattcaagatgcagatcactgtagaagtggatactcgtgagggccccaaactgaactcaacagcgcagaagggctatgaaaacctcgtgtcaccgatcacactgcttcctgaggcggagatcctgttcgaggacatacccaaggagaaaaggtttcccaagtttaaacgacacgacgttaatagcaccagaagagcccaggaggaagttaaaattcccctggtgaatatctcactgctcccgaaagatgcccaattatcactgaacactctggaccttcagctagaacacggcgacattactctcaaggggtacaacctaagcaagagtgcgctcctgcgttctttcctcatgaactcacaacatgccaagataaagaaccaggcaattattaccgacgagactaatgattccttggtggctcctcaagagaagcaggtgcacaagagtatcctgcctaattccctcggggtcagcgaaaggctccaacgactgacctttccagctgtgtccgtaaaagtgaacggccatgaccagggtcagaatccccccctggatctggaaaccacagccagattcagggtcgagactcacacccagaagaccattggcggaaacgtcacaaaagagaaacctccttcgctgattgtaccacttgagagccaaatgactaaagaaaagaaaattacgggcaaggagaaagagaattcgaggatggaggagaacgctgagaaccacatcggcgttaccgaagtgctgttagggcgaaagttgcagcactatacagactcctacttaggattcctgccctgggaaaagaagaagtacttccaggacttactcgatgaggaggaatctctgaaaacccagttagcctatttcaccgacagcaaaaataccggccgccagctgaaggacacctttgctgatagcttgaggtatgtgaataaaattcttaactcaaaatttggcttcacatccagaaaagtgcccgctcacatgccgcacatgattgacaggatcgtcatgcaggaacttcaagacatgttccctgaggagtttgataagacgtcttttcataaggtgcgacatagcgaagacatgcagtttgctttctcatacttctactatcttatgtcagccgttcagccactcaacattagtcaggtattcgacgaagtcgatactgatcaaagcggagtcctgtccgacagggaaatcagaacgttagcgactcgtatccacgaactcccactctcattgcaagatctgaccggcctggagcatatgttgatcaactgtagtaagatgctgcctgcagatattacccagctgaataacatcccacctactcaggagtcttactatgatccgaatctgcccccagtcaccaaaagcctggtaacgaactgtaaacccgtaaccgataaaatccacaaggcttacaaagataagaataaataccggtttgagatcatgggtgaagaagagatcgccttcaagatgatcaggacaaatgtcagtcatgtggtcggccagctcgacgacattagaaaaaacccccgaaaatttgtctgcctaaatgacaacatagaccataaccacaaggacgctcaaacagtcaaagcagtgctgagggacttttacgaatccatgtttcccattcctagccagttcgaactgcctagggaatacaggaataggtttctgcatatgcacgaactgcaggaatggagagcatatagagataagctgaaattttggacccactgtgtcctggccaccctgatcatgtttactatcttcagttttttcgcagaacaactgatcgctttaaaaagaaaaatttttccgaggcgacgaattcacaaagaagcttcacccaataggattagagtg

SEQ ID NO: 16909 - DNA, 3768 bp, Artificial Sequence
  Description of Artificial Sequence: Synthetic coding sequence
atgctgttcaaactcctgcaacggcagacttacacttgcctgtcccatcggtacgggctctacgtctgctttctgggagtggtcgtcactattgtgtcggctttccagtttggggaggtcgtgctcgaatggtcccgcgatcaataccacgtgctgttcgactcataccgggacaacattgcgggcaagtcattccagaatagactctgtctgcctatgccgattgatgtcgtctacacttgggtcaatgggaccgacctggaactcctcaaagaactgcagcaggtgagggaacaaatggaagaggagcagaaggctatgagagaaatactggggaagaacaccactgagccgaccaagaaaagcgaaaagcaactggaatgccttctcactcactgtatcaaggtccccatgttggtgctggacccggcactccccgccaatatcaccctcaaggaccttccgtcactttacccatcattccactccgcctctgatatcttcaatgttgcgaaaccgaaaaatccgtctactaacgtgagcgtcgtcgtgttcgattcgactaaagacgtggaggacgcgcactccggacttctgaaaggcaattcacgtcagaccgtctggcgcggctatctcaccaccgataaggaggtgccgggcctcgtgctcatgcaggacctggccttcctcagcggcttcccacctaccttcaaagaaacgaaccagctgaaaacgaaactgccagagaacctgtcaagcaaggtcaagctcctgcagctttactctgaggcttcagtggctctgctgaagttgaataacccgaaggatttccaagaactgaacaaacaaactaagaagaatatgaccattgacggcaaggaactgactatttcccccgcatacctcctctgggatctgagcgccattagccagtctaagcaagatgaagatatctcggcgtcacggtttgaagataacgaggagctgcgctactcgctccgctccatcgagcggcacgcgccctgggtcagaaacatcttcatcgtgacgaatgggcagatcccgtcgtggctgaacctggataatccgcgggtgactatcgtgacccatcaggacgtgttcagaaacctttcgcatctgccgacgttctccagccccgccatcgagtcccacattcacagaatcgaaggattgtcccagaaattcatctacttgaatgacgacgtcatgtttggtaaggacgtgtggccagacgacttttactcccactcaaagggccagaaggtgtaccttacttggccagttccaaattgcgccgagggttgccctggttcctggatcaaagacggatactgcgataaggcctgtaataactccgcatgcgattgggacggaggagattgctcaggaaattcaggaggaagccggtacatcgctggcggtggaggtactggatccatcggcgttgggcagccgtggcagttcggaggaggaatcaattcggtttcctactgcaaccaaggctgcgcgaatagctggctggcagacaagttttgcgaccaggcatgtaacgttctctcgtgcggattcgacgcgggagactgtggccaggatcacttccatgagctgtataaggtgattctcctcccgaaccagacccactacattatcccgaaaggagaatgtctgccgtatttctcctttgccgaggtggctaagcgcggagtcgaaggtgcttactcggataacccgatcatccgccacgccagcatcgcgaataagtggaaaacgatccatctgatcatgcactccggcatgaacgcgactaccatccacttcaatctgacctttcaaaataccaacgacgaagagtttaagatgcaaatcactgttgaggtggatacccgggaaggtccgaagctgaactcgactgcccagaagggttacgaaaatctcgtgtctccaatcaccctgcttccagaagcggagatcttgtttgaagatatccccaaggaaaagaggttcccgaaattcaagcgccatgacgtgaactccactcgtcgagctcaggaggaagtgaaaatccctctggtcaacatctcgctgctcccgaaagacgctcagctgtcactcaacacccttgacctgcagctcgagcatggagacatcactctgaagggttacaacctctcgaagtccgcccttctcagatcctttctgatgaactcgcaacacgccaagatcaaaaatcaggctattatcaccgatgaaaccaacgacagcctggtggccccacaagagaagcaagtgcacaagagcatcttgccaaactcgcttggagtgtcagagcggctgcaacggctgacctttcctgcagtgagcgtgaaggttaacgggcatgaccaggggcaaaaccctcctctggacttggagactactgcacgcttccgggtggagactcacacccaaaagaccatcggcggaaacgtgactaaggaaaaaccgccgtcgctgattgtgccactcgaaagccagatgaccaaggagaagaaaatcactggaaaagaaaaagaaaattctcgaatggaagagaacgcggaaaaccacattggggtcacggaggtgcttctgggacggaagctgcagcactatactgactcgtacctcggcttcctgccttgggagaagaagaagtacttccaagaccttctggatgaggaggagtctctgaaaacccagttggcctatttcaccgattcgaagaacactggtcgacagttgaaggacaccttcgcagacagcctgcgctacgtcaacaaaatactgaattccaagttcggattcaccagccggaaggtgccagcccacatgccgcacatgatcgaccgcatcgtgatgcaggaactgcaggacatgtttccagaagaatttgataaaacctccttccacaaagtgcggcactcggaagatatgcaatttgccttcagctacttctactacctgatgtctgccgtgcaaccgctgaacatctcgcaagtgttcgatgaagtggatactgaccaaagcggcgtgctgagcgatcgcgaaatccggactctggccacgcggatccatgaactgccattgtctcttcaagatttgaccggactcgagcacatgctgatcaattgttcgaagatgctgccagccgacatcactcaactcaataacattccccccacccaggaatcgtactacgatccgaacctcccgccagtgaccaagagcctggtgaccaactgcaagccagtgactgacaaaatccataaggcatacaaggacaagaataagtaccgctttgagattatgggggaggaggagatcgccttcaagatgattcgcacgaatgtttcccatgtcgtgggacagctggatgacattaggaagaaccctcgcaaattcgtctgcctcaacgacaatattgatcataatcacaaggacgcacagaccgtcaaggctgtgctgcgcgatttctacgagagcatgttcccaatcccttcacagttcgaattgccgcgagaataccggaacaggtttctccatatgcatgaactgcaggaatggcgggcctaccgcgacaagttgaaattctggacccattgtgtgttggccactctcattatgtttactatcttctcgttcttcgcggagcagctgatcgctcttaagcgcaagatctttccgcgccggcgcatccataaggaggcatcgcctaatcggatccgggtt

SEQ ID NO: 16910 - DNA, 3768 bp, Artificial Sequence
  Description of Artificial Sequence: Synthetic coding sequence
atgctgttcaagctgctgcagaggcaaacgtacacctgcctcagtcatagatacggtctgtacgtgtgctttttgggagttgtagtcactatagtgtctgcctttcagttcggcgaggtcgtgttggagtggagccgcgatcagtatcacgtgctgtttgatagttatagagataacatcgccgggaagtcattccagaacaggctgtgtctacctatgccaatcgatgtggtttacacctgggttaatggtaccgatcttgaactgcttaaagaactgcaacaagtacgggaacagatggaggaggagcaaaaggcaatgcgtgaaatattgggcaaaaacacgactgaacccacaaagaaaagcgaaaagcagttagaatgcctccttacgcactgtatcaaagttcctatgctggtgctggaccctgccctcccagcaaatatcaccctcaaggacctgcctagcctgtacccatcttttcactcagcatccgacatcttcaatgtagcgaagccgaagaatcccagcacaaatgtgtcagttgtggtgttcgattctacaaaggacgttgaagacgcccatagtggtctactaaaggggaactcccggcagactgtctggcggggctatctcaccactgataaggaggtcccaggactggttttaatgcaagatctggcttttctgagcgggttccctccaacatttaaagagacgaaccagttgaagaccaagcttcccgagaatctgtcctcaaaggtgaagttactgcagctctactcagaggcttccgtggccctcctgaaactgaacaatcctaaagatttccaagagctgaacaagcagacaaaaaaaaacatgacaattgacgggaaggaactgacaattagtcccgcatatctgctttgggatctgagcgctattagccagagcaaacaggacgaagatatctccgcgtcaagattcgaggacaatgaggaactccgctacagcctgcggagcattgagcggcacgccccctgggtgcgaaatattttcatagtgacaaacggccagatcccttcatggctcaatcttgacaatcctcgcgtgaccatcgtcactcatcaagatgtgttccgaaacctgagccacctccccacattctcgagtccggcaattgaatcccacatccatcggattgaagggctaagccagaagttcatttatttaaacgacgacgtcatgtttggaaaagacgtgtggcctgacgacttttactctcatagcaagggccagaaggtgtatttaacatggcctgttccgaactgtgcggagggttgtccaggatcatggatcaaggacgggtactgtgataaagcatgcaacaactcagcctgtgactgggacggcggggattgttccggaaacagtggcggcagccggtatatagccggcggcgggggtaccggctccatcggcgtaggccagccatggcaatttggcggcggaatcaattctgtgagctattgtaaccagggttgcgccaactcctggctagccgataagttttgtgatcaggcctgtaacgtgctaagttgcgggttcgatgccggcgattgcggtcaggaccactttcacgagttgtataaggttatcctccttcccaaccagacacattacatcatcccaaaaggcgagtgcttgccttatttttcattcgcagaggtcgccaagcgaggggttgagggagcttattccgacaatccaattatccgccatgcttctatagctaacaaatggaaaactatccacttaatcatgcattccggaatgaacgcaaccacgatccactttaacttgactttccaaaatacgaacgatgaggagtttaagatgcagatcacagtggaggtcgatacaagggagggtcctaaacttaacagcaccgctcaaaaaggctatgagaacctggtgtcacctattacactgcttccagaggccgagatattgttcgaagacattcctaaagagaagcggttcccaaagttcaaaagacacgatgtgaatagcaccaggcgcgctcaggaggaggtgaagatccccttggtgaacatctctctgctgccaaaggacgcccagctgtcattaaatactcttgatctacagctcgaacacggggatattaccctaaaggggtacaatttgtcgaagtctgctttgctgcgttcatttttgatgaatagtcagcacgccaaaatcaagaaccaggctataatcaccgatgaaaccaatgactctctggtggcaccccaggagaagcaagttcacaagagcatactcccaaacagcctgggcgtctctgagaggttacagcggttgacatttcctgcagtgtctgtaaaggttaacggacacgatcagggccagaatccaccgctggatttggaaactaccgcccgcttccgggtggagacacacacacaaaaaaccattggtgggaacgtgactaaggaaaaaccaccatctctcatagtgcccctggagagccagatgaccaaggaaaaaaagattacgggaaaggaaaaggaaaatagtaggatggaggagaatgcggaaaatcatatcggtgtgactgaagtccttttgggtcgcaagcttcagcactataccgactcctacctgggattccttccatgggagaaaaagaagtattttcaggatctattggatgaagaagagagcctcaagacccagctggcatatttcactgactctaaaaatacgggtcggcagttgaaagacacctttgcagacagtctgcgctacgtcaataagattctcaactcaaagttcggattcacatcaaggaaggtccctgcccacatgccccacatgattgaccgcatcgtgatgcaggagctccaggatatgttccccgaggaatttgacaagactagtttccataaggtccggcatagcgaggacatgcagttcgccttctcgtacttttattacctgatgagtgccgttcaaccactgaatatcagccaggtctttgacgaagtcgacactgatcagagtggggtgctaagtgatcgagagatccgcaccctggcaaccaggatccacgaactcccactaagtctccaggacctgactgggctggaacacatgttgattaattgcagcaagatgctgcccgctgacattacccagttgaacaacatcccacctacacaggagtcttattatgatcctaacctaccacccgtgaccaagagcctcgtcaccaattgcaagccagtcacggacaagattcacaaggcatacaaagataagaataaatatcggttcgaaattatgggtgaggaggaaattgcctttaagatgattagaaccaacgtgtctcacgttgtaggacagctggatgacatcaggaagaatccccgcaagtttgtttgtctgaatgacaacatcgatcataaccataaggatgcccagactgtgaaagccgtgctgagggacttttatgaatccatgttcccaatcccatcccagtttgaattgccaagagagtaccggaatcgctttctgcacatgcatgaattgcaagaatggagagcttatcgggataagttgaagttctggacacactgcgtcttggccacactgatcatgttcacaatcttttctttctttgccgagcagctgatagccctcaaaaggaaaatcttccctagacgaaggatccacaaggaagcgtcgccaaaccggatccgagta

SEQ ID NO: 16911 - DNA, 3768 bp, Artificial Sequence
  Description of Artificial Sequence: Synthetic coding sequence
atgttgtttaaactgcttcagagacagacatacacatgcctgtcccatcgctatggcctgtatgtgtgtttcctcggggtggtcgtgactattgtctccgccttccagtttggggaagtggtgctagagtggagccgagatcagtaccacgtcctctttgactcatacagggacaacatagctggaaagagcttccagaacaggctttgcctcccgatgccaattgacgtcgtgtacacctgggtgaacggaactgatctggagctgctgaaggagctgcaacaggtgcgggagcaaatggaagaagagcagaaagccatgagagagatcttgggaaagaatacaaccgaacctaccaagaagtcagagaagcagctcgaatgtctgctgactcactgtatcaaagtaccgatgctggttctcgatcccgctctaccagccaatattacactgaaagatctgccgtcactgtatccatccttccattcagcgtctgacatcttcaatgtggctaagccgaagaaccccagcactaacgtcagtgtggtagtgttcgatagcaccaaagatgtggaggatgcgcattccggactcctaaaagggaatagccggcagacagtgtggcgaggttatctgaccacggacaaagaagtgccagggctcgtcctgatgcaggatcttgcattccttagtggcttcccccctacctttaaggaaaccaaccaattgaagaccaagctccccgagaatctctcttctaaggtaaagctgctgcagctctactccgaggcttcagtggcgctgctgaagctcaataacccgaaggacttccaggaactgaacaagcaaaccaagaagaatatgacgatcgacggcaaggagttgactattagccctgcatacctgctgtgggacctttctgccatcagccagtctaagcaagacgaagacataagcgcctcaagattcgaggataacgaggagctccgatacagcctgagatccattgagcggcatgctccctgggtgagaaacatttttatcgttaccaatggacagatcccgtcctggctgaaccttgacaatccaagagtcacaatcgtgacacaccaggacgtgtttcgcaacttatctcatctgcccacttttagcagcccggcaatcgagagtcacatacaccgcatcgaagggctttcccagaagtttatctaccttaatgatgatgtcatgttcggaaaggacgtctggcccgacgacttttacagccatagtaagggccagaaggtctaccttacttggcctgttccaaactgcgccgaaggttgtcctggatcttggataaaagacggttactgcgacaaggcctgcaacaactccgcttgcgattgggatgggggagattgcagtggcaacagcggaggcagtaggtatatcgcaggcggagggggtacaggcagtattggggtggggcagccttggcaattcggagggggcatcaactcagttagctactgtaaccagggatgtgctaacagctggctggcggacaaattctgtgatcaagcatgtaacgtgctgtcatgtggtttcgatgctggcgactgcggtcaagaccatttccacgagctgtataaagtgattttgctgcctaatcaaacacactacatcatccctaagggcgagtgcctgccttatttctcctttgccgaggtggccaagcgaggagtggagggtgcatatagtgataatccgatcattaggcatgcgagcattgcaaataagtggaagacaatccacttgattatgcatagcggcatgaacgctactacaatacatttcaatctgacttttcagaatacaaacgacgaggaattcaaaatgcaaatcaccgttgaggttgatacccgggagggccccaaactcaactccacggcccagaaaggctatgaaaacctggtgtcgcccattaccctcctgcctgaagcggagattctattcgaggacattcctaaggaaaaaaggttccctaaatttaagcgccacgatgtgaattctacacgtcgagctcaggaagaggtgaaaatccctctggtgaacatctccctgctgcccaaggacgcacagctctcattaaatacactggatctgcagttggagcatggagacattacactgaagggctacaacctgtccaagtctgcattgctgcggagtttcctgatgaactcacagcacgcgaagattaaaaaccaggccatcataaccgacgagacgaacgatagcctggttgctccccaagagaagcaggtgcacaagagtatcctgcccaatagtctgggcgtgtcagagcgcctacaacggctgacatttccggccgtgagcgtgaaggtgaatgggcacgatcagggccagaaccctcctctggatctggaaactactgcccgttttagagtcgagacacacactcaaaaaactattgggggcaatgtaacgaaggagaaaccgccatcactcatcgtcccgcttgagagccagatgaccaaggagaagaaaatcactgggaaggaaaaagaaaatagtcggatggaggaaaatgccgaaaaccatattggcgttacagaagtactgcttggcaggaaactgcagcactacacagactcctatctgggatttctgccctgggagaaaaaaaagtatttccaggatcttctggacgaggaggaaagcttgaaaactcagctggcatactttacggacagcaagaacacagggaggcagctaaaagacactttcgcagacagtctaaggtacgttaacaagatcctcaactcgaagttcggatttacgtcccgaaaggtccctgcacacatgccacatatgattgaccgtattgtgatgcaagagctccaagacatgttccctgaggagttcgataagacatcttttcataaggtacgacacagcgaagatatgcaattcgctttctcatacttctattatctgatgagcgcggtccagccactaaacatatcccaggtgttcgacgaagttgacacagaccaatcgggcgttctgagcgatcgtgaaattcgcacgctcgcgacacgcatccacgagctgcctctctcactccaggatttaactggcttagaacacatgctgatcaactgctcgaaaatgctcccagcggatattacacagctaaataacataccgccgacccaggagagctattatgaccctaacctgcctcccgtcaccaaaagtcttgtgacaaactgcaaacctgtcaccgataagatacacaaagcatacaaagacaaaaacaagtatagattcgaaataatgggtgaggaggaaattgcctttaagatgatccgcacgaatgtgagccacgtagtcgggcagctggacgacattaggaagaatccccgcaagttcgtctgtttaaacgataatattgatcacaaccacaaagacgcacaaaccgtaaaggccgtgttgagggacttctatgaatcaatgtttcctattccctcccagttcgagctcccccgggaatacagaaatcgatttctccatatgcacgagcttcaggaatggagagcctatagagacaagttaaaattctggactcactgcgttctggcaacgctcattatgttcaccatcttctcattttttgctgaacaacttatcgcattgaagcggaaaatatttcccaggcgcaggatacacaaagaggcatcccccaaccgaatccgcgta

SEQ ID NO: 16912 - DNA, 3768 bp, Artificial Sequence
  Description of Artificial Sequence: Synthetic coding sequence
atgcttttcaagttgcttcagaggcagacatatacctgtttgagccacagatacggactgtacgtctgcttcctgggcgtggtggtgacaatcgtcagcgcttttcagttcggagaggtggtgctcgagtggtctagggatcagtaccacgtccttttcgattcctacagagacaacattgccggtaaatccttccaaaaccgcctctgcttgccaatgcccatcgacgtggtgtacacatgggttaacggcacggatctcgagcttcttaaagagctgcaacaagtcagggagcagatggaggaggagcagaaggctatgcgcgagattctgggcaaaaatacaaccgaaccgacaaagaagtccgaaaagcagttggagtgtttgctcacccactgcatcaaggtccctatgctcgtgctggacccagctctgccagcaaacatcaccctgaaggatctccccagcctttacccatcctttcactctgcttctgacatttttaacgtcgccaaaccgaaaaatccaagtaccaacgtaagcgtagtagtattcgactccactaaagatgtggaagacgctcactcaggccttctgaaaggcaattcccgccagactgtgtggagaggttacctcaccacggacaaggaagtgcccggtctcgtcctgatgcaagacctggcattcctttccggcttcccaccaacatttaaagaaacaaatcaactgaagaccaagctccctgagaatctttcttcaaaagtcaaactgttgcagctttacagtgaagcttccgtggccctgctgaagcttaacaaccccaaggacttccaggagctcaacaagcagaccaagaagaacatgactattgatggcaaagagctcactatctcacctgcttatctgctctgggacctgtcagcaattagccagtcaaagcaggacgaggatatatctgcaagcaggttcgaggataatgaggaacttcgctactccctgagatctatcgagcgccacgcaccatgggtgaggaacattttcatcgtgaccaacggacagattccaagctggctcaacctggacaatccaagagttactatcgttactcatcaagatgtgttcaggaacttgtctcacctgcccacattttcatctcccgccatagagagtcacatccacagaatcgaaggactgagtcagaagttcatttacctcaacgacgatgtaatgtttggtaaagacgtgtggccggacgatttctactctcattctaaaggtcagaaggtatatcttacctggcctgtgcctaactgtgctgaaggctgcccaggaagctggatcaaggatggatactgtgacaaggcgtgtaacaacagtgcttgcgactgggacggcggcgactgttctggtaatagtggtggcagtcgctacatcgcaggcggcggaggcacaggctccatcggtgtaggccagccgtggcagtttggaggaggaatcaactccgtatcctactgtaatcagggctgtgctaacagttggctcgctgataaattttgcgaccaagcctgtaatgtccttagttgtggtttcgatgccggcgactgcggtcaagaccacttccacgagctgtacaaggtgattctgcttccgaatcagactcattacatcatcccaaaaggagaatgcctcccctatttctcttttgccgaagtggctaagaggggcgtcgagggcgcttactccgataaccccatcatcagacacgcgagcatcgcaaataagtggaagacgatccacctcatcatgcatagcggaatgaacgcaactaccatccattttaacctgacattccagaacactaacgacgaagagtttaaaatgcaaattacagtggaggtggatactcgcgaaggaccgaagctcaacagtacagcccagaagggctacgaaaaccttgttagcccaatcactctgttgcccgaagcagaaatcctgttcgaggacatcccgaaggagaagcgcttcccgaagtttaagcgccatgacgtaaatagtaccagaagggcgcaagaggaggttaagatcccccttgtgaacatctcccttctcccaaaggacgcccagttgagcctgaacactttggaccttcagcttgagcacggagacattactctgaagggatataaccttagcaaatctgcccttttgagaagcttcctcatgaactctcagcatgctaagatcaagaatcaggccattataaccgatgaaactaacgacagcctcgtggccccacaagaaaagcaggtccataagtccattttgcccaacagtttgggtgtgtcagaacgcctccagaggttgacttttcccgcggttagcgtgaaggtgaacggacacgatcaaggccaaaacccccctctcgatttggagaccactgctagattccgcgtagagacgcatacccagaagaccattggcggtaacgtgaccaaggagaaacctccttcccttatcgttccgttggagtctcaaatgaccaaggagaagaagattaccggaaaagagaaagaaaactctaggatggaggagaatgctgagaatcatatcggtgtgacagaggtactgctcggtcgcaagttgcagcactatacagactcctacctgggttttcttccgtgggaaaaaaagaagtactttcaggacctgcttgacgaagaggagagcctgaaaactcagctggcctatttcaccgactcaaagaacactggaaggcagctcaaagacactttcgccgattctttgaggtatgttaataaaatccttaattccaaattcggatttacatctcgcaaggttccagcccacatgcctcacatgatcgatcgcattgtaatgcaggaattgcaagacatgtttcccgaagaatttgacaagacctcttttcataaggtgaggcacagcgaggatatgcagtttgctttctcttatttttattacctgatgtccgcagttcaacctttgaatatttcccaggtattcgatgaggtggacacggaccagtccggcgtactcagcgatcgcgaaattaggaccctggcaacaaggatccacgagctccccctctctttgcaggatttgacaggcctggagcatatgctgataaactgttctaagatgctgccggccgacattactcagctcaacaacatcccacctacgcaggagtcttactacgatccaaaccttccccctgttacaaagtcactcgtaacaaactgcaagccggttaccgacaagatccacaaagcttacaaagataagaacaaatacaggttcgagataatgggtgaggaggagattgcattcaaaatgattagaactaacgtgagccatgtggtcggacagctggatgacattagaaaaaatcccaggaaatttgtgtgcctcaacgacaacattgaccataaccacaaggacgcgcagaccgtgaaggcggtgcttagggatttctatgagtctatgtttccaattccatctcagtttgaactgcctagagagtatcgcaaccgcttcttgcatatgcacgagctgcaagagtggagagcttacagggacaaactcaaattctggacgcactgtgttcttgctaccctgatcatgttcacaatcttcagctttttcgccgagcaattgatagctctgaaaaggaagatctttccgagaagacgcatccataaagaagcgtccccaaataggattagggtc

SEQ ID NO: 16913 - DNA, 3768 bp, Artificial Sequence
  Description of Artificial Sequence: Synthetic coding sequence
atgctctttaagctgcttcaacgccaaacctacacttgcctctcacaccggtacggcctgtacgtgtgcttcctgggggtggtcgtgactatagtctccgccttccagttcggagaggtcgttctcgagtggtcacgcgatcagtaccacgtgctctttgattcctaccgggacaacattgcggggaaatccttccagaatcggctgtgtctgccgatgccaatcgacgtcgtgtacacttgggtgaacgggaccgacctggaactgctgaaagagctgcagcaagtccgcgaacagatggaagaagagcagaaagccatgcgggaaatcctgggcaagaataccaccgagccaactaagaagtctgagaaacaacttgagtgtctcctgacgcattgcatcaaagtgccaatgctggtcctggatccggcgcttcctgctaatatcactctgaaagacctgccctcgctctaccctagcttccactcggctagcgacatattcaatgtggccaaaccgaagaacccttctactaatgtgtcagtggtggtgttcgatagcaccaaggatgtcgaggatgcacatagcggactcctgaaaggaaactcccgccagaccgtgtggcggggatacttgactacggataaagaagtcccgggcctggttctcatgcaggatcttgccttcctgtcgggattcccaccgactttcaaagaaaccaatcaacttaagactaagctgccggaaaacctgtcgagcaaggtgaaacttctgcagctgtactccgaagcgtcagtcgccctgctcaagctgaacaacccgaaggactttcaagaactcaacaaacagactaagaagaacatgaccatcgatgggaaggaactgactatctcacccgcgtatctcctgtgggatctctcagccatttctcaaagcaagcaggacgaggatatctctgcatcccgcttcgaagataatgaagaacttcggtactcgctccgctcaatcgaacgccacgcgccctgggtccgcaacatcttcattgtgactaatggtcagattccctcgtggctgaatctcgacaaccctcgggtgaccatcgtaacccaccaagatgtctttcggaacctgtcccacctccctaccttctcgagccccgctatcgaatcccacatccataggatcgagggcctgtcacagaaattcatctacctgaacgatgacgtgatgttcggcaaagacgtgtggcccgacgatttctactcccatagcaagggccagaaagtgtaccttacgtggccagtcccgaactgcgccgaaggatgccccggatcgtggatcaaggacggatattgcgacaaggcgtgcaacaacagcgcatgtgattgggatggcggagactgttccggcaactcgggaggatcgcgctatattgcaggtggaggcgggactggatcgatcggcgtgggccagccttggcagttcggcggaggaatcaactccgtgtcgtactgcaatcagggatgcgcaaacagctggctcgccgacaagttctgcgatcaggcgtgtaatgtgctgtcgtgcggtttcgacgccggagactgcggacaggatcactttcatgaactgtataaggtgatactcctgccgaaccagactcactacatcatccctaaaggagaatgcctcccctacttcagcttcgcagaggtggctaagaggggagtggagggcgcgtactccgataacccaatcatcagacatgcgtccattgccaacaagtggaaaactatccaccttatcatgcactcgggcatgaacgcgaccactatccatttcaacctcactttccagaatactaacgatgaggagtttaagatgcagatcactgtcgaagtggacaccagagaaggcccaaagctgaatagcaccgcgcagaagggatacgagaacctcgtgtcgccgattaccctgctcccagaggccgaaatcttgtttgaagatatccctaaggaaaaacggttccccaagttcaagcgccacgatgtgaatagcacccggcgggcacaggaggaggtgaagatcccgttggtgaacatttcgctgctgcccaaagacgctcagctctcgctcaacaccttggatctgcagcttgaacatggggacatcaccttgaagggatacaacctgtctaagtccgccctgctgcgctccttcctgatgaactcgcagcacgccaagatcaaaaaccaggctattatcacggacgagactaatgactccctggtggctccacaggaaaaacaagtccacaaatcaattctgcctaatagccttggcgtcagcgaacgcctgcagcggctgaccttcccggccgtcagcgtcaaggtcaacggacatgaccagggacagaatccaccgcttgacctggaaaccactgctcgcttccgcgtggagacgcacacgcaaaaaactattggcggaaatgtcactaaggagaagcctccgtcactgatcgtgccgctggagtcgcaaatgactaaggaaaagaagatcaccggaaaggagaaagagaactctaggatggaagagaacgccgaaaatcacattggagtgactgaggtgctgctgggaaggaagctgcaacattacaccgactcttacctgggattcctgccgtgggagaaaaagaagtactttcaagacctgttggatgaagaggaaagcctcaagactcagctggcctactttaccgacagcaaaaacactggacgccaactcaaagacactttcgccgactcactgcggtacgtgaacaaaattctgaatagcaagttcggattcacttcgagaaaagtcccggcacacatgcctcacatgatcgatcggatcgtgatgcaggaacttcaggacatgtttccagaggaattcgacaagacgagcttccataaggtgagacacagcgaggatatgcagtttgccttctcgtacttctattacctgatgtcggccgtgcaaccgttgaatatctcccaggtgttcgacgaggtggacaccgaccagtccggagtgctgtcggaccgcgagatccggactctggcgactagaatccatgagctcccgctctctctgcaagatctcactggtttggaacatatgctgatcaactgttcaaagatgctgccggcggatatcacccaactgaacaacatcccgccgacccaggaatcgtactacgatcctaacctgccaccagtcaccaagtcgctggtgacgaactgcaagccagttaccgacaaaatccataaggcctacaaagataagaacaagtacaggttcgagatcatgggagaggaagaaatcgcttttaagatgatccgcaccaacgtgtcacacgtggtgggacaactggacgatatcaggaagaacccgaggaagtttgtgtgcctgaacgacaatattgatcacaaccacaaggacgcgcagaccgtgaaggccgtcctgcgggacttctacgagtcgatgtttccgatcccgtcacaattcgagcttccacgggagtaccggaatcgcttcttgcacatgcacgagttgcaagaatggagagcgtaccgcgataagctgaaattctggacgcactgcgtcctcgcaactctcatcatgttcaccatcttctccttctttgcagaacaactcatcgccctgaaaaggaagattttcccccggaggaggatccacaaggaagcctctccgaacagaatccgcgtc

SEQ ID NO: 16914 - DNA, 3768 bp, Artificial Sequence
  Description of Artificial Sequence: Synthetic coding sequence
atgctgttcaagttgctgcagcgccaaacctatacttgcctgagccacagatacggcttgtacgtctgttttctcggagtcgtggtgaccatcgtgtctgcttttcagtttggagaggtcgtcctggagtggtccagagatcaatatcacgtgctgtttgacagctacagagataacattgcaggaaagtcgtttcaaaacaggttgtgcctgcctatgccgatcgatgtcgtgtacacctgggtgaatggcactgacttggaattgcttaaggaactgcagcaagtccgcgaacaaatggaagaagagcagaaagcaatgcgggaaatcctgggaaagaataccaccgaaccgactaagaaatccgaaaaacagcttgagtgtctcctgacccattgtatcaaggtgccgatgctcgtgctcgatccggccttgccggccaatatcaccttgaaggatctgccgtccctgtacccttcgtttcactcggcgtcagatatcttcaatgtggcgaagccgaagaacccatcgaccaacgtgtctgtcgtcgtgttcgactcaaccaaggatgtcgaagatgcccactctggactgctgaaggggaattcgcgccagacggtctggcgcggttacctcaccaccgataaggaagtgccaggattggtgctgatgcaagacctcgcattcctctcaggcttcccaccgactttcaaggagactaaccagctgaaaacgaaactcccggagaacctgagctcgaaagttaagctcctccagctctactcggaggcatccgtggctctgcttaagctgaacaaccctaaggacttccaagagctgaacaagcagaccaagaagaacatgaccattgacggtaaggaactgaccatctcaccggcgtacctgctgtgggacctcagcgccatctcccagagcaagcaggacgaagatatctcggctagccggttcgaggacaacgaagagctgcggtactccctgcgctccatcgaacgccatgccccgtgggtccgcaacattttcatcgtgaccaatggacaaatcccttcctggctgaacctggacaacccccgggtcaccatcgtgactcaccaggacgtctttagaaatctgtcccatctgcctactttttcctcgccagcgatcgagtcacatatccaccgcatcgagggactgtcgcaaaagttcatctacctcaatgacgacgtcatgttcggcaaagatgtgtggcccgacgatttctattcgcattcgaaaggacagaaggtgtacttgacttggcccgtccccaattgcgcagagggttgtccgggatcgtggatcaaagatggctactgcgacaaggcctgcaacaactccgcgtgcgattgggatggaggagattgttcgggaaactcaggcggctcgcgctatattgccggaggtggaggaaccggctcgattggcgtcggacagccgtggcaattcggaggcggaatcaattccgtgtcgtactgcaaccagggatgtgcaaatagctggttggccgacaagttctgtgatcaggcatgcaacgtgctgagctgcgggttcgatgccggggactgcggccaagatcatttccatgaactgtacaaggtgatcctgctgccaaaccagactcattacatcatcccgaagggagaatgcttgccttacttttcatttgctgaggtggctaagcggggggtggagggagcctactcagataacccaatcatccggcatgcaagcatcgcgaacaagtggaaaaccatccatctgatcatgcactcaggaatgaacgctaccaccatccactttaatctgactttccaaaacaccaacgatgaggaattcaagatgcagatcaccgtggaagtggacacccgggaagggcctaaactcaattcgaccgcccaaaagggatacgaaaatctcgtctcacccatcacgctgctgccagaggccgaaatcctttttgaagatatcccgaaggaaaaacggttcccgaagttcaagcggcatgacgtgaactccacccgacgcgcgcaggaagaggtgaaaatcccactggtcaacatttcccttctgcctaaggatgctcagctgtcactcaacaccctggatctccagctcgaacacggcgatatcaccctcaagggatacaacctgagcaaatcggccctgctccggtcctttcttatgaattcgcagcatgccaaaatcaaaaaccaggccattatcactgatgaaacgaacgacagcctcgtggcgccgcaggagaaacaagtgcacaaatctatccttccaaactcgctcggagtgagcgaacggctccagcgcctgacttttccagcagtctccgtgaaagtaaacggacatgaccagggacaaaaccctccgctggatctggaaaccactgctcgcttccgggtggaaacccatacgcagaaaaccatcggaggcaacgtgacgaaagagaaacctccatcactcattgtccccctcgaatcacaaatgactaaggaaaagaagatcactggaaaggaaaaagaaaattcgcgcatggaggaaaacgccgagaatcatattggcgtgaccgaagtgctgcttggaaggaagctgcaacactacaccgattcgtacctcgggttccttccttgggagaagaagaaatactttcaagacctcctggacgaagaagaaagccttaagactcaactggcttacttcaccgattcaaagaacaccggccggcagctgaaagacaccttcgcagactccttgcggtacgtgaacaaaatcctgaacagcaagttcggcttcacctcccgcaaggtgccggcccacatgccgcacatgatcgaccggatcgtgatgcaagaacttcaagacatgttcccggaagaattcgacaagactagcttccacaaggtccgccacagcgaggatatgcaattcgcattcagctacttctactacctgatgtccgcagtgcagcctctgaacatctcacaagtctttgacgaggtggacactgatcagtctggagtgttgtccgaccgggaaatcagaacgctggcaacccggatccacgaactgccgctgtccctgcaagacctcactgggctggaacacatgctgattaactgttcaaaaatgctccctgctgatatcactcaactgaacaacatcccgccgacgcaagagtcctactacgatcccaatttgccaccggtgacgaagagcctggtgactaattgcaaaccggtgaccgataagatccacaaggcgtacaaagacaagaataagtacaggttcgagatcatgggtgaggaggagattgcctttaagatgatccgcaccaacgtaagccacgtggtcggtcaattggatgacatccggaaaaatccgcgcaagttcgtgtgcctcaacgataacattgaccataaccataaggacgcccagaccgtgaaggccgtgctgcgcgacttctacgagtcgatgtttccaatcccatcgcagtttgagttgccgcgcgaatacaggaatcgcttcctgcacatgcacgaactccaggaatggagggcataccgcgacaaactgaagttttggacccattgcgttctggctaccctcatcatgttcaccattttctcgtttttcgcggaacaactgatcgccctgaagagaaagatcttcccgcggcggcggatccacaaggaggctagccccaacaggatcagagtg

SEQ ID NO: 16915 - DNA, 3768 bp, Artificial Sequence
  Description of Artificial Sequence: Synthetic coding sequence
atgctcttcaaactgcttcagcgtcaaacctatacctgtctctcccatcgctacggactgtacgtgtgttttctgggcgtagtggtgacgatcgtctctgcctttcagttcggcgaagtcgtactcgagtggagccgggatcagtaccatgtccttttcgatagctaccgtgacaacattgctgggaagagctttcagaatcgactatgtctgcctatgccgattgatgtcgtgtatacatgggttaacggaacagatttagagcttctgaaggaattgcagcaggtgcgggaacaaatggaggaggagcagaaggcaatgagagagatcttaggcaaaaatacaacagagcccacaaagaagtccgagaagcagctggaatgtcttctcacacattgcatcaaagttcctatgctggtgctcgatccggctctgcccgcgaatattacacttaaggacctgcctagcctgtacccgagctttcacagcgcctccgacatctttaatgtggcaaagccaaagaatccaagcaccaatgttagcgtggtcgtgttcgactcgaccaaagatgtggaggacgcccacagcggcttactaaaaggaaactctaggcagactgtttggcgcggctacctgaccaccgacaaggaggtgcctggccttgttctgatgcaggacctggcctttctaagcgggttcccgcctacttttaaggaaaccaaccagcttaaaactaagttaccagaaaatttgtcatcaaaggtgaaactcttgcaactctacagcgaggcctctgtggctctgctgaaacttaacaatcccaaggacttccaggaattgaacaaacagactaaaaagaatatgactattgacggaaaagagcttaccatctcgccagcctacctgctctgggacctgtccgcaatcagccaaagtaagcaggacgaagacatttctgcaagtcggttcgaggataacgaggagttgcggtactctctgagatccatcgaaaggcacgccccctgggtgcggaatatcttcatagtgacgaacggacagatccctagctggttgaacttggataacccccgggtgacaatagttactcaccaggatgtgttccgtaacctgtctcatctgccaactttctcatcaccagccatcgaatcacacatacacagaatagaggggctgtcacagaaattcatttacctgaacgacgacgtgatgttcggaaaagatgtttggcctgatgacttctattcccatagcaaaggacagaaggtgtatttgacgtggccggtgcccaactgcgctgaaggctgcccaggtagctggatcaaggatggatattgcgacaaggcctgcaataacagtgcctgcgattgggatggcggggactgtagtggcaacagcggtggatcacggtatatcgcagggggaggtggcaccggctcaataggtgtcgggcagccatggcagttcgggggcggcatcaactccgtatcttattgtaaccagggatgcgctaacagttggctggccgataaattctgcgaccaggcatgtaatgttctgtcttgcgggtttgacgctggggactgcggccaggaccatttccatgaactttataaggttattttgctgcccaaccagacacactacatcataccaaagggtgaatgtttgccgtattttagtttcgccgaagtcgccaagcggggagtcgagggagcctactcagacaaccctattatccgccacgcctcaatcgcaaataaatggaagaccatccatctcatcatgcatagcgggatgaacgccacaaccatccactttaacctgaccttccagaacactaacgacgaggagttcaaaatgcagataaccgtggaggtggatactcgggaaggtcctaaactgaactccacagcgcagaaaggatacgagaatcttgtgagccctatcaccctgctgcctgaggcagagatcctcttcgaagacatacccaaggaaaagcgcttcccaaagtttaagcgccacgacgtaaactcgaccagacgagcgcaggaggaagtaaaaattccattggtgaacatcagtctgcttcctaaggatgctcagctttcactaaacacactagacctgcagctcgaacatggcgacatcactcttaaggggtataacctgtcaaagtcagcccttctgaggtcctttctgatgaattcgcaacatgctaaaatcaagaatcaggccatcatcaccgacgagacgaatgatagcctcgtggccccacaggagaaacaggtacataaatccatcctgccgaatagtctgggtgtgtcggagcgactccaacgccttacgttccctgccgtcagcgtgaaagtgaacggacacgatcaaggtcagaatcctcctctagatctcgaaacgaccgcaaggttccgtgtggagacacatacacagaaaacaatcgggggaaatgttaccaaggagaagccgccttccctgatagtgcctctggagagtcagatgaccaaggagaaaaaaataaccggaaaggagaaggagaattctcggatggaggaaaacgccgagaatcatatcggagtcaccgaagttctgcttggccgcaaactgcagcactacaccgacagttacttggggtttctgccttgggagaaaaagaaatatttccaggatttgttggatgaggaggaaagcctgaaaacccagcttgcttacttcacggacagcaagaatacaggacgacagttaaaggataccttcgcggactcattgagatatgtcaataagatcctgaactccaaatttggattcacatctcgtaaggtacctgcgcacatgccccatatgattgaccggatcgtgatgcaagagctgcaggacatgttccccgaagagtttgataagacgtctttccataaggtaagacacagtgaagacatgcagttcgccttttcctatttttattacctgatgtccgctgtccagccactcaatatcagccaggttttcgacgaggtggataccgaccagtcaggcgtcttgtccgacagagagattcgcactttagctacccgaatacacgaattacccttgtcacttcaggatttgaccggtctcgagcacatgctcattaattgtagtaagatgcttcccgctgacatcactcagctcaataacatcccacctacgcaggagagctactatgatcctaatctcccacccgtgacaaagtctcttgtcactaactgcaagcccgtcaccgacaagatacataaagcatataaggacaaaaacaaataccgatttgagataatgggagaggaggagattgccttcaagatgattaggaccaacgtttcccacgtggtgggccagctggacgacatcaggaagaatcccagaaaattcgtgtgtctcaacgacaatattgatcataaccataaagatgcacagacggtcaaggccgtcctgcgggatttctatgagtctatgtttcctatccccagtcagttcgaattaccacgcgagtatcgaaataggtttcttcatatgcatgagcttcaggagtggcgcgcctatcgggacaaactgaaattctggacgcactgtgtactcgccacactgattatgttcacaatattttcattcttcgccgagcagctgattgccctcaagagaaaaatattccccaggcgtaggattcacaaagaggcatctcctaatcggatccgggtt

SEQ ID NO: 16916 - DNA, 3768 bp, Artificial Sequence
  Description of Artificial Sequence: Synthetic coding sequence
atgctgttcaaactcctccagaggcagacctacacttgcctgtctcaccgctacggactgtacgtgtgtttcctgggtgtggtggtgactattgtcagcgcgtttcaatttggcgaagtggttctcgagtggtcccgagatcagtaccacgtcctcttcgattcctaccgcgataacattgcgggtaaatccttccagaaccgcctgtgtctcccaatgcctatcgatgtagtgtatacttgggtcaacggaactgacctcgagttgctgaaagagctccagcaagtccgtgagcagatggaagaggagcaaaaagccatgcgcgaaatcctgggtaagaatacgaccgaacccaccaaaaagagcgagaagcagctggaatgtctgctgacccattgcatcaaagttccgatgttggtcctggatccagctctgccagccaacatcacgttgaaggatctcccgtcgctctacccttcgtttcactcagccagcgacatcttcaacgtggccaagcccaaaaatccctcgactaacgtgtcggtcgtcgtattcgactccaccaaagatgtcgaggacgcccacagtggactccttaagggcaattctcgccaaacggtgtggcgcggatacctgaccaccgacaaagaagtgccgggactggtgctcatgcaggatctcgccttcctgtctggtttcccgccgacctttaaggaaactaatcagttgaaaaccaaactgccagagaacctcagctcaaaggtgaaactgctgcagctctactcggaagctagcgtggcgctgctgaaactcaacaacccgaaggatttccaagaactgaacaaacaaaccaagaagaatatgaccatcgacggaaaggagctgaccatctcgccagcgtatcttctctgggacctgtccgctatatcgcaatccaagcaggacgaggacatctcagcctcccgcttcgaagataacgaagaactgcgctactcacttcggtcgattgagcggcacgccccgtgggtgcgaaacattttcatcgtgactaatggacagatcccgtcttggctgaacttggataatccgagagtgacgatcgtgacgcatcaagacgtctttcggaatctgagccacctcccgactttctcatccccagctatcgagagccatatacataggatcgagggtctgtcccagaaattcatctaccttaacgacgacgtgatgttcggtaaagacgtgtggccagacgacttctattcccactcgaagggccagaaggtctaccttacttggccggtgcctaactgcgcagaaggttgcccgggatcatggatcaaagatggctactgcgataaggcctgcaataactccgcatgcgattgggatggaggcgattgcagcggaaactccggcggatcccggtacatcgcaggtggaggaggcactggcagcatcggagtgggacagccttggcagtttggcggcggaatcaactccgtgtcatactgcaaccaggggtgcgccaactcatggctggccgacaagttttgtgatcaggcctgcaacgtcctgtcgtgtggattcgatgcgggagactgcggtcaggaccatttccacgagctgtacaaagtgatactgctgcctaatcaaacccactatatcatccccaagggcgagtgcctcccttacttctcgttcgccgaggtggcaaagcgcggggtggaaggcgcctacagcgataatccaatcatccggcatgcttcaatcgcaaacaagtggaaaacgatccatctgatcatgcattcaggcatgaatgctactaccatccacttcaacctcactttccaaaacactaatgacgaagagttcaagatgcagataaccgtcgaggtcgacacccgggaagggcctaaactcaactccaccgcccagaagggatacgaaaatctcgtctccccgatcactttgcttccagaggcggaaatcctgttcgaggatatacctaaggaaaagagatttccaaaattcaagcgccacgacgtcaactcgactagacgcgcccaggaagaggtgaagatccctcttgttaacatctcactgctcccaaaagacgcacagttgtcgttgaacaccctggacctgcaactggagcatggagacatcaccctgaagggctacaacctctcgaagtcggctctgctgcgctcattccttatgaactcgcagcacgctaagattaagaatcaagcgattatcactgatgaaactaacgattccctcgtggctccccaggaaaagcaggtacataagtcaatcctgcccaactccctgggagtgtctgaaagactccagcgcctcaccttcccggccgtgtccgtgaaggtgaatgggcatgaccagggccaaaatccaccgctggacctggaaacgaccgcgagattccgggttgaaacccacacccaaaagacgatcggaggaaacgtcaccaaggaaaaaccgccaagcctgattgtgcctttggagtcccagatgaccaaggagaagaagatcaccggaaaggaaaaagagaactccaggatggaggaaaacgccgaaaaccacattggagtgactgaagtgctgttggggcggaagctgcaacactacactgactcctacctgggattcctcccctgggaaaagaagaagtactttcaagacctcctggacgaagaggagagcctgaaaactcagctggcctactttactgactcgaagaatactggccgccagctgaaggacaccttcgcggacagcttgcgctatgtgaataagattctgaattcgaagttcggattcacctcaagaaaggtcccggcccacatgccgcatatgatcgatcggatcgttatgcaggaactgcaagatatgttcccggaagagttcgataaaacctcctttcacaaagtgaggcattcagaagatatgcagttcgcgttctcgtacttctactacctgatgtccgcggtgcagcccctgaatatctctcaagtgttcgacgaagtggacaccgaccagtcaggcgtgctctccgaccgcgaaattagaactctggcgactcggatccacgaactgccactgtccctccaggacctgactggtttggagcatatgcttatcaattgtagcaagatgttgccggccgacatcacgcaactcaataacatcccgccaactcaggaatcctactatgacccgaatctcccgccggtcactaaatcccttgtgactaattgcaagccggtcaccgacaagattcacaaggcttacaaggataagaacaagtaccggttcgaaatcatgggggaggaagaaatcgcattcaaaatgatccgcaccaatgtgtcgcacgtggtcggacaacttgatgatattagaaaaaacccgcgcaagtttgtgtgcctgaatgataacatcgatcataatcacaaggacgcccagacggtcaaagcggtcctccgagacttctacgagagtatgttcccaataccatcccaattcgagcttccgcgggaatacagaaatagattcctgcatatgcacgaacttcaggagtggcgggcttaccgggacaagttgaagttttggactcactgcgtgctcgcaaccctgatcatgttcaccatctttagctttttcgccgagcaacttatcgccctcaagcggaagatctttcccaggcgccggatccacaaggaagcctcgccgaatcgaatccgcgtg

SEQ ID NO: 16917 - DNA, 3768 bp, Artificial Sequence
  Description of Artificial Sequence: Synthetic coding sequence
atgctattcaaacttctacagcgccagacctatacctgtctgtcacatcgatacgggttatatgtgtgttttctcggggtcgtcgtgaccatcgtgagtgcctttcagtttggcgaggtggtcctggaatggagcagggaccagtaccatgtgctgttcgacagctatcgggacaacatcgcaggaaaatcgttccaaaatcggctctgtttgcccatgcctatagacgttgtgtatacttgggttaacgggacagacctcgagttactcaaggaacttcagcaggtgcgagagcagatggaggaggagcaaaaggccatgagagagattctcggaaagaatacaactgaacctacaaagaagagcgagaaacaattagagtgcttgcttacccactgtattaaagtccctatgctggtcctggatcccgccctccctgccaatatcactttgaaagacctgcctagtctataccccagtttccactctgcctcagatatcttcaacgtggcgaagccaaagaacccaagtactaacgtgtctgtggtggtttttgattccaccaaagacgtagaggatgctcatagcgggctgttgaagggaaactccaggcaaaccgtctggagggggtacttgactacagacaaggaggtgccgggcctggtacttatgcaggatcttgcgtttctctccggattcccacctacctttaaagagactaatcagctcaaaaccaagctgcccgagaatctgtctagcaaggttaagctgctgcaactgtactctgaggccagcgttgctcttttgaagcttaataaccccaaagactttcaggagcttaataagcagacaaagaagaatatgacgattgatgggaaggaattaaccatctccccagcctacctcctgtgggatctctccgctattagccaaagcaaacaggacgaggacatctcagctagtcgcttcgaggataacgaagaacttcggtactccctgcgttctattgagcgacacgctccatgggtgcgtaatattttcatcgtcaccaatggccagatcccctcatggctgaatctggataacccccgggtgacaatcgtgacccatcaagatgtgttcaggaatctatcacaccttccaacattctcaagtccagcaattgagtctcacattcatagaatcgaaggtttgagccagaagttcatatacctgaacgatgacgttatgtttggtaaagatgtgtggccagatgacttttactctcattcaaagggccaaaaggtgtacttgacctggccagtgcccaattgtgcggaaggctgccccgggtcctggatcaaggacggctattgcgacaaggcttgcaataattccgcctgtgattgggatggcggagattgttcaggaaattccgggggatcacgttacatcgctgggggaggcgggacagggtccatcggcgtcgggcaaccttggcagtttggtgggggaatcaattcagtgagctattgcaaccagggatgtgccaattcctggttggctgataagttctgcgatcaggcctgtaacgtgttatcgtgtggatttgatgcaggagactgcggccaggaccacttccatgagctgtacaaggtgatcctgctgcctaatcagacacactacataattcccaagggcgagtgtctaccatatttttcctttgcagaagtggctaagagaggggtggagggcgcttatagtgacaatccgattatcaggcacgcgtccatagcaaataagtggaagaccatccatttgatcatgcattcaggcatgaacgccacaactattcatttcaatctcacattccagaacaccaacgatgaggagtttaagatgcagatcactgttgaagtggatactagagaggggcctaaacttaattccacagcccagaaggggtacgagaatctggtttcgcccattaccctgcttcccgaggccgagatactgttcgaagacatacctaaggagaagcgattcccaaagtttaagcgccatgacgtgaattccacaagacgggcacaggaggaggtgaagattccactggtgaatatcagcctcctccccaaggatgcacagctgagcctcaatacgcttgacttacagttggagcacggtgacatcactctgaaaggatacaacctgtcaaaatccgccctgttgaggagcttcttaatgaatagccagcatgccaagataaagaatcaggccatcataactgacgagacgaacgattcacttgtcgcaccccaggaaaagcaggtgcacaagtctattctgcccaacagtcttggagtatccgagcgcctgcagcggctcacctttccagccgtctctgtaaaagtgaacgggcatgatcaggggcaaaaccctcccctggacttggaaacaaccgcgcggttccgggttgaaacccacacccagaagaccatcggagggaacgtgacgaaggaaaaaccaccctcattgattgttcctctggaatcccagatgacgaaagagaaaaagataactggaaaggagaaggagaacagtagaatggaagaaaacgcagagaaccacattggagtgactgaagtcttgctcgggcgcaagttgcagcattatactgattcatatcttgggttcctcccctgggagaagaagaagtacttccaagacctactggatgaagaagaaagcctcaaaacacagttagcgtattttactgactctaagaatacagggagacaactaaaagacacgttcgccgacagcctgcgctacgtgaataagatactgaactccaagttcggattcacaagcaggaaagtgcctgcacacatgccccatatgatcgatcgcatcgtgatgcaggagttgcaggatatgtttccggaagaatttgacaaaacatccttccacaaagtgcggcacagtgaagacatgcagttcgccttctcttatttttactacctgatgagtgcggtgcagcccctgaatatctctcaggtcttcgacgaggtcgatacagatcaatcaggcgtcctcagtgatcgggagatccggacactggctactcgtatacatgaactgccactctcccttcaggatttaactggactggagcacatgctcattaattgcagcaaaatgttgcctgctgacatcacacagttgaacaatatccctcctactcaagaaagttattacgatcctaacctaccccccgtaactaagtcacttgtgactaactgcaaacccgtgacagataagatccataaagcctacaaagacaaaaataaatacagattcgagatcatgggtgaggaagaaattgcattcaaaatgatccggaccaatgtgtcacatgtggtgggacaactggatgacatccgaaaaaatccccggaagttcgtgtgcctcaacgacaacattgatcacaatcataaggacgcgcagacggtaaaggccgtcctgcgggacttttatgagtccatgtttccaattccctctcagtttgagttgcccagagaatatagaaaccgctttctccacatgcacgaacttcaagagtggcgcgcctatcgtgacaaactgaagttttggacccattgtgttcttgccacactcatcatgttcactatatttagcttttttgccgagcaactcatcgctctgaagcggaagatcttccctcgccgcagaatccacaaggaagctagcccgaaccggatcagggtg

SEQ ID NO: 16918 - DNA, 3768 bp, Artificial Sequence
  Description of Artificial Sequence: Synthetic coding sequence
atgctgtttaagctccttcagaggcagacctacacctgcctctcccatcggtacggactgtacgtgtgcttcctgggtgtcgtggtcaccatcgttagtgcattccaattcggagaggtcgttctggagtggagccgggaccagtaccatgtgctttttgattcctatagggacaatatagccggtaaaagctttcagaaccgcctctgcctgcccatgcccatcgacgtcgtctatacctgggtgaacggcacggatcttgaactattgaaagagcttcagcaggttcgtgaacagatggaagaagagcagaaggcaatgagagaaatcctgggcaagaatactaccgaacccacaaagaaatctgagaagcagctggagtgcttgctgacacactgtattaaggtgcccatgctggtgctggatcccgctttaccagccaatataacgctcaaggatctgccatcattgtatccttcattccactccgcctctgatatttttaacgtggctaaacctaaaaacccttcaacgaacgtgtctgttgtggtcttcgacagcacgaaagatgtcgaggacgcgcactcaggtctgctgaaaggaaactccagacagacagtctggcgtgggtatctgacaaccgacaaggaggtgcctggtctggttctgatgcaagacctggcatttctgagcgggtttccccccacattcaaggaaacaaatcagctgaaaactaagctgccggaaaatctttcctcgaaggtgaagttacttcagctctactccgaagcatccgtggctttactcaaactcaataaccccaaagatttccaggagcttaacaagcagactaagaagaacatgacgatcgacggaaaagagcttacaattagtcccgcctacctcctctgggacctctcagctatctcccagtcaaagcaagacgaggacatttccgcttcaagattcgaggacaacgaagagttaaggtatagtctgaggtcaattgagcgtcacgcaccttgggtgcgcaacatttttattgtcactaacggccaaattccctcatggttaaacttggacaacccacgcgtaaccatcgtcacccaccaggatgtgtttaggaatctcagtcatctgccgacattcagcagtccggcaattgaatcacacatccatcggatcgaagggctctctcagaagttcatctatttgaatgatgacgttatgtttggaaaagatgtgtggcccgacgatttctacagccattccaagggacagaaggtgtacctcacttggccagtgccaaactgtgctgagggctgtccaggctcgtggataaaagatggctattgtgataaggcctgcaacaactcagcgtgtgactgggacggtggggattgcagcggtaatagcggggggtcacggtatatcgcgggtgggggaggaaccggaagcataggcgtgggccaaccttggcagttcggcgggggtatcaactccgtttcgtattgtaatcagggctgcgcaaattcttggctggccgataaattctgtgatcaggcctgcaacgtgttgtcttgtggattcgatgcaggggactgcggacaggatcatttccacgagctgtataaagtcattctccttcccaaccagacacattatatcatcccaaaaggagagtgcctgccctacttttccttcgcagaggtcgccaaacgcggggtcgaaggcgcgtattccgataatcctattataagacacgcgtccatcgctaataagtggaagaccatccatctgataatgcattcgggtatgaacgcaaccactatccactttaatctcacttttcagaataccaacgacgaggaattcaagatgcaaattactgtggaggttgacacgcgcgaggggcccaagttaaattccaccgcccaaaaagggtatgaaaacttagtttctcccatcaccctcctacctgaggccgagatactgttcgaagatatcccgaaagagaagaggtttccgaagttcaagaggcacgatgtaaattcgacccggcgggctcaagaggaggttaaaatccctctggtgaacattagcctactccctaaggacgcacagctgagcttgaacacgctcgatctgcagctggaacatggcgacatcactctaaagggctataatctgtccaaatccgccttacttcggtcctttctgatgaacagccaacatgccaaaatcaagaaccaagccatcattaccgatgagaccaacgatagtctcgtcgccccgcaggaaaagcaggtgcataaaagtattcttccaaactccctcggagtgtcagaacggttgcaaaggctgacattccccgcagtcagcgttaaagtaaatgggcatgaccaaggccagaatccccccctggatctagagacaaccgctcggtttagagttgagacccatacacagaagacaatcggaggtaacgtaactaaggaaaagcctccctcacttattgttcctctggagtcccaaatgacgaaggagaaaaaaatcacagggaaagagaaagagaattcccgcatggaggagaatgctgaaaaccacataggcgtaaccgaggtcctgctcggccgaaagctgcagcactacactgatagttatctaggatttctgccctgggaaaagaagaagtattttcaggatcttctggatgaggaggaatccctgaagactcagcttgcatacttcaccgattcaaagaataccgggcgacagttaaaggacacatttgccgattctcttcggtatgttaataagattttgaactcaaagttcggattcacaagcaggaaggtgcctgctcacatgccacacatgattgatagaatcgtgatgcaggagctccaagacatgtttccagaggagttcgacaagacatcgttccataaggtgaggcatagcgaagatatgcagtttgcattcagttacttttactatctgatgagtgccgttcagccactcaacatatcccaggtattcgatgaggtggacactgaccagtccggggttctgtccgaccgcgaaatccgaacactagctacaaggattcacgaactgccactctccctgcaggatctgaccggactcgagcacatgctgatcaattgttctaaaatgctgccagctgacatcacccagctgaacaatatacccccgacccaggagagttattatgatcccaatctgccgccagtaaccaaatctctagttaccaactgcaagccggtgaccgataagattcacaaggcctacaaggacaaaaacaaatataggtttgaaatcatgggagaggaggagatagcttttaagatgataaggacaaatgtgtcccacgtcgtgggccagctggatgatattaggaaaaaccccagaaaattcgtttgtctcaacgacaacatcgaccacaatcataaagatgcccagaccgtcaaggcagtgcttagagacttctacgagagcatgtttcccatccccagccaatttgaacttcctagagaatatagaaaccgatttctacacatgcacgaactgcaggaatggcgcgcctacagggacaagctcaagttctggacacactgcgtgctcgcaaccctgataatgtttacaatcttttctttctttgccgagcaacttattgccctcaagagaaagatattccctaggaggcggattcacaaggaagcctctcccaaccgaattagggta

SEQ ID NO: 16919 - DNA, 3768 bp, Artificial Sequence
  Description of Artificial Sequence: Synthetic coding sequence
atgctttttaagttgctccaacgtcagacctacacctgtctatcccacagatacggtctgtacgtgtgtttcctgggagtcgttgtgaccattgtgagtgcctttcaatttggcgaagttgttcttgaatggtctcgtgatcagtatcatgtgttatttgattcctatcgcgacaatatagccgggaaatctttccagaatagactatgtctgcctatgcccatcgacgtagtttacacatgggtgaacggcacagatttggagctgctgaaagaactccagcaggttcgagagcagatggaagaagagcagaaagcgatgcgggagattctgggcaaaaacacgacagagccaaccaagaaatctgagaagcagttggaatgtcttctgactcactgtatcaaagtaccgatgcttgtgcttgatccggcactcccagctaatataacactgaaggacctgcccagtttgtatccatctttccactccgcaagtgatatttttaatgtggcaaagccgaagaaccctagtaccaacgttagtgtagtggttttcgactccactaaggacgtggaggacgcgcatagcggactacttaagggcaattcccgtcagacagtctggcgcggctacctaacaacggataaagaggtccctggactagtccttatgcaggatctggccttcttaagcgggttcccgcccacatttaaggagacaaatcagctcaaaaccaaattgccagagaatctgtcttccaaggtgaaactgctgcagctgtactcagaggcctccgtggccctcttaaaactcaacaatccaaaagatttccaggaactgaacaagcagacaaaaaagaatatgaccattgacggtaaagaactgacgatatctcctgcctacctcttgtgggacctgagtgctatcagccagtcaaaacaagacgaagacatctctgcctcacgatttgaggataacgaggagctgcggtattctctgaggtcaatcgaaagacacgctccatgggtgcggaatattttcatcgtaacaaacggccagatccctagctggctcaatctggataatcctagggtcactatcgtcacgcatcaggatgtttttcggaacctatcccacctgcctaccttcagtagccccgccattgagtcccacattcatcgtattgagggactgagtcagaagttcatttatttgaacgatgatgttatgtttggtaaagacgtgtggcccgatgatttctattcacattcaaaaggtcagaaggtttatctaacctggcccgttccaaattgcgcagaggggtgcccgggcagctggatcaaagacgggtactgcgataaagcatgtaacaactccgcttgcgattgggatggcggggactgcagcggaaacagtggcggctctaggtatattgcggggggaggagggacaggcagcattggcgtgggtcagccttggcagtttggcggtggtatcaacagcgtgagctactgtaatcagggttgcgcgaactcatggctggccgacaagttctgtgatcaggcttgtaatgtgcttagttgcgggttcgatgccggcgactgtggacaggatcacttccatgagttgtataaagtgatactgttgcctaaccagacacactacattatccctaagggcgaatgccttccctatttttcctttgccgaggtcgctaagcggggtgtcgagggggcttactcggacaatcccattattcggcacgcatccattgcaaacaaatggaagaccattcatctgataatgcattctggcatgaatgcgactaccatccacttcaacttgacctttcagaataccaacgatgaggaattcaagatgcagattacagttgaggtggacacccgagaagggcccaagcttaacagtacggcccagaaaggctatgaaaacctagtgtctcctatcacccttctgccagaggcggagattcttttcgaagatattccaaaggaaaaaagattccccaaatttaagaggcatgatgtgaactccacaaggagggcacaggaggaagtaaagattccactggtaaacatctccctcctgcccaaggatgctcaactgtcattgaataccctggacctgcaattggaacacggggacattacactgaagggatacaacctgtccaagtctgcgctccttagaagcttcctgatgaactcccagcacgccaaaatcaagaaccaggctatcattactgacgagaccaacgactctctggtggcaccccaagagaagcaagtccacaaatcaatactcccaaactctctgggcgtaagtgagcggctgcagcgcctaacttttccggcagtgtctgtgaaggttaacggccatgatcagggacagaatcctcctctggatctggaaaccaccgcaaggttcagagttgagactcacacccaaaaaacaataggcggaaatgttaccaaggagaagcctcccagcctcattgttcctcttgagtcacagatgacgaaagagaagaagatcactgggaaagagaaagagaactccaggatggaagaaaacgccgagaatcatattggagtcacagaggtgctcctgggcagaaagctgcagcactataccgatagttacctcggattcctcccatgggagaagaagaagtactttcaggacttgctggacgaggaggaatctctgaaaacccagttagcctacttcacagatagcaagaataccggccggcagctcaaggatacgtttgcagactcactcagatacgtgaacaagatactaaactctaagtttgggttcactagccggaaagttccagctcacatgccgcacatgatagataggatcgtgatgcaggaactacaggacatgtttcccgaagagtttgataagaccagttttcacaaggttcgacattccgaagacatgcagtttgccttcagctatttctactacctgatgagcgctgtgcaaccccttaatatcagtcaggtattcgatgaggtggataccgatcagtccggtgttctgtcagaccgcgagatacgaaccctggccacccgcatccacgagctgcccctcagtttgcaggatctaactggactcgagcacatgcttatcaactgtagtaagatgctgcctgccgacattacccagttaaacaatattccaccaacccaggaatcgtattatgatccaaatctgccacccgtgacaaaatctctggttacaaactgtaagccagtgaccgacaagatccacaaggcgtataaagacaagaataagtatagatttgagattatgggcgaagaggaaatcgcatttaagatgattcgtacaaacgtcagccatgtagttgggcaactggatgacatccggaagaacccacgcaaattcgtgtgtctgaatgataatattgatcataaccacaaagatgcccaaaccgttaaggccgtgcttagggatttctacgaatcaatgttccccatcccaagccaattcgaactgccaagggagtacagaaaccggtttcttcacatgcacgaactgcaggagtggcgtgcctaccgagataagctcaaattttggacccactgtgtgctcgctacccttataatgttcacaatcttctctttttttgcagagcagctcatagcactgaaaaggaaaattttccctcgacgccgcattcataaagaggccagtcccaatcgaatacgcgtt

SEQ ID NO: 16920 - DNA, 3768 bp, Artificial Sequence
  Description of Artificial Sequence: Synthetic coding sequence
atgctgtttaagctgcttcagcgccagacctacacttgtttgagtcaccgctatgggctctacgtctgttttctgggcgtcgtagttactatcgtgtcggccttccagttcggcgaggtagtacttgagtggtcgcgagatcagtaccacgtgctttttgactcatatagggataatatagccggcaaaagcttccaaaatagactgtgtctgcccatgcccattgacgtcgtctacacatgggtcaatggaactgacttagaactcctgaaggagttacaacaggtgagggaacagatggaagaagaacagaaagctatgagggagatactcgggaagaacacgacagagcctacgaaaaagagcgagaaacagctggaatgcttgttaactcattgtatcaaggttccaatgctggtgttagaccccgccttgcccgccaatatcaccttgaaagacctgccaagtctgtacccgtcattccattcagcaagtgatatattcaacgttgccaagccgaagaatcccagcaccaacgtcagtgtggtcgtcttcgattcaacaaaagatgttgaagacgcacactccggactgctgaagggcaactcccgccagaccgtgtggagaggatatctcaccacagacaaggaagtgccaggcctagtactaatgcaggacctagctttccttagcggattcccccctacgttcaaagagaccaatcagctcaagactaaactgcctgagaatctgtcatcgaaggttaaactcctgcaactctactctgaggctagcgtggcgcttctgaaactgaacaatcccaaggactttcaagagctgaacaaacaaactaagaagaacatgacgatagacggtaaggagctgacaatctctcctgcctacctcctgtgggatctgtccgccatttcacagagcaaacaggacgaagatattagcgccagcagattcgaggataatgaagagctgcggtattcgctccgaagtatcgaacggcacgccccgtgggtgaggaatatatttatagtgactaacggtcagattccttcgtggttaaatctagacaacccacgggtaaccatcgtgacacatcaggatgtctttcgcaacttgtcacaccttcccacattcagttctccagccatcgagtcacatatccacaggatcgaagggctgagccagaagttcatttacctgaatgacgacgttatgtttggcaaggacgtgtggccagatgacttttactctcacagtaaaggccagaaggtgtatctaacctggcccgtgccaaattgtgccgagggatgccccgggagctggattaaggacgggtactgcgataaggcttgtaacaattccgcctgtgactgggacggcggagactgcagcggcaactcaggagggtcccggtacatcgcaggcggaggcgggaccggctccatcggcgtgggccagccgtggcagttcggtggcggaatcaattccgtgtcatactgcaatcaggggtgcgctaactcttggcttgccgataaattctgcgatcaggcttgcaacgtactctcatgcggcttcgatgctggggactgcggacaagaccatttccacgaattatataaagtgatcctactcccaaaccaaacccactatataattcccaagggagagtgtttaccatatttcagctttgctgaggttgccaagaggggcgttgaaggggcttactcggacaacccaattatcagacatgcatctattgccaataagtggaaaactatccatttaattatgcattctggtatgaacgcgaccacgatccactttaatctgacattccagaatactaacgacgaagagttcaaaatgcagatcaccgtcgaggtagacactagggaggggccgaagctaaactcaaccgcgcaaaagggctacgaaaacctggtctcaccaattacattgctgcccgaagcagagatcttgttcgaagacattccgaaagaaaagaggttcccaaagtttaagagacatgatgtcaacagcactcggagggcccaagaagaagtgaagatcccattagtgaatatcagcctcctgcctaaggatgcacagctgagcctgaatacgttggatttacagcttgagcatggggacatcaccttgaaaggatataatctatctaaatcagccctgctgcgcagcttcctgatgaactcgcaacacgctaagataaagaaccaggccatcatcacagatgagaccaatgacagcctggtggcccctcaggagaagcaggtacataaatcaatactgcccaattctctgggagtttccgagcggctgcaaagactcacgttccctgccgtatcggtgaaggtgaatggtcacgaccaggggcagaatcctccactggatctcgagactaccgcacgctttagagtcgagacacatacccaaaagactattggcggtaacgtgaccaaggagaaacctccaagcctgatcgtgcccttagagtctcagatgaccaaggagaaaaaaatcacgggcaaggagaaagaaaactctagaatggaagaaaatgcagagaaccatataggtgtgaccgaagttctgcttggaaggaagctgcagcactacactgacagttacctaggattcctgccttgggaaaagaagaaatactttcaggacttgctggatgaagaggaatctctcaagacccagctcgcatatttcacagatagcaaaaatactggtagacagcttaaggatacctttgccgattccctgcgctatgtcaacaaaatcttgaacagtaagtttggctttacttcgagaaaagtacccgcccatatgcctcacatgattgaccgtatcgtgatgcaggagctccaggatatgttccctgaggagtttgataagacaagttttcacaaggtaaggcacagcgaggacatgcagttcgccttctcgtacttttattatctgatgagtgctgttcagccactaaatataagtcaggtgtttgacgaagtggacacagatcagtcaggcgtgctgtctgaccgggaaatcaggaccctggcaaccagaatccacgaactgcccttgagcctccaggacttaaccggacttgagcatatgcttatcaactgcagcaagatgttgcccgccgacataacccagcttaataacattcccccgacacaagagtcttactacgatcctaacctgccccccgttactaaatctctggtgacaaattgcaagcccgtcacggataagatccacaaagcctataaggacaagaataagtataggttcgaaatcatgggcgaggaggaaattgccttcaagatgattcggaccaatgtctcccatgtggtggggcaactggacgatatacggaagaatccccggaagttcgtatgcctgaatgataacatcgatcacaatcataaagacgcacagacagtgaaagctgtgctgcgagatttctacgaaagcatgttcccgataccatcccagtttgaactgcccagggagtatcggaacagattcctgcacatgcatgagctgcaagagtggagagcttatcgtgacaagcttaagttttggactcactgtgtgttagcgacgctaatcatgtttacaattttctccttttttgctgagcagcttatcgccttgaaacggaaaatttttccacgcaggcggattcacaaggaggcttccccgaatcgcattagggtc

SEQ ID NO: 16921 - DNA, 3768 bp, Artificial Sequence
  Description of Artificial Sequence: Synthetic coding sequence
atgctgtttaagctactgcagagacagacctatacttgcctctcacatcgctacggactttatgtgtgctttttgggagttgtcgtgaccattgtgagtgcctttcaatttggcgaagtggtgctggagtggtcacgagatcagtaccatgtactattcgactcctatcgtgacaacattgctggaaagagcttccagaatcgactgtgcctacccatgcctatcgacgtagtttacacatgggtgaacggcaccgatttggagttactcaaggagctgcagcaggtccgtgagcaaatggaagaagaacagaaagcaatgcgagaaattttaggtaagaataccaccgaacctactaagaagtctgaaaagcagctcgaatgcctgcttacacactgtataaaggtgcccatgctggtgttggacccggccctccctgccaatattacccttaaggatctgccaagcctgtacccatcctttcacagcgccagcgatatctttaatgtggcaaaacccaagaatccctcaactaatgtgagtgtcgtcgtattcgacagcaccaaggatgtcgaggatgcacacagtggtctgttaaaaggtaactccagacagacagtgtggcgcggatatctcaccactgacaaagaagttcccggactcgtgctcatgcaggatctagcgttcctgtccggattcccacctacattcaaagagacgaatcaattaaagaccaagttgcccgagaacttgagcagtaaagtgaaattgctgcaactgtacagtgaagccagcgtcgccctcctaaagctgaataacccaaaggattttcaggagctgaataagcagaccaaaaagaatatgacaattgatggaaaagagttaacaatctcacccgcttacctgctttgggatctctcagcgatttcccagtccaagcaagacgaggatatcagtgcctccaggtttgaagacaatgaggagctgcgatattctctaagatctatcgagcgacacgccccctgggttaggaatattttcatcgtgacaaatggacaaatcccaagttggctgaatctggataatcctagggtgactatcgtgacccaccaagatgtgtttagaaacctcagtcacttacctacctttagcagtccagccatcgaatcccatatccataggattgaaggcctgtcacagaaattcatttatctaaacgacgatgtgatgttcggcaaggatgtgtggcctgacgacttttattcccacagtaaagggcagaaagtgtatttgacttggcccgtcccaaattgcgctgagggctgtcctgggtcttggattaaagatggatactgtgataaggcttgcaacaatagcgcctgcgactgggacggcggcgattgtagtggcaacagtggcggatcccgatatatcgccgggggagggggaacggggtccataggggttggccagccttggcagttcggcggtggcatcaactccgtgagttactgtaatcaaggctgcgcaaactcctggcttgcagataaattttgcgatcaggcttgcaacgtcctcagctgtggattcgatgccggggactgcgggcaagaccacttccatgaattgtacaaagtgatcttgctgcctaatcagactcactatatcatccctaaaggggaatgcctgccttacttttcattcgccgaagtagccaaacgcggagtggagggtgcctattcagacaaccccatcattcggcacgcgtccatagccaacaagtggaagactattcaccttattatgcactctggcatgaatgctacgaccatccactttaacttgacctttcagaacactaacgacgaggagtttaagatgcagattaccgttgaggtagacacaagggagggacctaagcttaattccaccgcccagaagggttatgagaacctggtctcccccatcaccctcctcccagaggccgagatcctattcgaagatatccccaaggagaaacgctttccaaagttcaagcggcacgacgtgaatagtactcgtagggcacaggaggaggtgaagataccacttgtcaacatatcactgctacctaaagatgcccagctatcattgaacacactggacctccagctagaacacggcgacatcaccttgaaaggctacaacctgagcaagagcgccctgctccgcagcttcttaatgaattcccagcatgccaagatcaagaaccaggccatcatcactgatgagaccaatgactccttagtggcaccacaggaaaagcaggttcacaaatcgatcctgcctaattccctgggtgtgtctgaaagactgcagcgactcacgttccccgctgtatccgtgaaagtaaatggacacgatcaaggccagaatccccccctggacttggaaacaacggcaagatttcgggtggagacccacacacagaaaacgatagggggaaatgtaaccaaagagaagccaccatctctgattgtgcctctggagtcgcaaatgactaaggagaagaagataactggcaaagagaaggaaaatagtcgtatggaagaaaatgccgagaatcatatcggagtgaccgaggtcctcttgggacgcaaactacaacattacacggacagctatctgggattcctcccttgggaaaagaagaagtacttccaagatctgctcgatgaggaagaaagcctcaaaactcagctagcatacttcaccgattcaaaaaacacaggaagacagctgaaagacactttcgccgacagcctgcgctatgtgaacaagattctgaactccaaattcgggtttacttcccggaaagtcccagcccacatgccccacatgatcgaccgcatcgtcatgcaggagctacaggatatgtttcctgaagagtttgataaaacctcattccataaggtgagacattcggaagatatgcagtttgccttcagttacttctattacctgatgagcgccgtgcagccactaaatatttcccaggtgttcgacgaggtggacacggaccaatcaggagtgctaagtgaccgggaaattcggactctggccaccagaatacacgagctccctctgtccctgcaggacctgacaggactggagcacatgttgattaactgttccaaaatgttgccagcagacatcacccagctgaataacatccctcctacccaggagagctactatgatcctaacctcccgccagtgaccaagagtctggtaaccaattgtaagcccgtcaccgataagattcacaaagcctataaggataaaaacaagtaccggttcgaaataatgggtgaggaggagattgctttcaagatgatacggacgaatgtctcccacgtggtcggccagcttgacgacattcgcaaaaaccctcggaaattcgtttgtctgaatgacaatatcgaccacaaccacaaggacgctcagacggtaaaagcagtactacgggacttctatgagtcgatgttccccatcccgagccaatttgagttaccaagagaatataggaacagattcctgcacatgcatgagctgcaggaatggcgggcatacagggacaagctcaagttttggacccattgtgtcctggccacattaattatgttcaccatcttcagcttttttgccgaacaacttatagctctgaaacgaaaaatattccctagacgaaggatccataaagaggcttccccaaataggatccgggtg

SEQ ID NO: 16922 - DNA, 3768 bp, Artificial Sequence
  Description of Artificial Sequence: Synthetic coding sequence
atgctctttaagctgctccaaaggcaaacctacacttgtctttcccacagatacgggctctacgtgtgctttctgggagtggtggtgacgattgtgagcgcgttccagttcggggaggtggtcctggagtggtcgagggatcaataccatgttcttttcgatagctacagggacaacattgcgggaaagtcgtttcagaacagactttgcctccctatgccgatcgacgtggtgtacacctgggtgaatggaactgatcttgagttgctcaaagaactgcagcaagtgagagagcagatggaggaagagcaaaaggccatgcgtgagatcctgggaaaaaacactaccgaacctaccaagaaatcggaaaagcaactggagtgtctgttgactcattgcattaaggtgcctatgctggtgcttgaccctgcattgcccgcaaacataaccctcaaagatcttccttccctgtacccatcgttccactcagctagcgacatctttaatgtcgcaaagccaaagaacccctcgaccaatgtgtccgtggtagtgttcgactcgactaaggatgtggaagatgcgcactccggccttcttaaaggcaactcgcgtcaaactgtctggcggggatatctgaccaccgataaagaagttcctggcctggtgcttatgcaggacctggcatttctttcaggttttccccctacgttcaaggaaactaaccaacttaagactaagctccctgaaaaccttagctcaaaggttaagctgctgcagctttactcggaagcatccgtggcactgcttaaacttaacaaccctaaggattttcaagaactgaataagcagaccaagaaaaacatgactatcgatggaaaggagcttactatttcgcctgcgtacctgctttgggacctctcagcaatttcgcaaagcaagcaagatgaggacatctccgcatcacgctttgaggataacgaagaactgagatactcgcttagatccatcgagagacatgccccctgggtgagaaacatctttatcgtgaccaacggacagatcccctcctggctcaatctcgacaatcctcgcgtcaccatagtgactcatcaagacgtctttcgaaacttgtcgcatctccccactttttcgagccctgcaatcgaatcgcacattcatagaattgagggattgagccaaaagttcatttacctgaacgacgatgtgatgtttgggaaggacgtgtggcctgatgacttttactcccattcgaagggacaaaaagtgtacctcacttggcccgtccctaactgtgcagagggttgtcctggaagctggataaaggatggctactgtgataaagcgtgcaacaactcagcatgtgattgggatggcggagattgttcggggaactcaggaggttccagatacattgccggtggaggtggaaccggatcaattggagtgggccaaccttggcaatttggtgggggtattaactcagtgtcatactgtaaccagggttgcgcaaattcatggctggcagacaagttctgtgaccaagcgtgcaacgtgctgtcatgtggatttgacgcaggtgactgtggtcaagatcattttcatgagctgtacaaagtgattcttcttcctaatcaaacccactacataatacctaagggtgagtgccttccttacttttcgttcgcggaagtcgcaaagaggggagtggagggtgcctactcggataaccctattatcaggcatgcaagcatcgcaaacaagtggaaaaccatccacctgattatgcactccgggatgaatgcaaccactatacactttaaccttacgtttcaaaacactaacgatgaagaattcaagatgcagattactgtggaagtcgatacccgggagggtcctaagctcaattccactgcccagaagggatacgaaaacctcgtgtccccaattaccctgcttccagaagcagagattctgttcgaagatatccctaaagaaaagcgctttcctaaattcaaacggcatgatgtgaattcgaccagacgtgcacaggaagaagttaagatcccactggtcaacataagcctgcttccgaaagacgcccaactgagcctgaacactttggatctgcaacttgagcacggagatattactctcaagggttacaatctgtcgaaatcggcgcttctgagatcctttctgatgaactctcaacacgctaaaatcaagaaccaggcgataatcacggatgagactaacgactcactcgttgctcctcaggaaaagcaagttcataagagcattcttccaaactccctgggtgtgtcggagcggcttcaaaggctgacttttcctgccgtgtcggtcaaagtgaacggccatgatcaaggacagaaccccccactggatcttgaaactacggcacgattccgtgtagaaacccatacgcaaaagactatcggaggaaacgtgactaaggagaagcctccgtcactcatcgtgccactggaatcccaaatgaccaaagaaaagaagataaccggtaaggaaaaggaaaactcacgaatggaggaaaatgctgaaaaccatataggtgtgactgaagttcttctgggacgcaagctgcaacattacacggattcgtacctgggcttcctgccatgggaaaagaaaaagtactttcaagaccttctcgacgaagaagaatcgcttaagactcagcttgcctactttaccgatagcaagaacaccggacggcaactgaaggatacttttgctgactcactgaggtacgtcaacaagattctgaactcgaagttcggatttacctcgaggaaggtccctgcacatatgccccatatgatcgaccggatcgtgatgcaggaactccaagatatgtttcctgaagaatttgataagacctcgtttcataaggtgagacactcggaggacatgcaatttgcatttagttatttctactacctcatgtcggctgtccaaccactcaatatctctcaggtgttcgatgaagtggatactgatcaaagcggagtgctttcagatagagaaatccgaaccctggcaacgcggatccatgagctgccactgagcctgcaagatctgactggacttgagcacatgttgatcaattgctccaagatgctgccggccgatattactcagctcaataacatccctcctacccaggaatcctactacgatcctaatcttccccccgtcaccaaaagcctcgtgaccaactgtaaacctgtgaccgacaaaattcataaggcatacaaagacaagaataagtacaggtttgagatcatgggtgaagaggaaattgcttttaagatgatccgcacgaacgtgagccatgtcgtcggacagttggacgatatccgcaagaacccaaggaagttcgtgtgccttaacgacaacatcgaccataaccataaggacgcacagaccgtgaaggccgtcctgcgcgacttttacgaaagcatgttccccattccgtcgcagtttgaacttccaagggaatacagaaatcggtttcttcatatgcacgaacttcaagaatggcgcgcataccgggacaaactgaagttttggactcactgcgtccttgccaccctgattatgttcactatctttagcttttttgcagaacagctcattgcgctgaagcgcaagattttcccacggcggcgcattcataaagaagcatccccaaaccggatccgggtg

SEQ ID NO: 16923 - DNA, 3768 bp, Artificial Sequence
  Description of Artificial Sequence: Synthetic coding sequence
atgctctttaaattactgcagcgacagacctacacctgtctttcccaccgttatggtctatacgtgtgttttctgggcgtcgttgtgaccatcgtcagtgcctttcagttcggcgaggtagtcttggagtggtcgcgcgaccagtaccacgtcctctttgactcgtaccgcgacaacatcgccggcaagtcatttcagaaccgcttgtgtttgccaatgccgattgacgtcgtctatacctgggtaaacggcacagacctggaactgctcaaggagctgcagcaggtgcgggagcaaatggaggaggagcagaaagcgatgcgggaaatccttggaaagaacactacagagcccactaagaaaagcgagaaacagctcgagtgtttacttactcattgcattaaagtacctatgctcgtattggatccagccctgccagcaaacattactttgaaggatctgcctagcctttacccctccttccattctgcttctgacatttttaacgtcgccaagcccaaaaatccatcaactaatgtgagtgtggtcgtattcgactccaccaaggacgtcgaggacgcccactccggcttgctcaaagggaactcacgccagaccgtttggcgcggctacctgaccacggacaaagaggttcctgggctggtcctgatgcaggatcttgcctttctatcagggttcccccctacctttaaggaaacgaaccaactgaagaccaagctccctgaaaacctgtcgagtaaggtgaaactgctgcagctgtacagtgaagcctccgtcgccctgcttaaattgaacaatccaaaagattttcaagaactcaataaacagacgaagaagaacatgacgattgacggtaaggaactcacgatctcccccgcttatctgctgtgggacctgtccgctatctcacaaagtaagcaggacgaagatatttcggccagccgcttcgaagacaatgaagagttgcggtactcactgagatcaatcgaaaggcatgccccttgggtgcggaatatttttatcgtcactaacggtcagattccctcctggttgaacctcgacaatcctagggtgaccatagtgacccaccaggacgtgttcaggaatctgagccacctgccaacttttagtagtccagcaatcgaatcccacatccaccgcatcgagggcttgtcccagaagtttatttacttgaatgacgatgtgatgttcggtaaagacgtgtggccagatgatttctacagccatagcaagggtcagaaagtctacctaacctggcctgtccccaactgtgcagaggggtgtccagggtcatggattaaagacggctactgcgacaaagcctgcaacaatagtgcgtgcgactgggatggcggcgactgctccggaaactctggtgggagtagatacatcgccggagggggtggcactggcagcatcggcgtgggtcagccctggcagttcgggggagggataaattcagtctcgtactgtaatcagggatgcgccaactcctggttggcagacaaattctgtgaccaggcctgcaacgtgctatcgtgcgggttcgacgctggggactgcggtcaggatcactttcacgaactctacaaagtcatactgctgcccaatcagacccactacattataccgaagggtgagtgtctcccatattttagctttgctgaagtggctaaacggggtgtggagggggcctacagtgataacccgatcataagacatgctagcatagcaaacaagtggaagacgattcatctcataatgcactctggcatgaatgcgactaccattcatttcaatcttacttttcagaatacgaatgatgaagagttcaagatgcagatcacggtggaggtggacaccagggaggggcccaagctgaattcgacagctcagaagggctatgagaaccttgtgagccctatcacgctacttccagaggctgagatcctgtttgaagacattccgaaggagaagaggttccccaagtttaagcgccacgacgtcaacagcacaagacgggcccaggaagaagttaagatcccgcttgtcaatatctccctcctgcccaaggacgcacaattgtctctgaacaccttggatctccagctagaacacggtgatatcacactcaaaggatataatctctcaaagtccgcgttgctgaggtctttcctgatgaatagtcaacatgcaaagatcaaaaaccaggctataataacagacgagacgaacgacagcctggtggcaccgcaggagaagcaggtgcataagtcaattctgccgaattctctcggagtatccgaaagattacagcgccttaccttcccggcagtaagcgtgaaggtgaatggacacgaccagggacagaatccccccctggatctggaaaccactgcacggttcagggtcgagacccacacacagaagactattggcgggaacgtgaccaaggaaaaaccacctagcctcattgttcctctggagtcccagatgacaaaagagaagaaaatcactggcaaggaaaaggaaaattctcgtatggaggaaaatgcagagaaccacatcggtgtgaccgaggtacttttaggcagaaagctgcagcactatacggactcctatctcggatttctgccttgggagaaaaagaagtactttcaggacctcctggatgaagaagagagcctgaagactcagttagcctactttactgactccaagaacacgggacgacaactcaaggacacatttgccgattcactacggtacgtgaataagatactgaacagcaaattcggattcacgagccggaaggttcccgctcacatgccccacatgattgacaggattgtgatgcaagaattgcaggatatgttcccagaagaattcgacaagacctcttttcacaaggtcagacattctgaggacatgcagttcgcattctcgtatttctattatttgatgagtgcagtccagccacttaatatcagccaggttttcgacgaagtggacacagatcaatctggggtgctgtcggaccgggaaatccgaacgttggctacccgcatccacgaactccccctgagcctgcaggatctcaccgggctcgagcatatgcttatcaactgcagcaagatgttacccgccgacatcacacagctcaataatatcccaccaacacaggaatcatactatgaccctaatttaccccctgtcactaagtctctcgttactaattgcaaacctgtcactgacaaaatccacaaggcctataaagacaagaacaagtaccgcttcgaaatcatgggtgaagaggaaatcgcgtttaaaatgatcagaaccaacgttagtcacgtggtgggacagctggacgacatccggaaaaaccctagaaagttcgtctgtttgaacgataacattgaccacaatcacaaagatgctcagaccgttaaggctgttctccgggacttttacgaatcgatgttcccaatccctagtcaattcgaattgccacgggaatacagaaataggttcttgcatatgcacgagctgcaggaatggagggcttatagggacaagttaaagttttggactcactgcgtgttggcgacactgattatgtttaccattttctcattctttgccgagcagctgatcgcccttaagagaaagatctttcctagaaggcgcatccacaaggaagcttcccccaaccgtattagagtg

SEQ ID NO: 16924 - DNA, 3768 bp, Artificial Sequence
  Description of Artificial Sequence: Synthetic coding sequence
atgctatttaaactgcttcagcggcaaacctacacctgcttaagtcatcggtatgggttatatgtttgcttcctgggcgttgtggttactatcgtatccgcctttcaatttggagaggttgttctggagtggagcagggaccaatatcacgtgttattcgattcctacagggataacatcgccggaaagtccttccaaaaccggctctgcctgcccatgcccattgacgtggtatatacgtgggttaatggtactgacctggagctgcttaaagagcttcagcaggtgcgcgaacagatggaggaggagcaaaaagctatgagggagattttaggcaagaacacaacagagccaacgaagaaaagtgagaaacagctcgaatgcttactcactcattgcataaaggtgcctatgctggtgcttgatcctgccctacccgcaaatatcacgctaaaagatctccctagcctgtacccctcttttcatagtgcatcagatatctttaacgtggcgaaacctaagaaccccagcactaatgtgagtgtcgttgtgtttgactccacaaaagacgtggaagacgcccacagtggtttattaaaggggaattcccgccagaccgtctggagaggatacctgaccacggacaaggaggtgcctggtctggttctgatgcaggacctagcgttcttaagcggattcccaccgaccttcaaggagacgaatcagttgaaaacgaagcttccagagaacctgtcatctaaggtaaaactcttgcagctttacagcgaagctagcgtggctttgctcaagctaaacaatcccaaggacttccaggagctgaacaagcagacaaaaaagaatatgaccatagacggaaaagaattgacaatttctcctgcctatctcctgtgggatctgtcagctatttcacagtccaaacaagatgaggatatcagcgcgagcaggtttgaggataatgaagaattgcgctatagtctccgatcaatcgagcgtcatgctccctgggtacgcaacatcttcatcgtgacaaacggccagattccgtcatggctcaacctcgacaaccctagggtgaccattgttacccaccaggacgttttccggaacctgtcccacttacctactttttcatcccctgcaattgaatcccatattcatcggattgagggactgagccagaaattcatatacctgaacgatgatgttatgtttggaaaggatgtatggcccgatgacttctactctcactccaaggggcagaaggtctatctgacctggcctgttccaaactgtgcagaaggatgtccagggtcgtggataaaggacggctactgtgacaaggcgtgcaataactccgcctgcgactgggacgggggagattgtagcggcaattctgggggcagccgttacatagctggaggtggcggaacaggcagcatcggcgtcggtcagccatggcagttcggcggaggcattaatagcgtgtcttattgtaaccagggctgcgcgaattcgtggctggctgataaattttgtgatcaggcatgtaacgtgttaagctgtgggttcgatgccggagactgcggacaagaccactttcatgagttgtataaggtgattctgctgccaaaccaaacccactacattattcccaaaggcgagtgcctgccctacttttccttcgccgaagttgccaagcggggcgtcgagggtgcgtacagcgacaaccccatcattcgacacgcctcgattgcaaacaaatggaagactattcatcttatcatgcacagcggcatgaacgctacaacgatacactttaacttgacctttcagaatacaaatgacgaagagtttaagatgcagatcacagttgaggtggatactagggagggccctaagctcaattcgactgcccagaagggatacgagaacctggtttcccccattacactcctccctgaggccgaaatcttgttcgaggatattccaaaagagaaacgatttccaaaattcaaaagacatgatgttaattcaacacggagggcccaggaggaagtcaaaatacctctggtgaacataagcttgctgcccaaggacgcacaactgtccctgaacacccttgacctgcagctcgagcatggggatatcaccctgaagggctacaatctgagtaaatcagccctacttcggtcattcctgatgaactcccagcatgctaagatcaaaaatcaagcgatcattaccgacgagactaatgactcccttgtggctccccaagagaaacaggtgcacaaatcgatactgcctaactcactcggggtgagtgagcggctacagcggttgacattcccggcggtgagcgttaaagtcaatgggcatgatcagggtcagaacccacccttagacctcgagacgactgctcgattccgagtggagacccatacccagaagacaattggtggaaacgtaacaaaggagaaaccaccttcactgatcgtgcccctagagtcacagatgacgaaggagaagaagattaccgggaaagagaaagaaaattctagaatggaggagaacgccgagaatcatataggggtcacggaggtactgctcgggcgcaagcttcaacactacactgatagctatctcggcttccttccctgggagaagaagaaatacttccaggacctgctcgatgaagaggaatcgctgaagacccagttagcatactttaccgattccaagaataccggtcgccagctaaaggacacatttgcggactctctccgctacgttaacaaaatattgaactccaagtttggttttacatcacgcaaggttccagctcacatgccgcacatgatcgatagaatcgtgatgcaagagctgcaggatatgttccctgaagagtttgataaaacaagttttcacaaagttcggcattctgaagacatgcaatttgccttcagctatttctactatctgatgagcgctgtgcagcctctcaatattagccaggtcttcgacgaagtcgacaccgaccaatcaggcgtgttgagtgaccgggagattcgcaccctcgcaacgcgaatccacgagctacctctctcattgcaggatctcaccggactcgaacacatgttgatcaactgcagtaaaatgctcccggcagacattacccagctaaataacattccccctacacaggagtcctactatgatccaaatttaccccctgtaactaaatcgctcgtcaccaactgtaaacctgtcacagacaaaatacacaaggcttacaaagacaaaaataagtatcgcttcgaaatcatgggggaggaggaaatcgcattcaagatgataagaactaacgtttcacacgtcgtgggacagctcgacgacatccgaaagaatccacgaaagttcgtgtgtctcaacgacaacatcgaccataatcataaggatgctcagacagtgaaggctgtgctccgcgacttctacgagagtatgtttcctatcccatcacaatttgagttaccacgagaatacaggaaccgcttcttgcatatgcatgagctgcaagagtggagggcctatcgtgacaaactgaaattttggacccattgcgttcttgccacactgataatgtttacaatcttttcgttctttgcagaacagctgatcgcacttaagcgaaaaatattcccccggcgtcggatacataaggaggcatcgcccaatcggattcgtgtg

SEQ ID NO: 16925 - DNA, 3768 bp, Artificial Sequence
  Description of Artificial Sequence: Synthetic coding sequence
atgctgttcaaacttttacagcgacagacttatacatgtttgtcccatcggtatggtttgtacgtgtgcttcctcggagtggtggtgactattgtctcagcctttcagtttggggaagttgtgttggagtggtcgcgggaccagtatcatgtcctttttgacagctaccgggataacattgccggtaagtccttccagaacaggctgtgtctgccaatgcccattgatgttgtgtacacatgggttaatggcaccgacctcgagcttctgaaggaactccagcaggtgagggaacagatggaggaagagcaaaaggcgatgcgtgagattctgggaaaaaatactactgaaccaaccaaaaagtcagagaaacagctggaatgtctcttgacgcattgtatcaaggttccaatgctggttctggatccagcactgccagcgaatatcacactgaaggacctcccctccctgtatccctcctttcacagcgcgagtgacatcttcaatgtggctaagcctaaaaaccccagcacaaatgtgtccgtggtcgtgttcgacagcaccaaagacgtggaggatgcgcactcagggctgctgaagggcaattctcggcagactgtgtggcgggggtatctcacaactgataaggaagttccaggtctggtcctgatgcaggatctggccttcttgtcaggcttcccacctacatttaaagagacaaaccagctcaagaccaaactgcccgagaatcttagctctaaggtaaagctcctgcaattatactctgaggccagtgtagccctgcttaagctcaataacccgaaagatttccaggaattaaataagcagacgaagaagaacatgacaatcgatgggaaggaattaaccatttctcccgcctatctcctgtgggatctgagcgctatttcccagtctaagcaggatgaagatatcagcgcaagtaggttcgaagataatgaggaactcagatactctctccgctctattgagcggcacgctccctgggttcggaacatctttatagttacaaatgggcagatcccctcatggttgaacctggacaacccccgagtaactatcgtcacccaccaagacgttttcagaaacctatctcatttaccaacctttagctcacccgccattgaatctcatatccatagaatcgaaggcctcagccagaagtttatctatctcaatgatgatgttatgttcggcaaggatgtttggcctgatgacttttatagccattcaaagggccagaaggtgtatctcacttggcctgtgccgaactgcgctgagggctgccctgggagctggattaaggacggctattgtgacaaggcatgtaacaactccgcttgcgattgggacgggggtgactgctcgggaaacagtggtgggagtcggtacattgctggtggcggtggtacgggcagtatcggagtgggacagccatggcaatttggcgggggcattaacagtgtgagttattgcaaccaggggtgcgccaatagttggctggccgacaaattttgtgatcaggcctgcaatgtcctgagctgtggctttgacgcaggggattgcggacaggatcacttccacgaactgtataaagtgatcctgttaccaaaccaaacgcattatattatcccaaagggggaatgcctgccatacttcagctttgccgaggtagcaaaacggggcgtcgagggagcgtatagtgacaaccccattatcaggcacgcttcaattgccaataagtggaaaactattcacttaattatgcattccggaatgaacgctaccacgattcatttcaacctcacttttcagaacactaatgacgaagagttcaagatgcaaatcaccgtcgaggtggacacccgcgaaggaccgaaactcaactcgacggcgcaaaagggatatgaaaatctggtgtcacctattacgcttctgcctgaagcagaaatcctcttcgaagatatcccaaaggagaaaagattccccaagttcaagcgccacgacgtaaattctaccaggcgcgcccaagaggaggtcaaaataccactcgtcaatatttccctcctccctaaagacgcacagctgtcccttaatactttggatctgcagctggagcacggcgatattacactgaagggatataatctttccaaatctgcactgctccggagcttcctaatgaatagccaacatgccaaaatcaagaatcaggccataatcacggacgagactaatgattccctggtggctccacaggagaaacaggtgcataaaagtatattaccgaattcgttgggggtgtcagagcgactccagaggttaactttccctgctgtgagtgtcaaggttaatgggcacgatcagggacagaatcccccattggatttagagaccactgccagattcagagtggaaactcatacacagaaaaccatcggaggaaacgtcaccaaggagaagccgccttctttgatcgtgcctctagagtctcagatgactaaggaaaagaaaattactggcaaagaaaaggagaactcccggatggaagaaaacgcagaaaaccacattggtgtgacggaggttctacttgggaggaaacttcagcattacacggattcttatctgggcttcctgccttgggagaagaagaaatacttccaggacctgcttgatgaagaagagagtttaaaaacccagttggcttacttcactgattcaaagaatacgggcagacaattaaaggacactttcgccgattccctgcgctacgtgaataagatcctaaacagtaagttcggatttacttctcgaaaagtgcccgctcatatgccacatatgatcgataggatcgttatgcaggagcttcaggatatgttccccgaagaatttgataagactagtttccacaaagtccggcactcagaggatatgcagtttgcctttagctacttctattatctcatgtccgcggtgcagcctctcaatatcagtcaggtttttgatgaggttgacaccgaccagtctggggtcctaagcgatcgcgagattcgaactcttgccacccgcatccatgagctgccactaagtctgcaggacctcacaggattagagcacatgttgatcaactgcagcaagatgttaccggcagacatcacccagctgaataacatcccccccactcaggagagctattacgatccaaatcttcctcccgtgactaaatcattggtgaccaactgcaagcctgtgactgacaagatccacaaggcctacaaggacaaaaacaagtatcggtttgagatcatgggtgaagaagaaatcgccttcaagatgattcgcactaatgtgtctcatgtcgtggggcagctggatgatatccgcaaaaatcccaggaagttcgtatgccttaacgataatatcgatcacaaccacaaagacgctcagaccgtcaaagccgtgctacgggatttctatgagagcatgttccctattccatctcagtttgagctgccaagagaatacagaaaccggttcctgcatatgcacgagctgcaggagtggagggcttatcgggacaagctaaaattttggacccactgcgtgttagccacattaatcatgttcacaattttcagcttctttgcagaacagctaatagccctgaaacgaaagattttccctaggagacgaattcataaagaggctagccctaaccggatccgggta

SEQ ID NO: 16926 - DNA, 3768 bp, Artificial Sequence
  Description of Artificial Sequence: Synthetic coding sequence
atgttgttcaagctgcttcagagacaaacctacacttgcttatcccatcggtatggtctctatgtgtgcttcctcggtgtagttgtgaccatcgtgagcgcgtttcagtttggggaagtcgtcttggagtggagtagggatcagtaccatgtattgtttgacagttatcgagataacatcgcaggtaagtctttccagaacagattgtgcttacctatgcctatcgacgtagtttatacttgggtgaacgggacagacttggagttgctcaaagagcttcagcaagtgagagaacagatggaagaagaacagaaggctatgagggagatcctcggtaagaatacaactgagcctacaaagaagtccgaaaagcaattggagtgccttcttacccattgcatcaaagtaccaatgttagtgctggatcccgctctccccgctaacattacattgaaggatttgccgagtctttacccctctttccattccgcgagcgacatttttaatgtggctaagcctaaaaatccctctactaatgtctcggttgtggtgttcgattctactaaagatgtcgaggatgctcatagcggtcttctcaagggaaattccaggcaaactgtatggaggggttatctaactactgataaggaagttcctggccttgtgctcatgcaggacctggccttcttgtcaggtttcccgcctacttttaaggaaaccaatcagctgaagacaaagctacccgagaatctctctagtaaagtcaagctactccagctttactccgaagcttcggttgctcttttaaagctaaataatcctaaggatttccaagaattaaacaagcaaaccaaaaagaatatgacaattgacggcaaagaactcactatttcccctgcctatttgctctgggatctctccgccatttcacagtccaagcaagatgaagatatctctgcatcacgcttcgaagataatgaggagcttaggtacagcctcagatccatcgaaaggcatgcaccttgggtgagaaatatcttcatcgtgaccaatggtcagataccctcctggttaaatctcgacaatccaagagttacgatcgtgactcatcaagatgtgtttagaaacctgtcacatcttccaaccttcagttcacccgccattgaatctcatattcatagaatcgagggactttcccaaaagttcatttatttgaacgacgatgtaatgtttggtaaagatgtctggcccgatgacttttactcacatagcaaagggcagaaagtttaccttacttggccggtcccaaactgtgccgaaggatgtccgggatcttggatcaaggacggatactgtgataaggcatgtaataactctgcctgtgattgggacggcggagactgttctggcaatagtggaggatcccggtatatagctggcggaggtggtaccggcagtatcggcgtgggtcaaccgtggcaatttggtggtggcatcaatagcgtttcttattgcaaccaggggtgcgcaaattcatggcttgctgataaattttgcgaccaagcttgtaacgtgctctcttgcggtttcgacgcaggagattgcggacaagatcatttccatgaactctacaaggttattcttttgccaaatcagactcattacattatccctaaaggggagtgtctaccttacttcagtttcgcagaagtcgcaaagcggggcgttgaaggggcctactcagataatccaatcattcgtcatgcttctattgccaataaatggaagactattcatttgattatgcattctggtatgaatgcaaccacgattcattttaacttaacgttccagaacacgaatgatgaagagttcaaaatgcagattaccgttgaagtcgatacgagagaggggcctaagcttaattctaccgcccagaaaggatacgaaaacctcgtgtcacctattacgctcttgcctgaagctgagatactatttgaagatatcccgaaagagaaaagattcccaaaattcaagcgtcacgatgttaacagcactcgacgtgcccaggaagaagttaagatcccacttgtgaatatttctctgcttccaaaagatgcccaattgtccttgaacactttggatcttcaattagaacatggtgatattacgctgaagggttacaacctctctaagtcggctctcctcagatcttttcttatgaactcgcaacatgccaagattaagaaccaggcgataattactgatgagacaaatgattctttagtggctccgcaggaaaaacaggttcataagtctattttgccaaattcactgggagttagtgaaaggttacaaagattgacatttccagctgtttccgttaaggtgaatggtcatgatcaagggcagaatcctccgttagatttggagactaccgctagatttagggtcgagactcatacccaaaaaactatcggggggaatgtcacaaaggaaaaaccgccttcattgattgtacccttagagtctcaaatgactaaggaaaagaagattaccggtaaggagaaggagaattcgcgaatggaagagaacgctgaaaaccatatcggagttactgaagttcttctaggtcggaagcttcaacattatactgacagttacttggggttcctcccatgggaaaaaaagaaatacttccaagacctcttagatgaagaggagtctctaaagacccaattggcttactttacagatagtaaaaacactggtagacaattgaaagatacattcgcggactcactgcgttacgttaacaaaatcctgaactccaagttcggctttacttcgcgaaaagtccctgctcatatgcctcatatgatcgatcgcattgtcatgcaggagctgcaggacatgttcccagaagagttcgacaagacttctttccataaagttaggcattctgaagatatgcagttcgcattttcatatttctactatttaatgtctgctgtccagccccttaatatcagtcaggtcttcgatgaagtagatactgatcaatcaggtgtactttccgaccgagagatcagaactctcgctacgaggattcatgaactacctctttctctccaagatttaaccgggctcgaacatatgcttattaattgtagcaaaatgcttccagctgacattactcagttaaataacattccccctacccaggaatcttactatgacccaaatttgccgcccgtgacgaagtcactggttaccaactgtaagcccgttactgataagattcataaagcctataaggataagaataaatatcgttttgagattatgggagaagaagaaattgcatttaagatgattcggacaaacgttagtcatgttgttggtcaactcgatgatatccgaaaaaatcctaggaaatttgtgtgtcttaatgataacatcgatcataatcataaggatgcgcaaacggttaaagcagttctgagggatttctatgagtctatgtttccaataccctcgcaattcgagctacctagggaatataggaatagatttcttcacatgcatgagttacaggaatggcgtgcttatcgggataagttgaaattctggacccattgtgttctggctactctcattatgtttactatcttctctttcttcgcggaacagcttattgctctgaagagaaagatattcccaagaaggcgtatacacaaggaggcctctccaaatcgaattcgagtt

SEQ ID NO: 16927 - DNA, 3768 bp, Artificial Sequence
  Description of Artificial Sequence: Synthetic coding sequence
atgttgtttaagctgctccagaggcagacctatacttgtctttcccatcgttacggattgtacgtctgttttctgggggtggtcgtgaccatcgtttccgcattccagtttggcgaagtggtgcttgagtggtcgcgtgatcaatatcacgtgctgttcgattcgtaccgcgataacatcgccggtaagtcgttccagaaccggttgtgcctgcctatgcctatcgatgtggtctacacctgggtgaatggcaccgatctcgaactgcttaaggaactgcagcaggtgcgcgagcagatggaagaagagcaaaaggccatgcgagaaattctgggaaaaaacaccaccgaaccaaccaagaagtcagaaaagcaactcgaatgccttttgacccattgtattaaggtgccaatgcttgttctggatcctgcactgcctgctaacattaccctcaaggatcttccatctctctacccatcattccactctgcatcggatatctttaatgtcgcgaagcctaagaatccctccactaacgtgtcggtggtggtgtttgactccaccaaagatgtggaagatgctcattcaggtcttttgaagggtaactccagacaaaccgtctggagaggctatttgaccactgacaaggaggtcccaggtctggtgcttatgcaagatctcgccttcctgtcgggatttccccctacctttaaggaaaccaaccaacttaaaactaaacttcctgaaaacttgtcctccaaggtcaaactgcttcagctgtactccgaagcctcggtggcactgcttaaacttaacaaccctaaggacttccaggagttgaataagcaaaccaagaagaacatgacgatcgatggaaaagaactgaccataagcccggcatacctgttgtgggatctctcggctatttcacagtccaagcaggatgaagatatttcggcttctcgctttgaagataacgaggagcttcgttactccttgcgaagcattgaaagacacgccccctgggtgcggaacattttcatcgtcactaacggacagatccctagctggcttaaccttgacaaccctagagtcacgattgtcacgcaccaggatgtgtttcgcaacctgtcacatcttcctaccttttcatctccagcaatcgaatcacatattcatcggatcgagggtctgtcgcaaaagttcatataccttaatgatgatgtaatgtttggtaaggatgtctggcccgacgacttctactcgcattccaaaggtcagaaggtgtacctgacttggccagtccctaactgcgcagaaggatgtccaggttcgtggattaaagacggatactgtgacaaagcatgtaacaactcggcctgcgattgggacggaggtgactgttcgggtaatagtggtggttcgcgttacatcgcagggggaggagggaccgggtcaatcggtgtggggcagccctggcagtttggcggaggcattaacagcgtgagctactgcaaccagggatgtgcgaactcgtggctggcggataagttttgtgatcaagcctgtaatgtgttgtcctgtgggtttgacgcaggagactgtggccaggatcattttcatgaactgtacaaggtgatcctccttccaaaccaaactcattacatcattccaaagggggagtgccttccctacttttcgtttgcagaagtggctaagagaggtgtggagggggcctacagcgacaatccgattatcagacacgcatccatcgccaacaagtggaaaaccattcatcttatcatgcactcaggcatgaatgcaaccactattcatttcaatctgactttccaaaacactaacgacgaagagtttaagatgcagatcaccgtcgaggtggacactagggaagggcctaaactgaacagcactgcgcaaaaaggatacgaaaacttggtgtctccgattacccttctcccggaagcagaaatacttttcgaagatattcctaaggaaaaaaggtttcctaaattcaagaggcatgatgtcaactccactaggcgagcacaggaagaagtgaaaattcctctggtgaacattagccttctgcctaaagatgcccaactgtcgcttaacaccctcgatcttcagctggaacacggcgacattaccttgaagggctacaatctgtccaagagcgcactcctccgtagcttccttatgaactcacaacacgcaaagattaagaatcaagcaatcattaccgatgagactaatgacagcttggtggctccacaagagaaacaagtgcataagtcaattcttcccaactccctgggcgtgtcagaacggctccaaaggctgaccttccctgctgtgagcgtcaaagtgaacggacacgatcaggggcaaaaccctccacttgacctcgaaactaccgcccgcttccgcgtggaaacccatactcaaaagaccattggaggaaacgtgactaaagagaaacctccttcgcttattgtgccgctggaatctcaaatgactaaggaaaagaagattaccggtaaagaaaaggaaaattccaggatggaagaaaacgcggaaaaccatattggtgtgacggaagtcctgcttgggcggaaacttcagcattacaccgattcctacctgggttttttgccatgggagaagaaaaagtactttcaggacctcctggatgaagaagagtcgcttaaaactcaactggcgtacttcacggatagcaagaacaccggtagacagctcaaggatactttcgccgactcgctccgctacgtgaacaagatcttgaatagcaagttcggatttacttcccgtaaggtgcccgcgcacatgcctcatatgatcgatcgcattgtgatgcaagaacttcaggatatgttcccagaagagtttgacaaaacgtcctttcataaggtgcgccattctgaggatatgcagtttgccttctcctacttttactacctgatgagcgcggtgcaacctctgaacatttcgcaggtgttcgatgaggtcgacactgatcaatccggcgtcctctcggatagggaaatccggactctcgcaaccagaatccatgagctcccactttcactgcaagatctcactggattggagcacatgttgataaactgttcaaagatgctgccagcagacatcacccaacttaacaacattcctcccactcaggagtcatactacgatccaaatctgccacccgttaccaagtcactggtcactaactgtaaacctgtgactgataagattcataaggcctacaaggataagaacaagtatcggttcgaaatcatgggagaggaagaaatcgcctttaagatgattagaacgaatgtgagccacgtcgtggggcaactggacgatattcgcaaaaatcctaggaaatttgtgtgtctgaatgacaacattgatcacaaccataaggatgcgcagactgttaaggccgtgcttagagacttttacgaatccatgttccctattccctcacagtttgaactccctagagaataccggaatcgcttcctgcacatgcatgaactccaagaatggcgcgcgtaccgggataagctcaagttctggacccattgcgtacttgccacgcttatcatgttcacgattttctcttttttcgcagagcaactgatcgcgttgaagagaaagatttttccaagacggcgtatacacaaggaagctagccctaacaggataagagtg

SEQ ID NO: 16928 - DNA, 3768 bp, Artificial Sequence
  Description of Artificial Sequence: Synthetic coding sequence
atgctgtttaaactgcttcagaggcagacttacacttgcctttctcatcgctacggcctgtatgtgtgtttcctgggtgtggtcgtcaccattgtgtccgctttccagtttggcgaggtagtgcttgaatggtcaagggatcagtatcatgtactgttcgactcttaccgggataacatagccggaaagagcttccagaatcgactctgcctcccaatgcccatcgacgttgtgtacacatgggtaaacgggaccgatcttgagctgctcaaagagctgcaacaagtgcgggagcaaatggaagaagaacagaaagctatgcgcgaaattctgggcaagaataccactgagccgaccaagaaaagtgaaaaacagctggagtgtctgctcactcattgtatcaaggtgcctatgctggtactagatccagcactgcccgctaatattacgctcaaggaccttccaagcctttacccctcattccatagcgcgagcgacatcttcaacgtggctaaacccaaaaacccctctacaaacgtgagcgtagtggtgttcgactccactaaggacgtcgaggacgcccactctggcttgctgaaggggaactcccgccagaccgtgtggagaggctacctcacgacagacaaggaagtacctggtctcgtcctgatgcaggacctggctttcttaagcgggttccctccaacattcaaagaaacgaaccagctgaagaccaagctcccggagaatctgtcatcaaaggttaagctactacaattgtattccgaagccagcgtggcacttttgaagctcaacaatcctaaggactttcaagaattaaacaagcagacgaagaaaaatatgaccattgatggaaaggagcttacaatctctcccgcataccttctctgggatctgtccgccatcagccaatccaaacaagacgaagacattagcgccagccggttcgaagataacgaggaactgaggtattccctgcggtcaatcgaacggcatgccccctgggtccgaaacatcttcatcgtgacaaacggtcaaattcctagctggctgaaccttgacaaccccagggtgactatcgtcacccaccaggatgtgtttcggaatctgtctcatctgcctactttctcctctccagccatcgagtctcacattcaccgaattgagggcctctcacagaagtttatttacctcaacgacgatgtgatgtttggcaaagacgtgtggcccgacgacttctatagtcactccaaggggcagaaggtatatctgacgtggcctgtccctaactgcgccgaggggtgtccaggaagctggatcaaggatggatattgcgacaaggcctgcaataactcagcctgtgactgggatggtggggattgctccggtaactccggtggttcacggtacatcgccggagggggcggaacgggctcgattggcgtgggacagccctggcagttcggcgggggaattaattctgtatcgtactgtaatcaagggtgcgcgaacagctggctggcagacaagttttgtgaccaggcctgtaatgtgctgtcctgtggctttgacgcgggggactgtggacaggaccacttccatgaactatataaggtgatcttgttaccaaatcagacccattacatcattcccaagggggagtgcctgccttatttcagcttcgccgaagtagccaagagaggggttgagggagcttactctgacaaccctatcattaggcatgcgtcgattgctaataagtggaaaacaatacacctcatcatgcatagtggtatgaacgcaaccacaatccatttcaacctgacattccagaacaccaatgatgaggaattcaagatgcaaattactgttgaagttgacactcgcgagggaccaaaactaaacagcacagcacagaagggatacgaaaatctggtgtcccccataacactcctaccagaggccgaaatattgttcgaagatattcccaaggagaagaggttccctaagttcaaaaggcatgacgtcaatagcactcggagggcccaggaggaagtgaaaatccctcttgtcaacatttccctcctgcctaaggacgctcagttatctctgaatacccttgacctacagctagagcatggcgacatcaccctcaaaggctacaacttaagcaaaagtgctttactacgttccttccttatgaattcacaacacgctaagatcaaaaaccaggcaatcatcactgacgagaccaacgacagcctggtagctcctcaggagaaacaggtgcacaagagcatactcccgaatagcctgggcgtatctgagcggctgcagaggctgacattccccgctgtgtctgtgaaagtgaatggccacgatcagggccagaacccccccctagacctggagacgaccgcgcgcttcagggtcgaaacacacacccagaaaacgatcggagggaacgttaccaaggagaaaccgccaagcctcatcgtgccactagaatctcagatgacaaaagagaagaaaattacaggtaaagagaaagaaaattctcgaatggaagaaaatgcggagaaccacatcggagtcaccgaagttctgctcggcagaaaattgcagcactataccgattcttacctgggctttttgccctgggaaaaaaagaagtacttccaggatctccttgacgaagaagaatcgttgaaaacacaactggcatattttacagacagtaagaacacagggcgtcagctgaaggatacctttgccgacagcttgaggtacgtgaataagattcttaactcaaaattcggattcacaagcaggaaagtgccagcccatatgccccatatgattgataggattgtgatgcaggagttgcaagatatgttccccgaagaattcgacaagacctcctttcacaaggttagacactctgaagatatgcagttcgcctttagctacttctactacctgatgtctgccgtgcaacctctgaacattagccaggtgttcgatgaggtggataccgaccaatccggtgtgcttagcgatcgggaaatccgaacactagcaacaaggattcatgaactgcccctgtctctccaggatctgactgggctcgagcacatgcttatcaattgctctaagatgcttccagcagacatcactcagctgaataatatcccacctacacaggaaagctattatgatcccaatctcccacccgtcacaaagtccttggtcactaactgcaagccggtcaccgataaaatccataaggcctacaaggacaagaacaagtaccggtttgagattatgggtgaggaagagatagcattcaagatgattcggaccaatgtgagtcatgtggttggtcagttggacgacatcaggaagaatccaagaaaattcgtgtgtttgaacgacaacattgatcacaaccataaagatgcccaaaccgtaaaggctgtcctgcgtgacttctacgagtccatgtttcctatacccagccaatttgagttacctagggagtaccggaatcggtttctgcacatgcacgaactccaggagtggagggcctatcgcgataagctgaaattttggactcattgcgtgctagcaacactgattatgttcacgatcttctccttctttgctgagcagctgatagcacttaaaaggaagatcttcccaagacgaagaatccacaaagaagctagtccgaacagaatccgcgtt

SEQ ID NO: 16929 - DNA, 3768 bp, Artificial Sequence
  Description of Artificial Sequence: Synthetic coding sequence
atgttgtttaaactccttcaacgtcaaacttacacttgcctgtcgcaccggtacggactgtatgtctgctttctgggcgttgtggtgaccatagtttcggcatttcaattcggagaagtggtccttgaatggtcgcgggaccaataccatgtgctgtttgacagctaccgggacaacatagcgggtaaatcgtttcaaaaccggctgtgtctgcccatgcctatagacgtggtgtatacctgggtgaatggcaccgacctggagctgctcaaggaactgcagcaagtgagagaacaaatggaggaggaacagaaggcgatgcgagaaattctgggtaagaacaccaccgagccgaccaagaagagtgagaagcaactggaatgtctgctgacgcactgcatcaaagtgccaatgcttgtcctggaccctgcactgcccgcaaacatcaccctgaaggatctccctagcctctacccctcgttccattcggcaagcgatatctttaatgtggccaaacctaagaaccctagcaccaacgtgtcggtggtggtgttcgactcaaccaaggacgtggaggatgcgcatagcggcctgctgaaaggaaactccaggcagactgtgtggaggggttaccttactactgacaaggaagttcccggacttgtcctgatgcaggatcttgcctttttgtcgggatttcctccaaccttcaaggaaactaatcagcttaagactaaactgcccgagaacctctcttcgaaggtgaagctgcttcaattgtacagcgaagcgtcagtggccttgctgaagctcaacaaccctaaggatttccaagaactgaacaaacagaccaaaaagaacatgaccattgatggcaaggaactgactatctccccagcatacctcctgtgggacctctcggccatctcccagtccaagcaggatgaggacatctcggcatcaagatttgaggacaatgaggaacttcgttacagccttcgatcgattgagcgacacgctccttgggtccggaacatctttatagtgacgaatggacagattccttcgtggttgaacctcgataaccctagagtgaccattgtgactcatcaggatgtgttcaggaacctctcgcatcttcctactttctcatcccctgcaattgaatcgcacattcaccgaatcgaagggctctcacaaaagtttatctacctgaatgatgacgttatgttcggaaaggacgtgtggccagatgatttctacagtcactcaaaaggccagaaagtgtacctcacttggccagtccctaattgtgccgagggctgccccggaagctggatcaaagatggatactgtgataaggcttgtaacaattccgcctgtgactgggacggaggcgattgctcaggcaactcgggaggctcccgttacattgcgggaggtgggggaactgggtcaattggagtgggccaaccttggcaattcggtggtggtataaactcggtatcgtactgtaaccaaggttgtgcaaactcgtggctggcagacaagttttgcgatcaagcctgtaacgtcctttcatgcggatttgacgccggggattgcgggcaggaccatttccatgaactctacaaggtgattcttcttcctaaccaaacgcactacataattccaaaaggagaatgccttccctacttcagctttgcagaagtcgccaaaaggggagtggaaggggcctacagcgataatccaattatcagacatgccagcattgcaaacaagtggaaaacgatccatctgatcatgcattcgggaatgaatgcaaccactatccactttaacctcaccttccaaaacaccaatgatgaggaattcaagatgcaaatcaccgtggaggtggataccagggaaggtcccaagctcaacagcactgcacaaaaggggtacgagaatctcgtgtcacctatcaccctcctgcctgaagccgaaatcttgttcgaggatatcccaaaggagaagagatttccaaagttcaagcggcacgatgtgaactcaactagacgtgcacaggaagaggtcaaaattccacttgtgaacatttcactgctgcccaaagacgcacaactttccctgaataccctggatctgcagcttgaacacggtgatattaccctcaaaggctataatcttagtaaatccgcgctgctgcggtctttcctgatgaacagccaacatgccaagattaagaaccaggcgatcataacggatgaaactaacgacagccttgttgccccccaagaaaagcaggtgcataagtcaatacttccaaactcccttggtgtgtctgaaagactccaacgtcttacttttcccgcagtctcggtgaaggtgaacggacatgatcagggacaaaatccaccccttgatctggaaaccactgcgaggtttcgtgtggaaacccatacccagaaaactattggcggaaacgtgaccaaggaaaaaccaccttccctgatagtgcccctggaatcccaaatgaccaaagagaagaaaatcaccggtaaggagaaggaaaactcgcgcatggaggagaatgcagagaatcacataggagtgactgaagtccttctgggacgtaagctgcaacattacactgactcataccttggttttctcccctgggagaaaaagaaatactttcaagatctcctggacgaggaggaaagccttaagacgcaactggcgtactttaccgattcaaaaaacacgggcagacaactcaaggataccttcgcggattcgctccgatacgtgaacaaaattcttaattccaagtttgggtttacctcgaggaaagtgccggcccatatgcctcatatgatcgaccgaattgtcatgcaggagttgcaagacatgtttccagaggaatttgacaagacttccttccataaggtgcgccacagcgaggatatgcagtttgctttttcttacttttactacctcatgtcagcagtgcaacctcttaacatttcccaggtgtttgatgaagtggataccgaccagagcggtgtgctgtcggaccgcgaaattaggaccctggccactcggatccatgaacttcctctttccctgcaagatctgaccggactcgagcacatgctcattaactgttctaaaatgctgcctgcagacattactcaactgaacaacattcctcctacccaagaatcctactacgatcctaatcttcctccagtgactaagtccctcgttacgaactgtaagccagtgaccgataagatccacaaggcgtacaaggacaagaacaagtaccggtttgagatcatgggtgaagaagaaatcgcttttaagatgattagaactaacgtgtcccatgtggtgggtcagctcgatgatattcgcaagaatcctcgaaagtttgtctgtctcaacgataacattgatcacaaccataaagacgcccagacggtgaaggctgtgctgcgcgatttctacgagagcatgtttcctattcccagccagtttgagcttcctagggaatacagaaatagatttctgcatatgcacgaactccaggaatggcgggcctaccgggataagctgaagttctggactcattgtgtcctcgccaccctcattatgtttaccatcttctcattcttcgcagaacaactgatcgccctcaagcgaaagatattcccgcgaagaaggattcacaaggaagcatcgcctaatcgtatcagagtg

SEQ ID NO: 16930 - DNA, 3768 bp, Artificial Sequence
  Description of Artificial Sequence: Synthetic coding sequence
atgctgttcaaactgcttcagagacagacctacacttgccttagccatcgctacggactttacgtgtgctttctcggcgtggtggtgactatcgtgagtgcattccagtttggcgaagttgtgctcgaatggtcccgagatcagtaccatgtgctcttcgatagctaccgtgataacattgcaggcaagagcttccaaaataggctttgcctgcctatgcctatagatgtggtgtatacctgggtgaacggcactgaccttgaactgctgaaagaactccagcaggtgcgcgaacaaatggaagaggaacaaaaagcgatgagagaaatcctcggaaagaacactactgaacctaccaagaagtcggagaagcaactcgagtgtctgctcacgcactgtattaaggtgcccatgctcgtccttgatcctgctctcccggcaaacattaccctgaaagaccttccttcactctacccatcctttcattccgcatcagatatcttcaacgtggcaaagcctaagaacccgtccaccaacgtgtctgtggtggtgttcgattcaactaaggacgtggaagatgcgcacagcggactcctgaaaggaaactcacgtcaaaccgtctggcgtggatacctgactacggataaagaggtccccggtctggtgcttatgcaagaccttgctttccttagcggctttcctccaactttcaaggaaactaatcaactgaaaactaagctgcccgaaaatctgagctcaaaggtgaagctgttgcaattgtacagcgaagcgtcggtcgcactgctgaagttgaataaccccaaggatttccaggagctgaacaaacaaaccaagaaaaacatgacgattgacggaaaggagcttacgatcagccctgcataccttctgtgggatctgtcagcaatttctcagtcaaaacaagatgaggatatctcggcatccagatttgaagataacgaggaattgcgttactcgctccggtcaatcgaaaggcatgcaccatgggtccgcaacatctttatcgtgactaacggtcagattccttcctggttgaatcttgataacccgagagtgacgattgtgactcatcaagatgtgtttaggaacctctcgcacctccctacctttagttcgcctgcgattgaatcgcatatccaccgcatagaaggacttagccaaaagttcatctacttgaacgatgatgtgatgttcgggaaggatgtgtggcctgacgatttctactcgcattccaagggacagaaggtctacctgacctggcctgtgcctaactgtgcagaaggatgtccaggttcgtggattaaggatggctactgtgacaaggcatgtaacaattcagcatgcgattgggatggcggtgattgttcaggaaacagcggcggatcgagatacatcgccggaggaggtggtaccggctcgattggtgttggccaaccgtggcaatttggaggaggtattaactcggtcagctactgcaaccaaggatgtgccaattcttggctggcagataagttttgtgaccaagcgtgtaatgtgctgtcctgtggttttgatgcaggagattgcgggcaggatcatttccatgaactctacaaggtgattctgcttccaaatcaaactcattacattatccccaagggtgagtgccttccttacttctcgttcgcagaggtggccaaaagaggagtggaaggggcatacagcgataacccaatcattagacatgccagcatcgccaataagtggaaaacgattcatctgattatgcatagcggaatgaacgccaccactatacactttaatcttacttttcaaaataccaacgatgaggaattcaagatgcaaattaccgtggaagtggatactcgggaaggacctaaacttaattccaccgcacagaaaggttacgaaaacctggtgtcccccataactctcctgccagaagcagaaatccttttcgaggatatccctaaagaaaagagatttccaaagttcaaaaggcatgatgtgaatagcacccggcgcgcacaggaagaagtgaagatccccctggtgaacatctccctcctgccgaaggacgctcagctgtcactgaacaccctggatcttcagcttgagcatggggatataacgctgaaaggatacaatctttcgaagtccgcacttcttcgctcatttttgatgaattcccaacacgccaagattaagaatcaagccatcataaccgacgaaaccaatgattcgttggtggccccccaagaaaagcaggtgcataagtcaatccttccgaattcattgggagtctcggaaaggctccaacggcttacttttcctgccgtctcggtgaaggtcaatggacacgatcaaggacagaacccacccctggatctggagactaccgcaagattcagagtggaaacccacacgcagaaaactattgggggtaacgtgactaaggaaaagccaccatcgctgattgtacctcttgaatcccaaatgactaaagagaaaaagatcaccggtaaggagaaagagaattcccgcatggaggaaaacgcagaaaatcatattggggtgaccgaagtgctccttggccgaaaacttcaacactacaccgattcgtacctgggattccttccttgggagaagaagaaatactttcaggatctgctggatgaggaggaatcccttaaaacccagctggcatacttcaccgattccaagaacaccggacgtcaattgaaggatactttcgcagattcgttgcgatacgtgaataagatcttgaactcgaaatttggttttacctcgaggaaggtccccgcgcatatgccacatatgatagatcgcattgtgatgcaggaactgcaagatatgtttccggaagagttcgacaagactagctttcacaaggtgcggcacagcgaagatatgcagttcgctttttcgtacttttactacctgatgtctgcagttcaacctcttaacatcagccaggtctttgatgaggtggatactgatcaatctggagtgcttagcgacagagagatacgcactctggcaactcgtatacatgaactccctcttagcttgcaagaccttaccggactcgaacatatgctgattaactgttcgaagatgcttccagcagatataactcaactgaacaatattcctcccacccaggaatcgtactacgaccccaaccttcctccagtcaccaagtcgctggttaccaattgtaagcctgtgactgacaaaatccataaggcatataaggataagaataagtaccggtttgagattatgggagaggaagaaattgcttttaagatgattcgcactaatgtgtcccacgtggttggacaacttgatgatattcgaaaaaacccccgcaaatttgtgtgtctgaacgataacatcgatcataaccataaggacgcacagacggtgaaagcggttctgagagatttctacgagtcaatgtttcccatcccatctcagtttgaacttccaagagagtacaggaaccgcttcctccatatgcatgaactccaagagtggagagcataccgggataaactgaagttttggacgcactgtgtgctggcaactctgattatgtttactattttcagcttctttgcagagcagcttatcgcacttaaacgcaagatattccctcggcgacggattcataaggaagcgtcaccgaaccggattagagtt

SEQ ID NO: 16931 - DNA, 3768 bp, Artificial Sequence
  Description of Artificial Sequence: Synthetic coding sequence
atgctgttcaaactgctccaacgacaaacctacacttgcctctcacacaggtacgggctgtatgtgtgttttctgggggtggtggttactatcgtgtccgctttccaattcggtgaggtcgtcctggaatggtcccgtgaccagtaccacgtcctcttcgattcttaccgcgacaacatcgcgggtaaatcatttcagaatagactgtgcctgccaatgccaatcgacgtggtctacacctgggtgaacggaaccgatctggagctgctgaaggagcttcagcaggtccgcgaacagatggaagaagaacagaaagccatgagagaaattctgggaaagaatactactgagccaactaaaaaatcagaaaagcaactcgaatgcttgctgacccactgtatcaaggtgccgatgctggtcctggacccagccctgccggctaacatcacccttaaagacctgccttccctgtacccgtcgttccactcagcttcggatatcttcaatgtggcgaaaccgaagaaccccagcaccaacgtgtcggtggtcgtttttgattcgactaaggacgtggaggatgcccacagcggccttctgaagggaaactcccgccagaccgtgtggcgcggatacttgactacggacaaggaggtgccgggcttggtcctcatgcaggacctcgcattcctgtccggatttccacctaccttcaaggagacgaaccagctcaagaccaagctccccgaaaatctcagcagcaaggtgaagctgctgcagctctacagcgaagctagcgtggcgctgttgaaactgaataacccgaaggacttccaagaactcaacaaacagactaagaagaatatgacgatcgacggaaaggaactgaccatttcgccagcttacctgttgtgggacctgtccgccatctcacagtcaaagcaggacgaagatatctccgcttcgagatttgaggataatgaagagctccggtattccctgcggtcgatcgaacggcacgccccttgggtgcggaatatcttcatcgtgactaacggccagatcccgtcttggctgaacctggacaacccacgcgtgaccatcgtcactcatcaagatgtgttcagaaatctttcccatctgcccaccttctcgtccccggcgatcgaatcacacatccaccggattgaaggactctcgcaaaagttcatctaccttaacgacgatgtgatgttcggcaaagatgtgtggcctgacgacttctatagccatagcaaggggcagaaggtttacctcacctggcccgtgccgaactgtgccgagggttgccctggatcctggataaaagacggctactgcgataaagcatgcaacaactcggcgtgtgattgggacggaggagactgcagcggaaattcaggaggatcacggtatatcgctgggggaggagggactggctccatcggagtgggtcaaccttggcaattcggcggcggaatcaactccgtgtcctactgcaaccagggatgcgcaaacagctggttggccgataagttttgcgaccaagcctgtaatgtcctgagctgcgggttcgacgcaggagattgcggacaagaccacttccacgaactttacaaggtgatcctgctgccgaaccaaacccactacatcatcccgaagggcgagtgtctgccgtacttctcgttcgcggaagtggccaagagaggagtggaaggagcctacagcgacaaccctatcatcaggcacgccagcatcgccaataaatggaaaacgatccatttgatcatgcactcgggcatgaatgccaccactatacatttcaatctgacgttccaaaataccaacgacgaggagttcaagatgcaaatcactgtcgaggtggacactcgagaagggccgaagctcaacagcactgcccagaaaggttacgaaaatctggtgtcaccaatcacgctgctgccggaggcagaaatcctctttgaggacattccaaaggaaaaacggttccccaagtttaagcggcatgacgtgaattcgactagacgggcgcaggaggaggtcaagattccacttgtgaacatctccctgctcccgaaggatgcacagttgtcgctcaacacccttgatcttcagcttgagcatggagatatcaccctgaaaggctacaacctgagtaagtccgcactgctgaggtctttccttatgaactcccagcacgccaaaatcaagaaccaggcaattatcaccgacgaaaccaacgatagtctcgtggcaccgcaggaaaagcaggtgcataagtccattctcccgaattccctgggcgtgtcagagcggctgcaacgcctcaccttcccggctgtctcagttaaggtgaatggtcatgatcaagggcaaaaccctccgctggacttggaaacgaccgcccgctttcgggtcgaaacccacactcaaaagactatcggcggaaacgtgaccaaagagaagccgccttcgctgatcgtgccactcgaatctcagatgactaaagagaagaaaatcacgggcaaagaaaaggaaaactcgcggatggaagagaacgccgagaatcacattggggtgaccgaagtgctcctcggccgcaaactgcagcattacacggactcatacctgggattcctgccgtgggagaaaaagaaatacttccaggatctgctcgacgaagaggagtcccttaagactcagttggcgtacttcactgactcgaagaatactggtagacagctcaaggacaccttcgccgattcgttgcggtacgtcaataagatcctcaactccaagttcggatttactagccgcaaggtcccagcccatatgccgcatatgatcgatcgcattgttatgcaggaactgcaggacatgttccccgaagaatttgataagacctcgtttcacaaggtccggcacagcgaggacatgcagttcgcgttctcctacttttactacctcatgagcgcggtccaacccctgaacattagccaagtctttgacgaggtcgatactgaccagtcgggagtgctgtcggaccgcgaaatcagaaccctcgctacccggattcatgagctgccgctctcgctccaagatttgaccggtctggagcacatgctgatcaactgctcaaagatgctgccggccgacatcacccagctgaataatattccaccaactcaggaaagctactacgatccgaatttgccacctgtcaccaagtcactggtcaccaactgcaagccggtgactgacaaaatccacaaggcatacaaagataagaataagtaccgcttcgaaatcatgggagaagaggagatcgcgtttaagatgatccgtactaacgtgtcgcacgtagtcggacagttggacgatatcaggaagaacccgaggaagttcgtgtgcctgaacgacaacattgatcacaaccacaaggacgcgcagaccgtgaaggccgtgcttcgcgacttctacgagtcgatgttccctatcccttcccaattcgaactgccccgcgagtatcggaaccgctttcttcatatgcacgagctccaggaatggcgagcttacagggataagctcaaattctggactcattgcgtgctcgcaactctgatcatgttcaccattttcagctttttcgcagagcagctgatcgccctcaagagaaaaatcttccctcgccgcagaatccataaggaagcgtccccaaaccgcatcagagtg

SEQ ID NO: 16932 - DNA, 3768 bp, Artificial Sequence
  Description of Artificial Sequence: Synthetic coding sequence
atgttgtttaaacttctccaaaggcagacctatacatgtctgtctcacagatacggcctctatgtgtgttttctcggagtcgtggtgactatcgtcagcgccttccagttcggcgaggtcgtattggaatggtcaagagatcagtaccacgttcttttcgacagctacagggataacatcgctggaaaaagcttccagaacaggctatgcctccccatgcccatcgacgtggtgtatacatgggtaaacggcactgacttggaactgttgaaggagcttcagcaagttcgggaacagatggaagaggagcagaaggccatgagagagatcctgggcaagaacacgacagagccaactaagaaaagtgaaaaacaactcgaatgtctgctgactcattgcatcaaggtcccgatgctcgtgctggatcctgccctgccggcaaatataacccttaaggatctgccaagcctttacccctcgtttcatagcgcttccgacatatttaacgtagctaagcctaaaaacccatctacgaatgtttccgtggtggtgtttgacagtaccaaagacgtggaagatgcgcatagcggcctgctgaagggcaatagccgacagacggtgtggcgcgggtacctcacaactgacaaagaagtgcccggcctggtactgatgcaggacctcgcttttttgtccggattcccgccaacgttcaaagaaactaatcaactcaagacgaaactcccggaaaacttatcctctaaggttaagcttctgcagctgtactcagaggcaagtgtggcactgctgaagctgaacaatcctaaagattttcaggagttaaataaacagactaaaaagaatatgacaatcgacggcaaggagctgaccatctcccctgcttacttgctgtgggatttatccgccatctcacaatcaaagcaggatgaggacattagcgcctcaaggtttgaggacaacgaagagctcaggtatagcctgagatcgattgaacggcatgccccctgggtgcgcaatatctttatcgttaccaacgggcagattccctcctggctgaatttggacaatcctcgcgtcacaatcgtgacccaccaggacgttttcaggaatctaagtcacctcccaacgttcagcagtcccgcgatcgaaagtcacatccacaggatcgaggggctgtcccagaagtttatttaccttaacgatgacgtgatgtttgggaaagacgtatggccagatgatttttacagccactcaaaggggcaaaaggtctacctcacatggccagtgccaaattgtgccgagggatgtcccggtagctggatcaaggatggatactgtgataaggcctgcaataattcagcttgtgactgggatgggggggactgttccggcaattccggaggaagcaggtatattgccgggggtgggggtactggctctatcggggtcggtcaaccctggcagttcgggggaggcatcaatagcgttagctattgcaaccagggttgtgccaactcctggcttgcggacaagttctgtgaccaggcctgtaatgtcctttcgtgcggcttcgacgccggcgattgtgggcaggaccattttcacgaactttataaagtgatacttctgccaaatcagacacattatatcattcccaaaggggagtgcttaccatacttctcctttgccgaggtggccaaaaggggcgtggaaggcgcttacagcgataatccaattattcgccatgcgtcgatcgctaacaagtggaagacaattcatcttattatgcattcgggaatgaatgctaccactatccatttcaacctgactttccaaaatactaacgatgaggagttcaaaatgcaaatcaccgttgaggtggacaccagagaaggccccaagctgaacagcactgctcagaaaggctacgaaaacctggtgagccctatcacgctacttccagaggctgaaatcctcttcgaagacatcccaaaagagaaacggtttcccaagttcaagaggcacgacgtcaacagcacaaggcgagcacaggaggaagttaagattcctctggttaatatttctctcttgcccaaagacgcccagttatctctcaatacactggacctgcagcttgagcacggcgacataacactcaagggttataatttgtccaagagcgctctgctaaggagctttctaatgaactcccagcacgccaaaataaagaaccaggccataatcactgacgagacgaatgactcacttgtggcaccacaagaaaaacaggtgcataagtcaatcctgcccaacagcctcggcgtttctgagagactgcagcgactgacgtttccagccgtgtctgtgaaggtgaacggacatgaccagggacagaatccaccactcgatctcgagaccaccgccagattccgtgttgagacgcatacacaaaagaccattggagggaacgtgacgaaggagaagcccccatccctgattgtaccccttgagagccagatgaccaaagaaaaaaaaataacaggaaaagagaaagagaatagtcgcatggaagagaatgcagagaaccacatcggggtcaccgaggtgctgctcggaagaaagctccaacactatactgactcatatctggggtttttaccttgggagaaaaagaaatacttccaagacctcttagacgaagaggagtcactgaaaacacagcttgcttactttactgatagtaaaaacacaggacgacaacttaaagataccttcgcggactccttgcggtacgtaaacaaaatcctgaatagtaagtttggattcaccagtcggaaagtcccagctcacatgcctcacatgatcgataggatcgttatgcaggagttgcaggacatgtttcctgaagaattcgataagacctcctttcataaagtcaggcacagcgaagatatgcagttcgccttttcttatttttattatctgatgtccgccgtccagcctcttaacatcagtcaggtttttgacgaagtcgacacagatcagtctggggtcctctccgacagggagataagaacactagccacccgaattcatgaactgcccttatccttacaggatctcacggggcttgaacacatgctgattaattgctcaaagatgctgcccgctgatatcacacaactcaataatatacctcctacccaggaatcttactatgacccaaacctgcctcccgttactaagagcctggtcaccaattgtaagcccgtcaccgataagatacacaaggcctataaagacaaaaacaaatatcgatttgagatcatgggcgaggaggagatcgcgtttaagatgattcgcacgaacgtaagccacgtggtgggtcagcttgacgatattcgtaagaacccccggaagttcgtatgtctgaacgataacatcgatcataaccacaaggacgctcaaactgttaaggccgtcttgagagatttctatgaaagtatgttccccattccatcacaatttgagctgcctcgtgaatatcggaatcggttcttgcacatgcacgagctacaggaatggcgtgcatatagagataagctgaagttttggacccactgcgttctggccacactgataatgttcactatctttagttttttcgcggaacagctgatagctttgaagaggaagatcttcccaagacgcaggattcataaggaagcctctccgaaccgtatccgcgtg

SEQ ID NO: 16933 - DNA, 3768 bp, Artificial Sequence
  Description of Artificial Sequence: Synthetic coding sequence
atgttgttcaagctgctgcagcgacagacatatacttgcctgagccaccgctacggactgtatgtttgcttcctcggcgtcgtcgtcacaattgtctccgctttccaatttggagaggtggtacttgagtggtcacgagaccagtaccacgtcctgtttgatagttatagggataatatcgcagggaagtccttccagaatcggctctgtctccctatgccgatcgacgtcgtatatacttgggtgaacggaaccgatctcgagctcctgaaggagctccagcaagttagggagcagatggaggaggagcagaaggccatgagggagatactgggcaagaacaccactgaacccactaaaaagtcggagaaacagctggagtgcttactgacccactgtatcaaagtgccgatgctcgtgcttgacccggcccttccggccaatataactctgaaggatctgccatctctctacccttcgtttcactctgcctctgatattttcaacgtggccaaacccaaaaatccatccacgaatgtgtctgtggtagtgttcgattcaactaaggatgtggaagatgcgcatagcggccttctgaaaggaaactctaggcagacagtgtggcggggttacttgaccactgataaggaggtaccaggtcttgtgttgatgcaagacctggctttcctctcaggattcccccctacctttaaagaaacaaatcagctgaaaaccaagctgcccgaaaacctgagcagcaaggtaaaactgctgcaactctactctgaggccagtgtggctctcctcaagctgaacaaccctaaagacttccaggaacttaacaagcagactaagaagaacatgacgattgacggtaaagagctgacaattagccccgcttatctgctgtgggacttgtccgctatttctcagtcaaaacaagacgaggacatctcggccagccggtttgaggacaatgaagaacttaggtacagcctgaggagcatcgagcgtcatgcaccttgggtgaggaacatttttattgttaccaatggtcagatccctagttggctgaatttggataacccacgagttactatcgtcacacaccaggatgtcttccgtaatctgagtcacctgcccaccttcagtagtcccgctatcgaaagccacatccaccgaatagaaggactctcccagaagttcatatatctgaatgacgacgtcatgtttggcaaggacgtttggcccgatgacttctatagtcatagtaagggccagaaggtatacctgacttggcctgtcccgaattgtgcagaagggtgtcccggaagttggataaaggacggatactgtgacaaagcatgtaacaattctgcctgcgactgggacggcggagattgctccggaaactcaggcggtagtagatacattgcaggtggggggggcaccggatctatcggagttgggcagccttggcagttcggtggcggaatcaatagcgtgagttattgcaatcaaggctgcgccaattcgtggctagcagacaaattctgtgatcaagcctgcaacgtcttaagctgtggatttgacgctggggattgcggacaggaccattttcacgagctgtataaggtcatcctgttgcctaaccagacccattacataattccaaaaggggaatgtctaccctacttctcctttgccgaggtggccaaaagaggtgtcgagggggcgtactctgacaacccgattattaggcatgctagcattgccaataagtggaagacaatccacctgattatgcactccggcatgaatgccactacaatccactttaacctgacgtttcagaacaccaacgacgaggagtttaagatgcagattacagtggaggtggacactcgcgagggacctaagttgaattctactgcccagaaaggctacgaaaaccttgtgagcccgatcaccctgctgccagaagccgaaattctgttcgaggacatccccaaggagaagaggttcccgaagttcaaaagacacgacgtgaatagtactagacgggcacaggaggaagttaaaatcccattggtgaatatctctctgctccccaaggacgcccagctttctctaaacaccctggacttacagctggagcacggcgacattacattgaagggatataacttgtcaaagagcgcactgcttaggagtttcctgatgaactcacagcatgcaaaaataaaaaaccaggccataatcacagacgagacaaacgactctttggttgctccccaggagaaacaagtgcacaagtctattctgccaaactcactgggcgtctcagagcgcctccagcgcctaactttccctgccgtctcggtgaaggttaacgggcacgatcagggccagaatcctcctctggatctggagactaccgcccggttccgggtggaaacccatacccagaagaccataggaggaaacgtgactaaggagaagccgccatcactcattgtccctctggagtcccagatgacaaaggagaagaagattacaggaaaggagaaagagaattcacggatggaggaaaatgcagaaaaccacatcggtgtgacagaggttctgctgggaagaaagctgcagcattatactgatagttatctgggcttcctgccatgggagaagaaaaagtatttccaggacctactagacgaggaggagagcctgaaaacacaattggcatattttaccgacagtaagaacaccggcagacagctgaaggacacattcgccgacagcctgaggtacgtcaacaagattttaaacagtaagttcggctttacctctcgcaaggtgccagcacatatgcctcatatgatcgatcggattgtgatgcaggagctgcaggatatgtttcctgaagagttcgacaaaacctcattccacaaagtccgccactcagaggatatgcagttcgccttttcctacttttattatctcatgtccgctgtgcagcccctcaatataagtcaggtgttcgacgaagtggataccgaccaatctggagtgttgtcagatagagaaataaggactcttgcgaccaggatccacgagcttccattatctctgcaagacctgacaggactggaacacatgctgataaattgctcgaagatgctgcccgcagacataacacaattgaacaatattccccccacccaagaaagttattatgaccccaatctccctccggtgaccaagtcactggttacgaactgtaagccagtgacagataaaattcacaaggcttataaggataaaaataagtaccggtttgagataatgggtgaggaggaaatcgccttcaaaatgatccgcactaatgttagtcacgttgtcgggcagctggatgacatccggaagaacccccgcaaatttgtctgcctgaacgacaatatcgatcacaatcacaaggacgcccagacagtcaaggcagtgttgcgagatttctatgagagcatgttcccaattccttcccaattcgagctccctagggaatacagaaaccggttcctccacatgcacgaactgcaggaatggagggcctatagggataaattgaaattttggacgcattgcgtactcgcaaccctgatcatgttcacgatctttagtttcttcgctgagcaattgatcgccttgaaaaggaagattttccccagacgccgtatccataaagaagcaagccccaatagaatcagagtg

SEQ ID NO: 16934 - DNA, 3768 bp, Artificial Sequence
  Description of Artificial Sequence: Synthetic coding sequence
atgctcttcaaacttcttcaacggcagacgtacacctgtctctcgcacagatacggactgtatgtgtgctttctcggggtggtggttactatcgtgtccgcgttccaattcggagaggtggtgctggagtggtcgcgggatcaataccatgtgctctttgacagctatcgtgacaatatcgccgggaagagtttccagaatcggctctgtctcccaatgcctatcgatgtggtctacacctgggtcaacggaactgacctggagctcctgaaagaacttcaacaggtgagagagcagatggaagaggagcagaaggcaatgagggagatcttggggaagaacaccactgagcctaccaagaagtcggagaagcagttggagtgcctgctgactcattgcatcaaagtgccgatgctggtgctggacccggcactgcccgcgaacattactttgaaggatcttccgtccctctacccatcctttcactccgcctcagacatcttcaacgtcgcaaagcctaagaatccttccacgaacgtgtcggtggtggtgttcgattcgactaaggacgttgaggacgcgcactcaggattgctgaaaggaaactcgagacagaccgtttggcgcggatacctgactactgataaagaggtgcccgggctggtgctgatgcaggacctggccttcctgtcaggattcccaccgactttcaaagaaaccaaccaactcaagaccaagttgcctgaaaatctgtccagcaaagtgaagctgctgcaactgtactctgaagcctccgtcgcgttgctcaagctgaacaatcccaaggacttccaggaactgaacaagcagaccaaaaagaatatgaccatcgacggcaaggaactgaccatcagcccagcctacctcctgtgggatctgtcagcaatttcacaatcaaagcaagatgaggacatctccgcgtcgcgcttcgaagataacgaggagctgagatacagcttgcgctccattgaacgccatgccccctgggtccggaacattttcattgttactaacggacagatcccgtcatggctgaatttggacaatccacgcgtgaccatcgtgactcaccaagacgtgttccggaacctctcgcacttgccgaccttctcgagcccggcaatcgagagccatatccatcggattgagggtctgtcacaaaagttcatctacctgaacgatgacgtgatgtttggcaaagatgtgtggccggacgacttctacagccactcgaaaggacagaaggtttacctcacctggccggtgccgaactgtgccgaaggatgcccgggctcttggattaaggacggatattgtgacaaggcttgcaacaactctgcctgcgactgggacggaggtgactgctcggggaactcaggcggaagccgctacattgctggaggtggaggtaccggatcaatcggagtgggccagccatggcagttcggcgggggcatcaactccgtctcctactgtaaccagggatgcgctaactcctggctcgctgacaagttttgcgaccaagcctgcaatgtcttgtcctgcggatttgatgcgggagactgtggccaagatcacttccatgaactgtacaaggtgatcctgctgccgaaccaaacccactatatcatccctaaaggggaatgcctcccgtacttctcctttgctgaagttgccaagcggggtgtggagggtgcatattccgataatcctatcatccggcacgctagtatagcgaacaaatggaaaaccatccatctgattatgcacagcggaatgaatgctaccaccatccacttcaacttgacttttcaaaatactaacgacgaggaattcaagatgcagatcactgtggaggtcgacactcgcgagggccctaaactcaattctaccgctcaaaagggatacgagaatctggtgtcgcctatcaccttgctcccggaggcggaaatcctgttcgaggacatacccaaagagaagagatttccaaagttcaaaagacacgacgtgaactcgacccgcagggctcaagaggaagttaagatccctcttgtcaacatttcgctgctcccaaaggacgcgcagttgagcctgaacaccctcgaccttcagctggagcacggagacattaccctgaagggctacaacctctcgaagtccgcgttgttgcggtccttcctcatgaactcccagcatgcaaagatcaagaatcaggccatcatcaccgatgaaaccaacgattccctcgtcgctccacaggaaaagcaagttcataagagcattctgcccaattcgttgggagtaagcgagcgactgcagagattgactttcccggcagtcagcgtgaaggtgaatggtcacgaccagggacaaaatccgccgcttgaccttgagacgacggcgcgctttcgggtggaaactcacactcagaaaactatcggaggcaatgtcactaaggaaaagccaccgtccctgatcgtgccgctggagtcccaaatgacgaaagagaaaaagattaccggaaaagaaaaggaaaactcgcgcatggaagaaaacgccgaaaatcacatcggagtgaccgaggtgctcctggggcggaagctgcaacactacactgacagctacctgggatttctcccctgggagaagaagaagtactttcaggacctcctcgatgaagaggagtcacttaaaacgcagctggcctactttacggattcgaaaaacacgggccgccagttgaaggacactttcgctgactctctgaggtacgtgaataagatcctgaactcaaaattcggattcacttcgcgcaaggtgccagcacatatgccgcacatgatcgatcgcatcgtgatgcaggaactgcaggatatgtttcccgaagaatttgataagactagcttccacaaagtgcgccactcagaagatatgcagttcgcattctcctacttttactaccttatgtccgccgtccagccgcttaacatctcccaggtgttcgatgaagtggacaccgaccagtccggagtgctcagcgatagagaaattcggactctggcaaccaggatacatgagctgccgctttccctgcaagatttgaccgggttggagcacatgctgataaactgctccaagatgctgccagccgacatcacgcaactgaacaatatcccgccaacccaggagtcgtattacgatcctaacctgccgccagtgaccaagagcctcgtgaccaattgcaagcccgtcaccgataagattcacaaggcatacaaggacaagaacaagtaccggttcgagatcatgggcgaggaagagatcgcgttcaagatgatccggactaatgtgtcccacgtcgtgggccagctggatgatatccgcaaaaatccccgcaaattcgtgtgcctgaacgacaacattgatcataatcataaggatgcccaaactgttaaggcggtgctccgggacttctacgagagcatgttccccatcccttcgcaattcgaacttccaagggaataccggaacaggttcctgcacatgcatgaattgcaggaatggagagcatacagagacaaactgaagttttggactcattgcgtcttggccaccctcatcatgttcaccatcttctctttcttcgccgagcaactgatcgccctcaagcgcaagatattcccgagacgccgcatacataaggaagcgtcgccaaacagaatccgcgtg

SEQ ID NO: 16935 - DNA, 3768 bp, Artificial Sequence
  Description of Artificial Sequence: Synthetic coding sequence
atgctgtttaaactgctgcagagacaaacgtatacgtgcttaagccatcgttatggcctgtacgtatgctttcttggtgtggtcgtaaccattgtctcagcttttcaatttggcgaagtagtacttgaatggtctagagatcagtatcatgtgctgttcgattcttaccgcgacaacatcgctggcaaatcatttcaaaatcgactttgtctgccgatgcctattgatgttgtatatacatgggtgaatggaacagaccttgaactactgaaagaactccaacaggttcgcgagcaaatggaagaagaacagaaagcaatgagagaaatcttgggcaaaaatacgacggaaccgacaaaaaaatcagaaaaacagcttgaatgtcttcttacgcattgcattaaagtgccaatgctagtgcttgatcctgcgttaccggctaatatcacactaaaggacttgccatcattatatccgtcctttcactcagctagcgatattttcaatgtcgccaaaccgaaaaatccttctacaaatgtttcagttgtagtgtttgattcaacaaaagatgtcgaagacgcccattctggtctgctgaaaggtaatagcagacagaccgtttggagagggtatctgactacagataaagaagttcctggccttgtactgatgcaggatttagcttttctatcagggtttccgccaacgttcaaagaaacgaatcaattgaaaacaaagttgcctgaaaacctgtcttcgaaagttaaattgctccaattatatagcgaagcgtctgtagcactgttgaagttgaataaccccaaagatttccaagagcttaacaaacaaacaaagaaaaatatgacgattgacggcaaggagttgactatatcgcctgcgtacttgttatgggatttatcagccatttcacagtctaagcaggatgaggatatcagcgcgtcgcgcttcgaagataatgaagaactgcgatattctttacgttccatcgagcgccatgcgccatgggtgaggaacatattcattgtcacaaacggtcaaatcccctcatggctgaacctggacaacccgcgggtgacaattgtgacccaccaagacgtttttcgtaacttgagccacttaccgacgttttctagcccggctatagaatctcatatccataggatcgaagggctgtcacagaaatttatttatttaaacgacgacgttatgtttggaaaggatgtatggccagatgacttttattcccattctaaaggccaaaaggtgtatcttacatggcctgtgccgaattgcgctgaaggatgtccgggttcctggattaaagacggatactgcgataaagcttgtaacaatagtgcatgcgactgggatggtggggattgttcgggcaactcaggcggaagccgttacattgctgggggcggcggcacgggatcaattggggtcggacaaccgtggcaatttggtggtggcattaatagcgtatcttattgtaatcagggctgtgcgaattcatggttagctgataaattttgtgatcaagcttgtaatgtgttatcttgcggattcgatgctggagactgcggccaggatcattttcatgaattatataaagtaattctgcttccgaatcagacacattacatcatccccaaaggtgaatgccttccgtatttttcatttgccgaagttgcaaaaaggggggtggagggagcatattcagacaatccgatcatccggcatgcgagtattgctaataaatggaagacgatccatttaattatgcatagcggtatgaacgcaactacaatccactttaacctgacatttcaaaacacgaatgatgaagaatttaagatgcaaatcacagtcgaggtcgacacgcgtgaggggcctaaactgaactccacagcccagaagggatatgagaatttggtgtctcctatcactcttctgccagaagcggaaattctgtttgaagatattccgaaagaaaaacgttttccaaagtttaaacgacatgatgtcaatagtacaagaagagcccaggaggaagtcaagataccgctggttaatatatcattgcttccgaaagacgctcagctctctcttaacactttagaccttcagcttgagcatggcgacattacgctgaagggctacaacctctcaaaatcggcattgctgcgtagttttctgatgaatagtcaacatgcaaaaataaaaaatcaggccatcatcactgacgaaaccaacgattcattggtggcgcctcaggaaaaacaagtgcacaaaagcatcctgcctaatagtctcggcgtttcagaacgcttgcagaggttaacctttccggcggtcagtgttaaagtaaatggtcatgaccaaggccagaatccaccgctggatcttgaaacgacggcaagatttcgagttgaaacgcacactcaaaagacgataggcggtaatgtaacaaaagaaaaaccgccgtcacttatcgtgcctctcgaatcacagatgacaaaagaaaaaaaaattacgggaaaagaaaaagagaatagccgtatggaagaaaatgcggaaaatcacataggagttacagaggtcttactgggacgaaaattacaacactatacagatagttatttaggatttctgccgtgggaaaaaaaaaaatactttcaggatcttctcgatgaagaagaatcattaaaaactcagctggcctactttactgactccaaaaatacgggaaggcaactcaaagatacttttgcagattctttacgttatgtaaacaagattctgaactctaagtttggctttacaagtcgtaaggtcccagcacatatgccgcatatgatcgaccgtattgtgatgcaagaattgcaagatatgtttccggaggaatttgacaaaacaagcttccataaagtgcgccatagtgaagacatgcagtttgcgtttagctatttttattaccttatgtcagccgtccagccattaaacatttcccaagtctttgacgaggtggacacggaccaatccggcgtgctttccgatcgcgaaatcagaacgctggcaacccgaatccacgaactaccactgtcattgcaggatttaactggattagaacatatgcttattaactgcagcaagatgctgcctgcagatattactcaacttaacaatatacctccgacacaagaaagctactatgatccgaatcttccaccagtgaccaaatctctggtaacgaattgcaaaccggttacagataaaattcataaagcttacaaggataaaaataagtatagatttgaaataatgggcgaagaagaaattgcttttaaaatgatccgtaccaacgtttcacatgtagtcggacagcttgacgacatccggaagaatccgcgaaaattcgtctgtttaaatgacaatatagatcacaatcacaaggatgcacaaaccgtgaaagctgtgcttcgagatttctatgaatcaatgttcccaatcccgagtcaatttgaattacctagggaatatagaaaccgatttctccatatgcatgaactgcaagaatggagggcttatcgcgacaaacttaagttttggacgcattgcgtgttggccactttaataatgtttacaatcttttccttcttcgcggaacagcttatcgcattaaaaagaaaaatctttccgagacggcgcattcataaggaagcatcaccgaaccgaatacgtgtg

SEQ ID NO: 16936 - DNA, 3768 bp, Artificial Sequence
  Description of Artificial Sequence: Synthetic coding sequence
atgttatttaaactattacaacgtcaaacgtatacgtgtctatcgcatcgttatggtctatatgtatgttttttaggtgtagttgtaacgatagtatcggcgtttcaatttggtgaagtagttttagaatggtcgcgtgatcaatatcatgttttatttgattcgtatcgtgataatatagcgggtaaatcgtttcaaaatcgactatgtctaccgatgccgatagatgtagtttatacgtgggtaaatggtacggatttagaattattaaaagaattacaacaagttcgagaacaaatggaagaagaacaaaaagcgatgcgtgaaatactaggtaaaaatacgacggaaccgacgaaaaaatcggaaaaacaattagaatgtctactaacgcattgtataaaagttccgatgttagtattagatccggcgctaccggcgaatataacgctaaaagatttaccgtcgttatatccgtcgtttcattcggcgtcggatatatttaatgttgcgaaaccgaaaaatccgtcgacgaatgtatcggttgtagtatttgattcgacgaaagatgtagaagatgcgcattcgggtctactaaaaggtaattcgcgacaaacggtttggcgtggttatctaacgacggataaagaagttccgggtctagtactaatgcaagatttagcgtttctatcgggttttccgccgacgtttaaagaaacgaatcaattaaaaacgaaactaccggaaaatctatcgtcgaaagtaaaattattacaattatattcggaagcgtcggtagcgctattaaaactaaataatccgaaagattttcaagaattaaataaacaaacgaaaaaaaatatgacgatagatggtaaagaactaacgatatcgccggcgtatctattatgggatttatcggcgatatcgcaatcgaaacaagatgaagatatatcggcgtcgcgatttgaagataatgaagaactacgatattcgttacgttcgatagaacgacatgcgccgtgggttcgtaatatatttatagtaacgaatggtcaaataccgtcgtggttaaatctagataatccgcgtgtaacgatagtaacgcatcaagatgtatttcgtaatttatcgcatctaccgacgttttcgtcgccggcgatagaatcgcatatacatcgaatagaaggtctatcgcaaaaatttatatatttaaatgatgatgttatgtttggtaaagatgtatggccggatgatttttattcgcattcgaaaggtcaaaaagtatatctaacgtggccggtaccgaattgtgcggaaggttgtccgggttcgtggataaaagatggttattgtgataaagcgtgtaataattcggcgtgtgattgggatggtggtgattgttcgggtaattcgggtggttcgcgttatatagcgggtggtggtggtacgggttcgataggtgtaggtcaaccgtggcaatttggtggtggtataaattcggtttcgtattgtaatcaaggttgtgcgaattcgtggctagcggataaattttgtgatcaagcgtgtaatgtattatcgtgtggttttgatgcgggtgattgtggtcaagatcattttcatgaactatataaagttatattattaccgaatcaaacgcattatataataccgaaaggtgaatgtctaccgtatttttcgtttgcggaagtagcgaaacgaggtgtagaaggtgcgtattcggataatccgataatacgtcatgcgtcgatagcgaataaatggaaaacgatacatctaataatgcattcgggtatgaatgcgacgacgatacattttaatctaacgtttcaaaatacgaatgatgaagaatttaaaatgcaaataacggtagaagttgatacgcgtgaaggtccgaaattaaattcgacggcgcaaaaaggttatgaaaatttagtatcgccgataacgttattaccggaagcggaaatattatttgaagatataccgaaagaaaaacgttttccgaaatttaaacgtcatgatgtaaattcgacgcgtcgagcgcaagaagaagttaaaataccgctagttaatatatcgctactaccgaaagatgcgcaattatcgctaaatacgctagatttacaactagaacatggtgatataacgttaaaaggttataatctatcgaaatcggcgctactacgatcgtttctaatgaattcgcaacatgcgaaaataaaaaatcaagcgataataacggatgaaacgaatgattcgctagtagcgccgcaagaaaaacaagtacataaatcgatattaccgaattcgttaggtgtatcggaacgactacaacgattaacgtttccggcggtttcggtaaaagtaaatggtcatgatcaaggtcaaaatccgccgttagatttagaaacgacggcgcgatttcgagtagaaacgcatacgcaaaaaacgataggtggtaatgtaacgaaagaaaaaccgccgtcgctaatagtaccgttagaatcgcaaatgacgaaagaaaaaaaaataacgggtaaagaaaaagaaaattcgcgtatggaagaaaatgcggaaaatcatataggtgtaacggaagtattattaggtcgtaaactacaacattatacggattcgtatctaggttttctaccgtgggaaaaaaaaaaatattttcaagatttattagatgaagaagaatcgctaaaaacgcaactagcgtattttacggattcgaaaaatacgggtcgtcaactaaaagatacgtttgcggattcgttacgttatgtaaataaaatattaaattcgaaatttggttttacgtcgcgaaaagtaccggcgcatatgccgcatatgatagatcgaatagttatgcaagaattacaagatatgtttccggaagaatttgataaaacgtcgtttcataaagtacgtcattcggaagatatgcaatttgcgttttcgtatttttattatctaatgtcggcggttcaaccgctaaatatatcgcaagtttttgatgaagtagatacggatcaatcgggtgtattatcggatcgtgaaatacgtacgctagcgacgcgtatacatgaattaccgctatcgttacaagatttaacgggtctagaacatatgttaataaattgttcgaaaatgctaccggcggatataacgcaattaaataatataccgccgacgcaagaatcgtattatgatccgaatttaccgccggtaacgaaatcgttagtaacgaattgtaaaccggttacggataaaatacataaagcgtataaagataaaaataaatatcgttttgaaataatgggtgaagaagaaatagcgtttaaaatgatacgaacgaatgtatcgcatgtagtaggtcaactagatgatatacgtaaaaatccgcgtaaatttgtatgtctaaatgataatatagatcataatcataaagatgcgcaaacggttaaagcggtactacgtgatttttatgaatcgatgtttccgataccgtcgcaatttgaactaccgcgagaatatcgaaatcgatttctacatatgcatgaactacaagaatggcgagcgtatcgagataaactaaaattttggacgcattgtgtactagcgacgctaataatgtttacgatattttcgttttttgcggaacaactaatagcgttaaaacgaaaaatatttccgcgacgtcgtatacataaagaagcgtcgccgaatcgtatacgagta

SEQ ID NO: 16937 - DNA, 3768 bp, Artificial Sequence
  Description of Artificial Sequence: Synthetic coding sequence
atgctgttcaaactcctgcaaaggcaaacctacacctgtctatctcatagatatggcctttacgtgtgctttttgggagtggtcgttaccatcgtttctgccttccagttcggcgaagtcgtacttgagtggagcagggaccagtatcatgtgctgttcgattcttaccgcgacaatattgccggtaagtccttccaaaaccgcctgtgtctcccaatgccgatagacgtggtttacacatgggtgaatggcaccgacttggagctgctgaaggaactgcagcaggtcagggaacagatggaggaagagcagaaggccatgagggagatcctgggcaagaatacaaccgagcccaccaagaaaagtgaaaagcagctggagtgtcttctgacccactgtattaaggtgccaatgttggtgctggacccagccttgcccgccaacattaccctcaaggatttgccttcgttataccccagcttccattccgcaagcgacatttttaacgttgcgaaacctaaaaaccctagtactaacgtctccgtcgtggtcttcgattctacaaaagatgtcgaggacgcccatagtggcctgctgaagggaaactcccgccagaccgtgtggagaggctacctgacgaccgataaggaagtccccgggctggttcttatgcaggacttagcttttttgtctggctttccgccgactttcaaagagaccaaccagctgaaaactaaactgccggaaaatctcagttctaaagtgaaactgctgcagctgtattcggaagcgtccgtggccttattgaaattgaataacccgaaggacttccaagagctcaacaagcagacaaaaaagaacatgacaattgatgggaaagagctgacaatctccccagcatatctgctatgggatctgtcggccatatcccagtctaaacaggacgaagatataagtgcatcaaggtttgaggacaacgaagaactgagatattccctgagatctattgaacgccacgcaccttgggtcagaaatatctttattgttacaaacggtcagatcccgagctggctaaatttagacaatccgcgggtcacaattgtcactcaccaggacgtgtttcggaacctgtcccacttgccaactttcagctctccggccattgagtcccacattcaccggatcgaaggcctgtctcagaagttcatttatctaaacgacgacgtcatgtttgggaaagatgtgtggcccgatgacttctattcccattccaagggacagaaagtctatctgacctggccagtgcctaactgcgcagagggctgtccaggctcttggatcaaagacggatactgcgacaaggcttgcaacaattctgcctgtgattgggatggcggcgactgctccggtaattccggggggtcacgatatatcgccgggggaggaggcaccggcagtattggcgtgggccagccttggcagttcggggggggtatcaacagcgtcagttattgcaaccaagggtgcgctaacagctggctagcagacaaattctgcgaccaggcctgcaacgtgctttcatgtggcttcgatgcaggtgattgcggtcaggaccattttcacgagctgtacaaggtgattctgctcccgaatcagacccactatataatcccaaaaggggaatgcctgccatacttctcatttgccgaggtggctaagcgtggggtagagggcgcctacagcgataaccccattatcaggcacgcaagtatcgccaacaaatggaagaccatccatcttataatgcacagtgggatgaacgcaacaactattcactttaacctgacgtttcagaacacaaacgacgaggagtttaagatgcagatcaccgtggaagtcgacacgcgggaaggtcctaagctgaattctactgcccaaaaaggctatgaaaacctggtatcccctatcacactgctgcccgaagcagaaatccttttcgaagatattccaaaggagaagaggtttccaaagtttaagcgccatgacgtgaacagtaccagacgggcccaggaggaggtgaagatccccctggttaacatttccctcttaccaaaagacgctcaactctccctcaacaccctggatttacagttggagcacggcgacatcactctgaagggatataacctgtcaaaatcggccctgctgcgctccttcctcatgaatagtcagcacgcgaagattaagaatcaggctattattacagacgagacaaatgacagtctggtcgcacctcaggaaaagcaggtccacaagtctattcttccaaacagcctgggagtctcagaacggctgcagagactcacctttcccgctgtgtcggttaaggttaacggacacgaccagggccagaatcctcctctggacctcgagactaccgcgcgctttcgcgttgagacgcacacacagaagactatcggaggaaatgtaaccaaagagaagcccccctccttgatcgtcccactagaatctcagatgacgaaagagaagaagataaccgggaaggaaaaagagaactctcgtatggaggagaacgccgagaatcatattggagtcacggaagttctgctgggaagaaagctacagcactacactgacagctacttgggattcctaccctgggagaagaaaaaatactttcaagacctgctggatgaagaggagtcattgaaaacacagctcgcttacttcaccgatagtaaaaataccggacggcagctaaaggacacattcgccgacagtcttagatacgtgaataaaattctcaattctaagtttgggttcacatcccggaaggttcccgctcacatgcctcacatgatcgatcgaatcgttatgcaggagctccaggatatgttccccgaggagtttgacaaaacatccttccacaaggtgcggcactcagaggacatgcagtttgcattttcttatttttactatctcatgtccgccgtgcagcctctcaatatctcacaggtcttcgacgaggtggacaccgaccagtctggtgtgttgtctgaccgtgagattaggactctcgccaccagaatacatgagcttcctttaagcctgcaggacctgaccggattggaacacatgctgattaactgcagcaaaatgctccctgcagatattactcagctcaataacatccccccaacgcaggagtcctactatgaccctaatctcccgccagttactaaatcacttgtgacgaattgcaaaccagttacggacaaaatccataaggcctataaggataagaacaaatacaggtttgaaattatgggcgaggaggagatcgcctttaaaatgatcaggactaatgtgtcacacgtagttggacagttggatgatattcgcaagaaccctcgcaagttcgtctgcttgaatgacaatattgaccataaccataaggacgcccagacagtgaaagctgtcctgagagacttttacgagtctatgttcccaattccaagtcaatttgaattaccgcgggagtatagaaaccggtttctgcatatgcacgaactacaggagtggagggcctaccgggacaagttaaagttttggacacattgtgttctggccacccttattatgttcacaatattttcttttttcgccgagcagctgatagcattgaagcgcaagatttttcctcgcagacgcatccataaggaagcatcccccaatcggatacgagtg

SEQ ID NO: 16938 - DNA, 3768 bp, Artificial Sequence
  Description of Artificial Sequence: Synthetic coding sequence
atgctatttaaactcttgcagcggcaaacatatacatgcttgtctcaccgctatgggctctatgtttgtttcctgggagtagtcgtgactatagtcagtgctttccaatttggggaagtggtgctcgaatggtcccgcgatcagtaccatgtgctctttgattcttatcgggataacatagcaggaaaatcctttcagaaccgactctgcctacctatgcccatcgatgtggtgtatacatgggttaatgggacagatctcgaactgttaaaagagctacagcaggtccgcgaacagatggaagaagaacagaaagcaatgagggaaatcctaggaaaaaacactacagaacctacaaagaaatcagaaaaacagctggagtgcctattgacacactgtattaaagtacccatgctcgtgctagatccagccctgccagctaacatcacattaaaagatctcccctccctatatccatccttccattcggcctcggatatctttaacgtggctaaacctaagaacccctcaactaacgtttctgtggtggtgttcgattcaactaaggatgttgaagatgcccattctggattactaaaagggaattctcgacagacagtatggcgaggatatctcactacggataaggaggtaccaggactagtgctgatgcaggatctcgcctttctctccgggtttccacctacattcaaagaaactaaccagcttaagactaaactgccagaaaacctttcaagtaaagtgaaactgttacagctttactccgaggcctctgttgcccttttgaagctaaacaacccaaaggattttcaggaactcaacaaacagacgaagaagaatatgacaatcgatgggaaggaattgactatctcccccgcctatctcctttgggatctctccgccatatctcagtctaaacaggatgaagacatatccgcatctaggttcgaggataacgaagagttgaggtactctctcagatcgatcgaaaggcatgccccttgggtgcggaacatcttcatagtgacaaatgggcagattccaagttggctcaacctggataatcctcgggtcactatcgtgactcaccaggatgtattccggaacctctcccaccttcctacattctcttctccggccatagaaagtcacatccacagaatagaggggctctctcagaaattcatatatctgaacgatgatgtgatgttcggaaaagatgtgtggccagatgatttctacagtcattccaaagggcaaaaggtgtatttgacatggcctgtgcccaactgtgccgagggatgtcccggatcttggatcaaagatggatattgcgataaagcgtgcaacaacagtgcttgcgattgggatgggggagactgttcagggaactctggagggagtaggtacatcgccgggggaggaggaacagggtctatcggggtagggcagccctggcagttcgggggagggataaattctgtctcatattgcaaccaggggtgtgcaaactcatggctggccgataagttctgcgatcaggcatgtaacgtcttaagttgtgggtttgatgcaggagattgtgggcaggatcatttccacgagctgtataaggtgatccttctcccaaatcagactcactatataatacccaaaggggaatgtcttccatatttttccttcgcagaagttgccaagcggggagtcgagggagcatattctgataatcctataatcaggcatgcctctatagctaataaatggaagactatacatcttatcatgcactccggaatgaacgcaactacaatccacttcaatttgacatttcagaatacaaatgatgaagagttcaaaatgcagatcacagtagaagtagatacaagagaagggccaaaacttaatagtactgcccagaaagggtatgaaaacctcgtatcccctataacgctacttccagaggccgagatcctatttgaagatatacctaaggaaaagaggtttccaaaatttaaaaggcatgatgttaattcaactcggagggcccaggaagaagtaaaaataccgctcgtgaatatctctttgctccccaaagatgcacagctgtccctgaatacactagacttacagcttgaacatggagatatcacattgaaagggtacaacctttcaaaatctgctttgctcagatcatttcttatgaactcacagcacgctaagatcaaaaaccaggccataatcacagatgaaacaaacgactcactggtggctccccaggagaaacaggtgcataaatccatcctacctaactctctcggagtgtctgaaaggctacagaggctcacatttcctgctgtgtctgtgaaagtaaacgggcacgaccaggggcagaatcctcccctcgacttggaaacaactgctcgcttccgggtagaaactcatactcagaagacaattggggggaatgtgactaaagaaaaacccccatcactcatagtcccccttgagagtcagatgactaaagaaaaaaaaatcacaggaaaagaaaaagaaaacagtcggatggaagaaaacgctgaaaatcacatcggagttacggaagtcttactcggaaggaagctgcaacattatacagatagttacctgggatttcttccctgggaaaaaaaaaaatattttcaggacctacttgatgaagaggaatcccttaagactcagctggcttacttcacagatagtaaaaatacaggacggcagcttaaagatactttcgctgacagtctaaggtatgtcaataagatactcaactccaagttcggatttactagtaggaaggtgcctgctcatatgcctcacatgatcgataggatcgtgatgcaagaactccaggatatgtttccagaagaattcgataaaacatccttccacaaggtgcgacattctgaggatatgcagtttgctttctcctatttttattacctcatgtctgccgtccagccccttaatataagtcaggtatttgatgaagtcgatactgatcagagtggggtactaagtgaccgcgaaatcagaacactggcaacacggatccatgaactccccttatcattgcaggatctcacaggactggaacacatgctcattaattgttcaaagatgctaccagctgatataacacagttaaacaatatcccacctacacaggaaagttactatgatcccaacctgccccccgtgactaaatccctggtgacgaattgcaaacctgtgacagataaaatacacaaagcatataaggacaaaaacaaatatcggtttgaaataatgggggaagaagaaatagcctttaaaatgattaggactaacgtatctcacgtcgtggggcagcttgacgatatcaggaaaaatccaagaaagttcgtctgcttgaacgataatatagaccacaaccataaagatgcgcagactgtaaaagccgttctccgcgacttctatgaatcgatgtttcccatcccttcacaatttgaacttcctcgcgaatatcggaataggtttctccacatgcatgaacttcaggaatggcgagcatatcgcgataaattaaaattctggacacattgtgtgctggccactctgatcatgttcactatattctcctttttcgccgagcagcttattgcattgaaaaggaaaatattccctagacggcgaatacacaaagaagccagtccgaacaggatcagagtg

SEQ ID NO: 16939 - DNA, 3768 bp, Artificial Sequence
  Description of Artificial Sequence: Synthetic coding sequence
atgctcttcaagttgctccagagacaaacctacacgtgcctctctcacagatacggactgtacgtctgctttctgggagtcgtcgtcactatcgtgtcagcgtttcagttcggggaggtggtcctggaatggagccgcgaccagtaccatgtcctcttcgattcctaccgcgataacatcgctggaaagtcatttcaaaaccggttgtgtctgccaatgccgattgacgtcgtgtacacttgggtgaatggtaccgacctcgaattgctgaaagaactgcagcaagtccgggagcagatggaagaggagcaaaaggccatgcgcgaaatcctcgggaagaatactactgaaccgaccaagaagagcgagaagcagttggaatgcttgctgacccattgcatcaaagtgccgatgctggtgctcgatcctgcgctgcctgctaatatcacgctgaaagacttgccaagcctttatccgagtttccatagcgcatccgacatcttcaacgtggcaaagcccaagaatccgagcaccaacgtgtcggtcgtcgttttcgactctacgaaggatgtggaggacgcccattccggactgctgaagggaaattcacgccagactgtgtggagaggttaccttaccactgacaaagaagtgccgggccttgtcctgatgcaggacttggcgttcctgtccggcttccctccgacctttaaggagactaatcagcttaagaccaaactgccggaaaacctgtcgtcgaaggtgaaactcctgcagctgtattcagaggcttcggtggccctgctgaaactgaataaccccaaggacttccaggaactcaataagcaaaccaagaaaaacatgactatcgacggtaaggagctgaccatctccccggcctacctgttgtgggacctttccgcaatctcacagtcgaaacaggacgaggacatcagcgctagccgtttcgaagataacgaagagctgcggtactcgctgcgcagcatcgagcgccatgccccatgggtgcgcaacatcttcatcgtgaccaatggccaaattccctcatggctgaatctcgacaacccgcgggtgactattgtgactcatcaagacgtgtttagaaacctctcacatctgccaacgttttcttcaccggctatcgagtcacacatccaccgcatcgaaggattgtcacagaaattcatctacctgaacgatgatgtgatgttcggcaaggacgtgtggccggatgacttctactcccatagcaaaggacaaaaggtgtaccttacctggccggtgccaaattgtgccgagggatgcccggggtcctggatcaaagacggctactgcgacaaggcgtgcaacaactcagcttgtgattgggacggcggagattgctccggtaactcaggaggatcgcgctatatcgccggtggaggcgggactggatccatcggtgtggggcagccgtggcagtttggcggtggcatcaattccgtctcctactgcaatcagggctgtgcgaattcctggctcgctgacaagttttgcgaccaggcctgcaacgtgctgtcttgcggattcgacgccggagactgcggacaggatcactttcacgaactctacaaggtcatcctgctgcctaatcaaacccattacattattcccaagggagagtgtctcccttacttctcgttcgcagaagtggcaaagaggggcgtggagggcgcatatagcgataacccgatcataaggcatgcctcaatcgccaacaagtggaaaactattcatctgattatgcactccggaatgaacgccaccactatccacttcaatctcactttccaaaatactaacgatgaagagttcaagatgcaaatcactgtggaggtcgatactcgcgaggggccaaaacttaattccacggctcagaagggatacgaaaacctcgtcagccctatcacgcttctgcctgaagccgaaatcttgttcgaggatataccaaaggagaaacggttcccaaagttcaaaagacacgacgtgaactcgactcggcgggcccaagaagaagtgaagatcccgctggtcaacatatcgctgctcccgaaggatgcgcaactttctctgaacaccctggatttgcaactggaacatggagatattacgctcaagggctataacctgagcaagagcgcgcttctgcgctcgttcctgatgaattcgcaacacgcaaagatcaagaatcaagccatcatcactgacgaaactaacgactcgctggtcgcaccgcaggaaaagcaggtccacaagtcaatcttgccaaattcgttgggcgtgtcggagcgcctgcaacggctgaccttcccggccgtgtcggtgaaagtgaatggacatgaccagggacaaaaccccccgctggatctggagactactgctcgtttcagggtggagacgcacacccagaaaacgatcgggggcaacgtcacgaaggaaaagccgccgtccctcatcgtgcctctcgaatcacagatgaccaaagagaagaaaatcaccggtaaggaaaaagaaaactcgcggatggaagagaacgctgaaaatcatatcggcgtgaccgaggtgctcctgggccggaagctgcagcactacactgattcctacctcggtttcctgccgtgggagaaaaagaaatacttccaggatcttttggacgaagaagaatcgttgaaaacccagctggcctactttaccgactctaaaaacacgggccggcagctcaaagacactttcgctgattccctccggtacgtcaacaagatcctgaattccaagttcgggtttacgtccagaaaggtgccggcccacatgccgcacatgatcgaccggatcgtgatgcaggagctgcaggacatgttccccgaggagttcgacaagacctccttccacaaggtccggcactcggaagatatgcagtttgcgttctcatacttctactacctgatgtcagcggtgcagcctctcaacattagccaggtctttgatgaggtggacaccgaccaatctggcgtgctgtcagatagagagatccggaccctggccactagaatccatgaactgccgctgtcgctccaggacctgaccggactcgagcatatgctgatcaattgttccaaaatgcttcccgcagacatcacccagctgaacaacattcctccgacccaagagagctactacgatcctaaccttccgcccgtgacgaaatccttggtcaccaactgcaaaccagtcactgataagatccataaggcctacaaagacaaaaacaagtaccgcttcgagatcatgggagaagaagaaatcgccttcaagatgatcagaactaacgtttcccacgttgttggacagttggatgatatcagaaaaaacccgcggaagtttgtctgcctgaacgacaatatagaccacaaccataaggacgcacagacggtgaaggctgtcttgcgcgatttctacgaaagcatgttcccaatcccgtcgcagttcgagttgccccgggaataccgcaaccgcttccttcacatgcacgaactgcaagagtggcgggcatacagagacaagctgaaattctggacccattgtgtcctggctaccctgatcatgttcactattttcagcttctttgcagagcagcttatcgccctcaagagaaagatcttcccacgccgccgcatccacaaagaggctagcccaaaccgcatccgcgtc

SEQ ID NO: 16940 - DNA, 3768 bp, Artificial Sequence
  Description of Artificial Sequence: Synthetic coding sequence
atgctgtttaagttgcttcaacggcaaacctacacttgcctttcgcatagatacggactgtacgtgtgctttctgggggtggtcgtcactatagtttcagcatttcaattcggcgaagtggtgctcgagtggtcgagagatcagtaccacgtcctttttgattcgtacagagacaacattgccggaaagagctttcagaatcggttgtgcctgcctatgccaattgatgttgtgtacacctgggtgaatggaaccgacctggaactgctcaaagagctgcaacaagtgagagaacaaatggaagaagaacaaaaagccatgagagagatactgggcaagaacaccacggagccgacgaagaaaagcgaaaagcaacttgaatgtctgcttactcattgcatcaaggtgcccatgttggtccttgatcccgccttgccagcgaatatcacgttgaaggatctgccttcactttacccttcgttccattcagcatctgacattttcaacgtggcaaagccaaagaatccttctaccaatgtgagcgtggtggtgtttgactccactaaggatgtggaagatgcacactcaggactgctgaagggtaattcgcgacagaccgtgtggcgaggatacctgaccactgataaagaggtgccgggacttgtgctgatgcaggacctcgcgttcctgtcagggtttcctcctaccttcaaagaaaccaatcaactgaaaaccaagctcccggagaacctgagcagcaaggtgaaactcttgcaactgtatagcgaagcatcagtggctttgttgaagctgaacaacccaaaggattttcaagagctgaacaagcaaactaaaaagaacatgaccatcgacggaaaggagttgactattagcccagcatacttgctctgggatctcagcgccatctcgcaatctaagcaagacgaggacatatcagctagccggtttgaagataatgaggaactccgttacagccttcgatcaatcgagcgccatgccccgtgggtgcggaatatctttatagtcactaacggtcaaattccctcgtggcttaatcttgacaacccaagagtgacgatcgtgacccatcaggatgtgtttcgtaacctttcacatctgcctaccttcagctcgcctgccatcgagtcccacatccaccgtattgaaggactgagccagaagttcatctacctgaatgacgacgtgatgtttggtaaggatgtgtggcctgatgacttctactcccattcaaagggtcaaaaggtgtacctgacttggccagtgcccaattgtgcggaaggttgtcctggatcatggatcaaggacggttactgtgataaggcctgcaacaactcggcttgcgattgggatggtggcgattgtagcggcaattcaggtgggagccgctacatcgcgggtggaggtggaactggctcgattggggtcggacagccttggcaattcggcggtggtattaactcggtgtcttactgcaatcaaggctgtgcaaattcatggctggccgataagttctgcgaccaggcctgtaacgtgctttcatgtggatttgatgccggagattgcggtcaggatcacttccacgagctttacaaagtcatccttttgcctaaccagactcattacattatacccaagggagaatgtctgccctatttctcctttgcagaagtcgcaaagcgaggtgtggaaggtgcatactcggataaccccataatacgacatgcatccatcgcaaacaagtggaaaacgatccacctgatcatgcatagcggtatgaatgcaactaccattcacttcaacctgacttttcagaatactaacgacgaagagtttaagatgcagataaccgtggaagtcgatactcgcgaaggaccaaagctgaattcaactgcgcaaaagggatacgaaaatcttgtgtccccaattactctccttcctgaagcagagatccttttcgaggatattccgaaagaaaagagatttcctaaattcaagagacatgacgtcaactctactcggagagctcaggaagaggtgaaaattccgcttgttaacattagcttgctgccaaaagacgcacaattgtctttgaacactctggatctccagttggaacacggagatattactctgaaaggatacaacctctcgaaaagcgcactcctccgctcgtttcttatgaatagccaacatgccaagattaagaatcaggcaatcatcaccgacgaaaccaacgattctctggtcgcaccccaagagaaacaagtgcacaagagcattctgcctaactcccttggtgtctccgaaaggctgcaacggctgacgtttccggcagtgtccgtcaaagtgaatggtcatgatcagggacagaacccaccactggacctcgaaaccaccgcacgctttagggtggaaactcacactcaaaagactattggaggaaacgttaccaaggaaaaaccccccagccttatcgtgcctcttgagtcacagatgaccaaggagaaaaagatcactggaaaagaaaaggaaaactccaggatggaagagaatgcggagaaccatattggcgtcactgaagtgctgcttggaagaaaattgcagcattacaccgactcgtacctggggtttctgccgtgggaaaagaagaagtacttccaagatctgctcgatgaggaagaatcccttaaaactcagcttgcgtatttcaccgatagcaagaacacggggaggcaacttaaggataccttcgccgactcgttgaggtatgtcaataagatcctcaattcgaagtttgggtttacctcgcgcaaagtcccagcgcacatgccacacatgatagatcgcattgtcatgcaagagctccaggacatgtttccggaagaatttgataagacctcctttcataaagtccgccattccgaagatatgcaatttgcattcagctacttttactatctcatgtccgcagttcaacctcttaacatttcacaagtgtttgatgaagtggacaccgatcagtcgggcgtgctttccgatcgggagattagaacccttgcgacccgcatccacgagctgcccctctcccttcaagatcttactggactggaacatatgttgattaactgttccaagatgctgccagcagatattactcagctgaacaacattccaccaacccaggaaagctactatgacccaaatctgcctccagtgaccaagtcccttgttacgaactgtaaacccgtcaccgataagattcataaggcctacaaagacaagaacaagtacagatttgagatcatgggcgaagaagaaattgcattcaaaatgattcggacgaacgtcagccacgtcgtgggtcagcttgacgatattcggaagaatccaaggaagttcgtgtgtctgaatgataacatagaccataaccataaggatgcacagactgtcaaggccgtgctgagggacttttacgagtccatgtttcctattcccagccaatttgagcttcctagggagtatagaaatcgattcctccatatgcatgaactgcaagaatggcgtgcatacagggacaagctgaagttctggactcactgtgtgctggcaaccctcattatgttcaccattttctcatttttcgcggaacagctcatagccctgaagcggaagatttttcctaggcgtcggatccataaggaagcatccccgaacagaattagggtg

SEQ ID NO: 16941 - DNA, 3768 bp, Artificial Sequence
  Description of Artificial Sequence: Synthetic coding sequence
atgctcttcaaactgctgcagcggcagacctacacctgcctctcacaccggtatggtctttatgtgtgcttcctgggcgtggtggtgaccatcgtctccgctttccagttcggagaagtggtgctggaatggagccgcgatcagtaccatgtcctcttcgacagctaccgggacaacatcgcaggaaaatcctttcagaatcgactgtgtctgccgatgccaatcgatgtcgtgtacacgtgggtgaatggaactgatctggagctccttaaggaactgcagcaagtccgcgagcaaatggaggaggagcagaaggccatgcgcgaaatcctcggtaagaacactactgaacccacgaagaagtccgagaagcaactggagtgcctgctgacccactgcataaaagtgcccatgctggttctggacccggcgcttccagccaatatcactctgaaggacctgccatctctctaccctagctttcattccgcgtcagacatcttcaatgtcgcgaaacccaagaacccatcaactaacgtcagcgtggtggtcttcgactccaccaaggacgtcgaagacgcccactccggactgctgaagggaaactcccgccagactgtgtggcgcggctacctcacgaccgataaggaggtgcctggactggttctgatgcaagatctggcgttcctgtcaggatttccaccaacctttaaggaaaccaaccagctcaagaccaagctgccggagaacctcagctcaaaagtcaagttgttgcagctctactcggaggcatcggtcgcgcttctcaagctcaataaccccaaggattttcaggaactgaataaacagactaaaaagaacatgactatcgacggtaaagagctcactatttccccggcgtacctcctttgggatctgtccgccatctcgcaatccaagcaggatgaagacatcagcgcgtcgcgcttcgaagacaacgaggaactgagatacagcctgcgctctatcgagcggcatgcgccgtgggtgcgcaatatctttatcgtgaccaatggccagatcccctcatggcttaatctcgacaacccaagggtcactatcgtgacccaccaggacgtcttccggaacctgtcccacctgcctactttcagctctccggcaatcgaatcgcacattcaccgcatcgaaggcctgagccaaaagtttatctacctcaacgatgacgtgatgttcgggaaagatgtctggccggatgacttctacagccacagcaagggccagaaggtgtacctcacttggccggtgccaaactgcgcagagggatgtccaggcagttggatcaaggatggatactgcgataaagcctgcaacaacagcgcttgcgactgggatggtggcgattgctcgggaaatagcggtggatcgagatacatcgctggtggaggaggaaccggttctatcggggtgggacaaccgtggcagttcggagggggcatcaattcggtcagttactgcaaccaaggctgcgctaactcctggttggccgacaagttctgcgaccaggcgtgcaacgtgctgtcgtgtggcttcgacgcgggcgactgcggacaagaccacttccatgaactgtacaaagtaattttgttgcctaatcagactcactacatcatcccgaagggtgagtgtctcccgtacttctcgtttgcagaggtggcgaagagaggagtggagggcgcctactccgacaacccgatcatcaggcatgcatccatcgcgaacaaatggaaaaccattcacctgatcatgcattcgggaatgaacgccaccactatccacttcaatctgactttccagaacactaatgacgaggagttcaaaatgcagatcaccgtggaggtggacacccgggaaggcccaaaactcaactcaactgctcagaaggggtacgagaatctggtttcgccaatcactctgctgccggaagcggaaatcctgttcgaggacatcccgaaagaaaagcgtttcccgaaattcaagcgccacgacgtgaattcgacgaggcgcgcccaggaggaagtgaagatccctctggtcaacatctcccttctcccaaaggatgcgcagctctctctcaacacgcttgacctgcagcttgagcatggcgatattactctgaagggatacaacctctcgaagtcagcccttctccggtcatttttgatgaattcacaacacgccaagatcaaaaaccaagccatcatcactgacgaaactaatgactcactggtagccccgcaggagaagcaagtgcacaaaagcattttgccgaacagccttggtgtgtccgaacggctccaacgcctcacgttccccgccgtgtcagtcaaggtcaacggacacgaccaggggcagaacccacctctggacctggaaacgaccgcacggttccgggttgaaacccatactcaaaagactattggaggcaacgtgactaaggaaaagccaccatcactcatcgtgccgcttgaatcgcaaatgaccaaggagaagaagatcaccggcaaggaaaaagagaactcacgcatggaagagaacgccgaaaaccacatcggggtgacggaggtgctgctgggaagaaaactgcagcactacactgattcttatctcggattcctgccgtgggagaagaagaagtacttccaagatctgcttgatgaggaagagtccctgaagacccagctggcgtacttcaccgactcgaaaaacaccggcaggcaactgaaggatacttttgcagatagcctgcgctacgtgaataagatcctgaacagcaaatttggctttacctcacgaaaggtgcctgcccatatgcctcacatgatcgaccgcatcgtgatgcaagaactgcaggacatgttcccggaggaattcgacaagactagcttccataaggtgcggcattctgaagacatgcaattcgccttttcctacttctactatctcatgtccgcggtgcaaccgctgaacatcagccaggtcttcgacgaagtggataccgaccagtcaggtgtcctctcagacagggagatccgaaccctggccacccggattcacgaactgccactctcactgcaagacctgaccggactcgaacacatgctcataaattgctcaaaaatgctcccagcggacatcactcagctcaacaatatccctccgacccaggagtcatactacgaccctaacctcccaccggtcaccaagtcgctggtgactaactgcaagccagtgacggataagatccacaaggcgtacaaagacaaaaacaagtaccggttcgaaatcatgggagaagaggaaatcgcattcaaaatgataaggaccaatgtgtcccatgtcgtgggacagctggacgatatcagaaaaaatccacggaagttcgtctgcctcaatgacaatatcgaccacaatcacaaggacgcccagaccgtcaaggcggtcctccgcgatttctacgagtcgatgtttccaatcccctctcaattcgagctgccgcgcgaataccgcaacagattccttcacatgcatgagctgcaggaatggagggcctatcgcgataagctgaagttctggacccactgcgtcctggccactctgattatgttcaccatattcagcttcttcgcggaacagctcattgcactgaagagaaagatcttcccgcggcgcagaatccacaaggaagcctcgcctaaccgcatccgcgtg

SEQ ID NO: 16942 - DNA, 3768 bp, Artificial Sequence
  Description of Artificial Sequence: Synthetic coding sequence
atgctcttcaaactgcttcagagacagacatacacctgcctgagccataggtacggactgtacgtatgctttctcggagtggttgtcaccattgtgtcagcattccagtttggagaagtggttctggaatggagccgcgaccagtaccacgtcctgtttgactcttacagggataacatcgccggaaagtccttccagaacaggctttgcttgcctatgccaatcgacgttgtgtacacctgggtcaatggaaccgacttagaattgctgaaggaattacagcaggtgcgcgaacaaatggaagaagaacagaaagctatgcgcgagatcctgggcaaaaatacaacagagccgaccaagaagtcagaaaagcagctggaatgcctacttacccactgtattaaagtacctatgcttgttctcgatcctgcactgcccgccaatataactttaaaggatctaccgtctctttaccccagttttcatagcgcatcagatatcttcaatgttgctaagcccaagaatccttccactaacgtaagcgtagtggtattcgacagcactaaagatgtagaagacgcccacagcggactgcttaaaggaaattcgcgtcagacagtctggaggggctacctgaccaccgataaagaagtccccggcctcgtgctgatgcaggatttggcattcttgagcggatttccaccaaccttcaaggaaacaaaccaacttaagactaagctgccagagaatctttcaagcaaagttaaattgcttcagctctatagcgaagccagcgtcgccctgctgaagctgaacaatcctaaagactttcaagagttgaacaaacaaaccaaaaagaacatgaccatcgacggcaaggaactaactatcagccccgcttatcttttgtgggatttgtctgctataagccagagtaaacaagatgaggatattagcgccagccgattcgaagacaatgaagaacttaggtatagtttacgttctattgaacggcacgcaccctgggtgaggaacatatttatagtcaccaacggccaaatcccctcatggctcaacctggataaccctagggttacgatcgtcacacatcaggatgtatttcgcaatctgagccatctgcctactttctcatcaccggcgatagaatctcacatccatagaatcgagggcctctcccagaaattcatctatttgaacgatgatgtcatgttcggcaaagacgtttggccagatgacttttatagccactctaagggacagaaagtctatctgacatggcccgtccctaattgtgcagagggatgtcccggatcttggatcaaggacggttactgcgacaaggcctgcaacaacagtgcctgcgactgggacggcggagattgctctggaaattcaggcggatcaagatacattgctggcgggggcggtacaggatcaattggagtggggcagccttggcagtttggggggggaatcaactccgtgagttactgtaaccaagggtgtgcaaactcctggctggctgataagttttgcgatcaagcatgtaacgtcctgtcatgcggctttgatgccggcgattgtggacaagatcattttcacgagttgtacaaggtcatactgttgccaaatcaaacccactatattatcccaaagggtgagtgcctcccgtacttctcattcgccgaggttgcaaaaaggggagtcgaaggtgcctactcagacaacccaataatccgccacgctagcatcgcgaacaaatggaaaacaattcacctgattatgcactcgggaatgaacgcaactaccattcactttaacctgacatttcaaaacaccaacgacgaagaatttaaaatgcagataaccgtggaagtggatactcgagaaggtcctaaactgaattcaaccgctcaaaagggctacgaaaatctggtgtcacctatcaccctccttcctgaagctgagatcttgttcgaggacatcccaaaggagaaaagatttccaaagtttaaaagacacgacgttaatagcacccgtcgtgctcaggaggaagtgaagattccactggtcaatatcagtttgctgccgaaggatgcgcagctgtccctgaataccctcgaccttcaactcgaacatggcgatattaccctcaaaggctataacctttcgaagagtgccctcctgcggagcttcttgatgaacagccagcatgctaaaatcaagaaccaagccattatcacagatgagacaaacgatagcctggtggctcctcaagagaagcaggtacacaaaagcattctgcctaacagcctaggggtgtctgaacggctgcagaggctcacatttcccgctgtgagtgtaaaggtgaatggccacgatcagggtcagaaccctccactggacctcgaaacaaccgctagattccgggtcgagactcatacccagaagacaatcggtggcaacgttactaaggaaaaacctccttccctgattgtccccttggagtcacaaatgaccaaagagaagaaaataaccggcaaggagaaagaaaacagccgtatggaagagaatgctgaaaaccacatcggcgtcacagaggttttgctgggccggaagctgcaacattataccgatagctacttaggctttctgccttgggagaaaaagaagtactttcaggacctgctcgatgaagaagaatctctgaagacacaacttgcctacttcacagactctaaaaacacaggaaggcaattaaaggacacttttgccgacagcctgcgatatgtgaacaaaatcctcaactcaaaattcgggtttacttccaggaaggtgccagcccatatgccccacatgatcgatcgcatcgtgatgcaagaactccaagatatgtttcccgaggagtttgataaaacatcttttcataaggtaaggcatagcgaggacatgcaattcgctttttcctacttctattatctcatgagtgctgttcagccacttaatataagccaggtgttcgacgaggttgacaccgatcagagcggagtccttagcgaccgagaaatccgcacccttgctaccagaatacacgaactccccctcagtctgcaggacctgaccggtctggagcatatgctgatcaactgctctaagatgctgccggccgacataacacagcttaataacatcccacccacacaggagagttactacgaccctaacctgccccccgtaacaaaaagtctggttactaattgcaaaccagtcactgacaaaattcacaaagcatacaaagacaaaaacaaatacaggtttgagattatgggagaggaggaaatcgctttcaaaatgataagaaccaacgtaagccacgtggttggccagctggatgatatacggaagaaccctagaaaatttgtatgccttaatgataatattgatcacaaccataaggatgcccaaactgttaaggctgtgttgcgggacttctatgaatcaatgtttcctatcccaagccaattcgagcttcctcgcgagtatagaaacagattcctacatatgcatgagctccaggaatggcgagcgtatcgcgacaagctaaagttctggactcactgtgtgctggctacactgatcatgtttactatcttcagctttttcgccgaacagctgatagcacttaagcggaaaattttcccaaggcgtaggatccacaaagaggcaagtcctaacaggatccgggtt

SEQ ID NO: 16943 - DNA, 3768 bp, Artificial Sequence
  Description of Artificial Sequence: Synthetic coding sequence
atgttgttcaagctgcttcaaagacagacctatacctgcctttcgcaccggtacgggctgtacgtctgttttctgggagtcgtggtgaccatcgttagcgcgtttcagtttggagaggtcgtgctggagtggtcacgcgatcagtaccatgtgcttttcgattcataccgcgataacattgcaggcaagagctttcaaaacagattgtgtctgccgatgcccatcgacgtcgtctatacctgggtgaacggaaccgatcttgaactgctcaaggaacttcagcaagtgagagagcagatggaagaggaacaaaaagccatgcgagagattttgggtaagaacactactgaacctaccaagaagtcggaaaaacaactggaatgtctgctcacccattgcatcaaagtccctatgctcgtccttgacccagcacttcccgcaaacattacccttaaagatctcccctccctttacccgtcatttcactccgcctcagacatctttaacgtggctaaaccaaagaatccatccactaacgtctcggtcgtcgtattcgatagcactaaggatgtggaggacgcacattcaggactccttaaaggaaactctcgtcaaactgtgtggcgcggatacctcactacggacaaggaggtgcctgggctggtgttgatgcaggacctggcatttctctccgggtttcctcctactttcaaggaaacgaaccaacttaagaccaaactccccgaaaacctcagctccaaggtgaagctcctgcaactgtactccgaggctagcgtggccctgcttaaacttaacaaccccaaggattttcaagagctcaacaagcaaaccaagaagaacatgactattgacggaaaggaacttactatcagcccagcatacctcctctgggacctgtccgcaatttcgcaatcaaagcaagatgaagatattagcgcatccagattcgaggataacgaggagctgcgttattcccttagatccattgagcggcatgcgccgtgggtccggaacattttcattgtcaccaatggccaaataccgtcgtggctcaatctggataaccctcgggtgaccattgtgactcaccaggacgtctttaggaacctctcccatctgccgacgttttcctctccagcaattgaatcacatatccacaggatagaaggtctttcgcaaaagttcatctatctcaatgatgatgtgatgtttggaaaggatgtctggccagatgatttctacagccatagcaagggacagaaagtatacctgacttggcctgtgcccaactgtgcggaaggctgtccaggttcatggattaaggatggatactgtgacaaggcatgcaacaactctgcatgtgattgggatggtggtgattgttccggcaatagcggaggttccaggtatatagctggaggcggtggaaccggttcgatcggcgtggggcagccttggcagttcggcgggggaataaactccgtgtcctactgtaaccaaggatgtgcgaactcgtggttggccgacaagttttgcgatcaggcatgcaacgtgctgtcatgtgggtttgatgctggcgactgcggtcaggatcactttcacgagctctacaaggttattctgcttccgaaccagactcactacattattcccaaaggagagtgtttgccttactttagcttcgcagaggtggcaaagaggggcgtggagggtgcatactctgataaccctatcattagacatgcatccatcgccaacaaatggaaaactatacaccttatcatgcatagcggtatgaacgccaccactatacatttcaatcttacctttcaaaatactaatgacgaggaattcaagatgcaaatcactgtggaagtggatacccgggaaggaccaaaacttaactcgactgcgcagaaaggatacgagaatctggtgtcccctatcactttgctgcctgaagcagaaattctttttgaagatattcccaaagaaaagcgattccctaagttcaagcgccatgatgtgaactcgacccgaagagcacaagaagaagtgaagatacccttggtcaacatttcgcttctgcctaaggatgcccagctgtccttgaacaccctggatttgcagcttgagcatggtgatataactcttaaggggtacaacctgtcaaagtctgcactccttaggagctttctcatgaactcacaacacgcaaagatcaaaaatcaagccataatcaccgatgaaaccaatgattcccttgtggctccccaagaaaagcaagtgcataagtcgatcctcccaaactcacttggggtcagtgaacggctgcaaagactcacttttcctgcagtgtcagtgaaggtgaacggacacgaccagggacagaatcctcctctcgatcttgagacgaccgcaagatttagagtcgagactcatacgcaaaagacgattggaggtaatgtgaccaaggagaaacccccttccctgatcgtgcctctggagtcccaaatgacgaaagaaaagaagataactggaaaagaaaaggaaaattccagaatggaggaaaacgccgaaaatcatattggagtcaccgaggtgctccttgggcgcaaacttcagcattacacggactcatacctggggtttctgccttgggaaaagaagaaatacttccaggatcttttggacgaagaagagtcactcaaaactcagttggcatacttcaccgacagcaagaacactggacgtcagctgaaggataccttcgcggactcacttcgctacgtgaacaaaatacttaattccaaattcggattcacctcacgcaaggtcccagcgcacatgccacacatgatcgaccggattgtcatgcaggaacttcaggatatgttccccgaggagtttgataaaacttcatttcacaaggtcagacattccgaggatatgcaattcgcgttctcatatttctactaccttatgtcggccgtgcagcctcttaacatttcccaagtgtttgatgaggtggatactgatcagtcgggtgtgctctccgacagagaaattcgcacgttggcaactagaatacatgaactgccgctgtcactgcaagatctgaccggcttggaacatatgctcattaactgcagcaagatgcttcctgcagatatcacccagctcaacaatattccacctactcaggaatcatactacgatccaaatcttccgccagtgacgaagtcgctggtgaccaactgtaaacctgtgacggacaagatccataaggcctataaggacaagaataagtaccgtttcgagataatgggtgaagaagaaattgcattcaaaatgattagaaccaacgtctcgcacgtggtgggacaacttgacgatataagaaaaaacccaagaaagtttgtgtgcctgaatgataacatagatcacaaccacaaggatgcacagaccgtcaaagcagtcctccgcgacttctacgaatccatgtttccaatcccctcgcaattcgaactgccacgagaatacagaaatagatttttgcatatgcatgaactgcaggaatggcgcgcatacagggacaaattgaagttttggactcactgcgtgcttgccaccctcattatgtttaccatcttttccttttttgcagagcaacttatcgccctgaagcgcaagatttttccgcggcggcgcattcataaggaggcatccccgaaccgcatcagggtg

SEQ ID NO: 16944 - DNA, 3768 bp, Artificial Sequence
  Description of Artificial Sequence: Synthetic coding sequence
atgctgttcaagttgctccagagacaaacctacacttgtctgtcgcaccggtacgggctgtacgtttgctttctcggagtggtggtcactatcgtgagcgccttccagtttggcgaggtcgtgttggagtggtcaagggaccagtaccacgtgttgttcgactcttaccgcgacaatatcgcggggaagtcctttcagaatcggctgtgcttgccaatgccgatcgatgtggtgtacacctgggtgaacgggactgaccttgagctgcttaaagagctgcagcaagtccgtgaacaaatggaagaagaacagaaggccatgcgggaaatcttgggaaagaacaccactgagccgaccaagaaaagtgaaaaacagttggaatgcttgctgacgcactgcatcaaagtgcctatgctggtgcttgacccggctcttccggcgaatatcactctcaaagaccttccatcgctctacccctcattccacagcgcctcggacattttcaacgtggccaagccgaagaacccctccaccaacgtctccgtggtcgtgtttgactcaacgaaggacgtcgaagatgcccacagcggcctgctgaagggtaattcgcggcaaacggtgtggcgaggttacctgaccaccgacaaggaggtgccggggctcgtgttgatgcaggatctggcattcctcagcgggtttcctccgaccttcaaagaaaccaaccaattgaaaaccaagctccctgagaacctgtcctcaaaggtgaagctgctgcagctgtactccgaagcaagtgtggctctgctgaagctcaacaacccgaaagatttccaggaactcaataagcagaccaagaagaatatgactatcgatggtaaagagctcacgatcagcccagcgtacctcctgtgggatctgtcggctatatcgcagtctaagcaggatgaggacatctcagcatctcggttcgaagataacgaagaactccgctactccctgcggtccatcgaacggcatgctccgtgggtccgaaacattttcatagtgacgaatggccagatcccaagctggctgaacctggataaccctcgcgtgacgattgtgacccaccaggatgtgtttcgcaacctctcacatctgcccacgttctcgtcaccagcgatcgaatcccatatccaccgcatcgaaggactgtcacaaaagttcatctacttgaacgacgacgtgatgttcggcaaggacgtgtggccagatgacttttactcccactccaaagggcagaaggtttacctgacctggccggtccctaactgcgcggaaggatgtccgggctcatggatcaaggacggctattgtgataaggcctgcaacaattccgcgtgcgattgggacggaggcgactgctcaggaaattcgggaggatcccggtacattgctggcggaggcggcaccggatcgattggtgtgggacaaccgtggcaatttggaggtggaattaactcggtttcctactgcaatcagggatgcgcgaatagctggctggccgacaagttttgcgaccaagcctgtaacgtgctgtcctgcggattcgatgcaggagactgcggacaggaccatttccacgagttgtacaaggtgatcctgctcccgaaccaaactcattacattatcccgaagggagaatgccttccctacttctcgttcgccgaagtggccaaacggggagtcgagggagcatactccgacaaccccatcatcagacacgcgtcaatcgccaacaaatggaaaactattcacctcataatgcatagcggcatgaacgcgactaccatccatttcaacctgaccttccagaacactaacgacgaagaattcaagatgcaaattaccgttgaagtggatactcgcgaggggcctaagctgaattcgaccgcgcaaaaggggtatgagaacctcgtctcgcctattaccctgctcccggaagccgaaatactgttcgaagatatcccaaaagagaagagattcccgaagtttaagagacacgacgtgaactctaccaggcgggcccaggaagaggtgaagatccctctggtgaatatctccctgctccccaaggatgcccaactgtccctgaacactcttgacctccagctcgaacacggcgacatcaccctgaaaggatataacctgagcaagtcagcgctgttgcgctcgttcttgatgaattcccaacatgccaagatcaagaaccaagcaatcatcaccgacgaaactaacgactcgctggtcgcgccgcaggagaagcaggtgcacaaaagcattcttccaaattcgttgggcgtgtcggagcggctgcagcggcttactttcccggcagtgtccgtgaaagtgaacggtcacgaccaaggtcaaaacccgccactggacctcgagactaccgcccgcttccgcgtggagactcatactcaaaagacgattggagggaatgtgacgaaggagaagcctccgtcgctgattgtgccgctcgaatcacagatgactaaggaaaagaaaatcactggaaaggaaaaggaaaatagtagaatggaagaaaatgcggagaatcacatcggagtgacggaggtcctcctcgggagaaagctgcaacattacactgattcgtacctggggttcctcccgtgggagaaaaagaaatacttccaggaccttctcgacgaggaggaatctctcaagacgcagttggcatatttcaccgattcgaagaatacgggcagacagctgaaagataccttcgctgattcgctgagatacgtgaataagatcctgaactcaaaattcggatttacttcccgcaaggttccagcgcacatgccgcatatgatcgatcggatcgtgatgcaagaacttcaagatatgtttcctgaagaattcgacaaaacttccttccacaaggtgcggcacagcgaggatatgcagtttgccttctcctacttttactaccttatgtccgcggtgcaaccattgaatatctcacaagtgtttgacgaggtggacacggaccagtccggagtcctgtcggacagagagatccgtaccctcgccaccagaatccatgagctgccactctctttgcaagatctgaccggactggagcatatgctgatcaactgttccaagatgctgccagcggatatcacccagttgaataacatcccgccgactcaggagagctactacgaccctaacctgcctccagtgactaagtccctggtgactaactgcaaacctgtgaccgacaaaatccacaaggcgtacaaggacaagaacaaataccgcttcgagatcatgggagaagaggagatcgcgtttaagatgatcaggaccaatgtgtcacatgtggttggccagctcgatgacattagaaaaaacccacggaagtttgtgtgcctgaatgataacattgatcacaatcacaaggatgcacagaccgtaaaagccgttttgcgggacttctacgagtcgatgttcccaatcccgtcccagttcgagcttcctagagaatacaggaacagattcctccacatgcatgaattgcaggagtggcgagcctaccgcgacaaactcaagttctggacccactgcgtgctggccactttgatcatgtttaccattttcagctttttcgctgaacagctcatcgcgttgaagcgcaagatctttccgcgccgcagaatccataaggaagcctcgcctaaccgcatcagggtg

SEQ ID NO: 16945 - DNA, 3768 bp, Artificial Sequence
  Description of Artificial Sequence: Synthetic coding sequence
atgctgtttaagcttcttcaacggcagacttacacgtgcctaagccacagatacgggctctatgtgtgttttctgggagtggtagtgactatcgtgagcgctttccagtttggagaggtggtgctggagtggtccagggaccaatatcatgttttgttcgattcctaccgtgataatatagctggaaaaagctttcagaatcggctctgccttcccatgccaatagacgttgtgtatacatgggttaatggaacagatctggagcttctcaaagaactgcagcaggtgagggaacagatggaagaggaacagaaggctatgcgcgagatcctgggcaagaacacgactgagcctaccaagaagtccgaaaagcagctagagtgtctcctgactcattgtattaaggtcccgatgcttgtgctggatccggccttacctgctaacatcactctgaaagacctcccttcattgtacccatcttttcactccgctagcgatatctttaatgtcgccaaaccaaagaatccttctacaaacgtgtcagtcgtcgtcttcgactcaacgaaggatgtcgaggacgcccactcaggcctgttaaaagggaacagccgtcagacagtgtggcgaggatacttgactaccgacaaagaggtgcccgggcttgtcctaatgcaggacctcgcctttctgtcggggttccctccaacattcaaagagacaaaccagcttaaaaccaagctgcctgagaacctgtcatccaaggtaaagctgctccagttatacagcgaagcatctgtggctctgctcaagctgaacaatcctaaggattttcaagagctgaacaagcagaccaagaaaaacatgacaatcgacgggaaggaacttacaatcagtcccgcctacctcctgtgggatttgagtgcaatcagtcaaagcaagcaggatgaggacatctccgcttctagattcgaagataatgaggagttgagatactccctgagaagcatagaaaggcatgcaccttgggtgagaaatatcttcattgttaccaacggccagatcccctcatggctgaacttagacaacccccgagttactatcgtcacccaccaggacgtgtttcgtaacctgtcacaccttccaacattttccagccccgccattgaaagtcatattcaccgcattgaagggctgtcccaaaagttcatatatttgaacgatgatgtgatgtttgggaaagacgtttggccagacgatttttactcccactcaaaggggcagaaagtctacctgacgtggcccgtacccaactgcgcagagggttgccctggctcttggataaaggatggttactgcgataaggcctgtaacaatagcgcctgtgattgggacggcggcgattgctccggcaatagcggtggttccagatacatcgctggcgggggaggtactgggtcgataggggtcggtcagccttggcagtttggtggtgggatcaattctgtctcgtattgcaatcagggctgtgccaatagttggcttgcggataaattctgcgaccaggcatgtaatgtgctctcttgcggctttgacgcaggcgattgcggtcaggaccacttccatgagctctacaaagtgatactgctgccaaatcagacacattatataattccaaagggcgaatgtctaccctatttttctttcgccgaggtggccaaaagaggagtggaaggggcatactcagataacccaattatcaggcatgcctccatagctaataagtggaaaactatccacctcatcatgcatagtggcatgaatgcaaccaccatccacttcaatttaacgttccagaacacaaatgacgaagagttcaaaatgcagattacagtggaagtagacacgcgggagggtcctaaactaaattctacggctcagaagggatatgagaacctggtttctcccattacgttactgcctgaggccgagatcttattcgaagacatacctaaagaaaaacggttccctaagttcaagaggcatgatgtaaattcaaccaggcgggcacaggaagaggtgaagataccgctggttaacataagccttctacctaaagatgcacagttgtccttgaacaccctggacttgcagctggaacacggtgatattaccctcaagggttataacctgtctaaatccgccttattgaggagcttcctgatgaactcccagcatgctaagataaaaaatcaggccattatcacagacgagacaaacgactcattggtagctccccaggagaagcaggtgcacaagtcaatcttgcctaattcattgggagtctccgagaggctgcagcggctgacctttcccgctgtctcagtgaaagtgaatggacatgaccagggtcagaacccccctctcgacctagaaacaaccgcccgttttagagtggaaacacacacccaaaagactatcggaggaaatgtgaccaaggagaaaccccctagccttattgtgcccttagagagtcagatgaccaaggagaagaaaatcacaggcaaggaaaaagagaattcacgtatggaagagaatgctgagaatcatattggcgttaccgaggtgctgctcggtagaaaactccagcactacactgactcctacctggggttcctgccttgggagaagaaaaagtattttcaggatctcctagatgaggaggagtccttgaagacccagttggcctacttcaccgatagtaagaatacagggcggcagctgaaggacacgttcgctgactccctcagatacgttaacaagattctcaacagtaaatttggtttcacaagccggaaggtccccgctcacatgccgcacatgattgatcggatcgtaatgcaggagcttcaggatatgtttccagaggagtttgataagacatctttccataaagtcagacatagcgaggacatgcaattcgcttttagctatttctattatctgatgtctgcggttcagcctctcaatatctcacaagtgttcgatgaggtcgacaccgaccaatcgggcgttctgtcagatcgtgagatcaggaccctcgccactagaatacacgagctgcctctcagtctgcaagacctcactggcctcgagcatatgttaattaattgttctaaaatgttaccggccgatataacacagctgaacaacataccgccaacccaagagtcctactacgacccaaaccttccgcctgtgactaagagtctggttactaactgcaaaccagtaactgacaagatccataaagcgtacaaagataagaacaaatatcgtttcgagattatgggcgaagaagagattgcttttaagatgattagaacaaatgtgtctcatgtggtgggccagctcgacgacattaggaaaaacccccggaagttcgtttgccttaatgataacatcgaccacaatcacaaagacgcccagaccgtgaaagccgtcctgcgagacttctatgagtctatgttccctataccttcacagttcgagttgccacgcgaatatcggaaccgctttttgcatatgcacgaacttcaggagtggcgagcatatcgtgataagctaaagttctggactcattgcgtacttgcaacacttataatgttcacaattttttcctttttcgcagagcaactaatcgctttgaaaaggaaaattttcccacgaagacgcatccataaagaggcttctcctaatcggattagggtc

SEQ ID NO: 16946 - DNA, 3768 bp, Artificial Sequence
  Description of Artificial Sequence: Synthetic coding sequence
atgttgttcaaattgctgcaaaggcagacctacacatgtctttcgcacagatacggcctttacgtctgtttcttgggcgtggtggtaacgattgtttcggctttccaattcggtgaggtcgttctcgaatggtctcgggatcagtatcacgtcttgtttgacagctacagagataacatcgctggcaagtcgttccaaaaccggctgtgtcttcctatgccgattgatgtcgtgtacacctgggtcaatggtacggatctcgagctccttaaggagctgcaacaagtccgcgaacagatggaagaagaacagaaagcaatgcgtgagatactcggtaaaaataccacagaacctactaagaaatcggagaagcaacttgaatgcctgttgactcactgtattaaagtacctatgctcgttcttgaccccgctcttccagcgaacataacccttaaggatctgcctagtctctacccttcctttcattcagctagtgacatctttaacgtagcgaaacctaagaaccccagtacaaatgtttccgtcgtggtctttgactcaacaaaggatgttgaagacgctcattctggattgcttaaaggaaattccaggcagactgtctggcgaggttatcttacaaccgacaaagaagttcccgggttggtgctcatgcaggatctggccttcttgtctggtttcccacccaccttcaaggagacaaatcagctgaaaaccaagctcccagagaatttgagctctaaggttaagttgctacaactgtacagcgaggcgtcagtggcgttattgaaactcaacaaccctaaagacttccaagaactgaataagcaaactaagaagaacatgactatcgatggtaaggagctcacgatctcaccagcttacctgctatgggatctatcggcaatctctcagtccaagcaggacgaagatatctctgcctcccgattcgaggataatgaggagctcaggtattcactacgctcaattgagagacatgccccatgggtgcgcaatatattcattgtaaccaatggccaaattccttcctggttgaatctggacaatccccgcgttacgatcgtaacccatcaagacgtttttcgaaacctgtcccatctacccacattctctagcccggcgatagaatctcatattcatcgtattgagggattgtctcaaaagtttatatatttgaatgacgatgtaatgtttggaaaagatgtgtggcccgatgatttttacagccactctaagggtcagaaggtctacctgacatggcctgtaccaaattgtgccgaaggttgcccaggatcctggatcaaggacggctattgtgataaagcttgtaacaattcggcttgtgattgggatggaggtgattgctcaggaaactctggcgggtcgaggtacattgctgggggaggcggtacagggtcaataggcgtcggccaaccgtggcagtttgggggtggtatcaactctgtgagttactgcaaccaaggctgtgccaactcctggttggcggataagttctgtgaccaagcctgtaacgtgttgtcctgtggatttgacgccggcgattgcggtcaagatcacttccatgaactgtacaaggtcattcttttacccaaccaaacacactacatcattcccaagggtgaatgcttgccttacttctcgttcgctgaagtggctaaacgtggagtcgagggcgcatattctgacaacccgattatacggcacgccagcatagctaataagtggaagacgatccacctaatcatgcacagcggtatgaacgctaccacgattcactttaacctgacgtttcagaacaccaacgacgaagagttcaagatgcagatcaccgtcgaagtggacacgcgtgaagggcctaaactcaactctacggcccagaaaggttacgagaacctggtttctcccattaccctcctgccggaggccgagattctgtttgaggatattccaaaggagaaaagatttccaaagttcaaacggcatgacgtgaattctactcggcgcgctcaggaggaggtcaaaataccgctcgtcaacatctccctattgcccaaggatgcacagttgtctctgaataccctggacttacagctggaacatggcgacatcacccttaaaggatacaatctttctaagtcagctctcctccgctctttcctaatgaattctcagcatgccaagatcaaaaaccaagcgatcatcactgatgagactaatgactccctggtggcgccccaggaaaagcaggtgcacaagtcgattctgcctaatagcttgggcgtctctgagaggctgcagcgcctcacctttcctgcggtttcggtaaaagtaaatggtcatgatcaaggccagaaccctcctttagatttggagactaccgcacgtttccgtgtggaaacacacacgcagaaaactatagggggcaatgtgacaaaagagaagcccccttcccttattgtaccgcttgaaagtcagatgacgaaagaaaaaaagattacaggaaaagaaaaagagaactcccgaatggaagaaaatgccgaaaaccatattggagtgacagaggtcctgttgggccgcaagcttcagcactatacagatagctaccttggttttctaccttgggagaagaagaagtactttcaggatctacttgatgaagaagaatcactgaagacgcaattggcttatttcaccgacagtaagaatactggccgccagctcaaagatacattcgcggactcacttagatacgtgaataagatcctgaatagcaagtttggcttcacgtcccggaaagtacccgctcacatgccgcatatgatcgaccggattgtgatgcaggaactgcaggatatgttccctgaggagtttgataagaccagcttccataaagtgaggcactctgaggacatgcagtttgctttttcttatttctattatctcatgtccgctgtccagccgttgaacatcagccaggtcttcgatgaggtcgatactgaccagagtggagtgctctccgatcgcgaaattcggacgctcgctactagaattcacgaactgccactgtccctccaggacctaaccggactcgagcacatgttgataaactgttccaaaatgcttccggccgatataacccagctcaataacatcccaccaacccaggagtcgtactatgaccctaacttgccccctgtaacaaaatctttagttaccaattgtaagccggtgactgataaaatacataaagcctataaggacaagaacaagtacaggtttgagatcatgggcgaggaggagatagcatttaaaatgattcgcaccaacgtttcgcacgttgtgggtcaacttgacgacatccggaagaatccgcgtaaattcgtttgtttgaatgacaacatagaccacaatcacaaggacgcccagaccgtcaaggccgttctgcgtgatttttacgaatccatgtttcccataccatcgcagtttgagcttcctcgtgaatatagaaatcggtttcttcatatgcatgaactgcaagaatggcgtgcgtatcgggacaagctaaagttctggacccattgtgttttggccactttgattatgttcacaatattttcatttttcgccgagcagttaatcgccttaaaacggaaaatcttccctcgccgccggatccataaagaagcttctcctaatcgcattagggtt

SEQ ID NO: 16947 - DNA, 3768 bp, Artificial Sequence
  Description of Artificial Sequence: Synthetic coding sequence
atgctcttcaagctgctgcagagacaaacttacacctgcctctcccaccgctatggcctgtacgtctgcttcctgggagtcgtggttaccatcgtgtcggctttccagttcggtgaggttgtgttggagtggtcgagggaccaataccatgttctgttcgattcgtaccgcgacaatatcgccggcaagtcgttccagaatcggctgtgcctgccaatgccaatcgatgtcgtctacacctgggtgaatggaactgacctggagctgcttaaggaactgcagcaggtgcgggagcaaatggaggaagagcagaaggccatgagagaaattctgggtaagaataccaccgaaccaaccaagaagtctgaaaagcagttggaatgcctgctgactcattgcatcaaggtgccaatgctcgtcttggacccggccttgccggcgaacatcaccctgaaggacctgcctagcctctacccatccttccacagcgcctcagatatcttcaacgtcgctaagcctaagaatccgtccactaacgtcagcgtggtcgtgttcgactcgactaaggatgtggaagatgcccattctggacttctcaagggtaactcgagacaaaccgtgtggcggggataccttactaccgacaaggaagttcctggcctggttctcatgcaggatctcgcctttctgagcggatttccaccgactttcaaggaaactaaccaactcaagaccaagttgccggaaaatctgtcgagcaaggtcaaacttctccagctgtactcagaagctagcgtcgccctgctgaaactgaacaaccctaaggacttccaggagctgaacaaacagaccaagaaaaacatgactatcgatggtaaggaactgactatctcgccggcctacttgctctgggacctgagcgctattagccagtcaaagcaggacgaagatatctcagcgtccagattcgaagataacgaagaactgcgatactcgctccgatccatcgagcggcatgccccatgggtgcgaaacatctttattgtgaccaatggccaaatcccctcgtggctcaacctcgacaacccacgcgtcaccatcgtcacccaccaggacgtgtttcgcaacctgtcgcatctgccaaccttctcatcccctgctatcgaatcgcacattcaccggattgaaggactctcccagaagttcatctacctgaacgatgatgtgatgttcggaaaggacgtctggccagatgacttttactcccattccaagggacagaaggtctacctcacctggccggtgccaaattgcgccgagggttgccccgggtcctggattaaggacgggtactgcgataaggcgtgcaacaatagcgcgtgcgactgggacggaggagattgctccggaaactccggtgggtcacggtacatcgccggaggtggaggcactggtagcattggtgtcggacagccgtggcagttcggcggaggtattaacagcgtgtcttactgtaaccagggttgcgcaaactcatggctggcagacaaattctgtgatcaggcgtgtaacgtgttgagctgcgggttcgacgcgggagactgtggacaggatcacttccacgagctttacaaggtgatcctcctcccaaaccaaactcactacatcatcccaaagggcgaatgcctcccgtacttctcgttcgctgaagtcgccaaaagaggcgtggaaggagcgtactcggacaacccgatcattcggcatgcatccatcgccaacaaatggaaaactattcacctgattatgcactccggaatgaacgcgactactatccacttcaaccttactttccagaacactaacgacgaagaattcaaaatgcagattaccgtcgaagtggatacccgggaggggccgaaactcaactccactgcgcaaaagggatacgagaacctcgtgtcgccaatcaccctgctccctgaagccgaaatcctgttcgaagatatcccgaaagaaaagagattccccaagttcaagagacacgacgtgaactccactcgccgggcgcaagaagaggtgaagattccattggtgaacataagccttctgccgaaagacgcccaactgtcgctgaacaccctggacttgcagctggaacatggagacatcacccttaaggggtataacctctccaaatcggcgctgctgcggagctttcttatgaattcgcaacatgccaagatcaagaatcaagctatcattaccgatgaaacgaacgactcgctggtcgcccctcaggaaaagcaagtgcacaagtcgattttgccgaactcgctgggggtttcagagcggctgcagcggctgaccttccccgcggtcagcgtcaaagtgaacggccacgaccagggacagaacccgccactggatcttgaaactactgcacgatttcgggtcgaaactcatacgcaaaagactatcgggggaaacgtcactaaggaaaaaccgccatcgctcatcgtgcctctcgagtcacagatgactaaggagaagaagatcaccggaaaagaaaaggagaatagccgcatggaagaaaatgccgaaaatcacatcggagtgacggaagtgctgctcggccgcaagctgcagcactatactgactcgtacctgggcttcctgccttgggaaaagaagaaatacttccaggacctcttggatgaggaggaatccttgaaaacgcaactcgcatatttcaccgactccaagaatactggaaggcaactgaaggacaccttcgcggactccctccgctacgtcaacaagattctgaactccaagttcggctttacctcccgcaaagtgccggcacatatgccgcatatgatcgatcggattgtgatgcaagaactgcaggatatgtttcctgaagaattcgacaaaacgagcttccataaggtgcggcactcggaggacatgcagttcgccttctcatacttttactacctcatgagtgcggttcagcccctgaatatctcacaagtgttcgacgaagttgacaccgatcaatccggagtcctgtcggacagagagatcagaaccctcgccacccggatccacgaactgccgctctcactgcaggacctgacggggttggaacatatgctgataaactgctcaaagatgctccctgccgacatcactcaactgaacaacattccgccgacccaggagtcttactacgatccgaacctgccgccagtgacgaagtcgttggtgacgaactgcaagccagtgaccgacaagatacacaaggcctacaaagacaaaaacaaatacagatttgagatcatgggcgaggaggaaattgcgttcaaaatgatcaggacgaacgtttcgcacgtcgtgggccagctggacgacataagaaagaatccgaggaaattcgtctgccttaacgacaatatcgaccataatcacaaggatgctcagactgtcaaggccgttcttcgggacttctacgaatcaatgtttcccatcccttcccaattcgagctgccgcgcgagtaccggaaccgttttctccacatgcatgaactgcaggaatggcgcgcctaccgggataagctgaagttctggacccactgtgtgctcgctaccctcatcatgtttacgatcttcagcttcttcgcggagcaactgatcgcgttgaagaggaagatttttccgagacgccggatccacaaagaagcatcgccgaatagaatccgggtg

SEQ ID NO: 16948 - DNA, 3768 bp, Artificial Sequence
  Description of Artificial Sequence: Synthetic coding sequence
atgctgtttaaattgttacagcgccaaacttacacttgcctgtcccatcggtatggactgtacgtgtgcttcctgggggttgtggtaaccattgtgagtgcctttcagtttggagaagtggtactggaatggtccagggatcagtaccatgttcttttcgacagctatcgggataatattgccggcaagtccttccagaatcgcctatgcctcccgatgccaatcgacgtggtctatacatgggtaaacggaacagacctcgaactgctgaaagaactccagcaagtgcgtgagcaaatggaggaagaacagaaagcaatgcgggagatattgggcaaaaataccactgagcctaccaagaagagtgaaaagcaactagaatgccttctcacacattgcataaaagtcccaatgctcgtgctggacccagcacttccagcaaatatcactctgaaggaccttccttccttatacccctctttccattctgcctctgacatctttaacgtggccaagcctaaaaacccttctactaacgtgagtgtagtcgttttcgacagcactaaggacgtggaagacgctcactccggcctactcaagggcaattctcggcagaccgtgtggcgcggttacctgacaaccgataaagaagtgcctgggctggtcctgatgcaagatttggcttttctatctggctttccacctacctttaaagaaaccaaccagctgaagacgaaattacccgagaatctgtctagcaaagtcaagctactgcagctgtattccgaagcctctgtggcactcttgaaactaaataaccccaaggacttccaagagttgaataagcagactaagaagaacatgaccatcgacggaaaggagctcaccatctcacccgcttacctcctctgggatctgtcggccatatctcagtccaagcaggatgaggacatcagcgcaagccggttcgaggataatgaggagctgcgatacagtttgcggagcatcgagaggcacgccccttgggttcgcaacatcttcattgtgacgaatggccaaatccctagttggctgaatctcgacaacccacgcgtgactatcgttacccaccaggacgttttccgcaacctatcgcatctccccacattctcgagccctgcgatcgaatcccacatccacaggatagaaggactgagccagaaattcatctacctcaatgacgatgtgatgtttggcaaggacgtttggcccgatgacttctacagccatagtaaaggtcagaaggtgtatttgacatggcctgtccctaattgtgcggagggatgtccagggagctggataaaggacggctattgtgacaaagcctgtaataatagcgcctgcgactgggacggcggggactgttctggaaacagcgggggatcccggtacatcgccggcggcggaggcacaggctctattggagttgggcagccttggcaattcggtggcggcattaactctgtatcctattgcaaccagggttgcgccaatagctggctggccgacaaattttgtgaccaggcatgtaatgtgctgtcttgtggatttgacgcaggcgactgcggtcaagaccacttccatgaactttacaaagtgattctcttacccaaccaaacacactacattattcccaagggcgagtgccttccctacttctcattcgccgaggtagctaagagaggtgtggaaggtgcttatagtgataatccaattatccgtcacgcaagtattgcaaacaaatggaagaccatccatttgattatgcactcaggaatgaatgctactactatccacttcaacctgacattccagaacaccaacgacgaagagttcaagatgcagattaccgtggaggtcgatactagagaggggcctaagctaaactcaacggcccagaagggatatgaaaacctggtcagtcctattacactcttacccgaagccgagatcctgttcgaagacatccctaaggagaaacggttccctaagttcaagaggcatgacgtgaacagtacccgtagagcccaggaagaggtgaagatcccattggtcaacatctccctcttaccgaaagacgcacagctcagcctcaacaccctcgatcttcagctcgagcacggagacatcacactcaagggctacaacctctcgaagagcgccctcctgcggtcttttctcatgaactcgcagcacgcgaagattaaaaaccaggctatcattacagacgaaaccaacgacagtctcgtcgcaccccaagagaagcaagtccataaatcaatcctccctaactctctgggagtgtcggagagactacagcggttaaccttcccagctgtttccgtgaaagtgaacggccatgaccagggtcagaatcctcccctggacttggaaaccaccgcaagatttcgcgtggaaacccacacacagaaaactatcggcgggaatgttactaaggagaagcctccaagcctaatcgttcctctggaaagccagatgaccaaagagaagaaaatcacaggcaaagagaaggagaattctaggatggaagaaaacgccgaaaatcatatcggggtgactgaggtgctcctcggaagaaagctccaacattatacggacagctacttggggttccttccttgggaaaaaaaaaaatactttcaagacttgctcgacgaggaagaatccctcaagacccagctcgcgtatttcacggattctaagaacacggggaggcagctgaaagatacttttgccgatagcctccgttacgtcaacaagatcctgaactcaaaattcggatttacaagccggaaggtccctgcacacatgcctcacatgatcgaccgaatcgttatgcaggagctgcaagacatgttcccagaggagttcgataagacttccttccacaaagtacgccatagtgaggatatgcagttcgcctttagctatttctactacctcatgagcgcagtccagcctttgaacatcagtcaggtttttgatgaggtggatacagatcagtccggcgtgctgtccgatagagagataaggactctggccacccgcattcacgagctgccgctctctctgcaagatctcaccggcctggagcacatgctgatcaactgcagtaaaatgctgcctgctgacattacccagctaaataatattccacccactcaggaatcctactacgacccaaacctgcccccagtgactaagtccttggtcactaactgcaagcccgtcactgacaaaattcacaaggcctacaaggacaagaacaagtaccgattcgaaatcatgggagaagaagaaattgcttttaagatgatcagaacgaacgtctctcacgtggtcggtcagctcgatgatatcagaaagaaccctagaaagtttgtgtgcctaaatgataacatcgatcacaatcacaaggacgcccagacggtgaaggctgtgctgcgcgacttttacgaaagcatgtttccgattcctagccagtttgagctacctcgcgagtataggaaccgatttcttcatatgcacgagctgcaggaatggagggcttatagagataagctgaaattctggacacattgcgtgctggccacacttattatgttcacgatcttctccttctttgccgagcagttaatcgcgctgaaaagaaaaattttccctcgccgtcggatccataaagaggcttcgccaaaccgaattcgagtg

SEQ ID NO: 16949 - DNA, 3768 bp, Artificial Sequence
  Description of Artificial Sequence: Synthetic coding sequence
atgctgtttaagctcctgcagaggcaaacttacacctgcttgtcccacaggtatggactttacgtgtgcttcctgggcgtagtggtgactattgtctcagcttttcaatttggtgaagttgtcttggaatggagcagggaccagtatcacgtgctttttgattcttaccgcgataatatcgcaggaaagagttttcaaaaccgcctgtgcctcccaatgcccattgacgtcgtgtatacatgggttaacggaacagatctcgaactgctcaaggaactgcagcaggtgcgcgagcagatggaagaggagcagaaggctatgcgtgagattctgggcaagaataccacagagcccacaaagaagagcgaaaagcagttggagtgcctgcttacacattgcatcaaggtccccatgttggtgcttgatcctgcactcccagctaacataacattgaaggacttgccctccttgtatccaagttttcactccgcatcagacatcttcaacgtcgctaagcctaagaatccctctaccaacgtatccgtggttgtgttcgactcaactaaggacgtggaagatgctcattcaggtcttctgaagggcaactcccgtcagaccgtttggcgcggatacttgactaccgacaaggaagttcctggtttggtgttgatgcaagacttggcctttctctccggctttccccctacttttaaggaaactaatcaactgaagaccaaacttcctgagaacctttctagtaaggtgaaactgcttcaactgtattccgaggcttcagtcgccttgttgaaacttaacaatcccaaagattttcaggagctcaataaacaaactaaaaaaaatatgaccatcgacggaaaggagttgaccatttcaccagcatatcttctttgggacctcagcgctatctcccagagcaagcaagacgaggatatctctgcttcccgcttcgaggacaacgaggagctgcgttactccctccgcagcatcgagcgccatgctccttgggttcgcaacatatttatcgttactaacggtcaaattccctcctggctgaacttggataacccacgcgtgacaatcgtaacccatcaagatgtcttcagaaatctttcccatctccccactttctcctcccctgccatagagtctcatattcatcgtatagaaggcctctcccaaaagtttatctatctgaatgatgacgtaatgtttggcaaggacgtttggcctgacgacttctactctcacagcaagggacaaaaggtttacttgacctggccagttcccaattgcgccgagggttgccctggatcttggattaaagatggctactgcgacaaagcctgtaacaactctgcttgtgattgggacggcggtgactgctctggtaattctggaggcagccgctacatcgcaggcggtggaggtactggaagcataggagtaggacagccctggcagttcggaggcggcatcaactctgtgagttattgcaaccaaggatgcgccaactcctggcttgctgataagttctgtgaccaagcctgtaacgtcctgagctgcggttttgatgccggcgactgcggacaggatcacttccacgagctttacaaggtaatcctcctccccaaccagactcattatatcattcctaagggtgagtgtctgccttactttagctttgctgaggtggctaagagaggtgtcgaaggcgcttacagtgacaatccaataatcaggcatgcttctatcgccaacaaatggaagaccatccacctcatcatgcattccggcatgaacgcaacaacaatacacttcaacctcacattccagaacaccaatgatgaggaatttaaaatgcaaatcaccgtggaggtggatacccgtgaaggacccaaattgaacagcactgcccagaagggttatgaaaacctcgtttccccaatcactctcctcccagaggccgagattctgttcgaggacatccccaaggagaagcgtttcccaaagtttaagcgccacgatgtgaatagtacacgtcgcgcccaagaagaagtgaagatccctctggtcaacattagtctgctgcccaaggacgcccagttgtcattgaatactcttgatttgcagttggaacacggcgacataacactcaagggctataatctgagcaaatccgctctgcttcgcagtttcctgatgaactcacaacacgccaagatcaaaaatcaggccatcattactgacgaaacaaacgatagtctcgtagcccctcaggaaaagcaggtccataaatctatcctgcccaatagcctgggcgtctctgaaaggttgcagcgtctgacatttcccgccgtgagtgttaaggtcaatggacatgaccaaggtcaaaaccctccactggacttggaaacaaccgctaggtttagggtggaaacacacacccagaaaaccataggtggcaacgtgactaaggagaagcctccttctctcattgtccccctggagagccagatgacaaaagagaagaagataaccggcaaggaaaaggaaaattcacgtatggaggaaaacgctgagaatcacataggagtgacagaggtcctgcttggcaggaagctgcagcactatactgatagttatctgggtttcctcccttgggagaagaagaagtacttccaggacctgctggatgaggaggagagtctgaagacccaattggcatacttcaccgactctaagaacactggccgccaactgaaggacaccttcgccgatagcctgcgttatgtaaacaagatactgaatagcaaattcggctttacttctcgcaaggtaccagctcacatgccacacatgatagaccgtatagtcatgcaggagttgcaggacatgttccctgaggaatttgataagacctccttccacaaagttcgccattccgaggacatgcagttcgccttctcctacttctattacttgatgagcgcagtgcagcccctgaatatttcccaggtgttcgacgaggttgataccgaccagtcaggcgtgctctccgatcgcgagatccgcactctggccacaaggattcacgagctgcctctctccctccaagatcttaccggactggaacacatgctgataaattgctcaaaaatgttgccagccgatattacacagctgaacaacattccccccactcaggaatcatactacgaccctaacctccctcctgttacaaaatctctcgtgactaactgcaagcccgttaccgacaagatccacaaggcctacaaggacaaaaataagtacaggtttgaaatcatgggagaagaagagatcgctttcaagatgatccgcactaatgtgtctcatgtagtgggacagttggacgacatcagaaagaaccccagaaaattcgtctgcctcaacgacaacatcgatcataatcacaaggatgcccagaccgttaaagccgtcctgagagacttctatgagtctatgttcccaatccccagccagtttgaactgccccgcgagtacaggaaccgcttcctgcacatgcacgaactgcaggagtggcgtgcttaccgcgataaactcaagttctggacacactgcgtcctggcaactctgatcatgtttacaatcttcagctttttcgctgaacagctcatcgcactgaagagaaaaatcttccctagacgccgcatacacaaggaggcatccccaaacaggattcgcgtc

SEQ ID NO: 16950 - DNA, 3768 bp, Artificial Sequence
  Description of Artificial Sequence: Synthetic coding sequence
atgctgttcaagctccttcagcgccaaacgtacacctgcctgtcccatagatacggactctatgtttgttttctgggagtcgtggtcaccatcgtgagcgcttttcagttcggtgaggtggtgctcgaatggagcagggaccaataccatgttctcttcgacagctacagggacaatatcgccggaaagagcttccaaaatagactttgtctgcctatgcccatcgatgtggtctatacctgggtgaacggcaccgatcttgagctcctcaaggaacttcaacaagtgagagagcagatggaggaagaacagaaagccatgagagaaatccttggaaagaacactaccgagcctacgaagaaatcggaaaagcaactcgaatgcttgctcacccactgcattaaagtcccaatgcttgtgctcgatcctgcacttccggccaacattactctcaaagatctgccctcactttacccttcctttcacagcgcaagcgacattttcaatgtggctaaaccgaagaacccctcgaccaacgtcagcgtggtcgttttcgattccactaaagacgtcgaagatgcacattccggtctgctcaagggcaactcacgacaaactgtgtggcgcggctacctcaccaccgataaggaagtccctggacttgtgcttatgcaggatctggcgtttctttccggtttccccccaactttcaaggagactaaccagctgaaaaccaaactccccgagaatctgtcctcgaaggtgaaactgctccaactgtactcggaagcctcagtggccctccttaaactcaacaaccccaaggacttccaggagctcaataagcaaactaagaaaaacatgaccattgacggtaaggaacttactatctcacccgcttaccttttgtgggacctgtcggcgattagccagtctaaacaagatgaagatatttccgcaagcagatttgaggataacgaggaactgagatactcactgcgctctattgagaggcatgcgccatgggtgcgtaacatattcatcgtcactaatggacaaataccatcctggctgaatcttgataatccgcgggtgaccattgtgacccatcaggatgtgtttcggaaccttagccatcttccaacctttagctccccggccatcgaatcgcatatccatcgcatcgagggattgtcgcaaaagttcatttaccttaatgatgatgtgatgttcgggaaggatgtgtggcctgatgacttttacagccattccaaaggacagaaggtctacctgacctggccagtgccaaattgtgccgagggatgtccaggatcatggattaaggatggctactgcgataaggcttgtaacaactccgcctgtgattgggatggaggtgattgttccggaaattcgggagggtcacggtacattgcgggaggcgggggaacggggtcgattggagtgggtcaaccatggcaatttggaggtgggattaacagcgtctcatactgcaaccagggatgcgcaaactcgtggcttgcggacaagttctgcgatcaggcatgtaacgtcctgtcctgtggatttgatgcaggagattgcggacaagatcatttccatgaactgtacaaggtcattcttcttcctaaccagactcattacatcattccaaagggcgaatgcctgccttatttctcgtttgcagaggtcgccaagcgtggggtggaaggagcatactccgacaacccgatcatcaggcatgccagcattgcaaacaaatggaaaaccatacacctgatcatgcattcaggaatgaatgccaccactatccactttaatcttactttccaaaatactaatgatgaggagtttaagatgcaaattacggtcgaagtggatacgagagaggggccaaaacttaattccacggcacaaaagggatacgagaatctggtgagccccattactcttcttccagaagcggagattcttttcgaggatattccgaaagaaaaaaggtttccaaagttcaagagacatgatgttaacagtaccaggcgggcacaggaagaagtcaagatccctctggtgaacattagtctgctgccaaaagatgcacagctttcccttaacacccttgatctgcaacttgaacacggcgatattactttgaagggttacaacctttcgaagagcgcgctgcttcgatcgtttctgatgaattctcaacacgccaagataaagaaccaggcaattatcactgatgaaaccaatgattcacttgtcgccccacaagagaagcaagttcacaagtcgattcttccaaattcgcttggtgtgtccgaaagacttcaacgacttacttttccagcagtctcagttaaagtgaatggacatgaccaaggtcaaaatcctcctctggaccttgaaactactgcacgcttcagggtggaaacccacactcaaaagaccattggaggcaatgtgaccaaggagaaacccccctcgcttatcgtcccactggagtcgcaaatgaccaaagagaaaaagataaccggcaaggagaaggaaaactcgcgaatggaggaaaacgccgagaaccacattggagtgaccgaggtgctgctggggcgtaagctgcaacattacacggatagctacctgggtttcctgccgtgggagaagaagaagtattttcaggacctgcttgatgaagaagaatccctgaaaacccagctggcatactttaccgattcgaaaaacaccgggagacagctgaaggacacctttgccgattcacttcgatatgtcaataagattctcaactcgaaatttggatttacttcacgcaaagtgcctgcccacatgccacacatgattgaccggatcgttatgcaagagctccaagatatgttccctgaagaatttgacaaaaccagcttccacaaggttagacactcggaagatatgcaatttgctttctcgtatttctactacctgatgtctgcagtgcaacccctcaacattagccaggtgtttgatgaagtcgacaccgatcagtcaggcgtgctgagcgaccgcgaaatcagaaccctggcgactcggattcatgaactgcctctgagcctccaggatttgaccgggctggaacatatgctgatcaactgttcgaagatgcttcctgctgacattacccaactcaacaacatcccaccaactcaagaatcctactacgatccaaatctgccacccgtcactaagagcctggtgactaactgcaaaccggtgactgacaaaatacataaggcatacaaagataagaacaaatacagatttgagataatgggagaggaggagattgcatttaagatgatacgaaccaacgtgagccacgtggtcggacaactggatgatattcgtaagaatcctcgcaaatttgtgtgtcttaatgataacatcgatcataaccataaggacgctcagactgtgaaggccgtgctgcgagacttttacgagagcatgtttcccataccatcgcaatttgagctgccaagagaatataggaacaggttcctccacatgcatgaactgcaagaatggcgggcgtacagggacaagctgaagttttggacccactgtgtcttggcgactctgattatgtttaccatcttctcgttcttcgcagaacagctgatcgcccttaagagaaaaatcttcccaagacggcggatccataaggaggcctcccccaaccgcattcgggtg

SEQ ID NO: 16951 - DNA, 3768 bp, Artificial Sequence
  Description of Artificial Sequence: Synthetic coding sequence
atgctgtttaagctgctccagcggcaaacctatacctgtctgtcgcacaggtacggcctgtacgtgtgcttcctgggagtggtggtgactatcgtgagcgcgtttcaatttggagaggtggtgctggagtggtcccgagatcaataccatgtgctgttcgacagctatcgtgacaatatcgctggtaaatcgttccagaatcgcttgtgtctgccaatgccgatcgacgtcgtgtacacctgggtgaatggtaccgatcttgagctgttgaaagagctccaacaggtgagggagcagatggaagaagagcagaaggctatgcgggaaattctgggaaagaatactaccgaacccaccaagaaatcggagaaacagttggagtgccttctcacccactgtataaaggtgccaatgctcgtgctggatcctgcgctcccggcgaacatcactctcaaagacctgccctccctgtacccatccttccactccgcttcggacatctttaatgtggcaaagccgaagaacccatccactaatgtaagcgtggtcgtgttcgacagcaccaaggacgttgaagatgcccattcaggcctgttgaagggaaactcaaggcagactgtgtggcgcggctacctgactaccgacaaggaggttccgggactcgtgctcatgcaggacttggcgttcctgtcgggattcccgcctactttcaaggaaactaaccaactcaaaaccaagctcccggaaaacctcagcagcaaggttaagctcctgcagctgtactcggaggcgtccgtggcactgctgaagctgaataacccgaaggatttccaggaactgaacaaacagactaagaagaatatgaccatcgatgggaaggaactcactatttcaccagcgtaccttctgtgggatctgagcgcaatctcccaatcaaagcaggacgaggacatctccgcttcccggttcgaggataacgaagagctgagatactctcttcgcagcattgagagacatgccccttgggttcgcaacatctttatcgtgacgaacgggcagattccgtcttggctgaatctggataatccacgcgtgaccattgtcacccaccaggatgtgtttcggaatttgtcacatttgcctactttttcgtcaccggcaatcgaatcacatatccatagaattgaaggactctcgcaaaagttcatctacctcaacgacgacgttatgttcggcaaggacgtatggccggacgacttctactcgcattcgaaggggcaaaaagtctacctgacttggccggtgccgaactgcgcggagggctgcccagggtcgtggatcaaggatggctactgcgacaaggcctgcaacaactcggcctgcgactgggacggaggagattgcagcggcaactccggtgggagccgctacattgctggaggtggaggaactggatccatcggggtcgggcaaccgtggcagttcgggggcggaatcaacagcgtctcctactgcaatcaaggttgcgccaatagctggcttgccgacaaattctgcgatcaggcgtgcaacgtcctctcctgtggattcgacgccggagattgtggacaagaccatttccatgaactctacaaggtcattttgctgccgaaccaaacgcactatatcatcccgaagggggaatgtttgccgtacttctcatttgcggaggtggccaagcggggagtcgagggggcatacagcgataatcctatcattcggcatgccagcatcgccaacaagtggaaaacgatccacctgattatgcattccggtatgaacgccactaccatccatttcaacttgactttccaaaacaccaacgacgaggagttcaaaatgcaaatcaccgtggaggtggacacccgcgagggcccgaaactgaattcaactgcgcaaaaggggtatgagaatctcgtgtcgccgatcactctgctgcctgaagccgaaatcctgtttgaagatatcccgaaagaaaagagattcccaaagttcaagcggcacgatgtcaacagcaccagaagagcccaggaagaagtgaagatccctctcgtgaatatctccctgctgcccaaggacgcccaactttcgttgaacactctcgacctgcagctcgagcatggggatatcacccttaaaggatacaacctcagcaagtcggccttgttgcgcagcttccttatgaattcacaacatgctaaaatcaaaaatcaggcaatcatcacggatgagactaatgactccctcgtggcaccacaagagaagcaggtccacaaatcgatcctcccaaactccctgggcgtgtccgaacggctgcagagactgaccttcccagcagtgagtgtgaaagtgaacggacacgaccagggacagaacccgccgctggacctggaaaccactgctcggtttcgggtagaaactcatactcagaaaacgatcggaggcaatgtgacgaaggaaaaaccgccaagcctcatcgtgcctctggaatcccagatgactaaggagaagaagatcactggaaaggaaaaggaaaattcacgcatggaggagaatgcagaaaaccatatcggtgtgaccgaggtcctccttggtcgcaagctgcagcactacaccgactcctacctgggatttctgccatgggaaaagaagaaatacttccaggacctgctcgatgaagaggaaagcctcaagactcagctggcatacttcaccgattcgaagaatacgggccgccaactgaaggataccttcgcggactcgctgagatacgtgaataagatccttaactcaaagtttgggttcacctcaaggaaggtgccggcccacatgcctcacatgattgaccgcatcgtgatgcaggagctgcaggacatgtttccagaagaattcgacaagacctcattccacaaagtccgccatagcgaagatatgcaatttgcgtttagctacttctactacctgatgtcggcagtccaacctctgaacatctcgcaggtattcgatgaggtggatactgaccagagcggagtgctttcagaccgggagattagaactctggcaacccggattcatgaactcccgttgtcgctccaagatctgactgggctggagcatatgctgattaactgcagcaaaatgctgccagctgacattacccagctgaacaacatcccgccgacccaggagtcctactacgacccaaacctgccaccggtcactaagtcgctggtgaccaattgcaagccggtgaccgacaagatccataaggcctacaaggacaaaaacaagtatcggtttgagatcatgggtgaagaggagatcgcgttcaagatgatccggaccaatgtcagccacgtcgtcggtcaactggacgacatccggaaaaatccacgcaagttcgtgtgcctcaatgacaacatcgaccataaccacaaggatgctcagacggtgaaggcagtactgagagatttctatgagtccatgttccctatcccatctcaattcgaacttccgagagagtacaggaaccgtttcctgcacatgcacgagctgcaagaatggagagcttaccgggataaactcaaattctggacccactgcgtcctggcaacccttatcatgttcaccatcttctcgttctttgctgaacagctgatagcgctgaagcgcaaaatctttccgcgccgcaggatccacaaggaggcgtcccctaaccgcatcagggtg

SEQ ID NO: 16952 - DNA, 3768 bp, Artificial Sequence; identical to SEQ ID NO: 16879
  Description of Artificial Sequence: Synthetic coding sequence

SEQ ID NO: 16953 - DNA, 3768 bp, Artificial Sequence
  Description of Artificial Sequence: Synthetic coding sequence
atgctgttcaagctgctgcaacgccagacttacacctgcctgtcacatagatacggtctgtacgtctgtttcctcggggtggtggtgaccatcgtctccgcttttcagttcggagaggtggtcctggagtggtcacgagatcaataccatgttctcttcgattcgtaccgcgacaacattgcaggtaagagcttccaaaaccggctctgtctgcccatgccaattgatgtcgtgtatacttgggtgaatggaaccgatctggagctcttgaaggaactgcagcaagtgcgggagcagatggaggaagagcaaaaggctatgcgcgagatccttggaaagaatactactgagccgaccaaaaagtccgagaagcaattggagtgcctgctcactcactgtatcaaggtcccgatgcttgttcttgacccggccctgccggccaacatcacgctgaaggaccttccgtcactctacccttccttccattccgcctcggacatcttcaatgtggcgaaaccgaaaaatccgtcgaccaacgtgtccgtggtggtgttcgactcgactaaagacgtcgaggatgcacactcgggacttctgaaggggaactccagacagacggtctggcggggctacctgaccaccgacaaggaggtgccgggtcttgtcctgatgcaggatctggcctttctctcgggctttcctccaactttcaaagaaaccaatcagctgaaaactaagttgccggagaacctttcgagcaaggttaagctgctgcagctgtactcggaagcgtccgtggctcttctcaagctgaacaatccgaaagattttcaagaactcaacaagcagaccaagaagaatatgaccatcgacggaaaggaactgactatctcaccggcctacctcctctgggacctctccgcaatctcccagtcaaagcaagatgaggacatctccgcgagccgtttcgaagataatgaggaactgcgctacagcctgaggtccatcgagcgccatgccccgtgggtccggaacatcttcatcgtcactaatggccaaatcccgtcatggctgaatctggataatccaagagtgaccatcgtgactcaccaagacgtgttccgaaacctgtcacatttgccgactttctcatctccagccatcgagtcgcatatccatcgcattgaaggactgtcgcagaagttcatctacctcaacgacgacgtcatgtttggaaaggatgtgtggccggacgacttctacagccactcgaaggggcagaaggtgtatcttacctggccagtgcctaattgtgcagagggctgcccgggatcctggatcaaagacgggtactgcgacaaggcgtgtaacaattcggcctgcgactgggatggaggtgattgctcaggaaactccggaggatcccgctacatcgcgggtggaggaggaactggctccatcggcgtcgggcagccatggcagtttggaggaggaataaacagcgtctcttactgcaaccaaggttgcgccaacagctggctggcggacaagttttgtgaccaagcatgcaacgtgctctcgtgcggcttcgatgcaggcgactgtggccaggaccacttccacgagctctacaaagtgatcctcctcccgaaccaaactcactacataattccgaagggagaatgtctgccttacttctccttcgcagaagtggcgaagcggggtgtggaaggtgcgtactccgacaatcctatcatccggcatgcgtccatcgccaacaagtggaaaaccatccacctgatcatgcattcgggcatgaacgcgaccacgatccacttcaacctcaccttccagaataccaacgacgaagaattcaaaatgcaaatcaccgtggaggtggacacccgcgaaggaccaaagctgaacagcaccgcacaaaaaggttacgaaaatctggtgagcccgatcacgctgctgcccgaggctgaaatactgtttgaagatatcccgaaggagaaacggtttccaaagttcaagcggcacgacgtgaattcgactaggcgagctcaggaagaagtgaagatccctttggtcaacattagtctgttgccaaaggacgcccagctgtccctcaatacccttgatctgcagctggaacacggggacatcaccctcaagggttacaatctgtctaagtccgcgctcctgaggtcgtttctcatgaactcgcagcacgccaagatcaagaaccaagccatcatcactgatgaaaccaatgacagcctggtcgcgccgcaggaaaaacaggtccataagtcaatactgcccaactcccttggagtctccgaacgcttgcagaggctgaccttcccggcggtgtccgtgaaagtgaatggccatgaccagggtcaaaaccctcctctggatctcgagacgaccgcgaggtttagggtcgaaacccatacgcaaaaaaccatcggaggcaatgtgaccaaagaaaagccaccctccttgatcgttccgctcgagtcgcagatgactaaagagaagaagattactgggaaggaaaaggaaaactctcggatggaggagaacgcggagaaccatatcggggtgactgaagtgctcctgggacgcaaactgcagcactacaccgatagctacctcggtttcttgccgtgggaaaagaagaaatacttccaagacctgctggacgaggaggaatctctcaagactcagttggcctatttcactgatagcaaaaacactggccggcagcttaaggacactttcgcggattcgctccggtacgtcaacaaaattctcaattccaagtttggattcacttcgaggaaggtgccggcccacatgccgcacatgatcgacagaattgttatgcaggaactgcaagatatgttccccgaggaattcgacaaaaccagctttcataaggtgagacattccgaggatatgcaattcgccttctcatacttctactaccttatgtctgctgtacaaccactgaatatcagccaggtctttgacgaagtggacaccgatcaatctggcgtgctgtcggacagagaaatccggaccctggccactcggattcatgaactgcccctgtcccttcaagacctcactggactggaacatatgctgatcaactgcagcaaaatgttgccagcggacatcacgcagctgaacaacatcccacctactcaggaatcgtactacgatccgaacctgcccccggtgaccaaatcgctggtgactaactgcaagccggttaccgacaagattcataaggcctataaggacaagaacaagtacaggttcgaaatcatgggggaggaggaaattgccttcaaaatgatcagaacgaacgtttcccacgtggtgggtcagcttgatgatatccgcaaaaacccacggaagttcgtctgcctcaacgacaacatcgaccataatcacaaggatgctcaaaccgttaaggcagtgttgagagacttttacgaatccatgttcccaattccatcacaattcgaactccctcgggagtaccggaatcggttcttgcacatgcacgagctccaggagtggcgggcctaccgggataagctgaagttctggacccattgcgtgctggccactctgattatgttcaccatcttttctttcttcgcggaacagcttatcgcgctgaagcgtaaaatctttcctcgtcggaggattcacaaggaggcgtcacctaacagaatccgggtg

SEQ ID NO: 16954 - DNA, 3768 bp, Artificial Sequence
  Description of Artificial Sequence: Synthetic coding sequence
atgctgtttaagttgcttcaacgtcaaacttacacttgccttagccaccgatacgggctctatgtctgttttcttggagtggtcgtaaccatcgtttcggcctttcaatttggagaagtggtgctcgaatggtccagggatcaataccacgtccttttcgactcgtaccgcgataacatcgcgggcaagtcgtttcaaaatcgcctgtgtctcccgatgcctattgatgtggtctatacgtgggtgaacggtactgatctcgaactcctcaaggaacttcagcaggtcagagagcaaatggaagaggaacagaaggctatgagagaaatccttgggaagaacactactgaacctaccaaaaagtcagaaaagcagctggaatgccttctcacgcattgtattaaggtgccaatgcttgtgctggatcctgcattgcccgctaatatcactcttaaggaccttccgtcgctttacccctcctttcattccgcctctgacattttcaatgtggcaaagccaaagaatccatctaccaacgtctccgtggtggtatttgattcgactaaggatgtggaggacgcccatagcggattgctcaaagggaattcgcgacagactgtatggcgaggctacttgactaccgacaaagaggtgcccggcctggtccttatgcaggatctggcgtttctgtcgggttttccaccgactttcaaagaaaccaatcaactgaaaaccaaactgccggagaatctttcaagcaaggtgaaactcctccaattgtactcagaggcttcggtggcgttgcttaaactcaataatcccaaggacttccaagaactgaataagcagactaagaagaatatgactatcgacggtaaagaactcaccattagcccagcatacctgctgtgggatctttcggcaatctcccaatccaagcaggatgaggatatctcggcatcgcgttttgaggacaacgaggaactgcgctactcacttaggtccattgagagacacgccccatgggtccggaacatattcattgtcaccaatggccaaatccccagctggcttaacctggataaccccagagtcacgatcgttacgcatcaggacgtgtttcgcaacctctcccaccttccaactttttcctcgcccgcaatcgagtcccatattcatcgcatcgagggactctcccaaaagttcatttacctgaatgatgatgtcatgttcggtaaagatgtgtggcctgatgacttttacagccatagcaaaggccaaaaggtgtaccttacttggccggtgccgaattgtgcggagggctgcccggggtcctggatcaaagacggttactgtgataaggcctgcaacaactcggcctgcgattgggatggaggagattgttcgggtaattccgggggttcaagatacattgctggtggaggaggcaccggttcaattggcgtgggacagccctggcagttcggtggcggtataaacagcgtgagctactgtaaccaaggatgtgcgaacagctggcttgcagacaaattctgcgatcaggcatgtaacgtactttcgtgtggttttgatgcaggtgattgtggacaggatcatttccatgaactctacaaagttattctgttgccaaatcagacgcactatatcatcccaaagggggaatgtctgccatatttctcgtttgcagaagtcgcaaagcggggggtcgaaggagcatacagtgataaccccataattcgacatgcaagtatcgcaaacaaatggaaaactattcaccttatcatgcactcgggaatgaatgcaaccaccattcatttcaacctgacctttcagaacaccaacgatgaggagttcaaaatgcagattaccgtggaagtggatactagggaaggaccaaagctgaactcgaccgcccagaaggggtacgaaaacctcgtgtcacctatcacccttttgcctgaggcagaaattcttttcgaggacattccaaaggaaaaacgttttcctaagtttaagcggcacgatgtgaactccactaggagagcccaagaagaagtgaaaattcctcttgtgaatatctccctgctgcctaaagatgcacaactttcactcaataccctggaccttcaattggaacacggagacattacgcttaaggggtacaatctctccaagtcggcactgttgagatcctttttgatgaattctcaacacgcaaagattaagaaccaggctatcattaccgatgagactaacgactccctcgtcgcaccgcaggaaaagcaagtccataagagtatcctgccaaactcactgggcgtttctgagcgcctccaacgtctgacgtttcccgctgtgtcggtgaaagtcaacggacatgatcagggacaaaacccccctcttgatcttgagactacggcaaggttcagggtggaaactcatactcaaaagaccatagggggtaacgtgactaaagaaaagcccccttcgctgatagtgccactcgaaagccagatgacgaaggagaaaaagattaccggaaaggaaaaggaaaatagtagaatggaagaaaacgccgaaaaccatatcggtgtgaccgaagtgctcctgggacgcaagttgcagcattacaccgatagctaccttggctttcttccatgggaaaagaaaaagtactttcaggacttgcttgatgaagaggagagcctgaaaacccagctcgcgtacttcaccgactcaaagaacacgggtagacaacttaaggatacttttgcagactcccttcggtatgtcaataagattttgaacagcaagtttggatttacctcccgcaaagtgcctgcacatatgccgcatatgattgacagaatcgttatgcaagagctccaagatatgtttccagaagaatttgataaaacctcgttccataaggtgcggcactcggaggacatgcagtttgccttctcatacttctactacctgatgtcagcagtccagcctctgaacatctcccaagtgtttgatgaagtagacaccgaccaatcgggggtgctttccgaccgggagatacgtactctggcaactcggattcatgagctgcctctgagccttcaggaccttaccggtctggaacatatgctcatcaactgctcgaagatgctgcctgcggatattacccaactgaacaacatcccacctacccaagaaagctactacgaccctaacctgcctcctgtcactaagtccctggtcaccaattgtaaacctgtcactgataagattcacaaagcctacaaggataagaacaagtacaggttcgagataatgggagaagaagaaatcgcatttaagatgatccggacgaacgtgtcccatgtggtgggccaactcgacgatattagaaagaatccacgcaagttcgtctgcctcaacgacaatattgatcataaccacaaagatgcccaaaccgtgaaggcagtgcttcgggacttttacgaaagcatgttccccattccttctcaatttgaactgccacgtgaatacagaaatagattcctgcatatgcacgaattgcaggaatggcgcgcgtacagagacaaattgaagttttggactcactgtgtgctcgcaaccctgattatgtttaccatattcagcttctttgcggagcagctgattgccctgaaacgcaagatattccctcggcggagaattcataaggaggcctcacctaaccgaattcgtgtc

SEQ ID NO: 16955 - DNA, 3768 bp, Artificial Sequence
  Description of Artificial Sequence: Synthetic coding sequence
atgctgtttaagctgttgcaacgtcagacatatacatgcctttcacaccggtacggtctgtatgtatgtttcttgggtgtggtagtgacgattgtctcagcgtttcagttcggcgaggtggtgctagagtggagccgggatcagtatcacgtcctgttcgacagttaccgcgataacatcgctggcaagagctttcagaaccgtctttgcctgcccatgccgattgatgtagtgtacacttgggtaaacgggactgacctggagctgctgaaggagttgcagcaagttcgcgaacagatggaggaggagcagaaggccatgcgcgagatcttgggaaagaatacgacggaacccactaagaagagtgagaaacaactggagtgcctgctgacacactgcatcaaggtgccaatgctcgttctggacccggcgctgccagccaatattacgcttaaggatctgccctccttgtatccaagcttccattctgccagcgatatattcaacgtcgccaaaccaaaaaatcccagtacgaacgtatccgtggtggtgttcgattccacgaaggatgtggaggatgcgcacagcgggctgttgaaaggaaatagccgccaaacagtgtggcgcggatatctgaccaccgataaggaagtccctggtctcgtgctcatgcaagacctggcgttcctttctggtttccccccgacatttaaggagaccaaccagctcaaaaccaaactgccagaaaaccttagctccaaagtcaagctgctgcagttgtactcggaagcctcagtcgccctcttgaagcttaataatccgaaggacttccaggagcttaataagcagaccaaaaagaatatgaccatcgatggcaaagagctgacgatcagtcccgcctatttattgtgggacctgagtgcgatatcccagagcaagcaggacgaggacatttccgcctcaaggttcgaagataacgaggaactccgatacagtctgagaagtatcgagcgacatgctccctgggtgagaaacatttttatcgtcaccaatggacagattccgagctggctgaacttggataacccgcgcgtgacaatagtcacgcatcaagatgtcttcagaaatctatctcacctgccaaccttcagcagccccgccatcgaatcacacattcaccgaatagagggcctcagccagaaattcatttatctgaatgacgacgtcatgtttggaaaggatgtttggcccgatgatttttactcccatagtaaaggccaaaaggtctacctaacctggccagttccgaattgcgcagagggctgcccaggctcgtggatcaaggatggctattgtgacaaggcttgcaataattccgcttgcgattgggatgggggagattgctccggcaacagtggcggctcccgctacatcgcaggcggtggaggcacggggtcgatcggcgttggtcaaccgtggcagtttggcggcggaattaactcagttagttattgcaaccagggttgtgctaatagttggctcgccgacaagttctgcgaccaggcttgcaacgtcttgtcctgcggctttgatgcgggtgattgtggacaagatcacttccacgagctgtacaaggtcattctactaccgaaccagacccattacatcattcctaagggtgagtgcctgccttatttctccttcgctgaggtagcaaagcgcggcgtcgagggcgcctacagcgacaatccgatcatcagacacgcctccattgcaaacaagtggaagactatccatctgatcatgcattcgggcatgaatgccacgacgattcacttcaaccttacctttcaaaacaccaacgacgaggaatttaagatgcagatcacagtggaagttgatacgagggagggccccaaactgaactcgaccgcacaaaaaggctacgagaaccttgtatcgcccatcaccttgctgcctgaagctgaaatactgttcgaagacattccaaaggaaaagcgcttcccgaagttcaagcgccacgatgtgaattccacccgccgggctcaagaggaggtcaagatccccctcgtcaatatctccctgctccccaaggatgcccagctgtctctgaataccctcgacctgcagctcgaacacggcgacatcaccttgaagggctacaatttgtccaagagtgccctcctgaggtcctttctaatgaactcccagcatgctaagataaagaatcaagctattattacagacgaaacaaacgatagcctcgtggccccgcaggaaaaacaggtacacaaatccattttgcccaactcgttgggcgtgagcgagcgcctgcagaggctaacgttcccagcagtgagtgtaaaggtaaatggacacgaccaaggacagaaccctcctctggacctcgagaccacggccagatttcgcgttgaaacccacactcaaaagaccataggtggcaatgttacgaaggagaagccaccaagcctgatagtgccccttgagtcgcagatgacaaaggagaagaagattaccgggaaggagaaggaaaacagcagaatggaagagaacgctgagaatcatataggggtaaccgaagttttgctgggccgaaagctccagcattataccgactcgtatctgggcttcctcccctgggaaaagaagaagtactttcaagacctattggatgaggaggagtccctcaagacccagctggcatattttaccgactccaagaacacgggcagacagctaaaggatacttttgccgatagtctaaggtatgttaacaagattttaaactcgaaattcggcttcacaagtagaaaggtgccggcacacatgccacacatgatcgaccgtattgtgatgcaggagctgcaggatatgtttcccgaagagtttgataaaacgtcctttcacaaggttcgccatagtgaggatatgcagtttgcctttagctatttttactacctcatgtccgctgtccagccgttaaacatttcccaggtcttcgacgaagtggacaccgatcaatcgggagtgctttccgatcgcgagatacgcaccctcgcaacgcgtattcatgagttacctttgagcctgcaggatctgaccggtttggagcacatgctgattaattgctccaaaatgcttccagcggacattactcaactgaataacatcccacccacgcaggagtcctattatgatccaaatctacctcccgtgaccaagagcctggtcacgaactgcaagcccgtcaccgacaagatccacaaagcctataaagataagaacaagtatcgcttcgagatcatgggcgaagaggagatcgcatttaagatgatccgtacgaatgtgtctcatgttgtaggacagctggatgacattcggaagaacccgcgaaagttcgtgtgtcttaatgacaacatagatcacaatcacaaggacgcccagacggttaaggcagttcttcgtgatttttacgagagcatgtttccaatcccttctcagttcgaattgccacgcgagtaccgtaatcgcttcctgcatatgcacgaactgcaggaatggcgcgcttaccgcgataagctgaagttttggacccactgtgtactagcaactctcatcatgttcaccattttcagtttcttcgcggagcagcttatcgcgttaaaacgcaagatatttccacgccgtagaatacataaggaggcctccccgaacagaattcgcgtg

SEQ ID NO: 16956 - DNA, 3768 bp, Artificial Sequence
  Description of Artificial Sequence: Synthetic coding sequence
atgcttttcaagctcctgcaacggcaaacctacacttgcctgtcccatcgatacggactgtacgtgtgttttcttggtgtggtggtcaccatagtcagcgccttccaattcggggaagtggtgctggaatggtcgcgggaccagtaccacgtcctgtttgattcatacagggataacattgcagggaagtcctttcagaatcggctgtgcctgccgatgccaattgatgtggtgtacacttgggttaatggaaccgatctcgaattgcttaaggaacttcaacaagtgagagaacaaatggaagaagaacagaaagctatgcgcgagattctggggaaaaacaccaccgaaccgactaaaaagtcggagaagcagctcgaatgtcttttgacccattgtattaaggtgccaatgttggttcttgatcctgcgctccctgccaacataaccttgaaggatcttccttctctttacccatcatttcattcggcatcagacatctttaatgtcgcgaaacctaaaaacccttcaactaacgtctctgtggttgtgtttgactccaccaaggatgttgaggacgcacactctgggttgctgaaggggaattcgaggcaaactgtgtggagaggatacctcactaccgacaaagaagtgcctgggttggtcctcatgcaggatttggcatttctgtccggttttccccctacctttaaagaaactaaccaacttaagacgaagctcccagaaaatctttcgagcaaggtgaagctccttcaactttactccgaagcgtcggtggcgttgctcaagttgaacaatcctaaagactttcaagaactcaataagcaaacgaagaaaaacatgactatcgatggaaaggaactcaccatttcgcccgcttaccttctgtgggatctgtccgccatttcccaatcgaagcaagatgaagatatctccgcatcacgcttcgaagataacgaagaacttcgatactcccttcgatcaattgaacgccatgcaccttgggtgcggaacatctttattgtgaccaatggacagatccctagttggcttaatcttgataatcccagagtaaccattgtgacccatcaagatgtgtttcgtaacctttcccatctgccaaccttcagctcaccagcaattgagtcgcatatccatcgcattgaaggactttcccagaagttcatctatctgaacgatgatgtgatgtttggaaaggatgtatggcctgacgacttctactcccactcgaagggacagaaggtctaccttacttggcctgtgcctaattgtgccgaaggatgtcccggatcgtggattaaagatggatactgcgataaggcatgcaacaactcagcttgtgactgggacggaggtgattgctcgggtaactccggtggttcacgctatatcgcggggggcggagggactggttcaatcggcgtcggacaaccgtggcaatttggaggtggtatcaattcggttagctactgcaaccaaggttgtgcaaacagctggttggctgataagttttgtgatcaagcctgcaacgtgttgtcgtgcgggtttgatgcaggtgattgtggccaggaccatttccatgaactttacaaagttattcttctgccaaatcagacgcattacattatcccaaagggggaatgtctcccatacttttccttcgcagaagtggcaaagagaggggtggaaggcgcatacagcgataaccccatcattaggcatgcgtcgattgctaacaaatggaaaactatccatctcattatgcatagcggcatgaatgccaccacgattcacttcaacctgacctttcaaaacaccaacgacgaagagttcaaaatgcagattacggtcgaggtcgatacccgagaggggcctaagctgaattccaccgcacagaagggctacgaaaatctggtttcgccgataactcttctccctgaagcagaaattcttttcgaagatatccctaaggaaaagcggtttccaaagttcaaacgccatgatgttaactcgactagaagagcacaggaagaggtgaagattcccctggtgaacatttcgctccttccaaaggacgcccaactctcgttgaacactcttgatctccagttggaacacggagacattactcttaaggggtacaacctttccaagagcgcactcctcaggagctttcttatgaattcacagcatgcgaagatcaagaatcaagccattatcactgacgagactaatgattccctggtggctcctcaggaaaagcaagtccacaagagcattctgcctaactcactgggtgtgtccgaaagacttcagaggcttacctttcccgcagtgagcgtaaaggtgaacggacatgatcagggtcaaaacccccctctggacctggaaactactgcgagatttcgggtggagacgcacactcaaaagacgattggaggaaatgtgaccaaagagaagcccccaagcctcatagtgcccctcgaaagccagatgacgaaagagaagaagattaccgggaaggagaaggaaaattctcggatggaagaaaatgccgaaaaccacataggtgtcaccgaggttctcctcggcagaaagctgcagcactacaccgattcgtatctgggatttcttccatgggaaaagaagaagtactttcaagatttgctcgacgaggaggagtcactgaaaacccaacttgcatacttcactgactcgaagaacaccggacgccaactgaaggatactttcgcagattcgctgcggtatgtcaacaagatattgaactccaaatttggttttacctcacgaaaagtgccagctcatatgcctcacatgatagatcgcattgtgatgcaagaattgcaggatatgttcccggaggaatttgacaagacttcttttcacaaagtgaggcactccgaggatatgcaatttgcattctcctacttttactaccttatgtcggcagtccaacccctcaacattagccaggtgttcgacgaggtggataccgaccaatccggcgtcctgagcgacagggaaattcggactctcgccactcgaatccacgagctcccgctgagtctgcaggacctgaccggccttgagcatatgctgatcaactgttcgaaaatgcttcctgccgatattacgcagctcaacaacatacccccaacccaagaatcgtattacgatcccaacctgcccccagtgactaagtctctcgtgaccaactgtaagccagttaccgataagatccataaagcctacaaagacaagaataagtaccgttttgagataatgggcgaggaagagattgcattcaaaatgatcagaactaacgtgagccacgtcgtgggtcagcttgacgatatcagaaaaaacccacgaaaattcgtctgtctgaatgacaatatagaccataatcataaagatgcgcaaactgtgaaggcagtcctgcgagacttctacgagagcatgtttccgatcccatcccagtttgagctccctagagagtacaggaatagatttctgcatatgcacgaactgcaagaatggagagcataccgagacaaactcaagttctggacccattgtgtacttgcaactcttatcatgtttactatctttagctttttcgcagagcagctgatcgccttgaaacgtaagattttccctaggcggagaattcataaggaggcttcaccaaaccgaatccgtgtg

SEQ ID NO: 16957 - DNA, 3768 bp, Artificial Sequence
  Description of Artificial Sequence: Synthetic coding sequence
atgctgtttaagctcctgcagcgccaaacttacacttgtctgtcccatcggtacggcctgtatgtctgtttcttgggcgtggtcgtaactattgtttccgcgttccaattcggtgaagtcgttcttgagtggtcccgcgaccagtaccatgtgctgttcgattcataccgtgacaacatcgcaggcaagtcctttcagaatcgcctatgcttgcctatgcccattgatgtggtgtacacgtgggtgaatggtactgacctggaactgctgaaggagttacagcaggtccgagagcagatggaagaggaacagaaagcaatgcgcgagatccttgggaagaacaccaccgagccaacaaagaagtccgagaagcaactggaatgtctactcacccactgcatcaaggtccccatgttggttctcgatccggctctgcccgccaacatcacgttgaaagacctgcccagcctttacccatccttccattccgcgtcggacatcttcaacgtggccaagccgaagaacccgtctaccaacgtctcggtcgtcgttttcgacagtaccaaggatgtggaggacgctcactccggtctgctcaagggaaattcccgccaaaccgtctggcgcggctacctgaccactgacaaagaagttcctggtctagtcctcatgcaggacctggcgttcctctccggttttccccctacgtttaaggagactaaccaactcaagacgaagctcccggagaacctgtcctcgaaggttaagcttctccagctgtactctgaagctagcgtcgcactcctgaagcttaacaaccccaaagactttcaagagctgaacaagcagaccaagaaaaacatgacgatcgacggaaaggagctaaccattagccctgcatatttactttgggacctgtctgctatctcacaaagcaagcaggacgaggatataagtgcttctaggttcgaggacaatgaggaactccgctatagcttgagaagtatcgaacggcacgcgccatgggtcaggaacatcttcattgtcaccaatggtcagatcccttcgtggctgaatctggacaaccctcgtgttaccatcgtgacccatcaggatgtatttcgcaatctgtcacacctgcctactttctcgtcccctgcgattgaatcccacatccaccgtatcgagggtctctcccagaagtttatctacctgaacgatgacgttatgttcggtaaggacgtctggcccgacgacttctactcccattcgaagggccagaaggtttacttgacctggcccgtgcccaactgcgctgaaggttgcccgggcagctggattaaggacggatactgcgacaaggcctgtaacaattccgcctgcgattgggatggtggagattgcagtggtaactccggtgggtcgcgctatatcgcaggtggaggaggcactggttctatcggagtcggacaaccttggcagttcggtggcggcatcaactccgtctcgtactgcaaccagggttgtgcgaactcatggctggcagataaattctgcgatcaggcttgcaacgtcctgagctgcggcttcgatgctggggactgtggtcaggatcacttccatgaattatacaaggttatcctcctccccaaccagacacactatattatccctaagggagagtgtctgccctactttagcttcgctgaggttgctaaacgtggagtcgaaggcgcttactccgacaatcccatcattcggcacgccagcatcgcaaacaagtggaagaccattcatctgatcatgcattcgggcatgaatgctactactatccatttcaaccttacttttcaaaatacaaacgacgaggagttcaagatgcaaattaccgtcgaggtcgacactagggagggcccaaagcttaattccacagcgcagaagggatacgagaacctagtctcccctattacgcttttgcccgaggcggagattttgttcgaggacatccccaaggagaagcgtttccccaagttcaaacgtcatgatgtcaatagcacccgccgtgcccaggaggaggtgaagatcccccttgtgaacatatcccttctccctaaggatgctcaactttcgctcaacacgcttgatctgcagctcgagcacggtgacatcaccttgaagggatacaacctgtcgaagtccgctctgctgcggtccttcctgatgaactcgcagcacgcaaagatcaaaaatcaagctatcatcacggacgaaactaacgactccctggtcgcccctcaggagaagcaggtgcacaagtccatcctgcccaactccctcggcgtgtctgagcgccttcaacgtttgacctttcccgccgtttccgtaaaggtcaatggccatgaccaggggcagaacccccccctcgacttggagacgacagctcgcttccgtgtcgagactcatacccaaaagaccattgggggcaatgtcaccaaggaaaagcctccgagcctgatcgttccccttgagagtcaaatgaccaaagagaagaagatcaccggcaaagagaaggaaaatagcaggatggaggagaatgcagagaaccatattggcgtcactgaggtgctattgggccgaaagctccagcactataccgattcttacctgggcttcctaccgtgggagaagaagaagtatttccaggacttactggatgaggaggagtccctcaaaacccagctggcctacttcactgattctaagaacacgggaagacaactcaaggatacgttcgccgatagtcttaggtatgttaacaagatcctcaacagcaaattcggcttcacttcccgtaaggtgcctgcccacatgccccacatgattgaccgcatcgtcatgcaggagcttcaggatatgttccccgaggagttcgacaaaacatcgttccataaggtccgtcactctgaggatatgcagttcgccttctcgtacttttactatctgatgtccgccgtccaaccactcaacatctcccaagtgtttgacgaagtcgatactgaccagagcggcgtactgagcgaccgcgagatccggacgttggcgactcgtatccacgagcttcccctaagcctgcaggatctgactgggctcgaacacatgctgatcaactgtagcaagatgttgccagctgatatcacacagcttaacaacatcccacccacacaggagagctactacgatccgaaccttccccccgtgactaagtcccttgtcactaactgcaagcctgtcaccgacaagatccacaaagcctacaaggataagaacaagtaccgatttgagattatgggtgaggaggaaattgcattcaaaatgatccgaactaacgtgtctcatgtggttggccaactggacgatattcgcaagaacccgcgcaagttcgtttgcctcaatgacaacattgatcataaccataaggatgcgcagacggtcaaggccgtgttgcgggatttctacgagtcgatgttccctatcccctcacaatttgagctcccacgagaataccgcaaccgtttcctgcatatgcatgagcttcaggagtggcgcgcttaccgcgacaaacttaagttctggactcattgcgtgctcgctacgttgattatgttcacaatcttctccttttttgccgagcagcttatcgccctgaaaagaaagatcttccctcgtcgccgcatccataaggaggctagcccaaatcggatccgggtc

SEQ ID NO: 16958 - DNA, 3768 bp, Artificial Sequence
  Description of Artificial Sequence: Synthetic coding sequence
atgctgttcaagctcctgcaacgccagacctacacctgcctgtcacacagatatggactttacgtctgcttcttgggagtggtggtgactattgtgtcagcgttccagtttggcgaggtggtgctcgaatggtcgagggaccagtaccatgtcctgttcgattcgtaccgggataacattgccgggaagtccttccagaaccgcctgtgcctgccgatgcctatcgatgtggtctacacctgggtcaacggaactgacctcgagttgctgaaagagctgcagcaagtgcgcgagcagatggaggaggaacagaaggccatgcgcgaaatcttgggaaagaatactactgaaccaactaaaaagtccgaaaaacaactcgaatgcctcctgactcactgcatcaaagtgccgatgctcgtcctcgatccagccctgccagctaatatcaccctcaaggacctgccttccctgtaccctagctttcactcggcgtccgacatcttcaacgtcgcaaaaccgaagaacccatccacgaacgtgagcgtcgtggtgttcgattcgaccaaagatgtggaagatgcccattccggactccttaagggaaactcccgccagactgtgtggaggggatacctgactactgacaaagaggttccaggcttggttctgatgcaggacctggcattcctctcgggattcccgccgaccttcaaggaaaccaaccagctgaaaactaaattgccggaaaacttgtcctcaaaggtgaagctgctgcaactctattccgaggccagcgttgccctgctgaagctcaacaatccgaaggactttcaagaactgaacaaacagaccaagaagaacatgactatcgacgggaaggagctcaccatcagccctgcctacttgctgtgggacctgtcggcaatctctcaatcgaagcaggacgaagatatctcggcttcgcgtttcgaagataacgaggaactgcgctactcgctccgatcaatcgaacggcacgccccgtgggtcagaaacatcttcatcgtgaccaatggccagatccctagctggctgaacctcgacaatcctagggtcaccatcgtcacgcatcaagatgtgttccgcaatctctcccatctgccaacgttctcgtcacccgcgatcgagtcccacatccaccgcatcgaagggctctcccagaaattcatctacctgaatgatgacgtgatgttcggcaaggacgtgtggccggacgatttctattcgcattcgaaggggcagaaggtctacctgacctggccggtgccaaactgtgccgagggatgcccaggttcgtggattaaggacgggtactgcgataaggcttgtaacaattcggcatgtgactgggacggaggggactgctccggcaactcgggtggttcacgctacattgccgggggtggaggaacgggatcgattggcgtgggacagccgtggcagtttgggggagggatcaactccgtctcatactgcaatcagggatgcgctaactcatggctggccgacaaattctgcgaccaagcgtgcaatgtcctgtcgtgcgggttcgacgctggagactgcggtcaggaccacttccacgagctctacaaggtgatcttgctccccaaccaaactcattacatcatccccaaaggagagtgcctgccctacttctccttcgctgaagtggccaagcgcggagtggagggcgcctacagcgataaccctatcattcgccacgcatccattgccaacaagtggaaaactattcacctcatcatgcactccggcatgaacgccactaccatccatttcaacctgacctttcagaacactaatgatgaggagttcaagatgcaaatcacggtcgaagtggacaccagagaggggccaaaactgaactccaccgctcagaagggatacgaaaacctcgtcagcccgatcaccctgctgcccgaagcggagattctgtttgaggatatcccgaaagagaaacggtttccaaagtttaaacgccacgatgtgaattccacccggcgagcacaggaggaagtcaagattccgctcgtgaatatctcacttctgcctaaggacgcccaactgagcctgaatactctcgacctccagcttgagcatggggatatcacccttaaagggtacaacctgtcaaagtcagcactcctgcgctcattcctgatgaattctcaacatgctaagatcaaaaatcaggcgataatcactgatgaaaccaatgactcgctcgtcgcgccgcaggagaagcaggtgcataagagcatcctgcctaactcgctgggcgtttcggaacggcttcagagactgaccttcccggcggtgtcagtcaaggtgaatggccacgatcagggacagaaccctccgctggatctggagactaccgcgcggttccgggtggaaacccacactcaaaagacgatcggtggaaatgtgaccaaggaaaaaccgccgtcattgattgtcccgctcgaatcccagatgactaaggaaaagaagataactggaaaggaaaaagaaaactcgcggatggaagagaacgcggaaaatcacattggtgtgaccgaggtgctcctggggcgcaaactgcaacactacaccgatagctatctgggcttcttgccttgggaaaagaagaagtactttcaagatctccttgatgaagaggaatcgctgaaaacccagctggcgtacttcactgacagcaagaacaccggacgccagctcaaagatacgttcgcagatagcctgcggtatgttaacaagatcctgaattccaagtttgggttcacctcccggaaggtgcccgcccatatgcctcacatgatcgaccggatcgttatgcaagaactccaggacatgttcccggaagaattcgacaagacgagctttcacaaggttcgccattccgaggacatgcaattcgctttttcgtacttctactacctgatgagcgccgtgcaaccgctgaacattagccaggtctttgatgaggtcgacaccgatcaatcaggggtgctgtcggatcgcgagatccgcactttggcaaccagaattcatgagctgcctctttcgctgcaggaccttaccggactggaacacatgttgataaactgttccaagatgctgcctgccgacattacgcaacttaacaacatcccgcccacgcaggagtcgtactacgacccgaacctgccgcctgtcactaagtcgctggtgactaattgcaagcctgtgaccgacaaaatccataaggcttacaaggacaagaataagtacagatttgagatcatgggagaagaggaaatcgcattcaagatgatccgcacgaatgtgagccacgtggtgggacagctggatgacatccgcaagaacccacgcaagttcgtctgtttgaatgacaatatcgaccacaaccacaaggatgcccagaccgtgaaggctgtcttgcgcgacttctacgagagcatgttccctatcccaagccaatttgaactcccgcgagagtaccgaaacagatttctgcacatgcatgaactgcaagaatggagagcttacagagacaagctgaagttctggactcactgtgtgcttgccaccctcatcatgttcaccatcttctcattcttcgcagagcaattgattgcgctgaaacgcaagatctttcctagacgccggatccataaggaggcgagcccgaataggattagagtc

SEQ ID NO: 16959 - DNA, 3768 bp, Artificial Sequence
  Description of Artificial Sequence: Synthetic coding sequence
atgctcttcaagctgctccagagacagacctacacatgtctctcccatcggtatgggctgtacgtgtgtttcttgggggttgttgtgacaatagttagcgcgtttcagttcggggaggtggtgctggagtggagcagggatcaataccacgtgttgttcgacagttacagggataatattgccggcaagtcgttccagaacaggctctgtctccccatgcccatagatgtagtttatacttgggtgaacgggaccgatctggaactgctcaaagagctacagcaggttagggagcaaatggaagaagagcagaaagctatgcgcgagattcttggaaaaaataccaccgagcccacaaagaagtccgaaaaacaattggagtgcctgcttacccattgtatcaaggtgcccatgctagtgctggaccccgccctgcccgcgaacattacactgaaagacctcccatccttgtatccttcttttcacagcgcttctgacatctttaacgtggccaaaccaaagaaccctagcactaacgtgtcagttgtcgtgttcgatagtaccaaggacgtcgaagacgcccattctgggctgcttaagggtaatagtagacaaaccgtatggcgtggttacttgacaacggataaagaggtccccggactcgtcctgatgcaagatctggcttttctgagtgggttcccaccgacctttaaagagaccaaccagctaaaaaccaagctgcccgaaaatttgagcagtaaagttaagttgcttcagctctattcggaggcatctgttgcgcttttaaagctaaacaaccccaaagacttccaggaactgaacaagcagaccaaaaagaacatgacaatagacgggaaagagctcacgatttccccggcgtatctgctgtgggacttgtctgccatttcacagtccaaacaggacgaggatattagcgcctcacgcttcgaggacaatgaagagctgcggtattcactgcgttctatagagcgacacgctccatgggtgaggaatatttttatcgtgacgaacggccagatcccctcttggctgaatctcgacaatccccgcgtcaccatagtaacgcaccaagatgtttttcggaatctatctcaccttccgaccttttcatctcctgcaatcgaatcccacatccaccgaattgaaggtctgtcccagaagtttatctatctcaatgacgatgtgatgtttggaaaggacgtgtggcccgacgacttttacagccacagtaaggggcagaaagtctacctgacttggcctgtccccaactgcgccgaaggttgccccgggagttggattaaagatggatactgcgataaggcatgcaataactcggcatgtgactgggatggcggtgactgtagtggtaattccggagggtctaggtacatcgccggaggcggcggaacaggctccataggcgtagggcaaccctggcagttcggcggtggcatcaactccgtgtcatactgtaaccagggatgtgccaacagctggcttgcagacaagttctgcgatcaggcgtgcaacgtgctgtcttgcgggtttgacgcaggagactgcgggcaggaccacttccacgagctgtataaggttatattgcttccaaaccagactcattacattattcctaagggtgagtgtctaccctacttcagcttcgccgaagtcgccaagcgcggggtagagggggcgtattccgacaacccaatcatcagacacgcttccattgccaacaagtggaagaccatccacctgatcatgcacagtggaatgaatgccaccacaattcatttcaacctaactttccaaaatacaaatgacgaggagtttaaaatgcagattacagtggaagttgacacccgagaggggcccaaattaaattcaaccgcccagaaaggttacgagaacctggtctcaccgattacattgttgccagaagcagagatcctctttgaagatatccctaaagaaaagcggtttcctaaattcaagcggcatgatgtcaattctacgcggagagcacaggaggaggtgaagatcccattggtgaatatctcactccttccaaaggatgcccagctttcacttaatacactggacctacaactggagcacggagacattaccctgaaggggtataacctttcaaaaagtgctttgctacgttcttttcttatgaatagtcaacacgcaaagattaagaatcaggccattatcacagacgagacgaacgatagcctggtggctccacaggaaaagcaggtgcacaaaagtattcttccaaactctctgggtgtcagcgaaaggctgcagcgactgacatttccggcagtgtctgtgaaagtcaacggccatgaccagggacagaaccctcccctggatctagagactaccgccaggtttcgcgtggagactcacacacagaagactataggcgggaatgtgacgaaagagaagcccccctcactgattgtgccactggaatcccagatgacaaaggagaagaagataactggaaaggagaaggagaacagccggatggaggaaaacgccgagaaccatataggagtcaccgaagtccttctgggtcgcaagttgcagcactatactgactcgtacctgggctttctcccatgggagaaaaaaaagtatttccaggacttgttagacgaagaagagtccctgaagactcagctcgcctatttcaccgacagcaagaacaccggaagacagcttaaagatacattcgccgatagtctccgctacgtcaacaaaatcctgaattctaaatttggttttaccagtagaaaagtgccagcccacatgccgcacatgatcgatagaatagtgatgcaggaactgcaggatatgtttcctgaagagttcgacaagacatccttccataaggtgagacacagtgaggacatgcagttcgcctttagctatttctattatttaatgagcgccgtgcagccactgaatataagccaggtttttgacgaggtcgacaccgaccaaagtggggttctgtctgatagagagatccgaaccctggccacgcgaattcacgagctcccattgtccctccaagaccttacgggacttgaacatatgctgattaactgttcgaagatgctgcctgcagacatcacccaactgaacaacattccaccaacgcaggaatcctattacgaccctaacctcccccccgtcactaagagtctggtgaccaactgcaaacctgtgaccgataagatccacaaagcatacaaagacaagaataagtacagatttgagatcatgggcgaggaggaaattgcttttaagatgatccgaaccaatgtcagccacgtggttggccagctggacgatattcggaagaacccccgcaagtttgtgtgcctgaacgacaatattgaccacaaccacaaggacgcgcagaccgtaaaagccgtgctgcgcgatttttacgagtcgatgtttccaatcccatcccaatttgagctgccccgtgagtaccgcaataggttcctgcatatgcatgaattacaggaatggcgtgcttaccgcgacaaattgaagttttggacccactgtgtcctggccacactcatcatgtttaccatcttttctttcttcgcagaacagctcatcgcacttaagagaaaaatcttcccccgcaggagaatccacaaggaagcttcgcctaacaggatcagggtt

SEQ ID NO: 16960 - DNA, 3768 bp, Artificial Sequence
  Description of Artificial Sequence: Synthetic coding sequence
atgctgttcaagctgctgcaacggcaaacgtacacgtgtttgagccataggtacggtctgtacgtctgttttctcggtgtggtggtgaccatcgtctccgcatttcaattcggcgaagtggtgctggagtggtcgcgcgatcaataccacgtcctgtttgatagctaccgtgataacatcgccggcaagagctttcagaaccggctgtgcctcccaatgccgatcgatgtcgtgtacacctgggtcaatggcactgatctggagcttcttaaagaacttcagcaggtccgcgaacagatggaagaagaacagaaggcaatgcgtgagatacttggtaagaacaccactgaaccgaccaagaagtcggaaaaacagctcgaatgcttgctgactcactgtattaaggtgccaatgctggtgctggatccggcgcttcccgcaaacatcactttgaaggatctgccaagcctgtacccttcgtttcactccgcttccgacattttcaacgtcgccaagccaaaaaacccttctaccaacgtttcggtggtcgtgtttgattccaccaaggacgtggaggacgcgcactcgggactccttaaagggaattcccggcaaaccgtctggcggggataccttacgacggataaagaagtgcctggactggttcttatgcaggatcttgcatttctttcgggatttcccccgacctttaaggaaactaatcaactgaaaaccaaacttccggaaaatctgtccagcaaggtgaagctgctccagctttacagcgaagcctccgtcgcgcttctcaaactgaacaaccccaaggactttcaagagttgaataagcaaacgaagaaaaacatgactatcgacggtaaggaactcactatttcgcctgcataccttttgtgggatctttcggcaatctcgcagagcaaacaggatgaagatatctcggctagccgctttgaagataacgaagagttgagatactcgttgagatcgatagaacggcatgcaccgtgggtgagaaacatctttatcgtgactaacggtcagattccatcatggctcaatcttgacaaccctcgcgttaccattgtcacccaccaggacgtgttcaggaacctttcacatctccccacgttctcctcccccgcaattgaaagccatattcatcgcatcgaaggcctttcgcaaaagtttatctaccttaatgatgacgtgatgtttggaaaagatgtgtggcctgatgatttctattctcatagcaagggacagaaggtgtaccttacttggccagtgcctaactgcgcagaaggttgtccaggttcatggatcaaggacggttactgtgacaaggcctgtaacaacagcgcatgtgattgggatggaggagattgctcggggaactcgggaggctcacgctacatagccggaggaggcggaactggctccataggtgtcggtcaaccctggcagttcggaggaggaattaactccgtgtcgtactgcaatcagggatgtgccaactcatggctggcagacaagttttgcgaccaagcatgcaatgtgctgagctgcgggttcgacgcaggtgattgcggacaagatcacttccacgaactgtataaggtgatactgctgcctaatcaaacccattacataattccgaagggggaatgtctcccgtacttttcctttgcagaagtggccaagcgcggagtggagggggcatacagcgataatccaattatccgccatgcctcgattgccaacaagtggaaaaccattcatctgatcatgcactcaggtatgaatgcaaccactattcacttcaacctgacgtttcaaaacaccaatgatgaggagtttaagatgcaaataactgtcgaagtcgacacccgcgaaggaccgaaactcaattcaactgcacagaagggttacgagaatctggtgtcgccgattaccctcctgccagaggcagagattctcttcgaggatattccaaaggagaaacgctttcctaaattcaaacgccatgatgtgaactcgacccgccgtgcacaagaagaggtgaagattccgcttgtgaacatctctctcctccccaaggacgcgcaactttccttgaatactttggacctgcagctggaacatggagatattaccttgaaggggtacaacctttcgaaatcagcgctccttcggagctttctcatgaactcgcaacatgcaaagattaagaatcaggctattatcaccgacgaaaccaacgatagcctggtcgcgcctcaggagaaacaagtccataaaagcatcctgcccaacagcctcggggtgtcggagcgactgcagcgactgacctttcccgcagtgtccgtgaaggtcaacgggcatgaccaaggacaaaatcctcccttggatctggaaactactgccagattccgcgtggaaacccacacccaaaaaactataggcggcaatgttactaaggaaaaacctccatccttgatcgtgcctcttgagagccaaatgactaaagaaaagaagataacgggaaaggaaaaggaaaactcccgtatggaagaaaacgcagagaatcacatcggagtgactgaggttctgctgggacgtaagctccagcactacactgattcctacctcggattcctcccttgggagaagaagaagtattttcaagatttgcttgatgaagaagagtcacttaaaacccagcttgcgtactttaccgattcgaagaacacggggcgtcaactgaaggatacttttgcagattccctccggtatgtcaacaagattctgaacagcaagtttggattcacttccagaaaggtgccagcgcacatgccacacatgatcgatagaattgtgatgcaggaactccaggacatgtttccagaggagtttgataaaacttcctttcacaaggtgaggcattccgaggatatgcaattcgctttttcgtacttctactaccttatgtcagctgtccaaccattgaacataagccaggtgtttgacgaggtcgacaccgaccaatcaggtgtgctttcggaccgggaaatacgaacccttgccactagaatacacgagctccctctgtcactccaagaccttacgggtctggaacatatgctgataaactgttcaaaaatgttgccagcggacattactcagctgaataacatccctcctactcaagaatcctactacgaccctaacctgcctcctgtgaccaagtcgctggtcactaattgtaagcctgtcaccgataagattcataaagcatacaaggacaagaacaagtacaggtttgagattatgggtgaagaagagatcgctttcaaaatgatcagaactaatgtgtcacacgtcgtgggccagctggacgatattagaaagaatcctcgaaagtttgtgtgtctcaatgataacattgaccataaccataaagacgcacagaccgtgaaagcagttctgagagacttctacgaaagcatgttccctatcccgtcccaatttgaactgccaagagaatacagaaatagatttctgcatatgcatgaacttcaggagtggagggcatatcgggataagttgaagttttggacgcactgcgttctggcaacgctgataatgttcaccatcttctcgttctttgccgaacaactcattgcactcaaacgtaaaatcttccccagaagaaggatccataaagaggcatcgccaaatcgcatccgtgtg

SEQ ID NO: 16961 - DNA, 3768 bp, Artificial Sequence
  Description of Artificial Sequence: Synthetic coding sequence
atgctgttcaaactcctgcaaagacagacctacacttgtttgtcgcaccggtacggactgtacgtgtgctttcttggggtcgtggtgaccatcgtgtcagccttccaatttggtgaagtggttctcgagtggtcccgtgaccaataccacgtgctcttcgactcgtaccgagacaatatcgccggaaagtccttccaaaacaggctgtgtctgcctatgccaattgacgttgtgtacacttgggtgaatggaaccgatctggaactgctgaaggaactgcaacaagtgagagagcagatggaagaagagcagaaagcgatgcgagaaatcctcggaaagaacactactgaaccgactaagaaatccgaaaagcaactcgaatgcctcctcacgcactgcatcaaggtgcctatgctcgtcctggatccagctcttcctgcaaacatcactctgaaggacctgccatcactctacccgtccttccacagcgcatcagatatcttcaatgtggcaaagccgaagaacccatcgacgaatgtgtcagtggttgtgttcgattcgacgaaagatgtggaggatgcccattccggcctcttgaaaggaaattcccgccaaactgtctggcgcggataccttaccaccgacaaagaggtgccggggctggtcttgatgcaagacttggccttcctgtcgggtttcccaccaaccttcaaagaaactaaccaactgaaaaccaagctgccggaaaatctgtcctctaaggttaaactgttgcaactctactccgaggcttcggtggctctcctgaaactgaacaatcctaaagacttccaagagctgaacaagcagacgaaaaagaatatgaccatcgacggaaaggaattgaccatctcgcctgcgtacctcctctgggacctttccgcgatctcccagtcaaagcaggatgaggacatctccgcatcgcggttcgaagataatgaagaactgagatactccctgcgctccatcgagcggcatgctccatgggtgcgcaacatctttatcgtgaccaacggccagatcccatcgtggttgaacttggacaacccacgggtcactatcgtgactcaccaggacgtctttcgcaatctgagccatctcccaactttctcctcgccggccattgaaagccacatccatagaatcgaagggctctcgcagaagtttatctacctcaatgacgacgtgatgttcggaaaggatgtgtggccggatgacttttacagccattcgaagggacagaaggtgtacctcacttggccggtgccgaactgcgctgaggggtgccccggctcgtggatcaaagatgggtactgtgataaggcgtgcaacaattcagcgtgcgactgggacggaggagattgctccgggaacagcggaggctcgcgttacatagctggaggcggagggactggctcaatcggagtgggccagccgtggcagttcggtggagggattaactctgtgtcgtactgcaaccaaggatgcgccaattcatggctcgccgacaaattctgtgaccaggcttgcaacgtgttgtcgtgcggtttcgatgcaggcgactgtggacaagaccacttccatgaattgtacaaggtgattctgctgccgaaccaaactcactacattatcccaaaaggagaatgcctgccttacttcagcttcgccgaagtcgccaaacgcggagtggagggtgcatactccgataatcccatcatccgccacgcgtccatcgccaacaagtggaaaacgatccacttgatcatgcacagcggtatgaatgcaactaccatccacttcaatctgacgttccagaacaccaacgacgaggagtttaagatgcagatcactgtcgaggtcgacactcgcgaaggcccgaaattgaattccactgcacaaaaggggtacgagaatctcgtctcgcctattaccctgctgcccgaagcagaaatcctgttcgaggacattcccaaggagaagagattccctaagtttaagaggcacgacgtgaattcgacccggcgcgcgcaggaggaagttaagatcccgctggtcaacatctctctgctgccaaaagacgcacaactgagcctcaacaccttggatctccaacttgagcatggtgacatcaccctgaagggatacaacctgtccaagtcggcactcctgcgcagctttctcatgaatagccagcacgccaagatcaagaaccaggctatcatcaccgacgagactaatgactcgctcgtggctccgcaggaaaagcaagtgcacaaatctatcctgccgaacagcctgggagtgtcggagagactgcaacgcctgaccttccctgcagtgtcggtcaaggtcaacggacacgatcaaggacaaaacccgcctctcgacctggaaactaccgcgcgcttccgggttgaaacgcatacccagaaaactatcgggggcaacgttaccaaggagaagccgccgtcgctcatcgtgccactggaaagccaaatgacgaaggagaagaagatcaccggaaaagagaaggaaaattccagaatggaagagaacgccgagaaccacataggtgtgactgaggtgctgctgggcagaaaactccagcattacaccgacagttacctgggatttctgccttgggagaagaagaaatacttccaggacctgctggacgaagaagaatccttgaaaactcagttggcgtatttcactgactcgaaaaacaccggtcggcaactcaaggacaccttcgctgactcgctgaggtacgtgaacaaaatcctcaattcaaagtttggattcacttcaaggaaggttccggcccacatgccacatatgattgatcggatcgtgatgcaggaactccaggacatgtttcctgaggaatttgataaaacctccttccacaaggtgagacatagcgaggatatgcaattcgctttctcgtatttctactacctcatgtcggctgtgcaaccgctgaacatttcccaggtattcgacgaggtcgatactgaccagagcggagtgctgtcggatagagagatcagaaccctggctacccgcatccatgagctgccactttcgctgcaggacctcaccggactcgagcatatgctgatcaattgctccaagatgctgccagcagatatcacccaactcaacaatatcccgccgacccaagagtcgtactatgacccgaatctgccgcctgtgactaagtcgctggtcacgaattgcaaaccagtgaccgacaagatccacaaggcgtacaaagataagaacaagtatagattcgaaatcatgggagaagaggaaattgccttcaaaatgatccgcactaacgtgtcgcatgtggtgggacagcttgatgacattagaaagaacccacggaaatttgtatgcctgaacgataacatcgatcacaaccataaggacgcgcagactgtgaaggccgtgctgcgcgatttctatgagtccatgttccccatccctagtcagtttgaactcccccgcgaatataggaatcgcttcctgcacatgcacgaactccaggagtggcgcgcatacagggataagctgaagttctggacccattgcgtgctggccaccttgatcatgttcacgatcttctccttcttcgccgaacagctgatcgcactcaagaggaagatattccctcggcggcggatccacaaggaagcctctccaaataggatccgggtt

SEQ ID NO: 16962 - DNA, 3768 bp, Artificial Sequence
  Description of Artificial Sequence: Synthetic coding sequence
atgctcttcaaactgctgcagcggcaaacctacacctgcctgtcccaccggtacggactgtacgtgtgcttcctgggagtcgtggttaccatagtcagtgccttccagttcggcgaagtggtgttggagtggtccagagatcagtatcatgtattgtttgactcctaccgggataacatcgccgggaagagtttccagaatcggctgtgcctgcctatgcctattgacgtggtttacacttgggtgaacggaaccgatctcgaactcctcaaagaactgcagcaggtcagagaacagatggaggaggaacagaaagcaatgcgagagatactggggaagaatacaacggagccgaccaagaaatccgagaaacagctggagtgtctgctgacacactgcatcaaggtcccaatgctggtgttggacccagcactgccagccaatataacacttaaggacctgccatcactgtaccccagcttccactctgcgagcgatatctttaatgtggccaaacccaagaatccatccaccaacgtgtccgttgttgtcttcgacagtaccaaagatgtcgaggatgctcacagtggactgttgaagggtaattcacggcaaacagtgtggcgcggatacttgaccacggacaaagaggttcctggcctggtactcatgcaggacttggcttttctctctgggttccctcctacctttaaggaaacgaatcagcttaagaccaaacttccggaaaacctctcatccaaagtaaagcttctccagctgtacagcgaggctagcgtagcgctcctgaaacttaataatcccaaagatttccaggagctgaataagcaaaccaaaaaaaatatgaccatcgatggcaaggaactgaccatctcccctgcgtatcttctgtgggacctgagcgctattagtcaatctaaacaggacgaggatatcagcgcatcacggttcgaggacaatgaggagctgcggtattccctcaggagtatagagagacacgcgccttgggttcgaaatattttcattgtcacgaacggacagatcccttcctggcttaatctggataaccccagggtgaccattgtgacccatcaggatgtgttcaggaacctttctcatctcccaacttttagctcacccgccatagaatcccacatacaccggattgagggtctctcacagaaatttatataccttaacgatgatgttatgtttggcaaagacgtgtggcccgacgacttttactctcacagcaaaggtcagaaggtgtatctgacctggcccgtgcccaattgcgctgaagggtgccctggaagttggatcaaggatggctattgcgataaagcctgtaacaattcagcttgcgactgggatggtggagattgtagtggcaatagtggtggctctcggtacatagccggcggcgggggcactggctctattggtgttggccagccttggcagttcggggggggaattaattcagtgtcatactgcaatcagggatgtgctaactcatggctcgcagataagttttgtgatcaagcgtgcaacgtgctgagttgcggatttgacgcgggtgattgtggccaggaccattttcacgagctttacaaggttatcctgcttccgaaccagacccattatatcatccctaagggcgagtgccttccctactttagttttgctgaagtggctaaacgcggagtggagggcgcctactctgacaatccaataattcgccatgcctccattgcgaacaaatggaagacaatccatcttatcatgcactcaggaatgaacgctacaaccattcactttaacctgacatttcagaataccaatgacgaggagtttaagatgcaaatcaccgtcgaagtggacacaagagagggcccaaagttgaactctactgcccagaaaggatacgagaacttggtctcccccataaccctgctgccagaggctgagatcctgtttgaggacatacccaaggaaaagaggttccctaagtttaaaagacacgacgtgaattcaactcgaagagctcaggaagaagtcaagattcccctggtcaacatctctctgctccccaaagatgcccagctgagtctgaataccctcgacctccagcttgagcatggagatatcacactgaaaggatacaacttgagcaaatccgctctgctgcggtctttcctgatgaactcccaacacgccaagatcaaaaatcaggctattatcacagacgaaaccaatgattctctggtggcccctcaggagaaacaggtccataaaagcattctgcccaattcactgggagtcagcgaaagactgcaacggctcactttcccagcagtctcagtcaaggtgaacggccatgatcaaggtcagaacccccccttggatctggagacgacagcgcgctttcgagtggagactcacactcagaaaacgatcggggggaacgttacaaaggagaagcccccaagcctgatcgtccctcttgagtcacagatgactaaagaaaagaaaatcaccggaaaggaaaaagaaaactccagaatggaggaaaacgccgagaatcatattggcgtaacagaggttcttctgggccgcaagctgcagcattacacagactcctacctcggttttctgccatgggagaaaaagaaatactttcaggacttgctcgacgaggaggagagcctcaagactcagttggcgtactttaccgatagtaagaacacaggtcgccagctgaaggatactttcgccgacagcttgcgctatgtcaacaaaatcctcaatagcaaattcggctttactagcaggaaagtgccggcacatatgccgcacatgatcgaccggatagtgatgcaggagcttcaggatatgtttcctgaagagttcgataaaaccagctttcacaaagtcaggcattccgaagatatgcagtttgcgttctcatacttttattacctgatgagtgccgttcagcccctcaacatttcccaagtctttgacgaggtcgacacagatcagtcaggggtgctgagcgatcgcgagattaggactcttgccacacggattcacgagctccctctgagcctgcaagacctgacagggctcgaacacatgctgattaactgttccaagatgctgccagcggacatcactcagctcaataatattccccctacccaagaaagctattatgaccctaatttgccgcccgttaccaagagcctggtgactaattgtaaaccggtgaccgataaaattcacaaagcctataaggacaagaataagtaccgctttgaaatcatgggcgaagaggagattgcattcaagatgattagaaccaacgtgtcccacgttgtgggacagctggacgatatacgaaaaaaccctcgcaagttcgtatgtttgaatgacaacatcgaccacaatcacaaagacgcccagacagtaaaagcggttctccgagacttctacgaaagcatgttccccattccttcacagttcgagctccctcgagaataccggaatcgatttctgcatatgcacgagctccaggagtggagagcctaccgggacaaactcaagttctggacacattgtgttctggccacactgataatgtttacaattttctctttttttgccgagcagttgatagcccttaagcgcaaaatctttcccaggaggcggatccacaaagaggcctctccgaaccggattagagtt

SEQ ID NO: 16963 - DNA, 3768 bp, Artificial Sequence
  Description of Artificial Sequence: Synthetic coding sequence
atgctttttaagttgcttcagcgtcagacgtacacttgccttagccatcggtacggtctttacgtgtgctttcttggcgtggtagttaccatagtgtcagcatttcagttcggagaggtcgtgctggagtggtcaagagatcagtatcatgtgctttttgatagctatcgggacaatatagcagggaagagttttcaaaaccggctgtgtctgcctatgccaattgacgtcgtgtatacttgggtaaatggaacggatttagaactcctgaaggagttgcagcaggtgagggagcagatggaggaggagcaaaaggcgatgagggaaatcctggggaagaatactacagagcccactaaaaaatcggagaagcaactggaatgcctgctcacgcattgtatcaaggttcccatgctggtgttagatccagcgctgcctgctaacatcacacttaaggacctacctagtttgtacccaagcttccattctgccagcgatattttcaacgtggccaaacccaaaaatccttcgactaacgtctctgtggtggtgttcgactccactaaggacgttgaggacgcccacagtgggctgttgaagggcaacagccgtcagacagtatggcgcggatacctaacgaccgacaaggaagtgcctggtcttgtgctgatgcaagatttggcctttctcagcggattccctcctacatttaaagaaactaaccaacttaagaccaaactccctgaaaatctgagtagtaaggtgaagctccttcagctctattcggaggcttccgtggcgttgctgaagttaaataacccaaaggacttccaggagcttaataagcaaacaaagaaaaacatgactattgatggaaaggaactaaccatatcaccagcctacctcctttgggatcttagcgcaattagccagagcaagcaggacgaagacattagtgcctcaagattcgaggacaacgaggaactgcggtacagtctgagatccatcgagcggcatgcgccttgggttcgaaacatttttattgtgactaatgggcagataccgagttggctgaatctggacaatccacgggtgaccatcgttacacatcaggatgtgtttcgaaacctttcacatctcccaacgttcagctctcccgccattgagagtcatattcataggatcgaggggctcagccagaaatttatatatcttaatgatgatgtgatgttcggcaaagacgtgtggcccgacgacttttattcacacagtaaaggccaaaaagtgtaccttacatggccggtgcccaattgcgcagaaggctgtcccggctcgtggattaaggacggatattgcgacaaggcctgtaacaattcagcgtgcgactgggacggaggcgactgctcaggaaactctggcggatcccgttacatcgcgggtggtggtggcacagggtctatcggcgtggggcagccctggcagtttggcggtggcattaactcagtctcgtattgtaatcagggttgcgcaaactcctggctggccgataaattctgcgatcaggcctgcaatgtgttatcttgcggcttcgacgccggggattgtggccaggaccattttcacgaactctataaggtgattttgctgcccaaccagacacattacatcatccccaagggagaatgcctgccctacttcagttttgccgaggtcgccaagagaggagtagagggcgcatactcagataaccccatcatacgtcacgcaagcatcgccaacaaatggaagaccattcatttgattatgcacagtggtatgaatgcgacaacaatccattttaatctaacttttcagaacactaatgacgaagaatttaaaatgcagatcactgtcgaggttgataccagagaagggcccaaactcaatagtactgctcaaaaggggtacgaaaatcttgtgtctccaattacgctactgcccgaggctgaaatcctcttcgaggacatccccaaagagaagcgatttccaaagttcaagagacacgatgtgaactcaacaagacgggctcaggaagaggttaaaatcccactggttaatatctccctgcttcccaaggacgcacagctgtccctgaataccctggatttgcagctggagcacggggatatcactttgaagggctataatctcagcaagtcagccttgctgagatcgttcctgatgaatagccagcacgccaagataaaaaatcaagctattatcaccgatgagacgaacgacagtctggtcgccccacaggagaagcaggtgcacaaatccatcctgcccaattctttgggggtctcagaacggctgcaacgactgacgtttccggcagttagtgtcaaggtgaatggccacgaccaaggacagaacccaccactggatttggagactacagctcggtttcgggtcgagacccacactcaaaaaacgatcggcggcaatgttactaaagagaaaccgccatccctcatcgttccacttgagtctcagatgaccaaggagaagaaaatcactggaaaagaaaaagagaacagccgcatggaagaaaacgccgagaatcatatcggggtcaccgaagtcctgttaggaagaaagctgcagcattacaccgattcctatttaggctttctgccctgggagaagaaaaagtattttcaggaccttttagacgaagaggaatctcttaagacccaactcgcgtattttacggactcaaagaacactgggcgccagctgaaggatacatttgccgattctttacgttacgtgaataaaattctgaattcaaaatttggtttcacaagcaggaaagtccctgcacacatgcctcatatgatcgatcgaattgtcatgcaggaactgcaggacatgtttccagaagagtttgataaaaccagctttcacaaggtgaggcatagcgaggacatgcaattcgccttctcatatttctattatctgatgtccgccgtccaacccttgaatatcagccaggtgttcgacgaagtggacaccgatcaatctggggtgctatccgaccgcgagattcgcaccctggccaccagaattcacgaattacctctatccctacaagatctgacaggcctagaacatatgctaatcaactgtagtaaaatgctgccggcggacattacacagctaaataacattccgccaactcaagaaagctactatgatcccaacctcccacccgttacgaagtcgctagtgacaaactgtaaaccagttaccgataaaatccataaagcctataaggataagaacaagtatcggttcgagattatgggcgaagaagagatcgctttcaagatgattcgcactaacgttagccacgtggtggggcagctcgacgatattagaaaaaaccctcgcaagttcgtctgtcttaatgataatatcgaccataaccataaggacgctcagactgtgaaagccgtgctgcgggatttctacgagtccatgtttcccataccttcccagttcgaactgcctcgagagtacagaaacaggttcttgcatatgcacgagcttcaagagtggagagcttatagggataagctcaagttctggacacactgcgtgctggctacccttattatgttcaccattttttctttctttgccgagcagctgatagctttgaaacgaaaaatcttccccagaaggagaatccataaggaggcatctcccaaccgtatcagagtg

SEQ ID NO: 16964 - DNA, 3768 bp, Artificial Sequence
  Description of Artificial Sequence: Synthetic coding sequence
atgttgttcaaacttttacaacgacaaacctatacttgcttgagtcaccgatacggtctatacgtttgcttcttgggagtagttgtgactattgtttctgcattccagttcggagaagtggtgctagaatggtcacgtgaccaatatcatgttttgtttgattcctatcgggataatatcgctggaaagtcgttccaaaatagattatgtttacctatgccgattgatgtggtctatacatgggtaaatggaaccgatcttgaattactcaaagaattacaacaggtacgtgagcaaatggaagaagaacagaaggctatgcgtgagatcctgggaaaaaatactacagaaccgactaagaaaagcgaaaaacaacttgaatgcttgttaacgcattgtataaaagtgccaatgttggtccttgatcctgcactcccggctaatataactcttaaagatcttccatcactatatccatcattccattcggcctcagacattttcaatgtggcaaaaccaaagaacccttctaccaatgtgtccgttgtggtgtttgattcaacgaaggatgtggaagacgcacattcagggcttcttaagggaaatagccgtcaaacggtttggagaggttatcttaccacggataaagaagtgcctggactggtgcttatgcaagacttggcttttttatcgggatttccgccaacatttaaagagactaaccaattaaaaacgaagttgccagaaaatctgtcatctaaagtaaaattgcttcaattatactccgaggcttcagtggctttgctgaaattgaacaatccaaaagactttcaagagttgaataaacaaacaaaaaagaatatgacgatcgacggtaaggaacttacaataagtccagcttatcttttgtgggatctatctgcaatctctcagtctaaacaagatgaagatatatctgcgagcagattcgaagataatgaggaactccgctattccctcagatctatcgaacgccacgctccctgggttaggaacatttttattgtaactaacggtcagatcccctcatggttaaatctagataatccacgagtcacaattgtaactcaccaagatgttttcaggaatctgtcacatctccctacgttttcgtcaccggcaatagagtctcatattcatcgtattgaaggactgtctcagaagttcatttatttgaacgatgatgttatgttcggtaaggatgtatggccagatgacttctatagtcactcaaagggccaaaaagtttacttgacttggccagtccctaattgtgcagaggggtgcccggggagctggattaaggatggatattgtgataaggcatgcaataatagtgcctgtgactgggatggcggagattgctcgggaaattccggaggaagccgatacatcgctggaggcggaggaacgggttctatcggagtgggtcagccatggcaatttggaggtggaattaatagcgtgtcttattgtaatcaaggttgtgctaattcttggctcgctgacaaattctgcgaccaagcatgtaatgtgctatcgtgtggtttcgatgccggtgattgtggacaagatcattttcatgagttgtacaaggttattctactcccaaatcagactcattacatcattccaaagggagaatgcttaccctatttctcgtttgctgaagttgcaaagcggggagtagagggagcctatagcgataatccaattatacgccatgcttctattgccaacaaatggaagacaatacacctcataatgcattcaggaatgaacgcgacaactatccattttaatttgacgttccaaaatactaacgacgaggaattcaaaatgcagatcactgttgaagttgacacacgtgagggaccgaagttgaattcaacggctcaaaaaggatacgagaacttggtgtctcctattacattgttgccagaggctgagatcctattcgaagacattcctaaagagaaaagattcccaaaatttaaacgacacgatgtcaattccactaggcgcgcccaggaagaagtcaaaattccactcgtcaatatttccctcctcccaaaagatgctcaactcagcctgaatacactcgatttgcaacttgagcacggcgatattacactgaagggttataatctttcaaagtcggcattgcttaggtcattcttgatgaattctcaacatgctaagatcaagaatcaagcaattataaccgatgaaacaaacgactcacttgtcgctccacaggagaagcaagtacataagtccattcttccaaattcattaggagtcagcgaacgtctacaacgtttgaccttcccagctgtgtcagtaaaagtaaacggacatgatcaaggacaaaatccaccactcgatcttgaaacaaccgcaagatttcgtgttgagactcatactcagaagacaatcggtggaaacgtcacaaaagagaaaccgccaagccttatagtaccacttgagtcgcagatgactaaagaaaaaaaaattacgggaaaagaaaaggaaaactcgcgtatggaggagaacgccgagaatcatatcggtgtaactgaagttcttttgggtagaaagctacaacactatacagatagttacttaggatttttgccatgggaaaaaaagaaatactttcaagatttgttagacgaggaagagtcattgaaaacacaacttgcatattttactgactcaaaaaatacaggacgtcaactgaaggatactttcgccgattcactaagatatgttaataagatcttaaactcaaagttcggatttaccagcagaaaagttccagctcacatgccccacatgattgatagaatcgttatgcaggaattgcaagatatgtttccggaagaatttgataaaacttcattccataaggttaggcattcggaagatatgcaatttgcattctcatacttttactaccttatgtcggcagtgcaaccgctaaacatcagtcaggttttcgatgaggttgataccgatcagagcggtgtgctctctgacagggagatcaggactttggcgactcggatccacgaactcccattgagtttgcaagatttgactggattggaacatatgttaattaattgcagtaagatgttgccagcggacattacacaactcaacaatatcccacccacacaagagagctactatgacccgaatctgccacctgtaactaaatcattagttacaaattgtaagccagtgaccgataaaattcataaggcatataaagacaagaataaatatagatttgaaattatgggagaagaagagatcgcattcaaaatgattcgcactaatgtttcgcatgtcgttggacagctcgatgacattaggaaaaatcctcgcaagttcgtttgtctaaatgacaatattgatcataatcacaaggacgctcagacagtaaaagcagttctgcgagacttctatgaatctatgtttccgatcccaagtcaattcgaactcccacgagaatataggaatcgctttcttcatatgcatgagcttcaggagtggcgtgcttatcgagacaagttaaaattttggacgcattgtgtcctggccaccttgattatgtttactattttctcgttcttcgctgaacaattgatcgcactgaaacgaaagatttttccacgaaggagaatccacaaggaagcgtctccgaaccgtattcgagtt

SEQ ID NO: 16965 - DNA, 3768 bp, Artificial Sequence
  Description of Artificial Sequence: Synthetic coding sequence
atgctgttcaagctgctgcaaagacagacctacacgtgtctgtcccatcgatacggcctgtacgtgtgctttttgggagtggtcgtcactatcgtgtccgcctttcaattcggagaagtcgtgttggaatggtcccgtgatcagtaccacgtgctgtttgactcgtaccgcgacaacatcgctggaaagtcattccaaaaccgcctgtgcttgccgatgccaattgatgttgtgtatacttgggtgaacggaaccgacctcgaactgctcaaagaacttcaacaggtgagagagcagatggaggaagaacagaaggcgatgcgggagatcctggggaagaataccactgagccgaccaagaagtctgagaagcaacttgaatgcttgctgacccattgtatcaaggtgccgatgctcgtgctggaccctgcgctcccagcgaatatcactctgaaggatctgccaagcctctacccgtctttccactccgcctcagacattttcaacgtcgctaaacctaagaatccgagtacgaacgtcagcgtggtggtgttcgactcaaccaaggatgtggaggacgctcacagcggccttctgaagggaaatagcaggcagaccgtgtggcggggatatctgaccactgacaaagaagtgcctggcctcgttctgatgcaagacttggcattcctgtccggctttcctccaacttttaaggagactaatcagctgaaaaccaagctgccagaaaacctctccagcaaggtgaaactgctccagctgtacagcgaagcctcggtggcgttgctcaaactgaacaatccgaaagactttcaggagctgaacaagcagactaaaaagaacatgactatcgacggcaaggaattgaccatctcgccggcctacctgttgtgggacctctccgcgatctcgcagtccaagcaggacgaggacatctcagcgtcccgcttcgaggacaatgaggaactccgctacagccttagaagcattgaaaggcacgcaccgtgggtccgaaacatcttcatcgtaaccaacggccagatcccgtcctggctcaatttggacaacccgagagtcaccatcgtcactcaccaggatgtctttcgaaacctctcgcatctcccgaccttctcctcacctgccatcgaatcacacatccatagaatcgagggactctcccaaaagttcatctacctcaatgatgacgtcatgttcggaaaagacgtgtggcctgacgatttctattcccactcgaagggacagaaagtgtacctgacttggccggtcccgaactgcgcggaaggatgccccggttcgtggattaaggatggatactgcgacaaagcctgcaacaattcggcctgcgactgggacggtggagactgctcaggcaattcaggaggatcccgctacatcgctggcggcggaggaacgggttcaattggtgtggggcagccttggcagttcgggggagggatcaactccgtttcttactgcaaccaaggctgcgcgaattcgtggcttgccgacaagttctgcgaccaagcctgtaacgtgctgtcatgcggattcgacgcgggcgattgcgggcaggatcacttccatgaactctacaaggtcattctgctgcctaaccagactcattacatcatcccgaagggagagtgtttgccgtacttttcctttgctgaagtggcaaagcgcggcgtagaaggagcctacagcgataaccccatcatccggcatgcttcgatcgctaacaagtggaaaaccatccacctgatcatgcattccggcatgaacgccaccaccatccatttcaatctgaccttccaaaataccaacgacgaagaattcaagatgcaaatcaccgtcgaagtggatacccgcgagggacctaagctgaatagcactgcacagaagggatacgaaaacctggtgtcaccgatcaccctgctgccggaagcggaaatcctgttcgaagatattccaaaggaaaagaggttcccgaagtttaagcgccatgacgtgaactcgactagacgggcgcaggaggaagtgaaaatcccgctggtcaacatctcgcttcttccaaaggacgcccaactcagtctgaataccctcgatctgcagctggagcacggagacatcacgctgaagggttacaacctgtccaagtcagcgctccttagatccttcctgatgaactcgcaacatgccaagatcaagaatcaggcgatcattactgatgaaacgaacgactcgctcgtcgctccacaagaaaagcaagtgcacaaatcgatcttgccaaatagcttgggtgtctccgagaggctgcaacggctgacttttcccgccgtctccgtgaaggtcaatggacatgatcagggacaaaatccgccgttggacctggaaaccaccgcgcgcttcagagtcgaaacccacactcaaaagaccatcggcggaaacgtgaccaaggaaaagccacccagcctgatcgtgcctctggaatcacaaatgactaaggagaaaaagatcacgggcaaggaaaaagaaaattctaggatggaggaaaacgcggaaaatcatatcggagtgactgaggtgctcctgggacgcaagctccaacattacactgactcgtacctgggattcctgccgtgggagaagaaaaagtacttccaagacctccttgacgaagaagagtctctcaaaacccagctcgcctactttactgacagcaagaacacgggacgccagttgaaggacacctttgcagattcacttaggtacgtgaacaagatcctcaattccaagttcggatttacttcccggaaggtcccagcccacatgccgcacatgatcgaccgcatcgtcatgcaggaactgcaagacatgttccctgaggagtttgacaagactagcttccacaaagtccggcatagcgaggacatgcagtttgccttctcgtacttctattacctcatgtccgcagtgcagcctctgaacatctcacaagtgttcgatgaggtggacactgaccaatctggagtcctctccgaccgagaaatccggactctggcaacccggatccatgagctgcccctgtccctgcaggacctgaccggattggagcacatgctgatcaattgctcgaagatgctccccgcagatatcacccaactgaacaacatcccaccgactcaggagtcctactacgacccaaatctcccgccggtgactaagtcgctggtgactaattgtaagccggtaaccgacaagatccataaggcgtacaaagacaagaacaagtaccgcttcgagattatgggtgaagaggaaatcgcctttaagatgattcgcacgaacgtgtcacacgtggtgggacagctggacgatatccgcaagaatcccaggaaattcgtgtgtctcaacgacaatattgatcacaaccataaggacgcccagactgtgaaagctgtgctgcgcgatttctacgagtccatgttcccaatcccttcccagtttgaactgccgcgcgaataccgcaaccgcttcctccacatgcacgagctgcaggaatggcgcgcctaccgggataagttgaagttctggacccattgtgtcctggcgacgctgatcatgttcaccatcttctcatttttcgcggaacaactcatcgccctcaaaagaaagatcttcccgaggaggaggattcataaggaggcctcgcctaaccgcatcagagtg

SEQ ID NO: 16966 - DNA, 3768 bp, Artificial Sequence
  Description of Artificial Sequence: Synthetic coding sequence
atgttgttcaagctgttgcagagacagacttacacgtgcttgtctcataggtacggcctctatgtgtgcttcctcggagtggtggtcaccatcgtctcagcctttcagtttggagaggtcgtgttggagtggagcagagaccagtaccacgtgctgtttgacagctatcgagacaacatcgctggaaagagcttccagaatcggctctgtcttccgatgcccatcgacgtcgtttacacctgggtcaacggaaccgaccttgagttgcttaaagagctacaacaggtcagagaacagatggaagaggaacagaaggcgatgcgggagatcctgggcaaaaacactacagagccgaccaagaagtcagagaagcagcttgaatgtctgcttacccattgcattaaagttccaatgttagtgcttgatccagcgctgccagcaaacattaccctgaaagacctgccctccctgtacccatctttccatagcgcctctgacatctttaacgtggctaagcccaagaacccaagcacgaacgtctctgtggtggtgttcgacagcaccaaagacgttgaagacgcccacagcggactgctgaaaggcaattcaagacagaccgtttggcgcggctatctcaccacagacaaggaggtgcccgggctggttctgatgcaagacttggcttttctttcagggttcccgcctacctttaaagaaacaaaccagttgaaaaccaaattgcctgaaaatctcagtagcaaagtcaagcttctccagctgtattcggaggccagcgtggctttactgaaactgaacaaccccaaagactttcaggaactgaataagcaaaccaaaaaaaacatgactattgacggaaaggagctgaccattagcccagcgtatctgctgtgggaccttagcgctataagccaaagtaaacaagacgaggatatctccgccagtcgttttgaggataacgaagagttgcgctatagcctgcgcagtatagaaaggcacgcaccttgggtcaggaatatctttatagtgacgaacggacaaatcccttcctggctgaaccttgataacccacgggtgaccattgtgacccaccaagatgtgttccgaaacttgtcacatttaccaaccttctctagccccgcaatcgagagtcacattcatcgcatcgaaggcctgtcacaaaaatttatctacctcaacgacgatgtgatgttcggcaaagatgtttggcctgatgacttttacagtcattcaaagggccaaaaagtttatctgacctggccagtgcccaattgcgcggaaggctgcccaggaagctggatcaaagacggatattgtgacaaagcttgtaacaattctgcatgtgactgggatggcggcgactgctcaggaaactctgggggctcaaggtacatcgccggggggggaggaaccggatccatcggagtaggccagccctggcaatttggagggggaattaacagcgttagctactgtaaccagggatgcgctaatagctggctggcggacaagttctgcgaccaggcttgcaacgtgctctcatgtgggttcgacgccggcgattgcgggcaggatcattttcatgagttgtacaaagtgatactcctgcccaaccagactcactacatcatcccgaagggagaatgtcttccctatttcagcttcgctgaggttgctaaaaggggtgttgagggtgcatattctgataacccgataatcaggcatgctagcatagcaaataaatggaagacaatacacctgatcatgcacagcgggatgaatgccaccaccatccatttcaacttgacattccagaacacaaacgatgaagagtttaagatgcaaataaccgtagaggtcgacactagagagggacccaaactgaatagtactgcgcagaagggctacgaaaatttggtgagccctattactctcttaccggaagccgaaatcctgtttgaggacatccccaaagaaaaaagattcccaaaatttaaacgccatgatgtgaactctactcgccgcgcccaggaagaggtgaaaatcccgctggtgaatatctctttgctccccaaggacgcgcagctgtcgttgaatacactcgatttgcagctggaacacggcgatatcacactcaaggggtataatctgtccaaaagcgcacttctgcgctctttcctgatgaacagtcagcacgctaaaatcaagaaccaggccattataaccgatgagactaatgatagtctagttgccccccaggaaaaacaagtccataaaagcattctgcccaacagcttgggtgttagcgaaagactccagcggctcacatttcccgcagtttctgtcaaagtgaatgggcatgatcagggacagaaccctcctctggatcttgagacgaccgcacgtttccgagtagagacacatacacagaaaactatcgggggcaacgtcaccaaggaaaaacccccttccctgatcgtccctttggaaagccaaatgactaaagaaaaaaagataacaggtaaggagaaggagaatagcagaatggaggagaacgctgagaaccacattggtgtcacagaggtgctccttggcaggaaacttcaacactacaccgactcttaccttggctttttgccctgggaaaagaagaaatattttcaagatctgctggacgaagaagagtctttgaagacacaattggcttacttcactgactcgaaaaacacgggtaggcagcttaaggatacattcgcagactctctgaggtatgtcaacaaaattttgaactccaaatttggctttacatcacgcaaggtgcccgctcacatgccccatatgatcgataggatcgtgatgcaagaattgcaagacatgtttcctgaagaatttgacaagacgtcattccataaggtccggcattccgaagacatgcagttcgccttcagctacttctattacctgatgagcgccgtgcagcctctgaatatcagtcaagtcttcgatgaggtggacaccgatcaatcaggcgtactgtctgacagggagatccgaactctggcaactaggattcatgaactcccccttagcctgcaagacctgacaggcctcgagcacatgctgattaactgtagtaagatgttgccggcggacattacgcagctcaataatattccgccgacccaggagtcttactatgacccaaacctcccaccagtgactaaatccctggtgacaaactgcaaaccagtaaccgataaaattcacaaagcatataaagacaaaaataagtataggttcgagattatgggcgaggaggagattgcgtttaagatgatccgcactaacgtgagccatgtcgtaggccaactcgacgatatccgcaaaaatccgcgaaagttcgtgtgcctgaacgataacatcgaccacaatcacaaagatgcacaaaccgtcaaggctgtgttgcgagacttctacgagtccatgttccccatcccatcccaatttgaattgcccagggaatacaggaacagattcttacacatgcacgaattgcaggagtggagggcttatagggacaaactgaaattttggacccattgtgtcctggccacgcttatcatgtttacaatctttagcttctttgccgagcagctgatcgcattgaagagaaagatattcccgaggaggcgcattcacaaagaagcttctcccaaccggatcagagta

SEQ ID NO: 16967 - DNA, 3768 bp, Artificial Sequence
  Description of Artificial Sequence: Synthetic coding sequence
atgctatttaaactgctgcagaggcagacctatacatgccttagccataggtatggcctgtatgtatgttttttaggcgtggtggtcactatcgtgtccgcttttcaattcggcgaagtggttctggagtggtctagagaccaataccatgttctcttcgattcctaccgggacaacatagccggaaagagcttccagaaccggctgtgtctgccaatgcccattgacgttgtctacacctgggtcaacggcacagatctcgaactgctcaaagagcttcagcaggtgagagagcagatggaggaggaacaaaaagcaatgcgggagatccttggtaagaatacgactgagccaaccaagaagagtgagaagcagctggagtgcctactcacacactgcattaaggtgcccatgcttgtcttggacccggccctccccgcaaatatcacccttaaggatctcccttctttatacccatcgttccattctgcaagcgacatctttaacgtcgcaaaacccaagaacccctccacaaatgtgtccgtggttgtctttgactcaacaaaggacgtggaggacgctcacagtggtctcctgaagggcaatagcaggcaaactgtgtggaggggttatctgactaccgacaaagaggtgcccggtcttgtccttatgcaggacttagcatttctctctgggtttccacccactttcaaggagacgaatcagcttaagaccaagctccccgaaaatctttcttccaaggtcaaacttctgcaactatattctgaagcttccgtggcgctcctcaaactgaataatcccaaagattttcaggaacttaacaaacagactaaaaaaaatatgactatagatggcaaggagttgaccatttctccagcctatctgctctgggacctgtccgcgatctcccagagcaaacaggacgaagatattagtgcttctcggttcgaggataatgaggaactgcgctactccttgaggagcatcgagcgacacgccccctgggtccggaatatcttcatagtgaccaacggacagatcccctcctggcttaatctggacaaccctcgagttacgatcgtgactcatcaggacgtctttcggaacctgtcacaccttcccactttctccagccccgcgatcgaaagccacatccataggatcgaggggctctcacagaaattcatctatctgaacgacgatgtcatgttcggtaaagacgtctggccagacgatttttactctcactcaaaaggccagaaagtctacctgacctggcctgtcccaaattgcgcagagggatgtcctggctcttggatcaaggatggatattgtgacaaggcctgcaataatagcgcctgtgactgggacggtggggactgtagcggaaactctggggggtcacgatacattgcaggaggcggcggaacaggctccataggggtaggccaaccttggcagtttggcggcgggatcaacagtgtgtcatattgtaatcaagggtgtgctaactcctggttagccgacaaattttgtgatcaggcctgcaacgtgctctcctgcggtttcgatgcaggcgactgtggtcaggatcacttccatgaactatacaaggtgattctcctcccaaaccagacccactacataatccctaaaggtgagtgcctgccgtatttttcctttgcggaggtggcaaagaggggcgtggagggcgcgtattctgacaaccccatcattagacatgcttcgatagccaacaaatggaaaaccatccacctgatcatgcactccggcatgaacgccaccacaattcattttaatcttacctttcagaataccaacgacgaggagtttaaaatgcaaataacggtggaggttgatactcgagaggggcccaagctgaattcgactgcacagaagggctatgagaatctggtttcgccaattaccctgttgcccgaagcagagattctctttgaggacatacccaaagaaaagaggttcccgaaattcaaacgccatgacgtaaactctacccggcgcgctcaggaagaggtgaagatcccccttgtgaatattagtctgctgcccaaagacgctcagctctctctcaatacattggacctccagttggagcacggcgatatcacactgaaggggtacaatctctcaaaatctgcccttctcagatccttcctgatgaattctcagcacgctaaaattaaaaaccaagccatcatcaccgacgaaaccaacgacagtctggtggccccccaggagaaacaagtgcataagtctatactcccaaactcccttggcgtctccgaacggctccaacgattgactttcccggccgtaagtgtaaaggttaatggccatgatcagggccagaacccccccctcgatctggaaactactgcccgttttcgcgtggagacacacacacagaagacaattggtggaaatgtgaccaaggaaaaaccgccatccctcatagtccccctcgagtcccagatgaccaaggaaaagaaaatcaccggcaaggagaaagaaaacagcaggatggaggagaacgctgagaaccacatcggggttaccgaggtcctcttaggcaggaagttacaacactataccgacagttatctggggttccttccctgggagaaaaaaaagtacttccaggacctgttggatgaagaggaatcccttaaaactcagctcgcctactttacagacagcaagaacactggtaggcagctaaaagatacatttgcagacagtttgcggtatgtgaacaagattttgaatagtaaattcgggttcacatctaggaaggtccccgcacacatgccacacatgatcgatagaattgtaatgcaggaacttcaggatatgtttcccgaggagtttgacaaaaccagttttcataaggtcagacattcggaagacatgcaatttgccttctcatacttctactatctgatgtccgcagtgcaacctctgaatatctcccaggtgttcgatgaagtggatactgaccagtccggggtcctctctgatcgcgagatccggacgttggccacccgaatccacgagttgcccttgagcctccaggatctaacaggcttggaacatatgcttatcaactgctcaaaaatgctgcccgccgatatcactcagttaaataacatcccacccacacaagaatcatactatgacccgaatctaccaccggttaccaagtcgctggttacgaactgcaaaccggtgactgataagatacacaaagcctacaaagacaagaataaatatcggtttgaaatcatgggggaagaagaaattgcttttaaaatgatcaggacgaacgtctcgcacgttgtgggccagctcgacgatatacgcaagaaccctcgcaagtttgtctgtcttaacgacaacatagaccacaatcacaaggatgcccaaaccgtgaaggctgtcttgcgggatttctacgagtccatgtttccaatcccttctcaatttgagttgcctagagaataccggaaccgctttcttcatatgcatgagttgcaggaatggcgagcttaccgcgacaaactgaagttttggacccattgcgtgctggcgaccctgataatgtttaccatcttttctttcttcgccgagcaattgatcgcactgaagcggaagattttcccacgccggagaatacacaaagaggcatcccccaacagaatccgggtg

SEQ ID NO: 16968 - DNA, 3768 bp, Artificial Sequence
  Description of Artificial Sequence: Synthetic coding sequence
atgctctttaagctcctgcagcggcaaacatacacatgcctgtcacacagatacggcttgtatgtttgcttcttgggtgtggtagtaactattgtgtcggctttccagtttggagaagttgtgctggaatggagtcgtgaccagtatcacgtcttgtttgattcctatagagataatatcgcgggaaaatcttttcagaatcgcttgtgtttgcccatgcccatcgacgtggtgtacacatgggtgaacggtacagatctcgagcttttgaaggagctccagcaggtccgcgaacagatggaggaagagcaaaaggcaatgcgggagattctgggcaagaacacaacagaacctacgaagaagagcgagaagcagctcgaatgcttattgacgcactgcatcaaggtccccatgttagtgctcgaccccgccttgccagccaacatcaccctgaaggacctgccgagtttgtaccccagtttccatagcgcaagtgatatttttaacgtggcaaagcctaaaaacccttccacgaatgtgagcgttgtcgtatttgattccacaaaagacgtggaagatgcccactccggtctgttgaaaggaaactccagacagaccgtatggagaggatatctgaccactgacaaggaagtacccggcctggtgttgatgcaggacctcgcgttcttatccggttttccgccaactttcaaagaaaccaatcagctcaagacaaaactgccagagaacttaagttcaaaagtaaaacttttgcagctttatagcgaggcctcggtcgcactgttaaaacttaacaatcccaaagactttcaggagctgaataagcagactaagaagaacatgacaattgatggcaaggaattgaccatcagtccggcatacctgttgtgggacctcagcgccatatcccagagcaaacaagacgaggacattagcgcttctcgcttcgaagacaacgaagagttgcgctactccctccgaagcatcgaacggcacgctccctgggtgagaaacatttttatcgtcacaaatgggcaaatcccgtcgtggcttaacctagataatccgagggtcacaatcgtgacgcaccaggatgtgttccgcaatctatctcatctgcctacgttctccagtcccgcgattgaatcacacattcaccgcatcgaaggcctatctcagaagtttatttatctgaatgatgacgtgatgttcgggaaggacgtgtggccggatgacttctatagccattccaaaggccagaaggtctacctgacttggcctgtcccgaactgtgccgaggggtgtcctggctcctggatcaaggatggttattgcgataaagcttgtaataacagtgcctgtgattgggacggcggggactgcagcgggaatagcggcggatcacgctacatcgcgggtggcggtggaacggggtccatcggagtgggacagccctggcagtttggagggggcataaacagcgtgagctactgtaatcagggctgcgctaattcatggctcgcagacaaattctgcgaccaggcttgcaacgttttgagttgtgggtttgacgctggggattgcgggcaggaccactttcatgagctatataaagtaattttgctccccaaccagacacactatatcattccaaagggggaatgcctgccttatttcagtttcgctgaggtggcaaagcgaggcgtagaaggcgcctactcggacaacccaattatcagacacgcgagcatcgcaaacaagtggaagactattcatttgataatgcatagcggtatgaatgctaccaccattcattttaacttaaccttccagaacacaaatgacgaggaattcaaaatgcaaataacggtggaagtggacactcgcgagggacctaagttgaactctacagcccaaaaaggctatgaaaatctggtctcacctattactcttctacccgaagctgaaatcttgtttgaagatatcccaaaggagaagcgcttcccgaaatttaaaaggcatgatgtcaactcgacaaggagggctcaggaggaggtcaagatacctctcgtcaatataagccttttgccaaaagatgcccagttgagcctaaacactctggacctccagctcgagcacggcgacattactctcaaaggctataatttaagtaagtccgcgctactgcgatcctttctcatgaacagtcagcacgcgaagatcaaaaaccaggctattatcactgatgaaaccaacgacagcctggttgcaccccaggagaaacaggtccacaagagcatcctgcccaacagtctcggcgtgagtgagaggctccaaagactgacttttcccgccgtgtccgtgaaagtgaacggccacgatcagggccagaacccaccgttggatttagagaccactgcacgattcagggtggagactcatacacagaaaactatcggaggcaatgttacaaaagagaaacccccatctttgatcgtgcccctcgaatcccaaatgacaaaagagaaaaagataacgggaaaagagaaggagaattcccggatggaagagaacgctgagaatcacattggcgtcacagaagtcctgctcggcagaaaactgcaacactacacagatagctacttgggtttcctcccctgggagaagaagaaatattttcaggatctactagatgaggaggaatcactgaagacccagcttgcctacttcacggattcgaagaacacaggcagacaactgaaggacactttcgctgacagcctgcgatatgtgaataaaattctaaactcaaagtttggcttcacaagtaggaaggttccagcccacatgccccacatgatcgataggatcgtcatgcaggaactgcaggacatgttccctgaggagttcgacaagacctcctttcacaaagtgaggcactctgaagatatgcagtttgctttcagttacttttattatttgatgagcgcagtgcagcctttgaacatctcccaagtcttcgatgaagtggacactgatcaatctggggtgttgagtgaccgtgaaatccggactctggccactcgcattcacgaactgccactttctctgcaagatctcaccggcttggagcatatgcttataaattgttccaagatgctgcctgccgatattacacaactgaacaacattcctccaacacaggaatcctactatgaccccaaccttcctccagtcaccaagtctctggttacgaattgcaaaccagttactgacaaaattcataaggcgtacaaggataaaaataagtatcgctttgagatcatgggcgaggaggaaatagccttcaaaatgatcagaaccaatgtgagccacgtcgtgggccaactggatgatatccgtaaaaacccccgcaaatttgtttgcctcaatgacaatatagatcacaaccacaaagacgcccagaccgtgaaggctgtgctcagagacttttatgaaagtatgttccctatccctagccagttcgaactgcctcgagaatacagaaacaggttcctgcatatgcatgaactccaagagtggcgggcctacagagataagctcaaattttggacacactgtgtgctggctacactgattatgttcacaatcttctccttcttcgccgaacagctcatcgcactgaaacgaaagatattccctagaaggcggatccacaaggaggctagccccaacagaattcgcgtc

SEQ ID NO: 16969 - DNA, 3768 bp, Artificial Sequence
  Description of Artificial Sequence: Synthetic coding sequence
atgctgtttaagctgctgcagagacagacatacacctgcctgtcccaccgctatggactgtacgtatgtttcctcggggtagtggtcactattgtgagcgcattccagttcggtgaagtggtcttggagtggtccagggaccagtaccatgtgctcttcgattcttatagagacaatatcgcaggaaaatcattccagaaccgtctatgcctgcccatgcccatagatgtggtgtacacctgggttaatggcacagacctggagctgctaaaagagctgcagcaagtgcgcgagcaaatggaggaggaacagaaagctatgagagaaatcctgggcaagaacaccaccgagccaacaaaaaagtctgagaagcagctggaatgcctgctgacacactgcatcaaggtgcccatgctcgttctggacccagcgctccccgccaatataactttgaaagacctcccctccctgtacccttccttccactccgcctcggacatcttcaatgtggccaagcctaaaaacccatctacgaacgtcagcgtagtggtcttcgactcaacaaaggacgtagaagacgcacatagcggactgctcaagggaaattcaagacagaccgtttggcggggttacttgactaccgataaggaagtccccgggctggttcttatgcaagacctggcctttctgtccgggtttccccctacatttaaggagaccaaccaactcaagaccaagttgccggaaaatctgtcttcaaaggtcaagttgctgcagctatattccgaggcttcagtggccctgcttaaacttaataacccaaaggatttccaggaactgaataaacagacaaagaagaatatgaccatagacggcaaggaacttacgatctctccagcatatctgctctgggatctttccgccattagccaatctaagcaggacgaggatattagcgcctctagattcgaggataacgaggagctgcgctattccctgcggtccatcgaaaggcatgcaccgtgggtgagaaacatattcattgttaccaacggccaaattccatcttggctgaacctcgacaaccctagagtgacaattgtgacgcatcaagacgtattccggaacctgagccacctacccaccttcagctcccctgctatagagtcgcatatccaccgtatagaggggctgtctcagaagttcatatacctcaatgatgacgtcatgtttggcaaggacgtgtggccagacgacttttattcacactctaaggggcagaaggtatatttgacatggcccgtgcctaactgcgctgaaggctgtccaggttcttggataaaggacggatactgtgacaaggcttgcaacaacagcgcatgcgactgggacgggggagactgcagtggcaattccggggggtctcgctatatcgccggtgggggggggacaggaagcataggcgtgggacagccttggcaattcggcggcgggattaattccgtgtcttattgcaaccagggctgcgctaattcttggctagccgataaattctgcgaccaggcctgcaacgttctttcctgtggcttcgacgctggggactgtgggcaggaccatttccacgagttatataaagttatcctgctgccaaaccagacacactacattattcctaagggtgagtgcctaccgtacttttccttcgccgaagtggcgaaacgcggcgtggaaggtgcgtattctgataaccctatcatccggcatgcctctatcgcaaataagtggaagaccatccacctcattatgcattcaggcatgaacgccacaaccattcacttcaacctcaccttccagaatacaaacgacgaggaatttaagatgcaaataaccgtcgaagtcgacacacgggaaggtccgaaacttaacagtacggctcaaaagggttacgaaaacctcgtgagtccaatcaccctactgcctgaagctgaaatcctgttcgaagatatccccaaggagaagcggtttcccaaattcaagagacacgatgtgaatagcacacggagagctcaggaggaggtgaagattcctttagttaacatttctctcctccccaaggatgcgcagctgagtctgaataccctggacctccagctggagcatggagacattaccctcaaaggctataacttgtccaagagtgcccttttgcgctctttcctaatgaattcacagcacgctaaaatcaaaaatcaagccattataaccgacgagaccaacgactctcttgtggctcctcaggaaaagcaggtgcacaaatccatcctccctaattccctgggggtgagcgagcggttgcagcgccttaccttccccgcagtctccgttaaggtgaacggacatgatcaggggcagaatccccctctggatctcgagaccacagcacgatttagagtcgagactcacacacagaagaccataggcggtaatgtgactaaggagaaacctccatccctgatcgtccccctggagagccaaatgactaaggaaaagaaaattacaggtaaggaaaaggagaatagcagaatggaggaaaacgccgaaaaccatattggtgtgaccgaagtgcttctgggaaggaagttacaacattatactgactcttatttgggttttctaccttgggagaaaaaaaaatatttccaggatctgctggatgaagaggagtcacttaagacacagctggcttactttactgacagtaagaatacggggcgacagttgaaggacaccttcgccgacagtctgagatacgttaacaaaatcctgaatagtaaattcggattcacttcaagaaaggtgcccgcacatatgccacacatgatcgatcgcatagtcatgcaggagttgcaggatatgtttccggaagagttcgacaagactagttttcataaagtgcgccactcggaggacatgcagttcgctttctcttatttttactacctgatgtccgccgtgcagcccttgaatatcagtcaggtatttgatgaggttgatacggatcaatccggggtattgtctgacagagaaattagaacgctggccactagaatacacgaactgcccctctcactgcaggacttaaccgggttggagcacatgttgatcaactgtagtaaaatgttgccggcagacattacccaattgaataacatccctccaacccaggagagctactacgatcccaacctgccccctgtaacaaaatctctcgtaaccaattgtaaacctgtcaccgataagatccataaagcttacaaggataaaaataaatataggtttgagatcatgggagaggaagagatcgccttcaagatgattaggaccaacgtgagccacgtggttggccagctggacgacataagaaagaatccgaggaagtttgtgtgcctgaatgacaatattgaccacaaccacaaagacgcacaaaccgtcaaggctgttcttcgggatttttacgagtcaatgtttcccattcctagccagttcgagctgccgagagaatatagaaaccgatttctgcatatgcatgagctccaggaatggcgagcatacagggataaactgaagttttggactcactgcgtactagctacattgataatgtttactatcttttctttttttgccgagcagctgatagcgctgaaacggaagatctttcccagacgacggatccacaaggaggcatctccaaatcgaatccgagtc

SEQ ID NO: 16970 - DNA, 3768 bp, Artificial Sequence
  Description of Artificial Sequence: Synthetic coding sequence
atgttattcaagctcctgcagcgacaaacgtacacctgcctcagccaccgttacggattgtacgtgtgctttctgggtgtcgtcgtgacgattgtctccgcttttcaattcggagaggtggttttggagtggtcccgcgatcagtaccatgtgctcttcgactcctaccgggataacatcgcaggcaagagcttccagaaccgtctgtgtctccctatgccgattgatgtggtgtacacctgggtgaatggtaccgatctagagcttttgaaggagctccagcaggtccgtgaacagatggaggaagagcaaaaggcgatgcgggagatcctggggaagaacactacagagccgacgaagaagtccgagaagcagcttgaatgcctactcacacactgcattaaggtacccatgttggtgctcgatccggcactgcctgctaacatcaccctcaaggatctgcccagtctgtacccctccttccactcagccagcgacattttcaacgtggctaagccaaagaatccctctaccaacgtgagcgtcgttgttttcgatagtacaaaggacgtcgaagacgcccactccggtcttttaaagggcaattcgcgtcagaccgtgtggcgtggttacctgacgaccgataaggaagttcccggccttgtgcttatgcaggacctggcattcctctctggctttccaccgaccttcaaggaaaccaaccagctcaaaacgaaactcccggaaaacctctcttctaaggtgaagctgcttcagctatatagcgaggcctctgtcgcactcctgaagttgaacaacccgaaggacttccaggagctgaataagcaaaccaaaaagaacatgacaatcgatgggaaggaactgaccatcagccccgcctacttactctgggacctctccgccatctcccagagcaagcaggacgaagatatcagcgcctctcgctttgaagacaacgaggaattacggtactctctgcgcagtattgaacgccacgcgccatgggtccgtaatatcttcattgtcactaacggtcagatcccatcttggttaaatctggataacccgcgggtcaccattgtgacccaccaggacgtcttccgtaacctctcccacctccccaccttctcgtcccccgcgattgagtcccacatacaccgtatcgagggcctcagccagaaattcatctacctcaacgatgacgtcatgtttggaaaggatgtctggcccgacgacttttattcgcactctaaagggcagaaggtttacctcacctggccggttccaaactgcgccgagggatgccccggttcgtggatcaaggatggatattgcgacaaggcatgcaacaactctgcttgcgattgggacggtggggattgttccggaaacagcgggggttcacgatacattgcgggtggtggcggcactggctcgattggcgttggtcaaccttggcagttcggcggaggtatcaactctgtctcttactgcaaccagggatgtgcaaactcctggctggctgataaattttgtgatcaggcttgcaatgtcctgtcgtgtgggtttgacgctggggactgtggacaggaccatttccatgagttgtacaaggttatcctcctccctaaccagacacactacatcatccctaagggcgagtgcttgccttacttctccttcgccgaggtggcgaaacgcggtgtagagggcgcatatagcgacaaccccatcattagacacgcctcgatcgccaacaagtggaagaccatccacctcatcatgcacagtggtatgaacgccaccactatccacttcaacttgaccttccagaacaccaacgatgaagagttcaagatgcagatcaccgtcgaggtagacacccgtgagggtccgaagcttaattccacagcccaaaagggctacgaaaacctggtctctcccatcacacttttaccggaagcagagatactctttgaggacatccccaaggagaagcgcttcccgaagttcaaacggcacgatgtaaattccacgcgccgggctcaggaggaagtcaagatcccgctggtgaacatctccctccttcctaaggatgctcagctttctttgaacaccctggacctgcagctggagcatggcgatatcacgctgaaggggtacaacttgtcgaagtctgcgctgttgagatccttcctgatgaatagccaacacgctaagatcaaaaatcaggctatcattactgacgagaccaatgattcgttagtggccccccaggagaagcaggtccataagagcatcctgccgaatagcttgggcgtctcggaacgcttgcagcgacttacctttcccgccgtctcggtcaaagttaacggtcatgaccaagggcagaacccaccgcttgacctggagaccaccgccaggttccgcgtcgagactcacacccaaaagaccatcggaggcaacgtcaccaaagaaaagcctccatccctcattgtgccgctcgagtctcagatgaccaaggagaagaagatcaccggcaaggagaaggaaaactcccgtatggaagaaaacgccgagaatcatatcggtgtaaccgaggtcctgctaggcaggaagcttcagcattatacagactcctaccttggcttcctgccttgggagaagaaaaaatatttccaggacctcctggacgaggaggaatctttgaaaacccagctggcctactttacggattcaaagaacactggtagacagctgaaggataccttcgccgattcgcttcggtacgttaacaagatactcaactcgaagttcggttttacgtcccgcaaggtgccggcccacatgccgcacatgattgacagaattgtcatgcaagagcttcaggacatgttcccagaggagttcgataagacttcctttcacaaggtgcggcactcggaggacatgcagttcgcattctcgtatttttactacctgatgagcgctgttcagccgctgaatattagccaggtgttcgatgaggtcgacactgaccagagcggcgtgttgtcggaccgtgaaatccgcacccttgcgacccgtatccacgagctgcccctctccctgcaggatttgacaggcctcgagcacatgcttattaactgctcgaagatgctccctgcagatatcactcagctcaacaacattccccccacccaagagtcttactacgatccaaacctcccccccgtcaccaagtctcttgtgaccaactgcaagcccgtgactgacaagattcacaaggcatataaggataagaacaagtaccgtttcgagatcatgggtgaggaggaaatcgctttcaagatgatccgcactaacgtctctcacgtcgtcggccagctggatgatatcagaaagaaccctcggaagttcgtctgcctgaacgataacatcgatcataaccataaagatgcccagactgtgaaggccgttttgagggatttttacgaatcaatgtttcccatcccctcgcagtttgagcttccacgggaataccgaaatcgcttcctgcacatgcatgagctccaggaatggcgcgcttacagagacaaactgaagttctggacgcattgtgtgttggcaacattgatcatgttcaccatctttagtttcttcgctgagcagctcatcgctctgaagcgcaagattttcccgcgtcggcgcattcataaggaggcctccccaaaccgcattcgggtg

SEQ ID NO: 16971 - DNA, 3768 bp, Artificial Sequence
  Description of Artificial Sequence: Synthetic coding sequence
atgctgttcaagcttttgcagcgacagacgtacacctgtctcagtcaccgatacggcctgtacgtgtgttttctcggggttgtggtaacaattgtctccgcattccaattcggtgaggtcgtgctcgagtggtctcgagaccagtaccacgtgctctttgattcctatcgagataatatcgccggcaaatcatttcaaaatcgactgtgcctgccgatgcctatcgatgtggtttatacgtgggtaaatggcacagatctggaactcctgaaggaacttcagcaggttagagagcagatggaagaagaacaaaaggcgatgcgtgaaattctcggtaaaaataccactgagcctactaaaaaatcagaaaagcagctggagtgtttactcacacattgcattaaggtcccaatgcttgttctcgatcctgccttacccgccaatatcactctcaaggacctgccaagtctgtacccaagcttccacagtgcttcagacatcttcaacgtagcaaaaccaaaaaatccatcaactaatgtgtccgtggtagtcttcgactccacaaaagacgtggaagatgcccactctggactgctgaaaggcaacagtcgacagactgtctggagagggtatttgactacagacaaagaagtgcccggactggtgctgatgcaggacctcgcttttctgagtggcttcccaccaacgtttaaggaaaccaaccaacttaagactaagctgccagagaatctgtcttccaaagttaagctgctgcagctctattccgaagcttctgtggcactgctaaaactgaacaatcccaaggactttcaggaacttaacaaacagacaaaaaagaatatgactatcgacggcaaagaactaactatctctcctgcttacctgctctgggatttatccgcgatttctcagtctaaacaagacgaagatatctccgcgtctagattcgaagataatgaagagcttcgctacagcctgcgaagcatcgaaaggcatgcaccatgggtgagaaatatcttcattgtaacgaacgggcagattccctcctggctgaatctggacaatccaagagtgacgatcgtgactcaccaggacgtgttcagaaacctgagccatttacctacattcagctcccccgcgatcgagagccatatccataggattgagggtctaagtcagaagttcatataccttaacgacgacgtgatgttcggcaaggacgtctggcccgacgacttctactctcattccaaaggtcaaaaagtgtacctcacttggcctgtgcccaactgcgctgaagggtgccccggatcctggatcaaggacggatactgtgataaagcctgtaataacagcgcgtgcgattgggacggaggagattgtagcggcaactcggggggcagcaggtacattgctgggggcggcggtactggaagtatcggcgtggggcagccgtggcaattcgggggggggattaactccgtgagttactgcaaccaggggtgtgctaatagttggcttgccgataagttttgtgaccaagcatgcaatgtcttgtcctgcggatttgacgctggagattgtggtcaggaccactttcacgaattatataaggtgatacttttgcctaaccaaacacattacataatccctaagggagagtgcctgccttacttcagcttcgctgaagtggccaaacgcggcgtcgagggtgcatactccgacaatcctataattaggcacgcaagtatcgcaaataagtggaagacaatccacctcatcatgcactccgggatgaatgccacaaccattcattttaatttaacttttcagaacacgaacgacgaggaattcaaaatgcaaataactgtcgaggttgatactagagagggccccaaacttaacagtaccgcacagaagggttacgaaaatctggtctctcccattacactactcccagaggccgaaatcctgtttgaagatattccgaaggaaaaacgtttccctaagttcaaacggcatgacgtgaactccacaaggcgagctcaggaagaagtgaagataccgctggtgaacatctcactgcttcccaaagatgctcaactctctctgaacacccttgacctgcagctggagcacggggacatcaccctgaagggttataatctgtcaaaaagcgctctgttaagatccttccttatgaattcacaacacgctaaaattaaaaatcaggctatcattaccgatgaaacaaatgactcactcgtggccccccaagaaaaacaagtgcacaagagcatcctccccaacagcctgggggtatccgaaagactgcaaaggctgacttttccggccgtgtctgtgaaggtaaatgggcatgatcagggacagaatcctcctttggacctggaaacgaccgcccgcttcagggtggagacgcatactcagaagactattgggggaaacgtgactaaggaaaagccgcctagcctcatcgtgccgctcgaaagccagatgaccaaagaaaaaaagattaccggtaaggaaaaggagaactcgaggatggaagagaacgcagagaaccacatcggggtgactgaagtgttgctcggcaggaagctacagcactataccgactcctatttaggcttcctaccatgggagaagaagaagtattttcaggatctcctcgatgaggaagagtctttgaagacgcagctagcttacttcaccgactccaagaacacagggcggcagctcaaagacaccttcgccgatagtctccgatatgttaacaagatcttgaactcaaagttcggcttcacgagtcgaaaagtcccagcccatatgccgcacatgatagaccggatagttatgcaggaactacaggacatgttccccgaggaattcgacaaaacgtctttccataaagtgcgccattccgaggacatgcagtttgcattctcctacttttattacctcatgtccgctgtgcaaccgctgaacatcagtcaagttttcgacgaggtcgatactgaccagagtggcgtgttgtcggacagggagataaggactttggccactcgcatccatgaactccctctgagtttgcaggacctcactggtcttgagcacatgctaataaattgcagtaagatgttgcctgcagatatcacccagctgaacaacatccctcccacgcaggaaagttactatgatcctaacttacctccagtgacaaagtcactggttaccaattgcaagcctgttaccgataagattcacaaggcttacaaagacaaaaataagtatagattcgagattatgggggaagaagaaatcgcatttaaaatgatccgtacaaacgtgtcccatgtggttggacagctagacgatattcgcaaaaatcctcgtaaatttgtgtgcttgaatgataacatcgatcacaatcacaaagacgcccaaacagtgaaagccgttctgagggatttctacgagagcatgttcccaattccttctcaatttgaacttcctagggaatatcggaacagattcctgcacatgcacgagctacaggaatggcgagcctacagggataagctcaaattttggacgcactgtgtcctcgctaccctaatcatgttcactatcttctctttctttgcggaacagctgatagcactcaagagaaagatatttccgaggagaagaatccataaagaagcaagccccaatagaatacgtgtt

SEQ ID NO: 16972 - DNA, 3768 bp, Artificial Sequence
  Description of Artificial Sequence: Synthetic coding sequence
atgctgtttaagcttctccagcgccagacctatacctgtctttcacacagatatgggctgtatgtctgcttcctgggagtggtcgttactatagtgtcagctttccagtttggggaagtggttctagagtggtcaagggaccagtaccacgtgctgtttgattcataccgggacaatattgctggtaaatccttccagaatcgcttatgtctgccaatgcccattgatgtggtatacacgtgggtgaacggcacagatttggagctcctgaaagagctccagcaggtgagggagcaaatggaagaggagcagaaggccatgcgggagatcttgggtaaaaatactactgaaccaacaaagaagagtgagaagcagttggaatgtctgttgactcactgtatcaaggtcccaatgctggtgttggacccggctctgcccgcaaacattacgctcaaggacctgcccagtttgtacccttcttttcactctgcatccgacattttcaatgtggccaagccgaaaaacccatcaacaaatgtttcagtcgtagtctttgatagcacgaaagatgtggaagacgcacattctggtctactgaaaggaaacagccggcaaaccgtttggcgaggctatttgaccacggataaggaagtgcccggcctggtcctgatgcaggatctggcgtttctatcaggcttcccacctacttttaaagagacaaatcaactgaagacaaagctccccgagaacctttcctctaaggtaaagcttctccagctttattctgaggccagtgtggctctgctgaagctcaacaatcctaaagacttccaagagctcaacaaacaaactaagaagaacatgaccatagatggaaaggagctgaccatctctccagcatatctgctgtgggacctatcagcaatcagccaatccaagcaagatgaggacatcagcgcctctcgttttgaggacaatgaggagcttcgctattctctgcggtcaattgaaaggcatgcaccttgggtgagaaacatattcatcgtcaccaacggccaaattccaagctggctcaacctggacaaccctcgcgtaacgattgtcacccaccaggatgttttccgcaacctctcccacttacctacgttttctagcccagccatcgagagccacatccatagaattgaaggcttaagtcagaaattcatttacctcaatgatgacgtgatgttcggcaaggacgtgtggcccgatgacttttatagccactccaaggggcagaaggtgtacctcacatggcccgtacccaattgtgcggaaggctgtcccggttcttggattaaagatgggtactgtgacaaggcctgcaacaattctgcttgcgattgggatggaggggactgctcaggcaatagcggcggtagcagatacatcgcaggtggaggaggaacgggcagcatcggggtggggcagccttggcaatttgggggcgggatcaactcggtgagctactgcaatcagggatgcgcaaattcctggctggcagacaagttctgcgaccaggcatgtaatgtgctctcctgtggattcgatgccggcgattgtggtcaggatcacttccacgaactctacaaggtgattctcttacctaaccaaacacactatatcattcccaagggggagtgtcttccgtatttctccttcgctgaggtcgccaagaggggtgtggagggcgcctactcggataatcccatcattcgccatgctagcattgcgaacaagtggaagactattcatcttataatgcatagcggaatgaacgctactacaatccactttaacttgacctttcagaacactaatgatgaggaatttaaaatgcagataaccgtcgaagttgacacccgggaaggcccgaagctcaattccaccgcccagaagggatacgagaatcttgtcagtcctatcaccctcttgcccgaagcggagatactctttgaggatatccccaaagagaaaaggttccctaagttcaagcggcacgatgtgaattccactcgcagagcccaggaggaggttaagataccactggtaaatatttctttgctgccaaaggatgctcagctgagcctcaatacactcgatctgcagctggagcatggagatatcaccctgaagggctacaatttgtccaaatctgccctcctgcgcagttttctaatgaactcccagcacgcgaagatcaagaaccaggctatcattactgacgagaccaatgacagtctggttgcccctcaggaaaagcaggtacataaaagtatactccccaattccttgggcgtgtccgagaggctgcagcggctgactttcccagccgtctccgtgaaggttaacggtcacgaccaagggcaaaacccaccactcgatctggaaactaccgcccgatttagagtggaaacacacacgcagaagaccataggcggaaacgtgactaaggaaaaaccaccgagtctgatcgtacccttggagtcgcaaatgaccaaggaaaagaagattaccgggaaggagaaggagaacagcaggatggaagagaatgctgagaatcacatcggcgtgactgaagtcttattgggccggaaattgcagcattacactgattcctatttgggttttctcccatgggaaaagaaaaaatattttcaggatctgctggatgaagaggagagcctgaagacccaactcgcctacttcacagattccaaaaatactggaaggcagctgaaggatacttttgctgattcgcttcgttatgtcaacaagatactgaactctaaatttggcttcacttcccgcaaagtaccggctcatatgccccacatgattgacagaattgtgatgcaggaacttcaggacatgtttcccgaagaattcgacaaaacaagttttcataaggttaggcacagtgaggacatgcaattcgcattctcctatttctattacttgatgtctgctgtgcagcctctgaacatcagccaagtgtttgacgaggtggataccgaccagagcggcgttctgtcggacagggaaattcggacgctcgccacccgaatacatgagctgcctttgtctttacaggatctcaccggcctggagcacatgctgattaattgcagtaaaatgctcccagcagacatcacgcagctgaataatatcccaccaacccaggaatcatattatgatcccaatttgccccctgtgacaaagagcttggtaacaaactgcaaacctgtgacagacaaaattcacaaggcctataaagacaaaaacaagtataggttcgagatcatgggcgaggaagagatcgcctttaaaatgatacggactaatgtttcacacgtggtgggtcagttggatgacataagaaaaaatccacgcaagttcgtttgcctaaacgataacatagatcacaatcacaaagacgctcagactgtcaaggcggtactgcgggacttttacgaatctatgtttccaattccatctcaattcgagctaccccgggaataccgtaataggttccttcacatgcatgagctccaggaatggcgggcctacagagacaagctaaagttctggactcactgtgtcctagccaccctgatcatgttcaccatcttttcctttttcgccgagcagctaatcgctttgaagagaaagatcttcccgcgtcggcgtatccataaggaggctagccccaacagaatacgagtg

SEQ ID NO: 16973 - DNA, 3768 bp, Artificial Sequence
  Description of Artificial Sequence: Synthetic coding sequence
atgcttttcaagctgctgcaaaggcaaacctacacatgtctttcacatagatacggtctttacgtgtgcttcctgggtgtggtggtgacgattgtgagtgcctttcagttcggggaggtggtgttggaatggtctcgggatcagtatcacgtcctgttcgattcttatcgggacaatattgccggcaaatccttccaaaaccggctgtgcttgcccatgcccatcgatgtggtttacacatgggtcaacggaacagacctggaactgctgaaggaacttcaacaggtccgggagcaaatggaggaggagcagaaggctatgcgcgaaatactcggtaagaacactaccgagccgaccaagaagtcagagaagcagcttgagtgcctccttacgcattgtattaaagtcccaatgttggtgcttgaccccgcactgccagcgaatatcaccttgaaggacctgccaagcctttatccttccttccactccgcgtccgatattttcaatgtggccaagcccaaaaatccctccaccaacgtgtccgtggtggtgtttgatagtactaaagatgtcgaggacgctcacagtggccttcttaagggcaacagccgacagactgtttggagggggtatttgacaactgacaaagaagtgcccggactcgttctcatgcaggatctggccttcctgtccgggttccctccaaccttcaaggagacaaatcagctgaagacaaaacttccggaaaacctttcatcaaaggtcaaactgctccaactgtatagcgaggcctcagttgccctcctgaaactgaacaaccctaaggattttcaggagctcaacaaacaaaccaagaagaacatgaccattgacggcaaggaactgaccatttccccagcatacttgctttgggatttgtccgccattagccaaagcaagcaggatgaagatatcagcgccagtcgattcgaggataatgaggagctgcgctacagcctgagatccattgaacggcatgccccatgggtccggaacatcttcatcgtgacaaatggccaaattccgtcttggctcaacctcgacaaccccagagtcaccatcgttacacatcaagatgtatttcggaacttgagccacttgcctacgttctcatccccggctatagagtcccatatacataggatcgaggggctgtcccagaagtttatttacctgaatgatgatgtcatgtttggcaaggacgtctggccagacgacttctatagccattccaagggacagaaggtgtatctcacctggcctgtgcctaactgcgctgaggggtgtccaggttcttggattaaggacggctattgtgataaagcctgtaacaacagtgcatgcgattgggacggcggagactgcagtggaaactcagggggcagtcgatacatcgccggcggaggtggtaccggatccatcggtgtggggcagccttggcaattcgggggcggtatcaatagcgtgagctactgtaaccaggggtgtgccaattcttggctcgccgacaagttctgtgatcaggcgtgcaacgtgctctcctgcggattcgacgccggagactgcggccaggaccacttccacgagctgtataaggtcatcctcctgccgaaccaaacgcactatattatacccaaaggagagtgcctgccctactttagttttgccgaagtggcgaaacgcggcgtcgagggggcttatagtgacaatcccataattcgccacgcctctatcgcaaataagtggaaaactattcatctgattatgcattccgggatgaacgcaaccacaattcacttcaatctcacttttcagaataccaatgacgaggagtttaagatgcagattactgtcgaggtagatacacgggaaggtccgaagctgaactccaccgcccagaaaggatacgagaacctcgtgtccccaatcactctgctccccgaggcagagattctcttcgaggatatccccaaagagaagagattccccaagtttaagcgccacgacgtcaactccacacgacgggcccaggaggaagtaaaaataccattggttaacatttcactcctgcctaaagatgcacaactcagcctcaacacacttgatctgcagctggagcatggagacatcaccctgaaaggatacaatctgtccaagtctgcactcctgaggtcatttctgatgaatagccagcatgcaaagatcaaaaatcaagccataatcaccgacgagacgaacgatagtctggtggcgccccaagagaaacaagtacataagagcatccttcccaacagcttgggggtgagcgagaggctgcagcgcctgacttttcctgcagtatccgtaaaagtcaacggtcacgatcaggggcagaatcctcctttggacctggaaaccacagccaggttccgggtggaaactcatacgcagaaaacaatcggtggcaatgtaaccaaggagaagccccctagtcttatcgtacccctggagagccagatgactaaggaaaaaaaaataactggtaaagaaaaagagaattccagaatggaggaaaacgccgagaatcacattggcgtgaccgaggtactgctgggcaggaagcttcagcactacaccgacagctatctcggctttcttccgtgggaaaagaaaaagtattttcaggatctgctcgatgaggaagagagcttgaaaactcagttggcatatttcacagacagtaaaaatacaggccggcagctgaaggacacctttgctgactctctgcgctatgtgaacaagatcttgaattcaaagtttggctttacttcacgcaaagtacctgctcacatgccccacatgatagacaggattgttatgcaggaactgcaggatatgttccccgaggagtttgacaagacgagtttccacaaggtcaggcacagtgaggacatgcagttcgccttctcctatttctattacctgatgtctgctgttcaacctctgaatatatcacaggtttttgatgaggtggacactgatcagtcaggggtcctgtcagaccgggagattcgcaccctcgccacgagaattcacgagctcccattgagcctccaggaccttacggggcttgagcacatgctgataaattgttccaagatgctgccagctgacatcactcaactgaacaacatacctcctactcaggagagctactatgaccccaatctgccacctgtgactaaatccctggtcactaactgtaagccagttaccgataagattcacaaggcatataaggataaaaacaaatatcgctttgaaatcatgggcgaggaggagattgctttcaagatgattcgaaccaatgtgtcccacgtcgtgggacagctggacgatatcaggaaaaaccccagaaagttcgtatgtctcaatgacaacattgaccataatcataaagatgctcaaactgtgaaagcagttctgagggacttttacgagtccatgttccccatcccaagtcagttcgaactgccgagagaatatcggaaccggtttctccatatgcatgagctgcaggagtggagggcttaccgagacaaactgaaattttggacacattgcgtccttgccacactgatcatgtttaccatctttagcttttttgctgaacagctgatcgccctcaagaggaagatttttccccggagaagaattcacaaagaggccagtccaaatcgaatccgggtg

SEQ ID NO: 16974 - DNA, 3768 bp, Artificial Sequence
  Description of Artificial Sequence: Synthetic coding sequence
atgctttttaagctgcttcagaggcaaacctacacatgcctttcccaccgttacgggctgtacgtctgttttctcggcgttgtcgtgacgatcgtcagtgccttccagttcggggaggtcgtgttagaatggagccgtgaccaatatcacgttttattcgattcataccgagataacattgccgggaaatctttccagaaccggctatgccttcccatgccaatcgatgttgtgtatacatgggtaaacggcaccgatctggaactgctaaaagagctgcagcaagtcagggagcagatggaagaggagcagaaggccatgcgagagattcttggaaagaacacaactgaacctactaaaaaaagtgaaaagcagctggaatgcctgctgacccattgcatcaaggtgccgatgttagtgcttgatcctgctctccccgctaatataaccttaaaggatctcccatccttatacccaagcttccactccgcatctgacatcttcaatgtggccaaacctaagaatccttctacgaacgtgtccgtcgttgtgttcgattcaacaaaggatgttgaggatgcccacagcggactactcaaggggaacagtagacagacagtttggcggggatacctcacaacagataaggaggtaccgggactcgtgctgatgcaggatctcgcctttctgtccgggttcccgcccactttcaaggagacaaatcagctgaagactaaactccccgagaacttgtccagcaaggtgaaactgctgcagctgtactctgaggcctcagtggctctacttaaactgaataatcctaaggacttccaggagttgaacaagcagacaaagaaaaacatgactattgacgggaaagagttgaccatatccccggcatatttactgtgggacctaagtgccatcagccagtccaaacaggacgaagatatttccgctagtaggttcgaggacaatgaggagctccgctactcgttacgtagcatcgaacggcacgccccatgggtgcgcaacatttttattgtcaccaatggtcagatcccaagctggctcaacctggacaaccccagagtcaccattgtcacccaccaagacgtgtttcgcaacctgagtcatctgcccaccttttcttctcctgccatcgaaagccacattcatcgaatcgagggtctcagtcagaagtttatatatctgaacgatgatgttatgttcggtaaggatgtatggccagacgacttctacagccattctaaagggcagaaagtctacctcacctggcccgtacctaattgtgcagagggatgtccaggtagctggattaaagatggttattgtgataaggcttgtaataatagtgcgtgtgattgggacgggggggattgctccgggaactccggcggctcccggtacatcgcaggcggggggggcactggctccataggcgttggccagccatggcaatttggcggaggaatcaatagcgtgtcttactgtaaccagggttgtgctaacagctggctggcagacaagttttgcgaccaagcgtgtaatgtactgagttgcggttttgatgccggcgattgtgggcaagatcattttcatgagttgtacaaggtgatccttttgcctaatcagactcactatatcatcccgaaaggggagtgcctgccatacttttccttcgcagaggtcgccaagcggggagtggagggagcctacagcgacaatccaattatcaggcacgctagcattgcaaacaaatggaaaactatccacttgatcatgcattccggtatgaacgctaccaccattcatttcaaccttacatttcaaaatacaaatgatgaagagttcaagatgcaaattacagtggaggttgacaccagagaagggcctaagctgaatagcacagcacagaaaggatacgaaaacttagtcagcccgattacactactgcctgaggctgagatacttttcgaagatatacctaaggagaaaagattccccaagttcaagaggcatgatgtcaattcgaccagaagagcccaggaagaggtaaaaattcctctggtaaatatctccctgctgccgaaggatgcccagctgtccttaaatactttagacctccagttggagcatggggatattaccctcaaaggctacaacctcagcaagtctgctctgctgcgaagctttctcatgaactctcagcatgccaagataaaaaaccaggcgataataaccgatgagaccaacgattccttggtcgcaccccaagaaaaacaggtgcacaagtcaatcctgccaaatagtctgggggtgagtgagcggctgcagaggctcacttttccagcggtatcagttaaggtcaacggccatgaccaggggcagaaccctcccctcgacctggaaactaccgccagattcagagttgagacgcacacacaaaagacaatcggagggaacgttacaaaagaaaaaccgccatctctcatcgtaccactggagtcacagatgaccaaggagaagaaaataacagggaaagaaaaagagaattctcgtatggaagagaatgcggagaaccatattggagtaactgaggttttgctgggaagaaagctacagcactacaccgatagctacctggggttcctcccatgggaaaagaagaagtattttcaagatctgctggacgaagaagagtccttgaagacccagctggcatattttaccgacagcaaaaacaccgggagacagctgaaagatactttcgctgattctttgcggtatgtcaacaaaatcctcaacagcaagtttggatttacctctcggaaagttcccgcccacatgccacacatgatagaccggatagtcatgcaggagctgcaggacatgtttccggaagagttcgacaagacaagctttcataaagtccgacactctgaggatatgcagttcgccttctcctacttctattacttgatgagtgctgtccagcccctgaacatctcacaggtgttcgacgaagtggacaccgatcaaagcggagtgttgtctgaccgtgagatccgaaccttggctactaggatccacgagctgcccttgagtttgcaggatcttaccgggctggaacacatgcttatcaactgcagtaaaatgttgcctgcggacatcacccaactgaacaacatcccacccacccaggaatcttattatgatcctaatctgccacctgtcacgaagagcctggtgacgaattgtaagcctgtgacagacaagattcacaaagcctacaaggataagaataaatatagattcgaaatcatgggagaagaagaaatcgcctttaaaatgatacgtacaaatgtgtcccacgtggtaggtcagctggacgatatccggaagaaccctaggaagttcgtgtgccttaacgacaacatagaccacaaccataaagatgcgcagacagtcaaagctgtgctgcgcgacttctacgagtccatgttccctattccttcccaatttgaactgccaagggagtatcgtaatagatttctccacatgcacgaactccaggaatggagagcatatcgggataaattgaagttttggacccattgtgtactggctaccctgatcatgtttactatctttagcttttttgccgaacagctgatagccttgaagaggaagatatttcctcgacgacgcatccacaaggaagccagtccgaatagaatccgcgtt

SEQ ID NO: 16975 - DNA, 3768 bp, Artificial Sequence
  Description of Artificial Sequence: Synthetic coding sequence
atgctcttcaagctcttgcagcgccagacctacacctgtctctcccaccgctacggtctttacgtgtgcttcctgggcgttgttgtcacgatcgttagcgctttccagttcggcgaagttgtactggagtggtctagggaccagtatcacgtcttgttcgactcttacagggataatatcgccggcaagtcttttcagaaccgcctgtgcctgcctatgccgatcgacgtcgtctacacctgggtgaatggcactgacctggagctgctcaaggagcttcagcaagttcgcgagcaaatggaggaagaacaaaaagccatgagagagattctgggcaagaatactacagagccaactaagaagtcagaaaagcagctggagtgcctgctgactcactgcataaaggttcctatgttggtcctggatccagccttgcccgctaacataactctcaaagacctgccaagcctttaccctagctttcatagtgcgtccgacatttttaatgttgccaagcctaagaacccttccaccaatgtatcagttgtggtgtttgatagtactaaggatgtggaagacgcacacagcggacttcttaaaggcaattctagacaaaccgtgtggcgcggctacctgaccacggacaaggaggtccctggactggtgctgatgcaggacttggcctttctgtctggtttccccccgactttcaaagagactaaccagctgaagactaagcttcctgagaatctgagcagtaaggtgaagctgcttcaactgtacagcgaggcctccgttgctctgctcaagctgaacaaccccaaggacttccaagagcttaataaacaaacgaagaagaacatgactatcgatggaaaggagttgacaattagccccgcttacctgctgtgggacttgtctgccatcagtcaaagtaagcaagatgaggacatcagtgcctccagatttgaggataatgaagagcttcgctattccttgaggagcatagaaaggcacgcaccctgggtgcgcaacatcttcattgttaccaacggacagatcccatcctggctgaacctggacaaccccagagttactatcgtgacccaccaggatgtgttccgcaaccttagtcatctgcctaccttctcatctcctgcgattgagtctcatattcatcgcatagagggcctgtctcagaagttcatctatctgaacgatgacgtaatgttcggaaaggacgtgtggccggacgacttctattcccacagcaagggtcaaaaggtgtatctgacctggcctgtgcccaactgcgccgaaggttgtcctggatcatggatcaaagatggttactgtgataaggcttgtaacaacagtgcttgcgactgggacggaggcgattgcagcggcaactcaggcggtagtcgctacatcgcgggaggaggaggaaccggttccattggagtgggccagccctggcaatttggcggcggtataaactcagtgagctactgcaaccagggctgtgcaaacagttggctggcagacaaattctgtgaccaagcatgcaacgttctttcttgtggttttgatgcaggtgattgtggacaggaccatttccacgaactgtacaaggtaattctcctcccaaatcaaacccactacatcatccccaagggagagtgcctgccgtacttttcatttgccgaggtggcaaagaggggcgtcgaaggcgcgtactccgacaatccaattattcgccatgctagcattgctaacaaatggaagaccattcatctgattatgcactccggaatgaacgccaccaccatccacttcaacctcacattccaaaacaccaacgacgaggaattcaagatgcagatcacggtggaggtggacaccagggaaggaccaaaactcaactccactgcccagaagggatatgagaatctggtgagccccatcaccctgctgcccgaggccgaaatcttgttcgaagatatcccaaaggagaagaggttccccaagttcaagcgccacgatgtcaacagcacacgccgcgcacaggaggaggttaagatcccccttgtgaacataagcctgttgccaaaggacgcccagttgtctctcaacacgttggatctgcagctggaacatggtgatatcactctgaagggatacaaccttagcaaaagtgcgctgctccgcagttttctgatgaattcccagcacgccaagattaagaatcaggcaatcatcactgacgaaactaacgactcacttgtggcaccccaagagaaacaggtccacaagtcaatactgcccaacagtctcggtgtcagtgaaaggctgcagcgcctgacatttccagcagtttccgtgaaggtgaacggacatgaccaaggtcaaaatcctcccctcgacctcgagaccaccgcgaggttcagggtggagacccatacccaaaagactatcggaggaaatgttactaaagagaaacccccgagcctgattgttcccctggaatctcagatgaccaaggagaagaagatcacgggtaaggaaaaagaaaactcacgcatggaggagaacgctgagaatcatattggtgtgacagaagttctgctgggtagaaagcttcagcactatactgactcttatttgggtttccttccatgggaaaagaaaaaatacttccaagatttgctggacgaagaggaatctttgaagactcagctggcatatttcacagacagcaagaatactggtcgccaactcaaggacacctttgcggacagtctgcgctacgttaacaaaatacttaacagtaaatttggctttacatccagaaaggtgcccgctcatatgccccatatgatcgacaggatcgtgatgcaggaactgcaggatatgttccccgaggaatttgataaaacctcattccacaaagtcagacatagtgaagacatgcagttcgccttctcttacttctactacctcatgtctgccgtccaaccattgaacatctcacaggtcttcgacgaggtcgatactgatcagtctggtgtgctgtctgaccgcgagattagaacgctggcgaccagaatccacgaactgcctctctcccttcaggacctcaccggtctggaacacatgctcattaactgttcaaagatgctgccggcagatatcacgcagctcaacaatattccacccacacaggagtcctactatgatcccaacctgcccccagtcactaaatcacttgtcacgaactgtaagccggtgaccgacaagatccataaagcttacaaggacaagaacaagtatagatttgagatcatgggagaggaggaaattgcatttaagatgattagaacgaacgtcagccacgttgtaggtcagctggacgatatcagaaaaaaccccagaaagttcgtgtgcctgaacgacaatatagatcataaccacaaagacgcccaaacagtgaaagctgttctgagagatttctacgagtctatgttcccaatcccatcccaatttgagctcccccgcgagtatagaaatagatttttgcacatgcacgaactccaagagtggagagcctaccgcgacaagctcaaattctggacacactgcgtactcgccaccctgatcatgtttacaatttttagcttcttcgcggaacagttgatcgccctgaagcgcaagatctttcctagaaggagaatccacaaagaggcatcaccgaatcgcatccgcgtt

SEQ ID NO: 16976 - DNA, 3768 bp, Artificial Sequence
  Description of Artificial Sequence: Synthetic coding sequence
atgctgttcaagctcctccagcgccagacttatacatgcctgagccacagatatggcctttacgtatgttttctgggggtggtcgtgacaattgtgagcgctttccagttcggggaagtagtgctcgagtggtcccgggatcagtaccatgtgctgttcgacagctatagagacaatatcgcaggaaaatccttccagaaccgcctatgtctgcccatgcctatcgacgttgtgtatacttgggttaacgggaccgaccttgagctgctgaaagaactacagcaggtgcgagagcagatggaagaggaacagaaggccatgcgtgaaatcctgggaaaaaacaccactgaacctaccaaaaaatccgagaaacagctcgagtgcttgctaacacactgcataaaagtccccatgctcgtgcttgaccctgcactccccgcgaatatcacattaaaagacttaccgtccttgtatccctcatttcattcagcgagtgatatatttaatgtggctaagcccaaaaatccaagcacaaatgtgagtgtcgtggtgtttgattccaccaaggatgtcgaggacgcccactccgggctcctcaagggcaattctagacagactgtgtggagagggtatcttacgactgataaggaggtacccgggcttgttctgatgcaggatctcgctttcctgagcggatttccccccacatttaaggagacaaatcagctgaagacgaagctcccggagaatttgagctcaaaggtgaaactcctgcagctctactccgaagcgtccgttgcccttctgaagttgaataacccaaaggacttccaagagttgaacaagcagaccaagaaaaacatgaccattgacggcaaagaactgacgatatcaccggcttatttgctttgggatctctctgctataagtcagtccaagcaggatgaagacatctcagcaagccgattcgaagacaacgaagagcttagatattccttgcgatctattgagcgccacgcgccgtgggtgagaaatatttttatagtaacaaacggacaaatcccttcttggctgaacctggataacccacgcgtgaccattgtgactcaccaggatgtattccgcaacttgtctcacctgcccactttcagctcaccggctatcgaatcccacatccacaggatagaagggctcagtcagaagttcatatacctcaacgacgatgttatgtttgggaaggatgtctggccggacgacttttatagtcacagcaaaggacagaaagtatacctgacgtggccggtgccaaattgtgccgaaggatgtcctggttcatggattaaagacggctactgcgataaagcctgcaataacagcgcatgtgactgggatgggggcgactgctctggcaacagcggtgggtctcggtacattgccggggggggcggtacagggagcatcggggtgggccagccttggcaattcggcggagggataaacagcgtctcatactgcaatcagggctgcgctaactcttggctcgcggacaagttctgtgaccaagcttgtaatgtactgtcatgtggcttcgacgcaggggactgcgggcaggaccactttcatgagctttacaaagttatcttgctcccgaaccagacccattacattataccaaagggcgagtgcttgccgtactttagcttcgctgaggtagctaagcgcggggtcgagggcgcctatagcgataatcccattataaggcacgcttctattgctaacaagtggaagaccatccacctcattatgcactcagggatgaacgcaaccacaatacacttcaacctgactttccagaacaccaatgatgaagagttcaagatgcagatcacagtagaggtggacacccgtgaaggaccgaaactcaattctacagcacagaagggctatgaaaacttagtgtcccccataactttactacctgaagctgagattctgttcgaggacatcccaaaggagaagcgctttcccaagttcaagcgacacgacgtgaatagtacccggcgcgcccaggaggaagtcaagattcccctcgttaacatttcactgttaccaaaagatgcccagctctccctgaatactctggatctgcagctggaacatggagatatcaccctgaaaggctataatctgtctaagtccgctttgctcagatctttcctaatgaactcccaacatgcaaagatcaaaaaccaggctatcatcaccgatgagactaatgattccttagtggccccacaggaaaaacaagtgcacaagtcaatccttcccaacagcctgggcgtgtcagaacggttgcagcgcttgaccttcccagcggtctctgttaaagtgaacggtcacgaccaaggacagaatcccccgctggacctggagactactgcgcgattccgagtcgagacacacactcagaaaacaattgggggaaacgtgactaaggagaagcccccatccttgatcgttcctctcgagtctcagatgactaaggaaaaaaagattaccggcaaagaaaaggagaattctaggatggaggagaacgcagaaaatcacataggggttacagaagttcttttgggcagaaaactccagcactatacggacagctatctaggctttcttccctgggaaaaaaaaaaatattttcaggatctcttggacgaggaggaatccctgaaaactcagctggcttattttacagactccaaaaacaccggaagacaattgaaagataccttcgcagacagcctacggtacgtgaacaaaattctgaatagcaagtttggctttacttctcggaaagtgccggcccacatgccccacatgatagatcgtatcgtgatgcaagaattgcaggatatgttccctgaggagttcgataagacctccttccacaaggtgcgacactctgaagacatgcagttcgcgttctcttatttctactacctgatgtctgcagtgcaacccctcaatatttcacaggttttcgatgaggtagataccgatcaaagcggtgttctgagcgatagggagatcaggacactggccacacgaattcacgaactgcctctttccttacaggacctcactggcctggaacacatgctcatcaattgttccaaaatgcttcctgctgatattacacagctgaataacatccctcccacgcaggaatcatattacgatcctaatctgccgccggttactaagagtcttgtcactaattgcaagcccgtaaccgataaaatccataaagcttacaaggacaagaataaatacagatttgaaattatgggtgaagaggagattgccttcaagatgatcaggaccaacgtgtcccacgtggtcggacagcttgatgatatcaggaagaatcctcggaaatttgtgtgcctgaacgataatattgatcacaatcacaaggacgcacagacagtgaaagctgtgttgagagacttttatgaatctatgtttccgatcccctctcagtttgagctgccccgtgagtatcgaaatcggtttctgcacatgcacgaactacaagaatggcgcgcctatcgtgacaagctgaaattttggacccattgtgtgcttgctacactgataatgttcaccattttttctttttttgcagagcaactaattgccctgaaacgcaaaatattccctagacgaagaatacacaaggaggcatcccctaaccgtatcagggtg

SEQ ID NO: 16977 - DNA, 3768 bp, Artificial Sequence
  Description of Artificial Sequence: Synthetic coding sequence
atgctcttcaaactcctccagcgacaaacatatacctgtttgagccaccgttatggcttatatgtctgtttcctgggtgtcgtcgtcaccattgtgtccgcgttccagttcggtgaagtcgtcctcgagtggagtagagatcagtatcatgtgcttttcgatagttatcgcgataacatagcgggaaaaagcttccagaacaggctatgtctacccatgccgattgatgtggtctatacatgggtaaatggcacagatctggagttgttaaaggaacttcagcaggtgagggaacagatggaggaggagcaaaaagctatgcgcgaaattctcggaaagaacaccactgaaccaacgaagaagtcggaaaagcaactcgaatgcttgttgacccactgcattaaggttcccatgctggtgttagaccccgcactgcccgcgaacatcaccttgaaagacctgccatcattgtacccatccttccactcagcaagtgacatcttcaatgttgcgaagcccaagaacccatccacaaacgtgagcgtcgttgttttcgatagtaccaaggatgtagaagatgcccatagcggcctgctcaaggggaatagccggcaaacggtgtggcgaggatacctcacgaccgataaggaggtgcctgggctcgtcctcatgcaagacctggccttcttatcgggcttcccacccacatttaaggaaaccaatcagcttaagaccaagctgcctgaaaatctatcgtcgaaagtgaagcttctccaactgtattcggaagcatcggtggcgcttctgaagttgaataatccaaaagacttccaggagctcaacaaacagaccaaaaaaaacatgactatcgacggcaaagagttgaccatctcgccagcatatctgctgtgggatctctctgccatctctcaatctaagcaggatgaagatatctcggcgagtaggttcgaagataacgaggaacttagatatagcctgaggtccattgaacgccacgccccctgggttagaaacattttcattgtgacgaatggacagatccccagctggctcaacctggataatccacgtgtgacaatcgtcacgcatcaagacgtctttcgcaacttgtctcacctgcccactttttcgtctccggctatcgagtcgcacattcaccgtattgaaggtctcagccaaaaatttatctatcttaatgacgatgttatgttcggaaaggatgtatggcctgatgacttttattcgcacagcaaggggcaaaaggtttacttgacctggcccgtccccaattgcgcggaaggatgccccggttcctggataaaggatgggtattgcgacaaagcgtgtaacaactcggcgtgtgactgggacggtggagattgctcaggaaactctggaggttcacggtatattgcaggagggggtggtacgggttccatcggcgtaggtcaaccttggcagttcgggggaggaattaacagtgttagttactgcaatcaggggtgcgcgaactcctggttggcggataagttctgtgatcaggcgtgcaatgtgctatcatgcggcttcgacgccggggattgcggacaagaccatttccacgagctttacaaggttattctattgcctaaccaaacgcactatattatacctaaaggcgagtgtctcccgtatttcagcttcgccgaggttgcaaagcgaggggtcgaaggcgcatattccgataaccctatcattcgccacgcttccattgcaaacaagtggaaaacaatccatctaattatgcattcagggatgaacgcaaccactattcatttcaatctgactttccaaaacacaaacgacgaagagtttaagatgcagatcacagtggaagtcgatacgcgtgagggtcctaaactcaattccaccgcccagaaaggatacgaaaacctggtctctccaataacgctcttgcctgaagctgaaatcctatttgaagacattcctaaagaaaaaagatttcctaagtttaagcggcatgacgtcaattccaccaggcgtgcccaagaggaggtgaaaattccattggttaatatctccctgctgccgaaagacgctcaactttctttgaacacccttgatcttcagctagagcatggagatataactctcaagggatacaacctttcgaaatctgcactcctacggagcttcttaatgaattctcagcatgcgaagatcaaaaatcaagccataattacggatgaaactaacgactccttggtggccccgcaagagaaacaggttcacaaatcgattctaccaaacagtttgggcgttagcgaacgccttcagagactgacctttcctgccgtttcagtcaaagtgaatggacatgaccagggacagaaccccccactggaccttgagactacagcgcgcttccgtgtagaaacgcatacgcagaagacgattggtggaaatgtcaccaaagagaagcctcccagcctgatcgtgccactcgagagtcaaatgaccaaagaaaagaaaatcacaggaaaggagaaggaaaactcacgcatggaggaaaacgcagaaaaccacatcggcgtcacagaagtattactgggaagaaagcttcagcactacaccgattcatacctcggcttcttgccctgggagaaaaagaagtatttccaagatctgttggatgaagaagagagtttaaaaacccaactggcttactttaccgattccaaaaacacaggacgtcagctgaaggacactttcgcagacagccttcgttacgtcaacaagattctgaattccaagttcggatttacttcccgaaaggttccggcccacatgcctcacatgatcgatcgcattgttatgcaagaattgcaagacatgtttccggaggagttcgataagacgtcttttcataaggtacgtcactctgaagatatgcagtttgccttctcctatttttactacctaatgtctgctgtccagcctttgaacatcagccaggtcttcgacgaggtcgatactgatcagagtggagtcctttctgatcgcgaaattcgtacgcttgcgacacgaatccacgaacttcccctatcgcttcaagacttaacagggctcgagcacatgctaatcaattgctcaaagatgctccccgcggacataactcaactcaacaatatcccaccaacgcaagagtcctattatgacccgaatctaccgccggtgactaagagcctcgttactaactgcaagcctgtaaccgacaagatccataaggcctataaggacaagaacaagtaccgcttcgaaatcatgggagaggaggaaatcgcctttaagatgattagaacgaatgtgtcgcacgttgtagggcaattagacgacatccgcaaaaatccgcgaaagttcgtctgtcttaatgataatattgaccacaaccataaggacgctcagacggtaaaggccgtgcttcgggacttctatgaatcgatgttccctataccgagccaattcgagttgccacgcgagtaccgtaaccgattcctacatatgcacgaactccaggagtggcgcgcctatcgtgataagttgaaattctggacacactgcgtgcttgcaactttaataatgtttacgatcttttcattctttgcagagcaacttattgcgcttaagcgcaaaattttcccgagacgtcgaatccataaagaggcgtctcccaaccgtatccgcgta

SEQ ID NO: 16978 - DNA, 3768 bp, Artificial Sequence
  Description of Artificial Sequence: Synthetic coding sequence
atgctcttcaagctgttgcagcggcagacctacacttgcctgtcccatagatacggactatatgtctgcttcctcggggtcgtggtcactattgtgtctgcgtttcagtttggcgaggtggtattggagtggtcccgggaccagtatcatgttctctttgattcatatcgcgacaatattgcaggtaaaagcttccagaatagactttgcttaccaatgcccatcgatgtggtctacacatgggttaacgggactgacctcgagctcctcaaagagttgcagcaggtccgtgaacagatggaggaagaacagaaggcgatgcgggaaattctcggcaaaaacaccacagagcctaccaagaagtccgaaaagcagcttgagtgcctgctcacacattgcatcaaggtacccatgctggtgttggaccccgccttgcctgccaacattaccttgaaagatctgccctccttatatccttctttccatagtgcatccgacatcttcaatgtcgccaagcctaaaaatccgtcaacgaacgtgtcagtggtggtttttgacagcaccaaagatgtcgaggatgcccacagtggtctactgaagggcaatagccgacaaaccgtttggagaggttatctcaccacggataaagaagtacctgggctggtacttatgcaagaccttgcgttcctttcaggatttccccctacatttaaggaaacaaaccaactgaaaacaaaattgccggagaatctgtcctctaaggtcaagttgcttcagctgtacagtgaggcctctgtggcgctgctgaaactgaacaaccccaaggatttccaggagctgaacaagcagactaagaaaaacatgaccatcgatggcaaggagctgaccatctccccagcctatctgttgtgggacctaagtgccatcagtcaatcaaagcaagatgaagacatcagcgcttctaggtttgaagataacgaagagctgaggtattccctgcgctctatcgaacggcacgctccgtgggtcagaaatatattcatcgtgactaatgggcagatcccttcctggttaaaccttgacaaccctcgtgttactatagtgactcaccaggacgtcttcagaaacctttctcaccttcccaccttcagctctccagcaatagagagtcatatccaccggattgagggtctgtctcaaaaatttatctacctgaacgatgacgtgatgtttggcaaggacgtgtggcccgatgacttttacagccattctaaaggtcagaaggtttatttgacctggcctgtcccaaattgcgctgaaggctgtcccgggtcctggattaaggacggttattgtgataaggcttgcaacaatagtgcatgtgactgggacggcggggactgttctgggaacagtggcggctcgaggtatatcgcaggaggaggcggcactggatccatcggcgtcggccagccttggcaatttggaggtggtattaattctgtgtcgtattgtaatcagggctgcgcaaactcctggctcgcggataaattctgtgaccaagcttgtaacgtactgagttgtggctttgacgccggggactgcggacaggatcacttccacgagttgtataaagtgatcctgctacccaaccagactcattacattattccaaaaggtgagtgtctgccctactttagctttgctgaagtggccaaacgtggggtcgaaggagcatacagcgacaatcccattatcagacacgcaagcatagcgaataagtggaagacaatccacctaattatgcacagcggtatgaacgcaactacaatccatttcaatctgacattccagaataccaacgacgaggagttcaagatgcagattaccgtggaggttgatacccgagagggcccaaagctgaattcaactgcgcagaaagggtacgaaaatcttgtctctccaattacccttttgcctgaggcggagatcctcttcgaggatattccaaaagaaaaaagattcccgaagttcaaacgccacgacgtgaactctactcgccgagcccaagaagaagttaagattccactcgtaaacatatccttgctgcctaaggatgcgcagctgtccctgaatacactggacctgcagctcgaacacggcgacatcaccttgaaaggatataacctgagtaagagcgcactgcttaggtctttcctcatgaactcacagcacgcaaaaatcaaaaatcaggccatcatcacagacgagacaaacgactcactggtggctccccaggagaagcaggtgcataagtccattctgccgaactcactgggtgtgtccgaacgtctgcagcgcctcacctttcctgcagtcagcgtgaaggtgaacggacacgaccaaggccagaacccccctttagatctggagacaaccgcaaggttccgcgtcgaaacacacacacagaagacaatcgggggaaacgtcactaaggaaaagccaccttctctgattgtcccactggaaagccaaatgacgaaagaaaaaaagatcacagggaaggaaaaggagaacagtagaatggaggagaacgcggagaatcacattggggttacagaggttttgctgggcagaaaattgcaacattacaccgatagctaccttggcttcctcccttgggagaagaaaaagtatttccaagacctgttggatgaagaagagtcgcttaagacccaacttgcttactttacagacagtaaaaatactggccgacagctgaaggataccttcgcagactccctgcgttacgtgaataagatccttaactccaaattcgggtttacttcccggaaggttcctgcgcacatgcctcatatgatagatagaatcgtgatgcaagaactccaggacatgtttccggaggagttcgacaaaacttcattccacaaagtgaggcactctgaggacatgcagttcgcattctcttatttttactacttgatgagcgctgtacaacccttgaatatctcccaggtgtttgacgaggtagacaccgatcagtcgggtgtcctttctgacagagagatcagaacgttagcgaccaggatccacgagctccccctcagcctgcaggacttgaccggactggagcacatgttaatcaattgctcaaaaatgctgccagcagacatcacacaactgaataacatcccgcctactcaggaaagttactatgatccgaacctcccccctgtgaccaaatcactcgttaccaattgtaagccagtcaccgacaagatccacaaagcctataaggataaaaacaaataccgtttcgagattatgggggaagaggagatcgcctttaaaatgatacggactaacgtgagccacgtcgtcggtcaattagatgacatccgaaaaaatccaaggaaattcgtctgtctcaacgacaacattgatcacaaccacaaggatgcccagaccgtgaaagccgtcctgagagacttttacgagtcaatgttccccatacctagccaattcgagctccctcgggagtaccgcaaccggtttctacacatgcacgaactgcaggaatggcgggcttatagggacaagctgaagttctggacccactgtgtgctggccacactgatcatgtttacaatctttagctttttcgctgagcagctcatcgccctgaagcgcaagatctttcctcgccgcaggattcacaaggaggccagccccaacaggattcgcgta

SEQ ID NO: 16979 - DNA, 3768 bp, Artificial Sequence
  Description of Artificial Sequence: Synthetic coding sequence
atgctgttcaagcttcttcagagacaaacatacacatgtctcagccaccggtacggcctctacgtctgtttcctgggagtggtcgtgacaattgtcagtgcctttcaatttggagaggtggtgctggagtggagcagagaccagtaccacgtactgttcgactcatatagggataatattgcaggaaagagttttcagaatcggctgtgtctgccgatgcctattgacgttgtctacacttgggtcaacggcaccgatctggaacttcttaaagagctccaacaggttagggaacaaatggaggaagagcaaaaggctatgcgtgagatcctcggtaagaacaccacagaacctacaaaaaaaagtgagaaacagctcgaatgtcttcttacccactgcattaaggtgccgatgctggttctcgatcctgccctgcccgctaacatcacactgaaagacctgccatccctgtacccatccttccacagtgcatccgacattttcaacgtcgctaaaccaaaaaaccccagcactaacgtgtcagtggtcgtgtttgacagtactaaggacgtggaggatgctcactctggcctattgaaggggaattccagacaaaccgtttggaggggctacctgaccaccgataaagaggtcccaggtttggtgctgatgcaagatttggcttttctatctggatttcccccaacatttaaagaaacaaatcaactgaagactaagctccccgagaatcttagctctaaagtcaaactccttcagctgtactccgaggcaagcgtagccttgcttaaactgaacaaccccaaggacttccaggaactcaacaaacagactaagaaaaatatgactatagacggaaaggaattgaccattagccctgcttatctgctctgggatctgtccgccatctcacagagcaagcaggatgaggacatttcggcctctagattcgaagataatgaagaacttaggtattctcttagatcaatagagaggcacgccccttgggtgcggaacatattcatcgtgactaacgggcagatcccctcatggttgaacctcgataacccaagggttactatcgtgacccaccaggatgttttcagaaatctcagccatctccctacttttagctcccccgcaatagaaagtcacattcaccgcattgagggtctctctcaaaagttcatctatctgaatgacgacgtgatgtttggtaaggacgtgtggccagatgacttctacagccactcgaaagggcagaaagtttaccttacttggcccgtgcccaactgtgccgaggggtgtcctggttcgtggatcaaagacggctattgcgataaagcttgcaacaacagcgcctgcgattgggacggaggcgattgctctggaaattctggtggatcgcgttatatagctggtggtggaggcacgggctccatcggagtagggcagccctggcagtttggcgggggcatcaatagcgtgagctattgtaaccaaggctgtgccaacagctggctagctgacaagttctgtgatcaagcttgcaacgtgctgtcttgcggattcgatgcaggcgattgcggccaagatcactttcacgagttgtacaaagtgatcctgctcccaaaccagacacattacataattcccaagggcgaatgtctcccgtatttctcctttgctgaagtggccaaacgtggtgtcgagggtgcctacagtgataacccaatcattagacatgcctccattgctaacaaatggaagactatccacctcatcatgcatagtgggatgaatgctaccactatacacttcaacctcaccttccaaaacacaaacgacgaggaatttaaaatgcaaataaccgttgaggtggacactagagagggccccaagctcaatagcacagcacagaaaggatacgagaacctggttagccccatcacacttcttcccgaagcagaaatcctcttcgaagatattcctaaggagaagaggtttccaaaattcaaacgacacgacgtcaacagcactcggcgcgcacaggaagaagttaagatcccccttgttaacatctctttacttcctaaggatgctcagttgtcgctgaacacacttgatctgcaactcgagcacggtgatatcactctcaaaggttacaatctctcaaagtctgctcttctgagaagcttccttatgaactcacagcacgcgaagattaaaaatcaggctatcatcacagacgagaccaacgatagcctcgtggcacctcaggaaaagcaagtgcacaagtccatactgcccaactctctgggggttagcgaacggctgcaaagacttacattccccgctgtgagtgtcaaagtcaacggccacgaccaaggccagaacccacccctggatttagagactacagctagatttagggttgaaactcacacacagaagaccattggcggaaacgtaacaaaggagaagcctccatccctgattgtacccttggaatctcaaatgaccaaagaaaaaaagatcaccggcaaggagaaggagaacagtcgtatggaggaaaacgctgagaatcacatcggggtgaccgaggtgctcctgggaagaaaacttcaacactataccgacagctacctcgggtttttgccctgggaaaagaagaagtatttccaagacctgcttgatgaggaggagtctttgaagacacaacttgcttactttactgactcaaagaacacgggaaggcagctgaaggatactttcgctgacagcctcaggtacgtcaacaaaatccttaacagcaaatttggctttacttccagaaaagtgcccgcacacatgccacacatgatcgacagaatagtgatgcaggaactgcaagatatgttcccagaggaatttgataaaacaagcttccacaaggtccgccacagcgaggacatgcaatttgcatttagctatttctattacttgatgagcgccgtccagcctcttaacatatctcaggtattcgacgaagttgatacagaccagagtggggtgctgagcgaccgagaaataagaacccttgcaactcggatccacgagcttccactctcgctccaggacttgactggacttgagcatatgcttattaactgcagtaaaatgctgcctgccgatatcacccagctgaacaacatccccccaacccaggaatcgtactacgacccaaaccttcctcctgtcaccaagagcctcgtgacaaattgcaagccagtgaccgataaaatccataaggcatacaaggacaaaaacaaatacagatttgaaatcatgggcgaggaggagatagcttttaaaatgattcgcactaatgtgagccatgtggtgggacagctggacgatattagaaagaatcccaggaagtttgtctgcctgaacgacaacatagatcacaaccacaaggatgctcagaccgtgaaagctgtgctgcgggatttttacgagagtatgttccctatccccagccagttcgagcttcctcgtgagtacagaaaccgctttctccatatgcacgaattgcaagagtggagggcttatagagacaaactgaagttctggacccactgcgtcctggcaacccttattatgtttaccatcttttccttctttgcagagcaactgatcgctctgaaaagaaagatttttcctaggagacgaatacataaagaagccagtcctaacaggattagagtc

SEQ ID NO: 16980 - DNA, 3768 bp, Artificial Sequence
  Description of Artificial Sequence: Synthetic coding sequence
atgctgttcaagctgttgcagaggcagacttacacttgcctgtcccacaggtacgggctgtacgtatgcttcttgggggtcgtggtcaccatcgtgtccgcgttccaattcggcgaagtggtgctcgaatggagccgggatcagtaccacgtgctgttcgactcataccgcgacaatattgccggtaaatccttccagaaccggttgtgtctgcccatgcctatcgatgtggtctacacctgggtcaacgggacggaccttgagcttctgaaggagctgcagcaagtgcgggagcaaatggaagaagaacagaaggcaatgcgggagatcctgggaaagaataccaccgagccaacgaaaaagtccgagaagcaactggaatgcctgctcacccattgtatcaaggtcccgatgctcgtactggatccggcgctcccagctaacatcactctgaaagatctgccctcattgtacccgagcttccattcggcttcagacattttcaatgtcgccaagccgaagaacccctcgactaacgtcagcgtcgtggtgttcgattcaactaaggacgtggaggacgctcattcaggcctgctcaaaggtaattccaggcagacggtgtggagaggatacctgaccactgacaaggaagtcccggggctggtcctcatgcaggacctggcttttctctcgggattccctcctaccttcaaggaaactaaccaactgaaaactaaactgccggaaaacctgtcgtccaaggtgaaacttctgcagctttattcggaagcctcggtcgcactgctcaagctcaataatcccaaggactttcaagagctgaacaagcagaccaagaaaaacatgaccatagatggaaaagaactgaccatcagtccagcatacctgctttgggacctgtccgccatctcccaatcgaagcaggacgaggatatcagcgccagccgcttcgaggacaacgaggagcttcgctacagcctgcgatctatcgagcgccacgcaccgtgggtccgcaatatcttcatagtgactaacggccagatccctagctggctcaacctcgacaatccacgcgttaccatcgtgactcaccaagacgtgtttcgcaacctgagccatctgcctacgtttagcagcccagcgatcgaatcgcacatccataggatcgaaggactgtcccagaaatttatttacctgaatgacgacgtgatgttcggaaaagacgtgtggcctgacgacttttattcacactcaaagggacaaaaagtgtaccttacctggcctgtgcccaattgcgcagaaggctgccccgggtcatggatcaaggacggatattgtgacaaggcatgtaataacagcgcctgcgactgggatggaggggattgctcgggaaactcaggtggaagccgctacatcgccggcggaggaggtacggggtcaattggggtgggacagccgtggcagtttggcggaggcatcaactccgtctcatactgcaaccaaggttgtgcgaatagctggttggccgataagttttgtgatcaggcttgcaacgtgctgagttgcggtttcgacgccggagattgcggtcaggatcacttccacgaactgtacaaagttatccttctgccgaaccagactcattacatcatcccgaagggagagtgcctcccatacttttcattcgcggaggtggccaaacggggggtggaaggagcgtattcggataacccgatcatccgccacgcgtctattgcgaacaaatggaaaacgatccatttgattatgcacagcggaatgaatgcgactaccatccactttaatctcacttttcagaacaccaatgatgaagaattcaaaatgcagatcaccgtggaggtggacactagagagggaccaaagctgaactccactgcccagaagggctacgagaacctcgtgtccccaattactctgctgccggaggcggaaattctgttcgaagatattccgaaggaaaaaaggttcccaaagttcaagcggcatgacgtgaattcgacccgtcgcgctcaggaagaagttaagatcccgctcgtcaacatctcactgctcccgaaggatgcccaactctccctgaacactctggacctgcagctcgagcacggagacatcacgctcaagggctacaacctctcgaaaagcgctctgctgaggtcgttcttgatgaactcccagcacgccaagatcaagaatcaagcaatcatcaccgacgagactaacgattcgctcgtggccccgcaggaaaagcaggtgcacaagtctatccttccgaattcgctcggagtgtccgaacgattgcaaagattgacttttccggctgtgtcggtgaaggtcaacggccatgaccagggacagaaccccccgctggacctggaaaccactgcccgctttagagtggaaactcacacccagaaaaccatcggcggaaatgtgaccaaagagaagccgccttcactgatcgtccctctggaatcacagatgaccaaggagaaaaagatcaccggaaaggagaaagaaaactccagaatggaagagaatgcagagaatcacatcggagtgactgaggttctcctgggcagaaagctccagcactacaccgattcgtatctgggcttcctgccctgggaaaagaaaaagtacttccaagatctcctcgatgaggaagagtccttgaaaactcagcttgcctactttactgacagcaagaacactggccggcaactcaaagacaccttcgcagacagcctgagatacgtgaacaaaatcctcaactcgaagttcggattcacttcccgaaaggtcccagcacacatgccgcacatgattgaccgcatcgtgatgcaggaacttcaagatatgttcccagaagagttcgacaagacttcgttccataaggtgcgccactccgaagatatgcaatttgccttctcgtacttctactacctcatgtctgccgttcagccacttaacatctcgcaggtgttcgacgaagtggataccgaccagtcgggagtgttgtccgatcgggagattcggactctggcgacccggattcatgaactgccgctgagcttgcaggatctcaccggccttgagcacatgctcattaattgctcaaagatgctgcctgccgatatcacccaactgaacaatatcccgccgacccaggagagctactacgacccgaacctccctccagtgaccaagtccctcgtcacgaactgcaagccagtgactgacaagatccataaggcttacaaggacaagaacaagtaccggttcgagatcatgggagaagaagaaatcgccttcaagatgatcagaaccaacgtgagccatgtggtcggtcaactggacgatatccggaagaacccacggaaatttgtctgcctgaacgataatatcgaccataatcataaggatgcgcaaacggtgaaggcagtcctgcgcgacttttacgaatccatgttcccaatcccttcgcagttcgagctgccgagagagtaccggaatcgcttcctccacatgcatgaattgcaagaatggcgcgcctaccgtgacaagttgaaattctggacccactgcgtgctcgccaccctgatcatgttcaccatcttctcgttcttcgcggaacaactgattgcactgaagcgcaagatcttcccgagacggcggatccacaaggaggcttccccaaaccgcatcagagtc

SEQ ID NO: 16981 - DNA, 3768 bp, Artificial Sequence
  Description of Artificial Sequence: Synthetic coding sequence
atgttattcaaactgctccagagacagacatacacgtgcctcagccataggtatggcctctacgtctgttttctgggggtcgtcgtaacgatcgtctcggcgtttcagtttggggaggtggtcctcgaatggtcccgggatcagtaccacgtattgttcgactcctaccgagacaacatcgcagggaagtcattccaaaataggctctgtttgccgatgccgatcgacgtagtatacacctgggtgaacgggaccgacttggagctcctgaaagagcttcagcaggtgagagaacaaatggaggaagaacagaaggcgatgcgggagattctgggtaaaaacaccaccgaacccacaaagaagtccgagaagcagcttgaatgcctcttgactcattgcatcaaggtccccatgctagtattagatcccgcgttgcctgcaaatatcacgctcaaagacctcccttccctctacccatcattccacagcgccagcgatatttttaacgtagccaaaccaaaaaaccccagcaccaatgtgagcgtggttgtctttgactctacaaaggacgtggaggacgcccatagcggattgttgaagggtaacagtaggcaaaccgtgtggagggggtacctgaccacggacaaagaagtaccaggcctggtcctcatgcaagacctggcttttctgtctggatttccccctacttttaaagaaaccaatcagctaaaaacaaagctgcccgagaacttatcctctaaggtaaaattgctccagctctacagtgaagcctcagttgccttgcttaagttgaacaacccaaaagacttccaggaactcaacaagcagactaagaagaatatgacaatcgatgggaaggagttgaccattagtccagcctacctgctgtgggacctatctgctatcagccaaagtaaacaggatgaagacatcagcgcctctcgatttgaggataacgaggagctgcgttattccctgagatctatcgaacgccatgccccttgggtgagaaacatattcatcgtgactaatggccagattccctcttggctgaacctggataaccctagggtcacaatagtgacccaccaagacgtctttcggaatctgtcccacttgcccacttttagtagccctgcaattgagtcccacatccatcggatcgaggggttgtctcagaaatttatctacctcaatgatgatgtgatgtttggtaaggacgtgtggcctgacgatttctattcacacagtaaaggacagaaagtgtacttgacttggcccgtgcccaactgcgctgaggggtgccccgggtcctggatcaaagacggatattgtgacaaggcttgcaacaatagcgcctgtgactgggatgggggagattgcagtggtaactccggcgggagccgctatattgccggtggaggtggcaccggttccataggggtcggacagccctggcagtttggaggaggaattaatagcgtttcatactgtaatcaggggtgcgcaaactcgtggctggcggataaattttgtgatcaggcttgcaatgtgttgtcttgcggcttcgatgcaggcgactgcggacaggaccatttccatgagctgtacaaggtgattctcttgccaaaccagacacactacatcataccaaaaggcgaatgtttaccatattttagctttgctgaagtggctaaacggggcgtggaaggagcatacagcgacaatcccataatccggcacgcgtctatcgccaataagtggaagaccatacacctcatcatgcattctgggatgaatgccaccacaattcactttaacctgacattccaaaatacaaacgacgaagagttcaagatgcaaattaccgtcgaagtggacaccagggaaggtcccaagctgaacagtactgctcagaaggggtatgaaaaccttgtaagtccgatcactctgctccccgaagcagagatcctgtttgaggacatacccaaggagaagcgcttcccaaagtttaagcgccatgatgtgaacagtactcgtcgggcacaggaggaagtgaaaattccgctggtgaatattagtctcttaccgaaagacgcgcaactgtccctgaataccctggacctgcagctggagcacggagacatcacgctcaagggctacaacctctccaagtcggctctcctgaggtctttcctgatgaactctcaacacgcaaaaataaaaaaccaggctatcataacggatgagaccaacgactctctggtcgcacctcaggagaaacaggtgcacaagtctatcctgccaaacagcctcggggtgagcgagaggctccagcgcctgacattccctgctgtttccgtgaaggtgaacggccacgaccaggggcagaatccaccgctcgacctcgagactaccgccagattcagggtggagacgcatacccaaaaaacaataggcggcaatgttaccaaggaaaagcctcccagcctgattgtacccctagagtcacagatgacaaaggagaaaaaaattaccgggaaagaaaaggagaactcacgtatggaggaaaacgcagaaaatcacataggggtgacggaagtcctgctcgggaggaagttgcagcattacaccgactcctacctcggctttctgccttgggaaaagaaaaaatactttcaagatttactagatgaggaggagtcactcaaaacacagctagcttactttaccgactccaaaaacacaggcaggcagttgaaggacacgtttgcagactccctgaggtatgtgaacaagatactgaatagcaaatttgggtttacatcaaggaaagtaccggcccatatgccccacatgattgataggatagtgatgcaggaactccaggatatgttcccagaggagtttgataagacttccttccataaagtcaggcattctgaagacatgcagttcgcctttagctacttttattatttgatgagcgccgtccaacccctgaacatctcccaagtgttcgatgaggtagacacagatcagtccggtgttctgtctgatagagagattcgaacactggcaacaagaatccatgaattgccgttgtcactgcaagacctgacaggcctagagcatatgctgataaactgcagtaaaatgttaccagcagacatcactcaactgaacaatattccacccactcaggaatcatattacgatccaaacctgccacctgtgaccaaaagtctggtaaccaactgcaaaccggtcacggataaaatccacaaagcctacaaggataagaataagtacagattcgagatcatgggagaagaagagatcgcattcaaaatgattagaacaaacgtctcacacgtcgtcggccaactggacgacattaggaaaaacccacggaagttcgtttgcctcaatgacaacatcgaccataatcacaaagacgcccagacagtgaaagcggttctgagggacttctacgaatccatgtttcccatcccttctcagttcgaactgccccgggaatataggaaccggttcttgcacatgcacgaactccaggaatggcgtgcgtaccgggacaaactgaaattctggacacattgtgtgttggccactctgatcatgttcaccattttctcattcttcgccgagcagctgattgccttaaagagaaagattttcccccgaaggagaattcataaggaagcatcgcctaaccgaataagagtg

SEQ ID NO: 16982 - DNA, 3768 bp, Artificial Sequence
  Description of Artificial Sequence: Synthetic coding sequence
atgctatttaagctgctacagcggcagacatacacgtgtctaagccacaggtacggtctctacgtttgctttctgggcgtagtggttacaattgtaagcgccttccagttcggcgaggtggttcttgagtggagcagagatcagtatcacgtcctgtttgattcctatagggataatatcgccggcaaatcatttcagaacagattgtgtctccctatgcccatagacgttgtgtacacgtgggtgaatgggacagacttggaactcttgaaggagctgcagcaggtgcgcgaacagatggaggaggaacagaaagccatgagggaaatccttgggaaaaacaccacagagcccaccaaaaagtctgagaagcaactggagtgtctactgactcactgtatcaaggtccctatgctcgtcctggaccctgccctgcctgccaatattactttaaaggatttgcctagcctttatcccagctttcatagtgcatccgatatctttaacgtggccaaacctaagaacccttcgactaatgtctctgtcgtggtattcgacagcacaaaagatgtggaggacgcacacagcggcctgctcaaaggaaactctcgtcagaccgtttggcgggggtatctgactaccgataaggaagtgcccggcttagtgctgatgcaggatctcgcctttctgtctggatttcctcccacctttaaggaaactaaccaattaaagaccaagctacctgaaaatctgtcttcaaaagtgaagcttctgcagctttattctgaggccagcgtcgccctactgaagctgaataatcctaaggatttccaggagctgaacaaacagacaaagaagaatatgacaatagatggaaaggaactcaccatctcgccagcgtacctgctgtgggacctgtctgccatttctcaaagcaagcaagacgaagacatctcagcttccagatttgaggataatgaggagctaaggtatagccttcggtccattgagaggcatgctccttgggtcaggaatatttttatagtcaccaacggacagataccatcatggctgaacctggacaatccccgcgtgaccatagtgacccatcaggacgtttttcgcaatttatcccatctgcctacattctcatctcccgctattgagagccatatacatcggatcgaggggctgtctcagaaattcatctatttaaatgatgacgtgatgtttggcaaggatgtttggcccgacgacttctactcacacagtaaaggccagaaagtctacctgacctggccagtgcccaactgcgccgaaggctgcccgggaagctggattaaagacggatactgcgataaagcatgtaacaatagtgcctgtgattgggacggaggcgactgcagtggcaattcagggggctcacgatatattgcgggtgggggcggcacagggtccatcggagtgggtcagccctggcagtttgggggaggtattaactcggtgtcttactgcaaccagggatgcgctaacagttggttagcggacaaattctgcgaccaggcttgtaatgttctctcctgcggttttgacgccggggattgcggccaggaccatttccacgaactatataaggttattctgttgccgaatcagactcattacatcatcccaaagggagagtgtctcccatacttctcgttcgctgaagtggcgaagagaggcgtcgagggggcttacagcgataaccctattatccgtcatgcatccatcgctaataaatggaagaccatccatctgataatgcacagcggcatgaacgccacgacaatacactttaatctgacgtttcaaaataccaatgatgaggagtttaagatgcagattacagtcgaggtggataccagagaggggcctaagctaaatagtactgcccagaaaggatacgagaaccttgtatccccgattacgttgctacctgaggctgaaatactgttcgaagacattcctaaggagaaacgctttcccaagtttaagaggcacgacgtaaatagcactcgtagggcacaagaggaggtgaaaattccactggtcaatatcagtctgctgcctaaggatgcccagttgtcattgaatactcttgacttgcagttagaacacggagacataactctgaaggggtacaacctgtctaagtcagcactgctcagatccttcctgatgaattctcaacacgccaagataaaaaatcaggctatcataactgatgaaactaacgacagcctcgtcgccccccaagaaaaacaagtgcacaaaagtatcctcccaaatagtttaggggttagtgagcgactgcaacgcctaacgtttcctgctgttagcgtcaaggtaaacggacatgatcagggacaaaacccccctctcgatcttgaaactacagctagattccgggtagagacgcatactcagaagacaatcggcggcaacgttactaaggagaagcccccttctctgatagtgccactggagtcgcagatgaccaaagagaagaagattactggaaaagagaaggagaacagtcggatggaagagaatgcagagaaccacatcggtgtaactgaggtgctgctgggcagaaaattgcagcactacactgacagttaccttggcttcctgccatgggaaaagaagaaatactttcaggacctgttggacgaagaagaaagcttaaaaactcaactcgcttacttcactgacagtaagaataccgggcgccagctgaaagatacatttgcggattctttgcggtatgtgaataaaatattaaacagcaagttcggcttcacctcgcggaaggtgccagcacacatgccgcacatgattgatagaattgtgatgcaagagctccaggacatgttccctgaggagttcgacaaaacgtcctttcataaggtcaggcactcagaggatatgcagtttgctttcagctacttttattacctgatgagtgcagtacagccattgaatatctctcaggtgtttgatgaggtggacaccgaccagtcaggcgttctgagcgacagagagatcaggacactcgccactcgcatacacgaactcccactgtctttacaggatctaactggcctagagcacatgttgatcaattgttcaaagatgctgcccgccgatattacacaactaaataatatcccacctacacaggagagctactatgaccctaacttaccccccgtgaccaagtccctggtaaccaattgtaagcccgtgacagacaagatccataaggcttataaggataaaaataagtatcgatttgaaattatgggcgaggaagaaattgcctttaagatgattagaacgaatgtgagccacgtggttggacagctcgatgatattaggaagaatcccagaaaattcgtttgtttaaatgataatatcgaccacaatcacaaggacgcccagactgttaaggccgtgctaagagatttttacgaatcaatgtttcctattcccagccaattcgagctgcctcgtgaatacagaaatagatttctgcacatgcacgaactgcaggaatggcgggcgtatagggataagttgaagttttggacgcactgcgtgctggcaactctgattatgttcacaattttttcatttttcgccgaacagttaatcgcactgaagaggaagattttcccgcgacgacgaattcacaaggaagcttcgccaaaccgcataagagtt

SEQ ID NO: 16983 - DNA, 3768 bp, Artificial Sequence
  Description of Artificial Sequence: Synthetic coding sequence
atgctatttaagctcctgcagcggcaaacttatacctgcttgtctcatagatacggactttatgtatgctttctgggcgtcgtagttacaatagtctctgcctttcagtttggtgaggtggtactcgagtggtctcgcgaccaatatcatgtgctcttcgatagttaccgtgacaacattgctggcaagtccttccagaacagactgtgcttaccgatgcccattgatgttgtgtacacatgggtcaatggtacagacctggagctcctgaaggagctgcagcaggtacgtgagcaaatggaggaggaacaaaaggcaatgagggagatcctaggcaaaaatactaccgaacctaccaagaaatcggagaagcagctggaatgcctgctgacacactgtataaaggtgccaatgctggtgctggacccggccctgcctgctaacatcacgctgaaggatctgccaagcctgtacccctcctttcactccgcatccgatatttttaacgttgccaagccaaagaacccatcgaccaacgtctctgtggttgtgtttgatagtacgaaggacgtggaagatgcgcattcggggctgctgaagggcaactccaggcaaacggtctggaggggttacctcactaccgataaggaggtccccggactggtgttaatgcaggatttggctttcctgtcggggttcccacccacgttcaaggagaccaatcaacttaagaccaaactcccagagaatctgtcgagtaaggtaaagttacttcaactatacagcgaagcgagcgtggctctactgaagttaaacaacccaaaagactttcaggaactcaataaacaaactaagaaaaacatgacaatagatggcaaagagctgaccatcagtcccgcgtatctgctgtgggatctgagcgctatcagtcaatctaagcaggacgaggacatcagcgcatctcggttcgaggataacgaggagttgcgctactctctccgaagcatagagcgtcatgctccctgggtcagaaacatcttcatagtcaccaacgggcagattccttcatggctcaacctggacaatcctcgtgtcaccatcgtgactcaccaagacgtgttccggaacctgagccatctgccgacctttagttccccggctatcgagtcccacatacacagaatcgagggtttgtctcagaagttcatctatcttaatgatgacgttatgttcggcaaagatgtgtggcccgacgatttctactcccatagtaagggtcagaaggtctatcttacctggccagtgcccaattgtgctgagggttgccccgggtcctggataaaggacgggtactgcgataaagcttgcaataatagcgcgtgcgactgggacgggggagattgtagtggcaattccggaggctccaggtacattgctggcggtggcgggaccggctccattggcgtgggtcaaccttggcagtttggggggggcatcaatagcgtgtcgtattgcaaccagggctgcgcaaactcatggctggccgacaaattctgtgaccaggcatgcaacgtgctgagttgcggatttgatgccggtgactgcggacaggaccattttcatgagttgtacaaagtcatcctcctccccaaccagacacactacattatacctaagggtgaatgtctgccctatttctccttcgcggaggtggcgaagcgcggagttgagggagcttactcagataacccgataatccgacatgcctcgatcgcaaacaaatggaagaccattcacttgatcatgcacagcggaatgaacgccacaacaattcattttaaccttaccttccagaataccaatgatgaggagttcaagatgcagattaccgtggaggtggacacccgcgaagggcctaagctgaatagcacagctcagaaggggtacgaaaatctggtttcccctattacccttctgccagaggccgaaatactgtttgaagacattcctaaggagaagcggttccccaagtttaaacgccacgacgtcaacagtacccgaagggcccaggaggaagtcaaaatcccgctggtcaacatttctctgctgccgaaagatgcccagctgtcactgaacacattggacttacaacttgaacatggggacattaccctgaagggctacaacctgtctaagtccgccctgctgcggtcctttctcatgaacagtcaacatgccaaaataaagaaccaggctattattactgacgagacaaatgattctctcgtcgctcctcaggaaaagcaggtccacaaatctatcttgccaaatagcctgggcgtcagtgaacgtctgcagcgcctcacgttccctgccgtgtccgtgaaggtcaacgggcacgatcaggggcagaatccccctctagatctagaaactaccgccaggttccgggtcgagacccacactcagaagaccataggtgggaatgtgacgaaggagaaacccccgagcttaattgtgccactggagtcacagatgaccaaagaaaagaaaatcacaggcaaagagaaggagaacagcagaatggaggagaacgcagagaaccacatcggcgtaactgaggtgcttctgggcagaaagctccagcactacacagatagctacctgggttttttaccctgggagaagaagaaatacttccaggatctgttagatgaagaggagagtctgaaaacccagctggcctactttaccgactcgaaaaacacaggtcgacagctgaaagatacctttgccgactcgctgaggtatgtgaacaaaatactgaattctaagtttggtttcacgtcccggaaggtccccgcgcacatgccccacatgatcgataggatcgtaatgcaggaactgcaggacatgttcccagaagagtttgacaaaacctcttttcacaaggtccgccatagtgaagacatgcagtttgcattttcgtatttctactacctgatgtccgccgtgcagccattgaatatcagtcaggttttcgacgaagttgacacagaccagtctggcgtcctgagcgatagggagatccggaccttagcaaccagaatccacgaactgcccctgagcttgcaggatctgactggactggagcatatgcttatcaactgttctaaaatgctgcccgctgatattacccagctgaataacatcccccccacgcaagaaagttactatgaccctaacctcccccccgtaacgaagtcactggtgaccaactgcaagccagtgacagacaagattcacaaggcttataaggacaagaataagtaccgcttcgaaataatgggagaagaagagattgcttttaaaatgatccgcacgaatgtcagccacgttgtcgggcaactggacgacattagaaagaatccccgcaagttcgtctgtctgaacgacaacatagaccacaaccataaggatgctcaaacggttaaggcagtgctgcgggacttttatgagagcatgttcccaatacccagccaattcgagttgcctcgggagtaccggaatcgctttctccacatgcatgagctgcaagagtggcgtgcctatcgcgacaaactgaaattctggacgcactgcgtgctggcgactttgattatgtttacaatcttttccttcttcgcagaacagctcattgcgctcaaacggaagattttcccccggcggcgcatccacaaggaggcctcccccaatcggattcgcgtt

SEQ ID NO: 16984 - DNA, 3768 bp, Artificial Sequence
  Description of Artificial Sequence: Synthetic coding sequence
atgctttttaagcttctgcaacgtcaaacttacacatgcctctcccatagatatggtttgtacgtttgctttcttggtgtcgtcgtgacaatagtctcagcattccagtttggtgaggtggtactagagtggtcaagagaccagtaccatgtgttgtttgattcgtatcgagataacattgctgggaagagctttcagaaccgcttatgtcttcctatgccaattgacgttgtttacacatgggttaatggtaccgatctcgagctgcttaaagaattgcagcaagtaagagagcagatggaagaggagcagaaggccatgagggagatattaggaaaaaacactactgagcccacaaaaaagtctgagaagcagctggagtgtcttttgacacattgcataaaggttcctatgttagtgctcgacccagctttgcctgcgaatataacccttaaagatttacctagcttgtacccttccttccactccgcttctgatatattcaacgtcgctaagcctaagaacccttctactaacgtaagtgttgtggtgtttgattcaacaaaggatgtcgaagatgctcatagtgggcttcttaagggtaattccaggcaaacagtttggaggggatatttgactactgacaaggaagtccccgggctcgttttgatgcaagatcttgcattcttatccggttttccacctactttcaaagagacaaatcagctcaaaactaagcttccggagaacttaagtagtaaggtgaagctcttgcaattgtactctgaggctagcgttgctctcttgaaactgaacaaccccaaggattttcaagaacttaacaaacaaactaagaaaaatatgactattgatgggaaggaacttacaatctctccagcctaccttctttgggatttatcggcaatctctcagagtaagcaagacgaggatatatctgcgagtaggttcgaggacaatgaggaactgcgttatagtctcagaagcatcgaaaggcatgccccatgggtgagaaatatatttatcgttaccaacggtcagataccgtcatggctcaacttggataacccccgagttaccatagtgacccaccaagatgtttttaggaacctctctcatctcccgactttctcttcccctgctatcgagtcacatattcatcgaattgaggggctctctcaaaaatttatttacttgaatgatgacgttatgttcggtaaagatgtctggccggacgacttttatagccatagtaaaggacagaaggtgtatttaacatggcctgttcctaattgtgctgaggggtgtccgggttcttggatcaaggatggatattgcgataaagcatgcaataacagcgcctgcgattgggatggtggagattgctccggaaactctgggggcagtaggtatatagcaggaggggggggtaccggttcaatcggtgttgggcagccctggcagttcgggggtggaattaacagtgtttcttactgtaaccaaggttgcgctaactcttggcttgctgataagttttgtgatcaagcgtgcaatgtgctatcctgcggattcgatgccggtgattgtggtcaagaccacttccacgaactgtacaaggtcattctcctgcctaatcagactcattatattatcccaaagggagagtgcctcccatacttttctttcgcggaagtagctaagcgaggggtggagggtgcctactcagataatccaatcattcggcatgcatctattgctaacaaatggaagactattcacctgattatgcattctggtatgaacgccacgacgattcatttcaacttaacattccaaaacacaaatgatgaagagttcaagatgcaaattacagttgaagtggacactagagagggacctaagctcaattccaccgctcaaaaaggttacgagaatctagtttccccaataactctgctgccggaggctgagatactcttcgaagacataccgaaggaaaagagatttccaaaatttaagcgacacgatgtgaatagcactaggcgtgctcaagaagaagtaaaaattcccctggtgaatatttccctccttcctaaggacgcacaattgtcacttaatactcttgatctccaactcgagcatggtgatattactcttaaggggtataacctgtcaaaaagcgctctattacgatcattcttgatgaactcccaacacgcaaaaattaagaatcaggctattataactgacgaaacgaatgattctctagttgctccacaggagaaacaagtgcataaatcaattttacctaacagcttgggcgtctcagagagactacagcgtttgacctttcctgctgtttcggttaaggttaatggacacgaccaagggcagaatccccccctggatttggagaccacagctaggtttagggttgagactcacacccagaaaacaatcggcggaaatgtcacgaaagaaaaaccaccaagtcttatcgtccccctggaaagtcaaatgacgaaagaaaagaaaattacagggaaagagaaagagaattctaggatggaagagaacgctgaaaatcacatcggtgttaccgaagttcttcttgggagaaagcttcagcattatacagactcctacctcggattccttccctgggaaaaaaaaaagtattttcaggatctgttggatgaagaagaatctctaaagacacaacttgcatacttcactgactctaagaatactggacgtcagctaaaggatactttcgctgattcgcttaggtatgtgaataaaattcttaatagcaagttcggattcacatccaggaaggtccctgctcatatgcctcacatgattgataggattgttatgcaagaacttcaggacatgtttccagaagagtttgataaaacttcatttcataaagtgaggcacagtgaggatatgcaatttgctttctcttacttttattatttaatgtccgctgttcagccccttaacatcagccaagtctttgatgaagtcgatacagatcagtcaggggttctttcggatagagaaatccgaacgctcgctaccaggatccacgagttgccactttcactgcaggatcttaccggtcttgaacatatgctaatcaattgctctaagatgttgcctgctgatattacacagctaaataatatccctccaactcaggaatcctactatgacccaaaccttccgcctgttactaagagtctagtaactaactgtaaaccagttactgacaaaatacacaaggcttataaagacaagaacaaatatagattcgagattatgggtgaggaagagatcgcattcaaaatgattcggacaaatgtttcgcacgtggtcggtcaacttgatgatatcagaaaaaatcctcgtaaattcgtttgtttgaacgacaacatcgaccataaccataaagacgctcaaacagttaaagctgtgctgagggatttctatgagagcatgttccccattccgtcccaatttgagttgcccagggaatataggaatcgctttctccatatgcatgagcttcaagaatggcgagcctatagggataagctcaaattctggacacactgcgtgttagctactctaataatgttcacaatatttagcttctttgctgagcaattgattgctttgaaaaggaagattttccctaggagaagaatacacaaggaggctagccctaataggattagggtg

SEQ ID NO: 16985 - DNA, 3768 bp, Artificial Sequence
  Description of Artificial Sequence: Synthetic coding sequence
atgctgtttaaactgctgcaacggcaaacctatacttgcctttcgcacaggtatggactgtatgtatgctttctaggtgttgtggtcactatcgtatcagccttccagttcggcgaagtagtcctggaatggtcaagagatcaataccacgtgcttttcgactcgtaccgggataacattgcaggaaagtcctttcagaatcgcctctgtctccctatgccaatcgatgttgtctatacctgggtgaatggtactgacctggagttattgaaggagctgcagcaggtccgcgagcaaatggaggaggaacaaaaggcaatgcgtgagatattaggaaaaaacaccactgaacctaccaaaaagtctgagaaacagttagaatgtctgctcactcattgtatcaaagtgcctatgctggtgctggaccctgcactccccgccaacataacactgaaggatttacccagcctgtacccatccttccactcagctagcgatatcttcaatgtagctaaacccaaaaacccatccactaacgtttccgtagtggtatttgatagcaccaaggatgtcgaggacgcacactcagggcttctgaagggcaactctcgccaaactgtctggcgaggatatctcacaacagacaaggaggtccccggactggtgcttatgcaggatctggctttcctaagcggctttcccccaacattcaaggagaccaaccagctcaaaactaaactgcccgaaaacctgtcctctaaggtcaagttactgcagctctactcagaagccagcgtcgccctcctcaaattaaacaatcctaaggacttccaggaactgaataagcagactaaaaagaacatgaccatcgacggaaaagagctgaccatctcccctgcctatcttctttgggacctgagtgcaatctcacaatccaagcaagacgaggatatctcagcctcacgattcgaagataatgaagagctccgatattcgctccgcagtatcgagcggcacgccccctgggtcagaaacatcttcatcgtgaccaacggacagattccctcgtggctcaacctggataatccccgcgtgacgatcgtgacacaccaggatgtcttccggaatctctctcacctgccaacttttagctcacccgccatcgagtctcatatccacaggatagaaggtctatctcagaagtttatttatctgaatgacgacgtcatgtttggaaaggacgtctggcccgacgatttttactcccactctaaaggacagaaggtatatctcacatggcccgtgcctaactgcgcagagggctgtccaggtagttggatcaaagacggatactgcgataaagcttgcaacaatagcgcatgtgactgggacggcggtgactgttccgggaatagcggtgggtcacggtacattgccggtggcggaggtacagggtccataggagtcgggcagccttggcaatttggtggcggcatcaatagcgtgagctattgcaatcaaggctgtgcaaattcttggctggccgataaattctgtgaccaggcctgcaacgttctgagttgtggctttgacgctggcgactgcggccaggatcacttccatgagctgtataaagtcatactgctgcccaaccagacccactatatcattcctaagggcgaatgtctgccctacttctcctttgccgaggtggcaaagcgcggggtggaaggcgcatattccgataatccaatcatcagacacgccagcatcgcaaacaagtggaagactatacacttgatcatgcattcggggatgaatgcgacaactattcactttaacctaaccttccaaaatacgaacgatgaggagttcaagatgcagatcaccgtcgaggtggacacccgcgagggacccaaactcaacagcactgcgcagaagggttatgaaaaccttgtgagccccatcactttgcttccagaggccgagatactgtttgaagatataccaaaggagaaaagatttccaaagttcaaacggcacgacgtcaatagcactcgcagggcccaggaggaggttaagatccctcttgtgaacatatctctgctcccaaaggatgcccagcttagcctgaatacactggatttacaactcgagcatggagacatcacattgaaaggctacaacctgtccaaaagcgctcttctcagatcattcctgatgaacagtcagcacgccaagattaaaaaccaagccatcattaccgatgaaacgaacgactccttggtcgcaccacaggagaagcaggtgcataagtccattctgccgaactctctcggggtctctgagaggctccagaggctcactttcccagcagtctctgtgaaggttaacggccacgaccagggtcagaatccccccctggacttggagacaacagcccggtttcgagtggaaactcatacccagaagacgatcgggggcaacgtaaccaaggagaagcctcccagtttgatagttcccttagaatcccagatgaccaaagaaaagaaaattacgggaaaggaaaaagaaaactcgcggatggaggagaatgctgagaaccacatcggcgtgaccgaagtgttgctaggaaggaaactgcaacactacaccgatagttacctcggcttcctgccctgggaaaagaaaaagtatttccaggatctgctcgatgaggaggagtctctgaagacacagctagcctattttaccgatagcaaaaataccggcaggcagctgaaggatacgtttgccgatagtctacggtacgtgaataagatcctcaactccaagttcggtttcaccagtaggaaagtcccagcccatatgccacatatgattgataggatcgtcatgcaggagctgcaggacatgtttcctgaagaattcgataagactagttttcataaggtgcggcacagcgaggacatgcagtttgcgttttcatacttctactacctgatgtcagctgtacagccattgaacatctcacaggtgtttgacgaggtggatacagatcagtcaggagtgctgtcagaccgagaaatccgtacgctggccacgaggatccatgagctgccactatctctgcaggatctgaccgggctggagcacatgctgatcaactgcagcaagatgctgcccgcggacatcacccagctgaataatatcccgcccacacaagaaagttattatgatccgaacttaccacctgtgaccaaatccctagttaccaactgtaagcccgtgacagacaaaattcataaggcatacaaagataagaacaagtatcgcttcgaaatcatgggcgaagaggagattgcctttaagatgataagaaccaatgtcagccacgtcgtcggccagctcgacgatatcaggaagaatccgcgaaaatttgtgtgcctgaacgacaacattgaccacaaccacaaagacgcccagaccgtcaaagccgtgcttcgcgatttttatgaaagcatgttccctataccctcccaattcgaactcccacgggagtatagaaataggtttcttcacatgcacgaacttcaggagtggcgcgcctacagagacaaactcaagttctggactcactgcgtgcttgcaacactgattatgtttactatcttctctttctttgccgagcagctgattgctttgaagaggaaaatatttccaagaaggcggatccacaaggaggccagtcccaatcgaattagggtg

SEQ ID NO: 16986 - DNA, 3768 bp, Artificial Sequence
  Description of Artificial Sequence: Synthetic coding sequence
atgctcttcaaactgttacagcgccaaacctacacttgcttgtcacataggtatgggttatacgtgtgttttcttggcgtggtcgtaacaattgtgagcgctttccagttcggtgaagttgtgttagagtggtcccgcgatcaatatcacgtgctctttgattcttatagagacaacatcgctgggaaatccttccagaacagattgtgtttgcccatgcccatcgatgtagtctatacctgggtaaatgggacagaccttgagctgttgaaggaactgcagcaggttagggaacagatggaagaagagcaaaaggccatgagggaaatcttaggcaaaaataccaccgaacctactaagaaatccgaaaaacaactcgaatgcctgctgacccactgcattaaggtcccaatgctggttttggatcccgccctgccagctaacattactcttaaggacttgccttcgctttaccctagcttccactcagcttcagatatcttcaacgtcgcaaagcccaaaaatccttctactaatgtgtccgtcgtggtgtttgacagcacaaaagacgttgaggatgcccattccggcctgctgaaaggaaattcgcggcagaccgtttggagaggctacctgactaccgacaaggaagtccctggactagtactgatgcaggatctcgctttcttgtccggttttccaccaacattcaaagaaacaaaccagctgaagactaaactaccagagaacctctcctctaaagtcaagttgctccaactctacagcgaggcatctgtggccctcctgaagctcaataacccaaaagatttccaagaactgaataaacagacaaagaagaacatgaccatcgatggcaaagaattaaccattagcccagcctacttgctgtgggacttgagcgcaatcagtcaaagcaagcaggacgaggacatcagcgctagcagattcgaagacaatgaggagttaaggtacagcctgaggtcgatcgaacgacacgcaccatgggtcaggaatattttcatcgtgactaacggtcagatcccaagctggcttaacctggataacccccgagtaaccattgtgactcatcaggatgtgttcaggaatctatcacacctgccgaccttctcatctccggcgattgagtctcatatccatcggattgaaggactgtcacagaaattcatctatctgaacgacgatgtcatgtttggcaaagatgtctggccagatgatttctacagccattccaagggccagaaggtgtatcttacctggccagtcccgaattgcgcggaggggtgccctgggagttggatcaaagacggctattgtgataaggcctgtaataactccgcatgtgattgggacggcggcgactgttcagggaatagtgggggtagtaggtatattgcgggcggtggaggcactggctccatcggcgtgggccagccatggcagtttggcggtggcatcaactcagtttcctattgcaatcaggggtgtgctaatagttggctggcagacaagttttgcgaccaggcctgtaacgtcctcagttgcggcttcgacgccggcgattgtggacaggatcactttcatgagctgtacaaagtgatactgctccctaatcagacgcactacataattcctaagggcgagtgtctcccctactttagctttgccgaagtggctaagagaggggtggaaggggcgtattcggacaatcctatcatcagacatgcgtcaatagccaacaaatggaagaccatccacctcattatgcatagtggaatgaatgcaacgaccattcatttcaacttaacattccagaataccaatgatgaggaattcaagatgcagattacagtagaagtggacactcgcgaaggaccaaaactgaatagcaccgcccaaaagggatatgagaacctggtctcccctattacgctgctgcccgaagctgaaatcctgttcgaagatatcccgaaggagaagagatttcccaaatttaaaaggcacgacgtcaatagcacccggcgcgctcaggaggaagtgaagatcccacttgtgaacatctctctgttacccaaggacgcgcagctttccttgaacacgctcgatcttcaattagaacacggagatatcactctaaagggttataacctatcgaaaagcgccctgcttagatccttcctgatgaatagccaacacgcaaagataaaaaatcaggctataatcaccgatgagaccaatgactctcttgtggcgccacaggagaaacaggtccataaatctatcctgccaaactccctcggcgtctctgaaagattacaacgccttacatttcccgctgtgtctgtgaaggtgaatggccacgaccaaggccagaacccaccgttagatttggagacaaccgcacggtttcgcgtggagacacacacacagaagacgataggaggaaatgtcaccaaggagaaacccccctcgctgattgtgcctctagagtcccagatgacgaaggaaaagaaaatcaccggcaaggaaaaggaaaacagcagaatggaggaaaatgctgaaaaccacattggcgtcacagaagttcttctgggacgcaaattgcagcattacactgatagctaccttggtttcctcccgtgggagaagaaaaagtactttcaagatttactagacgaggaagagagtcttaagactcagctagcctatttcacagactcgaagaataccggaagacagttaaaggacaccttcgcggatagtttacgatatgtcaacaagatccttaacagcaaatttgggtttactagtaggaaagtgcctgcccacatgcctcatatgattgatcgaatcgtgatgcaggaattgcaggacatgtttccagaagagtttgataaaacctctttccataaggtgaggcactctgaggacatgcaatttgctttctcttacttttactacctgatgtccgccgtgcagcctcttaacatatcacaagtgttcgacgaagtggataccgaccagagcggtgtcttgtcagaccgagaaattcgcacactggccacacggattcatgaactgcctttgagtctccaagacctgacaggtcttgaacatatgctcattaattgttctaaaatgctgccagccgacatcacccaactcaacaacattcctccgacccaggaaagctactatgatccaaacttaccaccagttactaagtctctggtgaccaactgcaaacctgtaaccgataagatccataaagcttacaaagacaaaaataaatatcgcttcgaaatcatgggggaggaggaaatcgcgttcaagatgatccgtaccaacgtgtcacacgtggttggacagctcgatgacatccgtaagaacccacgcaaatttgtctgcctgaatgacaacattgaccacaaccataaagacgcgcaaactgtgaaggcagtgctcagagacttctatgaaagcatgtttccgatcccatcacagttcgagctcccacgcgagtacaggaatcggtttctgcacatgcatgaactccaggaatggagggcttatcgggataaattaaagttctggactcattgcgtcctggcaactttgattatgttcaccattttttccttcttcgcggagcaactgatcgcccttaagaggaaaattttcccgcgcagacgtattcataaagaagcttcaccaaaccgcatacgcgtg

SEQ ID NO: 16987 - DNA, 3768 bp, Artificial Sequence
  Description of Artificial Sequence: Synthetic coding sequence
atgttgtttaaactcttacagagacagacttacacatgtctatcccatagatatgggctatatgtgtgcttcctaggcgtcgtggtcactatagtcagtgcattccagtttggtgaagttgtcctggaatggtctcgcgatcagtaccatgtgctattcgatagttaccgtgataacatcgccgggaagagtttccagaacagactgtgcctgccgatgcctatcgacgtagtatatacctgggtcaacggcacggatctagagctgctgaaagagttgcagcaagtgagggagcagatggaggaggaacagaaggcaatgcgcgagatactgggcaagaatactaccgagcccaccaagaagagcgagaaacagctcgagtgcttgctgacccactgcattaaggttcccatgttggtcctcgatcctgctcttcccgcaaacatcaccctgaaggatctacccagcctctatcccagtttccacagtgccagcgacatcttcaacgttgcaaagcctaagaacccatcaaccaatgtatcagttgttgtattcgactcaactaaagacgtggaagatgctcacagcgggctccttaagggaaattcccgccagacagtgtggcggggttatctgaccaccgataaggaagtgccaggcctggtgctgatgcaggatttggcattcctatctggctttccaccaacgtttaaagagacgaatcagttgaaaacgaagctgcctgagaacctgagctcaaaggttaaacttcttcagctgtacagtgaagcgtcagtagccctgctgaaactaaacaaccccaaggacttccaagaacttaacaagcagaccaaaaaaaacatgacaatagatggcaaagaactgacaatatctccagcttacttgctgtgggacttgtccgcaattagccagtccaagcaggacgaggacatatccgcaagcaggttcgaagacaatgaggagctcaggtattctctcagaagtattgagagacacgcaccttgggtgcggaatattttcatcgttacgaatggacagatccccagctggcttaatctggataatccccgggtaactattgtcacacaccaagatgtgtttagaaacctgagccacttgcctactttctcttcacccgcaattgagagtcacatccaccggatcgaggggctgagccagaagtttatttacttaaacgatgacgtgatgtttggcaaagatgtttggcctgatgacttttacagccatagcaagggccagaaagtgtatctgacctggcctgtcccaaactgcgcagaagggtgccctggatcctggatcaaggacggatattgcgacaaagcgtgtaataacagcgcttgcgattgggatgggggggactgcagtggtaacagtggtgggtctcgctacatcgctggcggggggggcactggatccatcggtgtaggccagccatggcagttcggtggagggatcaattcagtgtcctactgtaatcagggatgtgccaatagctggctggccgataaattctgtgaccaagcatgcaatgtgttgtcatgtggatttgatgcaggggattgtggccaggatcatttccatgagttatataaggtgattctgcttcctaaccagacacattacattataccaaaaggagagtgcctgccatacttttccttcgctgaggtcgccaaacgcggcgtcgagggggcatactccgacaaccccatcattcggcatgcctcgatcgctaataagtggaaaaccatacacctcatcatgcacagcggcatgaacgcaaccaccatacacttcaacctgacatttcagaatacgaacgatgaggaattcaagatgcagatcacagtggaggttgacacacgcgagggaccgaagcttaatagcaccgcgcagaaaggatatgagaatctggtgagccctatcacccttctgccggaggccgagatcctttttgaagacatcccgaaggagaagaggttccccaagttcaagaggcacgatgttaattccacaaggagggcacaggaagaagtgaaaatacccctggtgaatatttctctattgcctaaggacgcacagctgtcactgaatactctggaccttcagcttgaacatggcgacattacactcaagggatacaacctgtctaagagtgccctgttacgcagctttcttatgaattctcagcacgccaaaattaagaatcaggccatcatcacagatgagaccaacgacagcttggttgctcctcaagaaaagcaggtgcataagtcaatcttaccaaattctttgggcgtgagcgagcgactccagcggctgaccttccccgccgtgtccgtcaaggtgaacggacatgaccaggggcagaacccacctctggatctcgaaactacagctagattcagagtggaaacccacactcagaaaactattggaggcaatgtgactaaggagaaacccccgtctctgatcgtgcccctggagtcccagatgacaaaagaaaagaaaatcacggggaaagagaaggagaatagcaggatggaggagaatgcggagaatcacatcggtgtgaccgaagtcttgctcggaaggaagttgcagcactacacagacagctacctaggattcctgccatgggagaagaagaaatatttccaagacctgctggatgaagaagagtccctgaagacccagctggcctactttacagatagtaagaacacaggccggcagctcaaagacacctttgccgactctttgcgatacgttaacaaaatcttaaattccaagtttggcttcacgtcacgaaaagtgcctgcccacatgccacatatgattgatagaattgtgatgcaggaactacaggacatgtttcctgaggagtttgataagacatctttccacaaggtccgccactctgaagacatgcaattcgctttcagctacttctactatctcatgtccgctgtacagcctctgaatatttcacaagtgttcgatgaggtggatactgaccagagtggcgtgttgagcgatcgcgagattcggacattggccacaagaatccacgaattgccactgtccctgcaagatcttaccggcctggagcacatgcttattaattgcagcaagatgctgcctgctgatatcacccagctgaacaacattcctccgacgcaagaatcgtactatgatcctaacttacccccagtcaccaagtcactggtgactaactgcaaacctgtaaccgacaagattcataaagcgtataaggataagaataagtatcgcttcgaaattatgggagaagaagagattgcatttaaaatgatccggacgaatgtgtcccatgtggtgggccagctggacgacataaggaaaaacccccgcaaatttgtttgtctgaacgataacatagatcataaccacaaggacgcacagacagtgaaggccgtgttacgggatttctatgaaagcatgttcccaattccctcacagtttgaactgccacgagagtacagaaatcggtttctgcatatgcatgaactgcaagagtggagagcctaccgagacaagttgaagttctggacccattgcgtgctagcaactttgataatgtttactattttttcctttttcgctgaacagctgattgcactgaaaagaaaaatattccctaggcggaggattcacaaggaggcaagtcctaatcgcattagggta

SEQ ID NO: 16988 - DNA, 3768 bp, Artificial Sequence
  Description of Artificial Sequence: Synthetic coding sequence
atgctgttcaaactgctgcagcgtcagacatacacgtgtctttcacatagatatggcttatatgtttgctttctcggagttgttgtaacgatagtaagcgcttttcaatttggagaagttgtgctcgaatggagccgagatcaatatcatgtcctttttgattcgtatagggataatattgcgggaaaatcatttcagaacagactgtgcttaccaatgcctattgatgttgtgtatacgtgggtgaatggcacggacttggagctgcttaaagagctgcaacaagtgcgtgagcagatggaggaagaacaaaaggccatgagagaaattcttgggaaaaatacgacggaacccactaaaaaaagtgaaaaacagctggaatgcctgctgactcattgcatcaaggtacctatgcttgtacttgatcctgctctgcctgctaacataacgcttaaagatctgccttccctgtatccgagctttcactctgcgagcgatatatttaacgtggccaaacctaaaaatccgtcgaccaacgtttctgtcgtcgtgtttgatagcacgaaggatgttgaagatgcacattcaggcttgcttaaaggcaactcccgccaaacggtgtggaggggttatcttaccaccgataaggaagttcctgggcttgttttgatgcaggatcttgcctttctttcaggttttccgccgaccttcaaagaaacgaaccagttgaagacgaaattaccagaaaacctgagctctaaagttaaactgttgcagctttatagtgaggcatcggtggcgctgctgaaattgaacaatccaaaagatttccaggagctcaataaacaaacaaaaaaaaacatgacgattgatggcaaagagctgacaattagcccggcgtacctcttgtgggatctgtcagcaatctcacagtcgaaacaggacgaagatatttcggcttcgagatttgaagacaacgaggaattacggtatagccttagaagcattgagagacatgcaccgtgggtccggaatattttcatcgtgacaaatggacaaatcccgtcgtggcttaacttggacaatccgagggttactatcgttacgcaccaagatgtttttcgcaatctgagtcatcttccgacattctcctcaccagctattgaaagccatatacataggatcgaaggactatcgcaaaaattcatctatctgaacgacgatgtaatgtttggcaaggacgtatggccggacgacttctatagccatagcaagggacagaaagtttatctgacgtggccagtgcctaattgtgctgagggctgtccgggctcttggataaaagatggctactgcgataaagcgtgtaataacagcgcctgcgactgggatggaggcgactgctcagggaatagcgggggatctaggtatattgcaggtggcggaggcacaggctctattggtgtagggcagccgtggcagtttggtgggggcatcaactccgtttcgtattgcaaccagggctgcgcaaactcatggttagctgataaattctgtgaccaggcctgcaacgtgttaagctgcggttttgacgcaggcgattgcggccaagatcatttccacgaactctataaggttattcttttgccgaatcaaacacattatattattcccaaaggagaatgcttaccttattttagtttcgcagaagtggccaaacgtggtgttgaaggcgcgtattcagataaccctatcattagacatgcaagtattgcaaataaatggaaaaccatccatcttatcatgcattctggaatgaatgcgacgacaattcattttaacttgacctttcagaatacgaacgatgaagagttcaagatgcaaattacggtggaagttgatactagggaaggacccaaactgaactcgacggcacagaagggctacgaaaatttggtcagccctattactctcttaccagaagccgaaattctctttgaagatatcccgaaagagaaaagatttccgaagtttaagcgtcatgatgtaaattcgacacgtcgtgctcaggaagaagtgaaaatcccgctggtgaatatatcacttttgcctaaagatgcccaactttctttgaacactcttgatctgcaactcgagcatggagatattacgctcaaaggttataacctctctaagagtgcacttcttcgcagctttctcatgaattcacaacatgccaaaatcaaaaatcaggccatcattacggacgaaacgaacgattcacttgtagcccctcaggagaagcaagtgcacaagtcaattcttccgaattcgctgggggttagtgaacgcctccagagattaacgtttcccgcagtcagcgttaaagtgaatggccatgatcagggtcaaaatcctccgcttgatctggaaacaacggctcgcttccgcgttgagactcatacgcagaagactattggtggaaatgtgacgaaagagaaaccgccgagccttatagttccgctggaatctcaaatgacaaaggaaaaaaaaatcacaggcaaagaaaaagaaaatagcagaatggaggaaaatgcggaaaatcatattggtgttacagaagttctcttaggccggaagttgcaacattacaccgactcatacttaggtttcttgccctgggaaaaaaagaagtacttccaggacctgttagatgaggaagaatctttaaagacgcaacttgcctacttcacggattctaaaaacaccgggcgacaacttaaagacacattcgctgattcattaagatacgtaaataagatcttaaacagcaaattcggctttaccagcagaaaagttccggcacacatgcctcatatgattgatcgcatagttatgcaggaacttcaagatatgtttccggaggaattcgataagaccagtttccacaaagtccgtcattctgaagacatgcaatttgcattctcttatttttattatttaatgtcagccgtccagccgttgaatatctcccaggtatttgatgaagtggacaccgatcaatctggcgtgttaagtgatcgtgaaatccgaacccttgcaaccaggatccatgaattgccgctatccctgcaagatttaacgggacttgagcacatgttaatcaattgcagcaagatgctgccggctgacatcacgcagctgaataatattccgcctacacaagagtcgtactatgatcctaatctgcccccggttacaaaatcacttgttacaaattgcaaacccgtcacagataagatccataaagcgtacaaagacaagaacaaataccgctttgagattatgggagaagaagagattgcattcaagatgattcggaccaacgtatctcacgttgtagggcagcttgatgatattagaaaaaatccgagaaagttcgtttgcctgaacgataatatagaccataatcacaaagatgctcagaccgttaaggctgtactccgtgatttttacgaaagtatgtttccaattccgagccagtttgaactgccgagggaataccgaaatagatttttacatatgcacgaactgcaagaatggcgggcatatcgggataaattaaaattctggacacattgtgttttagcgacactcatcatgtttactatcttttcttttttcgcggaacagttgattgctttgaaacgaaagatttttccaagacgacgcatacacaaagaggcgtcgccgaaccggatccgcgta

SEQ ID NO: 16989 - DNA, 3768 bp, Artificial Sequence
  Description of Artificial Sequence: Synthetic coding sequence
atgctgtttaaactactgcaacgtcagacatacacgtgcctgtcacataggtacgggctctatgtctgcttcttgggcgtggtagtaactatcgtgtctgccttccagtttggcgaggtggttcttgagtggtccagagatcaataccatgtgcttttcgattcatatcgagacaacattgccgggaagtcattccagaatcggctctgtttgccgatgcccattgacgtggtttatacctgggtgaacggcacagacctggaacttctgaaggaattacagcaagtccgtgagcaaatggaggaggagcagaaggccatgcgcgaaatcctgggaaagaacaccaccgaaccaaccaagaaatcagagaagcagctggagtgcctcttaactcattgtatcaaagtgccgatgctcgtgctggatcccgcactgcctgcaaatattacactgaaggatttaccgagtctgtacccttcctttcattctgcgtccgacatctttaatgtggccaagccaaaaaatcctagcacaaacgtgtccgtcgtggtttttgactctacaaaggatgtcgaagacgcccattccggcctcttaaaggggaactctcgacagacggtgtggcgcggatacttaactacagacaaagaagtccctggccttgtgcttatgcaggaccttgcattcctgtctggcttccccccaaccttcaaagagacaaaccagctgaagacaaagttgcccgagaatctctcttcgaaggttaagttgcttcaactttattcagaggcaagtgtcgcgcttctgaagctgaataatcctaaggactttcaggagttgaataaacagaccaagaagaacatgactattgacggcaaagagcttaccatttcccctgcatatctcctatgggatctgagtgccatctcacagtcaaaacaagatgaggatatttccgcctccagattcgaagacaacgaggagttaaggtactccctacgctcaatcgagcgccacgctccgtgggtgcgcaacatctttatcgttacgaacggccagataccaagttggttgaatttggacaaccccagggtcactatagtgactcatcaggacgtgttccgcaatctgagccatcttccaaccttcagttctcccgccattgaaagtcacattcataggatcgaaggcctttcccagaaattcatctacctcaatgatgacgttatgttcggcaaggacgtgtggcctgatgacttttattcacatagtaaaggccagaaggtgtatctaacatggccagtccctaattgtgctgaggggtgccccggcagctggattaaggatggctactgtgacaaagcttgtaataacagcgcttgcgactgggatggaggagactgcagcggaaattctggaggttcccgctatatcgccggcggaggcggcacaggatctattggggtgggtcagccatggcaatttggtggggggattaactccgtttcctactgtaatcaagggtgcgccaactcttggctagctgataagttctgcgatcaggcgtgcaatgtgctctcatgcggctttgacgccggcgactgcgggcaggatcattttcacgaactgtataaggttatcttgttacccaatcagacacactacattattcccaagggagagtgcctaccttacttctcgttcgctgaggtcgccaaacggggagtcgaaggagcttactccgataaccctatcatcagacacgcctctattgccaataagtggaagacaattcaccttattatgcattccggaatgaatgctaccacgatacactttaatctcacttttcagaacaccaacgatgaagagtttaagatgcagattaccgtcgaggtggataccagggagggtcccaagcttaactccacggctcaaaaaggatatgagaacctggtcagtcccattaccctgctgccagaggctgaaatactgttcgaggatatcccaaaagagaagcgatttccgaagttcaaaaggcatgacgtcaattcgactagacgcgcgcaggaagaagtgaagattccattggtgaacatttccctgcttcctaaggatgcccaactcagcctcaacaccttagacctgcagctcgaacatggggacatcacactgaagggttataatctgtctaaaagcgccctcctgcgctcattcctcatgaatagccagcacgcgaaaatcaaaaatcaggcgattattacggacgagaccaatgacagtctggttgccccacaggagaagcaggtacataagtctattctgcccaactccttaggagtgtccgaaagactgcagaggctcacatttcccgccgtgtccgtcaaagtgaatgggcatgatcaaggccagaacccacctctggatctcgagaccacagcgagattccgagtcgagacgcacacacaaaagaccatagggggtaacgtaacgaaggaaaagcccccctctctcatcgtgccacttgagagccagatgactaaggaaaagaagattacggggaaggaaaaagaaaacagtaggatggaagaaaacgcagaaaatcatatcggggtgaccgaagtcctgttggggcggaaactacaacattacaccgacagttacctcggcttcttgccatgggaaaaaaaaaaatactttcaggatcttctggacgaagaagagtcactgaaaactcagctcgcctacttcacagactccaaaaataccggcagacagctgaaggacaccttcgcggacagtctgcggtacgtcaataagatccttaacagcaagtttggcttcacctcaagaaaagtgcctgctcacatgccacacatgattgatagaatcgtcatgcaagaactgcaggatatgtttcctgaagagtttgataaaaccagttttcacaaggtgcgacacagcgaggacatgcaattcgcatttagctatttttactacctcatgtcggctgttcagccactgaacatttcacaagttttcgatgaggtggacactgatcagtccggcgttctgagcgatcgggaaattcggactctcgccacgagaattcatgaactgccactttccctccaggatctgaccggtctggagcatatgctgatcaattgtagcaagatgttacctgctgatattacacagctgaataatattccccccacgcaggagagctattacgacccaaacctgccccccgtgactaagtctctcgtgaccaactgcaagcccgtgaccgacaagatccacaaagcttataaggataaaaataagtatcgttttgagatcatgggggaggaggagattgcttttaaaatgatcaggacgaatgtctcgcatgtcgtcggacaactagacgatatacgcaagaatccacgcaagttcgtgtgtctgaacgataatatcgatcacaaccacaaagatgctcagaccgtgaaagccgtgttaagagacttctacgaatcgatgtttcccattcccagccagtttgagcttccccgcgagtaccgcaatagattcctccacatgcacgaactccaggagtggcgtgcataccgggataagctgaagttctggactcactgcgtgctcgctaccctcataatgtttacgattttttcattctttgcagagcagctgatcgccctaaaacgaaaaatctttccaaggaggcggatacacaaagaggctagcccaaatcggattcgggtt

SEQ ID NO: 16990 - DNA, 3768 bp, Artificial Sequence
  Description of Artificial Sequence: Synthetic coding sequence
atgctgttcaagctcctccagaggcagacatatacgtgcttgagccataggtacggcctttacgtctgtttcctgggcgtggtggtcaccatcgtgtcagcatttcaatttggcgaggtggtgctggagtggtcgagagatcagtatcatgtcctgttcgactcatatagagacaatattgcaggtaaatctttccagaacagattgtgcctgccaatgcctattgacgtggtgtacacatgggtgaacggcaccgacctggagttgctcaaagagctgcagcaggtgcgggagcaaatggaagaggaacagaaagccatgcgcgagatcctaggcaagaacaccaccgagcccacaaagaagtctgagaagcagctcgaatgcctgctgacccactgcattaaggtgcctatgctggtgctggatccggctctgcccgccaacatcacattgaaagaccttccttcactgtatcccagctttcatagcgcgtccgacatctttaatgtggccaagccaaagaatcccagtacaaacgtctcggtggtcgtgtttgactccactaaagacgtggaggatgcgcactctggcctccttaagggcaactctcggcagacagtgtggcggggatacctgacgaccgataaagaagttccaggtcttgtgctgatgcaggacctagcatttctgtctggatttcctccgactttcaaggagacgaatcagctgaagacaaagcttcccgagaatctttcctccaaggtgaagctgctccagctgtactctgaggcgtccgttgccctcctgaagctgaacaacccaaaggatttccaagagctgaataagcagacgaaaaaaaatatgaccatcgacggtaaggagttgacgatatcacccgcatacctgctatgggatctaagtgccatatcacagtctaagcaggatgaagacatcagtgccagccgattcgaggacaatgaagagttgagatatagcctaagatcaatagagagacacgcaccgtgggtgcgtaatattttcatcgttacaaatgggcagatcccctcttggctaaatcttgataacccacgggtcactatagtgacacatcaggatgttttccgcaacttgagtcatttgcctactttctccagccctgccatcgagagtcatatccaccggatcgaaggcttgtcccagaagtttatttacctcaacgacgatgtgatgtttgggaaggacgtgtggcctgacgacttctattcacatagcaagggccagaaggtgtacctgacttggcctgtccccaactgcgctgagggctgcccagggagttggatcaaagacggctactgcgacaaagcttgcaataattcagcttgtgattgggacggcggggactgctccgggaattccggcggtagcaggtacatcgccggcggcggcggcactgggtcaattggagtggggcagccttggcaatttggaggtggcatcaattcggtgtcctactgcaaccaaggatgcgccaactcctggctggcggacaagttttgcgaccaggcatgtaacgtcttgtcatgcggattcgatgccggcgattgtggccaggaccactttcacgagctgtataaagtgatccttttaccaaaccagacccattatattatccccaagggggagtgtttgccctattttagctttgccgaggttgccaaaagaggtgtggaaggggcctatagcgacaatccaataataaggcatgcaagcattgcaaataagtggaagaccatccatctgataatgcacagtggaatgaacgcaacgacgattcattttaacctcacctttcagaataccaatgatgaagagttcaaaatgcagattactgtcgaagttgacacccgggaaggtcctaaactcaactccacagcccagaaggggtatgagaatcttgtctctcccatcacgctgttgccagaagcagagatattgtttgaagatattccaaaggaaaagcggttccccaagttcaaaaggcatgacgtgaactccaccagacgcgcacaggaggaagttaaaattcctcttgtgaacattagtctgcttcccaaggacgcccagctttccctaaacacactcgatttgcagctggagcatggtgacatcacattgaagggctataatctttccaagagtgctctgttgcgaagtttcctgatgaattctcagcacgccaaaataaaaaaccaggcaattatcaccgatgagacgaatgattcgctggtagcgccacaggaaaagcaggtgcacaagtccatactacccaatagtttgggcgtttccgaacgcctacaaagactgacctttccagccgtgagcgtgaaagtgaacggccatgaccagggtcagaaccccccccttgatctggagactaccgcccggtttagagtggaaactcacactcagaaaactattgggggaaacgtaaccaaagaaaagcctcctagccttatagtgcctctggagagccagatgactaaggagaagaagataaccggcaaggagaaggagaattctcggatggaggagaatgcggagaaccatattggcgtgactgaagtgctgcttgggcgtaagctccagcactatactgactcatatctggggtttctgccctgggagaagaagaaatattttcaagatttactggacgaggaagagagtcttaaaactcagctagcctacttcacagactctaagaacacgggtaggcagttaaaggatacgttcgcggactctctacgatacgtcaataaaatactgaacagtaagttcgggttcacctctaggaaagtgcctgcgcatatgcctcacatgatcgaccgaatagtgatgcaggagctgcaggacatgttccctgaagagttcgataaaacaagtttccacaaggtcaggcactcagaagacatgcagttcgccttcagttatttctattatctgatgtctgcggtccaaccactcaatatatctcaggtgtttgatgaggtggacaccgaccagtctggggttctgtctgacagagaaatcagaacactggcaaccaggatccatgaacttcctctcagcctccaagacctcacgggattggagcacatgcttattaactgttctaaaatgctgcctgccgacatcacacaactcaacaatattccacctacacaggaaagctactatgaccctaacctgccccctgtaacgaaaagccttgtcacaaattgtaagccagtgactgataagatacataaggcatacaaagataagaacaagtatcggttcgaaataatgggagaagaggaaatagctttcaagatgattcgcaccaatgtttcccatgtcgtcggtcagttggatgatatcaggaagaatccccgcaaatttgtgtgcctcaatgataacatcgaccataaccacaaggacgcccagaccgtgaaggccgttctgcgcgacttctacgagtccatgtttccgattccgtcccagttcgagctgccgagagagtatcggaatcggtttctgcacatgcacgagcttcaggagtggcgtgcctaccgcgacaagctcaaattctggacccactgcgtacttgccacattaatcatgtttacgatcttctcgttcttcgctgaacagctgatcgcgctgaaacgcaaaatattcccgcgccgacgaattcacaaggaggcgtcccccaaccgcatccgcgtg

SEQ ID NO: 16991 - DNA, 3768 bp, Artificial Sequence
  Description of Artificial Sequence: Synthetic coding sequence
atgctgttcaagctactgcagaggcagacctatacatgcctctcacaccgctacggactttacgtgtgttttctcggagttgttgtcactatcgtgtcagctttccagttcggagaggtggttctcgagtggtctcgtgatcagtatcatgttctcttcgactcatacagggataacatagcaggcaaatcgttccaaaatcgcctgtgcctccctatgccgatcgatgttgtgtatacgtgggtgaacggcaccgaccttgaattgttgaaggagcttcagcaggtgcgtgagcaaatggaagaggaacagaaggctatgagagaaatactgggcaagaataccacggagcccacaaagaaatccgagaagcagctggagtgtcttcttacccattgtataaaagtgcccatgctggtgttggaccctgccctgccggctaacatcacgctgaaagacctgccctccctgtaccccagcttccactcagcatctgacatatttaatgtagcaaagccaaaaaatcctagcaccaatgtgtccgtggtcgtcttcgactctaccaaagacgtagaagacgcccactccgggctgctcaagggaaattcacgccaaactgtttggcgcggctacctgacgacggacaaggaggtaccaggactcgtcttaatgcaggacctcgctttcctgagtgggttcccaccgacctttaaggaaaccaaccagctcaaaacgaaattacccgagaatctaagttcaaaggtcaaactactccaattgtactcagaagcctccgtggccctgctgaagcttaacaacccaaaggatttccaggaactgaacaaacagacgaagaagaacatgaccatcgatgggaaggaactgaccatctcgcccgcatatcttctttgggatctgtctgccatatcccagtccaagcaagacgaggacatcagcgcgtccaggtttgaggataatgaagagctgcggtactctctccgttcgattgagcggcatgcaccctgggtaaggaatattttcatagtcaccaacggccagattccctcttggctcaaccttgataacccacgagtgaccatcgtcacccaccaggatgttttcagaaacctcagccatctccctacttttagctctcccgccatcgagagccacatacatcgaatagaagggctgtcccagaagttcatatacttgaacgatgacgtgatgtttgggaaagacgtttggccagatgatttttactcacatagtaagggtcagaaagtttatctgacttggccagtgcccaattgcgctgaagggtgtcccggctcttggatcaaagacggatactgtgacaaagcatgtaataattccgcttgcgactgggacggaggggactgcagcggcaattccgggggtagtaggtacattgccggggggggcggcaccggttcaatcggtgtgggccagccgtggcagttcggcggcggtatcaatagcgtgagctattgtaaccagggatgtgctaactcttggctggcagataaattctgcgaccaagcctgcaatgttctgagttgcgggttcgacgcaggcgactgtggccaggaccatttccatgaactgtacaaggtaatccttcttccgaaccagacacattacattatccccaaaggtgagtgcctgccctacttttctttcgctgaggtggcaaaaagaggagtggagggcgcctactccgataaccctatcattcgacacgcctccatcgccaacaagtggaagaccatccacctgattatgcacagtggaatgaatgcgacaacaatacattttaatctgactttccagaatacaaacgatgaagagtttaagatgcagattaccgtagaggtggacactcgagagggcccaaaactgaattcaaccgcgcagaaagggtatgaaaatctggtgtcaccaatcactcttctccctgaggctgaaatcctcttcgaggatattcccaaagagaagcggttccctaagttcaagaggcacgatgtgaatagcacaaggagggcccaggaggaagtgaagatcccgcttgtaaatataagtctcctgcccaaagacgcccagctgtcactgaacacactggatctgcagctggagcatggcgacattaccttgaaggggtacaacctgtcaaaaagcgcactgctccggtccttcctgatgaattcacaacacgcaaagatcaagaatcaggctatcatcaccgacgaaaccaacgattcactggtggcgccccaagagaaacaggttcacaagtcaattctgcctaactctctgggtgtgtctgaacggttgcagaggttgacctttcccgccgtctccgtcaaagtgaacggccatgaccaaggtcagaaccctccactggatctggaaaccactgcccgatttagagtggagacccacacacagaaaacaatcggcggcaacgtgaccaaggagaagcccccctcattgatcgttcctcttgagtcccagatgactaaggagaagaagataacaggcaaagaaaaggagaactctcggatggaggagaacgccgagaatcacatcggcgtgacggaagttctactggggaggaagctgcaacactatactgactcctacctcgggttcctgccttgggagaagaagaagtatttccaggatcttctggacgaggaggaaagcctcaaaacacaactagcttactttacggattctaagaatacaggcagacagctgaaggacacgtttgcggattctctgagatacgtgaataaaatcctaaacagcaaatttggcttcacatcacggaaagtgcccgcacatatgccgcacatgattgatagaattgtgatgcaagaactgcaggatatgttccccgaagaatttgataaaacaagctttcataaggtacgacactccgaggatatgcagttcgctttctcctacttctattacttgatgagtgcggtccagccattgaatatctcccaagtgttcgatgaggtagataccgaccagtcaggagtcctctctgatcgggaaatccggacactagccacaagaatacacgaacttccactatcactccaggatctgaccgggttagaacatatgctcatcaactgctcaaaaatgctgccagcagatataacacaacttaacaacattccacctacgcaggaaagctattacgacccgaaccttcctcccgtgactaagtccttggtaacaaattgcaagccggtaacggacaagattcacaaggcgtataaggataaaaataaatacaggtttgagataatgggcgaagaggagatcgcctttaaaatgattcgaactaacgtgtcccacgttgttggccagctggacgatatccggaaaaacccccgcaagtttgtgtgtctgaacgataatattgaccacaatcataaggacgcacagactgttaaagcagttctccgagatttctacgaatctatgtttcccatccctagccaatttgagttgccccgtgagtatcggaatagattccttcatatgcacgagctccaggagtggcgcgcttatcgggacaagttgaaattctggacccactgtgtactcgccacgctgatcatgttcacgatctttagcttcttcgccgaacaactgattgcgctcaagcggaagattttccccagacggaggatccacaaagaggccagcccaaaccgcattcgtgtg

SEQ ID NO: 16992 - DNA, 3768 bp, Artificial Sequence
  Description of Artificial Sequence: Synthetic coding sequence
atgctgtttaaattgcttcagcgtcagacctatacctgcctgagccatcgctacggactgtacgtgtgcttcctgggcgtggtggttactatagtgagcgcattccagttcggggaggtggttctagaatggagtcgcgatcagtatcacgtgttattcgacagctatcgcgataatatagccggcaagagctttcagaacaggttatgtttgcccatgccaatcgacgtcgtttatacatgggtgaatggtactgacctggagttactgaaggagctgcagcaggtgagagaacagatggaagaggagcagaaggcaatgcgggaaattctcggcaagaacacaaccgagcctacaaagaagtctgaaaagcagttggaatgcctgctgacccattgcataaaggtgcctatgctggtgctggaccccgctttacccgctaatatcactctgaaggacctaccctccttatacccgagctttcacagcgcctccgatatatttaatgtggccaagccaaagaatccatctacaaacgtctctgtggttgtcttcgatagcaccaaggacgtcgaggatgctcactctggtctactgaaggggaatagcagacagaccgtgtggcggggatacctgaccaccgataaagaggtgcctggcctggtactgatgcaagatctggcatttctgtccgggttcccccctaccttcaaggagactaatcagctcaagacaaagctgcctgagaatctgagttccaaggtcaagttactgcaactgtactccgaggctagcgtggctctactgaagctcaataatcctaaggatttccaagagctgaacaagcagaccaaaaagaatatgactattgacggaaaagaattgaccatatctcccgcctaccttttgtgggaccttagcgccatcagccaaagcaaacaggacgaggacatatcagcctcaaggttcgaggacaatgaggagcttcggtattctctgcggtctatcgaacggcatgctccctgggtgaggaacattttcatcgtcactaatgggcaaatccccagctggctaaacctggacaacccacgggtgacaatcgtgacccaccaagatgtctttaggaacctgtcccatttacccaccttctcctctcccgccatagagagtcacatccaccggatcgaggggctctcccagaagtttatctatctgaacgatgatgttatgttcggtaaggacgtgtggccagatgatttctacagtcacagcaaggggcagaaggtgtacctgacctggcccgtccctaactgcgcagaaggttgcccaggcagttggataaaagacggctactgcgataaggcatgcaataacagtgcctgcgattgggatggtggggattgctccggcaattctggtggaagccgctacatagctggcggcggcggcactggctcaatcggcgtgggtcagccttggcagttcggcggcggaattaactcagtgtcttactgcaaccaaggttgcgcaaattcttggctggctgacaaattttgcgaccaggcctgtaacgtgctgagctgcggctttgatgcaggcgattgcggacaagatcattttcatgagctgtacaaggtgatcctgctgccaaatcagacccattacatcattcctaagggggaatgtctgccctacttctcctttgcagaggtggctaaacgcggagtggagggggcatatagcgataatccaataatcaggcacgccagtattgctaacaagtggaagaccatccatctgatcatgcactccggcatgaacgctactaccattcattttaatctgacctttcaaaacactaacgatgaagaattcaaaatgcagataaccgtggaggtcgacactagagagggacctaagctaaattccacagcccaaaagggatacgagaacctggtgagccctataaccctactgcctgaggcagagattctgtttgaagacatcccaaaagagaagcgcttccccaaattcaagaggcacgatgtcaatagtacacgacgcgcccaggaagaagttaagatccctctcgtgaacatttctttactgcccaaggatgcccaactatctctcaacaccctggacctacagctggaacatggcgacatcacactgaaaggttacaacctcagcaagtctgcattactgaggagttttctgatgaatagtcagcacgccaagatcaagaaccaggccataattaccgatgagaccaacgactctttggtggcacctcaggagaaacaagtgcataagtctatactcccaaactctctgggcgtgagcgaaaggctgcagagactcaccttccctgctgtgagcgtgaaggtgaatggccacgaccaaggacaaaaccctcccctggatctagagactacagcacgattcagggtagagacacacactcaaaaaaccattgggggaaatgtgacaaaggagaagccaccttccctgattgtgccgttagagagccagatgactaaagagaagaagatcactggcaaggagaaagaaaacagtcggatggaagagaatgctgagaatcacattggagttactgaggtgctgttggggcgcaagctacaacactacactgatagttatctgggcttcctgccctgggaaaaaaagaaatacttccaggatttactagatgaagaagagagtctaaagacacagcttgcttacttcacagactctaaaaataccggcagacagctgaaagatacatttgctgactctctgcgctatgtcaacaagatactcaattctaagtttggcttcaccagccgaaaagtgcctgctcatatgccccacatgattgaccggatcgttatgcaagaattacaggatatgtttccagaagagtttgacaaaacctctttccacaaggtcaggcatagtgaggatatgcaattcgcattttcatatttttactatctaatgagtgccgttcaaccactgaatatatcccaggtcttcgatgaagtcgacaccgaccagagcggggtgctgagtgacagggaaatcaggaccctcgccacacgcatacatgagctccctttatctctccaggacctcaccggcctcgaacacatgctgattaattgcagtaagatgctgcctgcagacataacacaactgaataacataccccccacacaggaaagctattacgacccaaacctaccacccgtgacaaagagcctcgtgacaaattgcaagcccgttaccgataaaattcacaaggcatacaaagataaaaacaagtacagattcgagattatgggtgaggaagagatagcctttaagatgatccggaccaacgtaagccacgtggtgggccagttagacgacatcaggaagaacccccggaagttcgtgtgtctcaacgataatattgaccataaccataaagatgctcagactgtgaaagcagtgctgcgcgacttctatgagagcatgtttccaatcccttctcagttcgagttgccccgagagtaccgaaatcgcttcctgcacatgcatgaactgcaggagtggcgagcctatcgagacaaactcaaattctggacacactgtgtcttagccaccctgatcatgtttacaatcttttctttcttcgccgaacaactgatcgccctcaaaaggaagattttcccccggagacgcatccataaagaggccagcccaaatagaatccgtgtt

SEQ ID NO: 16993 - DNA, 3768 bp, Artificial Sequence
  Description of Artificial Sequence: Synthetic coding sequence
atgctatttaaattactacaacgacaaacgtatacgtgtctatcgcatcgatatggtctatatgtatgttttttaggtgttgtagtaacgatagtatcggcgtttcaatttggtgaagtagtattagaatggtcgcgagatcaatatcatgtattatttgattcgtatcgtgataatatagcgggtaaatcgtttcaaaatcgattatgtttaccgatgccgatagatgttgtatatacgtgggtaaatggtacggatttagaactattaaaagaattacaacaagtacgagaacaaatggaagaagaacaaaaagcgatgcgtgaaatattaggtaaaaatacgacggaaccgacgaaaaaatcggaaaaacaactagaatgtctactaacgcattgtataaaagttccgatgttagtactagatccggcgttaccggcgaatataacgctaaaagatttaccgtcgttatatccgtcgtttcattcggcgtcggatatatttaatgttgcgaaaccgaaaaatccgtcgacgaatgtatcggttgtagtatttgattcgacgaaagatgtagaagatgcgcattcgggtctactaaaaggtaattcgcgacaaacggtttggcgaggttatctaacgacggataaagaagtaccgggtttagtactaatgcaagatttagcgtttttatcgggttttccgccgacgtttaaagaaacgaatcaattaaaaacgaaactaccggaaaatctatcgtcgaaagtaaaattattacaattatattcggaagcgtcggtagcgttattaaaattaaataatccgaaagattttcaagaactaaataaacaaacgaaaaaaaatatgacgatagatggtaaagaattaacgatatcgccggcgtatttattatgggatttatcggcgatatcgcaatcgaaacaagatgaagatatatcggcgtcgcgatttgaagataatgaagaactacgttattcgctacgttcgatagaacgacatgcgccgtgggtacgtaatatatttatagttacgaatggtcaaataccgtcgtggttaaatttagataatccgcgagtaacgatagttacgcatcaagatgtatttcgaaatttatcgcatttaccgacgttttcgtcgccggcgatagaatcgcatatacatcgtatagaaggtctatcgcaaaaatttatatatctaaatgatgatgtaatgtttggtaaagatgtatggccggatgatttttattcgcattcgaaaggtcaaaaagtttatctaacgtggccggtaccgaattgtgcggaaggttgtccgggttcgtggataaaagatggttattgtgataaagcgtgtaataattcggcgtgtgattgggatggtggtgattgttcgggtaattcgggtggttcgcgttatatagcgggtggtggtggtacgggttcgataggtgtaggtcaaccgtggcaatttggtggtggtataaattcggtttcgtattgtaatcaaggttgtgcgaattcgtggctagcggataaattttgtgatcaagcgtgtaatgttttatcgtgtggttttgatgcgggtgattgtggtcaagatcattttcatgaattatataaagttatattactaccgaatcaaacgcattatataataccgaaaggtgaatgtctaccgtatttttcgtttgcggaagtagcgaaacgtggtgttgaaggtgcgtattcggataatccgataatacgtcatgcgtcgatagcgaataaatggaaaacgatacatttaataatgcattcgggtatgaatgcgacgacgatacattttaatttaacgtttcaaaatacgaatgatgaagaatttaaaatgcaaataacggtagaagtagatacgcgagaaggtccgaaactaaattcgacggcgcaaaaaggttatgaaaatttagtatcgccgataacgctactaccggaagcggaaatattatttgaagatataccgaaagaaaaacgatttccgaaatttaaacgtcatgatgtaaattcgacgcgtcgtgcgcaagaagaagtaaaaataccgttagtaaatatatcgctactaccgaaagatgcgcaattatcgttaaatacgttagatttacaactagaacatggtgatataacgttaaaaggttataatttatcgaaatcggcgttattacgttcgtttctaatgaattcgcaacatgcgaaaataaaaaatcaagcgataataacggatgaaacgaatgattcgctagttgcgccgcaagaaaaacaagtacataaatcgatattaccgaattcgctaggtgtatcggaacgactacaacgtctaacgtttccggcggtttcggtaaaagttaatggtcatgatcaaggtcaaaatccgccgctagatttagaaacgacggcgcgatttcgagtagaaacgcatacgcaaaaaacgataggtggtaatgtaacgaaagaaaaaccgccgtcgttaatagtaccgttagaatcgcaaatgacgaaagaaaaaaaaataacgggtaaagaaaaagaaaattcgcgtatggaagaaaatgcggaaaatcatataggtgtaacggaagttttattaggtcgtaaactacaacattatacggattcgtatctaggttttctaccgtgggaaaaaaaaaaatattttcaagatctactagatgaagaagaatcgttaaaaacgcaattagcgtattttacggattcgaaaaatacgggtcgtcaactaaaagatacgtttgcggattcgttacgatatgttaataaaatactaaattcgaaatttggttttacgtcgcgtaaagttccggcgcatatgccgcatatgatagatcgtatagttatgcaagaattacaagatatgtttccggaagaatttgataaaacgtcgtttcataaagtacgacattcggaagatatgcaatttgcgttttcgtatttttattatttaatgtcggcggtacaaccgctaaatatatcgcaagtatttgatgaagttgatacggatcaatcgggtgtactatcggatcgtgaaatacgtacgttagcgacgcgaatacatgaactaccgttatcgttacaagatctaacgggtctagaacatatgctaataaattgttcgaaaatgttaccggcggatataacgcaattaaataatataccgccgacgcaagaatcgtattatgatccgaatttaccgccggttacgaaatcgctagtaacgaattgtaaaccggttacggataaaatacataaagcgtataaagataaaaataaatatcgttttgaaataatgggtgaagaagaaatagcgtttaaaatgatacgaacgaatgtatcgcatgtagttggtcaactagatgatatacgaaaaaatccgcgaaaatttgtttgtctaaatgataatatagatcataatcataaagatgcgcaaacggtaaaagcggtattacgtgatttttatgaatcgatgtttccgataccgtcgcaatttgaattaccgcgagaatatcgaaatcgttttctacatatgcatgaattacaagaatggcgagcgtatcgtgataaattaaaattttggacgcattgtgtattagcgacgttaataatgtttacgatattttcgttttttgcggaacaactaatagcgctaaaacgaaaaatatttccgcgtcgtcgtatacataaagaagcgtcgccgaatcgtatacgagta

SEQ ID NO: 16994 - DNA, 3768 bp, Artificial Sequence
  Description of Artificial Sequence: Synthetic coding sequence
atgctgttcaagttgctgcaacggcagacttatacctgtctgtcgcatcggtatggcctgtacgtctgtttcctgggtgtggtggttaccatcgtatctgcctttcagttcggcgaggtagtgctcgagtggtctcgcgaccagtaccacgtactctttgatagctatcgcgacaatatcgccggcaagtcattccagaacaggttatgcctgccaatgcctatcgatgtagtgtacacgtgggttaatggaaccgaccttgaattgctgaaggaactccaacaggtgagggaacagatggaagaagaacagaaggctatgagggaaattcttggaaagaacaccacagaacctacaaaaaagtcggagaagcaactggagtgcctgctgacccactgcatcaaagtccctatgctggtcctggaccctgccctccccgccaatattaccttgaaggacctcccatccctttacccctcatttcattctgcaagcgatattttcaatgttgccaagcccaagaatccatctacgaatgtgagcgtggttgtcttcgattctacaaaagacgtcgaggacgcccatagcggcctgctcaagggcaactcaaggcaaaccgtatggaggggctatctgaccactgataaagaggtgccgggccttgtacttatgcaagacctcgcctttcttagcggatttccccccacctttaaggaaacgaatcagttaaaaactaagctgcctgagaatctctccagcaaagtgaagctgcttcagctctacagcgaagccagtgtggccctgttaaaactgaataatccaaaggactttcaggaactgaacaaacagaccaaaaaaaacatgactatcgatggcaaggagctgactatctccccagcatacctcctgtgggatctcagcgcaatttctcagagcaagcaggatgaggacatctcggctagcaggtttgaggataacgaggagttacgctactccctgaggtccatcgagcgacacgcaccctgggtcaggaacatttttatcgtaaccaatggccaaattcccagttggctaaacctggataacccacgcgtcaccattgtcactcatcaagatgtgttcaggaatttgtctcacctgcctaccttctcaagccctgccatcgaaagccatattcaccgtatagaagggctgagccaaaaatttatctatttaaatgacgacgtcatgttcgggaaggatgtgtggcccgatgatttctacagccacagcaagggacagaaggtgtacctcacttggcctgtccctaactgtgctgaaggctgcccaggtagttggatcaaggacgggtattgcgacaaagcttgcaataacagtgcctgcgactgggatgggggggattgttctggtaacagtggtgggtcgagatacattgcaggcggaggtggaacaggttccattggggttggacagccttggcagtttggaggtggaatcaactctgtgtcttactgcaatcaggggtgtgccaactcctggctggcagataaattttgcgaccaggcttgcaacgtcttaagctgtggcttcgatgcgggggattgcgggcaggaccacttccacgagctttataaggtgatcttgttgccaaaccaaacccactacatcattcccaagggggagtgtctgccttatttcagtttcgctgaagtggccaagcgcggggttgaaggcgcctactcagataatccgataatccggcatgcttcaatagctaacaagtggaagacaatacatttaatcatgcacagtggcatgaatgcaacaactatccatttcaatttgacattccagaacaccaatgacgaagaatttaaaatgcaaatcacggtggaagtggacaccagggagggccccaaactgaacagcaccgcccagaagggatatgaaaatctcgtctcccctatcacactgctacctgaggccgagattctctttgaggacatccccaaagagaaacggttccctaagttcaagcgtcacgacgtgaactcaactcgcagagcgcaagaagaagtgaaaatcccattggtgaacatatccttgctgcccaaagacgcacagctctcactgaacactctagaccttcagcttgagcacggcgatattaccttaaaaggctacaacttgagcaaatcagcgctgctgcgatccttcctcatgaattcccagcacgcgaagatcaagaaccaggctatcatcaccgatgagactaatgatagcctcgttgccccacaggagaagcaggtgcacaaatcaatcctgccaaactccctgggtgtcagcgagaggctgcagcgcttgacgttcccagctgtttcagttaaagtgaatggtcatgaccaggggcaaaatccaccactagatctagaaaccaccgccaggttccgggtggagacacatacacaaaagaccatcgggggaaatgtgaccaaggagaaacccccgtcgctgattgttccgctcgagtcacagatgactaaagagaagaaaattaccggaaaggagaaggaaaatagtagaatggaagaaaacgctgaaaatcacattggtgtgactgaggtgttattagggcgaaagctgcagcattacaccgatagttatttgggcttcctcccctgggaaaaaaagaagtattttcaggatctgcttgacgaagaggagtccctcaaaacacagttggcctacttcaccgatagcaaaaacactggaaggcagttgaaagacaccttcgccgacagcttgcggtacgtgaacaagattttgaactccaagttcggatttacttcacggaaggtccctgcccatatgccccatatgatcgacagaatcgtgatgcaggaacttcaggatatgtttcccgaggaattcgacaaaacttccttccacaaagtacgccactctgaagatatgcagtttgccttctcttatttctactatctgatgtccgccgttcagccactaaacatcagccaagtcttcgatgaagtggataccgaccagagcggggtcttatctgatcgtgagatcaggaccctcgcgacccgcattcatgaactccccctgagcttgcaggacctgactggactagagcatatgctgattaattgttctaagatgttgccagcggacattactcagttgaataatatcccacccacccaggagagctactatgaccccaatctccctccagtaactaagtccttggtgaccaactgcaagcctgtgactgacaagatccataaagcctacaaagacaagaacaaataccggtttgaaattatgggagaggaggagatcgcttttaagatgatccgcaccaatgtgagccatgtcgtaggtcagctcgacgatattcgcaaaaacccgaggaaattcgtctgtttgaatgacaatatcgaccacaatcacaaagatgcacagaccgtgaaggctgtgctacgagacttctacgagagcatgtttccaattccaagccagtttgagctccctcgcgagtaccgcaatagatttcttcatatgcacgagttacaggaatggcgggcctatagagataagcttaaattctggactcactgtgttctggcgacactgatcatgtttacaatcttctcttttttcgccgaacagctgatagccctgaaacgaaagatctttccccgaagaagaattcataaagaggccagtcccaatcgcatccgggtg

SEQ ID NO: 16995 - DNA, 3768 bp, Artificial Sequence
  Description of Artificial Sequence: Synthetic coding sequence
atgctttttaaactgctacagcggcagacttatacatgcctttctcaccgctacggactctacgtttgttttctcggagtagttgtgactatcgtttccgcattccagtttggagaggtggtgcttgagtggtcacgcgatcagtatcatgtgttatttgactcatatcgcgacaatatagctgggaaaagttttcagaacaggctttgcctacccatgcctatcgacgtggtctatacttgggtgaacgggactgacctggaactcctgaaagagcttcagcaggtgcgggaacagatggaagaagaacagaaggctatgagagagattctggggaagaatactactgagcccacaaaaaaatcagaaaaacagctagagtgcctccttacacactgcattaaggttccaatgctggtattagaccctgccctccctgcaaacataacgctaaaagatctcccctctctatatccctcgttccattccgcttcagatatcttcaacgtcgccaagcccaaaaatccttctacaaacgtgtccgttgtggtcttcgactccacaaaagatgtcgaagacgcccactcagggctgctgaagggaaatagtcgacaaactgtgtggcgggggtatcttacaacagacaaggaggtacccggacttgtgcttatgcaggacctagctttcctatcaggatttccacccactttcaaagaaacaaaccagcttaaaactaagctgcctgaaaacttgtcctcaaaagttaaactcctgcagttgtattccgaagcttctgtggctctgctaaaactcaataatcccaaagatttccaagagttgaataaacagacaaaaaagaacatgactatagatggaaaagaactcactatttctcccgcatacctactatgggacctttccgcaatctctcagtctaaacaggatgaagatatttctgcttctagattcgaagataatgaggaactgcgatattcattaagatctatcgaaaggcacgccccttgggtgcgaaacatcttcattgtgactaacggacagatacctagttggcttaatctagataacccacgggtcactatcgttactcatcaggatgtgtttcggaatctgtcgcacttacccactttcagtagtcccgctattgaatcacatatacatcggatcgaaggactctcacagaagtttatatacttaaatgatgatgtgatgttcggaaaagatgtatggcccgatgatttctattctcattccaaaggacagaaagtttacttaacatggccagtacccaactgcgctgaaggatgcccagggtcttggatcaaagatggatattgcgacaaggcttgtaataattcagcatgcgattgggatggaggggattgttctggaaactcagggggaagtcgatacatagccgggggaggagggacaggatccatcggagtcggacagccttggcagttcggagggggaattaactctgtatcctattgcaaccaggggtgtgcaaacagttggctggctgacaaattctgtgatcaggcctgcaatgtgctctcttgtggatttgatgcaggggattgcggacaggatcatttccacgaactctacaaagtaatcctgctgcctaaccagactcattatataataccaaaaggagaatgtctgccctatttctcattcgctgaagtggcaaaaagaggagtcgaaggggcttactccgataatcctattatcaggcatgcgtccatagccaacaaatggaaaacaatacacctcatcatgcattcgggaatgaacgctacaacgattcattttaatttaacattccagaacacaaacgatgaggagtttaaaatgcagatcactgtggaagtggatacacgggaaggacctaaactcaattctactgctcaaaaagggtatgaaaaccttgtatctcccatcactttactgcctgaagcagagatactctttgaagatatccccaaagagaaacggtttcccaaattcaaaagacatgacgtgaatagtacaaggagagctcaggaagaggtgaaaatccctttggtcaatataagtctcctccccaaagatgcccagctgtcgctaaacactttagacctccagctcgaacatggggatattactcttaaagggtataacctctctaagtctgctctccttcgctcttttctcatgaactcacagcacgcaaaaataaaaaaccaggctattattacggacgaaactaacgactcactggtggcaccccaggagaaacaagtgcataaatcaatcctgccaaactctctcggagtctcagaacgactacagcggctgacatttcctgcggtgagtgtcaaagtgaatggacacgaccagggacagaatcctccactcgaccttgaaacaactgcacgcttccgggtggaaacacacactcagaaaacgatcggaggaaatgtaactaaagaaaaacctccttctttgatagtccctctcgagtctcagatgacaaaagaaaagaagatcacagggaaagaaaaggaaaattctcggatggaagaaaacgccgaaaaccatattggagtcactgaggtccttctcgggcggaaattgcagcattatactgattcctacctagggttccttccctgggaaaaaaaaaaatattttcaggatctattggacgaagaagagagtctcaaaactcagcttgcttacttcacagactcgaagaatacaggacgccagctcaaggatactttcgctgattcactgaggtatgtcaacaaaatcctcaactctaaatttgggttcacgagtaggaaagttcccgctcacatgcctcatatgatcgatagaatagttatgcaggaattacaggatatgttccctgaagaatttgataaaacaagttttcataaggtgagacattctgaagacatgcagtttgcgttcagttatttctattatctgatgtctgcggtccagcctttgaatatttcccaggtgttcgatgaagtggatactgatcagtctggagtcctgagtgatcgggaaattaggacactcgccacaaggatacacgaactccctctgagtctgcaggatctaactgggctcgaacatatgttaataaactgtagtaaaatgttacccgcagatatcactcagctaaataacatcccccctacacaggagtcttattacgatcctaatcttccaccagtgacaaaatccctagtgactaattgcaaaccggtaacagataagatacataaagcatataaagataaaaacaaatatcggttcgaaattatgggggaagaggaaatcgcatttaaaatgataaggacaaacgtctcccacgtcgtcggacagctggatgatatccgcaaaaaccctcgcaaatttgtatgtcttaatgataatatcgatcacaaccacaaagatgcccaaacagttaaagccgttctaagggatttttacgaatctatgtttccaataccttcacagttcgaactgccacgggaatatcggaacaggtttttacatatgcatgaacttcaggagtggagagcttaccgggataaattaaagttctggactcactgcgtgctcgccacacttataatgttcactattttttcattctttgccgaacagctaatagccctgaaaagaaagatctttcccagacgccgcatccacaaagaagcgtcacccaacagaatccgggta

SEQ ID NO: 16996 - DNA, 3768 bp, Artificial Sequence
  Description of Artificial Sequence: Synthetic coding sequence
atgctattcaagctgctacagcgccagacttatacctgtttgagccatcgctacggactgtacgtctgttttctcggggtggtggtgactattgtctctgcttttcagttcggagaggtggtgttggagtggtcacgtgatcagtatcacgtgctgttcgacagctatagggacaacattgctggtaagtctttccaaaatcgcctctgcctgccaatgccgattgatgttgtgtatacttgggttaacggtacggatctcgagcttttgaaagaactgcagcaagtccgagagcaaatggaagaagagcagaaggccatgcgcgagatcctgggaaaaaacacgaccgaaccaaccaagaagtccgagaagcagttggaatgtctactgactcactgtataaaggtaccaatgctggtcttggaccccgcactcccagccaatatcactctgaaggatcttcccagtctgtatcccagtttccattccgccagcgatatctttaacgttgcgaaaccaaaaaatccttccactaacgtaagtgttgtggttttcgactcgaccaaagacgttgaggacgcacactcaggccttcttaaaggaaacagtagacagacggtgtggcgcggctaccttacaaccgacaaggaggtgcccgggctcgtgcttatgcaggatctggcatttctctctgggtttccacctacattcaaagagacaaaccagcttaagacaaaactcccagagaacctctcaagcaaagtaaagctgttacagctgtattcagaagcttccgtcgccctgctgaaactgaataatccgaaagattttcaggagctgaacaaacagaccaaaaagaacatgactatagacggcaaggagttgacaatctcgccggcgtaccttttgtgggacctctcagccatcagccagtccaagcaggacgaggatatctccgcaagccggttcgaagataatgaggagctgagatatagcctccgctccatcgaaagacacgctccctgggtgagaaatattttcattgtgacgaatggacagataccttcctggttgaatctggataaccctcgggtgactatagtgacccaccaagatgtgttcaggaacttatcccatcttcctacattttcgtctcctgccattgaaagccacattcatagaatcgaaggactttcgcagaagttcatttacctcaatgacgatgtgatgttcggaaaggacgtgtggcctgatgacttctactcccactccaagggacagaaggtctatctaacatggcctgtccctaactgtgcagagggctgccctggtagttggatcaaggacgggtattgtgataaggcttgcaataatagcgcctgcgattgggacggaggggactgctccggaaattcgggcggttcacgctacatagccggcggaggcgggactgggtccatcggcgtaggtcagccatggcagttcggaggcggcattaattctgtgtcgtattgtaatcagggttgtgctaacagttggctagcagataagttctgcgatcaggcttgtaatgtgttaagctgtggtttcgatgctggtgattgtggccaagaccatttccacgagctgtacaaggtgatcctactgcccaaccaaacgcactatatcatcccaaaaggcgagtgtctaccgtacttctcgttcgcagaagttgcaaaaaggggcgtcgagggggcttatagcgataatcccatcatacgccatgcctcaatcgccaataaatggaagactatccatctgattatgcattctggtatgaatgcgaccacaattcacttcaacctcacctttcagaatacaaacgacgaggagttcaagatgcagattaccgtggaggtggatacaagagaaggacctaaactgaactcgaccgcgcaaaagggctatgagaacctagtgtctccgatcacgctgctgcctgaagcggaaattcttttcgaagatatccccaaagagaagagatttcccaagtttaagcgacacgacgtgaacagcactaggagggcacaagaggaggtgaagatccccctcgtgaatatctccttgttgcccaaagatgcacagttaagcctcaacactctagacctccagttggagcacggcgacataacgttaaagggatataacctgagcaagtccgctctgctccgctcattcctgatgaactcccagcacgcgaaaataaaaaaccaggccattattaccgatgaaaccaacgattcgttggtggccccacaggaaaagcaggtgcataagtccattctgcccaattcccttggggtgagtgagagattgcagcgattgacgttccccgcagtaagcgttaaggtgaacggacatgaccaggggcagaacccaccgctggaccttgagactaccgctagatttcgtgtggaaacccacactcaaaagaccatcggggggaatgtgacgaaggaaaagcctcccagcctgattgttcccctggagagtcagatgacaaaagagaagaagatcacagggaaagagaaagaaaacagccgcatggaggagaatgctgagaaccacatcggcgtcacggaggtgctcctaggccgtaagctccaacattacacagactcatacctagggttcctgccctgggagaagaagaagtacttccaggacctgttggatgaagaggagagcctgaaaactcagctggcttacttcactgattccaagaacactggccgccaactcaaagatacttttgcggactccctcagatacgtgaataagattcttaattccaaattcgggtttacctcccgtaaagtccctgcgcacatgccgcacatgattgacaggatcgtgatgcaggagctgcaggatatgttccctgaagagtttgacaagacctcttttcacaaagtgcggcacagcgaggacatgcagttcgccttttcctatttctactatctgatgtccgccgtgcagccactgaacatctcacaagtgttcgacgaagttgacaccgaccagagtggagtacttagcgaccgagagatcaggacgcttgctacccgcattcacgagctgcccctttccctgcaagacttgaccggcctggagcatatgctgattaactgttctaagatgctccctgctgatataactcagctgaataacataccaccaacccaggagtcctactatgaccctaacttaccccccgtcaccaagtcactggttacaaactgcaaacccgtgaccgataaaatccacaaggcctacaaagataaaaataaataccggttcgaaataatgggggaggaggaaatcgccttcaagatgatacgcactaatgtctcgcacgtagttggtcagctggatgacattcgtaaaaaccctcggaagtttgtgtgcttaaatgataacattgaccacaaccacaaagatgcccagaccgtgaaggctgtgttgcgtgacttctacgagtccatgttccccataccctcccagttcgaactaccgcgggagtataggaacagatttctccacatgcatgaactgcaggaatggagggcctacagagataaactgaagttctggacacattgcgtcttggctaccctaattatgttcacaatcttcagtttttttgctgaacaactgatcgcgcttaagcgaaaaattttccctcgtcggaggatccacaaggaggcaagccctaatcgcattagagtt

SEQ ID NO: 16997 - DNA, 3768 bp, Artificial Sequence
  Description of Artificial Sequence: Synthetic coding sequence
atgctgtttaaattgctgcagcgccagacgtatacctgcctgtcgcaccgctacgggctgtatgtgtgctttctgggtgtcgttgtgactatcgtcagcgccttccagtttggtgaagtggtgttggagtggtcacgtgaccagtaccacgttctgttcgacagctatcgtgacaacatcgccggaaaatctttccaaaaccgattgtgcctgccgatgccaattgacgttgtgtatacttgggtcaatggaactgaccttgagctgttgaaggagcttcaacaagtgcgcgaacagatggaggaggagcagaaggcgatgcgcgagattttggggaagaacaccaccgagccgaccaagaaatccgagaagcagctggagtgcttactgacacactgtatcaaagtgccaatgctggtcctggacccggcgctgcctgcgaacatcaccttgaaagatttgcccagcttatatccatcgttccacagcgcctccgacattttcaacgtcgccaaaccaaaaaatcctagcaccaacgtgagcgtggtggtgtttgactccacgaaagacgtcgaagatgctcacagcggtctgctgaaaggaaatagccgccagacggtttggaggggttacctgacaactgacaaggaggtgcctggtctagtgctgatgcaggacctcgctttcctgagcgggttcccaccgacgtttaaggagaccaatcaactaaaaacgaagctgcctgaaaatctgagcagcaaagttaagttgctgcaactgtacagcgaggccagcgttgctttgctgaagctgaacaatccaaaggattttcaggaattgaataagcaaaccaaaaaaaacatgacgattgatggtaaagaactgaccatctccccagcgtatctgctgtgggacttgtccgccatttcccaaagcaagcaggacgaggacatttcggcttctagatttgaggataatgaggaactgcgctactcacttcgcagcatcgaaagacacgccccatgggtgagaaatatttttatcgttaccaacggccaaatcccatcctggctgaatttggacaacccgcgcgtaaccatagtgacccatcaagatgtcttccgaaacctgagccacctgccaacctttagctctcctgctattgagagccacatccataggatcgaaggtttgagccagaaatttatttacttgaatgacgatgtgatgttcggaaaggatgtatggccggatgacttctactcgcatagcaaagggcagaaggtttatttgacatggccagtgccaaactgcgccgagggctgtccgggtagctggattaaggacggctactgcgacaaggcttgtaacaactcagcgtgcgattgggacggcggagattgcagcggcaactcagggggcagcaggtatatcgctgggggcggtggtaccggtagcatcggcgtgggccaaccttggcaatttggcgggggcatcaatagtgtgagctattgtaaccaaggttgtgcaaacagctggctggcggataagttctgcgatcaggcctgtaacgtcctgagttgcggtttcgatgccggcgattgcggacaggaccattttcatgagctatataaggtgattttgctgccgaaccaaacgcactacatcatccccaagggggagtgtctcccatatttcagcttcgcggaggttgctaagcgcggcgtggagggggcgtacagcgacaaccctatcatccgtcacgcgtccatcgccaataaatggaaaacaatccatttgattatgcacagcggcatgaacgccacgaccatccactttaacttgacttttcagaacacaaacgacgaggagttcaagatgcaaatcactgtagaggttgacacccgcgagggccctaaattaaatagcaccgctcagaagggatatgagaacctggtgtccccaattactttattgcctgaggccgaaatcctgtttgaagacatcccgaaagagaaacgcttcccaaagtttaaaagacacgacgtaaacagcacacgtagggcgcaggaggaagtgaaaattccgcttgttaatattagcctgttgcctaaagatgcacagctcagcctgaatacgctggatctccaattggagcacggcgatataactctgaagggatacaatctgtctaaaagcgcgctgctgcgcagcttcctaatgaactctcaacacgccaagattaaaaatcaagctattattacggacgagaccaatgacagcctggtggccccgcaggagaagcaggtccataagtcgatcctgccaaattctctgggtgtgtctgagcgcctgcagagactgacctttccggcagtgtccgtgaaggtgaatggtcacgaccagggtcagaaccctccgctggacctggagacgacggcccgcttccgcgttgaaacccacacgcaaaagaccattggtggcaacgtgacgaaagaaaagcctccatccctgattgttcctctggagagccagatgaccaaagaaaaaaaaatcaccggtaaggaaaaggagaattctcgaatggaggaaaacgccgagaatcatatcggtgtcaccgaagttctgctgggtcgaaagttgcaacattacaccgactcctatctgggctttctgccttgggaaaagaaaaaatattttcaagatctgctggacgaagaggagagtctgaagacccaactggcatatttcaccgacagcaaaaacacaggcagacagttgaaggatactttcgcagatagcctccgctacgtcaataagatcctgaattctaagttcggcttcacctctcgcaaagtcccggcgcatatgccgcacatgatcgatcggattgtcatgcaggagctccaggacatgtttcccgaggagttcgacaagaccagctttcataaggtccgacatagcgaggatatgcaattcgcgttctcgtacttctattatctaatgtctgccgtacaaccactgaatattagccaagttttcgacgaggtagacactgaccagtccggggtgctgagcgaccgcgagatccggactctggcaacgcggatccacgaactgccactgagcctgcaagatctgacaggtctcgaacatatgctgatcaattgttctaaaatgctgccggctgatattacccagctaaacaacatcccaccgactcaggagagctactatgacccaaacctgccaccggtgaccaaatcattggtgacgaactgcaaacccgtcaccgataaaatccacaaagcttacaaggataaaaacaaatataggttcgagataatgggcgaggaagaaattgcgtttaagatgattagaaccaatgtctctcacgtcgtcggtcagctggacgatataaggaagaacccacgcaagtttgtgtgcctaaatgacaacatcgaccacaaccataaagacgcgcaaaccgtcaaggccgtgctgcgtgacttctacgaaagtatgttcccgatcccgtcccagtttgagctgcctcgcgagtatcgaaaccggttcctgcacatgcacgagttgcaggaatggcgcgcttaccgagataagctgaagttctggacccactgcgtgctggccacgctgatcatgttcactatattctccttctttgctgagcagctgatagcattgaagcgcaaaatttttccacgccgccgcatccacaaggaggctagcccaaacaggattcgtgtt

SEQ ID NO: 16998 - DNA, 3768 bp, Artificial Sequence
  Description of Artificial Sequence: Synthetic coding sequence
atgctatttaaactactgcagcgacagacttacacctgcttgagtcatagatatggtctatacgtgtgctttctcggcgtggtagtaactatagtaagtgcattccagttcggagaagtggtgctcgaatggtcccgagatcaatatcatgtcctgttcgatagctacagggataatatcgctgggaaatcgtttcagaacaggttatgtttgccaatgcctatcgatgttgtttatacatgggtgaacgggacggatctggaactgctaaaagaattgcagcaggtcagggagcagatggaggaggagcagaaagcaatgcgcgagatattggggaagaatacaaccgaacccactaagaaaagcgaaaagcagctcgagtgtctcctgactcactgcataaaggttcccatgctggttcttgatcctgcgctccctgcaaacatcaccctgaaggacctaccaagtttgtacccgtcttttcacagcgccagtgacatattcaacgtagccaaacctaagaaccctagcacgaatgtgtctgtggtcgtgttcgacagtactaaagacgtggaggacgcgcattccggactgctgaagggaaattctaggcagaccgtatggcgcggttaccttacaactgacaaagaagttccaggcctggtcctgatgcaggatctcgcgtttctgtcaggattcccacccacattcaaggagacaaaccagttgaaaaccaagctacccgagaatctaagctccaaggtcaaactactccaactgtattcagaggcgtcagttgcactcttgaaactgaacaatcccaaggacttccaggagctaaacaagcagaccaagaagaacatgacaattgacggaaaagagttgacaatctccccagcctacctcttgtgggatctaagcgcaatttcacaatcgaagcaagacgaggatattagtgccagtagatttgaggataacgaagaactgcgctactccctccgcagcatagagcgccatgccccgtgggtgcgcaatatctttatcgtgacaaatgggcagatcccttcctggttgaacctggataatccccgggtgactattgttactcaccaggacgttttccggaatctcagtcatcttccaactttcagtagtcctgcgatcgaaagccacatacacaggatcgaaggcttgtcccagaagtttatttatctgaatgatgatgtcatgtttggtaaagatgtctggcccgacgacttttatagtcattcaaaggggcagaaggtgtatttgacctggcccgtgccaaattgtgccgagggttgccccgggtcttggatcaaggatggatattgtgataaagcatgcaataactctgcgtgcgattgggatggaggagactgttctgggaattcggggggcagtaggtacatcgctgggggcgggggcaccggatccattggtgttgggcagccatggcagtttggcggcggaattaacagtgtgtcctattgtaatcaagggtgcgctaactcctggctggcagataagttttgcgatcaggcatgcaacgtgctttcttgtggctttgacgcaggggattgcggccaagaccactttcatgagctttacaaggttatcctcctcccgaaccagacacactacatcattccaaagggggagtgtcttccttattttagctttgccgaggtggccaaaagaggggtggagggggcatacagcgataatcctataattcggcacgccagcattgccaacaagtggaagaccatccatttgattatgcactccgggatgaatgctaccactatacacttcaatctgaccttccaaaacaccaatgacgaggaatttaaaatgcaaataaccgtcgaggtagataccagagaaggacccaagttaaacagtacagcacaaaaaggctatgaaaacttagttagtcctatcaccctgctaccggaggccgagatcctctttgaagatattcccaaggagaagaggtttccgaaattcaagcgccacgacgtaaactctacccgcagagcccaggaggaggtcaaaattcctttggtaaacatcagcttgctcccaaaggacgcccaactgagcctgaataccttggacctacagcttgaacacggcgacattacgttgaagggctataacctcagtaagagcgcacttcttcgatcttttttaatgaactcacagcacgccaaaattaagaaccaggccatcatcaccgacgaaaccaatgacagcctggttgcaccccaagagaagcaggtgcacaaatccattctccctaacagcctgggggtatctgagcgcctgcagcgacttacctttcctgcagtgagtgtaaaagtgaatggacacgaccaggggcagaacccccctctggacctggaaaccaccgcccggttccgagtagaaacccatacacagaaaacaatcgggggtaatgtgaccaaagagaaacctcctagtctcattgtccctctggaaagccagatgactaaagagaaaaagatcacagggaaggagaaagagaattcgagaatggaagagaatgctgagaatcacattggggtaaccgaggtgctgctgggccgaaaactccagcactacacagattcatatttaggctttctgccctgggagaagaaaaaatattttcaggacttactcgacgaagaagaaagtctcaagactcagttagcttacttcaccgattctaagaacacaggacgccaactcaaggacactttcgcggactccttgcgatatgtgaacaaaatcctaaattctaaattcgggttcacgtccaggaaggtgccagcccacatgccccatatgattgatcggatcgtgatgcaggaactccaggacatgtttccagaagagttcgataagacatccttccacaaagtgagacactccgaggacatgcaatttgctttctcctatttttattacctgatgtctgccgtgcagcctcttaacataagtcaggtgttcgatgaagttgacacagaccagtccggggtactgtctgatagggagattaggacgctagccaccaggatccatgagctccctttatcgctccaggacctcacgggcctggagcacatgctgatcaactgctcaaagatgctgccagccgatatcacacagcttaacaacattcctcctacccaggagagctactatgatccgaacctgcctccggttaccaagagtctcgtcactaactgcaagccagtaacggacaaaatccataaagcatataaagacaaaaataagtatcgcttcgaaatcatgggcgaggaggaaatcgccttcaagatgataaggacaaacgtgtcccacgtggtgggccagctcgatgatatcaggaagaatccaaggaaattcgtctgtctaaacgacaatattgatcataaccataaggatgcacaaaccgtgaaagccgtcctgagggacttctacgagagcatgttccctataccgtcccagtttgagctgcccagagaatatcgcaatcgatttctccacatgcatgaactgcaggaatggagggcctacagggataagctgaaattctggacccattgcgtgttggctacactcatcatgttcaccatattttccttttttgctgagcagctgatagctctgaagcgaaaaatcttccccagacgacggatccacaaggaggcaagtccaaatagaattcgcgtg

SEQ ID NO: 16999 - DNA, 3768 bp, Artificial Sequence
  Description of Artificial Sequence: Synthetic coding sequence
atgttattcaaattgctccaacgtcagacctacacctgcctatcgcatcgttacggattatacgtttgcttcttgggcgttgtcgttactattgtgtcggcgttccagttcggtgaggttgtcttagagtggagccgtgatcagtatcatgtcctcttcgattcgtaccgagataatattgccggtaaaagcttccaaaacagattatgccttcctatgccaatcgatgtcgtttacacttgggttaatggaaccgatttggaactcttgaaagaattacaacaggtaagagagcaaatggaagaagaacaaaaagcaatgagagagatcctgggtaagaatacaacagagccaactaagaaatcagaaaaacaacttgaatgtctgctcacacattgcattaaggtaccaatgcttgttcttgatccagcattgccagctaatatcacattgaaggatttgccgagtctatacccatcctttcattctgcttcagatatttttaatgttgctaagccaaaaaacccaagcactaatgtatcagtggtggtatttgatagcaccaaggatgtcgaagatgctcattctggattacttaaagggaactctcgccaaactgtttggagaggctaccttactaccgataaagaggtgccaggattggttctcatgcaagacctcgcctttctgtccggcttcccaccaacgttcaaagaaaccaaccaactcaagactaagcttccagagaatcttagttctaaggtcaaattgttacaactttactcggaagcttccgtcgccttattgaaacttaataacccgaaggatttccaggaattgaataagcaaacaaagaaaaatatgacgattgatggtaaagaactaacgatatcacctgcttacctgctgtgggacttaagtgcaatctcacagtcgaagcaggatgaagatatttcggcatctcgattcgaagataacgaagaacttcgatattcgcttcgatcaatcgaacgccatgctccatgggttcgaaatatttttatagttactaatgggcagataccatcgtggctcaatcttgacaatccacgggttacaattgtaacacaccaggatgttttccgaaacctctcccatttgccgacattttcatcaccggcgattgaatctcatattcatcggattgaaggcctatcacaaaagttcatttatcttaatgacgatgttatgttcggaaaggatgtttggccagacgatttctactctcacagcaaaggacagaaggtctatttgacatggccagttccaaactgtgctgagggatgcccaggcagttggattaaggacggttattgtgacaaagcttgtaacaattcagcttgtgattgggatggaggggactgttctggaaattcgggaggatcacgatatatcgctggaggaggtggaacagggtctattggtgtgggccaaccatggcaattcggaggggggattaatagtgtgagttactgcaaccaaggatgtgctaactcatggttagcagataaattttgcgatcaagcgtgcaacgttctgtcgtgcggattcgatgctggggattgcggacaggatcattttcacgaactttacaaggtcatattgcttccaaaccagactcattatattatcccaaaaggtgagtgtttgccctatttctctttcgctgaggtggccaaacgaggagttgagggtgcttactcagacaatccaattattcggcatgcttcgattgctaacaagtggaagaccattcatttaattatgcacagtggaatgaatgctacaacaatccattttaacctgacgtttcaaaatacaaacgatgaggaatttaagatgcaaattacagttgaagtcgatacgcgagagggtccaaagttaaatagcaccgcacaaaagggctacgaaaacctggttagcccgatcacattgctgccagaagcggaaattttgtttgaagatatcccgaaagaaaaacgatttccaaaatttaaacgccatgatgttaatagtactagacgagctcaagaggaggtcaaaattccactcgtcaacatctcattgctcccgaaagatgcacagctttcactaaacacattagatctacagcttgagcacggagatattacacttaagggatataatctgagcaaatccgctctcttaagaagtttccttatgaatagtcagcatgctaaaattaagaatcaagcgattatcacagatgagaccaatgatagcctagtggcacctcaagaaaaacaggttcataaaagcatccttccaaattctctcggagtatccgaacgacttcaacgcctaacattccctgctgtatcagtcaaggtaaatggacatgatcaaggtcaaaatccacctcttgatcttgagacaacggctcgattccgagtggaaacacatacacagaagactattggcggtaatgtaactaaggaaaaaccaccttcgttaatcgtcccactagaaagccaaatgaccaaggaaaaaaaaattacaggaaaagaaaaagaaaacagccgtatggaggaaaatgctgaaaaccatattggagtcacggaagttttgctgggacgtaaattacaacattacactgattcctatcttggattcctgccatgggaaaaaaaaaaatatttccaagatcttttggatgaggaagagtcgcttaaaacccaacttgcctattttactgattcaaaaaatacaggccgtcagctcaaagatacatttgcggattctttgcgatatgtaaacaaaattttaaattcgaaattcggttttacatcacgaaaagtgcctgcacatatgccgcacatgattgatagaatcgtcatgcaagagctacaagatatgttcccagaagaattcgataaaacatcctttcataaagtccgacactcagaagatatgcaatttgctttctcttatttctactacctcatgtctgcggttcagcctctcaatataagccaagtgttcgatgaagtagatacagatcagtctggagttttgagcgatagagagattagaaccctcgcgaccagaattcatgaacttcctttgtctcttcaggatctcacaggtctggaacacatgttaattaattgttcaaaaatgctccctgcagatatcacacagttgaacaacattccaccgacacaagagtcttactatgatccgaatcttcctccggtaactaaatcacttgttactaattgtaaaccagtcaccgacaagattcacaaagcatataaggataaaaataaatatcgcttcgagatcatgggagaggaagaaattgcttttaaaatgatacgtaccaatgtgtcacatgttgtcggtcaacttgatgatattcgaaagaaccctcgaaagttcgtctgtttaaatgataatattgaccataatcataaggacgcacaaactgttaaagcagttttgcgggatttttacgaatcgatgttccctattccgtcacaatttgaattaccaagagaatacagaaatcgttttttgcatatgcatgaattgcaagaatggcgagcttacagagataaactcaagttctggacacattgtgtactcgccacactcatcatgttcactattttctcgttttttgctgaacaattgatagcacttaagcgaaagatctttccacggcgtagaatacacaaggaagcgtcacctaatcgaattagagtt

SEQ ID NO: 17000 - DNA, 3768 bp, Artificial Sequence
  Description of Artificial Sequence: Synthetic coding sequence
atgttatttaaactgctccaacgacaaacttacacatgtttaagtcataggtatggcctgtacgtgtgttttctcggggtggttgtgacaatagtatccgcctttcaattcggggaggtagttctcgagtggtcccgagaccagtaccatgtccttttcgactcctaccgagacaatatcgctggaaaatcatttcagaatcgattgtgcctgccaatgccaatcgacgttgtgtatacatgggtcaacggaacagatcttgaactcctaaaagagctccagcaggtgcgagagcagatggaggaagagcagaaagcgatgagggaaatcctgggtaagaacacgacagaacctaccaaaaagtctgagaagcaactggaatgcctgctgactcactgcataaaagtccccatgctggtgttagatccagcgttgccagcaaatataactctgaaagacctgccaagcctgtacccttccttccactccgccagtgatatatttaacgtggccaagccaaagaacccttccacaaacgtctccgtcgttgtcttcgactctactaaagatgtggaggatgcgcactctggactcctcaagggtaattcaagacagacagtgtggaggggctatctcaccacagacaaagaggtgccagggctcgtcctcatgcaggacctcgccttcttaagcggctttccacctacctttaaagaaacaaatcaattgaagacaaagctgcccgagaacctcagctccaaggtcaaattgttacagttatactctgaggcgtctgtggcgcttttaaaattgaataaccccaaggacttccaagaactgaataaacagactaagaagaatatgactatcgacggcaaagagctgaccatcagtccggcttacctgctctgggacttgtcggcaattagtcagtccaagcaggacgaagacatatcagccagccgtttcgaagacaacgaagaactgaggtattcacttaggtccatagaaaggcatgcaccctgggtgcgaaacatttttatcgttaccaacggccagattccatcctggttgaatctcgacaatccaagggtcacgatcgtaacccatcaagacgtgtttaggaatttgtcacacttgccgacctttagcagccccgcgatagaaagtcatatccataggattgagggtttgtctcagaaattcatctacttgaacgatgatgtgatgtttggtaaggacgtttggcccgacgacttttactcccattccaaagggcagaaagtctatttgacatggccggtgccaaactgtgccgagggctgccctggatcttggatcaaagacggctactgcgacaaagcctgtaacaattctgcttgtgattgggatggcggggactgttctggaaactccggaggctctagatatattgccggcggagggggtaccgggtcgatcggggtgggccaaccatggcagttcggtggggggatcaatagtgtgtcctattgcaatcaggggtgcgctaattcctggctggcggacaagttttgtgatcaggcttgcaacgtactttcctgtgggttcgacgccggcgactgcggccaggaccactttcatgagctgtacaaagtaattctgttgcccaatcaaacccattacatcatcccaaaaggtgagtgcctgccctatttctcgtttgcagaggtggccaaacgaggtgtggaaggtgcgtacagtgataatccaattatccgacatgcgtccattgccaataagtggaaaactattcacctgattatgcacagcgggatgaatgcgacaacaattcactttaacttgacttttcagaacaccaatgacgaagagttcaagatgcagatcactgtagaggtggacacccgagagggtccaaagctcaatagcacagctcaaaaaggctacgagaacctcgttagcccaataaccctgctacccgaagctgagattctgttcgaggacatccccaaagaaaagagatttccaaagttcaagagacacgacgttaattcaactagaagagcgcaggaagaggtaaaaattcctctcgtgaacatcagcctccttcctaaagacgcacagttgtctctaaacaccttggacctgcagctggaacatggagacataaccttaaaagggtataacctgagtaaaagcgctctcctgcgttccttccttatgaatagccagcatgccaagatcaagaaccaggcaataataaccgatgagaccaatgatagccttgtagctccacaggagaaacaggtacataaatcaattctgcctaactccttgggggttagtgagcgactccaaaggctcacttttcccgccgttagcgtgaaagttaacggccatgatcagggacagaatccgccactagacctggaaactacagctagattcagagtagagactcatacccagaagactatcggtgggaatgttaccaaggaaaaacctcctagtctgatagtacctctggaatcccagatgactaaggaaaaaaaaattacaggaaaggagaaggagaattcccgaatggaagaaaatgccgagaaccacattggtgtaaccgaagtgttattggggcgaaagctgcaacactataccgactcctatctgggctttttgccatgggaaaagaaaaagtattttcaggacctgttggacgaggaagaatctctgaaaacacaactggcatattttactgattcaaaaaatacggggaggcagctgaaggatactttcgccgactcactccgttacgttaacaagatcctgaacagtaagtttggattcaccagccgtaaggttcccgcccacatgccccatatgattgatcgaatcgtcatgcaggaactgcaggatatgtttccggaagagttcgataagacctccttccacaaagtcagacactctgaggacatgcagtttgcgttctcgtacttttactacctcatgtctgcagtgcagcccttgaacatatcccaggttttcgacgaagttgacaccgatcagtcaggagtgctgagcgatcgcgaaattagaacgctggccactagaatccacgagttacccttaagtctgcaggacctaactggccttgagcacatgctgatcaattgttctaagatgcttcctgcagacataacccagctgaataacattccgccgacccaagagtcctattatgaccctaaccttccccctgtgaccaaatctttggtgaccaattgtaaaccggtgactgacaaaattcacaaagcttataaggataaaaataaataccgtttcgaaatcatgggcgaagaggagattgctttcaaaatgatccgaactaatgtgagccacgtcgtgggtcagttagatgacattaggaagaacccgcgaaagttcgtatgtctgaatgataatatagaccataatcataaggacgcccaaacagtgaaggcagtgctgcgagacttttatgaatccatgttccccatcccgagtcagtttgagctgcctagagagtacagaaatcgttttctccacatgcacgagttgcaggaatggcgtgcatatcgagataaactgaaattttggactcactgtgtcctggccaccctgatcatgtttacaatatttagtttttttgccgagcagctgatcgctctgaaaaggaagatcttccccaggagaaggattcataaggaagctagccccaacagaatcagagta

SEQ ID NO: 17001 - DNA, 3768 bp, Artificial Sequence
  Description of Artificial Sequence: Synthetic coding sequence
atgctctttaagctgctgcaacgacagacctacacctgcttgagtcaccgctacggcttgtacgtctgcttcctgggtgttgtggtgactattgtgtccgccttccagttcggcgaggtggttctggagtggagccgggaccagtaccatgtattgtttgattcgtaccgggataacatcgccggcaaatccttccaaaatcgcctgtgtctacccatgccaattgatgtcgtttatacatgggtgaacggtaccgacctagagttgctgaaggaattacagcaggtacgcgagcagatggaagaggaacagaaagccatgagggaaattcttgggaagaatacgacggagccgaccaaaaagagcgagaaacaactggagtgtctcctcactcactgtataaaggtgcccatgcttgtattagatccggctctcccagctaatattaccttgaaggacctcccaagcctgtatccctcgttccacagtgctagcgatatctttaacgtcgctaagccgaagaacccgagtacgaatgtctctgtggtggtatttgactccaccaaggatgttgaggatgcccactcagggttgctgaaaggcaattcgagacaaactgtgtggcgtggatacctgactactgataaggaggtcccaggcctcgtgctgatgcaggatctggcgtttttatcgggcttcccgccaacgtttaaggagacgaaccagctgaagacgaagctgccggagaacttatcgtcaaaagtcaagctactgcagctctactccgaagccagcgttgctctgcttaagctgaacaacccgaaggacttccaggagttgaataaacaaacgaaaaagaacatgacaatagatggaaaggaacttaccatatcacccgcctacctgctgtgggatctaagcgctatctcgcagtcaaagcaggacgaggatatttcggcgtcccggttcgaagacaatgaggagcttcgctatagcctccgctcgattgagcgtcatgctccctgggtccgaaacatctttatcgttactaacggccagatcccctcctggctcaaccttgacaatccccgagtgacgatagtgacccatcaggacgtcttccgcaatctatctcacctgccaactttctcgtcgccagcaattgagtctcacatccaccgcatcgagggtctctcgcagaagtttatctatttgaatgatgatgtgatgttcggcaaagacgtctggcctgacgatttttattcccatagcaagggacagaaggtgtacctgacctggccagtgccgaactgcgcggagggttgtcccgggtcttggatcaaggatggctattgcgacaaggcctgcaacaattcggcgtgtgattgggacggcggcgattgctcaggcaatagcggagggtcacgttacatcgctggcggaggcggcacaggaagcatcggagtaggccagccgtggcagttcggaggcggcattaacagtgtgagttattgcaatcagggctgtgctaattcgtggcttgcagacaaattttgcgaccaagcctgcaatgtgttgtcttgcggattcgatgcgggtgactgtggccaggatcattttcatgagctgtataaggtcattctcctgcctaaccaaacacattatatcattccgaagggtgagtgccttccgtatttcagcttcgctgaggttgcaaagcgaggggtagagggcgcatacagtgacaatccgattatcaggcatgcaagcattgcgaataagtggaagaccattcatctgataatgcactccggaatgaacgcaacaacgattcacttcaatttgactttccagaatacaaatgacgaagagttcaagatgcagattactgtggaggtggacacgcgagagggccccaaactgaactccacagcacagaaaggttacgagaacctggtctcccccatcactctgctgccagaggcggagatcttattcgaggatattccaaaggaaaagcgattcccgaagtttaagagacacgacgtcaactctacccggcgggcccaggaagaggtcaagatccccctggttaacattagcctcctcccaaaggatgcccagttgtcactgaacacactggacctacagctcgaacacggcgatattacactgaagggttacaatttgtccaagtcagcactgctgcgctcctttctgatgaatagccagcacgcgaagattaagaaccaggcaattattaccgacgagacaaatgattctttggtggcaccacaggagaaacaggtccacaaaagcatactacccaattcgctgggggtgtccgagcgcctgcaacggttgacgttcccggccgtttcggtgaaggttaatggccacgaccagggccaaaacccaccactcgatttggaaactactgcacggttccgcgtggagactcatacgcaaaaaactatcggcggcaacgtgacgaaggaaaaacccccaagtctaatcgtgcccctggaaagccagatgaccaaggaaaagaaaattactgggaaagaaaaggagaatagccgcatggaagagaacgcagagaaccacatcggcgtgaccgaggtcctgctgggacgtaagctccaacactacacagactcctaccttggcttcttgccttgggagaaaaagaagtacttccaggatctgttggatgaggaagagagcctgaagacgcagctggcatactttacggatagtaagaacaccggaaggcagctgaaggacacgtttgccgactcgctgcgctatgtgaacaaaattctcaattccaagttcggattcacgagcagaaaggttcccgcccatatgccacacatgatagatcgaatcgtgatgcaagaactccaggacatgttcccggaggagttcgataagacgagcttccacaaggtccgacacagtgaagacatgcaattcgcattttcgtacttctactacctgatgagcgccgtccagccgttgaacatctcgcaggtgttcgacgaggtagatactgatcaatcgggtgtcttgtctgatcgagagattcgaaccctggcaactaggatccacgaactgccacttagcttgcaggaccttaccggcttggagcatatgcttatcaactgttcgaagatgctcccagcagatatcacccaactgaacaacattccgcccacgcaagagtcttactatgatcccaacctgccgcccgtcaccaagtcactggtaactaactgcaaaccagtcaccgataagattcacaaggcatacaaggacaaaaataagtaccgcttcgagattatgggtgaggaggagatagcctttaagatgatacgcactaatgtctcccacgttgtcggacagctggacgatattcgcaagaacccgcggaagttcgtttgtttaaacgataacattgaccacaaccacaaggacgcccaaaccgtgaaggccgtccttcgagacttctatgagtcgatgtttcccataccatcgcaatttgaactcccacgggaatatagaaaccgcttcctgcatatgcacgagttgcaagagtggcgggcgtacagggacaagctgaagttttggacccattgcgtgttggccacgctcatcatgttcaccatttttagctttttcgccgaacagcttattgcgctcaagcgcaagatcttccctagacgccgcatacacaaggaagcctcgccgaatcgaatacgagtt

SEQ ID NO: 17002 - DNA, 3768 bp, Artificial Sequence
  Description of Artificial Sequence: Synthetic coding sequence
atgctgttcaagttgcttcagcgtcaaacgtacacgtgtctgtcacataggtatggtttgtatgtttgctttttaggagtggtggttactatcgtgtcagcgtttcagttcggggaagttgtcctggagtggtctagagaccagtaccatgtgttgtttgacagctatagggataacattgccggaaaaagctttcagaatcgactatgtctgcctatgcccatagatgtcgtgtacacctgggtgaacggcactgatctggagctgttgaaggagttgcagcaggtacgggagcagatggaagaagaacaaaaagccatgagagagatcctgggcaaaaatacaaccgagccgaccaagaaatctgaaaagcagctagagtgtcttctgacccattgcattaaggtgcctatgctggtgctcgatcctgccctgccggcaaatattacacttaaggatcttccctctctctatccttcatttcattctgcctctgacatcttcaacgtcgccaagccaaaaaatccatctaccaatgttagcgtggttgtgtttgacagtacgaaagatgtggaggatgcacactcggggctgctcaagggcaactcgagacagacggtgtggaggggctacttgaccacggacaaggaagtgcccggattagtgctgatgcaggacctggcatttctctccggcttccctccgacattcaaagagacaaatcagcttaagactaaactccccgaaaacctttcctcaaaggtgaagttactgcagctatattctgaagcttcagttgccctcctgaaattgaacaatcccaaggatttccaagaactgaacaaacaaaccaaaaagaacatgactatagatggaaaggagcttacgataagcccagcctacctgctttgggacctgtccgccatttctcagagtaagcaagacgaggatatctccgcatctagattcgaagataacgaggagttgcgttactcacttagaagtatagaacgccatgctccatgggtaaggaatattttcatcgtcacaaatggtcagatcccgtcttggctgaacctcgataatccaagggtgaccattgttacacatcaggatgtgttccgaaatctgtctcatctgccaaccttctcgtcgccggcgatagagtcgcacattcaccgaatcgaaggtctgtcccagaagttcatctaccttaatgatgatgtgatgtttggtaaagatgtctggcctgacgacttctattcccattcaaaaggccaaaaagtgtacctgacgtggccagtccccaactgtgccgagggctgtccaggaagttggatcaaagatgggtactgtgacaaagcgtgtaataactctgcctgcgactgggacggaggcgattgctccggcaatagcggaggctctcgttatatcgcaggagggggtggtaccggcagtataggcgtcggacagccgtggcagtttggggggggaatcaacagcgtgtcctattgcaatcaaggttgcgccaacagctggctagccgacaagttttgtgatcaggcgtgtaacgtgctcagttgcggatttgatgccggagactgcgggcaggatcattttcacgaactgtataaggtgatcttactgccaaatcagacgcattacataatccctaaaggagaatgcttaccatacttcagctttgctgaggtggccaagcggggagtggagggcgcttacagcgataatcccatcatccgtcacgccagtatagcaaacaagtggaagactattcatttaatcatgcacagtggaatgaacgccactactatccattttaacctcactttccaaaataccaacgacgaagaattcaagatgcaaattaccgttgaagtcgacacaagagagggaccgaagctcaactcaacggcgcagaaggggtacgagaacctcgtatccccaatcactttgttgccagaagcagaaatattgttcgaggacatccccaaggagaagagatttcccaagttcaaacgacatgacgttaactctacacggcgcgcccaggaagaagtgaagatcccattagtcaatatttctctacttcccaaagacgctcagctgtcattaaacaccctagacttacagctggagcacggtgatatcacactgaagggatacaatctttccaagtcagctcttttgcggtctttcttgatgaatagccagcacgccaagattaagaatcaggcaattatcacggacgagaccaacgattcactcgtggcacctcaagagaagcaggttcacaaaagcattctacccaactcgttgggagtgagtgaacgcctccagaggcttacatttccagcagtgtcggtaaaagtgaacggacacgatcagggccagaacccaccgctcgacctagaaaccacagcccgcttccgggtggagacccatacccagaaaacaatcggggggaacgtgaccaaggagaaaccaccctcgctgatcgtgcctctggagtcacagatgactaaggagaaaaagattactggaaaagagaaggaaaatagtcgcatggaggaaaacgctgagaaccacattggagtaacagaggttctcctggggagaaagctgcagcactacaccgattcatacctgggtttcctgccatgggaaaaaaaaaaatactttcaagatctcctggacgaagaagagagccttaagactcagctcgcatatttcactgattccaaaaatacggggaggcaattaaaggatacttttgcagactctctgcggtatgtcaacaaaatccttaacagcaagtttggatttacaagccgaaaggtccctgctcatatgccccacatgattgatcggattgtgatgcaggagctgcaggatatgttcccggaggagtttgataagacctcattccataaggtcagacactctgaagatatgcagttcgcttttagctatttttattacctgatgagcgccgtacagcccctgaacataagccaggtgtttgatgaagtggacactgatcagtctggtgtcctgagcgacagagaaatacgcacgctggctacacggattcatgaactgccccttagcttacaagatttgaccggccttgagcacatgctcattaactgcagtaaaatgctacctgcagatatcacacagctgaataatatccccccaacccaggaaagttactatgacccaaacttgccaccagtgactaaatcactggtgaccaattgtaaacccgttacggataagatccacaaggcctataaagataagaacaagtaccggtttgagataatgggcgaagaggaaatcgcgtttaaaatgatccggacaaatgtttcccatgtggtgggccagttggacgatattagaaaaaacccacgaaagttcgtctgcctgaatgacaatattgaccacaatcataaggacgcccaaacagttaaggccgtgctccgtgatttttacgagagtatgtttcctatcccttcacagttcgaactacctagggagtatagaaaccggtttttgcatatgcatgaactgcaggagtggcgcgcttatagggacaaactgaagttctggacccactgtgtgctggctaccttaatcatgtttaccatcttctccttcttcgcagaacagttaatagctctgaagcgcaagattttccctcgccgaagaatccacaaggaagcttcccctaacaggatcagagtg

SEQ ID NO: 17003 - DNA, 3768 bp, Artificial Sequence
  Description of Artificial Sequence: Synthetic coding sequence
atgctatttaaacttcttcaacgtcagacatacacatgtctgtcgcatagatacgggctatatgtgtgctttctgggggtggtcgtgactatagtctctgcgtttcagtttggtgaggtggtgcttgagtggtctcgagatcagtaccatgtgttgttcgattcctatcgcgataatattgcaggcaaaagctttcagaaccggctgtgcctccctatgccaattgacgtcgtatacacctgggtaaatggcactgatttggagctacttaaggaactgcagcaggttcgcgagcaaatggaggaggagcaaaaagcgatgcgggaaatactgggaaagaacaccacggaacccaccaagaaatcggagaagcaactggagtgtctgctaacgcattgtataaaggttcccatgttggttctggacccagcactgccagccaatatcaccctgaaggacctgccatcactatacccatcatttcatagcgcgtctgatatcttcaacgtggcgaaacccaagaacccgagcacaaacgttagtgtggttgtgtttgactccactaaggatgtggaggacgcacatagtgggctgctcaaaggaaactccaggcaaaccgtttggcgggggtaccttacgacggataaagaagtccccgggttggtgctgatgcaggatctggccttcttgtccgggttcccccccacttttaaggagactaaccaactaaaaaccaaactcccagaaaacttgtcttcaaaggtgaaactgcttcagctctactctgaagcatccgtggccctgttaaagttgaataatcctaaggatttccaagagttgaacaaacagactaaaaagaatatgacgatcgacggtaaggagctcactatatctccagcctaccttctctgggacttaagcgccatttcgcaatctaagcaggacgaagacatctcagccagccgctttgaggataacgaggagctgagatacagtctgaggtccatcgagaggcacgccccttgggtacggaacatattcatcgtgacaaacgggcagattcccagctggttgaacctggacaaccctagagtcactatagtgacacaccaggacgtgtttagaaacctcagtcacctgcctacatttagtagtcccgccattgaaagccatatacatcggatcgagggtctgtcgcagaagtttatatacctcaatgacgacgtgatgttcggcaaggatgtatggccagacgatttttattcacattcaaaggggcagaaggtatacctgacctggcctgtcccaaactgcgcagagggatgtccgggttcctggataaaggacggctactgtgacaaggcgtgcaacaatagcgcttgcgactgggacggtggagactgttctggcaactccgggggtagtcgctatattgcaggcggaggcggcactggctcgatcggcgtggggcagccatggcagttcgggggaggcatcaactcagtctcatactgcaaccaggggtgcgccaactcttggcttgctgataaattttgtgatcaggcttgcaatgtgctgagctgtggtttcgacgctggcgactgtgggcaagaccattttcatgagttgtataaggtgatcctgctcccgaatcaaacccattatattatacctaagggggagtgtcttccatacttctcgtttgctgaagtggccaagagaggggtcgagggagcatattccgacaaccctattattaggcatgctagcatcgctaacaagtggaaaaccattcatttgatcatgcattccggcatgaatgccacaactattcacttcaatttgactttccaaaatacaaatgatgaggagttcaagatgcagatcacggtagaggttgacacaagagaagggccaaaactcaattccaccgcccagaaagggtacgagaacctagttagcccaatcacgctgttacctgaggctgaaattcttttcgaggatatcccaaaagagaaacgatttccaaagtttaagagacacgatgtaaattcaaccagacgagcccaggaggaggtgaagatcccactagtcaacatttcattgctcccaaaggatgcccagctgtcactgaataccctcgacctgcagctcgagcacggtgacatcacgttgaaaggttacaacctgtcaaagtcggcactcttgcggagtttcctcatgaactcacagcacgctaaaattaagaatcaagcaatcattaccgatgagaccaacgactcgctcgtcgctccccaagagaaacaagtacataaaagcatccttcctaactccctcggcgtgtcagagcgtctccagagattgacatttcctgccgtttcagttaaagttaatggtcatgaccaaggccagaaccctcccctggatttggagactaccgcgcggtttcgagtggaaacacatacacagaagacaataggcggcaacgtgaccaaagaaaaacccccgagcctgatcgtccccctagaatctcagatgaccaaggaaaagaagataacagggaaggagaaggaaaactctcggatggaggaaaacgcagaaaaccacatcggcgtaacagaggtcctgctcggtagaaagcttcagcactatacagacagctacttggggtttttaccgtgggaaaagaagaagtactttcaagacctactagatgaagaagagagcctgaaaacacagcttgcatattttactgactctaaaaataccggacgccaactcaaagatacatttgcagattccctccggtacgtgaacaagattttgaacagtaagttcggcttcactagcaggaaagtcccggctcatatgccacacatgattgacagaattgtcatgcaggaactgcaggacatgtttccggaggagttcgataaaactagcttccacaaagtccggcatagtgaggacatgcagttcgccttctcttatttctactatcttatgagcgcagtccagcctctaaacataagtcaagtgttcgatgaggtggatacagatcaatcgggcgtcttgtccgaccgggaaatccgcaccttggctacgagaattcacgagttacccctgtctttgcaggacctgactgggttagagcacatgttgattaactgttccaaaatgttgccagcagatatcacccagctcaataacatcccccccactcaagaatcctactatgacccgaatttgccacctgtgacaaagtccttagtcactaattgtaagcctgtaaccgataagattcacaaagcctacaaggacaagaataaataccgtttcgagataatgggagaggaggaaatagctttcaagatgataaggacaaacgtgtctcatgttgtcggccaattggatgatatacggaagaaccctcggaagttcgtttgcttgaatgacaacatcgatcacaatcacaaggacgcccaaacagtgaaggccgtgctgagggacttttatgagtccatgttccccattcccagccagtttgagctgccaagggaatataggaacaggtttctacatatgcatgagttgcaggagtggcgggcctacagggataagttaaaattctggacacactgtgttttagcgactctgatcatgtttacaatctttagcttttttgctgagcagcttatagcactgaagaggaaaatctttcctcggcgtaggatccataaggaagcctcccctaatagaatcagagtg

SEQ ID NO: 17004 - DNA, 3768 bp, Artificial Sequence
  Description of Artificial Sequence: Synthetic coding sequence
atgctgtttaaactgctgcagcggcagacctacacctgtctatcacacagatatggcctctacgtatgtttccttggagtggtggtgacgatcgtctcagcattccagttcggtgaagtagtgctggagtggtcgcgagaccagtaccacgtactgttcgactcatatcgagataatatagctggaaagtccttccagaacaggctgtgcctccccatgccaatagatgttgtttatacctgggttaacgggacagatttagagctcctgaaggaactacaacaggtgagggaacagatggaagaggaacagaaggctatgagggagatcctcgggaaaaatacaaccgagcccaccaagaaaagcgaaaagcaactagaatgtctgctcacacactgcatcaaagtccctatgctggtgctggatcccgctttgccggcgaacatcactcttaaggacctgccttccttatatccctctttccattcagcttctgatatattcaatgtggcaaagcccaagaacccgagtacaaacgttagtgttgtggtgttcgattctacaaaggacgtcgaggacgctcatagcggattacttaagggtaacagtagacaaacagtgtggcggggctacctgacgaccgataaggaagtacctgggcttgtattgatgcaggacctggcattcctgtcaggattcccacctacctttaaggagaccaaccagttaaagactaaattgcctgagaatctaagcagcaaggtaaagctgctccaactgtatagcgaagcttccgtggcactcctcaaactaaacaaccctaaggactttcaggaactgaataagcaaactaagaaaaacatgaccattgatggaaaggagctgacaattagcccagcttacctgttatgggacctatccgctatctcgcagtccaaacaggacgaagacattagcgcaagccggttcgaggataatgaagagctaagatattccctgcgctcaattgagagacacgcaccctgggttagaaacatctttatcgtaactaacgggcagatcccttcttggctcaacctggataatccaagggttacaatcgtgactcatcaagacgtctttcggaacctgtctcacctgccaacttttagttcgccagcaatagagagtcacatccatcgcatagagggcctatcacagaaattcatatacttgaatgacgacgttatgtttgggaaagacgtatggcctgatgacttctacagccacagcaagggtcagaaagtttatctgacctggcccgtgcccaactgcgccgaagggtgtccaggtagctggattaaggacggctactgtgacaaagcttgcaataactccgcatgcgattgggacggcggagactgttctggaaactccggaggcagccggtacattgccggggggggcggaacaggatcaatcggcgtgggccagccttggcagttcggtggggggataaactcagtctcctattgcaatcagggatgtgcgaatagttggcttgccgataaattttgtgatcaggcctgcaatgtgttgagctgcgggttcgacgccggagattgtggccaggatcactttcacgaattgtacaaggtgatcctactgcccaaccagacccactacatcatccccaaaggggagtgtctaccatacttttcttttgctgaagtggccaagcgcggagtggagggtgcttattcagacaatcccattataagacatgcatcgattgcaaacaaatggaaaactatccatttaatcatgcactcaggcatgaacgcaacgaccatacacttcaacctcactttccagaatacgaatgacgaggagttcaagatgcaaattaccgttgaagtcgacacgagagagggtcccaagctgaattctacagcccagaagggctacgagaaccttgttagtccaattacactcttgcctgaagctgagatcctgtttgaggacattcctaaagagaagaggtttccaaagttcaagaggcatgacgtaaattcaacccgtagagctcaagaagaagtgaagatacccctcgtaaatatttctctcttgccaaaagacgcccagttatccctgaatactttggaccttcagctagaacacggggatatcacactcaaggggtacaacctcagcaagtctgcactcctcagaagttttttgatgaactcacagcatgccaaaattaagaaccaagctatcattacagacgaaacgaatgatagccttgttgcccctcaggagaagcaagtccataaatctattctcccgaatagcttgggcgtgtcggaacggttgcagcgccttaccttcccagcagtcagtgtgaaagtgaacggccatgaccagggccagaatcctccactcgatctggagacaactgcccggttcagagtggaaacacacacacagaaaactatcggtggaaatgtgaccaaggaaaaaccaccgtctctgatcgtcccactcgagtcacagatgaccaaggagaaaaagattacaggaaaagagaaagagaattcacgtatggaagaaaacgctgagaaccacatcggagtgaccgaagtgcttctgggccgcaaactgcagcattacacggatagttacttgggcttcttgccttgggagaagaaaaaatatttccaagatcttctcgatgaagaggagagcctcaaaactcagttggcctactttactgatagcaagaacaccggacgccagctaaaagacaccttcgccgattccttaagatacgtaaataagatactgaattctaagttcggcttcacctctagaaaggtgccggcgcacatgcctcacatgattgacaggatcgtgatgcaggagttgcaggatatgttccccgaagagtttgacaagacttctttccataaggtgcggcactctgaggacatgcagtttgccttttcatatttctactatctaatgtctgccgttcagcccttaaatatttcacaagtattcgatgaggttgataccgatcaatctggagtgctgtcagaccgagagataaggactcttgccaccaggattcatgagctgcctctgtcgctgcaggacctgacgggccttgaacatatgttgatcaattgctccaaaatgctgcccgccgacatcacccagctcaacaacatcccaccaactcaagaatcctactatgaccccaacctaccccctgtgactaaatccctggtcacgaactgcaagcctgtgacagataaaatccataaagcatataaagacaagaacaagtatcgctttgagataatgggggaggaggaaattgccttcaaaatgattcgtaccaacgtttctcatgtagtggggcagctggatgatattcgcaaaaacccccgcaagttcgtttgcctcaatgacaacatcgaccataatcataaggatgcccagaccgttaaggcagtcctccgagatttctatgaaagtatgttccccataccctcccagttcgaattgccacgggaataccgtaatcgattcttacacatgcatgagttgcaggagtggcgggcatacagggataagttgaaattttggacgcattgcgtcttggcaacactgatcatgttcactatcttctcattcttcgccgaacagttgatcgcgctgaaaaggaaaatcttcccgcgccggcgaatccacaaagaggcatcaccgaaccgcatcagggtg

SEQ ID NO: 17005 - DNA, 3768 bp, Artificial Sequence
  Description of Artificial Sequence: Synthetic coding sequence
atgctgtttaagctcctccaacgacagacttatacctgcctatctcatcgctacgggctatacgtgtgttttctcggagtggtggtgacgatcgtctctgctttccagtttggtgaagtggtgctggagtggtccagggatcagtatcatgtgctgttcgatagctatcgcgacaatatcgcaggcaagagttttcagaacaggctgtgcctgccaatgcccatcgacgtcgtgtacacgtgggtgaacggtactgacctggagctcctcaaagagttacagcaagtgcgggaacagatggaggaagaacagaaggccatgagagagatactgggaaaaaacaccaccgaacccaccaagaaatccgaaaagcaactggagtgtctcctcacgcactgcatcaaggtgcctatgctcgtgctggatcctgcactccccgcaaatattaccctaaaggaccttcctagcttgtaccctagcttccacagcgcctcggatattttcaacgtggccaaacccaagaacccttccactaacgtctccgtcgtggtattcgatagtaccaaggacgtggaggatgcccactcggggctattgaaagggaattctaggcaaaccgtgtggcgcggatacctgacaaccgacaaggaagtaccagggctggttctgatgcaagatctggcatttctatctgggtttccccccacatttaaggagacaaatcagctcaagacaaagttgccggaaaacctctcatctaaggtgaaacttctccagctctactctgaggccagtgtcgccctgctgaaactgaataatcctaaagatttccaggaacttaacaagcaaacgaaaaaaaacatgaccattgacggtaaagagctgaccatatcccccgcatatttactctgggacctgtcagcaatttcccagtcaaagcaggacgaagacatttcagcaagccggtttgaggataatgaggaattacgctactctcttcggtccatcgagaggcacgctccatgggtccgtaacattttcattgtgacgaacggccagatcccaagctggcttaatctagacaacccgcgggtgaccattgtcacccaccaggatgtcttcagaaatctttctcacctgccaacattctcttcgccagctatcgagagccacatccaccggattgagggattgagtcaaaagtttatttatctcaatgacgacgtgatgtttgggaaagatgtgtggcccgacgacttttattcacattccaagggacaaaaggtctatcttacctggcccgttcccaattgcgcagaagggtgcccgggaagttggatcaaggatggatactgtgataaagcctgcaacaacagcgcctgtgattgggacggaggcgactgctcgggtaacagtggtgggtcgcgctacattgccggcgggggaggcaccggatccattggcgtggggcagccgtggcagtttggaggtgggatcaactctgtgtcctattgcaaccaaggatgtgctaactcctggcttgcagataagttctgcgatcaggcctgtaacgtgctgagctgtggcttcgacgccggcgactgcgggcaagatcactttcacgaattgtacaaagtgatccttctgccaaatcagacccactacattatcccaaagggcgagtgcctgccctacttcagttttgccgaggtggccaagaggggtgtcgaaggcgcttacagcgataatcctataatacgccatgccagcatcgcaaacaagtggaagacgatccacttgataatgcattcggggatgaacgccacgaccatacattttaatctgacgtttcagaacaccaacgatgaggagtttaagatgcaaattaccgtggaggtggacactagggagggaccgaagctcaactctactgcgcagaagggttacgaaaacctcgttagtccgatcacattgcttcctgaggcagaaatcctttttgaagatatccctaaggagaaaaggtttcccaaatttaagagacacgacgtgaacagcacgcggagggcacaggaggaggttaaaatccccctagttaatatcagccttcttccaaaggacgctcaactctccttgaacacactggacctccagctcgagcatggagatattacactaaaaggatacaacctttccaagagcgccctgttgcgctcttttctgatgaactcacaacacgctaagatcaaaaatcaggcaattatcaccgatgaaaccaacgactccctggtggctccacaggaaaaacaggtacacaagagtattctccccaattccctgggagtatccgaaagactgcagcggctgacctttcctgcagtctccgttaaagtgaacggccacgaccaaggccagaaccctccgttagatcttgagacaaccgcacgattcagagtggaaacgcatactcagaaaacaatcggagggaatgtgaccaaagaaaagccaccttcactgattgtgcccctcgagtctcagatgactaaggagaaaaaaattaccgggaaagagaaggagaattccagaatggaggagaatgctgaaaatcatatcggcgtcacggaggtgctactcgggagaaaattgcagcactacactgactcatatttgggtttcctcccttgggagaagaagaaatattttcaagacctcttagacgaggaagagagcctgaagacgcagctggcgtacttcaccgattcaaagaacaccgggcggcagctcaaggacaccttcgcagattcattgcgttatgtgaacaagattctcaatagcaagtttggattcacaagccgcaaagtgcccgctcacatgccgcatatgatcgacagaattgtcatgcaggaactgcaagatatgtttcccgaggagttcgataagacgtctttccacaaagtgagacacagtgaggacatgcagttcgccttctcttatttctactacctgatgagtgcagtgcaaccactgaatatttctcaagtctttgacgaggtggacaccgaccagtcaggcgtgctgtccgatagagagatccgcacactggccacaaggatccatgagctccctctgtccctgcaggatttaactggcctggagcatatgctcatcaactgctccaagatgcttcctgctgacattacgcagctgaataacatcccccccactcaggagtcctattacgaccctaacctcccaccggtaaccaaaagcttagtcaccaattgtaaaccagtgaccgataagatccacaaagcatacaaagacaagaacaagtataggttcgagatcatgggcgaggaagaaatagccttcaagatgatacgcactaatgtgtcccacgtagtcgggcaacttgacgacattcggaaaaatccaaggaagtttgtctgcttgaacgacaatatcgaccataaccacaaggatgcccaaaccgtgaaggctgtcctacgagatttctacgagtccatgtttccgattccatcacagttcgaactacctcgggaatatcggaatagattcctccacatgcacgaactgcaggaatggcgcgcttacagggacaaactcaagttctggacgcattgcgtgttagctaccctgatcatgttcaccatcttcagtttctttgcggagcaacttatcgcactgaagcgcaaaattttcccccgtcggcgcattcataaagaagcctcgcctaaccgcattcgggtg

SEQ ID NO: 17006 - DNA, 3768 bp, Artificial Sequence
  Description of Artificial Sequence: Synthetic coding sequence
atgctgtttaagctcctacagcgccaaacttatacctgcctgagccaccgatacggactgtatgtttgctttctgggggtggtggtaaccatcgtgtctgccttccagtttggcgaggttgttctggagtggagtcgagatcagtaccacgtcttgtttgactcttatagggacaacattgcagggaaatcctttcaaaataggctttgcctccctatgccaattgacgtggtctacacctgggtgaatggaaccgacctcgagttactgaaagagctgcagcaggttagggagcaaatggaggaagaacaaaaggccatgcgcgagatactgggtaagaacacaaccgagccgacaaagaaaagcgagaaacaactggagtgcctacttacgcattgtatcaaagtgcctatgttggtcttagacccagccctgcccgctaatattaccttaaaagatttacccagcttgtatcctagctttcacagcgcatccgatatctttaatgttgcaaaaccaaagaatccatccacaaacgtctcagtggtcgtgttcgacagcaccaaggatgtggaagacgctcacagcggtctactgaaaggcaactcccgccagacagtttggagaggttacctcactaccgacaaggaagtgccagggctggtgctgatgcaagacttggctttcctcagcggattcccacccacatttaaggagacaaatcagcttaagacaaagctgcccgaaaatctctcgtcaaaggtaaagctgctgcagctttacagtgaagcttccgtggctttgctcaaactgaacaacccgaaagactttcaagagctaaacaagcaaacgaaaaagaacatgaccatcgacggtaaggagctgaccatcagtcccgcatacctgctgtgggatctgtctgcaatctcacagagcaagcaggatgaggatataagcgcctctcggtttgaggacaatgaggagctgcggtattcactgagatccattgagcgccatgctccctgggttagaaatatttttatcgtgactaacgggcagattccaagctggctgaatttagataatcccagggttactattgtgactcaccaggacgttttccgcaatctgtcccatctgcctacattctcaagtcccgccatagagagccacatccaccggatcgagggtctttcccagaaattcatctacttgaacgacgacgtcatgtttgggaaggatgtgtggccagatgatttctatagccacagcaagggccagaaggtctacttaacgtggcctgttccaaattgcgccgaaggctgcccgggttcctggattaaagacggctactgcgataaggcctgtaataattctgcttgcgactgggacggcggcgactgcagtgggaatagcggagggtcgagatacatcgcggggggcggtggaaccggttccattggggttggccagccctggcaattcggaggcggaattaattcagtaagctactgtaaccaaggttgtgctaattcgtggctggcagacaagttttgcgatcaggcatgcaatgtgctttcctgcggctttgacgctggcgattgtgggcaggatcacttccacgaactgtacaaggttatccttcttcctaaccagactcattacataatccctaaaggggaatgtctgccatatttctccttcgccgaggtggccaaaaggggggtcgaaggggcatattcagacaaccctatcataagacatgcgtcaatcgccaataagtggaagacaattcacctcataatgcacagcgggatgaatgcaaccactatccactttaatctcacctttcagaacacgaatgacgaggagtttaagatgcagattaccgtggaggtggacacacgggaggggcccaagctgaattcaacagcacagaagggttatgagaatctggtctcccctatcactctgctcccagaggccgagatcctatttgaggatataccaaaggaaaagcggtttcctaagttcaaaaggcatgacgtgaactctacaaggcgcgctcaggaagaggtgaaaatacctctcgtcaacatcagcttgcttcccaaggatgcgcagctttcactcaacacactagatctgcaactcgaacacggcgacattacactgaagggctacaatctgtcgaaatcagccctactcagatcttttctcatgaactctcagcatgctaaaatcaaaaaccaggctattatcactgacgaaacgaatgatagtctagtggcacctcaggaaaagcaggtgcataagtcgatcttacctaacagtctgggtgtgtccgagaggcttcagcgcttgacctttcccgcagtgtcggttaaagtaaacggacatgatcaggggcagaacccacctctcgatctcgaaactactgcgcggtttagggttgaaacccacacccagaagactatcggtggaaacgtcaccaaggagaagcccccgagcctgatcgtacccctggaatcacagatgactaaagaaaaaaagatcacaggtaaggagaaggaaaactcgaggatggaagagaacgccgagaaccatatcggggtaacagaggtgttgctggggcggaagctccagcactacaccgactcatacctgggattccttccttgggagaagaaaaagtattttcaggatctgctggatgaggaggagagcctaaagacccagctggcctactttaccgattctaaaaatacaggacgacagctgaaggataccttcgcagactccctgcgatacgtgaataagattcttaacagtaagtttgggttcacaagccggaaggtcccggctcatatgccacacatgattgaccgaatcgtgatgcaggagctacaagacatgttccccgaggaattcgataagacatccttccataaagtgcgacacagcgaagacatgcagtttgccttctcctacttctattatctgatgagtgccgtgcaacccctgaatataagccaggtctttgacgaggtcgacacagaccagtcaggggtgctgagcgatcgagaaattaggactctggctacccgcatacacgagctccccttgtccctacaggacctcacaggattagagcacatgctgattaattgcagcaaaatgcttccggctgacatcactcaacttaataatattccccccacccaggagtcatactatgatcccaatttacccccagtgacgaagtccctcgtgaccaactgcaaaccggtgacggacaaaatccataaagcatacaaagataagaacaagtacaggttcgaaatcatgggtgaagaggagattgcgttcaagatgataagaacaaatgtgtcccacgtagtgggacagctggacgacattagaaagaacccccgcaagttcgtttgtctgaatgacaacattgaccataatcataaggacgctcagacagttaaggccgtgctgcgggacttctacgaaagcatgttccctattccgagtcagtttgaacttccgcgggaatacaggaataggttcctgcatatgcacgagctccaagaatggcgggcttacagggataagctcaagttttggacccactgcgtgctcgccacgctcattatgttcacaattttctctttttttgccgagcagctcattgctctgaagcggaaaatatttccccgacggcgtatacataaagaggcaagccccaatcgaatacgtgta

SEQ ID NO: 17007 - DNA, 3768 bp, Artificial Sequence
  Description of Artificial Sequence: Synthetic coding sequence
atgctcttcaagctgctccagcgccagacctatacatgtctgtcccatcgctacggcttgtatgtgtgcttcctcggggtggtggttaccatcgtgtctgcttttcaatttggtgaagtcgtgctcgagtggagtagagaccagtaccacgtgctgtttgactcttaccgggataatatcgctgggaaaagcttccaaaacaggctgtgcctgcccatgccaattgacgtggtgtatacatgggtcaatggcaccgatctggaactgctgaaagagctccagcaggtgagagagcagatggaagaagagcaaaaagccatgcgcgaaatcctcggcaaaaataccaccgaacctacaaaaaaatctgaaaaacagctcgagtgtcttctcacacactgcatcaaggttcccatgctcgtgctggaccccgctctgccggcaaacatcacgctcaaggatctgcccagcctgtaccccagctttcattcagcctccgatatctttaatgtggccaagccgaagaacccttcaacaaacgtgtccgtggtcgtgttcgactccaccaaagacgttgaggacgcacactctggtctcctgaaaggcaactcccggcagacagtgtggagaggctacctgacgaccgataaggaggtccccggattggtactgatgcaggatctcgcgtttctctcaggatttcctcccaccttcaaggagaccaaccagctgaagaccaagctccctgagaatctgagcagtaaagtaaaattgctgcagttgtacagtgaagcctctgtggcgctgctgaagctcaataatccgaaagattttcaagagctgaacaaacaaactaagaagaacatgactattgacggcaaagagttgacaatttcccccgcttatcttctttgggatctctctgcgatttctcagagtaagcaggacgaggacattagcgcatccaggtttgaagataatgaggaattgagatacagtctgcgatccatcgaacggcatgccccatgggtgcgcaacatctttattgtcacgaacggtcaaatcccttcatggctgaatttggacaacccgagagtgacaattgtcacacaccaggacgtctttaggaacctgagccatcttcctactttttcctctcccgcgatagagtctcacatccatcgaattgaaggattgtcacaaaaatttatttatctgaatgacgacgtgatgttcggaaaggacgtctggcccgatgacttttatagtcacagtaagggtcagaaggtgtaccttacctggcccgttccaaactgcgcagaaggatgcccaggctcctggattaaagatggctattgtgacaaagcatgcaataattctgcatgtgactgggacggaggagactgctctgggaatagtggggggagcagatacatcgcagggggcggaggaacaggcagtatcggtgtgggacaaccatggcagttcggcggcgggattaactctgtatcctactgtaaccaaggctgtgccaattcatggctggccgataagttttgtgaccaagcctgcaacgtgctcagctgtggctttgacgcaggtgactgcgggcaagatcacttccatgaactctataaggtgattctgctgccaaatcagacccattatattatccctaagggggaatgtcttccatactttagctttgcggaggtcgccaaaaggggagtggaaggggcatattccgacaacccaatcatccgccacgcctccatagcgaacaagtggaaaaccatacacctgatcatgcactctgggatgaatgccacgacaattcatttcaacctgacctttcagaacactaacgatgaagagttcaaaatgcagatcactgtggaagtggatacaagagaaggtcccaagctgaactctactgcacaaaagggttacgaaaacctggtgtcaccgatcacactgctgcccgaggcagagatcttgttcgaagacattccgaaggaaaagcggtttcccaagttcaagcggcatgatgtgaactcaaccagaagggcacaggaggaggtgaagatccccctggtgaatatatccctgctcccgaaagacgcccaattgagtctcaacacgttggacttgcagctggagcacggagatatcaccctgaagggctataatctgtccaagagcgcattgttgagatcctttctgatgaatagccagcacgccaagattaagaatcaggctatcatcacagacgagactaacgattcactcgtggcaccccaggagaaacaggtccacaagtcaattcttcccaacagcctcggagtgtcagagaggctccaaaggctgacttttccagctgtgagcgtgaaggtcaatggacacgaccaaggccagaacccacccctggatcttgagacaactgcacgcttcagggtggagacccatactcagaaaactatcggcggaaatgtgactaaggaaaaacctcccagcctgatcgtgcctctggaaagccagatgaccaaagaaaagaagatcactggtaaggaaaaggagaatagccggatggaagagaatgcggagaatcacattggagtgactgaggtgctgttgggacgcaaactgcagcattataccgacagctacctggggtttctgccttgggagaagaaaaaatattttcaggatcttctggatgaagaggagtcacttaagacgcagctggcctacttcactgactcaaaaaataccggaagacagctgaaggatacatttgcggactcactgcgctacgtgaacaagatactgaattcaaagtttggctttacgtccagaaaagtccccgcccatatgccccacatgatagaccggattgtgatgcaagagttgcaggatatgtttccagaggagttcgataagacaagctttcacaaggtccgacacagcgaagacatgcagttcgccttctcttatttttactacctgatgagtgccgtccaacccctgaatatttctcaggtgttcgacgaggtagacacagaccagtccggagtcctgtctgatagggaaatacgaacactcgcaactcgaatccatgaactgcccctgagtctccaagaccttacgggactcgaacatatgctgattaactgtagtaaaatgctcccagcggacatcacgcagttgaataatattccgcccacccaggaaagctactatgaccccaatctcccccctgtgacaaaatctctggtgactaattgcaagcctgtgactgacaagatccacaaagcgtacaaggataagaataagtaccgctttgagatcatgggcgaagaggagatcgcctttaaaatgatccgcaccaacgtgtcccacgtggtggggcagttggacgatatacgaaagaacccgaggaaattcgtgtgtctcaatgacaacatagatcataatcacaaagatgcccagactgtcaaggccgtgttgagagacttctatgagagtatgtttcccatcccatcccagttcgaactgccgagggaatatcgcaatcgctttttgcatatgcacgaacttcaagagtggagagcttacagggacaagctcaaattctggacacactgcgtgctggcgacgttgattatgtttacaatcttctccttttttgccgaacagctgatagctctgaagaggaaaatttttccgaggcgcagaatccacaaggaagcctcacccaatagaattcgggtg

SEQ ID NO: 17008 - DNA, 3768 bp, Artificial Sequence
  Description of Artificial Sequence: Synthetic coding sequence
atgcttttcaaactgctgcaaagacagacctatacatgtttgtctcatcgatacggcctgtacgtctgtttcttgggggtggtcgtgaccatcgtctcagcatttcagttcggagaggttgtgttggagtggtcgcgggaccagtatcatgtcctgttcgattcttacagggataatattgccggaaagtcctttcagaacaggctgtgcctaccgatgcccatcgatgtcgtgtacacttgggtgaacgggacagacctggaacttctgaaagaacttcagcaggtgcgagagcagatggaggaggagcagaaagccatgcgggagatcctcgggaagaacaccaccgagccaactaaaaagtccgaaaagcagctggagtgcttgttgactcattgcatcaaagtcccgatgctggtcctggaccctgctctgccagccaatatcacgctaaaagacctgccgtctctgtatcctagctttcatagcgcttctgacattttcaacgtcgctaagcccaagaatccaagcacgaatgtatccgtggtggtcttcgactcaacgaaggacgtcgaggatgcgcactctggtctgctgaagggaaatagtcgacagaccgtgtggcgagggtaccttacaactgataaggaggtccctggcctggtgctgatgcaagacctggctttcctgtcaggttttccacccacattcaaggagaccaatcaactgaaaaccaagctaccggagaacctgtctagtaaggttaagctcttgcagctgtacagtgaggcctcagtagcccttctcaaactgaataacccgaaggatttccaggaattgaacaagcagacgaagaaaaacatgactattgatggaaaagagctgactattagccctgcctatctgctgtgggatctctcagccatcagtcagtcaaagcaggacgaggacatcagcgccagtaggttcgaagataacgaggaactgaggtacagtctgagaagtatcgagaggcacgccccctgggtccggaacatcttcattgtgacgaacgggcagatcccaagttggctcaatctggacaatcctcgcgttacaatcgtcacgcatcaggacgttttccgaaatctgtcacacctgcctactttcagtagccccgctattgaaagccatatacaccgaattgagggcttgagtcagaagtttatttacctcaatgatgacgtgatgtttggtaaagatgtgtggcccgatgacttttattcccactctaagggccagaaagtttatctgacttggcctgtaccgaactgcgccgagggctgcccaggttcatggataaaagacggctactgtgataaagcctgcaacaacagtgcttgtgactgggacgggggagactgcagcggtaactctggcggatcacgttacatcgcaggtggggggggcacgggctcaattggcgtcggccagccttggcaattcggaggcggaataaattccgtctcttattgcaatcaggggtgcgcaaacagctggctggctgacaaattttgtgatcaggcctgtaatgtattgtcctgcggctttgatgctggcgactgtggtcaagaccacttccatgaactgtacaaggtcatactcctacccaaccagacgcattatattatccccaagggggaatgtctgccctacttctcgttcgccgaagtagctaagaggggagttgaaggtgcctactcagataatccaattatccgccatgcctcgatcgcaaacaagtggaagactattcacttaatcatgcactccgggatgaatgccaccaccattcacttcaatctcacgttccaaaataccaacgacgaagaatttaaaatgcagatcaccgtcgaggtggacacgcgggaggggccgaagctcaacagtaccgcccagaaagggtacgagaatctggtgtctccgatcacgctcctgcccgaagcagaaattctcttcgaggacattccaaaagagaagcggtttcccaagttcaagaggcacgacgtgaacagcacaaggagagcccaggaggaagtgaagatccctttggtgaatatctccctactgccaaaggacgcccaactgtcactcaacacacttgatttacaactggagcatggggatatcaccttaaaggggtataaccttagcaagagtgcgttgctgcgctcattcctcatgaattctcagcacgcaaagattaagaatcaggcaattatcacggacgaaaccaacgattcactcgtggcacctcaagagaagcaggttcataaatccatactgccaaactccctgggagtctctgagcgtctgcagcgactgacctttccggcagtgtcagtcaaagtgaacggtcacgatcaagggcagaaccctcctctggatctcgagaccacagccaggtttcgagttgagacccacacccagaaaaccataggaggaaacgtgacaaaagagaagcctcccagtttgatcgtgccattagagagccagatgactaaagaaaagaaaattactgggaaagaaaaggaaaattcccgaatggaagaaaacgcagagaaccacataggggtgaccgaggtcctgcttggacggaaactgcagcactacactgatagttatttgggattcctgccctgggaaaagaaaaagtatttccaggatcttctggacgaagaagaatccctgaaaacccagctcgcatactttacagactcgaagaacacgggcagacagctcaaagacacttttgcagactctttgcggtatgtgaataagattctaaacagcaagttcggctttacatcccgcaaggttcctgcccacatgccccacatgatcgacagaatcgtgatgcaagaacttcaggacatgtttccagaggaatttgataaaacgtcctttcacaaggtccgccacagtgaggatatgcagtttgcctttagctatttctattatctgatgtccgctgtgcaacccctcaacattagccaggtttttgatgaagtggataccgaccagtccggggtgttatctgacagagagatccggacactggcaacaaggatccacgaactgccgctgtctctccaagatctgactggtctggagcatatgctgatcaactgttcaaagatgctaccggcagacattacgcaacttaataatataccacccactcaggagagctattacgatccaaaccttccgccagtgactaaatcgttggtaacgaactgcaagcctgttaccgacaagatacataaggcctacaaggataagaacaaatatcgatttgaaatcatgggcgaagaggagatagcctttaaaatgattcgaacaaatgttagccacgtggtgggacaacttgatgatattcgcaagaaccccagaaagtttgtttgcttgaacgataacatcgaccacaatcataaggacgcacaaacagtgaaagccgttctccgagacttctacgaaagcatgttccctatacctagccagtttgagctgccacgggagtaccggaaccgcttcctgcacatgcacgagctacaggagtggagagcgtaccgcgataagttaaagttttggactcactgcgtccttgccaccctgatcatgtttacgatcttttctttctttgccgagcaacttatcgctctgaaaaggaagatcttcccgaggcgacgcatccacaaggaggcgagtccgaacagaatcagagtc

SEQ ID NO: 17009 - DNA, 3768 bp, Artificial Sequence
  Description of Artificial Sequence: Synthetic coding sequence
atgttatttaagcttcttcaacgtcaaacttatacttgtcttagtcatagatatggattatatgtatgtttcttaggagttgttgttactattgtctctgcatttcaatttggagaagttgttcttgaatggtcaagagatcaatatcatgttctttttgactcttatagagataatattgcaggaaaaagttttcaaaatagattatgtcttcctatgccaattgatgttgtttatacttgggttaacggtacagatcttgagttattaaaggagttacaacaagttagagaacaaatggaagaagaacagaaagcaatgagagaaattttaggaaagaatactacagagccaacaaaaaaaagtgaaaaacaacttgaatgtttacttacacattgtataaaagttccaatgttagtattagatcctgctttaccagcaaatataactttaaaagatcttccatcattatatccatcatttcattcagcatcagatatctttaatgttgctaaaccaaaaaatccatcaacaaatgtatcagttgttgtcttcgatagtacaaaagatgttgaagatgcccatagtggattattaaagggtaattcaagacaaacagtttggcgtggttatttaactacagataaagaggttccagggcttgttttaatgcaagatttagcatttctctcaggttttccacctacttttaaagaaactaatcaacttaaaaccaaattaccagaaaatttaagtagtaaagttaaattattacaattatattcagaagctagtgtagccttgttaaagttaaataatccaaaagatttccaagaacttaataagcaaactaaaaaaaatatgactatcgatggaaaggaacttactatttctccagcttatttattatgggatctttctgctatatcacaaagtaaacaagatgaagatatttcagcttcaagatttgaagataatgaagaattaagatatagtttacgttctattgaaagacatgctccatgggtaagaaacattttcatagttacaaatggacaaattccaagttggttaaatttagataatccaagagttacaatcgtaactcaccaagatgtttttagaaatctttcacatttaccaacatttagttctccagctatagaatcacatattcacagaattgaaggattaagtcaaaaattcatttatcttaatgatgatgttatgtttggaaaagacgtttggccagatgatttttattctcattcaaagggtcaaaaggtttatcttacatggccagttccaaattgcgcagaaggatgtccaggtagttggattaaagatggatattgtgataaagcatgtaataattctgcatgtgactgggatggaggagattgttcaggaaattcaggaggttcaagatatattgctggaggaggaggtacgggatcaattggtgttggacaaccatggcaattcggtggaggaattaattcagttagttattgtaatcaaggatgtgcaaattcatggcttgcagataaattttgtgatcaagcatgtaatgttttatcatgtggatttgacgctggagattgtggtcaagatcattttcatgaattatataaggttattttgttaccaaatcaaacacattacattattccaaaaggagaatgcttaccatatttttcgtttgcagaagtagcaaaaagaggggttgaaggtgcttattcagataatccaataatacgtcatgcttcaattgcaaacaaatggaaaacaattcatttaattatgcattcaggtatgaatgcaacaacaattcatttcaatcttacttttcaaaatactaatgatgaagaattcaaaatgcaaattactgttgaagtagacacacgtgaaggtccaaaacttaatagtacagctcaaaaaggatatgaaaatttagtatctccaataacattacttccagaggctgaaatattatttgaagatattccaaaagaaaagagatttccaaagtttaaaagacatgatgttaactcaactagaagagcacaagaggaagttaagattccacttgttaatatatctttattaccaaaagatgcacaattaagtcttaatactttagatttgcaattagaacatggggatattactcttaaaggttataatttatctaaatcagctttacttcgatcttttcttatgaattcacaacacgctaaaattaaaaatcaagctattatcactgatgaaacaaacgattcattagttgcacctcaagaaaagcaagtacataaaagtatattaccaaactcccttggtgttagtgaaagattacaacgtttgacatttccagctgtaagtgttaaggttaatggacatgatcaaggtcaaaatccaccattagatttagaaactacagcaagatttagagttgaaactcacactcaaaaaactattggaggaaatgttactaaagaaaaaccaccaagtcttattgtacctttagaatctcaaatgacaaaggaaaaaaagataacaggaaaagaaaaggaaaatagtcgtatggaagaaaacgcagaaaatcatattggagtaacagaagtcttattaggacgtaaattacaacattatacagatagttatttaggttttttaccatgggaaaagaaaaaatattttcaagacttattggatgaagaagaatctttaaaaacccaattagcatattttacagattcaaaaaatactggaagacaattaaaagatacgtttgcagattcattgagatatgtaaataaaattttaaattctaaattcgggttcacaagtagaaaagtacctgcacatatgccacacatgattgacagaatagtaatgcaagaacttcaagatatgtttccagaagaatttgataaaacatctttccataaggtaagacactctgaagatatgcaatttgctttttcttatttttattatttaatgtcagctgttcaacctctcaatattagtcaggtatttgatgaagttgatacagatcaaagcggagttctttcagatagagaaattagaacattagctactagaattcatgaattaccattgtcactacaagatttgacaggattagaacatatgttaattaattgctcaaagatgttaccagcagatataacacaattaaataatattccaccaacacaagagagttattacgatccaaacttaccaccagttacaaaatcattagtaactaattgtaagccagtcacagataagatccataaagcatacaaagataagaataaatatagatttgaaattatgggagaagaagaaatagcttttaagatgattagaactaacgtctctcatgttgttggacaattggatgacattagaaaaaatccaagaaaattcgtatgtttaaacgataatattgatcataatcataaagatgctcaaacagttaaggctgttttacgtgatttttacgagtcaatgttcccaataccatctcaatttgaattaccaagagaatacagaaatagatttttacatatgcatgaattacaagaatggagggcatatagagataaacttaaattttggactcactgcgtacttgcaactttaatcatgtttactatttttagtttctttgctgaacaattaattgcattgaaaagaaaaattttccctagaagaagaattcataaagaagcaagtccaaatagaattcgagtt

SEQ ID NO: 17010 - DNA, 3768 bp, Artificial Sequence
  Description of Artificial Sequence: Synthetic coding sequence
atgctgttcaaattactgcagagacagacatatacctgtctttctcaccggtacggcctgtacgtgtgcttccttggagttgtggtgactattgtcagcgcgtttcagttcggggaggtggtgctcgaatggtcccgcgatcagtatcatgtgctatttgacagttaccgagacaatattgcaggtaaaagcttccagaacagactttgtctgcctatgcccatagacgtggtgtacacctgggtgaatgggacggatttagagctgctgaaagaactgcaacaggtccgcgagcagatggaggaggagcaaaaggcaatgagggaaatactcggaaagaatacaacagaaccaacgaagaaaagtgagaagcagcttgaatgcctcctgacccattgcatcaaagtgcccatgctggtgctggatccagcattgcccgccaacatcactctaaaagacctgccttccctctatccctctttccactctgccagtgatatttttaacgtcgccaaacccaaaaacccgtcaaccaacgttagcgtagtggtctttgattcaaccaaggatgtagaagacgcgcatagtggtctcctgaaggggaactctagacaaaccgtttggaggggataccttactacagacaaagaggtgcctggactagttctcatgcaggatctggccttcctgagcggcttcccgcccaccttcaaagaaactaaccaacttaagaccaaactgccagaaaatctgagttctaaggttaagcttctccagctgtattcggaggccagcgtggcattactcaagctgaataatcccaaggactttcaagaattgaataaacagacaaaaaagaatatgaccatcgacggaaaagaactcactatatcaccagcctacctgctgtgggatctctcagcgatctcccagtctaaacaggatgaagacatctcagctagcaggtttgaggataatgaggagctaaggtattcactgcggagcatagaacgtcatgccccgtgggttagaaatattttcattgtaactaacggacagatcccgagttggcttaatctcgataacccgcgggtcacgatagtgacgcatcaggacgtctttagaaatctgtcccacctaccaacattttcatccccggcaatagaatctcacattcaccggatcgagggactgtcccagaagtttatctaccttaacgacgatgtgatgttcggcaaggatgtatggccagacgatttttactcccactctaaggggcagaaggtctacctgacttggccagtgcctaactgtgcagaaggttgccctggctcatggattaaagacggctactgcgataaggcatgcaacaactcagcttgtgattgggacggcggagattgtagcggaaactctggaggcagtcgctatatagccggcgggggcggcactgggagtataggcgtcggacagccatggcaatttggcggggggatcaacagcgtgtcctactgcaatcaaggatgcgctaactcctggttggcggataaattttgcgaccaggcatgtaatgtcctgtcttgtggattcgacgcaggagattgtgggcaggatcatttccatgaactctacaaagtaatccttctaccaaatcagacacactacatcatccctaagggagaatgcctgccatacttctctttcgccgaggtggccaagaggggagttgagggtgcctattccgacaatccaatcattcggcacgccagcattgctaataagtggaagacaattcatctgatcatgcactcaggcatgaatgcaacgacaattcatttcaatctgacgttccagaacacaaatgacgaggaatttaaaatgcagatcacagtcgaggttgacacgcgcgaagggcctaagctgaatagcacagcgcagaagggatacgaaaatctggttagtccaatcacactgcttcccgaggccgaaattctgttcgaagatatcccaaaggagaagcgttttcccaagtttaagcgacacgacgttaattcgacccgacgcgcccaggaagaggtgaagatccctctggttaatatttccctgctgccaaaagacgcgcagctgtcactcaatacactggatttacaactcgagcatggggacattaccttgaagggttacaatctgagcaaatcggcgttactgcgttcttttctcatgaattcccagcatgcgaagataaaaaatcaggctatcattacagacgaaaccaacgactcgctggttgctccccaggaaaagcaagtgcataagtccatcctgcccaatagtctgggtgtcagcgagcggctccagaggctcacgttcccagcagtgtcggttaaggtcaatggacatgatcagggccaaaaccctcctctagatctcgagaccacggcaagatttagagtggagacacatacccagaaaacaataggcgggaacgtcacaaaagagaaacccccctccctgattgtgcccttggaatcacagatgaccaaagaaaagaaaatcactggcaaggagaaggagaattccaggatggaagaaaacgccgagaatcatattggggtgactgaggttctcctgggccgtaagctgcagcactatacagattcctacctgggcttcctcccatgggagaaaaagaagtactttcaggacctgctcgacgaggaggaatctctgaagacacaactggcatatttcaccgattctaaaaacactgggagacagctgaaggacacctttgccgatagcttgcggtacgtgaataaaatcttgaatagtaagtttggtttcacgtctcgtaaagtccccgcccatatgcctcacatgattgatcgtatcgtgatgcaggagttacaagacatgtttccagaagagtttgacaagaccagcttccacaaagtgcgccactccgaggatatgcagtttgcattcagttatttctattacctcatgtctgccgtgcagcccctcaacatctcccaggtcttcgacgaagttgacacagaccagtccggagttctgtccgaccgggaaatcaggaccctggccacccgaatccacgagctgccattgtcactgcaggacctcacgggacttgagcacatgctgattaactgctcaaagatgctacctgctgatattacgcaactgaataatattccacctacccaggagagctattacgatccaaatctcccaccagtgacaaaatcccttgttaccaactgcaaaccggtgactgataaaattcataaggcctataaggacaaaaacaagtaccgcttcgagatcatgggagaggaagaaatcgcttttaagatgatcagaacaaacgtgtcccacgtagttggacagctggatgatatacggaaaaatccccggaagtttgtatgcttgaacgacaacatcgatcataatcacaaagacgctcagacagttaaagctgtgctaagagacttttacgagtcgatgtttcctatcccaagccaattcgaactgccacgggaataccgaaacagattcctgcatatgcatgaattgcaagaatggagagcatacagggataagctgaagttctggactcactgcgtcctggccacccttatcatgttcaccatcttttctttctttgccgagcagctgattgccctgaaaaggaagatattcccacggcggcgcatccataaggaggcctcgcctaatagaattagggtc

SEQ ID NO: 17011 - DNA, 3768 bp, Artificial Sequence
  Description of Artificial Sequence: Synthetic coding sequence
atgcttttcaagctcttgcagcggcagacctatacctgcctcagccacagatacggtctgtacgtgtgctttttgggcgtagtggtaaccattgtttctgctttccagtttggcgaggtggtgttggagtggtcaagggaccagtatcacgtgctgttcgatagctatagggacaacatcgcaggaaagagctttcagaataggttgtgtctgcctatgcccattgacgttgtgtatacctgggtgaacgggacagatttggaactcctgaaagagcttcagcaggtacgcgagcagatggaagaggagcagaaagctatgagggaaatactgggaaagaatacgacagagcccacgaagaaatcagagaagcagctcgaatgcctgcttacccactgtatcaaagtccccatgctggtgctggaccccgctcttccagcaaacatcacactgaaggatctgccgtctctgtacccctcatttcacagtgcctcagatatctttaacgtggcaaagcccaagaaccccagcactaacgtgtcagtcgtggtgttcgattctaccaaggacgttgaggatgcccattctggactgctgaaaggcaacagcaggcagacggtgtggaggggctatctgacaacagataaagaggtccccggactcgtgcttatgcaggacctcgcatttctcagtggcttccctccaaccttcaaagagacaaaccagctcaagaccaaactgcctgagaaccttagcagtaaagtgaaactcctgcaactttattctgaggcctccgtggcactgcttaagctgaacaatcctaaggacttccaggagctgaataagcaaacaaagaaaaatatgaccattgacgggaaggagcttactatctccccagcttatctgctttgggatttgagcgctattagccaatctaaacaagatgaggatatttcagcctctaggtttgaggataatgaggagctcagatattccctcaggagcatcgaaaggcacgcaccctgggtacgaaacattttcatcgttaccaatggccaaatcccctcctggctcaacctggacaatcctagggtaacgatagtcactcatcaggacgtgtttagaaaccttagccacctgcccacctttagctccccagcaatcgagagtcacatacaccgaatagagggcctctctcagaaatttatttatctgaatgatgacgtaatgttcggtaaggacgtctggccagacgatttttattcacattctaagggacagaaggtgtatcttacctggcccgttccaaattgcgccgagggttgtcccggatcctggatcaaggacgggtactgtgataaggcgtgcaacaactccgcctgtgactgggatgggggagattgcagcggtaacagtgggggttctagatacattgcaggagggggtgggaccggatccattggagtgggtcagccttggcagttcggcggtggcattaatagtgtgagttactgtaatcagggttgtgcaaacagctggctggctgacaagttttgtgatcaggcctgtaacgtgctttcctgcggatttgacgccggagactgcggccaagatcacttccacgagctgtataaagttattctgctgcctaaccagacccattacatcattcccaagggggagtgtctgccatacttcagttttgctgaggtggccaaaagaggtgttgaaggggcctactcagataaccccataatccggcatgcttctattgcaaataaatggaagactatccatcttataatgcattctggtatgaacgccactactattcatttcaacttgacgtttcagaataccaatgacgaggaatttaaaatgcagatcacagtggaggtagacactagggaggggcctaagttgaacagcacagcacagaagggctacgagaacctggtttctccaataacgttgctgcctgaggccgaaatcctgtttgaggatatcccaaaggagaagcgatttcctaagttcaaacgacacgacgtcaatagcacacggagagcgcaagaagaagtgaaaattccactggtgaacatttcccttcttcccaaggacgcccagttgagccttaacacacttgacttgcagctggagcatggcgatattactcttaaaggctataatttgagcaagagcgccctcttgcgatcttttctgatgaatagccagcacgccaagatcaagaaccaggccattatcaccgacgaaaccaacgactcacttgttgcaccccaggaaaaacaggtacacaaatccatcttgccaaactccctgggcgtcagcgagcgcctgcagagactcacttttccggcggtatctgttaaggtcaatggccacgaccagggacagaatccaccactggatttggagactacagcccggttccgcgtggaaacacatactcagaaaaccatcgggggaaatgtgactaaggagaaacccccatcacttatcgttccacttgagtcccagatgactaaggaaaaaaaaatcacggggaaggagaaagagaattcaaggatggaagaaaatgccgaaaatcatatcggggtgactgaagtgcttctcggacgcaagctgcagcactataccgactcctacctgggctttctgccctgggaaaagaagaaatacttccaggacttgctggatgaagaggagagtctgaagacccagcttgcctactttaccgacagcaagaataccggaaggcaattgaaggataccttcgccgatagcctgcggtacgtcaataagattctgaattcaaaattcggatttacctcccgcaaagtgcctgcacacatgcctcatatgatcgatagaattgtgatgcaggagctgcaggatatgttccctgaagaatttgacaagacaagcttccataaagtgaggcattcagaagacatgcagttcgcgttctcttatttctactatcttatgtctgctgtgcagccgttgaatatatcccaggtgtttgacgaagtggacacagatcagtccggcgtccttagcgacagggagattcgcacgctcgctactcgaattcacgagctccccctttctctgcaggaccttactggactggagcacatgttgattaattgctccaaaatgctgcccgcagacatcacacagcttaacaacatcccccccacacaagagagttactacgatcctaatctgcccccggtaacgaaatcactggtgacaaactgcaaacctgtcaccgataagattcataaggcttataaggataagaataagtacagattcgaaatcatgggagaggaagagatagcctttaagatgatacggacaaacgtttctcacgtggtgggacaactggatgatattcgaaaaaacccccgcaaatttgtgtgcttgaatgacaacatcgaccataaccacaaggatgcacagacagttaaggctgtactccgcgacttttacgagtccatgttccctatcccttcacagttcgaacttcccagagagtatagaaatcgctttctgcatatgcatgaactccaggaatggcgggcatatagggacaaactgaagttctggacgcattgtgtcttggcaaccctgatcatgtttactattttctcattctttgccgagcaactgatcgcccttaagcgcaagattttcccaaggcggaggatacacaaggaagctagtcctaacagaatcagggtg

SEQ ID NO: 17012 - DNA, 3768 bp, Artificial Sequence
  Description of Artificial Sequence: Synthetic coding sequence
atgctgttcaagttattgcagagacaaacttatacctgtcttagccatagatatggcttatacgtgtgctttttgggggtcgttgtgacaattgtgtcagcttttcagttcggcgaagttgtgttagaatggtcccgagaccaataccacgtgctgttcgattcgtaccgtgacaatatcgccggcaagagcttccaaaataggctgtgcttgccgatgcccattgatgtggtttacacctgggtgaatggaacagacctcgaactgctcaaagaactgcagcaggttagagagcagatggaggaggaacagaaggctatgagggagatccttggtaaaaacacgactgagccgacgaaaaagtcggaaaagcagctggaatgtctcctgacacactgcatcaaagttcctatgctggtgctcgaccccgccctgcctgctaacataactctcaaggatctgcctagcctatacccaagctttcacagtgccagtgacatattcaatgttgccaagcccaagaaccctagtaccaatgtgagcgtggtcgtgtttgatagtactaaagatgtagaagatgctcactctggtttgctgaagggcaactcaagacagacagtgtggaggggctatctgaccactgacaaggaggtcccgggattggtactgatgcaggacttggcctttttgagtggatttcctcccaccttcaaggagacgaatcagttgaagacaaagttaccggaaaatctttctagcaaggtaaaattgctgcagctttattctgaggcctctgtggcactccttaagctaaacaacccaaaagactttcaggagctcaataagcagacgaagaaaaacatgactattgatggcaaggagctgaccatcagtccagcctatctcctttgggacttgagtgccataagccagtccaaacaggatgaggatatcagcgcctcccgttttgaggataatgaagaacttaggtattctctccggtcgattgagagacatgctccttgggtcagaaacatattcattgtaaccaatgggcagataccaagctggcttaacctagataatcccagggtaacgatcgtgacacaccaggacgtatttaggaatctgtcccacctgcccactttttctagcccagccattgaaagtcacatccaccggattgaggggctgtctcagaagtttatatatttaaatgatgatgttatgttcggcaaagatgtttggccagacgacttctattcccactcaaaaggccaaaaagtgtatctcacttggcctgtccctaattgcgccgaagggtgccccggtagttggattaaggatgggtactgtgacaaggcttgcaacaattcagcgtgtgactgggacggtggagattgctctggcaattccgggggctctcggtatatcgctggcggaggtggaaccggctccataggagtgggacaaccatggcagtttggcggaggtattaattcagtatcctattgtaatcagggctgcgccaatagttggttggctgacaagttctgtgaccaggcttgcaatgtgctgagctgtggatttgatgctggggattgcggtcaagatcactttcacgagctttacaaagtgatcctcctgccaaaccaaactcactatattatccctaagggcgaatgtttgccatacttcagctttgcagaagtcgccaaacgaggggtcgagggagcctactcggataacccaataatccggcacgcatctatagccaataagtggaagaccatacatctgatcatgcactcaggaatgaacgcaaccaccatccactttaacctgacttttcaaaatactaatgatgaggaattcaagatgcagattacagtcgaagttgacacaagggagggccctaagctgaattcgaccgctcaaaagggctacgagaacctggtttctccaattaccctactgccggaggccgaaattctctttgaggacatccccaaggaaaagcggtttcctaagttcaagagacacgatgtaaattcaactagacgggcacaggaggaagtcaagatccctctggtcaacatttcattattgcccaaggatgcacagctgtccttgaacaccctggatctccagctggaacacggagacatcactctgaaaggctacaacctgtctaaaagcgctctactgcgttccttcctgatgaattctcaacacgccaagatcaagaaccaagccataatcacggatgagacgaacgacagtctggtggccccccaagaaaaacaggttcataagtccatactgcctaacagcctgggcgtatctgaacgcttgcagcgcctgacgtttcctgccgtctcggtgaaagtgaatggtcatgaccagggccagaaccctcctttagatttggagacaactgctcggtttagggtggagacgcatacacagaagaccattggaggaaacgtgacaaaagaaaaacccccctccctgatagtgcctttggagtcccaaatgacaaaagaaaaaaagattaccgggaaagaaaaggagaactcaaggatggaggagaacgcagaaaatcatatcggagtgacggaggtgcttctgggcaggaagctgcagcactacacagactcatatctgggctttctgccctgggagaaaaagaagtactttcaggatctcctggacgaggaagagagcctgaaaacgcagctagcgtacttcacagatagcaagaacaccggaaggcagttgaaggacacctttgccgattcgctcagatatgtgaataagatccttaacagcaagttcggattcacctcccgaaaagtaccagcacacatgccccacatgattgatcggatcgtgatgcaggagctccaggacatgtttcctgaggagtttgacaagacatcatttcataaggtgcgccatagcgaggacatgcagttcgctttctcctacttctactatctaatgagcgccgtccagcctttgaacattagccaagtctttgatgaggtcgacacggatcagtctggcgtgctcagcgacagagagatcaggacactcgccacccgaatccatgagctgcccctcagtttgcaagatctgaccgggctggaacatatgctcatcaactgtagcaaaatgcttcccgcagatatcacacaactgaataacatcccaccaacacaggaatcatattatgaccctaacctgcccccggtgacaaaatcactggtgaccaactgtaagccagtgacggataaaatacacaaggcgtacaaagataagaataaatacagatttgagatcatgggcgaggaagaaatcgcgtttaagatgatccgcaccaacgtgtcacacgtagtcgggcagctagacgatatccgcaagaacccccgtaagttcgtctgtctgaacgacaatatcgaccacaatcataaggacgctcagacagtgaaggccgttctgagggacttttacgagtcgatgtttcctatcccctcacaatttgaacttcctcgcgaatacaggaaccgttttctgcacatgcatgagttgcaagaatggcgggcctatcgcgacaagctaaagttttggactcactgtgtgttggctacactgattatgttcaccatttttagcttctttgccgaacagcttatcgccctgaagcggaagatcttcccgaggcggcggattcacaaagaagcctctcctaataggatacgtgtg

SEQ ID NO: 17013 - DNA, 3768 bp, Artificial Sequence
  Description of Artificial Sequence: Synthetic coding sequence
atgctctttaagcttctccagcggcaaacctacacatgtctttcccaccggtatgggctttacgtttgctttctgggggtggtggtgacaatcgtgagcgcatttcagtttggcgaagtggttctagagtggtctagagaccagtatcacgtcctgtttgattcatacagggataacattgcagggaagtcctttcagaacagactgtgtctgccaatgccaatcgatgtagtttatacatgggtgaacggcactgacctggaactgctaaaagaacttcagcaagtcagagagcagatggaggaggagcagaaagctatgcgtgagattctcggaaagaataccactgaaccgacaaagaaaagcgaaaagcagcttgagtgtctcctgacgcattgcattaaggttcctatgttggtcctcgaccccgcgcttcctgcaaacatcactcttaaggatttgccttcactgtacccctcttttcactcggccagtgacattttcaacgtggccaaacctaagaatcccagcaccaatgtctctgttgttgtgtttgattccacgaaagacgtggaagacgcgcattcaggtctgctgaagggtaattcgcgacagactgtgtggcggggataccttactactgacaaggaggtgcctggcttggtactcatgcaagacctcgcttttctgtctgggttcccacccactttcaaagagacaaaccaactgaagactaagttgccggaaaatttgagtagcaaagttaagctgttacagctatactctgaagcttctgtagctctgctcaaattaaacaacccaaaggacttccaggagctgaataaacaaactaagaagaacatgactattgacggaaaagaactgacgatatcacccgcttacttgctgtgggacctgtccgcaatttctcaatcgaagcaggatgaggacatcagcgcatctagatttgaagataacgaggagctccgatacagcctgaggtccattgagagacacgcaccctgggtgcggaacattttcattgttaccaatggtcagatccccagctggttgaatctcgacaatccaagggtgaccattgtgacccaccaagatgtgttccgcaacctaagtcaccttccgaccttctcttcccctgcaatcgagtcacacatacacaggatcgaagggctgtcccagaagtttatctatctaaacgacgatgtgatgtttggcaaagatgtttggcctgacgacttctattcccatagcaaaggccagaaggtgtatttaacatggcccgtgccaaattgcgcggagggatgccccggctcttggattaaagacggttactgtgacaaggcttgcaataactccgcatgtgattgggatggtggcgattgtagtgggaattctggcggcagcaggtatattgctgggggcggaggaactggcagcatcggagtgggacaaccttggcagttcggcggaggcattaactccgtgtcctactgcaatcaaggttgcgcgaattcgtggctagcagacaaattctgcgatcaggcatgcaatgtgttaagctgtggcttcgacgcgggggactgcggtcaggaccactttcacgagctctacaaggtcattctgctgccaaaccagacccattacatcatccccaaaggggaatgtctgccttatttcagctttgcagaagtggctaagaggggggttgagggcgcgtattctgacaaccctattatacgtcatgcgtccattgccaacaaatggaaaactattcatctgatcatgcactccggaatgaacgccaccactattcatttcaatctgacattccagaataccaatgacgaggaatttaagatgcaaataaccgtcgaagtggatacacgagagggccctaagcttaattcaactgctcagaaagggtatgaaaacctggtgtccccaatcacactgctccccgaagctgagatactgttcgaagacatcccaaaggaaaagagatttccgaagtttaaacgacacgatgtcaattcaacacgcagggctcaggaggaggtgaagattccccttgtgaacataagcttgctaccgaaagatgcacaactctctctcaatactctagatctacagttggaacatggggacattacgctcaaaggctacaaccttagcaaaagtgctttgcttaggtccttcctgatgaacagccaacatgcgaagattaagaatcaggccatcatcactgatgagactaacgatagcctagtggcacctcaagaaaagcaggtgcataagtcaatcctgcctaactcactcggggtctctgagaggttgcagcgcctgaccttcccagctgtgagcgtcaaggtgaatggtcatgatcagggccagaacccaccactggatctcgagaccactgctaggttcagagtagaaacccacacacagaagacgatcggggggaatgtgactaaagaaaaaccaccaagtcttattgtgcctcttgaatctcagatgacgaaagagaagaagatcaccggcaaggagaaggagaactccaggatggaggagaacgccgaaaatcatattggggttaccgaagtgcttcttgggcggaagctgcagcattacacagactcgtatctgggcttcctgccatgggaaaagaagaaatactttcaggacttgttggacgaggaggaatccctgaagacgcagctggcctacttcacggactctaagaacaccggtaggcagctgaaagacactttcgccgactcattacgctacgttaacaagattctgaattctaagttcggctttacgagcagaaaggtccctgctcacatgccacatatgattgataggatcgttatgcaggagctgcaggatatgttcccagaggagtttgataaaacatcattccacaaagtccgccactctgaggacatgcaattcgccttcagctatttctactacttaatgagcgccgttcaacccctaaacatttcccaggtgtttgacgaagtcgatacggaccaatctggggtactgagtgacagagaaatccgcactctggccaccagaattcatgagctaccgctgtctctgcaggaccttaccggactcgaacacatgctcatcaactgctccaagatgctgcctgctgacattacacaactgaacaatataccccctactcaggagtcatactacgatccgaacctgccacctgtgacaaagagcctggtgaccaattgcaagcccgttacagataagatacacaaagcgtacaaggacaaaaataagtatcgttttgaaatcatgggcgaagaggagatagctttcaagatgataagaaccaatgtttcacatgtggtggggcagctggacgatatccggaaaaatcccagaaagtttgtctgtcttaacgacaacatcgatcacaatcacaaagacgcgcagaccgttaaagctgtgctaagggatttttacgagtctatgtttcctatcccgtcacagtttgagcttccgcgtgaataccggaataggtttcttcacatgcatgagctgcaagagtggcgcgcataccgcgataagctaaagttttggacgcattgtgtcctagcgacccttataatgttcaccatcttttcattctttgccgagcagctgatcgcgttgaagcgaaaaatctttccacggagacgaatccacaaggaagcgagtccaaatcgcattcgggtg

SEQ ID NO: 17014 - DNA, 3768 bp, Artificial Sequence
  Description of Artificial Sequence: Synthetic coding sequence
atgttgtttaagttgcttcagaggcagacttatacctgtctgtctcatagatacggcctgtatgtgtgcttcttgggtgttgtggtgactatcgtgagcgctttccagtttggagaggttgtcctggagtggagccgcgaccagtatcatgtgttgttcgacagctatcgcgacaacatcgcaggaaaaagcttccagaacagattgtgcttgccaatgcctatcgatgtggtatatacttgggtcaacggaaccgatctcgagctccttaaggaactccagcaggtgcgtgaacagatggaagaagaacaaaaggctatgcgcgagattttgggcaagaacactacagagcctaccaagaagagtgaaaagcaacttgaatgtcttttgacacactgtatcaaagtgcctatgcttgtgttggaccccgctctccccgccaacatcaccctgaaagacctcccatctctgtaccctagctttcatagtgcctcagacatcttcaacgtggcaaaacccaagaaccccagcacaaacgtctccgttgttgtcttcgactccactaaagatgtagaggacgcacatagtggattgttgaagggtaactccaggcaaaccgtctggaggggatacctcactacagacaaggaagttccaggactggtgcttatgcaagacctggcctttttgtccggtttcccacccaccttcaaagaaactaaccagttgaagactaagctgcccgagaatctcagttccaaggtaaagctgctccagttgtactctgaggcatcagtggctctcctgaagttgaacaatccaaaggactttcaggagcttaacaaacagactaagaaaaatatgactatagacggcaaagagcttactatctccccagcctatctcctctgggatctttcagccatttctcaatctaagcaagatgaggacataagcgctagtaggttcgaggacaatgaagaactgcgctacagcctcaggtcaatcgaacgccacgctccttgggtgagaaacatctttatcgtgaccaacggacagatcccttcctggcttaacctggacaaccccagggtgacaattgtcactcaccaagatgtgttcaggaatttgtctcatctgccaacatttagcagtccagccattgaatcccatattcatcgcatcgaaggactctcccagaagttcatctacctcaatgacgacgtaatgttcggcaaggacgtgtggcctgatgacttctactctcactccaagggtcagaaagtgtatctcacatggcctgttccaaattgcgccgaaggatgccccggatcatggattaaggacggttactgtgataaagcttgcaacaacagtgcctgtgattgggatggtggcgactgctccggtaacagcggaggatccaggtatatcgccggaggtggcggcacaggctccattggcgtgggccagccttggcaattcggaggtggcatcaactcagtgtcttactgcaaccagggatgcgctaatagctggttggcagataaattctgtgaccaggcctgcaatgtattgtcatgcggatttgatgcaggagattgtggccaggaccattttcacgagctgtacaaagtgatattgctgcccaaccagacccactacatcattccaaagggagaatgcttgccctacttctcctttgcagaggtggcaaagcgtggagtcgaaggtgcttacagtgacaacccaattattagacacgcttccattgccaataagtggaaaaccattcatctcataatgcacagcggaatgaatgccaccaccattcacttcaaccttacatttcaaaatactaacgacgaggaattcaagatgcaaatcaccgtggaagttgatacaagagagggccctaaacttaattccacagctcagaaaggctacgaaaatctcgtctccccaatcaccctgctccctgaggctgaaattctttttgaggacattcctaaggaaaaaagatttcctaagttcaagagacatgatgttaattctacccgtagggctcaagaagaagtcaaaatacccctcgtgaatattagtcttctgccaaaggatgctcagctctctctgaacacactggacctccagctggagcatggcgacatcaccctcaagggctacaatctttcaaagtccgcactgcttagatcctttcttatgaactcccagcacgctaaaatcaaaaaccaagctatcataactgatgaaactaacgactcactcgtggctcctcaagagaaacaagtgcacaagagtatcttgcctaattctttgggtgtgtctgagaggctgcagagactgacctttcctgccgtttctgttaaggttaacggacacgatcaaggacagaacccacctctcgatctggagaccacagcaaggttcagagttgaaacccatactcagaagacaattggtggcaacgtgacaaaggagaaacccccctcactcattgtgccactggagtcacagatgaccaaggagaagaagatcaccggaaaagagaaggagaatagcaggatggaggagaacgccgagaaccatatcggcgtaactgaggtgctgcttggtcgcaaattgcagcattacactgactcctacctcggattcctcccatgggagaagaaaaaatattttcaggacttgctcgatgaggaggaatcactcaagactcaactggcttacttcaccgactctaaaaacactggtaggcagttgaaggatacttttgctgatagcctccgttacgtgaacaagatcctcaattccaagtttggttttactagcaggaaggtgcccgcacatatgccacacatgatcgatcgcatcgtcatgcaggagctccaggatatgttccccgaagagttcgataagactagcttccataaggtccgtcacagcgaggacatgcagttcgcattcagctatttctattatctgatgagcgccgttcagccattgaatatttcacaggtattcgatgaagtcgatacagaccaatctggagttttgtctgaccgcgagattagaacattggctacacgtattcacgaattgcctctcagccttcaggacttgaccggtctcgagcacatgcttatcaattgtagtaaaatgttgcccgctgacatcactcagcttaacaacatccccccaacacaggagtcttactacgaccccaacctcccaccagttaccaaaagtctggtgaccaactgcaaacccgtgaccgacaaaatccacaaggcctataaagacaagaataagtataggttcgagattatgggcgaggaggaaatcgcttttaagatgattcgtaccaacgtaagccacgttgtgggccaactggacgacattcgtaaaaaccctaggaagttcgtttgcttgaacgacaatatcgatcacaaccataaggacgcacagaccgtgaaagccgtgcttcgcgacttttatgagtctatgttccctatcccttcacagttcgaactgcctcgtgagtataggaaccgtttcctgcacatgcatgaactccaagagtggagagcctacagggacaagctgaagttctggacccattgtgtccttgccactctcatcatgttcactattttttcattttttgcagagcagcttattgcactgaagcgcaagatcttcccccgtcgtcgcattcacaaggaggcctctcccaatcgtattcgcgtg

SEQ ID NO: 17015 - DNA, 3768 bp, Artificial Sequence; identical to SEQ ID NO: 16985
  Description of Artificial Sequence: Synthetic coding sequence

SEQ ID NO: 17016 - DNA, 3768 bp, Artificial Sequence
  Description of Artificial Sequence: Synthetic coding sequence
atgctctttaaattactacagaggcagacatatacatgtctttctcatcgatatggactgtatgtctgttttctcggagtagttgtgacgattgttagtgctttccagtttggggaagtggtcttagagtggagtcgggatcagtaccatgtcctatttgattcttacagagataacatcgctgggaaaagtttccagaatagactgtgtcttccaatgcctatcgatgtggtgtatacttgggttaatgggacagatctggaacttctcaaagaactccagcaggttcgggaacagatggaagaagaacagaaggcaatgcgggagatacttggaaaaaatacaactgaacctactaagaaatctgaaaaacagctcgaatgtctcctcacacactgtattaaagtgcccatgcttgtactagacccagctttacccgctaatatcacactgaaggatctcccctctctttatcctagttttcattccgcctctgatatcttcaacgtggctaaacccaaaaatccttccacaaatgtgtccgtggttgtttttgattcaacaaaagatgtcgaagatgctcatagtggactcctaaaagggaactcacgccagacagtctggcgtgggtatttgactactgataaagaggtgcccggactcgtacttatgcaggatttagcttttctgtcaggatttccccctacttttaaggagacaaatcagttaaaaacaaaacttcccgaaaatctgtcatcgaaagtcaaattactacagctctatagtgaagcctcagtagccctgctgaagctgaataaccccaaagatttccaggaacttaataaacagactaagaaaaatatgactatagatggaaaggaactcacaatatcaccagcttaccttttatgggatctcagtgccatatcccagagtaaacaggatgaagatatctctgcctcacgattcgaagataacgaggaactccggtattccctacgatccatcgaacggcatgcaccctgggtgcggaacatattcattgtgacaaacggacagataccttcatggctaaacttggataaccctcgcgtgactatagtcactcaccaggatgtattcagaaacttgtcacatctccccactttctcatctccagcaattgaaagtcacatccacaggatcgaagggctcagtcagaagtttatctatcttaatgacgatgtgatgtttgggaaggacgtgtggcctgatgatttttactctcacagtaaagggcagaaagtgtatctaacatggcccgtccccaattgcgctgaaggatgtcctggatcatggataaaggatgggtattgtgataaagcatgtaataacagtgcgtgtgattgggacgggggggattgtagtggaaattctgggggaagtaggtatatagcaggggggggaggaacaggatcaataggggtggggcagccttggcagtttggaggggggattaattccgtgtcttactgtaatcaggggtgcgcaaattcttggctagcggataaattctgcgatcaggcatgcaacgttttatcttgtgggttcgacgctggagattgtgggcaggatcactttcatgagctatacaaagtgattctcctccctaaccagacacactacataattcctaagggggaatgtctgccctatttctcattcgcagaagtggctaaaagaggggtggaaggggcctattccgataaccccatcatccgacatgcatccattgcaaataagtggaaaactatccaccttatcatgcactccggaatgaatgctacaactatacatttcaacctaacattccagaacacaaacgatgaagaattcaagatgcagataactgtagaagttgatacacgagaaggacccaaactcaactccacggcccagaaggggtatgaaaacctggtgtcgccaatcactctccttcctgaagccgagatccttttcgaagatatccccaaagaaaagagatttcctaaatttaaaagacacgatgtcaattctacaaggcgcgcacaggaagaagtgaagattccactagtgaacatctccctgctcccaaaagacgcacagttatcactaaacactctggatctgcagttagagcacggagatataacgctgaaaggatacaatctatctaagtccgccctactccgctcatttttaatgaattcccagcatgctaaaatcaaaaaccaggctattataacagacgaaacaaatgattctctagtggcacctcaggaaaagcaggtgcataaatctatcctgcctaattcccttggagttagtgagcggcttcagaggctgacatttcctgcagtcagtgtgaaagtaaatgggcatgaccaggggcagaacccacctctcgacttagaaacaacagcacggttccgagtagagactcatactcagaaaactattggagggaacgtcacaaaagaaaaaccaccttctctaatcgtgccactcgaatctcagatgactaaagaaaaaaagataacaggaaaagagaaggagaactctcgaatggaggaaaacgccgaaaaccacataggggtgactgaagtacttctcgggcgtaaattgcagcactacacagattcctatcttggatttcttccctgggaaaaaaaaaagtattttcaggacctcctcgatgaagaggaatccttgaaaacacagttggcctatttcacagatagtaaaaatactggacggcagctcaaagatacttttgccgattcactaagatatgtaaacaagatcctgaactcaaaatttggatttacatctaggaaagtgcctgctcacatgcctcatatgatagatcgaatcgtgatgcaggagctgcaggatatgttccccgaagaattcgacaagacatctttccataaagtcaggcactccgaagatatgcagttcgctttctcttatttttattacctcatgtcagccgtgcagccccttaacatctcacaagtgtttgatgaagtcgatactgatcagagtggagtgttgtcggatagggagatacgaactctcgccacacgaattcatgaactgccactgagtctgcaggatctgacggggcttgaacatatgctcatcaattgtagtaaaatgctgcccgctgatatcacacaacttaacaacatcccacccactcaggaaagttattatgatccaaatctacctccggtgacaaaatcactggttacaaattgtaaaccagtaactgataaaatacataaagcctataaagacaaaaataagtatagattcgagattatgggagaagaagagattgcatttaaaatgatcagaacaaacgtttcacacgttgtggggcagctcgatgatatccgcaagaaccctaggaaattcgtgtgtctgaatgataacatagatcataaccataaggatgcgcagacagtcaaagcagtgctgagagatttctacgaatctatgtttcccatcccttcacagttcgaactaccacgggaatatcggaatcgcttcctccatatgcatgaactgcaagaatggcgcgcatatagggacaagctgaagttctggactcactgtgtcttagctacattgattatgtttacaatcttttcattctttgcagagcagctcatagcacttaaacggaaaatatttccaaggcgaaggatccataaagaagcctcaccaaatcggattcgggtt

SEQ ID NO: 17017 - DNA, 3768 bp, Artificial Sequence
  Description of Artificial Sequence: Synthetic coding sequence
atgttgttcaagctgctgcagcgccagacatacacctgcttgtcacaccgctatggcctgtatgtctgcttcctcggcgtcgtagtcacaatagtttcggcgttccagtttggcgaggtggtcctcgaatggagccgggatcagtaccatgtcctttttgactcttatcgcgacaatatcgcggggaagtctttccaaaatagactgtgtttgccgatgccaatcgacgtcgtttacacttgggtgaacgggaccgacctggagttgcttaaggagctacagcaggtgcgggagcagatggaagaggaacagaaagcaatgcgggagattttagggaagaatacgaccgaacctactaaaaagtcggagaagcagctcgaatgtctcctaacccactgtattaaagtccctatgctcgtgctggacccagctttacccgcgaatattactttgaaggatcttccctcactgtacccctccttccatagcgcctcagacatttttaatgttgcaaaaccaaagaacccttctaccaatgtctcagtggtggtgttcgacagcacaaaggatgttgaggacgcccatagcgggttgctgaaaggcaactctcgccagaccgtctggaggggctacctgactacagacaaggaggtgcctggtcttgtgctgatgcaggacttggcctttctctccgggttcccgcctactttcaaagaaaccaaccagctcaagacaaaactgccggaaaacctcagctcaaaggtaaaactactgcagctctacagtgaagcttcagtagccctcctcaagctcaataaccccaaagattttcaggagctaaacaaacagacaaagaagaacatgacaatcgacggtaaggaactaaccattagtcccgcctatctcctgtgggacctctcggcaatatcacagagcaagcaggatgaggatatcagcgcctcccgatttgaggataatgaagagctccggtattcactacggtccatcgagaggcatgctccctgggtgcgcaatatattcatcgttaccaacgggcagataccatcgtggcttaatttggacaaccccagggtgacaattgtcacgcatcaagacgtgttccgaaatctctcccacctgccaaccttctctagtcccgcaatagaaagccacatacataggattgaggggcttagtcagaaatttatctacctcaacgatgatgttatgttcggcaaggacgtttggcccgatgacttttactcccacagcaaggggcagaaagtgtatcttacatggccagtcccgaattgcgctgaaggctgcccaggatcatggattaaagacggatattgtgacaaggcttgcaataattcggcttgcgattgggacgggggggactgttcaggcaactcaggtgggagcaggtatattgccggcggaggaggcactggcagtattggagtgggacagccatggcagttcgggggcggtatcaattccgtgtcctactgcaaccagggctgtgccaattcatggctggctgataaattctgcgatcaggcttgcaacgtattgtcctgcggatttgatgcaggggactgtgggcaagaccacttccacgagctgtataaggtcattctgctgcccaaccaaacacactacataatccctaagggagagtgcctcccatatttcagctttgcggaggtggcaaaaagaggagtggagggcgcttactctgataaccctatcatccgacatgcatccattgccaataaatggaagacaatccatctgattatgcatagtgggatgaacgctaccacgatccactttaatctcacattccaaaacaccaatgatgaagagttcaagatgcagatcactgttgaagttgatacccgtgaaggaccgaagcttaacagcaccgctcagaagggttatgaaaacctggtttctcccatcactttactgcccgaagccgagatactgttcgaggacatccctaaagagaaacgattccctaaattcaagcgccatgacgttaactctaccaggcgcgcccaggaagaagttaagatccctttggtgaacataagccttctgcccaaggatgctcagctgtctctcaatacgctggacttgcagctggaacacggagacattaccctgaaaggctacaacctcagcaaaagtgctctgctccggtcattcctgatgaactcccagcatgccaagattaaaaaccaggctatcattaccgacgagacaaatgatagtctcgtggctccgcaggagaagcaggtgcacaagagtattcttcccaacagtttgggtgtgtccgaacgtttacaacgacttacctttcctgccgtgtcagtgaaggtgaacggccatgaccaaggacagaaccccccccttgatctggaaaccacggctaggttccgagtcgaaacccacacccagaaaactatcggaggcaacgttacaaaagagaagccacctagtcttatcgtcccgctggagagccagatgactaaggagaaaaaaatcaccggaaaagaaaaagagaattcccgaatggaggagaatgcagaaaatcatataggagtgaccgaagtgcttctcgggagaaaactgcaacattatacggatagctatttagggtttctaccatgggagaagaaaaagtactttcaggatttactcgatgaggaagagtctctgaagacccagcttgcgtacttcaccgacagcaaaaatacaggaagacagctgaaggataccttcgctgattctctgcggtatgtgaacaagatcttgaactccaaattcgggttcacatccaggaaggttcccgcgcatatgcctcatatgatcgaccgaatcgttatgcaggaactccaagatatgtttccggaagaattcgataagacgagctttcataaggttcgccactccgaggacatgcagttcgcctttagttatttttactatctgatgagcgcagtgcagccccttaacatcagccaagtgttcgatgaagtggacaccgatcaatcaggggtactgtctgaccgcgaaattcggacacttgccacccgaatacacgaactgcccctgagcctgcaagacctcaccgggctggaacatatgttaattaattgttctaagatgctgcctgccgatataacccagctcaataatatcccaccaacacaggagtcttactatgatccgaatttgcctcccgtcactaagagcctcgtcaccaactgtaagcctgtgacagataagatccataaggcatataaagataagaacaaatatcgcttcgagatcatgggtgaggaggagatcgcctttaaaatgatccgtaccaatgttagccatgtggttggtcagctcgatgatatccgtaaaaaccctcgcaagtttgtgtgccttaatgacaatatcgaccacaaccataaggacgcgcagaccgtcaaggccgtcctccgcgacttttacgagagcatgttccctattccctcgcagtttgaactgccgagggaatatagaaatagatttcttcacatgcacgagctccaggagtggagggcctaccgagataagttgaagttttggacccactgtgtgctcgcaactttaattatgttcactattttcagcttttttgccgaacagctgatcgctctcaagcgaaagattttcccaaggagacgcatccacaaagaggcctcgccaaataggatcagggtt

SEQ ID NO: 17018 - DNA, 1602 bp, Artificial Sequence
  Description of Artificial Sequence: Synthetic coding sequence
atggcaaccgccctcatggccgtggtcttgcgggccgctgctgtagccccgcgcctgcggggaaggggcggaactggaggggctcggagactgtcttgcggagccagaagaagagcagcccgaggcacttccccgggacgcagactgtcgactgcgtggtcccaaccgcagccaccgccggaagaatacgcgggagcggatgacgtgtctcagtcgccggttgcagaggaaccgagttgggtcccatccccgcgtccacccgtcccgcacgaatccccggagcctccgtctggccgtagcctcgtgcagcgagatatccaggcattcctcaaccaatgtggtgcctcccctggagaggcaagacactggctgacgcagtttcaaacttgccatcacagcgcggataaaccatttgcggtgatcgaggtggatgaagaggtgctcaagtgtcaacagggcgtgtcctcgctggcgttcgcactggctttcctgcagcgcatggacatgaagcctttggtggtcctgggcctcccagccccgactgcaccttccggatgcctctccttttgggaggcaaaggcgcagctcgccaagtcttgcaaggttttggtggatgctcttcgacataacgcggcggccgcagtacctttcttcggaggaggtagcgtgctccgggccgctgagcctgccccgcacgccagctacggtggtatcgtctccgtggagactgacctcctgcagtggtgcttggaatccggctccatccctatcctgtgcccaatcggggaaaccgcagcgaggcgcagcgtcctcctggactcgctggaggtgaccgcgtctctggccaaggccctgcgcccaaccaaaatcatcttcttgaacaataccgggggcctccgtgattcatcgcacaaggtgctttcgaacgtgaaccttccggccgatcttgatctcgtgtgtaatgctgaatgggtgtcgaccaaggaacgacaacaaatgcgcctgatcgtggacgtcctgagccgcctgcctcatcactcatcagccgtcatcaccgccgcctcaaccctcctgaccgaattgtttagcaataagggaagcggtaccctgtttaagaacgccgagcgcatgttgcgggtgcgctcgttggacaaactggaccagggacgcttggttgatctggtgaatgcatcattcgggaagaagctgagggatgactacctggcttcgcttcggccccgattgcacagcatttacgtgagcgagggttacaacgccgctgcgatcctgactatggaaccagtcctcggcgggactccataccttgacaaattcgtggtgtcatcaagccgccagggacaaggttccggacagatgctctgggaatgcttgagacgcgatctgcaaactctgttctggagaagccgcgtgactaacccgattaatccatggtactttaagcactcagacgggtccttctccaataagcagtggattttcttttggttcggactcgcggacatacgcgacagctatgaacttgtgaaccatgcgaaaggactccctgattcgttccataaaccagcctcagaccctggaagc

SEQ ID NO: 17019 - DNA, 1602 bp, Artificial Sequence
  Description of Artificial Sequence: Synthetic coding sequence
atggccactgccctgatggccgtcgtgctgagagcagcggccgtcgctccaaggctgcgcggtagaggcggtaccggtggtgctcgccgcctttcctgcggagctcgcaggagggcagcaaggggcacttctcctggcagaaggcttagtaccgcatggtcacagccccaacctcccccagaggagtatgccggcgcagacgatgtctcacagagtcccgttgcagaagaaccatcctgggtgccatctccgaggccccccgttccacacgagtcccccgaacctccctcaggaaggtcccttgtccaaagggacatacaggctttcctcaatcagtgtggtgcgagtcccggtgaagcaagacactggcttacacagtttcagacctgtcatcatagtgccgacaaacctttcgccgtcattgaggtggacgaggaggttctgaagtgccagcaaggcgtgtcctctcttgctttcgccttggcgtttctccagcgcatggatatgaagcccctggttgtattgggactgccagctcctaccgctccctctggatgcctgtccttttgggaggctaaggcccaactggcaaagagttgcaaagtgcttgtagatgcactcagacacaacgcggctgcagccgttcctttctttggtggaggttcagttctcagagccgctgagccggctcctcacgctagctatggcggcatcgtatctgttgagaccgatcttctgcagtggtgtctggagtccggttctatcccgattctctgccccatcggtgagaccgctgcgagaaggagcgtcctcctggacagcctggaggtgacggcctccttggctaaggcccttcgcccaacaaagataatcttcttgaataataccggaggccttcgcgattcatcacataaggtgctgagcaatgtcaatcttcccgcggaccttgacctggtctgtaacgccgagtgggtatctacaaaagagcgccaacagatgagactgatcgtggatgtgttgtcccgccttccccaccatagctctgctgtcatcaccgcggccagtaccctcctcaccgaactgttctctaataagggtagtggcaccctgtttaagaacgcggaaaggatgctgagggtgagatctcttgataaactcgaccaaggaaggctggtcgatctcgtaaatgcctcctttggcaagaagctgagagatgattacctggccagcctccgcccacgcctccatagcatctacgtgtccgagggctataatgctgctgccatcctcacaatggaaccagtccttggtggaacaccataccttgacaaatttgtagtgagtagttctaggcagggccaaggttcaggccagatgctttgggaatgcctgaggagagacctccaaacactgttctggagatccagagtgactaacccaattaacccctggtactttaaacacagtgacggatcattctccaacaaacaatggatcttcttctggttcggtttggccgacatcagggactcctatgagctggtcaatcacgctaagggccttcccgactctttccataagcctgcctcagacccgggctct

SEQ ID NO: 17020 - DNA, 1602 bp, Artificial Sequence
  Description of Artificial Sequence: Synthetic coding sequence
atggcgaccgcactcatggcagtggtgctgagagccgctgccgtggcaccacggctccggggcagaggtggaaccggaggggcacgtaggcttagctgtggggcccgtaggcgtgcagctcgagggacctcgccaggccggaggcttagcactgcgtggagccagccccagcccccacctgaggaatacgcgggtgcagacgatgtgtcccagtccccagtggctgaagaaccctcctgggtcccaagcccgaggcctcctgtgcctcatgaatcccctgaaccaccctcaggaaggtcccttgttcaaagggatatccaagcatttcttaaccaatgtggagcctccccaggagaggccagacactggctgactcaatttcaaacttgccaccactcggcagacaagccgttcgcggtcattgaagtggatgaggaggtgcttaagtgtcagcagggagtctcgtcacttgccttcgccttggcatttctccagaggatggacatgaagccactggtggtcctgggtctgcctgcccctactgcacccagcggatgtctttccttttgggaagcaaaggcccagctggccaagtcgtgtaaagttctggtggacgcgctgagacataacgccgcagccgcagtgccatttttcggaggaggctccgtgcttcgggcagcagaaccggccccacatgcatcgtacggcggaattgtgtcagtggagactgatctcctgcagtggtgtctcgagtcaggatcaatacctatcctgtgccccattggtgagactgcagcgcgccgctccgtcctgctcgattcgcttgaagttacggccagcctggccaaggcactgcggcctactaagattatctttctcaacaacacgggtggactccgagattcctcccataaggtcctgagcaacgttaacctgccagcagacctggacctcgtgtgtaatgcagaatgggtgtccactaaagaaaggcagcagatgagactgattgtggacgtcctctcaagacttcctcaccatagctcggcagtcataaccgcagcatcgaccctcttgaccgagctctttagcaacaaaggttccggtactttgtttaagaacgccgagcggatgctgcgtgtgcggtcgcttgacaaactggaccaaggacgtcttgtggacctggtgaatgcatcctttggtaagaagttgagggatgattacctcgcgtccctgcgcccgaggctgcattcgatctatgtgtcagagggttacaacgccgccgccattctgaccatggaaccagtgcttggaggcaccccctatctcgataagtttgtggtgtcatcatcgcggcaggggcaaggttccggacaaatgctttgggaatgcctgcggagagatctgcagactttgttttggcgctcaagggtgacgaatccgattaacccttggtactttaagcatagcgacgggtccttttcgaataaacagtggattttcttctggtttgggcttgcagatataagggactcgtacgagctggtgaaccatgccaaaggattgcccgattcgtttcacaaaccagcaagtgatcctggttcg

SEQ ID NO: 17021 - DNA, 1602 bp, Artificial Sequence
  Description of Artificial Sequence: Synthetic coding sequence
atggccacagccctgatggcagtggtgcttcgcgccgctgcggtcgcccctcggctcagggggcggggaggcactgggggggcccgaaggctaagctgtggagcacgaaggagagcagcccgaggcacctctccgggccgaagattatctacggcgtggtcacagcctcagccccccccagaagaatatgccggggccgacgacgtgtcacaaagtcccgtggccgaagagccaagctgggtgccctctccgcggccacccgtcccacacgagtctcccgaacctccttcgggccgctcccttgtgcagcgggacatacaggccttcctgaatcaatgcggcgcctcacctggcgaagcgaggcactggctcacacagtttcagacgtgccatcatagtgcggacaagccttttgctgtcatcgaggtggatgaggaggtcctgaagtgtcaacagggcgtgtcaagcctggcctttgctcttgccttcctccagaggatggacatgaaacctctggtggtgctgggcctgccagccccaacagccccaagtgggtgcctctcattctgggaggcaaaggcacagctggctaagagctgcaaggtgcttgtggacgcccttaggcacaatgcggccgccgcggtgcccttctttgggggtgggagcgtccttcgagccgctgagccagcccctcatgcaagctacggcgggatcgtctccgtcgagaccgacctgctccagtggtgcctggaaagcgggagcattcccattctgtgccctataggggaaaccgcggcccgacgaagcgtgttgctggattctctggaggtgaccgccagtcttgcaaaggctctgagaccaaccaagatcatatttcttaacaatactggcggtctgcgcgattcgtcccataaagttctttccaatgtaaatctccctgccgatttggacctggtgtgcaacgcggagtgggtgtccacaaaggagaggcagcaaatgagactcatcgttgacgtcttgtcaaggctgccacaccattcttcagccgtcatcactgctgcatccacgttgctgacagagctctttagcaataagggaagcggcacactctttaagaatgcagaacgaatgctgagggtccgaagtctggataagctggatcagggacggcttgtggacctggtgaatgcctcgttcggcaagaagttgcgcgatgactatctggcgtcgctgagaccaagactacatagcatatacgtctccgaaggctacaacgcagcagctatcctgaccatggaacctgtgctagggggtactccctacctggacaagttcgtcgtatcctcttcccgacaaggccagggtagtgggcaaatgctgtgggaatgtctccggcgggacctccagacgcttttctggcgcagcagagtaactaaccccattaacccatggtattttaaacactcggacggaagtttcagcaataagcagtggatttttttctggtttgggcttgcagacataagagattcctacgagctcgttaatcacgcgaaaggacttcctgactccttccataagcctgcaagcgaccccggtagc

SEQ ID NO: 17022 - DNA, 1602 bp, Artificial Sequence
  Description of Artificial Sequence: Synthetic coding sequence
atggccactgctctcatggcagtcgtgctcagagccgcagcagttgctcccaggctcaggggaaggggcggaactggtggagcgcgaaggctctcgtgtggcgccagacggagagcagccaggggtactagcccaggtcgtagactgtcgaccgcgtggtcgcagcctcagcccccacctgaagagtatgccggtgcagacgatgtgtcacaatcgccagtggcagaagagcccagctgggttccttccccccgccctcctgtccctcatgaatcgccagagccgcctagcgggcgctcactggtccaaagagatatccaggcattcctcaaccaatgcggtgcgagccctggagaggcacgtcattggcttactcaatttcaaacttgccatcattcagcggataagccatttgcagtgatcgaagtggatgaagaggtgctcaagtgtcagcagggcgtctcatcccttgcatttgcactggcctttcttcagaggatggatatgaagcccctcgtcgtgctgggactgcccgcacctactgcgccaagcggttgtcttagcttttgggaagcaaaagcacagctggctaaaagctgtaaggtgcttgtggacgcacttagacataacgcggcggcagcagtgcccttttttgggggtgggtcggttctccgcgcagcagagcctgcaccacatgcatcctacggcggaatcgtctccgtggaaactgacctgcttcaatggtgtctggagtcggggtcgattccgatcctttgtcctatcggagaaactgcggcacgaaggagcgtgcttcttgactcgttggaggtcacggcatcgcttgccaaggccctcagacctactaagataatcttcctgaacaacaccggtgggcttcgggactcgagccataaggtgctttcaaacgtgaatcttcccgcagacctggacttggtgtgtaacgccgaatgggtgagcaccaaggaacgacagcagatgcgcttgattgtggacgtgctgtctcgccttccccatcatagctccgcagtgattaccgcggcgtcaacccttcttaccgaactttttagcaacaaaggttcaggcaccctgtttaagaacgctgagcggatgctgagagtgaggagcctggataaactcgaccaagggcggcttgtggacctggtgaacgcttcatttgggaagaagctccgcgatgattacctggcatccctgcggccacgactgcactcaatttacgtatccgaagggtacaacgccgcagcgatccttaccatggaaccagtgctcggcggaaccccatacctggataagtttgttgtgtcctccagtagacaggggcaagggtcagggcagatgctgtgggaatgtctgagaagagatctgcaaacccttttttggcgatcccgggtcactaatccaattaacccatggtacttcaaacattcagatggatccttttctaacaagcagtggatctttttctggtttggactggcagatattcgggattcgtacgagcttgtgaaccatgcaaagggactgccagacagctttcataagccggcctccgatcctgggtcc

SEQ ID NO: 17023 - DNA, 1602 bp, Artificial Sequence
  Description of Artificial Sequence: Synthetic coding sequence
atggccactgccctgatggcagtggtgctccgggctgcagcagttgccccaagactacggggtcggggaggcactggcggcgcccgccgcctgtcctgcggggcaagacgacgggctgcaaggggcacatcccccgggcgaagattatcaaccgcatggagccagccccagccccccccagaagaatatgctggcgccgacgatgtttcacagtctcctgtcgctgaagaacccagctgggtacccagcccaaggccccccgtaccacacgagtcacctgaacctccttccggccgctccctggtccagcgggatattcaagcattcctgaaccagtgtggcgccagccccggagaggctagacattggctgacccagttccaaacttgtcatcattcagcagacaagcctttcgccgtgatcgaggtggatgaggaggtgctgaaatgccagcagggtgttagcagcctagctttcgccttagcatttcttcaacggatggatatgaagcccctggtggtgctgggactgcccgcacctacagcccccagtggctgtctgagtttctgggaggctaaggctcagctggctaagtcttgtaaagttctggtggacgctttgagacacaacgctgctgccgccgtgcccttttttgggggcggaagcgtactgagggctgccgagcctgcaccacatgcatcctatggcggtatcgtttccgtcgaaactgatctcctacagtggtgcctggaatcaggaagcataccgatactttgcccaataggcgagactgccgcccgccggtctgtgctactggactcactggaagtcaccgcttctttggcaaaggccctgcggccaaccaagattatttttctgaataacacaggcgggctcagagactccagtcacaaggtgttgtccaacgtgaatttgcccgccgatctggatttggtgtgcaacgctgagtgggtgtctacaaaggaacgacagcagatgcggctaatcgtcgatgttctatccagactaccacatcactctagtgctgtgataaccgccgcaagcactctgctcactgagctattttccaataagggcagcgggaccctatttaaaaatgctgaacgaatgctcagggtgaggtccctcgacaagctggaccaaggccggctagttgatttggtcaacgcttcttttggtaaaaagttgagggacgattaccttgctagcctccggcccagactgcatagtatatatgttagcgaagggtataacgctgcagccattctaaccatggaaccagtgctgggggggacaccctacctagacaaattcgtggtgagcagttcccggcaagggcaggggagtggccaaatgctgtgggagtgcttaaggcgggacctacagactctgttctggcggtcaagagtgaccaacccaataaacccatggtacttcaaacattccgacggcagcttctctaataaacagtggatcttcttttggtttggtctcgctgatatacgcgattcttatgaactggttaatcatgctaaaggtctccctgatagtttccataagcccgcctctgaccctggcagt

SEQ ID NO: 17024 - DNA, 1602 bp, Artificial Sequence
  Description of Artificial Sequence: Synthetic coding sequence
atggcgacggcgctaatggcggtagtactacgagcggcggcggtagcgccgcgattacgtggtcgaggtggtacgggtggtgcgcgacgattatcgtgtggtgcgcgtcgacgagcggcgcgaggtacgtcgccgggtcgtcgattatcgacggcgtggtcgcaaccgcaaccgccgccggaagaatatgcgggtgcggatgatgtatcgcaatcgccggtagcggaagaaccgtcgtgggtaccgtcgccgcgaccgccggttccgcatgaatcgccggaaccgccgtcgggtcgatcgttagttcaacgtgatatacaagcgtttttaaatcaatgtggtgcgtcgccgggtgaagcgcgtcattggctaacgcaatttcaaacgtgtcatcattcggcggataaaccgtttgcggttatagaagtagatgaagaagtattaaaatgtcaacaaggtgtatcgtcgttagcgtttgcgctagcgtttctacaacgtatggatatgaaaccgttagtagtattaggtctaccggcgccgacggcgccgtcgggttgtctatcgttttgggaagcgaaagcgcaattagcgaaatcgtgtaaagttttagtagatgcgttacgacataatgcggcggcggcggttccgttttttggtggtggttcggttttacgtgcggcggaaccggcgccgcatgcgtcgtatggtggtatagtatcggttgaaacggatttattacaatggtgtctagaatcgggttcgataccgatactatgtccgataggtgaaacggcggcgcgtcgttcggtactactagattcgttagaagtaacggcgtcgctagcgaaagcgctacgtccgacgaaaataatatttttaaataatacgggtggtttacgtgattcgtcgcataaagtactatcgaatgtaaatctaccggcggatctagatttagtttgtaatgcggaatgggtatcgacgaaagaacgtcaacaaatgcgactaatagttgatgtactatcgcgactaccgcatcattcgtcggcggtaataacggcggcgtcgacgttattaacggaattattttcgaataaaggttcgggtacgttatttaaaaatgcggaacgtatgttacgagtacgatcgctagataaattagatcaaggtcgtctagtagatttagtaaatgcgtcgtttggtaaaaaactacgtgatgattatctagcgtcgttacgtccgcgtttacattcgatatatgtatcggaaggttataatgcggcggcgatattaacgatggaaccggtattaggtggtacgccgtatttagataaatttgttgtttcgtcgtcgcgtcaaggtcaaggttcgggtcaaatgctatgggaatgtctacgtcgtgatctacaaacgttattttggcgttcgcgagtaacgaatccgataaatccgtggtattttaaacattcggatggttcgttttcgaataaacaatggatatttttttggtttggtttagcggatatacgtgattcgtatgaactagtaaatcatgcgaaaggtttaccggattcgtttcataaaccggcgtcggatccgggttcg

SEQ ID NO: 17025 - DNA, 1602 bp, Artificial Sequence
  Description of Artificial Sequence: Synthetic coding sequence
atggctacagctttaatggcagtcgttctccgtgcggctgctgtggcacctcgcctgcgtggccgcggtggtaccgggggggctcgacggctgtcctgcggcgcccgacgccgcgccgcccgtggcacctcgccggggcgtaggctgagcacagcctggagtcaacctcagcctcccccagaggaatacgctggcgctgacgatgtgagccagagccctgtggcagaggagcccagctgggttccgtccccacggccccccgtgccgcacgagtcccctgaaccaccgtcgggacgcagtctggtgcaacgagacattcaggcgtttttgaaccagtgtggtgcgagcccgggagaggctaggcattggctcactcagtttcagacatgccaccactcagctgacaagcccttcgccgtgatcgaggttgatgaagaagtcctgaaatgccagcagggtgtatcatcgctagccttcgcattggcatttttgcagcggatggatatgaaacctctggtggtgctgggcttaccagcccccaccgctccatcgggttgtctctcgttctgggaggcgaaggcgcaactcgcaaagtcttgcaaggtcctggttgatgcgctcagacataacgcggctgctgccgtaccgttttttggaggaggttcggttctccgcgcagcagaaccggcgccacatgccagctatggaggtatcgtttcggtcgagacggacttgctccaatggtgcctcgaatcgggatctattcccatcttgtgtccaatcggagagaccgcggcccgacgatccgtcttgctcgactcgttagaggtcaccgccagtcttgcaaaggctttgcggccaacaaagataatctttcttaacaatactggcggactgcgagactctagccataaggtcctgagtaatgtaaacctcccagccgatcttgatctagtgtgcaacgcagaatgggtctctaccaaggaacgacagcagatgcgtctgattgttgatgtcctctcacggctgcctcatcattccagcgccgtcataactgcggcgtcaacccttttgaccgaacttttttcaaataaaggctccggcaccctgttcaagaacgccgaaaggatgcttcgagtgcggtcccttgacaaacttgatcaaggtcgcttggtcgatttggtcaatgccagttttggcaagaagctccgagacgattacctcgcttctctgcgtccgcgcctccactcaatctatgtttccgagggatataacgctgccgcgattttaacgatggagccagtcttaggtggcacaccttatcttgataagtttgtcgtttctagcagccgacaaggtcagggttcaggtcagatgttatgggagtgcctgaggcgagatcttcagactcttttctggagaagccgggtcaccaatccaatcaatccgtggtattttaagcactcggatggaagtttttccaataaacagtggatttttttctggttcggcctcgctgacattcgtgattcctacgaattggtgaatcacgccaaaggcctccctgattccttccataagcctgcttcagatccaggctca

SEQ ID NO: 17026 - DNA, 1602 bp, Artificial Sequence
  Description of Artificial Sequence: Synthetic coding sequence
atggccacagcgctgatggctgtggtgctgcgggccgcagcggttgcacccagacttcgcggacggggaggaaccggtggcgctcgcagactgtcctgcggcgcccggaggcgggccgcaagaggcacgtctcctggcaggagactgagcaccgcttggagccagccgcagccaccgccagaagaatacgccggcgctgacgacgtgagccagtccccggtggcagaggagccgagttgggtccccagtccccgcccacccgttcctcacgaatctcctgagcccccgtctggccggtctctcgtgcagcgcgacattcaggcatttctgaatcagtgtggagccagtcccggagaagcgcgccattggttaactcagttccagacttgtcatcattcagccgacaagccttttgctgtgattgaggtcgatgaagaggtgcttaaatgccagcagggagtctcctcacttgcctttgccctcgcctttctccagagaatggatatgaaaccgctcgtcgtgcttggtctgccagcacccaccgccccatctggttgtctgtcattctgggaggctaaggctcaattggccaagagttgtaaggttcttgtcgatgctcttcggcataacgcagcagcggccgtgcccttctttggagggggaagtgtgctgcgtgctgcagagccagctccccatgctagttacggaggtatcgtgtccgttgaaactgacctgttgcagtggtgtttggagagcggctccatccctatcctgtgcccgattggagaaaccgcggcccggcgctcggtgttactcgatagcttggaggtgacagcatcactggcgaaagccctaagacccacaaaaataatcttcctgaacaacaccggcggcctcagggattcttctcataaagtcctgagtaacgtcaacctgcctgcggatcttgatctggtgtgcaatgcagagtgggtaagcaccaaggagcggcagcaaatgagattgattgtggatgtgctgtcacgtttaccgcaccattcaagcgcagtgatcacagctgccagtacattgctgaccgaacttttctcaaataagggtagcgggaccctgttcaaaaacgccgagagaatgctccgtgttagatccctagacaagctcgaccagggccgccttgtcgatctcgtcaatgcctctttcggaaaaaaactaagggatgattacctcgcgtcactgagaccccgtctgcacagtatctatgtatctgaaggatataatgcagccgcaatactgacaatggagcctgtcctggggggcaccccttaccttgacaagtttgtagtgtcttcaagccggcaggggcaagggtccggccagatgttgtgggaatgtctgagaagggacctgcagacgctcttttggcggagccgagtgacaaaccccatcaatccctggtattttaagcacagtgacggctctttttcgaacaagcagtggattttcttttggttcggactagcagacatacgcgatagctacgaactggttaaccatgctaagggtcttccggacagcttccacaagcccgcctccgaccccggtagc

SEQ ID NO: 17027 - DNA, 1602 bp, Artificial Sequence
  Description of Artificial Sequence: Synthetic coding sequence
atggccacagctttaatggcagtcgtgctccgagccgcagcggtggcaccacgattgagaggaagaggcggcaccggtggtgccaggcgactgtcgtgtggagctaggcgcagggctgcgagagggaccagccctgggaggcggttgtccacagcttggagtcagccccagccgccgccagaagagtatgctggcgctgacgatgtgagccagtcccccgtggctgaggagccgtcgtgggtccccagccccaggcctcccgtccctcatgagtcccccgagccccctagcgggcgttctttggtccaaagggatatacaggcattcctgaaccagtgtggcgccagtcccggcgaagctaggcactggctaacacagtttcagacatgccaccactcggcggacaagccgtttgccgtgattgaagttgatgaggaagtgctaaagtgccagcagggcgtgagctcccttgcgttcgcactcgcttttctgcagcgaatggacatgaagcccctagtggttcttggccttccggcccccactgcacccagcggttgcctgtccttctgggaggccaaagctcaactggctaagtcatgcaaagtacttgtagacgccctgcgccataacgccgcagcggccgtgccattcttcggcgggggaagcgtcttgagggccgcagagcctgccccccacgctagctacggtgggatcgtgagtgtagagacggatcttctccaatggtgtttagaatccgggtctattccaatcctatgcccaatcggagagacagctgcacgacgatccgttctgctggactcccttgaggtcacagcttctctggccaaggcccttaggccaaccaagattatctttctgaataacaccggcgggcttagagactcttctcacaaagttttgtctaatgtgaacttgcctgccgacctcgacctggtatgtaatgccgaatgggtctctaccaaagaaaggcagcagatgcgacttatagtggacgtgttaagcagacttccccaccactctagcgccgtaatcaccgccgcatctacattgctgactgaactgttctcgaacaaggggagtggaaccctgttcaagaacgccgaacgtatgctccgcgtgagatctctagacaaactcgaccaggggagactggtcgacctcgtcaacgcttctttcggcaagaagttgagagatgactacctggcttcattgcgtccacgcctgcatagtatttacgtgagcgagggatataatgccgccgcaatacttacaatggaacccgtcctgggaggaacaccgtatctggacaagttcgtagtctcgagtagccgacagggccaaggctccggccagatgttatgggaatgtctcaggcgagatctccaaacactcttctggcgaagtcgagtcactaacccaattaacccctggtacttcaaacattccgatgggtccttcagcaacaaacagtggatcttcttttggttcggcttagctgatattagggatagctatgagctagtaaaccatgccaagggtctgcctgactccttccataagcccgcctctgatcccgggtcc

SEQ ID NO: 17028 - DNA, 1602 bp, Artificial Sequence
  Description of Artificial Sequence: Synthetic coding sequence
atggcaaccgcgctgatggcggtggtcctgcgggcagcagccgtggcgccgcgcttgagaggccggggaggaaccggcggggctagacggttgtcctgcggggccagacgccgggccgcccggggcacttcgccaggacgccgcctgtctactgcctggtcgcagccacaaccgcctccagaggaatacgccggagccgacgacgtgtcgcagagcccggtggccgaagaaccatcatgggtgccgagcccgcgaccgccggttccccacgaatcgccggaaccgccgtccggacgctcgctggtgcagagggacatccaggccttccttaaccagtgtggcgcatccccgggagaagcacgccactggcttacccagttccaaacttgccatcattccgccgacaaaccgttcgccgtgatcgaggtcgatgaagaggttctgaagtgccagcagggggtgagttccctggctttcgcactggcattcctccagagaatggatatgaagccgctcgtggtactggggttgccagcgccgactgcgccgtcaggatgcctctcgttttgggaagcgaaggcccagctcgccaagtcctgcaaggtgctggtggacgcgctgcgccataacgcggccgctgcggtcccgtttttcggaggggggtccgtgctgcgcgctgccgagccagcgcctcatgcgagctacggaggaatcgtgtcggtggagactgacctcctgcagtggtgcctcgaatcaggatcgatccctatcctgtgcccgatcggggaaaccgccgcacggcgatccgtcctgttggactcccttgaggtgaccgcatccctggccaaggcgttgcgccccaccaagatcatcttcctcaacaatactgggggactgcgggactcctctcacaaggtgctttcgaatgtcaacctcccagcagacctggatctggtctgcaacgccgaatgggtgtcaactaaggagcgtcaacaaatgagactgatcgtggatgtgctgtcacgcttgccgcaccactcgtccgcagtgatcacggcggcttcaaccctcctgaccgagctgttctcgaacaagggctcaggaaccctgttcaaaaacgccgaacgcatgttgcgggtgcgctcccttgacaagctggaccaaggacggctggtggacctcgtaaacgccagctttggtaagaagctgcgcgacgactaccttgcatccctccggccgcgcctgcactcgatttacgtttccgagggttacaatgcagccgccatcctcactatggaaccggtgttgggcggaacgccgtacctggacaagttcgtggtgtcgagctcacgccaaggtcagggatcgggtcaaatgctgtgggagtgtctgcggcgcgatcttcagaccctgttttggcgcagccgcgtgacgaatccgattaacccctggtactttaaacactccgatggatcattttcgaacaaacagtggatcttcttctggtttggcctcgcggatatcagagactcatacgagttggtgaaccatgctaaaggactcccggactccttccacaaaccggccagcgatcctggatcc

SEQ ID NO: 17029 - DNA, 1602 bp, Artificial Sequence
  Description of Artificial Sequence: Synthetic coding sequence
atggcaacagcattaatggctgttgttttaagagctgcagctgtggcacctagattaagaggacgtggaggaacaggaggagcacgtagactttcatgtggagctagaagaagagctgcaagaggtacatcaccaggtagacgacttagtacagcttggtctcaacctcaaccaccacctgaagaatatgctggagcagatgatgtgagtcaatctccagttgcagaggaaccatcatgggttccttctccaagacctccagttcctcatgaatctccagaaccaccttctggaagatctttagttcaacgtgacattcaagcttttttaaatcaatgtggtgcttcacctggggaagcaagacattggttaactcaatttcaaacatgtcatcactcagcagataaaccatttgctgtaattgaagttgatgaagaagttttaaaatgtcagcaaggtgtcagttcattagcttttgcactagcttttttgcaacgtatggatatgaaacctttagttgttcttggattaccagctccaactgctccatcaggatgcctttcattctgggaagcaaaagcacaattagctaagtcatgtaaagttcttgttgatgctttgagacataatgcagcagctgcagtaccatttttcggaggaggaagtgtattaagagcagctgaaccagctccacatgcatcatatggaggtattgttagtgttgaaactgatttattacaatggtgtttagaatctggaagtatacctattctttgtccaattggagaaactgctgctaggcgatctgtccttcttgattctttagaagtaactgcaagccttgctaaagctcttagaccaacaaaaattatttttcttaataatacaggtggattaagagatagtagtcataaagttttatcaaatgtaaatcttccagcagatcttgatcttgtttgtaatgcagaatgggtgtctactaaggaaagacaacaaatgagacttattgtggacgtattatcaagattaccacatcattcatcagcagttattactgcagcaagtactttattaactgaattatttagtaataagggttcaggtactcttttcaaaaatgctgaaagaatgttaagagttagaagtttggacaaactagatcaaggaagattagttgatcttgtaaatgcatcttttggtaaaaaattaagagacgattatttagcatcacttcgtccaagattacattctatatatgttagtgaaggatataatgcagcagcaattctaacaatggaaccagttttaggtggtactccatatttagataagttcgttgtttcatcatctagacaaggacaaggatctggacaaatgttatgggaatgtttacgtagagatttacaaactttattttggagatcacgtgttacaaatccaataaatccatggtattttaaacattctgatggatctttctctaataaacaatggattttcttttggttcggattagctgatataagagacagttatgaattagtaaatcacgcaaaaggattaccagattcattccataaacctgcatcagatccaggatct

SEQ ID NO: 17030 - DNA, 1602 bp, Artificial Sequence
  Description of Artificial Sequence: Synthetic coding sequence
atggccaccgccctgatggccgtggtgttgcgggccgccgccgtggctccaaggctccgcggaagaggagggactggaggtgctaggcggctgtcctgcggcgcgcggcggcgggcagctcgcggaacttcaccggggcggcgcctttccacggcctggagccagccacaacccccgccagaagagtatgcgggtgcagatgacgtgtcacaaagccctgtcgctgaagagccgtcttgggtgccgtctccccgtccgccggtcccgcacgaatcgcctgaaccgccctccggacggtcgctggtgcaacgcgacattcaggccttccttaaccaatgcggagccagcccgggagaggcccgacattggctcacccagttccagacctgccaccactcagccgataaaccatttgccgtcatcgaggtcgatgaagaggtgctgaaatgtcaacaaggcgtgagcagcctggcctttgctttggccttcctccagcggatggacatgaagccgctggtggttctcggtctgccggcgccgaccgctccttcgggatgcctgagcttctgggaagcaaaggctcaactcgcaaagtcgtgcaaggtgctggtggacgcactccggcataatgcagcggcggcagtgccgttctttgggggagggagcgtcctgcgcgctgcagagcccgcaccgcatgcctcgtacggcggaatcgtgtcagtggagactgatttgctccagtggtgtctggaatctggctccattccgatcctgtgtcctatcggagaaacggcagctcgccggtcagtcctgttggactcgctggaggtgaccgcatcgctggcgaaggcgcttcgcccgaccaaaatcatttttctgaacaataccggagggctgagagactcgagccataaggtcctgtcgaatgtgaatctgccggccgatctcgacctggtttgcaacgcagaatgggtgagcacgaaggagcggcagcagatgcgcctgatcgtggatgtgctctcaagactcccacaccactcgtcagccgtgatcaccgcagcgtcaaccctgctgaccgagctgttctcgaacaagggatcgggaaccctgttcaaaaacgctgaacgcatgctgagggtgcgaagcctggataaacttgatcaaggacgcctggtggacctcgtcaatgcgagcttcggcaagaagctgagagacgattacctggcttcgctgcgcccgcgcctgcactcgatctatgtctccgaggggtacaacgcggccgccatcctgaccatggaaccagttctcggaggaaccccatacctggacaaattcgtcgtcagctcgtcgaggcaaggccaaggcagcggacagatgctgtgggaatgccttcggagagatcttcagaccttgttctggcggtcgagagtgactaacccgattaatccatggtacttcaaacactcggacggatcattcagcaacaagcaatggattttcttttggttcggactggctgacatccgcgactcctacgaactcgtgaaccatgctaagggactgccggactcgttccacaagccagcatccgaccctggctca

SEQ ID NO: 17031 - DNA, 1602 bp, Artificial Sequence
  Description of Artificial Sequence: Synthetic coding sequence
atggctactgctttgatggcagttgttttgcgtgctgccgctgttgctccaagattgaggggtaggggggggacaggtggtgctagacggctaagttgtggtgcacgtaggcgtgctgctcgcggaacgtcacctggacgcagactgtccacagcttggagtcaacctcagccccctcctgaggagtatgctggagccgatgacgtgagtcaatcccccgttgctgaggaaccttcctgggtgcctagcccccgaccacctgtccctcacgagtccccagaacctccaagcggaagaagtcttgtgcaacgtgatatacaggcttttcttaaccagtgcggggcaagtcctggggaagctagacactggttgacccaattccagacttgccatcactccgccgacaaacctttcgctgtcatagaagttgacgaggaagttcttaaatgccaacagggggtgagtagcctagcctttgcgcttgctttccttcagaggatggatatgaaaccactggtggttctgggcttgcctgcacctaccgccccatccgggtgcctatcattctgggaggctaaagcacagctggctaagagttgcaaggtcttagttgatgccctccgacacaacgcagcagctgctgtgccgtttttcgggggtggctccgtcttgcgtgctgccgagccagcaccacatgcttcatatggaggtattgtgtcggttgaaacagatttgttgcagtggtgcttggaatctggttctatcccaatcttgtgccctattggggagactgctgctaggcggagtgttttgctagattccctggaagtgactgcttcactagctaaggctcttcggcctacgaagattatttttctcaacaatacaggggggttgagggatagttcccataaggttctcagtaacgtcaacttgcctgctgatcttgaccttgtatgcaatgccgaatgggtttccactaaggaacgtcaacagatgaggctcatagttgatgttctttctagactacctcaccattctagcgcagtgattacagcagcttccacactgctgaccgagctattctccaacaaaggatccggaaccctatttaaaaatgctgagaggatgctaagggttcgctcacttgataagcttgatcaaggaagattagttgacctggtcaacgcctcatttggaaaaaaacttagggatgattacttggcttctttgaggccacgattgcattctatttatgtttcagaaggttacaacgctgctgctattcttacaatggagcctgtcctcggcggaacaccttatctggacaagtttgtcgtaagttcttctcggcaggggcaaggctcagggcagatgctttgggaatgtctccgtagagatcttcagacgcttttttggcggtctcgagttacaaacccgattaacccctggtactttaaacatagtgacggcagtttctccaataagcaatggatcttcttttggttcggtctagctgacatacgagactcttacgaattagtaaaccacgctaaaggacttcccgacagttttcataagcctgcatctgatccgggctcg

SEQ ID NO: 17032 - DNA, 1602 bp, Artificial Sequence
  Description of Artificial Sequence: Synthetic coding sequence
atggcgacagctttaatggcggtggtcctgcgggcagcagctgttgcccctagactacgagggcgggggggaactggcggcgcaaggcgactgagttgcggtgcacgaagacgcgccgccagagggacgtctcccggacgacggctaagtactgcgtggagccaacctcaacctccccctgaggaatacgctggggcagatgacgtaagtcagtctcccgtggccgaagagcccagctgggtcccctcccctcggccccctgtgccgcacgagagccccgagcctcccagtgggaggagtctggtacaacgggatatccaagcattcttaaatcagtgtggagcatcacctggtgaagcacggcactggttgactcagtttcaaacctgccaccattccgcagacaaacccttcgctgtcatagaggtcgatgaggaagtgttgaaatgccagcagggagtctcttctctggcgtttgccctggcctttctgcaacgtatggacatgaagcctctggttgtattagggctcccggccccgactgccccttctggctgcttgtcattttgggaagctaaggctcagctggcaaagagctgtaaagttctagtcgatgctctgcgacataacgcggctgcagctgtccccttcttcggaggggggagcgtcctgcgcgccgccgagccagctcctcacgcttcttatggaggcatcgtctccgtggagactgatctcctacagtggtgcctggagtcaggaagcattccaattttatgcccgatcggggagacggccgctagacgctcagtgctgctcgactctctggaggtgaccgcttcattagcgaaggctctgcgccccacgaagatcatatttctcaataatactggcgggctgagagactccagccataaagtgctttccaacgtcaacctccctgcagacctggacctggtttgtaatgctgaatgggtgtccactaaagagcggcagcagatgcggttgatcgtggacgtcctgagcaggctgcctcaccactcttcggcggtcatcaccgccgcctccaccctgctgacagagctctttagcaacaaaggcagtggcaccctcttcaagaacgctgaaaggatgctgagggtacgatctctggataaactcgatcagggacgtctggtcgacctggttaacgcttccttcggaaaaaaactgcgggacgactatcttgcctctctgagacctcgcctgcattccatttacgtctctgagggttacaatgccgcagccatcttaacaatggagcccgttctcggtgggaccccctacctggataagtttgtggtgtctagctctcgccagggtcaaggcagcgggcagatgctgtgggaatgtcttaggcgcgacctgcagacactattctggaggtcccgggtgacaaatcccattaatccttggtactttaagcatagcgatggatcttttagcaacaagcaatggatctttttctggttcggcctggccgatatccgagattcgtacgaactggtgaatcacgctaaaggactgccagactccttccacaaacctgcaagtgatcccggtagc

SEQ ID NO: 17033 - DNA, 1602 bp, Artificial Sequence
  Description of Artificial Sequence: Synthetic coding sequence
atggctaccgccctgatggctgtggtgctgcgcgccgccgctgtcgccccacggctgcgcggacgcggaggcactggaggagccagacggctgtcatgcggagcccgccgccgggcggcccggggaacctcaccgggacgccgcctcagcaccgcatggtcgcaaccgcagccaccacctgaagaatacgcgggagcagatgacgtctcgcagtcccctgtcgcggaagaaccaagctgggtgccgagcccgcggccgccagtccctcatgagagccctgaaccgccttctggacgctcacttgtgcagagagacatccaggcctttctcaatcaatgcggagccagcccgggagaggcacgtcactggctgacccaatttcaaacttgccaccactccgctgacaaaccatttgcggtcatcgaagtggacgaagaagtgctgaaatgccagcaaggcgtgtcgtcactggcctttgcgctggctttcctgcagcgcatggatatgaagcccctggtggtcctgggacttcccgcgccgaccgcaccatcaggatgcctgtccttctgggaagctaaggctcaattggcaaagtcatgcaaggtgctcgtggacgcgttgcgccacaacgccgcagccgccgtgccatttttcggaggaggatcagttctgagagcagccgaacccgcaccgcacgcttcgtacggcggtatcgtgagcgtggaaaccgatctgctccagtggtgcctggagtcaggaagcatccctatactgtgcccgatcggcgaaaccgccgcccgcagatcggtgttgctggactcccttgaagtgactgcctcgcttgccaaggcgctgcgcccgactaaaatcatcttccttaacaacaccggcggtctgcgcgactccagtcataaggtgctgtccaacgtgaatctgcctgcggacctcgacctcgtctgtaacgcagagtgggtgtccaccaaggagagacagcaaatgagactgatcgtggacgtgctctcaaggctccctcaccatagcagcgccgtgatcaccgccgcatcaactctgctgaccgagctcttcagtaacaaaggctccggaacccttttcaagaacgctgaacgaatgctgcgcgtgcggtccctggacaaactcgatcagggacggcttgtggacttggtgaacgcttccttcggaaagaaacttcgcgacgactacctcgctagcctgcgtccgcgcctgcactccatctacgtgtcggaaggctataacgcagccgccattctcaccatggagccggtcttgggagggacgccctatctggataagttcgtcgtgagctcatcgaggcagggccaaggatccgggcagatgctctgggagtgcctgagacgggacctgcaaactctcttctggcggtcccgcgttactaatccgatcaacccatggtacttcaagcattcggatggcagcttctcaaacaagcagtggattttcttttggtttgggctggccgacatccgggattcgtacgaactcgtgaaccacgccaaagggttgcctgactcgtttcataagcctgcctccgatccgggctct

SEQ ID NO: 17034 - DNA, 1602 bp, Artificial Sequence
  Description of Artificial Sequence: Synthetic coding sequence
atggctaccgctctgatggccgtggtactgcgggcagccgctgtggcgcccagactccggggaagaggcggcaccggaggtgcaaggaggctgtcgtgcggggcccggagaagagccgcacgcggcacttcaccaggcagacgattaagcaccgcctggagccagccccagccaccaccagaagagtatgcaggggctgacgacgtgtctcaaagcccggtggctgaggagccaagttgggtgcccagcccaaggccacccgtcccgcacgaatcacccgagccccccagcgggcgatccttggtccagcgggatatccaggctttcctcaaccagtgtggtgctagcccgggggaagctcgccattggcttacacaattccaaacctgccatcactccgccgataaaccttttgccgtgattgaagtcgacgaggaggtgctaaaatgccagcaaggcgttagttctctggcattcgcgctcgcttttttgcagagaatggatatgaaaccgttggtggtactcgggctgcctgcacccaccgcaccctcggggtgtctaagcttctgggaagctaaggcacaattagccaagtcctgcaaagtgctggtggacgccttacggcacaacgctgccgccgccgttcccttctttggaggcggcagcgtgctaagggcggccgaacccgcgccacatgcatcatacggcggaatcgtgtccgttgaaaccgatctactgcagtggtgcctcgaatccggaagcatcccaatactgtgccctataggggagacagccgcaagacgaagcgtgcttcttgatagcttggaagtgaccgcaagcctggccaaggctctgcggcctacgaagatcatctttctcaataacacgggcggcctgcgtgactctagccacaaagtgctctcaaacgtgaatctgccagcagatctagatctggtctgtaacgctgagtgggtctccacaaaagagcggcagcagatgcggttaattgtagacgtgctctcaaggctgccccaccatagtagtgccgtgattaccgctgcgagcactctgttgacagaattgttctccaacaaagggagcgggactttgttcaagaacgccgagcggatgcttcgggtgaggtcgctggataagttagatcagggccggctggtcgaccttgtgaatgccagttttggtaaaaagctgcgggacgattacctggcctctctgcgtccccggttacactctatctacgtgtccgaaggatacaatgccgccgccattttgaccatggagcccgtgctcggggggacgccatatttggacaagtttgttgtgtctagttcccggcagggtcaggggagcgggcagatgttgtgggagtgtctgaggagggacttgcagacactgttctggcgttccagagtgaccaaccctatcaacccttggtactttaaacacagtgatggctcgttctccaataaacagtggatattcttctggtttggactcgctgacatccgggacagctatgaactggtgaatcacgcaaagggcctgcctgactcattccacaagccagccagtgacccaggtagc

SEQ ID NO: 17035 - DNA, 1602 bp, Artificial Sequence
  Description of Artificial Sequence: Synthetic coding sequence
atggcaactgcgcttatggccgttgtcctccgcgcggcggccgtggccccgcgactgagaggacgcggagggaccggaggcgcccgcagactgtcgtgtggcgcccggagacgcgcggcacggggtacttcgccgggacgccgactgtccactgcgtggtcacagcctcagcctccaccggaagagtacgccggagcggacgacgtgtcccaatcgcccgttgcggaagaaccgtcgtgggtgccgtccccaagaccccccgtcccgcacgagtcacctgaaccccctagtggacggtcgttggtccagagagacattcaggcctttctcaaccaatgtggtgcgtcccctggagaagcgcggcactggctgacccagttccagacttgccatcatagcgccgacaagccgtttgccgtcatcgaggtggacgaggaagtgctgaagtgccaacagggagtctcaagcctggcgttcgccttggcattcctgcagcggatggacatgaaacctttggtcgtgcttggactgccggccccaaccgccccttccgggtgcctctcattctgggaggcaaaggcacaactggccaagtcatgcaaagtcctcgtggatgcgctccgccacaacgccgctgctgccgtgccatttttcggaggaggatcggtgttgcgggccgcagaacctgccccacatgcttcatacggaggtatcgtgagcgtggaaaccgatctgctccagtggtgcctggagtcagggagcattccgatcctttgcccgatcggagagacggcggcgagacgctcggttctcctggactcgctggaggtcactgcatcactggccaaagccctgcgcccaaccaagatcattttcctcaacaatactggaggattgagggactcatcccataaagtcctgagcaacgtgaacctgccggctgacttggatctcgtctgtaacgcggaatgggtgagcactaaggaacgtcaacagatgcgcctcattgtggatgtgctgtcgcgtctgcctcaccattccagcgccgtgatcactgccgcgtcaactctcctgactgaactgttctcgaataaaggaagcggcacgctgttcaagaatgcagaacgcatgctgcgggtccggtcgctggacaagctggaccagggacgccttgtggacctcgtgaacgcctcatttgggaaaaagctgcgggacgattacctggcgtcccttaggcctaggctgcactcaatctacgtgtcggaaggttacaatgccgcagccatcttgactatggaacctgtccttggaggaaccccgtacttggataagttcgtggtcagttcgtctcggcaaggtcagggatcgggtcaaatgctgtgggaatgcctgcggagggacctgcaaactctgttttggcggtcgcgggtgactaacccgatcaacccttggtacttcaagcattcggatggctccttctcaaataagcagtggatcttcttctggttcggactcgcggacatccgggactcctacgagcttgtgaatcacgccaaggggttgcctgattcatttcacaagccagccagcgacccaggatca

SEQ ID NO: 17036 - DNA, 1602 bp, Artificial Sequence
  Description of Artificial Sequence: Synthetic coding sequence
atggctactgctctgatggctgtggtgctgagggcagccgccgtcgccccaaggctgcggggacgcggcggcacagggggggctcggcgcctttcatgtggtgctcgccggcgcgccgctcgcggcacctctccaggacgccgcctcagtacggcgtggtcacagcctcagccgcctcccgaggagtacgcaggagctgatgacgttagccagagtcctgtggccgaggagccttcatgggtgccctccccccggcccccagtgccacatgagtctcctgaacccccgtcaggacggagcctcgttcagagagatatccaggcattcctgaatcagtgcggggcaagtccaggcgaggctcgacactggttgacgcaatttcaaacctgccaccatagcgctgataagcctttcgccgtaatcgaagttgatgaggaggtgctcaagtgccagcagggagtttcgtctcttgcattcgctctggctttcctccaacgcatggacatgaagcctcttgtggtgctgggcctcccagccccgacggcaccttcgggatgcctctccttctgggaggctaaagctcaactagctaagtcatgtaaggtgctcgtggacgccctgcgtcataatgccgccgctgccgtcccattctttggaggtggcagcgtgttgagggctgcagagcccgctccacatgccagttatgggggtatagttagtgtagaaactgatcttttacagtggtgtttggagagtggcagcattcccatcctatgccctatcggcgagaccgccgccagacgctccgtcttgctggactcattagaggttaccgctagtttagcaaaggcgttaagacctacaaaaattatcttcttgaataacacgggaggtttgagagactccagccataaggtgctctcaaacgtgaatctgccggcagacttagatctggtctgcaacgctgagtgggtgagtactaaggagcgccagcagatgaggttgatagtggatgttctctccagactgccccaccattctagtgcagtcattacggcggctagcacactgctgactgagctcttcagtaacaagggctcagggacattgttcaagaatgcagagcgaatgttgcgtgttcggagcttagataaactggaccaggggcgacttgtagatctggtgaatgcatcatttggcaagaagttgcgcgatgattacttggcctcattacgacccaggctgcatagtatctatgttagcgagggctacaatgccgcagctatcctgactatggaaccagtactcgggggaacgccctatctcgataaattcgttgtgagcagctctaggcaggggcaaggaagcggccagatgctgtgggagtgtctgagaagagatctgcagacgttgttttggaggtcccgggtaaccaaccctatcaatccatggtatttcaagcacagtgatggttcattcagcaacaaacagtggatttttttctggtttggcctggctgatatcagagacagctacgaactggttaatcacgccaaggggctgcccgattcttttcacaagcctgctagcgaccccggaagc

SEQ ID NO: 17037 - DNA, 1602 bp, Artificial Sequence
  Description of Artificial Sequence: Synthetic coding sequence
atggcgactgctctgatggcagtggtactgcgggcagccgccgtcgccccccgtttgaggggtcgagggggaacaggaggggccaggcggctgagctgcggagccagacgccgcgccgcgcgtggaaccagccccgggcgcaggctctctaccgcatggagtcaaccccagccaccgcccgaggagtacgccggcgccgatgacgtgtcccagtcaccggtagctgaggaacctagctgggtaccttcgccccgcccgcccgtcccacacgaatctcccgaaccgccatctggacgctcgctcgtgcagagggacatccaggctttcctgaatcagtgcggtgcatcgcccggagaggctcgtcattggttgacccaattccagacctgtcaccatagtgcagacaagccctttgccgtgatcgaggtcgacgaggaagtcctgaaatgccaacagggagtctcgtctctggcgttcgctctggcgtttctgcaacgcatggacatgaagccgctggtggttttagggcttcccgccccaacagctccgtcaggctgtctcagtttttgggaggctaaagcccagctcgcgaaaagttgcaaggttttggttgatgccctgcgtcacaacgctgcagctgccgtccctttctttggcggcggcagcgttctgcgagctgccgaaccagctccacatgcatcctacggcggcatcgtttcagttgagacagatctgctgcagtggtgcctcgaatcgggtagcattccgattttgtgccccatcggggaaaccgccgccagaagaagcgtactcctggacagtctggaggtgacagccagcctggccaaagccctgcgtcccacaaagatcatttttctgaataacaccggaggactgcgagatagctcgcataaagtgctatcaaacgttaacctaccggctgacctcgatctcgtctgcaacgcggaatgggtttccacaaaggagaggcagcaaatgcgtctgattgtggatgtgttgtcgcggttgccacaccatagttcggctgttattactgccgcctcaaccctcttgacagagctgttttctaacaaaggatccggcaccctttttaagaacgccgagagaatgctgcgggtgagaagtttggacaagctggatcagggccgactggttgacctggttaacgcctcttttggcaagaagctgagagacgactaccttgccagcttaagaccaaggctgcactccatttatgtgtcagagggctacaacgcagcggctattctgactatggagccagtgctgggcggcacaccctatcttgacaaatttgtagttagctcttcccggcaaggccaagggagtggccaaatgttgtgggaatgcctgagacgggatctccagacgctcttctggcgatctcgggtgaccaacccgattaatccatggtacttcaagcactccgacggatctttcagtaataaacaatggatatttttttggttcggattagctgatatccgcgactcctatgagctcgtcaatcatgcgaaaggactgcccgactcatttcacaaacctgcaagcgaccccggatca

SEQ ID NO: 17038 - DNA, 1602 bp, Artificial Sequence
  Description of Artificial Sequence: Synthetic coding sequence
atggccacagccttgatggccgtggttctgcgggcagctgcggtggcgccaagactgcgggggagagggggtacaggcggcgcccgccgactgagctgtggcgctcgacgacgggccgccaggggtactagtcccggacgaagactctctaccgcttggtctcagccccagcctccccccgaggagtacgctggggccgatgacgtatctcaatctccagttgctgaggaaccgtcatgggtgccatccccgcgaccacctgtgccacacgaaagccccgagccacccagcggcagaagcctggtccaacgagacatccaggcatttctgaatcaatgtggcgcgagccccggtgaggcaaggcattggcttactcagttccagacctgccaccactcagctgacaaaccttttgctgtgatagaggtggatgaagaggttctgaagtgccagcagggcgttagcagcttggccttcgccctcgcctttctgcagcgcatggatatgaaaccactggtggtgctggggctgcctgcgccaacagcccctagtggatgcttgtctttctgggaagccaaggctcagctggcaaagagctgcaaggttcttgtagacgcattgaggcacaatgctgcggctgccgtgcccttctttggaggggggagtgtgcttagggccgccgaacctgccccacatgccagttatgggggaattgtgtctgttgaaacagatctcctccaatggtgtctggagagcggatcaattcctattttgtgccctattggggagactgcggctagaaggagcgtattgcttgactctctggaagtcactgcgagtctggccaaagcgctgcggcctaccaaaatcatcttcttgaacaacacaggcggcttgcgggacagttcccataaggtgctgagtaacgtgaacctgcccgctgacctggacttggtctgtaacgctgagtgggttagcacaaaggagagacaacagatgcggctgattgtggacgttctgagccggctgcctcaccacagcagcgctgtgattactgccgcctcaaccctgctgaccgagctgttctccaacaaagggagcggcacgcttttcaagaacgccgaaaggatgctcagagtgcggagcctggataaactcgatcaggggaggctcgtggacctggtgaacgcttcctttgggaagaagctgcgggacgactacctggctagcctgcgaccccgattgcactctatctatgtgagcgaaggttataacgccgcagctatcctgactatggagccagtgcttggaggcactccctatttggacaagttcgtggtgtcaagcagtcgacaaggacaaggaagcgggcaaatgttgtgggaatgccttaggagggacctgcagaccttgttttggagatcccgcgtcacaaacccgattaacccatggtactttaagcacagcgatggttctttctcaaacaaacagtggatctttttttggttcggtctggctgatattcgagacagctacgagcttgtcaaccatgcaaagggattgcccgactcctttcataaacccgccagcgacccgggctcc

SEQ ID NO: 17039 - DNA, 1602 bp, Artificial Sequence
  Description of Artificial Sequence: Synthetic coding sequence
atggccaccgcactaatggccgtggttctgagagccgctgctgtggctccacggctgcgcggccggggtggaactggaggagccaggagattaagctgtggtgccagaagacgtgccgccagagggacctcccctgggcgaaggctatcgaccgcgtggtctcaaccgcagcccccccccgaggaatacgcgggcgccgacgatgtttctcagtcaccggttgcagaggagccatcgtgggttcctagccccagaccaccagtgccccacgagtccccagagccccctagtggccgctcgctggttcagagggatattcaggccttcctgaatcagtgtggcgcatctcctggggaggccagacactggcttactcagtttcaaacctgtcaccactctgctgacaagccattcgcggttatagaggttgatgaggaagtactgaagtgccagcaaggtgtctccagcctagcctttgctttagcgtttctccagcgaatggatatgaagcccttagtggttctggggctgcccgcgcccacggccccctcagggtgtttgagcttttgggaagcaaaggcccaacttgcaaaatcatgtaaagtgttggtagacgccctgaggcacaacgcagccgccgctgtgccgttctttgggggcggtagtgtgcttagagccgcggagcctgcgccacacgcctcttatggaggcattgtcagcgttgaaacggatctcctacagtggtgcctggaaagtggatcaatccccattttatgcccaatcggcgaaacagcagccagacgatccgtgcttctcgactcattggaagtcaccgcctcccttgccaaggcgcttagacctaccaaaatcatctttctgaacaatactgggggcctgcgcgattcatctcacaaggtcctctctaatgttaatttgcccgcggatctggatctggtgtgtaacgcggagtgggtttcaactaaagagcggcaacagatgcgcctgattgtggatgtactctcacggctccctcatcacagcagcgcagtcattaccgccgcctccactttgctcacagagctctttagcaataaaggaagcgggactctctttaaaaacgcagagaggatgctgcgggtgagatccctggataaactggatcagggtaggctggtggacctcgtgaatgccagctttgggaaaaagctccgtgatgactacttggctagcctgcgcccgaggcttcactccatatatgtttctgaaggatataacgcagctgctatactaactatggagccagtgctaggaggcacgccctacttggacaaattcgttgtttcctcctccagacaagggcagggctccgggcaaatgttgtgggaatgtctgcggcgggacctgcaaactttgttctggaggtcccgggtgacgaacccaattaacccttggtacttcaaacatagtgacggcagttttagtaataagcagtggatttttttttggttcggcctggcggacatccgggattcctatgaacttgtaaaccatgctaaagggctcccggactcattccacaagcctgcatccgaccctggttcc

SEQ ID NO: 17040 - DNA, 1602 bp, Artificial Sequence
  Description of Artificial Sequence: Synthetic coding sequence
atggcaacggcactgatggccgttgtgcttagggccgctgccgtggcccccagactccgcggtaggggcggtactggaggcgccaggcgactgtcttgcggggccaggagacgcgctgcacgaggaaccagtcccggtcggagactctcaacagcatggtctcagccacagcccccgcccgaagagtacgccggggccgacgacgtatcacagagtccggtggctgaagaaccgtcttgggtacctagcccccggcctcctgtgccccatgagagtcccgagccaccttccggcagaagcctggtgcagcgcgacattcaggctttcctgaaccagtgtggggcctcaccaggcgaagctagacattggctgacccaatttcagacttgtcaccatagcgctgataagccatttgccgtgatcgaggttgacgaggaggtgctgaagtgtcagcagggtgtgtcttccctggcctttgcactcgcgttcctgcaacgcatggatatgaaacctcttgtagtgctgggcctgccagctcctacggctccaagcggttgcctgtcattttgggaggccaaagcccagctggcaaagtcttgcaaggtcctcgtagatgccttgcgccacaatgctgcggcagccgttccattctttggcggcgggtctgtcctgcgagccgccgagcccgctcctcacgccagctatggggggatagtgtctgtcgagacagacttgctgcagtggtgtctcgaaagcggttccattcccattctgtgccctataggagagacggcagcccggaggtctgttctgctcgactctcttgaagttaccgcctcccttgccaaggctctcagacctactaaaatcatcttccttaataataccggaggcctcagagattctagtcacaaggtgctttcaaacgtcaatcttccagccgacctggatctggtgtgtaatgccgagtgggtgagcacaaaggagaggcagcagatgaggctcattgtggacgtgctctcaaggctccctcatcatagtagtgctgtgataactgcggcaagcaccctcttgacggagctcttctccaacaagggctcaggaaccctctttaagaacgccgaaagaatgctgcgggtgcgatcactggacaagctggaccaagggaggctcgtcgatctcgtgaatgcttctttcggtaagaagctcagggacgactatctcgctagtttgcgacctagactgcactccatctacgtctctgaggggtacaatgcagctgcaatcctgacgatggaaccggtgctgggaggtacaccatatctcgacaagtttgttgtgagcagctcccggcagggccaggggtcaggccagatgttgtgggagtgcctgaggagagacctccagacacttttctggaggagcagggtgacaaacccaattaatccctggtattttaaacattctgatgggagctttagtaataaacaatggatattcttttggttcgggctggccgatattagggattcttacgaactggtgaatcatgctaaaggcctccctgattcctttcataaacccgctagcgatcctggctcc

SEQ ID NO: 17041 - DNA, 1602 bp, Artificial Sequence
  Description of Artificial Sequence: Synthetic coding sequence
atggcaactgcactgatggctgtcgtcctgcgtgcggccgccgtggccccccggctaagagggcggggagggaccggcggcgcccggcgattgagctgcggggccagacgcagggccgcgagaggaacttcccccggacgacgactgtccactgcctggtcacagccacagcccccccctgaggagtacgcgggggccgacgatgtctctcagtcccctgttgctgaagagccttcttgggtgccttctccccgaccccctgtgcctcatgaatcaccagagcctcctagtggacgctccctggtgcaaagggatatccaggcgtttctgaatcagtgtggagcctcgcccggggaggcgcggcactggctgacacagttccagacctgccaccacagcgccgacaaaccctttgctgtcatcgaggtggatgaggaggtgctgaaatgccaacagggtgtctcttcactggcctttgcgttggccttcctgcagcgcatggacatgaaacctcttgtggtgctgggactgccggcaccaaccgctcccagcgggtgtctatcattttgggaagccaaagcgcagcttgccaagtcatgtaaggtcctcgtggacgcactgcgacataatgccgctgccgcagtcccattcttcggcggaggatctgtgctgcgcgcggccgaaccggccccccatgccagttacggaggtattgtatccgtagagacggatttgcttcaatggtgcctcgagagcggtagcattccgatcctgtgtccaattggcgagacggcggcacgccgttctgtactgctggactctttggaggttaccgcttcgctggccaaggcactccgccctaccaagattatcttcttgaacaacacagggggcctccgggattcttcgcacaaggttctgtcaaacgtgaatctgcctgccgacctggatctcgtgtgcaatgccgagtgggttagcacaaaagagcgtcagcagatgcggctgatcgtcgatgtgctcagccggctgccgcaccactcaagcgccgtgattacagcggcctctaccttactgaccgagctgttttccaacaagggatcaggtacactgtttaagaatgcggagcggatgctaagggtgcgttctctagataagctagatcaaggccgtttagttgatctcgtaaatgctagtttcggaaagaagcttcgtgatgactacctagccagcctccgcccgagactgcattcaatttacgtgtctgaaggttataatgcggcggctatcttgactatggaacctgtgttaggggggacaccctacttggacaaattcgtggtcagcagcagccggcagggtcaggggtccgggcagatgctttgggaatgccttagacgagatctccagaccctgttttggcgatctcgggttacaaatcccatcaacccatggtattttaaacacagcgacgggtctttttctaataaacagtggattttcttttggtttggactagcagacatcagggattcttatgagttggttaaccacgctaaaggactccccgatagttttcacaagcccgcgtcagatcccgggtcg

SEQ ID NO: 17042 - DNA, 1602 bp, Artificial Sequence
  Description of Artificial Sequence: Synthetic coding sequence
atggcgactgctctcatggccgtggttctccgtgctgcggctgtagcaccacgcctgagaggacgaggtggtacaggcggcgcacggagattgagctgtggcgccaggcgccgtgctgcgcgaggaacgtccccaggacgcaggctcagtacagcctggtcacaaccccagccgcctcccgaagaatacgctggcgccgatgatgttagccaatcccccgtcgcagaagaaccctcttgggtcccgtctccgcgacctcctgtgccacacgaatctcccgaaccacccagcggcagatctctcgttcagcgggatattcaggccttcctgaaccagtgcggggcctcccccggcgaagcccgccactggctcactcagttccagacctgccatcactccgcggacaaacccttcgctgtgattgaagtggacgaggaagtactgaagtgtcagcagggcgtctcctctctggcattcgccctggctttcctgcagaggatggacatgaagcctctagtggtgctaggtctgcccgctccgacagcgccgagcggatgcctttctttctgggaggcaaaagctcaattagcaaaatcctgtaaagtgttggttgacgccttaaggcataacgccgccgccgcagtgccattttttggcggcggcagtgtactccgcgcggcagaacccgcccctcacgcatcttatggaggcatcgttagcgttgaaacagacctactgcaatggtgtttagagagcgggagtattccgatcctgtgtcccatcggtgagaccgctgcacgacggagtgtgttgctggattcattagaggtcacagccagtctggcaaaggcgctccgaccaacgaagatcattttcctgaacaataccggaggtctgcgggactctagccataaagtcttgagtaacgtaaatctgcccgctgacctggacctcgtatgcaacgcggagtgggtctcgactaaggaaaggcaacaaatgaggctgatagttgatgttctctcacgcctacctcaccacagttccgccgtcattacagccgcctcgactttgttaaccgaactgttctccaacaaagggtcaggcacgctcttcaagaatgccgagagaatgctgcgagtgcgctcactggataagcttgaccagggtcgcctcgtcgacctggtcaatgcatcatttggaaaaaaactgcgggacgattatcttgcatcactacggcccagactacacagtatttatgtctcggaggggtataatgcagccgccattttgaccatggagcccgttctaggggggaccccttatttggataaatttgttgtatcaagttcgaggcagggtcaggggtctggtcaaatgctgtgggagtgtctgaggagagatctgcagaccttgttttggcgcagtagggtcaccaaccctatcaatccttggtatttcaagcactctgacgggtcgttcagtaataaacagtggatctttttttggttcggactggccgatatacgcgactcctatgagctggttaatcacgctaaaggcttgcccgatagtttccataaaccggcctcagatcctggctca

SEQ ID NO: 17043 - DNA, 1602 bp, Artificial Sequence
  Description of Artificial Sequence: Synthetic coding sequence
atggcgactgcgttgatggcggtggtgctgcgcgccgccgctgtcgcaccccgtctcaggggtcgcggcggcacagggggagcccgtcggcttagttgcggagctcgtagacgcgcggctcgcggcacctctcctggtcggcggctcagcactgcctggagtcagccacagccacccccagaggagtacgctggagctgacgacgtcagccagtctcctgttgccgaagagccgtcctgggtcccttccccccgtccgccagtccctcacgagagccctgagccccccagcggccgctcccttgtccaacgggacattcaggccttcctcaaccagtgtggcgcatcgccgggagaagctcgccactggctgacccagtttcagacctgtcatcacagtgcggacaagccgtttgcagtaattgaggtcgacgaagaggtcctaaagtgccaacagggtgtttcttccttggcattcgccctggctttcttgcagcgcatggacatgaagcccctcgtcgtcctcggcctccccgcgccgaccgccccctcgggctgcctgtctttctgggaggccaaggcccagctcgccaagtcgtgcaaggtcctcgtggatgcgctgaggcacaatgccgccgccgccgtccctttctttggtgggggatctgtgctgcgcgccgcggagccggccccgcacgcttcctacggtggtatcgtgtccgtcgaaactgatctgctgcagtggtgcctcgaatctggctccatccctatcctctgccccattggcgagaccgcggctcgtcgctccgtgctgctcgattcacttgaagttaccgccagcctggccaaggctttgcgccccaccaagatcatctttctcaacaataccggcggcttgcgcgactcatcccataaagtgctctccaacgttaacctccctgctgaccttgatttagtctgcaacgcagagtgggtgtcgactaaggagcgtcagcaaatgcgtctgatcgtcgacgtactgagcaggctgcctcatcattcttccgccgtaatcaccgccgcctcgaccctccttaccgagctgttctcaaacaagggctccggtaccctgttcaagaatgccgaacgcatgctccgggtgcgttccctggacaaactcgatcaagggcggctggtcgatttagttaacgcctccttcggcaagaagttgcgtgatgattacctcgcctcgctccgcccccgcctgcactcgatttacgtgtctgaaggatacaacgcggctgccatactcactatggaaccggtgctggggggtactccctatctggacaagttcgtcgtaagttctagccggcaagggcagggatccggccagatgctttgggagtgtctcagacgtgacctccaaaccttattctggagatcccgtgtcactaatccaatcaacccgtggtactttaagcattccgacggcagtttctccaacaagcagtggatcttcttttggttcggcctggcagatattcgtgattcgtatgagctggtcaatcatgccaagggcctgcctgactcatttcataagcccgcaagcgaccctgggtcc

SEQ ID NO: 17044 - DNA, 1602 bp, Artificial Sequence
  Description of Artificial Sequence: Synthetic coding sequence
atggcaaccgcactgatggcagtggtgctgcgcgcggcagccgtggcaccgagactgcggggacgcgggggcaccggcggtgccagacgcctctcgtgtggcgcaagaagaagagctgcgagaggaacttcgccaggccgccgcctgtcgactgcctggagccaaccgcagccacccccagaagaatacgcaggagcggacgatgtgagccagtcccctgtggctgaggaaccaagctgggtcccctccccaagacctcctgtgccacatgagagccctgagcccccttcaggaagatcacttgtacaacgcgatattcaagcatttctgaatcagtgcggcgcgtccccaggtgaagcgaggcattggcttactcagtttcaaacctgccatcattccgcagacaagccgtttgctgtgattgaagtggacgaagaagtcctgaagtgtcagcagggcgtctcgtccctggcatttgctcttgcctttcttcagcgaatggacatgaaacctcttgtcgtgctcggacttcctgcaccaactgctccatccgggtgcctgagcttttgggaggccaaagcgcagcttgccaaatcatgtaaagtgctggtcgatgcactgcgccacaacgcggccgccgccgtcccatttttcgggggaggctcggtcctcagagcagcagagcctgcaccccatgcgtcgtacggcggaatagtgagcgtggaaaccgatctgctgcaatggtgtctcgagagcggctctatacctatcctctgccctattggtgaaacggcggcaaggcgatccgtccttcttgatagcctggaagtcaccgcaagcctggccaaggcactccgacccaccaagattatcttccttaacaacaccggtggacttagggattcctctcacaaagtcctcagcaacgtgaacctcccagcagaccttgacctcgtgtgtaacgcagaatgggtgagcacgaaggagagacaacaaatgcggcttattgtcgatgtgctctcgcgcttgccccatcatagctccgcagtgatcaccgcggcctcaaccctcctgactgaactgttttcgaataagggatcggggactctctttaagaacgcggaaagaatgcttcgggtccgatcccttgacaagctggatcaaggacgtcttgtggatttggtcaacgccagcttcggaaaaaagttgagagatgactatctcgctagccttaggccgagactccattctatctatgtgagcgagggttacaacgcggctgcaattcttactatggagcctgttctgggaggtaccccttacctcgataagttcgtggtgtcgtctagccggcaaggacaaggttccggtcagatgctctgggaatgtttgcgtcgagacttgcagacgctgttttggcgcagccgtgtgactaaccctattaacccatggtactttaaacactcagacggctcgttcagcaacaagcaatggattttcttctggttcggacttgcagatatcagagattcttacgagcttgtgaaccatgcaaaggggctgcccgattcctttcataagccagcatccgacccaggttcg

SEQ ID NO: 17045 - DNA, 1602 bp, Artificial Sequence
  Description of Artificial Sequence: Synthetic coding sequence
atggctaccgccctgatggccgtggtgcttagagcagcagcagtggcccctcggctgcgcggcagaggtggcaccggaggcgcaaggagactgtcctgtggtgctcggcgccgcgctgcacggggcacttcccccggtaggcggctctcaacagcatggtcacagccccagccaccacccgaagagtatgccggcgcggatgatgtatcgcagagtcctgtggcagaagagccctcctgggtgccttcgccccgtcctcctgtgcctcacgagagtccagagccaccatctggccggagcctcgttcagcgtgatatccaagccttccttaaccagtgcggcgcctcccctggtgaggccaggcactggctaactcaatttcagacctgccaccattccgcagacaagccgttcgccgtgatcgaggtcgatgaggaggtgttaaagtgtcagcagggggtctcctccttagcgttcgccctagcgtttctgcaaagaatggatatgaagcctctcgtggtgttagggttaccagcccccacagctcccagtggctgtctcagtttttgggaggctaaagctcagctcgctaaatcctgcaaagtgcttgtggacgcgttaagacacaacgcagccgcagctgttccgttcttcggcgggggctcagtgctgagggccgccgaaccagctccccacgcgagttatggtgggatcgtcagcgtggagaccgatctcctgcaatggtgcttagagagcggaagcatcccgatcctgtgcccaatcggcgaaacagcggcgaggagatcagtcctgctggactcgctggaggtcaccgcgtcgttggcgaaggctctacgtcctactaaaatcattttcctgaacaacacaggaggattgcgcgacagctcccacaaggtactcagcaacgtaaacttgcctgccgatctcgatctggtatgtaacgccgaatgggtgagcacgaaggagcgtcaacagatgcggctaatcgtggatgtgctctcccgcttaccccatcactcgtcagcagtgattacagcagcaagtacattactgactgagctgttcagtaataagggcagcgggaccctatttaagaacgcagagaggatgttgcgcgtaaggagtcttgataagttggatcagggaagactcgtcgatctggtgaacgcaagctttgggaagaaactacgagatgactatctcgctagcctgaggccgagacttcacagcatttatgtgtccgaaggctacaatgccgccgctattttgaccatggagcccgtattgggcggtaccccgtacctcgacaagtttgtcgtgagtagctcccggcaggggcagggctcagggcagatgctgtgggagtgccttcgtcgggacttgcagacacttttttggcggagtcgagtcacgaaccctattaacccgtggtattttaagcattcggatgggtccttctccaacaagcagtggatatttttttggtttggcctggctgatatcagagattcatacgaactggtcaaccatgctaaaggtctacccgactctttccacaagccggcttcggaccctggctca

SEQ ID NO: 17046 - DNA, 1602 bp, Artificial Sequence
  Description of Artificial Sequence: Synthetic coding sequence
atggccaccgcgctgatggcagtggtgcttcgggccgctgcagtggcaccgcggctgcggggacgtggaggaacgggtggggctcgccggctgtcatgcggagcccgccggcgcgcagccagagggacctccccagggagacgtctctccactgcctggtcgcagccccagccgccgccagaagagtacgcaggcgctgacgacgtctcacagtccccggtggccgaagagccttcctgggtgccgagcccccgcccgcccgtgccacacgagtcacctgagccgccgagcggccgcagcctcgtccagcgggatatccaggcttttctgaatcagtgcggtgcatcgccaggtgaagcgagacactggctcactcaattccaaacttgccaccacagcgcggacaagccatttgctgtgatcgaagtcgatgaggaggtgctgaagtgtcagcaaggggtttcatcactggcgttcgcattggcgttcctgcaacgcatggatatgaagcccctggtggtcctcggattgccggccccaactgctccatcaggatgcctctcgttctgggaagcaaaagcgcaactcgcgaagtcatgtaaggtcctcgtcgacgcgttgcgccataacgcagccgcagccgtgccgtttttcggagggggaagcgtgctgcgcgcggccgaacccgctccgcatgcgtcgtacggcggaattgtgagcgtcgagactgatttgctccagtggtgtttggaatcgggatcgattccgatcctctgtccgatcggagaaacggccgcccggcgctccgtcctgctggactcgctggaagtgaccgcctccctcgcaaaagcgcttagaccaaccaaaatcatcttcctcaacaacacgggcggactgagagactcgtctcataaggtgctctccaacgtgaacctcccggccgatctcgacctggtgtgtaacgccgaatgggtatccactaaggagcggcaacagatgcgcctgatcgtggacgtgttgtcgaggttgccgcatcattcgtccgccgtcatcactgcggcctccacgctgctgaccgaattgttctcaaacaagggtagcgggaccttgtttaagaatgccgaacgcatgctgcgggtgagatccctggataagctggatcaaggtagactggtggacctggtgaacgcctctttcggaaagaaactgcgcgatgattatctggccagtctccggccacggctccactcaatctacgtctcggagggttacaacgcagcggccatcctgactatggagcccgtcctgggcgggactccttacctggacaaatttgtggtatcatcctcccgccaggggcaggggtcgggccagatgctgtgggaatgcctgcggagagatctccaaaccctgttttggcgatcgagagtcaccaatccgattaacccttggtacttcaagcactctgacggatcattttccaacaaacagtggatctttttctggtttggactggccgacatcagagattcatacgagcttgtgaatcacgcaaagggacttccggacagcttccacaagccagcctccgaccctgggtca

SEQ ID NO: 17047 - DNA, 1602 bp, Artificial Sequence
  Description of Artificial Sequence: Synthetic coding sequence
atggccactgcccttatggcggtggtgttgcgtgcagccgccgtggctcctaggctacgaggccgcggcggaaccggcggtgcccggcgcctgtcttgcggggcacgtcgccgggccgccaggggaactagcccaggcaggcgcctgagcacagcgtggtcgcagccccaacctccgccagaggaatatgctggtgcagatgatgtgagccagtctcctgttgcagaggagcccagctgggttccaagcccccggcccccagtgcctcatgagagcccagaacctccctcaggccggtctctcgtgcagcgggacatacaagcatttctcaaccaatgtggagcctcccctggagaagcccggcactggctcacacagttccagacatgccatcactcagccgacaaacccttcgccgtaatagaagtagacgaggaagtgctgaagtgccaacaaggggtgtcaagcctggcgtttgcactggccttcctacagaggatggacatgaagcctttagtagttctgggcctgcctgctccaaccgccccttctggatgtcttagcttctgggaagcaaaggctcaactcgcaaagtcatgcaaggtcttggtggacgcacttcgccacaatgccgccgccgccgtgccattcttcggcggtgggagtgtcctccgagcagcagaaccagcaccccacgcttcatatggcggcattgtgtcagttgaaaccgacctcctgcagtggtgtctggagagtggaagcatccctatactgtgccccataggagaaaccgccgcccgccgctctgttctgctcgattctctggaggtgacagctagcctcgctaaggcccttcgccccactaagatcatttttttgaacaacactggtggccttcgcgatagctcccacaaagtattgagtaatgtcaacctccctgcagacctggacctcgtgtgtaacgccgagtgggtctctactaaggaacgccaacagatgcgactgattgtggacgtcctgtctcgacttccccatcactcatctgcggttatcacagccgccagtacacttctgacagagctgttcagcaacaaagggtcaggaaccctgtttaagaacgccgaacgaatgttaagggtcaggagcttggataaactggaccagggacgcctggtggatctcgtcaatgcctctttcgggaaaaagctgagagatgattacctggcatctcttaggcctcgattgcatagtatctacgtaagtgaaggatacaacgccgcggctatcctcaccatggaacccgtcttaggcggtacaccctatttagataaattcgtagtatcttcgtccagacaggggcagggcagcggccagatgctttgggaatgcctccgcagagatctgcagaccctcttttggcgttccagagtaacaaaccccatcaatccatggtattttaaacatagcgatgggagttttagcaataaacagtggatttttttctggtttggcctggcggacattcgcgactcctacgaattggtcaaccacgcgaaaggcctgcctgattctttccataaaccagcgtctgatcccgggagc

SEQ ID NO: 17048 - DNA, 1602 bp, Artificial Sequence
  Description of Artificial Sequence: Synthetic coding sequence
atggctactgcgctgatggcagtggtgctcagagccgcagccgtggcacccagactgagagggcgaggcggtactgggggggcgcggagactcagctgtggagctcgaaggcgcgcagcccggggtactagcccgggccggcgcctgagcaccgcatggagtcagccacagccccctccggaggaatacgccggagcagacgacgttagccagtcccctgtagctgaggaacctagctgggtgccctctccaaggccaccagttccacacgaaagccctgagcctccttccggtcgatccctggtgcagagagatatccaggcttttttgaatcagtgtggggcctccccgggcgaggctagacactggctgacacagtttcaaacatgccaccactcagctgataagcccttcgccgtgatcgaagtggatgaagaggtgctcaaatgtcagcagggagtgtcttctctcgcattcgccctcgccttcttgcagcgaatggacatgaagcctctggttgttctgggcttgcccgcgccgactgcaccttccggctgcctgtctttctgggaagctaaggcacagctggccaaatcctgcaaggtgcttgtcgatgccctgcggcacaacgctgccgctgctgtaccattcttcggaggcggcagcgtcttgagagccgccgagccggctcctcacgcttcatacggtggcatagtgagcgtggaaacggatttgctgcaatggtgcctcgaatcagggtcaatccctatcctctgccctattggcgagacggccgcacgccgatccgtcctcctggatagcctggaggtgacggcgtcactggctaaggcactccgccccaccaaaatcattttccttaacaatactggcggtctgagggacagttctcacaaggtcttgtccaacgtgaatttgccagccgaccttgacctggtttgcaacgcagaatgggtcagcactaaggaaaggcagcaaatgaggctgattgtggacgtccttagtcgactgccccatcatagctcagcagtgataacggcagctagtacactgctgacagagcttttttctaataaagggagcgggacactcttcaagaacgccgaaaggatgctgcgggtccgcagtctcgacaaactggaccagggcaggctggttgacttggtcaacgcgagtttcggcaagaaactgcgggatgattaccttgcctccttgcgcccccggctgcacagcatttacgtctctgagggatacaatgccgccgctattcttaccatggaacctgttttgggaggtaccccctacctcgataagttcgtggtaagctcttccagacagggccagggctcagggcaaatgctgtgggagtgcctccgcagggatctgcagacattgttttggcgaagccgggtgacaaatcccatcaacccctggtatttcaagcactctgacggaagcttctccaataaacagtggatttttttctggttcggcctggccgatattagggacagctacgagcttgtaaatcacgctaaagggctccctgactcttttcacaaacccgcttctgaccccggatct

SEQ ID NO: 17049 - DNA, 1602 bp, Artificial Sequence
  Description of Artificial Sequence: Synthetic coding sequence
atggcaacggcccttatggctgtcgttctgcgcgctgccgctgtcgcgccgcgtctgagagggcgcggtggaaccgggggagcgcggcggctctcttgcggcgcacggagaagggctgctagaggtacgtcacctggccgaagattaagcacagcctggtctcaacctcaaccgccaccagaggaatacgcaggcgctgatgatgtatctcaaagcccagttgcagaagaaccgagctgggttccgtcaccgcgtccgccggtccctcacgaaagcccggagccaccttcaggccgcagcttggtacaacgggatatccaagcgttcctcaaccaatgcggtgcatccccgggagaagcgagacattggttgacgcaatttcaaacctgccaccatagcgcggataagccgttcgcggtaattgaagtagatgaagaggtgctgaaatgccagcaaggtgtatcatcattggcgtttgcgcttgcgtttctacaacgcatggacatgaagccgctggtcgtgctaggtttgccggcaccgacggcgccgtcaggctgtctttcattttgggaagcaaaagcccagctagccaaaagctgcaaggtcctggtagatgccttacgtcataatgcagcagccgcggtcccgttctttggaggtggaagtgtccttcgcgctgcggaacctgctccgcacgcatcgtatggcggaatcgtctccgtagaaacagatttacttcagtggtgcctggagagcggtagcattccaattctatgtccgataggagaaactgccgcaagacgttctgttctgcttgactcactggaagtcacggcttcattagctaaagcacttcggccaacaaaaattatctttttaaacaacacagggggccttcgtgattccagccacaaagtcttgtcaaatgttaacctacctgccgacctagacctggtgtgcaatgccgaatgggtatctaccaaagagcgtcagcaaatgcgcctgattgttgatgtactctcacgcctgcctcaccattcatctgccgtaattacagcagcaagcacattacttacagaactatttagcaataagggttctggtacgctttttaaaaacgccgagcggatgctgagagtccgatctcttgataagttagatcaaggaagacttgttgacctagtcaatgcaagctttggaaaaaaactgcgggatgactatctcgcatcgttaagaccgcgcttgcatagcatttatgtctcggagggttataatgcagctgctatcctcaccatggaacctgtacttggaggcactccttatcttgacaagttcgtagtttctagctctagacaaggtcagggcagcggtcagatgttgtgggaatgtcttcgtcgtgacttacaaaccctgttctggcgtagccgtgtgacaaatccaattaatccgtggtactttaaacattctgatgggtctttttctaataaacagtggatttttttttggtttggacttgcagatatccgcgatagctacgagcttgtcaaccatgcgaaaggacttcctgattctttccataaacctgcttctgatccgggttct

SEQ ID NO: 17050 - DNA, 1602 bp, Artificial Sequence
  Description of Artificial Sequence: Synthetic coding sequence
atggctacagctttaatggccgttgtgctcagggctgccgccgtcgccccccggctgagggggaggggaggaaccggcggagcaagacgtctttcctgcggcgctaggagacgggccgccagggggacaagcccaggaaggcgcttatccaccgcatggagtcagcctcagcctccgcctgaggaatacgcaggcgccgatgacgtgagccagagtcccgtggctgaggagccaagctgggtgccgtccccacggcccccagtgccacacgagtctcctgagcccccttccggaaggtctctggtgcagagggacattcaggcatttctgaaccagtgcggagctagcccaggtgaggctaggcactggttgacccagtttcagacttgccaccatagcgcagacaaaccgttcgcagtgattgaagtcgacgaggaggtgctcaagtgtcagcaaggtgtgtctagtctggctttcgccctcgccttcctgcaaaggatggacatgaagcctctcgtagtcttgggactgcccgcgcccactgctccgagcggctgcctgtctttctgggaggcaaaagctcaactggcaaaaagctgcaaggtcttggtcgatgcactgcggcacaacgctgcagcagctgtgccttttttcggaggtggcagcgtgctgagagctgcagaaccagctccgcatgcaagctatggcggaatagttagcgtggagactgacctgttgcagtggtgcctggagagcggttctatcccaattttgtgtcctatcggagagacggctgctagaagatccgtgcttctcgactccctggaagttaccgcatctctggccaaggcgttacgccccacaaaaatcattttcctcaataacactggtggcctgagagattcatcacataaagtcctctctaatgtcaacttgccagcagatctcgatctggtgtgcaacgctgagtgggtcagtactaaggaaagacagcaaatgcgactgattgtggacgtcctgagccgattgccacaccatagtagtgcagtgataacagcagctagtactctgttgacagagctgttttctaataagggcagcggtacacttttcaagaacgctgaacgcatgctgcgcgtgcgcagcctggacaagctagaccaaggccggctggtggaccttgtcaacgcttctttcggaaaaaagctcagggatgattaccttgcctcattgcggcctagacttcacagcatctatgtgagtgagggatataatgccgcggcgatcctgactatggagcccgtcctgggtggaaccccatacctagataaatttgtggttagttccagcaggcaaggccagggctctggccagatgttgtgggaatgcttaaggagagatctgcagacactgttctggaggagccgcgtgaccaatccaattaacccctggtatttcaaacatagcgatgggagcttttctaacaagcaatggatcttcttttggttcggccttgcggatatcagggattcctacgagttagtcaaccacgcaaagggattgccggactcttttcacaagcctgccagcgacccaggcagc

SEQ ID NO: 17051 - DNA, 1602 bp, Artificial Sequence
  Description of Artificial Sequence: Synthetic coding sequence
atggccacagccctgatggccgttgtgcttagggctgctgccgtggcaccaaggcttcggggaagggggggaaccggcggcgccaggcggttgtcatgcggtgctcgaaggcgcgccgctcgtggtaccagccccggtaggaggctgagtactgcttggagtcagccgcaaccgccccccgaggaatatgccggagctgacgacgtcagtcaatcccctgttgcagaagaacctagctgggtcccttcaccaagaccaccagtgcctcatgagagcccagagcccccttcgggccgaagcctcgtgcaaagagacatccaggcatttcttaaccagtgcggtgctagtccaggggaggcccgacattggctgacccagtttcaaacatgccatcatagcgctgacaaaccatttgctgtcatcgaggttgacgaagaggtgcttaaatgtcaacaaggcgtgagctctctcgcttttgcacttgccttcctgcaaaggatggatatgaaaccattggtagtcttgggcctgcctgcaccaacggctccatcaggttgtctgtccttttgggaagcgaaagcacagctggccaagagctgcaaggtcctcgtagacgctctgaggcacaacgctgccgcggctgtgccttttttcgggggaggttctgtgctgagagccgctgaaccagcaccccacgcctcctatggagggatcgtctctgtggagactgatttgctccaatggtgcctggaatccggaagcattccaatactctgccccatcggagaaaccgcagcacgccgctcagtgttgttggactctctggaagttactgctagccttgcgaaagcactccgtcctacgaagattatctttcttaacaacacgggaggcctcagggattcaagccacaaggtgttgagcaacgttaacctccctgctgatctggacctcgtgtgcaatgcagagtgggtgagtactaaggagagacaacagatgagactgatcgtcgatgtgcttagccggctcccccatcacagttcagccgtgattaccgcggcctctacactgcttactgaactgttttccaacaagggatcagggacactgtttaaaaatgcagagcgcatgctgagagtccggtccctggataaactcgaccagggacggttggttgatctggtcaacgcaagcttcggaaaaaagctgagggatgattacctggcctcactgagaccacggctgcacagcatttacgtcagcgagggctataatgctgcagccatcctgactatggaaccagttttaggaggaactccttacctggacaagtttgtagtgagcagctctaggcagggacagggcagcgggcaaatgctgtgggaatgccttagacgggatctgcagaccctgttttggaggtctagagtgacgaatcccatcaatccatggtatttcaaacatagtgatggcagctttagcaacaaacaatggatctttttctggttcggccttgcagatatccgggattcttatgaactggtgaatcatgccaaggggcttcccgactcatttcacaaaccagctagcgaccctggctca

SEQ ID NO: 17052 - DNA, 1602 bp, Artificial Sequence
  Description of Artificial Sequence: Synthetic coding sequence
atggccactgcgcttatggcggtggtccttcgggcggccgccgttgcacctcgcctgcgaggacgtggaggaactggcggtgcgagaaggctgtcatgtggtgctcggagaagagcagccagaggaacttcgccaggtcggcggctttcgactgcatggtcacaacctcaacctccacccgaagaatatgctggggcagatgatgtgtcgcaatcgccagtcgccgaagaaccctcttgggtgccgtcgccaaggccaccggtgcctcatgagtcccctgagcctccttccggaagatcattggtccagcgtgatatccaagccttcttgaaccagtgtggtgcgagccctggagaagcccgccattggcttactcagttccagacctgtcatcattccgccgataagccatttgcggtgatagaagtggacgaagaggtcctgaagtgtcaacaaggcgtgagctcgttggcctttgcgctggcgttcctgcagcgcatggacatgaagccgctggtggtcttgggtctgcctgcccccactgcaccatcgggatgtctttcgttttgggaagcaaaggcgcagcttgcaaaatcgtgtaaggtcctggtcgatgctctccgccacaacgctgcagcggcagtgccttttttcgggggcggatcagtccttagagctgctgagcctgcaccgcacgcaagctacggaggaattgtgtccgtggagactgaccttctccagtggtgtcttgaatcggggagcattcctatcctttgtccaattggtgaaaccgcagctcgacggagcgtgttgcttgatagcctcgaagtgactgcttccctggccaaagcgctcagaccaactaagattatcttcctgaacaataccggcggtctgagagacagctcacacaaagtcctttcaaacgtgaatctgccggccgacctggaccttgtctgtaatgcagagtgggtgagcaccaaagaacgccagcagatgaggttgatcgtcgacgtgctctcgaggcttcctcatcattccagcgccgtgattacggcagcctccactcttctcactgagctgttctcgaataaaggttccggaacgctctttaagaatgcagaaaggatgcttagagtgagatcgctcgacaaacttgaccaaggtcgactcgtggatctggtgaacgcctcatttggtaaaaagctgcgagatgattaccttgcgtcgcttcggccccggctgcattcgatttatgtgagcgaagggtacaacgcagcagccatcctcaccatggagcctgtgctcggtggcactccatacctggacaagtttgtggtgtcatccagccgtcaggggcagggttccggacagatgctgtgggaatgcctgcgtagagatctgcaaactcttttctggaggtcgcgggtcaccaacccaatcaatccgtggtactttaagcatagcgatggaagtttctcgaataagcaatggatattcttttggtttggtcttgcggacatcagggattcctacgaacttgtgaaccatgccaagggactccctgattcctttcataagcctgcatcggatccaggatca

SEQ ID NO: 17053 - DNA, 1602 bp, Artificial Sequence
  Description of Artificial Sequence: Synthetic coding sequence
atggccactgcattgatggccgtggtactgcgcgccgccgctgtcgctccaaggcttagaggtcgggggggcacagggggagctagacgcctgtcatgcggagccagaagacgcgctgccagagggactagtcccggtagaaggctctctaccgcatggagccagccgcagccccctccagaagagtacgccggtgctgacgatgtctcccagtcaccagtggcagaggaaccaagctgggtcccatcccccaggccccccgttcctcacgaaagccccgaaccccctagtgggaggagtctcgtgcagcgcgatatacaagcctttcttaaccagtgtggggcttcccctggagaggcacggcactggctcacccagttccagacttgccatcactccgccgataagcccttcgccgtgatagaggtggatgaggaggtgttgaagtgtcagcaaggagtgagtagcctggcttttgcactggcttttctccaaaggatggacatgaaacctttggtggtgttgggcctccctgcccccaccgcaccatccggttgcttatccttctgggaggccaaggctcagctagccaagagttgtaaggtgctggtggacgctttacgccataatgcagccgcagcggtgccgtttttcgggggaggtagcgtgcttcgcgcagcagagcccgctcctcacgcatcttacggaggaatcgtgtctgtggaaaccgatcttctgcagtggtgtttggagagcggctccattccgattctctgtcctattggcgagacagctgctagacgcagcgtcctcctggactctctggaggtcactgcatctctcgctaaagcgctacgcccaaccaaaatcatcttcctaaataatacaggggggttacgcgatagttcacacaaagtgctgtctaacgtaaacttacccgccgacttagacctggtgtgtaatgcagagtgggtatcgacaaaggagcgtcagcagatgagactgattgtggacgtgctttccaggctgccacatcacagttccgcagtgatcactgccgcctctactctcctaacggagctcttttcgaataagggtagcggaactctgttcaagaatgctgaacgtatgctaagagttagaagtttggacaagctggatcaaggacggttggtggacttggtgaacgcctcatttggcaaaaaattgagagacgactacctcgcctccttgcggccacgcctgcattcgatttacgtgagtgagggttacaatgccgccgcaatcttaactatggaacctgtcctgggaggcactccctatctggataaatttgtggtgtcttcaagcaggcaaggccagggatccggacagatgctgtgggagtgcctgcgtcgggatctacagacacttttttggagatctcgagttacaaatcccataaacccatggtactttaaacatagtgatggtagctttagtaacaaacagtggatcttcttctggttcggcttagccgatatcagggacagctatgagctagttaatcacgctaagggccttcccgatagcttccataaaccggccagtgatcctggtagc

SEQ ID NO: 17054 - DNA, 1602 bp, Artificial Sequence
  Description of Artificial Sequence: Synthetic coding sequence
atggccacagcattgatggcagtggtgctccgagccgctgccgtagctccccgcctccgtggtcgaggcggtactggtggggctaggcggctcagttgcggagcacgacggagagctgccagaggaaccagcccaggacgccggctgtcaacagcttggtcgcagccccagcccccccctgaggagtatgccggggctgacgacgtgagtcagtccccagtcgctgaggagcctagttgggtcccgtccccaaggccccctgtaccccacgagtcccctgaacccccaagcggccgatctcttgttcaacgggacattcaggccttcctcaaccagtgcggcgcctctccaggagaggcccgccactggcttactcagttccaaacctgccatcactccgcggacaaacccttcgcggttatagaggtagacgaggaggttctgaagtgtcagcagggtgtcagctccctcgctttcgctctcgcctttctgcagcgcatggatatgaagcctcttgtggtgttaggcctccccgcccctaccgccccctcaggatgcctgtctttttgggaagccaaagcccagctggccaaaagttgtaaggttcttgtggatgcattgaggcataacgcggccgctgcggtacccttttttggtggcggctccgtgctgagggctgcagaaccagctcctcatgccagctacgggggaatcgtgtcagtcgaaaccgacctactccagtggtgtctcgaatccggcagtatacctattctctgtcctataggcgagactgcagctcgcagatctgtgctcctggattctttggaggtgaccgccagcctggccaaagctcttcggccgactaagataattttcctcaacaacacaggggggctgagggatagttctcacaaggtgctgagtaatgtaaatctgcctgccgacctcgatctggtgtgcaacgccgagtgggtgtccactaaggagagacaacagatgagactgatcgttgatgtcctgtctcgccttccccatcattcttcagctgtgattaccgcagcctccacgctcctaacggaattgttcagcaacaagggatctggcactctctttaaaaatgctgagcggatgctcagagttcgctcgctcgataaactggaccagggccgacttgtcgatctagtgaatgcgtcctttggcaaaaaactaagagatgactatcttgcgtccctgagaccgaggttacattctatttatgtctctgagggctataatgccgcagcaattctgaccatggagcccgttctcggaggtacgccgtatctggataagttcgtggtgagctctagtcggcaggggcagggctctgggcagatgttatgggaatgcctgaggcgtgacctgcagacactcttttggcggagcagggtgactaaccctatcaatccctggtattttaagcatagcgatgggagtttttccaataagcagtggatctttttttggttcggcttagccgatattagggacagttatgagctagtaaatcatgctaaggggctacctgactcctttcacaagccggccagtgacccagggtcc

SEQ ID NO: 17055 - DNA, 1602 bp, Artificial Sequence
  Description of Artificial Sequence: Synthetic coding sequence
atggccacggcgctgatggctgtggtgctgcgggccgcggcggtggcccctcggcttcgggggaggggtggcaccggaggcgcacgccggctgagttgcggggcaaggcggagagcagcccgtggcacttcaccaggaaggcgcctgtcgacggcatggtcgcaacctcagcctccccctgaagagtacgctggagcagatgatgtgtcccagtccccggtggccgaggagccatcatgggtgccctcccctagacctcccgtgccacacgagtcgcctgaaccaccctcggggagaagccttgtgcagcgagacattcaagcatttctgaatcagtgcggtgcctcccctggtgaagctcggcattggctgacccaatttcaaacctgccaccactctgcagacaaacctttcgcggtgatcgaagtcgatgaagaagtgctgaagtgccagcaaggagtttcgtcgctcgcatttgcactggcatttctgcaacggatggatatgaaaccactcgtggttctgggactccctgccccaactgccccgtcggggtgcctgtcgttttgggaggctaaagcgcaacttgcaaagtcgtgcaaggtccttgtggatgcactccgtcataatgcagcagcagcggtgcctttctttggaggaggttccgtgctgagagcggcagaaccagcaccccacgcatcgtacggaggtatagtctccgtggagactgacttgctgcaatggtgcctcgaatccggatcaattccgattctttgccccattggtgagactgcggcaaggagatccgtgctcctggattcactggaggtcaccgcatcgctcgctaaggcactcaggccaactaagatcattttcttgaacaacactgggggactcagagattcatcgcataaagtcctctccaacgtgaaccttccagcagatcttgacttggtgtgtaacgcagaatgggtttccaccaaggaaaggcagcagatgcggctgattgtggatgttctttcaagacttcctcaccattcatccgccgtgatcactgcagcaagcaccctgctcaccgagctctttagcaataaaggatccggcaccctgtttaagaacgccgagaggatgctgagagttaggtcgctcgacaagctggatcagggacggctcgtggacctggtgaatgcatccttcggtaagaagctcagagatgactatctggcttccttgcgaccacggttgcactccatctacgtgagcgaaggttacaatgctgcagcaatacttaccatggaaccagtgttgggtgggaccccttaccttgataagtttgtcgtgtcatcctctaggcagggccaaggatcaggccaaatgctctgggaatgtctgcgcagggatctgcaaaccctgttctggcgctccagagtgactaatcctatcaacccatggtactttaaacacagcgatggttcattttcaaacaagcagtggattttcttttggtttggccttgcagacattcgcgactcgtacgaattggtgaatcatgccaaaggtctgcccgactccttccataaacctgcgtccgaccccggtagc

SEQ ID NO: 17056 - DNA, 1602 bp, Artificial Sequence
  Description of Artificial Sequence: Synthetic coding sequence
atggccactgcattgatggcagtcgttctgagagcggctgcagtggccccaaggcttcgcggaaggggtggaaccgggggtgcacggagactttcgtgtggagccaggaggcgcgctgcacgaggaacttcaccaggtagacggttgtcaacggcatggagtcaaccccaacctcctcctgaggagtacgcaggggccgacgacgtcagccagtcccctgtggccgaagaaccatcatgggtgcctagccccaggccccccgtccctcatgaatcgcctgagccaccttcgggtagatcgctcgtccagagagacattcaggcctttcttaaccaatgtggcgcatccccaggtgaagcaagacattggcttacccagttccagacctgccaccactcagccgacaagccctttgccgtcatcgaggtggacgaagaagtgcttaaatgtcagcagggtgtgtcgtcccttgcattcgccctcgcatttcttcagcggatggatatgaagccgctcgtcgtgctgggactccctgcaccaaccgccccatcgggatgcctgtcgttctgggaggccaaagcacaactggcaaaatcctgtaaagtccttgtcgatgcacttcgccataatgccgcagcagcagtgcccttctttggtggcggatcagtgctccgggcggcagaaccggcccctcatgccagctacggaggtattgtctccgtggaaaccgatcttctgcagtggtgccttgaaagcggcagcattcccattctctgtccaattggcgaaactgcagcgcgccgctcggtgctgcttgattcgcttgaagtgaccgcatcgcttgccaaggcgctgcggcccaccaagatcatatttctgaacaacaccggtggacttagggattccagccataaagtgctctcgaatgtgaatttgcccgccgatctggatctcgtgtgcaacgccgaatgggtaagcaccaaggagagacaacaaatgcgtttgatcgtcgacgtgctgtcgaggttgccacatcattcttccgccgtgattacggcggcctccaccctcttgaccgagctgtttagcaacaagggatccgggaccctgtttaagaatgccgaacgcatgcttcgcgtgcgtagcctggacaagctggaccaaggtcggctggtggatctcgtcaatgcatcttttggcaagaaactgcgcgatgactaccttgcatcgctgcggccgaggctccattcaatctacgtctcggaaggatacaacgccgccgcaattcttaccatggaaccagtgcttggaggtaccccttacctggacaagtttgttgtcagctcgagccggcaaggtcaaggatccgggcagatgctgtgggaatgcctgagacgagatcttcagactctgttttggcgctcccgggtcaccaaccctataaacccatggtatttcaaacatagcgacggatcattctctaacaagcagtggatctttttctggtttgggctcgcagacattcgggattcttacgagcttgtcaatcacgccaagggccttcctgattccttccataagcctgcctcagatccaggttcg

SEQ ID NO: 17057 - DNA, 1602 bp, Artificial Sequence; identical to SEQ ID NO: 17042
  Description of Artificial Sequence: Synthetic coding sequence

SEQ ID NO: 17058 - DNA, 1602 bp, Artificial Sequence
  Description of Artificial Sequence: Synthetic coding sequence
atggccaccgccttgatggcggtggtccttcgagcagcagcggtggcacctaggctccgcggtcgcggaggtactggtggagcacggcgtctgtcatgtggcgctcgacggcgggccgcgcggggaacctcacccgggaggcggctctccactgcttggtcacaaccgcaaccacccccagaagaatacgcgggagccgatgatgtatctcagtcccctgtcgccgaggagccctcttgggtcccatcccctcgacctccggtgccccacgagtcgcctgaaccgccgtctggtaggtcgcttgtgcagagagacatacaggcattcctgaaccagtgcggcgcttcccctggtgaggcgagacattggctcacccagttccagacttgccaccactcagccgataagccgttcgctgtaatcgaggtcgatgaagaggtgctgaaatgtcagcaaggcgtctcgtcactcgccttcgctctggcgttcctccaacggatggatatgaaaccgctggtggtgcttggactgcccgcccctacggcgccgtccggatgtttgtcgttttgggaagcaaaagcccaactggcaaagtcgtgcaaggtgctggtcgatgctctcagacataacgctgcggcggccgtgccgttctttggcggcgggagcgttctgcgcgctgcggaacccgccccacacgcatcctacgggggaatcgtctcagtggagactgaccttctccaatggtgcctggagagtgggagcatcccaatcttgtgcccaatcggagagacggcggcgcggcggagcgtgctgctcgactcactggaggtcactgcttccctggccaaggccctccgcccgaccaaaatcatcttcctgaataacacggggggtcttagggattcctcccacaaagttctctcgaatgtcaatctgccggccgacctggatctcgtgtgcaacgctgaatgggtgtcgaccaaggaacgccagcaaatgcgcctcatcgtcgacgtgcttagcaggttgccgcaccattcgtccgcggtgattactgcggcctcgactctgttgactgaactgttttcgaacaagggaagcggaaccctgttcaagaacgcggaacgaatgctgcgggtccgcagcctggacaagctggaccagggacgtctcgtggacctggttaatgcttcgttcggcaagaagttgcgggacgattacctggcaagcctcagacctcgcctgcattcgatctacgtatctgaaggatacaatgccgccgcgatcctgaccatggaaccggtgctcggagggaccccgtacctcgacaagttcgtggtcagctcctcacgccagggccaagggagcggccagatgctgtgggagtgccttcgccgggacttgcagaccctcttctggagaagccgggtgaccaacccaattaacccgtggtactttaagcactcggacggttccttctcaaataagcagtggattttcttttggtttggtttggccgacatcagagatagctatgaactggtcaaccacgctaaaggcctcccggacagcttccataagccagcatcggatcctggatct

SEQ ID NO: 17059 - DNA, 1602 bp, Artificial Sequence
  Description of Artificial Sequence: Synthetic coding sequence
atggcaaccgcactcatggcagtggtccttagggcggcagcggttgcccctagacttagaggacgaggcggaactggaggagcaagaaggctttcgtgtggagcacggcgaagagccgcacgcggaacctcgccagggaggaggctttccactgcctggtcacagccacaaccaccccctgaggaatacgccggagccgacgacgtctcgcaatcgcctgtggcagaggaaccttcttgggtcccctcgccaaggccacccgtgcctcacgaatccccagagccaccttcagggcggtcactcgtgcagcgcgatatacaagccttcttgaaccaatgcggtgcttccccaggagaagcaagacattggcttacccagttccagacctgtcatcattcggcagataagccatttgccgtgattgaagtcgacgaggaagtgcttaagtgccagcagggggtcagctcactcgcatttgcactggcatttctgcaaagaatggatatgaagcctctggtcgtcctcggactccctgcaccgactgcgccctcggggtgtctctcattttgggaggcgaaggcgcaactggctaagtcctgtaaggtgctcgtggacgcgcttcggcacaacgctgccgcagccgtcccattcttcggtggtggaagcgtcttgagagcagccgaacctgcgccacatgcaagctacggcggtatcgtgtcggtggagactgacttgctgcagtggtgccttgaatcgggctccatccctattctctgccctattggtgagactgcagcaagaagatcggtgctcctggattccctggaggttaccgcatctctcgcaaaggccctcagaccaaccaagattatcttcctgaataacacggggggactgcgggactccagccacaaagtcttgtcgaatgtgaatctgcctgcggatctggatctcgtgtgtaacgccgagtgggtgtcgactaaggaacggcagcaaatgcggctgattgtggacgtgctgtctcgtctgcctcatcattccagcgctgtgattacggcggcatcgaccctgttgaccgaactgttttctaacaagggctcaggtaccctctttaagaacgcagagagaatgctcagagtccgctcgctggataaactggatcagggtcgactggtcgatcttgtgaatgcatcgttcgggaagaaactccgtgacgattacctcgcatccctccgacctagactgcactccatttacgtgtccgaggggtataacgccgcagcaattctgacgatggaaccggtgctgggcggtactccatacttggataagtttgtcgtttccagctcccgtcagggtcagggctcggggcaaatgctttgggaatgcctgcgacgggacctgcagactctgttctggagatcgcgtgtgaccaatcctatcaacccttggtacttcaagcatagcgacgggtcgttttcgaataaacaatggatctttttctggttcggtcttgctgacattcgcgattcgtacgagcttgtcaaccatgcaaagggactgcctgatagctttcataagcctgcatcggatccaggctcg

SEQ ID NO: 17060 - DNA, 1602 bp, Artificial Sequence
  Description of Artificial Sequence: Synthetic coding sequence
atggcaaccgccctgatggctgtcgtgctccgtgcggccgctgtggcacctagacttagaggaagaggcggaactggaggggcccgccgactctcgtgtggggctcggagaagagcagccagaggaacctcaccaggaaggagactgtccaccgcttggagccaaccccagccacctccagaggaatacgcaggcgcagacgatgtgtcccagtcgcccgtggcagaggaaccatcatgggtgccaagccctaggccgccagttccacatgagtctccagaacctccttctggacggtcgctcgtgcaaagggatatccaagcatttctgaatcaatgcggggcatccccgggagaagcaagacactggctcacgcagtttcaaacgtgccaccactccgcggacaagcctttcgcagtgatagaggttgatgaagaggttctgaagtgtcaacagggggtgtcctcgctggcattcgcactcgccttcctccaacgcatggatatgaagccgttggtcgtcctcggtttgcctgcgcctaccgccccgtcagggtgtctctcgttttgggaagcaaaggcccaactggcaaaatcatgcaaggttctggtggatgccctgaggcataacgcggcagcggccgtgccgttttttgggggagggtcagttctgcgggcggccgaaccagcccctcatgcgtcttacggtggtattgtgtccgtggaaactgatcttctgcagtggtgtctcgaatcgggaagcatccctattctttgtccgattggagaaaccgcagcccgaagatcagtgctgcttgactctctggaggtgactgcatcattggcgaaggcacttagaccaacgaaaatcatctttctgaacaataccgggggtctgcgggactccagccacaaagtgttgtccaatgtcaacctgcccgcagatctggatcttgtgtgcaatgctgaatgggtgagcactaaggagcgccagcagatgcgacttatcgtggatgtgttgagccggctgccacatcactcatcagcagtcatcaccgcagcatcgactctcctgaccgaactctttagcaacaagggctccggtaccctgttcaaaaacgcagaaaggatgctgcgcgtccgtagccttgacaaactggaccagggaagattggtggatcttgtgaatgcgtcatttgggaagaagctgcgtgatgattacctggcctcgctgcggccacggcttcactccatttacgtgtccgaaggttacaacgcagcagcaattctgactatggaacctgtccttggcggtaccccctacctggataagtttgtcgtgagcagctcaaggcagggtcaagggagcggtcaaatgctgtgggagtgtctgagacgcgaccttcaaactctgttttggagatcgcgagtgactaaccccattaacccttggtatttcaaacatagcgatggatcattttcgaacaagcaatggattttcttttggtttggacttgctgatataagagattcctacgagttggtgaatcatgcaaaggggctgccagactccttccataagccggcaagcgaccccggtagc

SEQ ID NO: 17061 - DNA, 1602 bp, Artificial Sequence
  Description of Artificial Sequence: Synthetic coding sequence
atggcaactgcccttatggcagttgtgctgagggccgctgcggtggccccgcgcctacgtggaaggggcgggactggtggagctaggagattgagctgcggcgcacgccggcgcgcagctcgtggtacctccccagggcggcgtctatccacagcatggtcacaaccccaacctccgcccgaggaatacgcaggtgcagacgacgtctcacagagtcccgtagccgaggagcccagctgggtacccagtcctagacccccagtgcctcatgagtctccagaacccccatccgggagatctctcgtacagcgggatattcaggcttttctcaaccagtgcggcgcaagtccgggagaggcacggcactggttgacgcaatttcagacgtgccaccatagcgctgataagccattcgcagtcatcgaggtagacgaggaagtcctgaaatgtcagcagggtgtttcctcactggccttcgcattagctttcctccagaggatggatatgaaacccctggttgttctcggcctgcctgccccgaccgcccctagcggatgtctgtcattctgggaagcgaaggcccagcttgcaaaatcatgtaaggtactagtcgatgccctccggcacaacgctgctgctgcagtgccctttttcggaggcggctctgtgctgagggctgcagagccagcccctcacgcgagttatggaggaatcgtatctgtcgagacagacctgttgcagtggtgtctggagagcggatcaatccctattctgtgccccataggggaaaccgcggcccggcggagtgtgctgctagacagcctggaggtgacagcttctctggctaaagctctgcggccaaccaagatcatattcctgaataacacgggcggcttgcgcgactcctcccacaaagtcctgagcaatgtcaacctccctgccgatctcgatttggtgtgcaacgctgaatgggtgagcacaaaggaaaggcagcaaatgagactcattgtagacgtgcttagcagacttccccaccatagttccgcagtgatcactgcagcctccaccttactaaccgaactattcagcaacaaaggttctggtaccctgttcaagaatgccgagaggatgctgcgcgtgcggtccctggataaactagaccagggcagattggtggatctcgtgaacgccagctttggaaagaagcttcgggatgactatctcgcaagcctgcgtccaaggctgcactcaatatacgtatccgagggctacaacgctgcagcgattctgactatggaacctgtactaggcggtaccccatatctggacaaattcgttgtgtccagtagtcggcaggggcagggcagcggacagatgctgtgggaatgcctcaggcgcgaccttcagactctgttttggcggagtagggtgactaatcccatcaatccttggtattttaagcactccgacggaagcttctctaataagcagtggatatttttttggttcggattagctgacatcagggacagctatgagctggtgaaccatgccaagggcctgcctgatagtttccacaaacctgcctccgacccaggctcg

SEQ ID NO: 17062 - DNA, 1602 bp, Artificial Sequence
  Description of Artificial Sequence: Synthetic coding sequence
atggctaccgcgttgatggcagtcgtgctgcgggccgcagccgtggcacccaggcttaggggacgaggtggcactggtggtgcaagacgactctcctgtggtgcccgccgacgagccgcaaggggaacgagccctggtagacgactgagcactgcatggagccagcctcagccacctccagaggaatacgccggcgcagatgatgtgagccagtcgcccgtcgcagaggagccatcctgggtgcctagccccaggccgcctgtgccacatgaatccccggagccaccaagcgggcgcagcctggtgcaacgcgatatccaagcatttctcaatcaatgcggtgcgtctccaggagaagcccggcattggctgactcaatttcagacgtgccatcactcagccgataagccttttgctgtgatagaagtcgatgaagaggtgctgaagtgccaacaaggggtgtcgtcactggcatttgcactggcatttctgcaaaggatggacatgaagcccctcgtggtccttggactgcctgcaccaacggcgccatccggatgcctgtccttctgggaagccaaagcacagttggcaaaatcatgtaaggtcctggtggatgcattgagacacaatgcggcagcggcggtcccttttttcggtggcggatcagtgctccgggcggcagaaccggcacctcatgcgtcctacggtgggattgtctccgttgagacggatctgctgcagtggtgtctcgaatcaggttcgataccgattctttgccccattggcgagacggcagcacgtcgatctgtccttctcgactcgctggaggttaccgctagcctggctaaggcccttcgaccaactaagataatcttcctcaacaacactgggggacttagggattcaagccacaaggtgctttccaacgttaacctgccggcagacctggatttggtctgtaacgcagaatgggtgtcaaccaaggaacggcaacagatgaggctgattgtggacgtgttgtccagactcccacatcattcgtcggccgtgattaccgcggcgtcgactcttctgaccgaactgttcagcaacaagggatctggtactcttttcaaaaacgcagaaagaatgcttcgtgtgcgaagcctcgataaacttgatcagggtagactcgtcgatctggtcaatgcatcctttggaaagaaacttagagacgactaccttgcgtcgctccgtcctaggcttcattcaatttacgtctcggagggctacaacgcagcagcaattctcaccatggaacccgtccttggaggtaccccttacctcgacaaattcgtggtgtcaagctcaaggcaaggacagggttcgggacagatgctctgggaatgccttcggagagatttgcagacgcttttttggcgatcacgggtgactaatcccattaatccatggtactttaagcattcggatggctccttttcaaataagcaatggatctttttctggttcggattggcggacatacgggactcgtacgaactggtgaaccacgcaaaggggcttccagatagcttccacaagcccgcctccgatcccggctcc

SEQ ID NO: 17063 - DNA, 1602 bp, Artificial Sequence
  Description of Artificial Sequence: Synthetic coding sequence
atggctaccgcactgatggccgttgtcttgcgtgcagccgcggtggcgccccgcctccgagggcggggaggaactggaggagcaagacggctgtcatgtggagctcgacgccgagcagcaagaggcacctcacctggcagacgactgtcaaccgcgtggtcccaaccccagccaccgcccgaagaatacgctggagcggatgatgtgtcgcagtccccagtcgcagaagaaccatcctgggttccttcacctagacctccagtgccacacgaatccccagagccaccctccggaaggagcctggtccaaagggatatccaggcctttcttaaccaatgtggggccagccccggagaggcacgccattggctcactcaatttcaaacctgccaccactccgcggataagccctttgcggtgatcgaagtcgatgaagaagtcctgaagtgtcaacagggcgtgagctcgctggcttttgctcttgcttttcttcagagaatggacatgaagccactggtcgtgttgggactccctgcaccaactgcgcccagcggctgcctttccttttgggaagcaaaggcacagcttgccaaatcgtgtaaggtgctggtcgatgccctgcggcataacgcagcagcagccgtgccattcttcggcggaggttcagtgctgagagcagcagagcctgcaccgcatgcatcttacggtggcatcgtctcggtggagactgatctgctgcagtggtgccttgaatcagggtcaattccaatcctctgtcccattggtgaaaccgctgcacgcagatcggtgctgctggacagcctcgaggtgacggcctcgctggccaaggcactgcgacccaccaaaatcatttttctgaataacaccggaggtttgcgggactcgtcgcataaagtgctctcaaacgtcaatcttccagcagaccttgatttggtgtgtaatgcagaatgggtgtccaccaaggaacgccaacaaatgcggctcattgtggatgtcctgtcccggttgccccatcattcctcagcagtcatcactgcagctagcactttgctcaccgagctgttttcaaacaagggatccggaacgctcttcaagaacgcagaaagaatgctgcgggtcagatccctggataaacttgaccaagggcggcttgttgacctggtgaacgcttcgttcggaaagaaacttcgggatgactacctcgcatcgcttcgcccaagactgcactccatttacgtgtcagaaggctacaatgcagccgcaattctgactatggagcctgtgcttggagggaccccgtaccttgacaaattcgtggtgtcgagctcacggcaaggtcagggatcaggacagatgctttgggagtgccttaggagagacttgcagacgctgttttggcgttcgcgggtcaccaatccaatcaatccttggtactttaagcactcagacggatccttttccaacaagcaatggatcttcttttggttcggtcttgcggatatacgcgactcatacgaacttgtgaaccatgcaaagggactgcctgatagctttcataaaccagcatccgatccggggagc

SEQ ID NO: 17064 - DNA, 1602 bp, Artificial Sequence
  Description of Artificial Sequence: Synthetic coding sequence
atggcaaccgctctgatggcagtggtgctcagggctgccgctgttgcaccccggctgcgggggagaggcggcacgggaggggctagacgcctctcttgcggcgcgcgccgaagagcggccagaggaacctctcctggtcggaggctcagtacagcgtggtcacagccccagccacctcctgaggagtacgcgggcgccgacgatgtgtctcagtcacccgtggccgaggagccttcctgggtgccctcaccgcgcccaccagtcccccacgagagtccagaacccccaagcggacgatctttagttcaaagggacatccaggccttcctgaaccaatgtggagcctctccaggcgaagcccggcactggttgacccagttccagacttgtcaccatagcgctgacaagccatttgctgtgattgaggtcgatgaggaggtgctgaagtgccagcagggagtgtcatccctggcctttgcccttgctttcctgcagcgaatggatatgaagccactagttgtgttaggccttcctgctcccaccgcacctagcggttgtctgtctttctgggaagctaaagctcaactggcgaagagctgcaaagtcctggtggacgctctcaggcataacgccgcggccgccgtcccattctttgggggcggctctgtgctgcgcgctgctgaacctgcgccccacgcttcttacggcggcatagtcagcgtggagactgatctattgcagtggtgtctcgaatccggttctatacccatcctttgtcccattggcgaaaccgctgcgcgcaggtctgtcttgctggactctttagaggtaacggcaagcttggcaaaggcattaagacccacaaagataatctttcttaacaataccggggggctcagggatagctcccataaagtgctgtccaatgtcaatctgcccgccgacctggatctggtctgcaatgctgagtgggtcagcactaaggagaggcagcagatgcggctgattgtggacgtgctgtcacgcctgcctcaccatagctccgccgttatcacggcagcaagtaccctgctgactgaactatttagtaacaagggatctggcactctgtttaaaaatgctgagagaatgctgcgcgtgaggagtctagataagttagaccagggacggctggttgacctcgtgaatgcatcctttggcaagaaattacgcgatgactaccttgcctccttgaggccccgcctgcacagtatttacgtcagcgagggctacaatgctgcagccattctcacaatggagccggtcctggggggaactccttacctagataaattcgttgtatcctcttctcgtcaggggcagggcagcggccaaatgttatgggaatgtctccgcagggacttgcagacgctgttttggaggtctcgggtcaccaacccaattaacccctggtacttcaagcacagtgacggtagcttttcgaacaagcagtggatatttttctggttcggactagcggacatccgggatagctatgaactcgtgaatcacgcaaaaggtctgcccgactctttccataaacccgcttctgacccagggtca

SEQ ID NO: 17065 - DNA, 1602 bp, Artificial Sequence
  Description of Artificial Sequence: Synthetic coding sequence
atggcaacagcactgatggcagtggtgttacgggccgcagctgttgccccacgccttagagggcgagggggaactgggggagctcggcgattatcttgtggggcccgacggagagcagcacgagggacttcacctgggcgacgcttatccacagcatggtctcagccacagccccccccagaagaatatgccggggctgatgatgtctcacagtcacccgtagcagaagaaccctcttgggtaccctctccaagacctcctgtcccacatgagagtcccgaaccaccttccggaagaagtctggtgcaacgagatatacaggcttttctcaaccagtgcggagcctcccccggagaagccaggcactggctaacacagtttcagacatgccaccactcagcggataaaccctttgccgtaattgaggtggatgaggaagtactcaaatgtcagcagggggttagtagtcttgccttcgctctggcctttttacaacggatggatatgaaaccacttgtggttcttgggctacctgccccaactgcaccctcagggtgtctcagtttttgggaagcaaaagcccagctggctaaaagttgcaaagtgctcgtggatgctctcagacacaacgccgctgcagctgtcccattttttgggggagggtccgtactgagagccgccgagccagctccccacgcctcttatggggggatagtgtccgtggaaactgatctactccagtggtgcctcgaatctgggtctattccaatcctatgcccaattggggaaacagccgcacgacgctcggtgttactggattctcttgaagtcacagcctctctggccaaagccctgagacctacgaaaataatatttctaaataatactggaggactgcgcgactcttcacacaaagttctatctaatgtcaaccttcctgctgatctagatctggtgtgtaatgctgaatgggtctccacaaaagaacgccagcagatgcggctgatagtggatgtactttcgagactgcctcatcattcttccgctgttattacagccgccagtacactcctaactgagttgttttccaacaagggatcagggacgctgtttaaaaacgcagaacggatgctgagagtgcggagtctcgacaaactcgatcagggaagattagtagatctcgtcaatgccagtttcgggaaaaagttgcgcgacgattatttagcatcgcttcgaccccgcctccactccatctatgtctcagaaggatataacgctgccgcaatacttacaatggaacctgtcctgggagggacaccatacttggataaatttgtggtgtcatcgtcacgacagggacagggatctggacagatgctttgggagtgtttacggagagatctccagacattattctggcggagtcgggtaactaaccctattaatccttggtattttaagcactccgatggatctttcagtaataaacagtggatattcttttggttcggactcgccgatatacgggattcctacgaacttgtgaaccatgcaaaagggctacccgattccttccataaaccagcatcagatccaggaagt

SEQ ID NO: 17066 - DNA, 1602 bp, Artificial Sequence
  Description of Artificial Sequence: Synthetic coding sequence
atggcaactgcacttatggcggtggtgcttcgagcagccgcggtggcaccccgtttgcgcggaagagggggaactggtggtgcccggcgattgtcctgtggagccagacggagggcagctcgcggtacttcgcctggcaggcggctcagcactgcatggtcacaaccacaacctccaccagaggagtatgccggggcagatgatgtctcacaatcgcctgtcgcagaggaacctagctgggtgccaagcccccggcctcccgtcccacatgaatctcctgagcctccttccggaagatccctggtgcagcgggatattcaagcgtttctgaaccaatgcggcgcatcgcccggagaagcaaggcactggctgacccagttccaaacctgtcatcatagcgcagataaaccgttcgcggtgatcgaagtggatgaagaagtgctgaagtgccaacaaggcgtgtcatccctggcctttgcccttgccttcttgcagcgcatggacatgaaaccacttgtcgtgctcggcctgcctgcaccaaccgccccatcaggatgcctgtcgttttgggaggcaaaggcgcaacttgcaaagtcatgtaaggtcctcgttgacgccctgcgtcataatgccgcagctgccgtcccttttttcgggggtgggtcagtcctgcgggccgcagagccagcacctcacgcgagctacggaggaatagtgagcgttgaaaccgacttgcttcaatggtgtcttgaatccggatccattccaatactttgccctataggcgaaaccgcagcacgacgaagcgttctgctcgatagcctggaggtgaccgcatccctcgctaaggccctgcggcccaccaagatcatattccttaacaacactggaggactgcgtgatagctcccataaggtgctgtcgaatgtgaacttgcctgccgaccttgaccttgtgtgtaacgccgaatgggtatccaccaaagaaagacagcaaatgcggctgatcgtggatgtgctctcacggctgcctcatcattccagcgcagtgattacggcggcttctactctgctgactgaactgttttccaacaaaggttccggcacgctgtttaagaatgcagaaaggatgctgcgagtccggtcgcttgataaactggatcaaggtcgcctcgtggatctggtcaacgcctcgtttggaaagaagctgagagacgactacctcgcatcgcttagaccccggcttcattcgatttacgtgagcgaggggtacaatgccgcggcaattctcaccatggagcccgtcctggggggcaccccttaccttgataagtttgtggtttcgagctccaggcaagggcagggttcgggtcaaatgctgtgggaatgcttgcgacgggacctgcagactctgttttggagatccagagtgacgaatcccatcaacccttggtacttcaagcacagcgacggttccttttcgaacaagcagtggattttcttttggtttggtcttgccgatatccgcgactcatatgaactggtgaaccatgcaaaagggctgccggattcatttcacaagccggcatcggatccaggaagc

SEQ ID NO: 17067 - DNA, 1602 bp, Artificial Sequence
  Description of Artificial Sequence: Synthetic coding sequence
atggctaccgctctaatggcagtggttttgcgcgcagccgccgtcgctcctcgtcttaggggtcgaggaggcacaggtggggcacgccggttgagttgtggcgcacgacgtagggccgctaggggaacttcaccagggcgtagactgtcaactgcgtggtcccagcctcagcctccgccagaggaatatgctggagctgacgatgtgtcccagtccccggtggctgaggaaccaagctgggtaccctcgcctagacctcccgtcccgcatgaaagccccgagccgccctctgggagatccttggtgcaaagagacatccaagcattcttgaatcagtgcggagcctcaccaggagaggctaggcactggttaacacaatttcagacctgtcaccactctgccgacaaaccattcgcggtgatcgaagtggatgaagaggttcttaagtgccagcagggggtgagcagtctggcgttcgcactcgcctttctgcagaggatggacatgaagccgctggtggtgctgggactgccagcgccaactgccccatccgggtgcctgtccttctgggaggccaaggcccagctggccaagagttgcaaagtgctggtggatgctctgcgacacaacgcggccgcagcggtgcccttctttgggggaggctctgtgctgcgggcagctgagcccgccccacacgcttcatacggagggattgtctccgttgagaccgatttgctgcaatggtgcttggaatccggtagtatccccattttatgccccatcggagaaactgccgctagacgatccgtccttttggacagcctcgaggtcaccgcctccttagccaaggctctgcgcccaactaagataatcttccttaacaacacgggtggcctgcgggactccagccacaaagtgcttagcaacgtgaacctgccggcagatttagatctggtctgtaatgcggagtgggttagtaccaaagagagacagcaaatgagactgatcgtggacgtgctgagtaggctgcctcatcactcctccgcagtgataaccgcagccagcaccttgctcacagaattgttttccaataagggaagcggcacattatttaagaacgcagaacgaatgctccgtgtgcgctctcttgataagctcgatcaggggagattagtagatctagtaaatgcctcatttgggaaaaaactcagggatgactatctcgcttctctccgacccaggctacactcgatttacgtgagcgaagggtataacgcggccgccatcttaaccatggagccagtgctcggtggcacgccatacttggataagttcgtggtcagcagtagcagacaggggcaaggaagtgggcagatgctatgggagtgtctgcgaagggatctgcagactctcttttggaggagccgggttactaatccgatcaacccttggtacttcaaacattctgatggcagctttagcaacaaacaatggattttcttctggttcggtcttgctgacatccgggatagttacgagctggtgaaccatgccaagggactccccgattctttccacaaacctgcaagtgacccaggtagc

SEQ ID NO: 17068 - DNA, 1602 bp, Artificial Sequence
  Description of Artificial Sequence: Synthetic coding sequence
atggccacagccctgatggcagttgtgctgcgggcagcagccgtcgctccgcgattaagggggcgtggcggcacggggggcgccaggcgcctgtcatgtggagctagacgacgtgcggcgcgcgggacatctcccggccgtcgccttagcacagcttggagtcagccccagcctcccccagaggagtacgccggcgccgacgatgtaagccaatctcctgttgcggaagaaccaagttgggttccctccccgaggcctccagtgcctcatgaaagcccagaaccgccctctggtcgttcactggtgcaacgggacattcaggcattcttgaaccagtgcggagcctccccgggggaagcccgacactggttaacccagttccaaacatgtcaccattcagccgataagccctttgcagtgattgaggtcgacgaagaggtcctcaagtgccagcagggggtttcatctctagccttcgcccttgcgttcctgcagagaatggacatgaaaccactggtcgtcctgggcttgcccgcccctacagctccctccggttgtctgagtttctgggaagccaaggcccagcttgccaagtcttgtaaggttcttgtcgatgctttgcggcacaacgctgcagctgcggttcccttcttcggcggcggatccgtgctccgggcggccgaacccgctcctcacgccagctacggagggatagtaagcgtcgagacagacttgttacagtggtgcttagagagcggaagcatcccaatcttatgccccattggagagaccgcagcgagacgcagcgtcctgcttgattctctggaggtaaccgcttcactggccaaagctttgagacccacaaaaataatctttctcaacaacaccggcggactgcgagatagcagccataaggtgctgtctaatgtcaatctaccggcggacctggacctggtttgcaacgcggagtgggtgtcaactaaagaaaggcagcagatgcgactaatcgtcgacgtgttaagccgattgccacatcactcatccgctgtcatcaccgccgcctcgacactcctgaccgagctgtttagcaataaggggtccgggaccctcttcaaaaacgctgagagaatgctcagagtgcggtccctagataagctggaccagggaaggctggtagacctggtcaacgccagcttcggaaaaaaactgagagatgactacctcgcttcccttcgacctcgtctgcactctatctacgtcagtgaaggatacaatgccgcagccattcttacaatggagcctgttctgggaggaactccgtacctcgataagttcgtggtgtcaagttcccggcaaggacagggcagcgggcagatgctgtgggagtgcctgaggagagatctgcagactctgttttggcggagcagggtgacaaatcccatcaatccctggtactttaaacacagcgatggctcctttagtaataaacagtggatctttttctggtttgggctggctgacatacgcgatagctacgagctggtgaatcacgcgaaggggctcccagattcttttcacaaacccgcttcagatccaggcagc

SEQ ID NO: 17069 - DNA, 1602 bp, Artificial Sequence
  Description of Artificial Sequence: Synthetic coding sequence
atggctactgctctgatggctgtggtcctgagagcggcagcagtggcgcctaggctcagaggaaggggtggaactggaggtgcccgccgactttcatgcggggcgagacgccgtgcggctagaggtacctcacctggaaggcgtcttagcaccgcgtggtcccagccacaaccgcccccagaagaatacgccggagccgatgacgtgtcgcaatccccggtggcagaggagccatcctgggtcccatcgcctcgaccacctgtccctcacgaatcccccgagcctccgtctggacgcagccttgtccaacgggatattcaagcattcctgaatcagtgcggtgcatcacctggcgaagcaagacactggctgactcagttccagacctgtcatcacagcgcagacaagccgtttgcagtgattgaggtcgatgaggaagtccttaagtgtcaacagggagtatcctcgctggcttttgcacttgcatttctgcaacgaatggatatgaaacctctcgtcgtgcttggacttccagcacctacggcgccatcaggatgcctgtccttttgggaggcaaaagctcaactggcgaagtcatgtaaagtgctggtggacgcattgcgacataatgccgcagctgctgtgccgttttttggaggcggatccgtgcttagagcagcagagccggcccctcacgcatcctatggtggtatcgtctcggtggaaaccgatctgctgcaatggtgcctggagtccggtagcattcctatcctgtgtcctattggcgaaaccgcggccagaagaagcgtccttctggactcccttgaagtcactgcaagccttgcaaaggctctgcgccccactaagatcatcttccttaacaataccggtgggctgcgtgattcatcacataaggtcttgagcaacgtgaaccttccagcagacctcgacctcgtctgtaatgcagaatgggtgtccaccaaggagcggcaacagatgcggcttattgtggatgtcctcagtagactgcctcatcatagctcagcagtgataactgcagcatcaacgctgctcactgaacttttttccaacaagggatcgggtaccctctttaagaatgctgaacgcatgctgagggtcagatcgcttgataaactggaccaggggcgcttggtggatctggtcaatgcatcgtttggtaagaaacttcgggatgactaccttgcctcgctcagacctcgcctccattccatctacgtgtccgagggatacaacgcagccgcaatattgaccatggaaccagtgctcggtggtacgccttacttggacaagtttgtggtttcctccagtcgtcaggggcagggatccggacaaatgctgtgggaatgtctgcgcagggaccttcagaccctgttttggagaagccgagtaaccaacccaattaacccctggtactttaagcactccgatggatccttttcaaataagcaatggattttcttctggttcggactcgcagacataagggattcgtatgagctggtgaaccatgctaaggggctgcctgattcttttcacaaacctgcctcggatccaggatcc

SEQ ID NO: 17070 - DNA, 1602 bp, Artificial Sequence
  Description of Artificial Sequence: Synthetic coding sequence
atggcaaccgcgctcatggccgtcgtcctccgcgcggccgccgtggctccaagactgcgaggcaggggaggaaccggaggagctcgcagactttcctgtggcgccagacggcgggccgcccgcggcacctcacccggacgccggctgtctacggcatggagccaacctcagcctccacctgaggagtacgctggagcggatgatgtgtcccagagcccggtggccgaggagccgtcctgggtgccctcgcctagaccgccggtgccacatgaatcaccagaacccccttcagggcgctcgctggtgcaacgcgacatccaagcattcttgaatcagtgtggtgcgtcgcctggagaggcgagacactggctcactcagttccaaacctgccaccattcggcggataaaccgttcgccgtgatcgaagttgatgaggaagtgctgaagtgccagcaaggggtgtcgtcactggcctttgccttggccttcctccagagaatggatatgaagcccctcgtggtgctcggactccccgcacctaccgctccgagcggatgcctgagcttctgggaagcgaaagcacaactggcgaagagctgcaaggtgcttgtcgacgcgctgagacacaatgcggccgccgccgtgcctttcttcggaggcggatcggtccttcgggccgcggagccggccccacacgcgtcctacggtggaatcgtgtccgtggagactgacctgctgcagtggtgcctggagtctggcagcattccaatcctttgccctatcggcgaaacggcggcacgccgctccgtgctgctggattcccttgaggtgacggcttcgctcgcgaaagctctgcgaccgaccaagatcatcttcctcaataacaccggaggactgcgggactcatcccacaaggtgctgtccaatgtgaaccttccggcagacctggacctggtgtgcaacgccgaatgggtgtccacgaaagagaggcaacagatgcgccttatcgtggacgtgctcagccgcttgcctcatcactcatcggcagtcatcactgcggcgtcaaccctcctcaccgaacttttctccaacaagggatcgggaacccttttcaagaacgcagaacgcatgctgcgcgtgcgctcgctggacaagctggatcagggacgactggtcgacctggttaacgcgtcattcggaaagaagctcagagacgactacctggcctcgctccgccctcgcctccactcaatctacgtgagcgagggatataacgccgctgccattctgactatggaaccggtcctcggaggcactccgtacctcgacaagttcgtcgtctcgtcctcccgccaaggacagggatcaggacagatgctgtgggagtgcctgcggcgcgacctccagaccctgttttggcgcagccgggtcacgaaccctatcaatccatggtactttaaacattcggacgggagcttctctaacaaacaatggatcttcttttggttcggactcgccgatatccgggattcatacgaactggtcaaccatgccaagggcctgccggacagctttcacaaaccggcctcagatccaggctca

SEQ ID NO: 17071 - DNA, 1602 bp, Artificial Sequence
  Description of Artificial Sequence: Synthetic coding sequence
atggccacggccctgatggccgtagtattgagagccgcagctgtggcccctagactgagaggccggggcgggacaggcggtgctaggaggttaagttgcggtgcacgaagacgcgcggctcgcggcacttctcctggcagaagactgagtaccgcatggtcccaacctcaacctccccccgaagagtacgctggggctgatgatgtgtcacagtcaccggtggccgaggagcctagctgggtgccgagcccgcggccacccgtgcctcatgagtctcctgagcctccctccggacgatcactcgtgcagcgcgacatccaggccttcctgaatcagtgcggggcatcacctggcgaggcccggcactggctgacacagtttcagacctgccaccacagcgcagacaagccgttcgccgtcatcgaagtggatgaagaggtgctgaaatgccagcagggcgtgtcttccttggcgttcgccctcgcctttctgcagcgcatggacatgaaacctctcgtggttctgggattgccagcccccactgccccctctggatgcttaagcttttgggaggcaaaagcccagctggctaagtcctgcaaggtgttggttgacgccctgcgccataacgctgcagccgcagtgccattcttcgggggcgggtcggtgctgcgggccgccgagccagccccccatgccagttatgggggcatagtgtcagtggaaacagacctccttcaatggtgtttggaatccggctcaatacctatcttgtgtccgatcggtgaaaccgctgcgcgccgaagtgttctgcttgattcactcgaggtgacagcaagtctcgcaaaagctctgcgacctacaaagatcattttcttaaacaatactggtggcctccgcgattcaagccataaggttttgagcaatgtaaatctgcccgctgatttagatctggtgtgcaatgctgagtgggtctccaccaaagagagacagcaaatgcgactaattgttgatgtcctctccaggctgccgcatcattccagcgctgtcattacagctgcttctactcttctgactgaactcttttcaaataagggctccgggactctattcaagaatgccgaaaggatgcttagggtccggagcctggataaacttgaccaggggcgactggtagacctggtaaatgcatctttcggcaagaaactccgcgatgattacctagcttccctccgtcctagactgcactccatttatgtgtcagagggatacaatgccgccgcaatcctgaccatggagcctgtgctgggcggaactccctacctggataagtttgtcgtaagctccagtaggcagggccagggctccggacagatgctgtgggaatgcctgaggagagatctgcagactctgttctggcggtctcgcgttacaaatcccatcaatccatggtactttaaacatagcgacggctctttttcgaataagcagtggatcttcttttggttcgggctcgcggatatccgtgacagctacgagctcgtgaatcatgccaaagggctaccagatagcttccacaagccagcgtccgaccccggatct

SEQ ID NO: 17072 - DNA, 1602 bp, Artificial Sequence
  Description of Artificial Sequence: Synthetic coding sequence
atggctaccgccctgatggccgtcgtcttgcgtgcagcagccgttgccccgcgcctgcgaggcagaggtggaactggcggcgctcgtagactgtcatgcggcgcacgacgcagagccgctagaggcacctcccccggacgacgcttatctacggcgtggagccaaccccagcccccgcccgaggaatacgctggggctgatgatgtatcccagtctcccgtcgccgaggagccgtcctgggtgccatctccaagaccaccagtacctcatgagtcacccgagccaccaagtgggcgatccctcgttcagcgggacatccaggcttttctgaatcagtgcggagcaagccctggcgaagcacggcactggttaactcagtttcaaacctgccatcatagtgctgataagcccttcgctgtgatcgaggtggacgaggaggttctgaaatgtcagcaaggggtctcctccctggcattcgccctggcctttcttcagcggatggatatgaaaccactcgtagtcttaggactgccagctcccacggccccatcaggttgtctctcattctgggaggctaaggctcagctcgcaaagtcatgcaaggtcctcgtggatgcgctgcggcacaatgcggctgctgcggtgccgttttttggtggaggttctgttctgagagctgctgagcctgcaccgcacgcctcttatggtggaattgtgtccgtggagacggacctcctgcagtggtgcctcgagtcaggaagtatccctattttgtgcccgatcggcgagactgcagccagaagatccgtgctgttggattccctcgaggtgactgcctccctggccaaggctctgcgcccaaccaagattattttcctgaataatactggcggactgagggatagctctcataaggtcctgagtaatgtgaatttaccagccgacctggatctcgtgtgcaacgccgagtgggtatccacaaaggagaggcagcaaatgcggctgatagtggacgttcttagccggcttccccaccatagtagcgcggttattactgctgcatcaacattactgaccgaactattcagtaacaagggttctggaaccttgttcaagaatgcagagcgaatgctcagggttagatccctggacaaactggaccagggtaggctcgttgacttggtcaatgcctccttcggaaagaagcttagggatgactacctggccagcttgaggcccagactgcacagcatttatgtctctgaaggctacaatgcagccgcgatactcactatggagccggttttaggaggaacaccttaccttgacaagttcgtggtgagcagctcccggcagggtcagggtagcggccaaatgctttgggaatgtctgaggagagatctccagaccctgttctggaggagccgggtcacgaaccctatcaatccatggtactttaaacacagcgatggaagcttttcaaataagcagtggatcttcttctggtttggcttggcagatattagggactcgtatgaactcgtgaaccatgcaaagggcctgcccgactctttccataaaccggcctctgatcccgggtcc

SEQ ID NO: 17073 - DNA, 1602 bp, Artificial Sequence
  Description of Artificial Sequence: Synthetic coding sequence
atggccactgccctcatggctgttgtactgagggcggcagcggtggccccccgcctgagggggagagggggcactggcggcgcgcggcgattaagctgcggagctcggcgacgagccgcgaggggcacttccccaggaaggcgactgtctacagcatggagccaaccgcaaccaccccctgaagagtatgccggtgcggatgatgtgtctcagtcaccagtggccgaggaacccagctgggttccgtcccctcgtcctcccgtgcctcacgaatcgcctgagcctccttccggccgcagtttggtgcagagggacatccaggccttcctaaatcagtgcggtgcgtcacctggcgaagcccggcattggctgacccaatttcagacctgtcaccatagcgcagacaagcctttcgcggtcatcgaggtggacgaggaggtgctcaaatgccaacagggtgtatcctccctggcctttgcacttgctttcctgcaaagaatggacatgaagcctctggtggtcctgggcctccccgcccccaccgcgccttccgggtgcctgtcattttgggaagctaaggcacagttggcaaaatcttgtaaagttctcgtcgacgccctgcgtcacaacgcagccgctgccgtgcccttcttcggcggaggctctgtcttacgcgcggcggagccagctccccacgcttcgtacggcggtattgtcagcgttgaaacggatctattacaatggtgcctggagtctgggagcataccgatcttgtgcccaatcggcgaaactgcagcaaggaggtctgtcctcctcgactctcttgaagtcaccgcaagcctggcgaaagctctgagaccaaccaaaataatctttctgaataacacaggcggactgagagattcaagtcataaagtactttccaacgtgaatttgccggctgatctcgacctggtctgtaacgccgagtgggtatccaccaaagagcgccaacagatgcgcctgattgtagacgtactgtcgaggctaccccatcacagctcagctgtaattaccgccgcttccaccttactcaccgagctcttttctaacaagggatcggggaccctttttaagaacgctgagagaatgttgcgggtacgtagcctggataaattggatcagggtcggctggtggatctggtcaatgccagtttcgggaaaaagcttagggatgattatctagcgagcctcagaccacgactgcatagcatctatgtgtctgagggatataacgctgccgcaattttaacaatggaaccagtgctaggcggtacaccgtacctggacaagtttgtggtaagcagtagccgccagggccaaggaagtggccagatgttgtgggagtgcctgcgaagagaccttcagaccctgttctggcgctcgcgggttactaacccaatcaacccctggtacttcaagcacagtgatgggtctttcagcaacaagcagtggatattcttctggtttggactggccgacattcgggactcatacgaattggtgaatcacgcgaaggggcttcccgattcctttcataagcctgcctcggacccaggatcc

SEQ ID NO: 17074 - DNA, 1602 bp, Artificial Sequence
  Description of Artificial Sequence: Synthetic coding sequence
atggcgactgcattgatggctgtggttctccgtgccgctgcagttgcgccacgtttgcgtggaagaggaggtaccgggggcgctcgtcggctgtcgtgcggagcccgtcgacgcgcggcacggggaacgtctcctggacgtcgcctcagtacagcatggtcgcaaccccaaccgccgccggaggaatatgcaggtgcagacgacgtgtctcaatctcctgttgcggaagaaccgagttgggttccaagtccccgtccacctgttccacacgaaagcccagaaccaccaagcggacgttcccttgtgcaacgagacatccaggcttttcttaatcaatgcggtgccagtccgggagaagctcgtcattggcttacacaatttcaaacttgccatcacagtgctgataaaccatttgccgtcattgaggtggatgaagaagttctcaaatgtcagcaaggagtgtcctcactcgcatttgcactggctttccttcaaagaatggatatgaaaccgttggttgtattgggacttccagcaccaacagcaccatctgggtgtctctccttttgggaagctaaggctcagttggcaaaatcgtgcaaggtcttggtagacgcgctgcgacacaatgcggctgcggcggtgccattttttggggggggatcggtgttgagggcagcggagccagcaccccacgcatcgtacggtggaattgtttctgtagagactgatttgctccagtggtgcctggagtcaggaagtatcccaatcctttgcccaataggtgagaccgcagccagaaggtcggttttgctggactctttggaggtaactgcctcactggcgaaagccttacgtccaactaaaattatcttcctgaataacactggtggattgagagattcctctcacaaggttctttccaacgtgaatttgccagcagacctagatttggtctgtaacgccgagtgggtttcgacaaaagaaagacaacaaatgaggcttattgtcgatgtcctatcgcgacttccgcaccactctagcgcagtcatcacggctgcatcgacacttcttacggaactcttttctaataaaggaagtgggactttgtttaagaatgcggagagaatgttgcgggtcagatcattggataaattggatcaaggaagactcgtcgatttggtcaatgcttcgttcggaaagaaacttagagatgattatcttgcatcgcttaggccgcggctccattcaatatacgtttcagaaggatataacgctgctgcaattttaacaatggagccagtcctcgggggaactccttacctcgataaattcgtagtgtcttcctcaagacaaggacagggatccggacagatgttgtgggagtgtttgcgtcgagacttacaaacactattctggagatctcgggttactaaccctataaatccgtggtattttaaacatagcgacggatcgttcagcaataaacaatggatttttttctggttcggacttgccgacattcgagactcttatgaactcgtgaaccatgctaaagggcttcctgattcgttccataaacctgcgtccgacccaggatca

SEQ ID NO: 17075 - DNA, 1602 bp, Artificial Sequence
  Description of Artificial Sequence: Synthetic coding sequence
atggcgaccgccctgatggccgtggtcctgcgcgcagcggcagtcgctcctcgcttgagaggcagaggaggaactggcggagcccggagactgtcgtgcggagcacggcgtagagccgcgcgcgggacctccccggggcgccgactttcgaccgcctggtcgcaaccccagccgccgccggaagagtacgcaggagccgacgacgtgtcacagtctcccgtcgctgaggagccctcttgggtgccttccccacgcccgccagtcccacacgaaagcccagaacccccgtcgggaagatcgctcgtgcagagagatatccaagcattcctgaatcagtgcggcgcctccccgggagaagctcgccactggctgactcaatttcagacttgccatcattccgcggacaaaccattcgctgtgatcgaggtcgacgaagaggtcctcaagtgccagcagggcgtgtcatcgcttgcgttcgcccttgcttttctgcagcggatggacatgaagcccctcgtggtgctgggactgccggcgccaactgcgccgagcgggtgcctttcattctgggaggcaaaggcccagctcgccaagtcgtgtaaggtgctcgtggacgccctcagacacaacgccgccgccgcggtcccattctttggaggaggctccgtcctgcgtgctgcagagccggcaccgcacgccagctacggaggcatcgtgtcggtggaaactgacctcctgcagtggtgcctggagtcaggaagcatccctatcctgtgccctatcggagagactgccgcccggcgctcggtgctgcttgattcgctcgaagtgaccgcgtcgctggcgaaagcgcttcggccgacgaagatcattttcctcaacaacaccggcggtctgagagattcgtcgcacaaagtcctcagcaatgtgaacctgccggctgacctggacctggtctgtaacgctgagtgggtgagcacgaaagagcgccagcagatgagacttatcgtggacgtgctgtcgcgtctgcctcaccattcgtccgctgtcatcactgcagccagcaccctgctcactgagctgttctccaacaagggatcagggactctgttcaagaacgctgagcgcatgctccgcgtgcggagcctcgacaagctggaccagggccggctcgtggatctggtgaacgccagctttggcaagaagctgcgcgacgattaccttgcttcgttgcgcccacgcctgcattcaatctacgtgagcgaagggtataacgcagccgcaatcctgacgatggaaccagtgctcgggggaaccccgtacttggacaaattcgtggtttcatcgtcccggcaggggcagggatcaggacaaatgctgtgggagtgcctgagaagggacctccagacgctgttttggcggagcagagtgactaaccctatcaatccgtggtacttcaagcattcagacggatcgttctccaataagcagtggatctttttctggtttggattggccgatatccgggactcctacgagctcgtcaaccacgcgaagggtttgccggattcatttcacaagcctgcatccgatccaggcagc

SEQ ID NO: 17076 - DNA, 1602 bp, Artificial Sequence
  Description of Artificial Sequence: Synthetic coding sequence
atggcgactgcacttatggcagtcgtgctgagagctgccgccgtggcgccccggctgcgagggcggggcggcaccggaggagcccgcagactgtcttgcggagcccgccggagggccgcacgcggcaccagcccgggacggcgcctgagcaccgcctggtcccagccgcaaccaccgccagaggagtacgctggcgcggacgatgtgagccaatccccagtggcagaagagccctcgtgggtgccgtcccctcggccgcctgtgcctcatgagtccccagaaccacccagcgggcgctccctggtgcagagagacatccaggcctttctgaaccagtgcggtgcttctccgggagaggcgagacactggctgactcaatttcagacgtgccaccactcagccgacaagccattcgcggtcatcgaagtggacgaggaggtcctgaaatgccagcagggggtgtcatcactcgccttcgccctggccttcctccagcggatggatatgaaaccgctggtcgttctgggcctccccgccccgaccgccccgtctggctgcctgtcgttctgggaagcaaaagcacagctggcgaaatcctgtaaagtgctggtggatgcgctgcggcataatgcggcggcagccgtgccatttttcgggggcggaagcgttcttcgagccgcggagccagcgcctcatgcctcatacggaggcatcgtgtcggtcgaaactgacttgctgcagtggtgcctggaatccggatcaatccctattctttgcccgatcggagaaactgcggccaggcgctcagttctgctggattccctcgaagtcactgcgtctcttgcaaaggcattgcggcctaccaaaatcattttcctcaataacacgggtgggcttcgcgatagcagccacaaggtgctttcgaatgtgaatcttccggcggacctcgatctggtatgcaacgcggaatgggtgtccaccaaggagcggcaacaaatgagactgatcgtcgatgtcttgagcaggcttccgcaccactcatcggccgttatcaccgcggcatcaactttgctcaccgaactgttcagcaataaagggtcaggcactttgttcaagaacgcggagaggatgctcagagtgagatccctggacaagctggatcaggggcgccttgtggacctcgtgaatgcctcattcgggaaaaagttgcgggatgattacttggcgtcgctgcgccctcgtctccactcgatttacgtgtcggaaggctacaatgcagcagcaatcctcaccatggaacctgtcctcggaggcaccccatacctggacaaattcgtggtgtcatccagcagacaaggacagggctcgggtcagatgctgtgggagtgtctcaggcgggacctgcagacgttgttctggcggtcgagagtgactaatcccatcaacccttggtactttaagcacagtgacggctcgttctcaaacaagcaatggatcttcttctggttcgggctcgcagacatccgggactcctacgaactggtgaaccatgccaagggcctcccagatagcttccacaagccagcatcagacccgggatca

SEQ ID NO: 17077 - DNA, 1602 bp, Artificial Sequence
  Description of Artificial Sequence: Synthetic coding sequence
atggctaccgccttgatggccgtcgtgctgcgggctgccgccgtggcccctagactgcgcggacgcggggggaccggtggagcgagacggctgtcctgcggagccagaaggcgggccgcgcgcggaacgtcaccgggccggcggctgtcaaccgcgtggtcacagcctcaaccaccgcctgaggaatacgcaggcgcggatgacgtctcccagtccccagtcgccgaggagccgtcctgggtgccgtccccaaggcccccggtgccacacgaatcacctgaaccgccgtcgggacgatccctggtgcagagagatattcaggcattcctgaaccagtgtggagccagtccaggtgaagctcgccactggctgactcagttccaaacttgccatcacagcgcggacaaaccgttcgctgtgatcgaggtggacgaagaggtgctgaagtgccagcagggagtgtcctccctcgcttttgccctggccttccttcagcgtatggatatgaagccactggttgttctggggttgccagcacctaccgcaccgagcgggtgcttgtcattttgggaagccaaggcgcagctggcaaagtcctgcaaggttctggttgacgcgctgcggcacaacgccgcagcagccgtgccgttttttggaggtggtagcgtccttagagcggccgagcccgcaccacatgcgtcctacgggggaattgtgtcggttgagacggaccttctccaatggtgtctggaatccggatcaatcccgattttgtgcccgatcggagaaaccgctgccagacggtcggttctgcttgatagcctcgaggtgacggcatccctggcgaaggcgctgcgccctactaagatcatctttctgaacaacaccggcggactgagggattcgtcgcataaggtcttgtccaatgtgaacctccccgctgaccttgacctggtgtgcaatgcggagtgggtcagtaccaaggaaagacagcaaatgagactgattgtggatgtgctgtcaagactgccgcatcactcctcggccgtgatcaccgctgcctccaccctcttgaccgagctgttctcgaacaagggaagcgggaccctcttcaaaaacgcagaacgcatgctcagagttagatccctggacaagctggaccaaggtagacttgtggacctcgtgaacgcttccttcggaaaaaagctccgcgatgattacctggcctcactccgcccgagactgcattccatttacgtgtccgagggctacaacgccgcggcgatcctgactatggagcctgtgctcggcgggactccttatcttgacaagttcgtcgtgtcgtcgagccggcagggtcaaggatcagggcagatgctgtgggaatgcctccggcgggaccttcagactttgttctggcgctctagggttactaatccgatcaatccctggtacttcaagcactcagacggcagctttagcaacaaacagtggatctttttctggttcggcctcgcggacatccgcgattcctacgagctggtcaaccacgccaagggattgcctgacagcttccataagccagcttccgatccaggctct

SEQ ID NO: 17078 - DNA, 1602 bp, Artificial Sequence
  Description of Artificial Sequence: Synthetic coding sequence
atggctactgcattgatggccgtggtgctgagggcagccgccgtggctccccgcctacgtggaagaggcggtaccggtggggcgagaaggctgtcctgtggagctaggcgacgggcagcccgcgggacaagcccgggcaggaggttgtccaccgcatggtcccagccacagcctcctccagaagaatacgccggggccgatgacgtctctcaatcccccgtggccgaagagcccagctgggtgcccagccccaggcctcccgtgcctcatgagtcaccagaaccgccctctggtcggagtcttgtgcaaagagatatacaggcatttctgaaccaatgtggtgcctcccctggggaggctaggcactggcttacacagttccagacatgccatcactccgccgacaaaccatttgccgtaatcgaagtcgacgaggaggtgctcaaatgtcaacagggggtgtcttctttagctttcgccctagctttcctccaacgtatggacatgaagcccttagtggtcttaggcctccctgccccaacggcacccagcgggtgcctgtccttctgggaggccaaagcacagctggccaaaagttgtaaggtcctggtcgatgctctacggcacaatgccgctgcagcagtgccgtttttcggggggggtagcgttttgagggcagccgagcccgccccacacgcgagctacggggggatcgtgtctgtcgagaccgatctcctacagtggtgtctggaatccggaagcatccctatactgtgcccaatcggtgaaacagccgcgcggcggagcgtgctgctggactcccttgaagtcaccgcaagcctggcgaaggcattgcggcccaccaagatcattttcctcaacaacacaggaggcctgcgcgacagctcccacaaagtattatctaatgtgaacttgccagctgaccttgatctcgtgtgtaatgcagagtgggtctctacaaaagagagacagcagatgagactgatcgttgatgtgctgagtcggttgccccaccatagttccgctgtgatcaccgctgcgtctacgctgctaacagagctgttttccaataaggggtccggcaccttgtttaaaaacgcggaacggatgctcagggtacgcagtcttgataaactagaccaaggaaggctcgttgatctcgtaaacgccagctttggaaagaagcttagagatgattacttggctagtttgcggccaaggttgcactcaatctatgtgagcgagggatataatgcggccgctatcctaaccatggaacctgtgctcggcggcactccctacttggacaaattcgtggtgtcaagctctaggcagggtcaagggtcggggcagatgttgtgggaatgtctaaggagagacctgcagacactgttttggcgcagtcgagtcactaatccgattaatccatggtattttaaacatagcgatggatcattttcgaataagcagtggatatttttctggttcggcttagctgatattagagacagctatgaactggtcaaccacgccaaagggcttccggattcattccacaagccagcctccgatccaggcagc

SEQ ID NO: 17079 - DNA, 1602 bp, Artificial Sequence
  Description of Artificial Sequence: Synthetic coding sequence
atggcaacagccctgatggcagtggtgttgcgggccgcggccgtggccccgcgcctgcgagggcgcggaggaaccggtggagcacgccgtttgagctgcggtgccaggcgacgcgcggcccgtgggacttcaccaggccgccgtctgagcacagcttggtctcagccgcagcctccgcctgaggagtacgctggtgcagacgacgtgtcgcaatcaccggtcgctgaagaacctagctgggtccctagcccacgcccgccagtcccacacgagagtcctgagcccccgtcgggtcgcagcctggtgcagcgcgatattcaggccttcctgaaccaatgtggtgcaagccctggcgaggctcgccactggctgactcagttccagacttgccaccacagcgccgacaagccgttcgcagtcatcgaagttgacgaggaggtgctgaaatgtcagcagggagtgtctagcctggcttttgcactggcgtttctacagcgtatggacatgaagccattggtggtcctgggtttgcctgcgccgaccgcacctagcggttgcctcagcttttgggaagcaaaggctcagctggcgaaaagctgcaaggtccttgttgacgctctgcggcacaacgccgcggccgcagtccctttcttcgggggtggctcagttctgcgcgcggcggaaccagcgccgcacgcgagctacggtggtatcgttagtgtagagactgatctgcttcaatggtgtctggaaagcggttccattccgattctgtgtccgatcggcgagaccgcggcacgcaggtcagtcttactggattctttagaggtgactgcgagcctggcgaaagcactgcgcccgactaaaatcattttcctgaataacaccggtggcctacgcgacagcagccataaggtcctgtccaatgttaacctgcctgccgacctggacctggtgtgtaacgccgagtgggttagtacgaaggagagacaacagatgcgcttgatcgtggacgttctctcccgcctgccacatcacagcagcgcagtgataacggccgccagcaccctgttgacggagctgttcagcaataaaggatccgggaccctcttcaaaaacgcggagcgcatgctgcgtgtacgttcattagacaaactggatcaaggtcgcttggtggatttggttaatgcctcctttgggaagaaactgcgcgatgactatctggccagccttcggccgcgactgcatagcatttacgtgtcagagggttataacgccgcagctatcctgaccatggagccagtcctgggcgggaccccgtatcttgacaaatttgtggtgagcagctctcgacagggccaaggctcaggccagatgctgtgggagtgcctcaggagagacttacaaaccctgttctggcgcagccgcgtaacaaacccaatcaatccgtggtattttaaacatagcgatggcagcttcagcaacaagcagtggatctttttctggttcggtctggccgatatccgtgactcctatgagctggtgaatcacgcgaagggtctgccagactccttccacaaacctgccagcgacccaggtagc

SEQ ID NO: 17080 - DNA, 1602 bp, Artificial Sequence
  Description of Artificial Sequence: Synthetic coding sequence
atggctacagccctgatggccgtggtgttaagagccgctgccgtggctcctaggttgcgtggacgagggggaacaggaggagcgaggaggctaagttgtggagcgcgcagaagagcggcccgaggaacgtcccccgggcgacgtctaagtactgcgtggtcacagccccagcccccgcccgaagaatatgcaggagctgatgatgtatcacagtcaccagtcgcagaagaaccctcatgggtgccctctcctagaccccctgtgccccacgaatcccccgaaccgccctcagggcgatccttggtgcagagagacatacaggcttttctgaatcagtgcggagcatcccccggggaagccaggcattggttaacacagttccagacttgtcaccactccgccgataaaccatttgccgtgattgaagtagatgaagaagtgcttaaatgtcaacagggagtttcttctcttgctttcgctctggcatttcttcagagaatggatatgaaacctctagtagtcctggggcttcctgcgcccacagccccctctggatgcctatctttttgggaagccaaagctcagctggcaaaatcctgtaaagttctcgtggatgctctacgccacaatgccgccgccgccgtgcctttcttcggggggggatctgttctgcgagccgctgaacccgcccctcatgcttcttacggaggaatcgtgtccgttgaaactgatctgctccagtggtgtctcgaatccgggtctattcctatcctctgtcctattggagagacagccgcccgccggtccgttctgcttgactctcttgaagtgacagcaagtttggccaaagccctccggcccacaaagataatcttcttaaacaatacaggagggttacgcgattcgtcgcataaagtgctgagtaatgtaaatcttcctgcagatctcgatctcgtgtgcaatgctgaatgggtctctacaaaagaaaggcagcagatgaggctaatagtggatgtgctcagtcgattgccccatcacagttctgcagtaatcacagccgcatcaacactcctcacagaactcttttccaataaaggatctgggacactattcaaaaatgctgaacgcatgcttcgcgtgcgttcactagataaactcgatcaggggaggctcgtagatttggtgaacgcctccttcggaaagaagttaagagacgattatctggcctccctcaggcctcggctgcattcaatatatgtatctgaaggatataacgccgctgctatcttgactatggaaccagttctcggggggacaccatatttggacaagtttgtggtgtcttcttcacgacaggggcaggggtccggacagatgctctgggaatgtctgaggcgcgatctccagactcttttttggcggtctagggtgactaaccccataaatccttggtacttcaaacattcagatggaagtttctcaaataaacagtggatcttcttctggtttgggctggcagatatacgcgactcttacgagctagtgaatcatgcgaaagggctccctgatagtttccacaaaccagcaagtgatccagggtcc

SEQ ID NO: 17081 - DNA, 1602 bp, Artificial Sequence
  Description of Artificial Sequence: Synthetic coding sequence
atggctactgcgctgatggccgtcgtgctgcgcgctgctgctgtggccccgcgactgcgcgggaggggaggcacgggaggagccagacggctgagctgtggtgcccggcgcagagcggcccgaggaacttcgccgggcagacgcctctcaaccgcctggagccagcctcagcccccgcctgaagagtacgcgggcgccgacgatgtgtcccaaagcccggtcgccgaagagccgagctgggtcccatcgcccagaccgcctgtcccacatgagtcgcctgagccaccctctggacgctcgctggtgcaacgggacatccaggctttcctgaatcagtgcggagcgtcgccgggagaggcccggcattggcttacgcagttccagacttgtcaccactcggctgacaaaccgtttgcagtcatcgaggtggatgaagaagtcctgaagtgtcagcaaggagtcagttccctggccttcgccctggcgttcttgcagaggatggacatgaagcccctcgtggtgctcggactgccggctcctactgccccgtccggatgcctctcattctgggaggcgaaagcgcagctcgctaagtcatgcaaggtgctcgtggatgccctgcgacataatgcggcggccgcagtgccattcttcggaggaggctccgtgctgagggctgccgagcctgccccccacgcctcgtacgggggaattgtgagcgtggagactgacttgctgcagtggtgcctggagtcagggtcgatcccaatcttgtgtccgattggagaaaccgcagcaagacgctccgtgctcctcgatagcctggaagtgactgcatccctggcgaaagcgcttcgccctactaagattatctttctcaataacactggaggactgcgcgattcctcgcacaaagtgctctcgaatgtcaacctgcccgccgacctggacctcgtctgcaatgcggaatgggtttccaccaaggaaagacagcaaatgaggctgatcgtcgatgtcttgtccagactgccgcaccattcatccgcagtgatcaccgccgcgtcaactctcctgacggagctcttctccaataagggatccggcaccctgtttaagaacgccgaacgcatgctccgcgtccgttcgctggacaagctcgaccagggtaggctcgtggatctggtcaacgcatccttcgggaaaaagctcagagacgactacctggcctccctgcgcccccggctgcactcaatctacgtgagcgaaggatacaatgccgcggcaatcctcaccatggaacctgtcctgggaggaaccccatacctggacaaattcgttgtctcgtcatcaagacaaggacagggaagcggtcagatgctgtgggaatgtctgagaagagacttgcagactctcttctggcgctcacgtgtgactaacccgatcaacccttggtacttcaagcactcggatggatccttttccaacaagcaatggatcttcttctggttcgggctggccgacatccgagactcctacgaattggtgaatcacgctaaaggtctgccggattctttccacaagccggcttccgacccaggctcc

SEQ ID NO: 17082 - DNA, 1602 bp, Artificial Sequence
  Description of Artificial Sequence: Synthetic coding sequence
atggcaactgctctcatggccgtggtgctccgcgcagcggctgtcgccccaaggctccgggggagggggggaactggaggagcaagacgccttagttgtggggcacgccgaagggcggcgaggggaacctctccagggcgaaggctcagtaccgcgtggtcgcagccacaacctcctcccgaggaatacgctggggctgacgatgtctcgcagtcaccagtcgcagaagagccctcttgggtaccgtctccccgcccccctgtgccccatgagagcccggagcccccctcaggccgatccttggtacagagggacatccaggcatttctgaatcagtgcggggccagcccaggtgaggctcggcactggcttacgcaattccagacctgccaccacagcgctgacaaaccattcgccgtcattgaagtggatgaggaagtgttgaaatgtcagcaaggagttagctctctggccttcgctttagccttcctccagcgcatggatatgaaacccctcgtggtgttggggttacctgccccgaccgccccgtcgggctgtctttcattctgggaagctaaggctcagctagccaagtcatgtaaagtgctggtagatgccctaagacataacgcagccgctgctgtgccgttttttgggggaggcagcgtgctcagagcggcagagcccgcaccacacgcctcttacggagggatcgtcagtgtggagacagaccttctgcagtggtgtctggagtccggctctatccccattctctgccccatcggtgagactgcggctcggaggtcagttttgctggattccttagaggttactgcttctcttgccaaggcacttagacctacaaagattatattccttaataacactggaggtctaagggactcttcgcacaaggttctttctaacgtgaacctgcctgctgacctggacctggtgtgcaacgccgagtgggtgagtacgaaggagcgtcaacaaatgcgccttatcgtcgatgtcctgagcaggctaccacatcacagttctgcggttatcaccgcagcttcaacactgctgactgagctgtttagcaataaaggcagcggaacattattcaagaatgctgagcgtatgctgcgcgtaaggtctttagataagctggaccagggaagactggtcgacttagtcaatgcatctttcggaaagaagctgcgagatgattacctcgcttctctgagaccccgactccactctatttacgtgagcgaggggtataacgccgcagccatcctaaccatggagcccgtattgggcgggactccctatctggacaagtttgtggttagttcttctcgtcaagggcaggggagtgggcagatgctatgggaatgcttgaggagagatctccaaacattattctggcgatctcgtgtgaccaacccgataaacccctggtacttcaagcattcggacggatcatttagcaataagcaatggattttcttttggtttggacttgctgatattcgagactcatacgagcttgtgaatcacgctaagggcttgccagactctttccataaacctgcgtcggacccagggagt

SEQ ID NO: 17083 - DNA, 1602 bp, Artificial Sequence
  Description of Artificial Sequence: Synthetic coding sequence
atggcgacggcgctgatggcggtggtccttagagcagccgctgtcgcaccaagactccgggggcggggaggaaccgggggcgcgcggaggctgtcatgtggagcccggcggagagcagccaggggcacctcaccagggcggcgcctgtccactgcctggtcacagccgcagccgccacctgaggaatacgcgggagccgatgatgtgtctcaatcaccagttgcagaggaaccgagctgggtgccaagccctcgcccaccagtcccgcatgaatcgccggagcccccatccggaagatcgctcgtgcagcgggatatccaggcttttctgaaccagtgcggagcgtctccgggagaagcccgacactggctgactcagttccagacctgccatcactcggcggataagccgttcgcggttattgaggtggatgaagaggtgctgaaatgccagcaaggcgtgtcgtcgctggccttcgcactcgcgtttttgcagcgcatggacatgaaaccattggtggttctgggactccccgccccgacggccccgtcgggctgcctctcgttttgggaggcaaaggcgcaactggccaagtcgtgcaaagtgctggtggacgccctgcggcataacgcagccgcagcagtcccgttctttggaggaggatcggtgctgagagccgccgagcccgctccacatgccagctacggaggaatcgtgagcgtggaaactgatttgctgcagtggtgcctggagtcaggatccataccgatcctgtgcccgatcggtgagactgccgcgaggcgatccgtgctgttggacagcctggaggtgaccgcgtcactcgcaaaggcacttcggcctaccaagattatcttcctgaataacaccggcggtctgcgcgattcgtcccacaaggtcctgagcaatgttaatctcccggccgacctggatctggtgtgcaatgccgaatgggtgtcgaccaaggaacggcagcagatgagactgatcgtggatgtgttgtcgcggctgccgcaccactcgtcagccgtgatcactgcagcttcgacgctcctgacggaactcttctcgaataagggctcggggacgctcttcaaaaacgcggaacgcatgcttcgggtgcggtccttggataagctggatcaaggcagactggtcgacctggtgaatgcctcctttggcaagaagctgcgggacgactaccttgcatcattgcgcccaaggctccacagcatttacgtctcagaaggatacaacgctgcggccattctgaccatggagcctgtgcttggcgggactccgtacctggacaagttcgtggtttcatcgtcgcgccaaggacaaggctccggccaaatgttgtgggagtgcctgcgccgggacctgcagaccctgttttggaggagcagagtcactaacccgatcaacccctggtactttaagcattccgacgggtcgttctccaacaagcagtggatctttttctggttcggacttgcggatattcgcgattcatacgagctcgtgaaccacgctaaggggctgcctgactcgttccacaagccggccagcgatccgggttcg

SEQ ID NO: 17084 - DNA, 1602 bp, Artificial Sequence
  Description of Artificial Sequence: Synthetic coding sequence
atggccaccgccctgatggccgttgtgctgcgcgcggccgccgtggctccccgcctgcgaggtcgtggtggcaccgggggtgcccgccggctgtcgtgtggtgcgcgtcgccgggccgctaggggcacaagtccgggccgtcgattgagtactgcgtggtcgcagcctcagccccccccagaagagtacgcaggcgccgacgacgtgtcccagtccccagtggccgaggagccgagttgggtgccgagcccccgcccgcccgtgccgcacgagtcccctgagccgccatcgggacgttcgctcgtgcagcgcgatattcaggcttttttgaaccagtgcggagcatcgccaggggaggcccgccactggctgacacagttccaaacatgtcatcattcggccgacaagcctttcgccgtgattgaggttgatgaggaggtgctgaagtgccagcagggtgtctcctccttggcattcgcgttggcttttctgcagcgaatggatatgaagccccttgtggtgttgggtctgccggcccccacggctccgtctggctgtctgtcgttttgggaagccaaggcccagttggcgaagtcatgcaaggtacttgtcgatgccctacgccataacgccgccgccgccgtcccatttttcggtggcggcagtgttttgcgggcggctgaacccgctccacatgcttcctacggcggaattgtctccgtggaaactgatctcttacagtggtgcttggagagtggcagtattcccatactctgccctattggtgagaccgctgccagacggagcgtgctgctcgacagtctcgaggtgacagcctcgctagccaaggccttgcggccgaccaaaataatttttctcaacaatacgggaggcctacgagactcaagtcacaaggtcctgtccaacgtgaatctgcccgcggatttagatctggtatgcaacgccgagtgggtgagtacaaaggagcgccagcagatgaggcttatagtggatgtgctgtcccggctgcctcatcattcgagtgcggtgattaccgctgcaagcaccctgctgaccgagctcttttccaacaagggctccggcaccctgtttaagaacgccgagcgcatgctccgcgtgcgcagtctggataagctggatcaaggccggttggttgacctcgtaaacgcctcatttggcaagaagctgagggatgactacctagcgagcctgcgcccccggctgcatagcatctatgtgagcgaaggctacaacgctgctgctattttgaccatggagccagttttaggcggcacaccatatctggacaagtttgtggtctccagttccagacagggccagggatccgggcagatgctctgggagtgcctccgccgtgatctccagactctcttctggcgatctcgggtcacaaaccctataaatccatggtatttcaaacactccgatggtagcttctccaacaagcaatggatctttttttggtttggtctggctgacattagggactcctatgaactggttaaccacgctaagggcctcccagattcttttcacaaaccagcttcggacccaggaagc

SEQ ID NO: 17085 - DNA, 1602 bp, Artificial Sequence
  Description of Artificial Sequence: Synthetic coding sequence
atggctacagctctcatggccgtggtcctgcgcgcggcagcagtggctcctaggcttcgcggacgaggcggaactggtggagcccgccgcttgagctgcggcgctcgcagacgggccgcccgcgggacatctcccgggcgacgcctgtccacagcgtggagtcagccgcaacctcctcccgaagaatacgccggcgccgacgatgtatcacagtctccagtggcggaggagccatcctgggtgcccagccctcgaccccctgtaccgcacgaatcccccgaacccccatcgggccgctcccttgtccagcgcgatatccaagcttttctaaatcagtgcggagccagcccgggggaggcgcggcactggttgacacaattccagacatgtcatcatagcgcagacaaacccttcgctgtgatcgaggtggatgaggaagtgctgaagtgccagcagggagtgtctagcttagctttcgctctggcgtttctacaaaggatggacatgaaaccattggtcgtgttgggattgccagcaccgaccgctcctagtggttgcctgtcattttgggaggcaaaggcacagctggccaaatcttgtaaagttctcgtagacgcccttagacataatgcagctgctgcggtccccttcttcggcggaggctccgtactgcgggccgccgagccagccccccatgcctcttatgggggtatcgtgtctgtggagaccgatctgttacagtggtgtttagagtccggctccatcccaattctgtgtcccatcggcgagacagccgctagaaggagcgttttattggacagtctggaagtgaccgcaagtctcgcaaaggccctgagacctacaaagatcattttcctcaataacactggagggctgcgggattcgtctcataaggtcctgagcaacgtgaacctgcctgcagatctggatctggtctgcaatgctgagtgggtcagtaccaaggagcggcaacagatgaggctcatcgtagacgtgctgagccgccttcctcaccactcttctgcggtgatcaccgcggcaagtacactcctgacagagctgttttctaacaagggcagcggaacactcttcaaaaatgccgaaagaatgctacgtgtgcggtcgttggacaaattggatcaggggcggctggtggatttggtgaacgcatccttcgggaagaaattgcgcgatgattacttggcttctctgagaccgcggctgcactccatatatgtgagtgaaggttataacgcagctgctatcttgactatggaaccggtgctcggcggaaccccatatttagacaaattcgtggtctccagctcacggcaggggcagggcagcggacagatgctctgggagtgtctgaggagggatctccagacattgttctggcggagtagagtgaccaaccccataaacccgtggtatttcaagcatagtgacggatctttcagtaacaagcagtggatctttttttggtttgggcttgccgatattagggattcctacgagctcgttaaccacgccaagggactccctgactcttttcacaagccagcatctgaccccggctcc

SEQ ID NO: 17086 - DNA, 1602 bp, Artificial Sequence
  Description of Artificial Sequence: Synthetic coding sequence
atggcaacggctcttatggcagtcgtactcagggcggccgccgtggcacctcggctgaggggtagaggaggtaccggcggtgccagacgccttagctgcggagcacggcgccgggcagcaagagggaccagccctggaaggcgcctttcaaccgcctggtcccaacctcagcccccacctgaagagtacgcgggagcagatgacgtgagccagtcgcctgtggcagaagagcctagctgggtccctagcccccggcccccggtcccccacgaaagccctgaacctccttcggggcggtcgcttgtgcaacgtgacatccaggcttttctgaatcaatgcggagcatcgccaggagaagccaggcactggctgactcaatttcaaacttgtcatcattcagctgataaaccattcgctgtcatagaagtggacgaggaagtgctcaagtgtcaacaaggagtgtcgagcctggcattcgccctcgccttcttgcaacggatggatatgaagccgctggtggtgctgggacttcctgcacctaccgcaccatcgggctgtctttccttctgggaggcgaaggcccaacttgcaaagtcttgcaaggtcctggtggatgccctcaggcataacgcggccgccgcagtgccctttttcggaggtggttcggtgctgcgtgcagcagaaccagcaccacacgcgtcctatggtggaatcgtatcggttgaaactgatctgctgcaatggtgccttgagtcggggtcgataccaattctctgcccaattggagaaactgccgcccggcggtccgtgctgctggactcgctcgaagtgactgccagcttggcaaaagcactgcgacccaccaagatcatttttctgaacaacaccggcggactccgtgattcatcgcataaggtcctttccaatgtcaacctgcccgcagatctcgatttggtctgtaacgcagagtgggtatcaaccaaggagcggcagcagatgcgccttattgtcgatgttttgtcgcgtctgccacatcacagctccgcggtcatcaccgcagcatcaacgctgctcactgagctcttttcgaataagggctccggcactctcttcaagaacgcggagcgaatgctgagagtgcgttctctcgacaaactggatcagggtcgactggtggatctggttaacgccagttttggtaaaaagctgagggacgattaccttgcaagtctgcgcccaaggcttcactcgatttacgtgagcgaaggatacaacgccgcagccatcctgacgatggaaccagtgctggggggaaccccataccttgataagttcgtcgtgtcctcgagcagacaagggcaagggtctggtcaaatgttgtgggaatgcttgcgaagggatctgcagacgctgttttggagaagcagagtgactaacccaatcaatccttggtacttcaagcattcagatggttcattttccaataagcaatggattttcttttggtttgggctcgccgacattagagattcgtacgaactggtcaaccacgcaaaaggtttgcccgacagctttcataagccggcatcggaccccggatcc

SEQ ID NO: 17087 - DNA, 1602 bp, Artificial Sequence
  Description of Artificial Sequence: Synthetic coding sequence
atggccactgccctgatggccgtggtgctgagggcagccgccgtggccccaagacttcgtggtcgcggtggaacgggtggcgcacggagactgtcatgtggagcacgtcggcgggctgcaagagggacttcgcctggacgccgcctgagcactgcctggagccagccccaacctccacctgaggagtacgcgggagcagatgacgtgtcgcagtccccagtagccgaagaaccttcttgggtgccatcgccaaggcctcctgtgccacacgagagcccggaacctccttcagggcgtagcctggtgcaaagagatattcaggcctttctgaaccaatgcggggcatcgcccggagaagcccgccattggttgactcaatttcaaacctgccaccattccgcagacaagccattcgcggtgatcgaagtggatgaagaggtccttaagtgtcaacagggtgtgtcgtcgcttgcctttgctcttgcgttcctccaacgtatggacatgaagcccctcgtggtgcttggtctgcctgcaccgaccgcaccttcaggatgtctttcattttgggaagcaaaagcacagcttgcgaagtcgtgcaaagtcctggtggatgccctgcggcacaacgcagcagctgcggtgcccttttttggtgggggaagcgtcctcagggcggccgaacccgcgcctcacgcctcatatggaggtattgtttccgtcgaaactgatctgctccagtggtgcctggaatcagggtccattccgattctgtgtccaatcggggaaactgcagcccgcagatccgtgctgcttgattcgcttgaagttaccgcctccctggccaaagcactccgccccaccaaaatcattttcctgaataacaccgggggcctccgtgattccagccacaaggtcctttccaacgtcaaccttcccgcggacctggatctcgtctgcaatgcagaatgggtgtccactaaggaaaggcagcaaatgcgcctgatagtggatgtgcttagcagacttccccatcattcctcggcagtcatcaccgcagcgagcacccttctgactgagctgttttcgaacaagggatcagggaccctcttcaagaatgcagaacggatgctccgggtgagatcactggacaagctggatcaaggtagattggtggatctggtgaatgcatcgttcgggaagaaactgcgggatgattacctggccagcctgcggccacgccttcactccatttacgtctctgaagggtacaatgcagcagccattcttaccatggagccagttctcggaggaaccccatacctcgataagtttgtggtgtcctcatcgagacagggtcaagggtctggccagatgctctgggaatgccttcgccgcgatctgcagactctgttctggcggtcgagagtgaccaaccccatcaatccctggtactttaaacattctgacggctcattttcgaataaacaatggatcttcttttggtttggccttgccgatattcgggactcctacgagcttgtgaatcatgccaagggactccctgattcattccataagccagcatcagacccaggcagc

SEQ ID NO: 17088 - DNA, 1602 bp, Artificial Sequence
  Description of Artificial Sequence: Synthetic coding sequence
atggctactgcactgatggcggtggtcctgcgggctgcggcagttgctccccgactgagaggaaggggcggcacagggggtgcgagacgcctgagttgcggggcccggaggagggccgcaagaggcacaagtcctggacgacgactaagcaccgcctggtctcagcctcaacctcctcctgaggagtatgcaggggctgacgatgtttcccaaagccccgtggctgaggagccaagttgggtgccgagcccacggccaccggttccccatgagtctcctgaaccaccctctggcagatcactggtgcaacgagatatccaggccttcctgaatcagtgtggagcttctcctggcgaagctcgccactggctgacacagtttcagacatgccaccattctgcagacaaaccattcgcagtaatcgaagtggacgaagaagtcctgaagtgccagcaaggagtgtcaagcttagcctttgcactcgcattcctgcagcggatggatatgaagccgcttgtcgtgctggggctgcccgctccaacggctccatccggttgcctgagtttttgggaggcaaaagctcaactggccaaatcctgtaaagttctggtcgacgccctgcgccataacgccgcggccgccgttccgttttttggtggcggctcagttttgagggcggcagagccagccccacacgcatcgtacgggggaatcgtatccgtggaaacagatctcctccaatggtgccttgagagcggctcaattcccatactatgtcctataggcgagacagccgcccgacgctccgtcctcctagactcacttgaggtgacagccagtctagcaaaggcactgaggccaaccaagatcattttcctcaacaacacagggggccttagggattccagccacaaggttttgagcaacgtcaacctccctgctgacttagaccttgtttgcaatgctgaatgggtgtccactaaggagcgccagcagatgcggctgatcgttgacgtgctttcccgcctgccacaccacagcagcgccgtgatcacggcagcctctacactgctgacagagctgttctctaacaagggaagcggcaccctatttaaaaacgcggaaaggatgttgagagtgcgatccctggacaaattggaccaggggcggctggtggaccttgttaatgcttccttcggcaaaaagctccgggacgactatctcgcttcgctccggccacgcctccacagtatttatgtatcagaaggctacaatgcggcagcgattctgaccatggagcctgtcctaggggggaccccgtacctggacaaattcgtggttagcagctccaggcagggccaaggctcagggcaaatgctgtgggagtgtctccgccgcgatcttcagacactgttttggcggagtagggtaaccaaccccataaatccgtggtattttaaacattctgatgggagcttcagtaacaagcagtggatttttttttggttcggactggctgacatcagggacagctatgagctggtcaaccacgcgaagggtctccctgattcatttcacaagcctgcgtcagatcctggcagc

SEQ ID NO: 17089 - DNA, 1602 bp, Artificial Sequence
  Description of Artificial Sequence: Synthetic coding sequence
atggcgaccgcgctgatggcggtggtgctcagggccgcggccgtcgcaccgagactgcgcggaagaggaggaaccggaggagcccggagacttagctgcggagctagacggcgcgccgccagaggaacctcgccgggacggcgcctgtcaactgcatggagccaaccccagccgccaccggaagaatacgctggagcagacgacgtttcgcagtcgccggtggcagaggaaccatcatgggtgccatccccccgcccaccggtgccgcacgaatcgcctgaaccgccgagcggcagatctctcgtgcaaagagacatccaggcgttccttaaccaatgcggagcttccccgggagaagcacggcactggctgactcagttccagacgtgccaccattctgcggacaaacctttcgccgtgatcgaagtcgacgaagaagttttgaagtgccagcaaggagtttcctcactggctttcgcactggccttcctgcaacggatggacatgaagcctcttgtggtgcttggactgccagcgccaaccgcaccttcgggatgtctgtccttttgggaggcaaaggcccaactggcgaagtcgtgtaaagtgctcgtggacgcccttcgccataacgcggccgctgcggtcccgttcttcggcgggggctcagtgttgcgggcagccgaaccggcaccgcacgcaagctacggcggaatcgtgtcggtcgaaaccgacctgctgcagtggtgcctcgagtcggggtccatcccaatcctgtgccccataggagagactgcggcccgccgctcagtcctcctcgattccctcgaggtgaccgccagcctggcgaaggcgctgcgcccgactaagatcatcttcctcaacaacaccggcggcctccgcgatagctcacataaagtgctgagcaatgtgaacctccctgccgatttggacctggtgtgtaacgcggaatgggtgtcaacgaaagaacggcagcagatgagactcatcgtcgatgtcctgtccagactcccccaccattcgtctgccgtgattactgcagcctcgaccttgctgactgaactgttctcaaacaagggctccggtactctgtttaagaacgcagaaagaatgctgagggtgagatcactggataagctggatcagggacgcctggtggacctggtgaatgcatcgttcggtaagaaacttagggatgactacctggcgagcctgcgaccgcggctccacagcatctacgtctcggagggatacaatgcggccgctatcctcactatggagccggtgctggggggcactccatatctggacaagttcgtcgtctcatcttctcgccaaggtcagggttcaggtcagatgctgtgggagtgcctgcgccgggatctccaaaccttgttctggcggagccgggtcaccaacccaatcaatccttggtacttcaaacattccgacggctcattttccaataagcagtggatcttcttctggtttggactggccgacattagagatagctacgagctggtcaaccacgccaagggactcccggacagcttccacaagccggcctccgatccggggtcg

SEQ ID NO: 17090 - DNA, 1602 bp, Artificial Sequence
  Description of Artificial Sequence: Synthetic coding sequence
atggcaacggctctgatggctgtcgtgcttagagcagcagccgtggcacctcgcctccgcggcagaggtggaaccgggggtgcacggcgcctcagctgtggggcacgtcggcgggcagcaaggggcacctcccctggacgtcggctttcgaccgcctggtcacaacctcagcctcctcctgaggaatacgcaggggctgatgatgtgtcgcaatcgcctgttgccgaagagccctcgtgggtgccttcacccagacctcccgtgccccatgaaagccccgaaccaccatcgggtcggagcttggtgcaacgagatatacaggcattccttaatcagtgtggggcctccccaggcgaggccaggcactggcttacgcaatttcaaacctgccatcattctgcggataagccatttgcagtgattgaggtggatgaagaggtgcttaaatgtcagcagggggtgtcctccctcgcatttgccctcgcatttcttcaacgcatggacatgaagccccttgtcgtcctcggtctgccggcgccaaccgcaccgtccggatgtctgtccttttgggaggccaaggcgcaacttgccaagtcctgtaaggtgctggtggacgcactgagacacaacgcagctgcggccgtgccctttttcggagggggaagcgtccttcgtgctgccgaacctgccccccatgccagctacggaggaatagtgagcgtggaaacggacctcctccaatggtgtctcgaatcgggatcgattccgattctttgtcctatcggggaaacggctgctaggcgctctgtgttgcttgattccctcgaagttactgcatcactcgctaaggcacttcgccctactaagattatctttcttaacaataccgggggactccgggattcatcgcataaagtgctgtcgaatgtgaacctcccagcagatctcgatttggtgtgcaatgcggaatgggtgtcgactaaagaaagacagcaaatgcggcttatcgtggacgtgctgtcacgacttccccatcatagcagcgcagtgattactgccgcctccacccttcttacggaactgttctccaataaaggttcaggtactcttttcaagaacgcagagaggatgctgagagtccgttctctggacaaacttgaccaaggacggttggtggatctggtgaacgcgtcatttggtaaaaagctcagagatgactaccttgcttcgctcagaccaagattgcattcgatatacgtgtccgaaggatacaatgcagccgcgattctgactatggagccggtgctcggaggtactccatacctcgacaagtttgtcgtgtcctcctcgcgacagggtcaaggatccggacaaatgctgtgggaatgccttagacgcgatcttcagaccttgttttggaggtcaagagtgaccaatcctatcaatccatggtactttaaacacagcgatggctcgttctcaaacaagcaatggatattcttttggttcggactggccgacatccgtgatagctacgagctggtgaatcatgctaaggggcttccagattcgttccacaagcctgcttccgaccccgggtct

SEQ ID NO: 17091 - DNA, 1602 bp, Artificial Sequence
  Description of Artificial Sequence: Synthetic coding sequence
atggcgacagcacttatggcggtggttctgcgggccgcggctgtcgccccacggcttcgtggtcgcggcggcaccggaggcgcccgacggctgtcttgcggggccaggagaagggctgctagaggcacctcccctggacggcgcctgagcaccgcgtggagtcagcctcagccgccccccgaagagtacgccggggccgacgacgtgtcccaaagtccagtcgctgaagaaccatcctgggttcccagtccacggcccccagtgcctcacgagtctcccgagcctccaagcgggcggtcgctcgtgcaaagagacattcaggcattcctgaatcaatgtggcgccagtcccggagaagcccgccactggcttacacagttccagacctgccatcattctgcggacaaaccctttgcagtgatcgaagtcgacgaggaggtcctgaaatgccagcaaggggtaagcagcctggcatttgccctggcgtttcttcagagaatggacatgaaaccactggtcgtcctcgggctgccggccccaacagcaccaagcggctgtctgtcattctgggaggccaaggctcagcttgcaaagagttgcaaggtactggtcgacgcactccgccacaatgccgccgcagccgtgccattctttggggggggatccgtgctcagggccgctgagcctgccccacacgcttcatacgggggaatcgtgtctgtggagacggaccttctccagtggtgcttagagtctgggtccattcccattctgtgtcctatcggagaaactgctgccagacgatctgttttgttggactccttggaggtgactgcatcattggccaaggccctaaggccgacgaagattatctttctgaataacaccggcggcctgagggacagttctcacaaagtgctttccaatgtgaacttgcccgctgatttggacttggtgtgtaacgctgaatgggtctctaccaaggagcgccagcagatgaggctcattgtggatgttctctcacggttgccccaccactcctcagcagtcatcaccgctgccagtactttgctgacggaattgtttagtaacaaaggatcgggcacactttttaaaaatgctgagaggatgctccgggttagatctcttgataaattggaccaggggaggctggtagacctcgtgaatgcctcctttggaaaaaagctaagagatgactacctggcctcattaagaccacgtctgcatagcatttacgtgagcgaggggtacaatgccgcagcaatcttgaccatggaacctgtgctggggggaacaccttatttagacaagtttgtggtaagcagttcaaggcagggccaaggttcaggtcagatgctgtgggaatgtctaaggcgagatctgcagaccttattctggcggagcagggtgaccaaccctataaatccatggtatttcaaacattcggacggatcttttagcaacaagcaatggatcttcttctggtttggattggctgacattcgcgatagttatgaactggtgaaccacgccaaggggctccctgactcttttcacaagcctgccagcgatcccggtagt

SEQ ID NO: 17092 - DNA, 1602 bp, Artificial Sequence
  Description of Artificial Sequence: Synthetic coding sequence
atggccacagctctgatggcagtggtactgagggccgcagctgtggctccccgcctgagaggcaggggaggcacaggtggtgctaggcgtcttagctgcggagcccgtcgccgtgcagcacgcggaacctcccctggacgcaggttgtctaccgcttggtctcagccccagcctcctcccgaagagtacgccggcgcagacgacgtatcccaatccccagtggcagaggaaccaagctgggtcccttctccccgtcccccagtcccccacgagtcaccagagccaccttccggtcgtagcttggtgcagcgtgacatccaagcattcctcaatcagtgtggagcctcacccggtgaagctcgccactggctgactcagtttcagacctgtcaccacagcgccgataaaccctttgctgtcattgaagttgatgaagaggtcctgaaatgccaacagggtgtgtccagcctggcattcgcactggcttttctgcaaaggatggacatgaaaccactggtcgtgttgggactccctgcccctacagcaccatctggctgcctcagtttctgggaagccaaggctcagctggccaagtcatgcaaggtactggtggatgctcttagacacaatgccgcagccgcagtgccattttttggaggtggttctgttctccgcgccgcagaacctgcccctcatgcatcctacggtggcatcgtttccgtcgaaaccgacctgctccagtggtgtctggagtctggtagcatcccaatattgtgtcccatcggcgagactgccgcacgcagaagcgtcttgctggacagcctggaggtcacagcttctctggctaaggctctgagacctactaaaatcatcttcctcaacaatacaggcggcctccgtgattctagtcacaaggttctgtctaatgtgaacctcccagccgacttggatcttgtttgtaacgctgagtgggtctccactaaggagcgccagcagatgagactgatcgtggacgttttgtcaaggttgccccaccactcttccgctgtgatcacagctgcaagcactcttctgaccgaactcttttctaataaaggctccggcacactgttcaaaaacgcagaaagaatgctgcgcgtgaggtctcttgataagctggatcagggtcgcctggtagatttggtaaacgctagctttggaaaaaaactgagggacgattaccttgcctcactgcgtccacgtctccactccatttacgtgagtgagggctacaatgctgctgcaattttgaccatggaacccgtgctcggaggtacaccttaccttgataagttcgtagtgagctcatctcgccagggacaaggatctggtcagatgctctgggaatgtttgcgcagagacttgcagactttgttctggagatccagagtaacaaaccccatcaatccctggtacttcaagcacagtgacggttccttttcaaacaagcagtggatattcttctggttcggactcgcagacataagagacagttatgagctcgttaaccacgcaaagggtctgcctgactcctttcacaagcctgcttccgatcctggctcc

SEQ ID NO: 17093 - DNA, 1602 bp, Artificial Sequence
  Description of Artificial Sequence: Synthetic coding sequence
atggccacagcactaatggccgttgtcctaagggcagctgctgttgcccctcgcttacgcggtaggggcgggacaggtggtgcccgaaggttgtcctgcggcgcgcgtcgccgtgctgcacggggaacctcccccggacgcaggttgtcaaccgcttggtcccaacctcagcctccccctgaagagtacgccggcgctgacgatgtctcgcagtctcccgtggctgaggaacccagctgggtgccgagcccaagacctcccgtgccccatgagagccccgaaccaccaagtggcaggagccttgttcagagggatattcaggcctttctcaaccaatgcggcgcctcgccaggtgaggcaagacactggctcacgcagttccaaacctgtcatcacagcgccgataagccgtttgccgtgatcgaagtcgatgaagaggtgctgaaatgtcagcagggagtgagctctctggcatttgctttagcgtttcttcagcgaatggatatgaaacccctcgttgttctgggactgccagccccaacagcaccttccggctgcctgtcattttgggaagctaaagcccaactggcgaagtcttgcaaagtattggtagatgctctgaggcataacgccgctgcagcagtcccttttttcggaggaggaagcgtgctgagggccgcggaaccggcgccacacgcaagctatggcggtatagtgagtgtcgagacagatctgttgcagtggtgcctggaaagcgggtccatcccaatcctgtgccccataggtgagaccgcagcgcgtagatctgtactgctggactctttagaagtcaccgcgtcactggccaaagctctcagacctaccaagataatattcttgaataatactggtggtctgagagatagcagtcacaaagtcctcagcaacgtaaacctcccggctgacctggaccttgtgtgtaatgccgaatgggtgtcaacaaaggaaaggcagcagatgaggctgattgttgatgtgttgagtagacttccgcatcacagctccgccgtgattacagctgccagtacacttctgaccgagctgttctctaacaaggggtctggcactctgttcaagaatgccgaaagaatgttgcgcgtgcgttccctcgacaaactggatcaagggagactggtagatctggtgaatgctagctttggaaagaaattacgggacgactacctggcaagtctccggcctaggttacactcgatttatgtttcggaggggtataacgccgccgccatcctgaccatggagccagtcctcggaggaacgccctaccttgataagtttgtggtgagcagctctcgacagggccagggctccggccagatgttgtgggagtgcctcaggcgggatctacagaccctcttttggagatcaagggttacgaatcctatcaatccttggtattttaaacacagtgacggatcctttagtaataaacaatggatctttttttggttcggactagccgacatccgagatagctacgaactcgttaatcacgccaaagggctgcccgacagctttcacaagcccgcctcggatcccgggtcc

SEQ ID NO: 17094 - DNA, 1602 bp, Artificial Sequence
  Description of Artificial Sequence: Synthetic coding sequence
atggccaccgcacttatggcggtcgtgttgcgagccgcagccgtcgcaccgagactccgaggccggggtggcaccggaggtgcgaggaggctcagctgtggagctagaagaagggctgccagaggcacctcgccgggtagacgcctctctaccgcttggtcgcagccacagccgccgcccgaggagtacgccggagcggacgatgtgtcacaatcgccagtggcagaagaaccttcgtgggtcccttccccaaggccgccggtgccgcatgaatcgcctgaaccacccagcggacggagcctggtccaacgggacatccaagcgtttctgaaccaatgcggggcctcaccaggagaggccagacattggttgacccagttccaaacttgccaccactcagccgacaagcctttcgcggtgattgaagtggatgaagaggtgttgaaatgccaacagggggtttccagcctcgcattcgctctggcctttctgcaaaggatggatatgaaaccacttgtggtgctcggactgccagctcccactgccccgtcagggtgtctgagcttttgggaagccaaggcacaactggctaaatcctgcaaggtcctcgttgacgctctgagacacaacgcggcagccgccgtccccttctttggaggaggttcagtgcttcgggcagcggaaccagccccgcacgcctcctacggtggaatagtgtcagtcgagactgacctgctgcagtggtgcctggaatccggatctatcccaatcctctgtccgattggggaaactgccgcacggcggtcagtccttctggactccttggaggtgactgcttctctggcaaaggcgctcagaccgactaagatcatttttctgaacaacacgggcggacttcgcgactcatcccacaaggtcctgagcaatgtgaatctccctgccgacctcgatctggtctgtaacgcggagtgggtgagcacgaaggaacggcaacaaatgagactgattgtggacgtgctgtccagactgcctcatcacagttcagccgtgatcaccgccgcgtccaccctgcttaccgagctcttctcgaacaagggtagcggcacgctgttcaagaatgccgaacggatgctgagggtgcgctccctggataagctggaccagggaaggctggtggatctggtaaatgcgtcgtttggaaagaagctcagagacgactacctggcgtcactgcggccacgcctgcactcgatctacgtgtcagaggggtacaatgctgcagccatccttaccatggagccggtcctgggcgggaccccctacctggacaaattcgtcgtgtctagctcccggcagggccaggggtcaggccagatgctctgggagtgtctgcggcgggatctccagactctgttctggagatcgcgggtgaccaatccgatcaacccgtggtactttaagcactccgatggatcgttctccaacaagcaatggattttcttttggttcggattggcggatatcagggacagctacgaactcgtgaatcacgctaagggactgccagactcgttccacaagccagcgtcggatccgggttcc

SEQ ID NO: 17095 - DNA, 1602 bp, Artificial Sequence
  Description of Artificial Sequence: Synthetic coding sequence
atggcgaccgccctgatggccgtggtgctgagggctgcagccgtcgcaccacggctgcggggacggggtggcacaggaggtgccagaaggctctcttgcggggccaggcgaagggccgccagaggcaccagcccgggtcgtcgtctgagtaccgcctggtcccagccgcagccgccacccgaagaatatgcaggggcggacgacgtgagccagagcccggtggccgaggagccctcctgggtcccttcacctcgccccccagtcccgcatgagagccctgagcctccttcgggaagatcactcgtgcagcgggacatacaggccttcttgaatcaatgtggggcatcgcctggtgaagcacgacactggctcacacagttccaaacctgtcaccatagcgctgataagcccttcgcggtgatcgaggtggacgaagaagtcctgaagtgccagcagggcgtgtcaagtctagcattcgctttagcttttttacagcggatggacatgaagccgctggtggtgctcggtctgcccgcaccaaccgccccctcggggtgcctcagcttctgggaagctaaggcacaactcgccaaatcttgtaaggtcctggtggatgccctgcgtcacaatgccgccgctgcggtgcctttcttcggcggcgggtccgtcttaagggccgctgagcctgctccacatgctagctatggtggcattgtttccgtcgagactgatcttctccagtggtgtttggagagcggctccattcccatactgtgccctattggtgagaccgctgcgcggcgctccgtgctcctcgactcattggaggtcactgccagtctagcaaaagccctgcggcccaccaaaatcattttcctgaacaataccggcggcttaagagatagctcgcacaaagtcttgtccaacgtcaacctgcctgcagacctggacctggtctgtaacgctgagtgggtttccacaaaggaacgccagcagatgcgcctgatcgtcgacgtactgagccggctgccacaccactcatctgctgtcatcaccgcagcttcgacgcttctaaccgagctcttctctaacaagggaagtggtacgctttttaaaaacgccgaaaggatgttgagagtgaggtcgctagataagctagatcagggacggttggtggatttagtcaacgcgtccttcggtaagaaacttcgcgatgactaccttgcttcgcttagacccaggctgcattcgatttacgtgagcgaaggctataatgcggccgctatcctgaccatggaacccgtcctgggtgggacaccctacctcgacaaattcgtcgtctcatctagccggcagggacagggaagcggacagatgctgtgggaatgcctgcggcgggacctccagacgttgttctggaggtcgcgggtcactaatccaattaatccctggtattttaaacattccgatggctcattcagtaataaacaatggattttcttttggttcggtctcgctgatatccgtgatagctatgagcttgtgaatcacgctaaggggctgccggattctttccacaaaccggctagcgaccctggctca

SEQ ID NO: 17096 - DNA, 1602 bp, Artificial Sequence
  Description of Artificial Sequence: Synthetic coding sequence
atggcgaccgcactgatggcggtcgtgctccgggctgctgccgtggccccgaggcttcggggccggggaggcactggaggagcgcgccgcctgagctgtggtgccaggcgccgcgcagcccgcggaacgtcgccaggccggcggctctcaactgcatggtcgcaaccgcagccaccaccagaagaatacgcgggagccgatgacgtgtcccagtccccggtcgccgaagaaccaagctgggtcccctcacccagacctccggtgccgcacgagagcccggagccgccatccggaagatctttggtccagagagacatccaagcgttccttaaccaatgcggagcatcccctggagaggcacgccactggttgactcagttccaaacctgccaccactccgcagacaaaccattcgccgttatcgaagtggacgaggaggtgctcaagtgccagcagggcgtgtcctcactcgccttcgccctggcttttctccagagaatggacatgaagccgctggtggtgctgggcttgcccgcccccactgcaccgtccggttgcctgtcgttttgggaagccaaagcacagctggcaaaatcctgcaaggtgcttgtggatgctctgcgccacaacgccgcggcagcagtgccgttttttgggggtggctccgtcctgcgcgcagccgaacctgcgccgcacgcctcttacgggggaatcgtgtccgtggaaaccgatctgttgcaatggtgcctggagtcggggagcatccctatcctgtgtcccatcggagagactgcagcgcgccgctcagtcctcctggactcgctcgaggtgaccgcctcgctggccaaggccctccggcccacgaagatcatattcctgaacaacactggaggactgcgcgactcatcgcacaaggtactcagcaatgtgaatctccccgcagacctggatctggtttgcaatgcggagtgggtgtcaactaaggagaggcaacaaatgcggctcatagtggacgttctgagccggttgccacaccattcgagcgccgtgatcaccgcagctagcaccctgcttactgaactgttttcgaacaaaggatcgggaaccttgttcaagaatgcggagcgcatgctccgcgtgagaagccttgataagttggaccagggacggctcgtggacctggtcaacgcctcgttcgggaagaagctgcgtgacgactaccttgcctcgttgcgcccaaggctccattcaatctacgtgtcggagggttacaacgccgcagcaatccttactatggaaccggtgctgggtggcaccccgtacctggacaaattcgtcgtgtcatcatcccgtcagggccaggggtccggacagatgctctgggagtgcctgcgccgggacctccagacgctgttctggcggtcccgcgtcactaatccaatcaacccatggtactttaagcattcggatggctcgtttagcaacaagcaatggatcttcttctggttcggcctggcggatatccgggatagctacgaactggtgaaccatgcaaagggcctgccagatagcttccataaaccggcgagcgaccctggatca

SEQ ID NO: 17097 - DNA, 1602 bp, Artificial Sequence
  Description of Artificial Sequence: Synthetic coding sequence
atggcaaccgctctgatggcggtggtgctgcgcgccgccgcagtggccccaaggctgcgcgggagaggcggaactggtggagcgcggagactttcctgtggtgcgaggcggcgggccgcccggggaacttcgccaggtcggcggctgtccactgcgtggagccaacctcagcctccgcctgaggagtacgcaggagctgacgacgtgtcccagagccctgtggcagaggagccgtcgtgggtcccatcccccagacccccggtcccacacgaaagcccggagcctccctcgggacgcagcctggtgcaaagggatatccaggcattccttaatcagtgcggcgctagcccgggagaagctcggcactggctgacccagttccagacttgtcatcattccgccgacaaaccgttcgccgtgattgaagtggacgaggaagtcctgaagtgccagcagggagtgtcaagcctggcgttcgccctggctttcctgcagcgcatggacatgaaaccgcttgtcgtcctcggcctgccagccccgaccgccccatcggggtgtctctcattctgggaagcaaaggcgcaactggccaaatcgtgcaaggtgctggtggacgctctgcgccacaatgcggccgcagcggtcccattctttggcggcggttctgtactgcgcgccgcggagccggccccccacgctagctatggaggaatcgtgagcgtggagactgacttgcttcagtggtgtctggaatccggcagcatcccgattctctgccctatcggagaaaccgcggctagacgcagcgtgctgctggactcgttggaagtgaccgcctcgttggctaaggcactccgcccgactaagatcatcttcctcaacaacactggaggactgcgcgattcatcacataaagtgttgtcaaatgtgaacctcccagcagacctggatctggtctgtaatgcagaatgggtttccaccaaggaacggcaacagatgcgcctcatcgtggacgtgctgtcccgccttccacatcactcctccgcagtgatcacggccgcgtccactctgcttactgagctcttctcgaacaagggatcaggtacgctgttcaaaaacgcagagcggatgttgcgagtgcggtcactggacaagctcgatcagggaagattggtcgacctcgtgaacgcctctttcgggaaaaagctgagagacgattacctcgcctccctgcggccgcggctgcattccatttacgtctccgaaggctacaatgccgccgcgatccttaccatggagcccgtgctcggaggaaccccctatctcgataaattcgtggtcagctcctcccggcaggggcagggatccggtcaaatgctctgggaatgccttcgccgggacctccagacgctgttttggcgcagcagagtgacgaaccccattaacccatggtacttcaaacattcagacggatcgttttcgaacaaacaatggatcttcttctggttcggactggccgacatacgcgattcgtacgagttggtgaaccacgctaagggactccctgattcgtttcacaagccggcctcagacccaggctcc

SEQ ID NO: 17098 - DNA, 1602 bp, Artificial Sequence
  Description of Artificial Sequence: Synthetic coding sequence
atggccactgcactgatggccgtggtgctgcgtgcagcagcagtggcgccaagactgaggggccgtgggggaactggtggagcccggagactttcgtgtggtgccagacgtcgagctgcgcgcggtacctctccagggcggcgcctgtcaactgcgtggtcgcaaccccagcctcctccggaagaatacgccggagcagatgatgtatcccaatccccggtggcagaggagccatcatgggtcccgtcaccgcgcccacctgtgccacatgaaagcccagagccaccatccggaagatcacttgtccaacgcgatattcaagcatttctgaaccagtgtggtgcatcccccggggaagcgagacattggcttactcaatttcaaacctgccatcatagcgctgataaaccttttgcagtcattgaagtggacgaagaggtgcttaagtgtcaacagggcgtgtcgagcctggcttttgcactggcatttctgcaacggatggacatgaaacctctggtggtgctgggactcccagcacctaccgccccaagcggctgcctctcattttgggaagccaaggcgcagcttgcaaagtcctgcaaagtgctggtggatgcattgcggcacaacgccgcagctgctgtcccgtttttcggcggggggtcggtcctgcgtgcagctgaacctgctcctcacgcatcgtacggtggaatcgtgtcagtggaaaccgacttgctgcagtggtgtttggagtccgggtcaatccccatcttgtgtcctatcggcgaaactgcagctaggagatccgtgcttctcgactcgctcgaagtgaccgcgtcactggcaaaggcacttagaccgactaaaatcatttttctcaataacactggagggctgagggatagctcccacaaggtcctgagcaatgtcaaccttcctgccgatcttgaccttgtatgcaacgctgaatgggtgagcaccaaggagagacaacaaatgcgcctgatcgtcgacgtgctgtcgaggcttccacatcattcgagcgctgtcattacggccgcctcgactctgctcactgaactgttttcaaataaggggagcggcaccctgtttaagaacgccgaaagaatgctgcgagttcgatcccttgataaacttgatcaaggacgcctggtcgatctggtcaacgcgtcgtttggaaagaaactcagagatgattacctggcatcgttgcgtccgcggctgcactcaatctatgtgtccgaggggtacaatgcagccgcaattttgaccatggaacccgtgcttggcggaacgccatacctggacaagttcgtggtgtcgtctagcagacaaggacaggggtcaggccagatgctttgggagtgtcttaggagagatcttcaaaccctgttttggaggtcgcgagtgaccaaccctatcaatccttggtacttcaagcattcagatggctcgttctcgaataagcagtggattttcttctggtttggtcttgccgacataagggatagctacgaacttgttaaccatgcaaagggcctgccggactcctttcacaaacctgctagcgaccccggctcg

SEQ ID NO: 17099 - DNA, 1602 bp, Artificial Sequence
  Description of Artificial Sequence: Synthetic coding sequence
atggcaacggctctgatggcggtcgtcctgcgcgctgcggcggtggcaccccgtctgaggggtagaggcggcacgggcggcgcccggcggctgtcgtgtggtgccaggcgacgggcggcaagggggacatctcccgggaggcggctgtcgaccgcctggagccagccgcagccacctccagaggaatacgccggtgctgacgacgtctcacaaagtcccgtggccgaagagccatcttgggttccttcccctcggcccccggttcctcatgaaagtccggagcccccttctggccgttccctggttcagagagacatacaagcattcctgaatcagtgcggcgcgagccctggggaggctcggcactggttaacccagtttcagacatgtcatcattccgcggataagccttttgcagtgatcgaagtggatgaggaggtgctgaaatgccagcagggcgtttcttcgttggccttcgcactcgcgtttctccaaagaatggacatgaaaccacttgtggtccttggactgccggcaccaactgccccaagcggttgccttagtttttgggaggccaaagcacagttggccaagtcatgtaaagtccttgtcgacgccttaagacacaatgcagctgccgctgttcccttctttggtgggggctccgttctccgcgccgcagaacctgcccctcatgcgagttatggaggaatcgtcagcgtggaaacagacctgcttcagtggtgtcttgaaagtgggtctattcctatactttgtccaataggggagactgctgccagaagatcagtgcttttggacagcctggaggtgactgcctctttggcgaaagcccttaggcctaccaagattatattcctgaacaatacgggtggccttcgggacagctcccacaaggtcctgtcaaatgtcaacctcccagccgatctcgatctggtatgcaacgcagagtgggtgagtacaaaggagaggcagcagatgaggctgatagtagacgttctcagccggttgccacaccattcatcagcggttatcacggcagcaagcactctgctgaccgagttattttctaacaaaggaagcgggacactgttcaaaaatgcagaaaggatgctgagggtgcggtctttggacaagttagatcaagggcggctggtggatttggtgaatgcttcatttgggaaaaagctgagggatgattacctggcaagtttgcgcccccgactacattccatatacgtgtctgaggggtataacgccgcggcaatactgacaatggaaccggtcctgggggggaccccctatctagacaaattcgtcgtcagttcttcaaggcaggggcagggatcaggccagatgctctgggagtgtctccggagggatctccaaactctcttttggcgatctagagttacgaatccaatcaatccatggtactttaagcattctgatggcagcttctcgaacaaacagtggatattcttttggtttggcttggcagacatccgggattcgtatgaacttgtgaatcacgctaagggactgcccgacagtttccataaaccggcctctgatcccgggtca

SEQ ID NO: 17100 - DNA, 1602 bp, Artificial Sequence
  Description of Artificial Sequence: Synthetic coding sequence
atggccactgctcttatggccgtggtcctccgggccgccgcagtggctccgcggcttaggggtagaggaggcaccggaggagcaaggaggctcagctgtggggcgcgccgaagggcagcacggggtacttcgcccgggagacggttgtcgactgcctggagccagccccaacctccacccgaggagtacgcaggagcagatgacgtgtctcaaagcccagttgcggaagaaccatcctgggtcccatcccctagacctcctgtcccacatgaaagccctgagccgccctccggacgatcccttgtgcaacgcgacattcaggcatttctgaaccaatgcggtgcatccccgggagaggcacggcattggcttactcaatttcaaacctgtcaccactcggcggataagccttttgcagtgattgaggtggacgaggaggtgcttaagtgccaacagggtgtctcatccctggcttttgcgctcgcattcctgcagcgtatggatatgaaaccattggtggtgttgggacttccagcccccacggcgccatccgggtgtctttccttttgggaagccaaggcgcagctggcgaaatcatgcaaggtgctggtggacgcactgcgccacaacgccgccgcagccgtgcccttttttggaggcggatcggtgctgcgcgcggcagaaccagctccacacgcctcgtacgggggaattgtgtcagtggagactgatctgcttcagtggtgtcttgaatccggatcgatcccaattctctgccctatcggggaaactgctgcaaggagatccgtccttcttgattcgcttgaagtgaccgcatccctcgcaaaggctctccgtcccactaagattatcttcctcaacaacaccggaggcctgagagactctagccataaggtgctgtcaaacgtgaatctccctgcagacctggaccttgtgtgtaatgcagaatgggtgtcaaccaaggaacgacaacagatgagacttattgtcgacgtgctctccaggctgccccatcattcctcggcagtgattactgcagcatcaactcttctcaccgagctcttctcaaataagggatctggcactctgtttaagaatgcagaacgcatgctgagagtcaggtcgcttgataaactggatcagggaagattggtggacctggtgaacgcttctttcggaaaaaagctgagggatgactacctggcatcattgaggccccgcctccatagcatctatgtctcagagggttacaacgcagcagctatactgaccatggagcctgtgctcggtggcactccatacctggataagttcgtggtgtccagcagccggcaaggtcaaggttcgggacaaatgctctgggaatgtttgcgccgagatctgcagacgttgttctggcgctcccgggtgacgaaccctattaacccttggtacttcaagcacagcgatggatcgttttcaaacaagcaatggatattcttctggtttggcctcgctgatatccgcgatagctacgagttggtgaaccatgcaaagggcctcccagactccttccataagccggctagcgatcccggaagt

SEQ ID NO: 17101 - DNA, 1602 bp, Artificial Sequence
  Description of Artificial Sequence: Synthetic coding sequence
atggctactgccctgatggccgtggtcttaagggcagcagccgtggcccctaggctacggggccgagggggcacaggaggcgcacgccggctaagttgcggcgcccgaagacgcgcagctagggggacttctcctggccggaggctatccacagcctggtcccagccacagccgccaccggaagaatacgccggagcggatgatgtgagccaaagtccagtggctgaagagccaagttgggtgcccagcccccgtccgcccgtgccccacgaaagccctgagcccccttctgggcgatctctggtgcagcgagacatccaagcttttctgaaccagtgcggggcatctcccggagaggcacggcactggctcacacagttccagacttgccatcactccgccgacaagccatttgctgttatagaggtggacgaggaggtcctaaaatgtcagcaaggagtgtcttctctcgcatttgcgttagcattcctgcagaggatggatatgaagcccctcgtcgtactgggactgcccgcacccactgccccctctgggtgtctctctttttgggaagcgaaggcccaattggcaaagagctgcaaggttcttgtggacgccttgcggcacaatgccgccgctgccgtcccgttcttcggcggaggaagtgtgctgcgtgccgcagaacccgccccccacgcctcatatgggggtatagtgtcagtggagactgatctcttgcagtggtgtctagaatctggttcaatcccaatcttatgcccgattggggagactgctgccagaaggtcagtactgctagacagcctggaggtgactgcctctctcgcgaaggcgctgaggccgaccaaaatcatcttcctaaacaataccgggggccttcgcgacagttctcacaaagttctctccaacgtaaacttgccggccgatttagatctcgtgtgcaacgctgaatgggtgtcaaccaaagagcgccagcaaatgcgcctgattgtcgatgtactctcaagactgccccatcactcatctgctgtaattaccgcggcgtctactctgctgacggagcttttctctaataaaggctcaggcacactatttaagaacgccgagcgaatgctcagggttcgaagcctggacaagttggatcaaggtcgtcttgtggatttagtgaacgcttccttcggcaagaagttgcgggacgactatcttgcctcacttagaccccggctgcattccatttatgtatctgaagggtacaacgccgctgcaatcctgactatggaacccgtgctgggaggcacaccttacctagataagttcgtggtgtcaagtagccggcagggccaagggtctggccagatgctgtgggaatgcctgcggcgcgatctgcagacgttgttttggcgctcccgtgtgacaaaccctataaacccctggtacttcaagcatagtgacggctcctttagtaacaagcagtggatattcttttggtttggccttgccgatattagggactcttacgagctggtgaatcacgctaaagggttaccagattctttccataagcctgcctccgatcccgggtct

SEQ ID NO: 17102 - DNA, 1602 bp, Artificial Sequence
  Description of Artificial Sequence: Synthetic coding sequence
atggccactgccctcatggcggtggtgctgcgtgcggcggcagtcgcccctcgcttgcggggaagaggaggaactgggggcgctaggagactgtcgtgcggggcacggcgccgggcagctcgaggtacttcgccaggaaggagactctccaccgcctggtcccagcctcagcccccgccggaagagtacgctggagccgacgacgtttcacaatcacctgttgcagaggagccatcgtgggttccatcgccgcgcccgccggtgccccatgaatcgccggaaccgccaagcggacgctccctcgtgcaacgcgacattcaggcgttccttaaccaatgcggagcctccccgggtgaagcacggcattggctcactcaattccagacttgtcaccactcggcggataagccattcgcagtgatcgaggtggacgaggaggtgctgaagtgccagcaaggcgtgtcgtccctggccttcgcgctggcattcctgcaacgcatggatatgaagccactcgtcgtgcttggactgccggctccaacggcgccttcgggctgtttgtcgttctgggaggctaaggcacagcttgccaagtcttgcaaagtgctcgtggatgccttgagacacaacgctgccgcagctgtgcctttcttcggcggcggaagcgtgctgagagctgccgaaccggcaccgcacgcttcgtacggtggaatcgtgtccgtggaaaccgacctgctgcaatggtgcctcgagagcggaagcatcccgatcctctgcccgatcggtgaaaccgcggcgcgtcgctcagtgttgcttgacagcctcgaagttaccgcctctttggcgaaggcgctgaggccgaccaaaatcatttttctgaacaacaccgggggactccgcgactctagccataaggtcttgtccaatgtgaatctccccgccgatctggacctggtgtgcaacgcggaatgggtcagcaccaaggaacgacagcagatgcggctgattgtggacgtgctttcgcgcttgcctcaccactccagcgcagtgattactgctgcctccactctccttaccgaacttttctcaaataaggggtcggggacgctgtttaagaacgcggagcgcatgctccgtgtgaggtcacttgataagctggatcagggcagattggtggatctggtcaacgcgtcgttcggaaagaaactgcgggatgactacttggcgagcctgcgcccccggctccattctatctacgtttcagaaggatacaatgccgccgccatcctgactatggaaccagtcctgggcggcacgccttacctcgacaaatttgtggtttcctcatcccgacaaggccagggctccggacagatgctttgggagtgtctgcggcgggacctccagaccctgttctggcgcagcagggtcacgaaccctatcaacccgtggtactttaaacactccgatggatcattctcgaataagcagtggatcttcttttggtttggactcgctgacatccgagactcatatgagctcgtcaatcatgccaaagggctgcccgactcattccacaagcccgcttccgacccaggttca

SEQ ID NO: 17103 - DNA, 1602 bp, Artificial Sequence
  Description of Artificial Sequence: Synthetic coding sequence
atggcgactgctctcatggcagtcgtcctgagagccgccgctgtggcaccacgactgagagggcgaggtggcacagggggagctagaaggctgtcttgtggtgccaggcgtagggccgccaggggcacaagccctgggagacggctgtccaccgcatggagtcagccccaaccccctccagaagaatacgccggcgccgatgatgtcagccaaagtcccgtggctgaggaacccagctgggtcccgtctccaaggcctccagttccccatgaatctcccgaaccaccatccggaagaagtcttgtgcagcgtgacattcaggcgtttctcaaccaatgcggagctagcccgggtgaggcaaggcactggctgacacagtttcagacctgtcaccatagcgctgataaacccttcgccgttatcgaggttgacgaagaagtgttaaagtgtcagcaaggtgtctcgtcacttgccttcgccctagcatttctacaacggatggacatgaagccgctcgtggtcttgggactgcccgccccaacagcccctagcggttgtctttctttttgggaggcgaaggcccagctggctaagtcttgtaaagtgcttgtcgatgcattgcgccataatgctgccgccgctgtccccttcttcggaggaggcagcgtcctacgtgccgcggagcctgcgccacacgcatcctacggagggatcgtctcagtcgaaaccgatctgctgcagtggtgtttagaatcgggatcaatacctatcctgtgtccaatcggagaaaccgccgcgaggcgctccgtacttctggattccctggaggtgacagcttctctcgccaaagctctgagaccaacaaagatcattttcctaaacaatacagggggactgagggattcaagccataaagtgctgtccaatgtgaatttgcctgccgacttggacttggtgtgtaacgcagaatgggtcagtacaaaggagaggcagcagatgagactgatcgtcgatgtcttatctagattgccccaccactcctcggctgtgatcacagcagcttccaccctgctaacagaactgttctccaataaaggctcaggcaccctgtttaaaaacgctgaaaggatgctgcgagttcgtagcctggataagctcgatcagggtcgattagtagacttggttaacgcgagctttgggaaaaaattgcgagatgattatctagcttctctgaggccacggttgcacagcatctacgtgtctgagggatataatgctgctgctatcctgacaatggagccagttctgggcggtaccccttacctcgacaagtttgtggtttctagttcgagacagggtcagggttctgggcagatgctatgggaatgccttagacgcgacttgcagacgctcttctggaggagcagagtcaccaaccctattaacccctggtattttaaacactctgacggaagcttttcgaacaagcagtggatcttcttctggtttggcttggccgacatacgggactcgtacgagttggtgaaccacgccaaaggccttcctgattcctttcacaagcccgcttctgatcccggctca

SEQ ID NO: 17104 - DNA, 1602 bp, Artificial Sequence
  Description of Artificial Sequence: Synthetic coding sequence
atggctacggccctgatggccgtggtgttgcgcgcggccgccgttgcaccaagactgcgcggccggggcggcacgggaggtgcgcggcgcctgtcgtgtggcgcccggcgcagggcagctcgcggaacctccccgggtcgcagactgtcaaccgcatggagccagccgcagcctcctccggaagaatacgccggagccgacgacgtgagccagagcccggtggccgaagaaccaagctgggtgccttccccacggccgcctgtgccgcacgaatcaccagagcctccctcaggacggtccctggtgcagcgcgatatccaggcgttcctcaatcagtgcggagcgagcccgggagaggcgcgccattggctcactcagttccagacctgccaccattcggcagacaagccgttcgccgttatcgaggtggatgaagaagtgctgaaatgccaacaaggcgtctcctcgctcgcgttcgccctggcgtttctgcaaagaatggatatgaagccgctggtcgtcctgggacttcccgcaccaactgccccgtccggatgcctgtccttctgggaggcaaaggcacaactcgcgaagagctgcaaggtcctggtcgacgctctcagacacaatgccgccgccgcagtcccgttttttggcggagggtcggtcctgcgagcggctgagccagcccctcacgcctcatacgggggaattgtgtcggtcgaaactgacctgctccagtggtgcctggagagcgggtccatcccaatcctgtgtccgatcggcgaaaccgccgcccgtagaagcgttctgctggattcactcgaagtgactgcctcattggctaaggcgctgcgcccaactaagatcatcttcctgaacaacaccggaggcctgcgcgattcgtcacacaaagtgttgtcgaatgtgaatctgcccgcggacctcgacctggtgtgcaacgcagagtgggtgtcaactaaagaaaggcaacaaatgaggctgatcgtggacgtcctttcgcggctcccacaccacagctcagctgtcatcactgcggccagtacgttgctcaccgagctcttttccaataagggtagcggtaccctgtttaagaacgctgagcgaatgctccgcgtgcgctcgttggacaagctggatcaaggacggctcgtcgaccttgtgaacgcgtcgttcggtaaaaagctccgggacgattacttggcctcgctgcggccgagacttcattccatctacgtgtcggaggggtacaacgctgcagccattctgactatggaacccgtgctcggaggaaccccgtatttggacaaattcgtcgtgtctagctcccgccagggacagggatccgggcagatgctgtgggaatgtctccggcgggatcttcaaaccctgttctggagatcgagagtgaccaatcccattaacccgtggtacttcaagcattccgacggatctttctcgaacaagcagtggatctttttctggttcgggcttgctgacatcagggattcctacgagctggtgaaccacgcaaagggactcccggattccttccataaacctgcttcggacccaggcagc

SEQ ID NO: 17105 - DNA, 1602 bp, Artificial Sequence
  Description of Artificial Sequence: Synthetic coding sequence
atggctactgctctaatggcggtagtgctgagggctgctgctgttgcaccgcgactgcggggacgaggcggaaccggcggcgcaaggagattgagttgtggagcccgaaggcgcgccgcgcgtgggaccagccccggccggcggctgtcaacagcttggtcccagccgcaaccacctccggaagagtacgctggagctgatgatgtcagccagtctcccgttgccgaagagccttcttgggttccgagtcctcgcccacccgtgcctcatgagtcccccgaacccccttctggaagaagtttggtacagcgcgacatccaagccttcctaaaccaatgtggggccagtccaggcgaggctcgacattggctcacccagttccagacgtgtcaccactctgccgataagccctttgccgttatcgaggttgacgaggaagtcctcaagtgccagcagggtgtgagcagtctggctttcgccttggccttcttgcagcggatggacatgaagcccctcgtggtgctgggattgcccgcccccacggcaccaagcgggtgcctgagtttttgggaggccaaggcccagctggctaaatcgtgtaaggtactcgtggacgcactacggcacaacgctgcagccgcagtgccattcttcgggggcgggtctgtgttgcgggctgctgagccagcaccacacgcaagctacggaggaattgtctctgtggagactgacctgctgcagtggtgcctagaatctggaagcatcccaatcttgtgcccaattggagaaaccgccgctcgacggtctgtgctcttagactctctggaggttacagcaagcttggctaaggcgctgcgacctaccaagatcatcttcctcaacaacactggcggcttgcgggactctagtcacaaagtgctgtcaaacgtgaatttgcccgcagacctcgacttggtctgcaatgccgaatgggtgagtacaaaagagagacaacagatgcggctgatagtggatgtgctgagccgattgccccaccactcttcagccgttatcaccgccgcctctactcttcttacggaactcttttctaataaaggcagcggcaccctcttcaagaatgctgagagaatgctcagagtgaggagtctggataagctagaccagggaaggttagtagacttggttaacgcttcgttcgggaaaaagctgagagatgattacctggccagcctcaggccccgactgcatagcatttatgtttccgaaggctacaatgcagctgcgatactgacaatggaaccagtgcttggagggacaccctatctggacaagttcgttgtcagtagctcacgacagggacagggctccggtcagatgctgtgggagtgcctacggagagacctccagaccctgttctggcgctccagggttacgaaccctatcaacccttggtacttcaaacacagcgatggtagttttagtaacaagcagtggatctttttctggtttggcctcgcagacattagggactcttacgagctcgtgaatcatgctaaaggtcttcccgattccttccacaagccagcctccgatcccggtagt

SEQ ID NO: 17106 - DNA, 1602 bp, Artificial Sequence
  Description of Artificial Sequence: Synthetic coding sequence
atggcgactgctttaatggctgtggtcctgagggcagctgccgttgcacctaggttgagaggaagaggtggcactggaggtgcaagaaggctcagctgtggagcgagaagacgtgctgcgaggggtacttctccaggccggaggttgtctaccgcgtggtcacagcctcagccccctccagaggaatacgcaggggctgatgacgtctcacagagccccgtggccgaagaaccctcatgggtgcccagtcctcggccccccgttccacacgagagtcccgagccgccatcaggacggtcgctagttcagcgcgacatccaggctttcctgaatcagtgcggcgcatcccctggggaagccaggcactggctgactcaattccagacatgtcaccatagtgcagacaagccattcgccgtcatcgaggttgatgaggaagtgttgaagtgtcagcagggagtcagctcactggctttcgcccttgccttcttgcagcgcatggacatgaaaccactggttgtcttgggcctgcccgctccgactgcccccagtggatgcctttccttttgggaggcaaaggcacagctggctaaatcctgcaaggtcctcgtggacgccttgaggcacaatgccgcagccgccgtgcccttcttcggcggaggctccgtgctaagagccgccgagccagcccctcatgctagttatggcggtatagtgtccgtcgaaacagatctgttacagtggtgtttagagtccggtagtattcctatactttgcccaatcggcgaaaccgccgctaggagatcggtcttacttgactccctggaagttactgcctccttggccaaagcccttaggcccaccaagataatcttcctgaacaatacgggaggcttaagggatagcagccataaagtgctgtcaaacgtgaacctgcccgctgacctggacctagtgtgcaatgcagaatgggtaagcacaaaagagaggcaacagatgcgccttattgtggatgtactttctcggcttccacaccattccagtgccgtcattaccgcggcctctacccttctgacagagttgttctctaataagggaagcggtaccctcttcaaaaatgcagagcggatgttaagagttagaagtctggacaaattggaccaaggccgactggtcgatctagtcaacgcttcatttgggaaaaaactccgagacgattatcttgcatccctgcgacctagactacactcgatttacgtgtcagaaggatataatgcagccgcaattctgacgatggagccagtgctcgggggtaccccctacctggacaagtttgtcgtctcttcctcccgccagggccaaggcagtggccagatgctctgggagtgtctcagaagggatcttcaaaccttattttggcgaagcagggtgactaaccctatcaacccatggtatttcaaacacagcgatgggtccttctccaacaaacaatggatcttcttttggttcggactggctgacattagagactcatacgaactggtgaaccatgctaagggccttcctgatagcttccacaagcctgcaagtgatccaggctca

SEQ ID NO: 17107 - DNA, 1602 bp, Artificial Sequence
  Description of Artificial Sequence: Synthetic coding sequence
atggcgacagcattgatggcagtggttctgcgcgctgctgccgttgctccaaggctgcgtggaagaggcggtacgggcggtgcgcggaggctttcttgcggagcccggcgaagagcggcacggggcacctcgccagggcgacgactcagtaccgcatggagtcagcctcagccccctcccgaagaatacgccggagcagacgatgtttcgcagtcacccgtggctgaagaaccatcatgggtgccgagtccccgtcccccagttccacacgagtctccagagccaccaagcggtcggagcctggtacaaagggacattcaggccttcttgaatcaatgcggcgcttctccaggagaggcacgacactggctcacccagtttcaaacgtgtcaccattccgcggataagccgttcgcagtcatcgaggtggacgaggaagttctgaaatgtcagcagggggtgagtagtctagcttttgctttggctttcttgcaaaggatggatatgaaacctctggtggtgctcggcctgcccgcacctacagcaccttcagggtgtctatctttttgggaagctaaggctcagctggccaagagttgcaaagtgctggtggatgcactacggcacaacgccgccgccgccgtgccattcttcgggggtgggagcgtcctccgtgctgcggaacccgcgccccatgcatcctatggcggcattgtttcagtcgagaccgatctgctgcaatggtgtctcgagtcaggtagcatccccattctgtgtccgatcggagaaaccgccgctaggcggagcgtcctgctcgacagcctcgaggtaaccgcttcacttgcaaaggctcttcggcctacgaaaatcatcttcctgaacaacactggaggtctccgcgactcttctcataaggttttgagcaacgtgaatctccccgctgacctggacttggtttgtaacgccgagtgggtcagcaccaaggagcgccaacaaatgagactcattgtcgacgtcctgagtcggctcccgcaccacagctccgccgtgataaccgctgcgtctaccttgttgacagagctttttagcaataagggctctggcacactgtttaaaaatgccgaacggatgttgcgcgtgagatctctggataagttggatcaaggaagactggtcgatcttgtaaacgcatcattcggcaaaaaactgagagatgattacctcgcctcactgaggccaaggcttcacagcatctatgtctccgaaggttataacgccgccgcaatcctgactatggaacccgttctcggtggaacaccatatctggacaaattcgtggtgagttcatctaggcagggccaggggtccggccagatgctgtgggagtgcctgaggcgcgatttacagacccttttttggaggagcagagtcactaatcctatcaacccatggtactttaagcactctgatggatccttttccaacaagcagtggatctttttctggttcggtctggctgacatccgagattcttatgagttagtcaaccacgctaaaggcctaccagactccttccataaacccgcatccgatccgggctct

SEQ ID NO: 17108 - DNA, 1602 bp, Artificial Sequence
  Description of Artificial Sequence: Synthetic coding sequence
atggcaacagccctgatggcagtcgtactgagggctgctgctgttgcaccccggctcaggggccggggcggaactgggggtgcgagacgcctgtcctgcggcgcacggagacgcgcggctcgcggtactagccccggacggagactaagtactgcttggagccagccacaacccccacccgaggagtatgccggtgccgatgacgtctcccagagccctgtggctgaggaacctagttgggtcccctcaccccgacccccagtgccgcacgagagcccagagccaccttcaggacggtctctggtgcagcgcgatatccaggcttttcttaaccagtgcggggcatcgccaggcgaggctcgccactggctcacgcagttccagacctgtcatcattctgcagataagccatttgctgtgatagaggtagacgaggaagtgctcaagtgtcagcagggcgtgtcaagtctggcattcgctctggcattcctgcaacgcatggacatgaagccactcgtggttctggggctgccagctcctacagcaccttctggctgtctttccttctgggaagctaaagctcagcttgcgaaatcatgtaaagtcctggtggatgctttgaggcataacgctgctgctgccgtgccttttttcggggggggtagtgtactgcgggcagccgaacccgctcctcacgcctcttacggaggaatagtttcagtggaaactgatctgctccaatggtgcttggaaagcggatcgatccctattctgtgccctatcggagagacagcggcaagaagatccgtgttgctcgactcgctggaagtcacagccagcctggcaaaggcacttcggcccaccaagatcatcttcctgaacaacaccggcggactgagggattcatcacacaaagtgctctctaacgtcaatcttcccgctgatctggacctggtatgcaacgccgagtgggtatcaaccaaggagcgtcaacagatgagactgatcgtcgatgtactgagtcgccttccccaccatagctccgcagtgataacagctgcttcgaccttactgaccgagctgtttagcaacaagggatctggcactctgtttaaaaacgcagaaaggatgttgagagtcagatcactcgataagctcgatcaaggacggttagtcgacctagtgaatgcttcattcggaaagaagttgagggacgactacctggctagtttgagacccagactgcattccatctacgtcagcgagggctataacgccgccgcaatcctcaccatggagcccgtcctcggtggcaccccttacctcgataaattcgtggtatcatcttctaggcagggccaaggaagcggccagatgctttgggaatgtctgaggcgtgatcttcaaacgctcttctggagaagccgcgttacaaatccaatcaacccttggtactttaaacactcggatggaagctttagtaataagcaatggatctttttttggtttggtctcgctgacatcagggattcatacgagcttgtcaaccacgcgaagggccttcccgactcattccacaaaccagcctctgaccccggctct

SEQ ID NO: 17109 - DNA, 1602 bp, Artificial Sequence
  Description of Artificial Sequence: Synthetic coding sequence
atggcgacggcgctaatggcggttgtactacgagcggcggcggtagcgccgcgtttacgtggtcgaggtggtacgggtggtgcgcgtcgtttatcgtgtggtgcgcgtcgtcgagcggcgcgaggtacgtcgccgggtcgtcgactatcgacggcgtggtcgcaaccgcaaccgccgccggaagaatatgcgggtgcggatgatgtttcgcaatcgccggttgcggaagaaccgtcgtgggttccgtcgccgcgtccgccggtaccgcatgaatcgccggaaccgccgtcgggtcgttcgctagttcaacgtgatatacaagcgtttctaaatcaatgtggtgcgtcgccgggtgaagcgcgtcattggttaacgcaatttcaaacgtgtcatcattcggcggataaaccgtttgcggtaatagaagtagatgaagaagtactaaaatgtcaacaaggtgtatcgtcgctagcgtttgcgctagcgtttctacaacgaatggatatgaaaccgttagtagtattaggtctaccggcgccgacggcgccgtcgggttgtttatcgttttgggaagcgaaagcgcaattagcgaaatcgtgtaaagtattagttgatgcgttacgacataatgcggcggcggcggtaccgttttttggtggtggttcggttttacgtgcggcggaaccggcgccgcatgcgtcgtatggtggtatagtatcggtagaaacggatctactacaatggtgtttagaatcgggttcgataccgatattatgtccgataggtgaaacggcggcgcgtcgatcggtattattagattcgttagaagtaacggcgtcgctagcgaaagcgctacgaccgacgaaaataatatttttaaataatacgggtggtttacgtgattcgtcgcataaagtattatcgaatgttaatttaccggcggatttagatttagtatgtaatgcggaatgggtatcgacgaaagaacgtcaacaaatgcgactaatagtagatgtattatcgcgtttaccgcatcattcgtcggcggttataacggcggcgtcgacgctattaacggaattattttcgaataaaggttcgggtacgttatttaaaaatgcggaacgaatgctacgtgttcgttcgttagataaattagatcaaggtcgtttagtagatctagttaatgcgtcgtttggtaaaaaactacgtgatgattatttagcgtcgttacgtccgcgtttacattcgatatatgtatcggaaggttataatgcggcggcgatattaacgatggaaccggttctaggtggtacgccgtatttagataaatttgtagtttcgtcgtcgcgtcaaggtcaaggttcgggtcaaatgctatgggaatgtctacgtcgtgatttacaaacgctattttggcgttcgcgtgttacgaatccgataaatccgtggtattttaaacattcggatggttcgttttcgaataaacaatggatatttttttggtttggtctagcggatatacgagattcgtatgaattagtaaatcatgcgaaaggtctaccggattcgtttcataaaccggcgtcggatccgggttcg

SEQ ID NO: 17110 - DNA, 1602 bp, Artificial Sequence
  Description of Artificial Sequence: Synthetic coding sequence
atggcaaccgccctgatggccgttgtcctcagggccgccgctgtggcacctaggcttaggggccgcgggggaactgggggcgcccgccggttgagctgcggggcgagacgaagggcggctaggggtacaagtcctggtcgccgattaagcaccgcatggtcacaaccccagcccccccccgaagagtacgccggtgccgacgatgtgtctcaaagtcctgtggccgaagaaccctcctgggttccttctcctcggccccctgtgcctcacgaatccccagagcctccgtctgggaggagtcttgttcagcgagacatccaggcttttctgaatcagtgcggggcctccccgggggaggctaggcattggcttacgcaattccagacttgtcaccattccgccgataaaccattcgcagtgatcgaggtagacgaggaggtcctgaagtgtcagcagggggtttcttccctggccttcgcgttggcattcctccagcggatggacatgaaacctctcgtcgtcttagggctcccagcccccactgcgccttcgggctgtcttagtttctgggaggcaaaagcacagctcgccaaatcatgcaaggttctcgtcgatgcactgcgccacaatgccgcggctgctgtccccttttttggaggagggagcgtcctgagggctgctgagccggccccccacgcaagttatggaggtattgttagtgtcgagaccgatctcctccagtggtgccttgaatccggctccattcctatactctgtccaatcggagagactgcggcacgcagatctgtgctccttgattctctagaggtgacagcttctctggcaaaagcacttagaccaactaagatcattttcctcaacaatacaggagggctccgagatagctcacataaggtcctgagcaacgtcaacctccccgcagatcttgacctggtatgtaacgctgaatgggtatcaaccaaagagagacagcagatgcgtttgatcgtggatgtgctatccaggctgcctcatcacagcagtgccgtgattaccgctgcatccaccctactcaccgaactcttttcaaacaagggttccggaaccctgttcaagaacgctgaaaggatgttacgtgtgagatcccttgataagctcgatcaggggagactcgttgatttggtgaatgctagctttggaaagaagctaagagatgattacctcgcgtcactcaggcctcggttacattctatttacgtgtcggaaggttacaatgctgccgctatactgaccatggaaccagtgctggggggaacaccgtatttggacaaatttgtggtgagttcaagtcggcagggacaaggctccggccagatgttatgggagtgcctcaggagagatctgcagacgttgttctggcggtctagagtgactaatcctattaatccgtggtactttaagcactctgacgggtcctttagcaataagcagtggatcttcttctggtttggactagccgacatccgcgacagctacgaattggtaaaccacgccaaagggttgcccgactcctttcataaaccagcctccgacccaggctcg

SEQ ID NO: 17111 - DNA, 1602 bp, Artificial Sequence
  Description of Artificial Sequence: Synthetic coding sequence
atggccacagcactgatggccgtggttttgagggccgcagctgtggcgcctagactacgcgggcgggggggcacaggcggggcaagacggttgtcctgcggagcacggcgccgcgcagcacgcggcacttcgccaggccggcggctttctacagcatggtcacagcctcaacctccgccagaagaatatgctggtgccgacgatgtgagccagtcacctgtggccgaggaaccaagttgggtgccatcgcccagaccccctgtgcctcacgaatctccagaaccaccctcgggccggagtttagttcagcgcgacattcaagcattcctgaaccagtgtggcgcatctccaggagaggcaagacactggctgacccagtttcagacctgccaccactccgctgataagccttttgcagtgatagaagttgacgaagaagttctgaaatgccagcaaggggtgtcttcacttgctttcgcactcgcttttcttcaaagaatggatatgaaaccactggtcgtgttaggactgccagcaccaaccgcaccatcgggttgtctctcattctgggaggctaaggcacagctggccaagtcttgtaaggtcctcgtcgacgcactgcggcacaatgccgcagctgcagttccctttttcggtggagggtcagtgcttcgcgccgccgagccagccccacacgcttcctacggcggaatagtgtctgtggaaactgacctgctccagtggtgtttggagagtggctccataccaatactgtgtccaatcggagagactgccgcacgcagaagcgtcctgctcgacagcctggaggtcaccgccagtctggctaaagcactcaggcccactaaaatcatcttcttgaataacacgggcggcctcagagatagcagtcataaggtgctgtcaaacgtcaatctgcccgccgacctggatctggtttgtaacgcggagtgggtttctaccaaagaacggcagcagatgcgactgatagtcgatgtgctgtcgagactgccccaccatagcagcgcagtaataacagccgccagtacccttctcacagaactgttctcaaacaaggggtcaggcaccctgtttaaaaacgcagaacggatgctgagagtgagatctctggataaattggaccagggccggttggtggatcttgtcaacgcaagcttcggaaagaaactacgggatgattacctcgcgagtctgcggccccggcttcattccatctatgtctctgaggggtataatgccgctgcaatactgaccatggaaccagtgctcggaggcacaccttacctcgataagtttgtggtctcctcctcacgacaaggacagggttccggacagatgttgtgggagtgcctgcgcagggatcttcagacccttttctggcgatccagggtgactaatcccataaacccatggtacttcaaacactccgatggatctttttccaacaagcaatggatattcttctggttcggattggcagatatacgcgatagctatgaacttgtgaatcatgctaagggattacctgattcttttcacaagccagccagcgacccaggctca

SEQ ID NO: 17112 - DNA, 1602 bp, Artificial Sequence
  Description of Artificial Sequence: Synthetic coding sequence
atggccacagccttgatggctgttgtactgcgggccgcagcggtggccccacggctgaggggtagaggaggtaccggaggggctcgccgtctgagttgtggagcacgcaggagggccgctagaggcacaagccctggaagacggctgagcacagcttggagtcagcctcagcccccgccagaggaatacgccggcgcagatgacgtctcccagagcccggtggctgaggaaccctcttgggtcccaagcccccggcctccggtgccacatgagtcccctgaaccgcctagtggccgtagcctagtacagcgggatatccaggcgttcctgaaccagtgtggcgcgtctcctggcgaagcacgacactggttgacacagttccaaacatgtcaccattcagcagacaagcccttcgcagttatcgaagtcgacgaagaagtgttgaagtgtcagcagggcgtgtctagcctggcatttgccctggcttttcttcagaggatggacatgaaaccgctcgtggtgcttggccttccagctcccactgccccctcaggatgcctgagcttctgggaggctaaggcccagctggcaaagagctgtaaagtcctggtggatgctctcagacacaatgcagccgctgctgtgcctttttttggtggtggatctgtgctgagggcagctgagcctgccccccacgcctcttacggaggaatcgtgagcgtcgagacggatcttctgcagtggtgtctcgaatcaggctccatccccatcttatgccccattggagagaccgctgctcgacggtcagtcttgctcgactcccttgaggttaccgcctcactggcaaaggccctgcgccctacgaaaataatctttctgaataacaccggcggactccgcgatagttcacataaggtactttccaatgtgaacttgcctgctgacttggacttagtgtgcaacgcggagtgggttagcacaaaggagcgtcagcagatgcggctcatcgtcgacgtgctttcacgcttgcctcatcactccagcgccgtcattaccgctgccagcaccttgctaaccgagctttttagtaacaaagggtccggaaccctgttcaagaatgccgaacggatgctgagggtgcggtccttggataagcttgatcaaggccgcttggtggatttggtcaatgcgtcatttgggaaaaagctgagggacgactatctggcgtctcttaggcctcgtctgcatagcatctacgtgtcggagggttacaacgcggccgcgatcctgaccatggagccagttttgggagggactccttacctagacaaatttgtggtctctagttcacgacagggccagggctctgggcaaatgttgtgggaatgtctgaggcgggacctgcaaactctgttctggaggagcagagtgacaaatcctatcaatccttggtacttcaagcactctgacggcagctttagcaataaacagtggatttttttctggttcggactggcagacatacgagactcttatgaacttgtgaatcacgccaaaggcctgcccgattctttccataaaccagcctccgacccaggaagt

SEQ ID NO: 17113 - DNA, 1602 bp, Artificial Sequence
  Description of Artificial Sequence: Synthetic coding sequence
atggctacagccctgatggccgtcgtgcttcgagccgccgccgtggcgcctaggctgcgcggtcggggggggaccggaggggcacggcggttatcctgtggcgcccggagacgggccgcaagaggcaccagtcccggcagaaggttgtccactgcatggtcacagcctcagcctcctcccgaagaatatgcgggagcggatgacgtctcccagagccccgtagctgaagagcctagctgggtaccctccccccgccctcccgtgccccatgagtcccccgagccccctagcggacggtctttagtgcagagggatattcaggcgttcctgaatcagtgcggcgccagtcctggtgaggctagacattggctgacccagttccaaacatgtcatcactcggccgacaaacctttcgcagtgatcgaggtggatgaagaggtcctgaaatgtcagcagggcgttagcagcctggccttcgctctggcgttcttgcaaaggatggatatgaagccattggtagtgctcggtctcccagcaccaacagctccctcaggctgtctgtccttctgggaggcgaaagctcaactcgcgaaatcttgcaaagtacttgtcgacgcccttaggcacaacgcagctgctgcggtcccctttttcggtggcggaagcgtgctgcgtgccgccgaacctgccccacacgctagctacggtgggatcgtttccgtcgaaaccgatttgttgcagtggtgcttggaaagtgggtctattccaatactttgccctataggtgagacagcagcacgcaggagcgtgctgctagactctctggaggtcaccgcgagtctggccaaagctctgagacccactaaaataatcttccttaataatactgggggcctgagagacagctctcataaggtcctgtcgaatgtcaacctgccagccgatttggatctggtgtgtaatgccgaatgggtgtccaccaaggagcggcagcagatgcgcctaattgtggacgttctctcacgactcccacaccatagttccgccgtaatcaccgcagcctccacactgttgacggagttattttcaaataagggaagcggcaccctttttaaaaatgcggagcggatgctcagagtgcgatcattagacaaactcgaccagggtcgtcttgtggatcttgtgaatgcgagctttgggaagaagctccgggacgattacctggcatcattgcgcccccggctgcatagcatttacgtgtccgagggctacaacgcagctgccattctcacaatggagccagtgctaggaggaacgccctatctggacaaatttgtcgtttcatcttcaagacagggacaagggtccgggcagatgctctgggagtgtctgagacgcgatttgcagacgcttttctggcgaagccgggtcacaaaccccattaacccatggtactttaaacatagtgacggcagtttttccaacaagcaatggattttcttttggtttggattggcggacatcagggactcttatgagctggtcaaccatgccaaggggttgccagatagcttccacaagccagcttctgatcccggctca

SEQ ID NO: 17114 - DNA, 1602 bp, Artificial Sequence
  Description of Artificial Sequence: Synthetic coding sequence
atggccactgcactgatggctgtagtcctgcgagccgccgccgtggcacctcggctgcgcggaagagggggcaccggtggtgcccggagactaagctgcggtgcccggcggcgagctgcgaggggcacatccccagggcgccgactcagcaccgcctggagtcaacctcagccccctccagaggaatacgccggtgccgacgatgtatcccagtcaccggtggctgaagaaccatcgtgggttccctcacctagaccccccgtcccccatgagagtcccgagccgccctctggtcgctccctcgtccaacgcgatattcaggcgtttcttaatcagtgcggcgcttccccaggagaggctagacattggctgacacagtttcagacatgccatcattctgctgataagccatttgccgttatagaagtagatgaagaagtcctcaagtgtcaacaaggcgtgagctcattagcattcgctttagctttcctccagcggatggacatgaaacccctggttgttctggggctccctgcccctaccgctccctctggctgtctgtccttttgggaggctaaagcccagctagccaagtcatgcaaagtcctggtggacgctctcaggcacaatgctgcggcagccgttcccttttttggaggcggctcagttctgcgcgccgctgaaccggctccccacgccagctatggcggcatcgtctctgtggagacggacctgctccagtggtgtctggagtcaggatccatcccaatcttgtgccctattggcgaaacggcagctagacggagcgtcctgttggattcactcgaagttaccgcaagtttggccaaggcactgaggccaacaaaaattatattccttaataataccggaggacttcgcgactcctcacacaaagttctctccaacgtaaatcttccagccgacctggatctcgtctgcaatgcggagtgggtctcgaccaaagagcggcagcaaatgcgccttattgtggatgtcctttctcggctgccacaccactcaagtgcagtcatcaccgccgcaagcacactgctgacagaactcttctccaataaaggcagtgggactctgttcaagaacgcagaaaggatgctccgtgtccggagtctagataagctagaccagggaagactggtagatctggttaacgcttcttttggtaagaagttacgtgacgattatctggcttctctgcgacctcggctgcattcgatctacgtgtccgagggatacaatgcagcagcgattctgaccatggaacctgtgctcggcggcacaccatatctcgacaaattcgtggtctcttccagtagacagggacagggctcgggccaaatgttgtgggaatgcttacggagggatctccagacactcttttggcgcagtcgggtcacaaaccctattaatccatggtatttcaagcactccgatggaagcttcagcaataagcagtggatttttttttggtttggcctggcggatattcgcgatagttatgagctggtgaaccatgccaaaggcttgcccgactcctttcataaacccgcctcagaccctggttct

SEQ ID NO: 17115 - DNA, 1602 bp, Artificial Sequence
  Description of Artificial Sequence: Synthetic coding sequence
atggctacagctcttatggccgtcgtgctgagggccgccgccgtagcacctaggttgcgcggaagaggcggaacaggcggtgcgaggaggctttcctgcggagcaagaaggagggccgcgagaggcacatcccctggccggcgattaagcaccgcgtggtcccagccccaaccaccacctgaagagtacgcgggggcggacgatgtcagtcagtcgcccgttgccgaagagccgtcgtgggtgccgtctccccggccaccagtaccgcatgagtcccccgaacctccaagtggacggagcttggtgcaaagggatatccaagctttcctgaatcagtgtggtgccagccccggggaagctagacactggctgacccagttccagacatgccaccattctgctgacaagccgtttgctgtgatcgaggtggacgaagaagtgctgaagtgccagcaaggggtatcctccctggcatttgccctggcctttttgcaacggatggacatgaaaccactcgtcgtgctgggccttcccgctccaactgccccttcaggctgcctgagtttctgggaggccaaagcacaattggctaaatcatgtaaagtcctggtggatgcattacgccataatgcggccgccgccgtgcctttctttggtggcggctccgtccttcgagctgctgagcctgctccgcatgcctcatatggcgggattgttagtgtcgaaacggatttactccagtggtgcctggagtccggctctattccaatcctgtgtccaatcggagagacagccgctcgcagatcagtcttactggatagcctcgaggtgactgcgtcactggccaaggccctgaggcccacgaaaatcattttcctgaacaacacgggcgggctgcgcgacagctcccacaaagtactgagtaacgtgaatctcccagcagacctcgacctggtgtgcaacgctgagtgggtctcgacaaaggagaggcagcagatgcgtctgattgtcgacgttctatcccgcctgccgcatcacagcagcgcggtgattaccgcggcatccaccctcttgaccgagctcttctcaaacaaggggtcgggaacgcttttcaagaacgcagagcgcatgcttagggtgagaagtctggacaagctcgatcagggtcgccttgtagacctagtcaacgcatcattcggcaagaagctgagagatgactacttggccagtctcaggcctaggctacattccatctacgtgagtgagggctacaacgcagcagctatcctgactatggagccagtcctgggtggaacaccctatctggataaatttgtagtgtcttccagtaggcagggtcagggctctggccagatgctctgggaatgcttgagaagggacttacagacactgttctggaggagccgagttaccaatcctatcaatccgtggtattttaagcatagtgatggaagcttcagtaataagcagtggatcttcttttggttcgggctggccgatataagggactcctatgagctggtgaaccatgctaagggcctcccagattcgtttcataagcccgcctcagatccggggtca

SEQ ID NO: 17116 - DNA, 1602 bp, Artificial Sequence
  Description of Artificial Sequence: Synthetic coding sequence
atggcaaccgccttgatggctgttgtcctacgcgccgctgctgtggcccctcgtttgagaggacgcggcggaactggcggagccaggcgattgagctgcggggcccggcgacgggccgccaggggcacgtcaccaggccgaagactgagtactgcatggagccagccccagccaccaccagaggaatacgcaggcgctgacgacgtgtctcagagccctgtggcagaggagcccagctgggtcccgtctccacgtccaccggtgccccacgagtcaccagagccccccagcggacgcagcctggtacagcgcgacattcaggctttcctaaaccagtgtggcgcttcccccggggaggccagacattggcttacccagttccagacttgccaccatagcgccgataagccattcgcagtgattgaggtcgacgaggaagtgctaaaatgccagcagggggtgtcatcactagctttcgcactggcttttctgcagcgcatggacatgaagcctcttgtcgtgctgggactacccgcccctaccgctccgagtggctgcctgagtttttgggaagctaaggcgcagctagcgaagagctgtaaggtactagtggacgctctgagacataacgcagcagccgcagtccctttcttcggcgggggatccgtgctccgcgccgcagaacctgcaccccacgcttcctatggaggtatcgttagtgttgaaacagatctgctgcagtggtgcctcgaatctggatccattcctatcctgtgcccaatcggcgagaccgccgcccggagatccgtgcttctggactcattagaggtgacggctagtctggccaaagcactcagacctactaaaattatttttttgaacaacacgggggggttaagggattcctcacacaaggtgttatccaatgtaaacctaccagccgatctggatctcgtgtgcaacgcagaatgggtgtcgacgaaagagcggcagcagatgcggctgatcgttgatgtgctgagcagactcccccaccattcgagcgctgttattacagctgcatccacgctgctgacagagcttttctccaacaagggcagcggtactttatttaaaaatgcagagcgcatgttacgagtgagatccctggacaagctggaccaggggaggctggtcgacctggtgaatgcctccttcgggaagaagttgcgagatgactatctggcatccttgcgtcctaggctgcactcaatatacgtctctgagggttacaatgccgcggccattctcaccatggaacctgtgttgggcggtacaccttacctcgataagttcgtcgtatcctcttcaaggcagggccagggctccggacagatgctgtgggaatgcctccggcgtgacctccagaccctgttctggcggtcaagagtgaccaaccccatcaatccttggtatttcaaacattcagacggatctttcagcaacaagcaatggatatttttttggttcggactagcagatattagagactcatacgagttagtgaatcatgctaagggccttccagactcgttccataaacctgccagtgaccccggctcc

SEQ ID NO: 17117 - DNA, 1602 bp, Artificial Sequence
  Description of Artificial Sequence: Synthetic coding sequence
atggcgacagcgctcatggctgtcgttctcagggccgctgctgtggccccaaggctgaggggccgtggcgggacaggcggggcgcggagactgtcctgcggggcccgccgtcgcgccgcaaggggcacgtcccctggccgcagactttcaacggcttggagccagccacaacctcccccagaggaatatgctggagctgatgacgtgtctcaatctccagtggctgaggaacccagttgggtccccagccccagaccacctgttcctcacgaaagccccgaacccccgtccggaaggagcttggttcagcgcgatatccaggcctttttaaaccagtgcggcgcgtcgccaggcgaggcacgccattggctcacacaattccagacttgtcatcactctgcggataagccctttgctgtgatcgaggttgatgaggaagtgctcaagtgccaacagggtgtctcctcattggcttttgccttagctttcctgcaaagaatggacatgaagccattagtggttttggggctcccagccccaaccgcgccatcagggtgtctgagtttctgggaagctaaagcccagttggcaaaatcctgcaaggtgcttgtagacgccctccggcataatgcagctgctgccgttccttttttcggagggggcagcgttttgcgggccgccgaacccgcgccccacgcctcatacggagggattgtgtcggtcgaaactgatctgctgcagtggtgcctcgagtctggcagcatccccattctgtgtccaatcggcgagaccgcagcccgccggagcgtgcttctggatagcttagaagttacggcaagcctagcaaaagcactcaggcccaccaagataatttttttgaacaatactggtggccttagagactcaagtcacaaggttcttagcaatgtgaatctgccggctgacttggatctcgtatgcaacgccgaatgggttagcacgaaggagcgacagcagatgcgactgattgtggacgtgctctcccggctgcctcatcatagttctgccgtaatcaccgcagcttctacccttctcaccgaactgttttccaacaaaggatctggtaccctgttcaagaacgctgagcgtatgttgcgagtgcggagcctggacaagctcgaccaaggacgactcgtcgacctcgtaaacgcaagttttggtaaaaaactgcgagacgactatttggcatctttacgccctcggctccacagtatttacgtatccgagggatacaatgcggctgctatcctgactatggagcccgtgttgggcgggacgccttatttggacaagtttgttgttagcagctcccggcaggggcagggttccggacagatgctttgggagtgtcttagaagagatctccagacgcttttttggaggtccagagttaccaatcccatcaatccctggtattttaaacatagtgatgggtctttctctaataagcagtggatttttttttggttcggcctggccgatatccgcgactcttatgagttagtgaaccatgcaaaggggctgcctgattcttttcacaagcccgcaagcgatcctggctct

SEQ ID NO: 17118 - DNA, 1602 bp, Artificial Sequence
  Description of Artificial Sequence: Synthetic coding sequence
atggctactgcactgatggcggtggtgttgagagcagcggctgtcgcaccgcgcctccgcggacgcggcggcactgggggcgcccggcgcctgtcctgcggggcccggcgtcgagctgctcgcggaacctcccccggtcgccgcctgtctaccgcctggtctcaaccacagcccccccccgaggaatatgccggagccgacgatgtcagtcagtctccagtagcggaggagccttcctgggtgccttctccacgaccccccgtaccacatgaaagtcccgaaccaccaagtgggcgtagcctggtccagcgcgatatccaggcattcttgaatcaatgcggcgcttcaccaggggaagcgaggcactggctcacccagttccagacttgtcatcacagcgcagataaaccatttgctgtgatcgaggtcgacgaagaggtacttaagtgccagcagggcgtttcttcacttgcattcgctttagcatttttgcaaaggatggatatgaagcctctggttgttctggggttgccagcccccacagcccccagcggatgcctctctttctgggaggcaaaagctcagcttgccaagagctgcaaagttctcgttgacgccctccggcataacgcagcggccgccgtcccgttctttggaggcggtagcgtcctacgggctgccgagcccgcaccacatgccagttatggaggaattgtctccgtggaaactgaccttctacagtggtgcttggagagcggttctatcccaattctttgtccaatcggggagacagcagcaagaagatccgtgctacttgattctctagaagtaacagcctcccttgccaaagctcttcgcccaaccaaaataatatttctgaataacacaggcggacttcgtgattcaagccataaagttctgtcaaacgtgaacctgccggcagatctagatctggtgtgtaacgccgagtgggtcagcacgaaagagagacagcaaatgagacttatagtggatgtcttatcaaggctcccccatcacagctcagcagtcattaccgcagcgagtacgctattgacagagctctttagcaataagggttctggtaccctgtttaagaacgccgaacggatgttgcgtgttagatccctcgacaaactggaccagggacggctcgtagacctggtgaacgctagttttggaaagaagttgagggatgattacctagcctccctgcggccccggctacacagcatctacgtgagcgagggctacaacgcggctgccattcttaccatggagcctgtactggggggtacaccctacctggacaagttcgtggtctcctcaagcagacagggccaagggagcggtcagatgttgtgggagtgcctgcgaagggatctgcagactctgttttggaggagcagggtgacaaaccctatcaacccgtggtatttcaagcacagcgatgggtctttctcaaataagcagtggatctttttctggtttggcttagcggacattcgtgactcctatgagctggtgaaccacgcgaagggccttcccgactccttccataaaccagccagtgaccccgggtct

SEQ ID NO: 17119 - DNA, 1602 bp, Artificial Sequence
  Description of Artificial Sequence: Synthetic coding sequence
atggccactgcgctgatggccgtcgtcttgagagccgccgccgtagctccaagactgcggggccgtgggggcaccggaggagccagacggctgtcctgtggagcacggcgacgcgcagctagaggtacctcccctggccgtcgcctaagcacggcctggtcacagccgcagcccccgccagaagaatacgcgggcgccgacgacgtctctcagtctccggtcgcggaagagccctcctgggttccatctcctcgcccgccggtgccccatgagagcccggaaccgccatctggtcgcagcctggttcagcgtgacatccaagcatttctgaaccagtgcggcgctagtcccggcgaggcccgccattggctaacgcagttccagacgtgccaccacagcgcggacaagcctttcgccgtcatcgaggtggatgaggaggtcctgaagtgccaacaaggagttagctcgctcgctttcgccttggcttttctgcagcgtatggacatgaagcccctggttgtccttgggcttcctgccccgaccgccccgagcggttgcttgtcgttctgggaagctaaggctcagctcgccaagagctgcaaggtcctggtcgacgccctgcgacacaacgcagctgctgccgtccccttttttggaggcggatctgttcttcgcgcggccgaaccggctccccacgcttcgtacggcggtatcgtatcagttgagaccgacttgctgcagtggtgcctcgagtccggctccatcccgatactgtgcccgatcggtgagacagccgcccgtcggtccgtccttcttgactccctcgaagtcactgcgagcttggccaaggctctgcgccccaccaagatcatcttcctgaacaacacgggtggcctgcgtgattcctctcacaaagtgctttccaatgttaacctgccggcggatctggacctcgtgtgcaacgcggaatgggtttccaccaaggagcgtcaacaaatgcgtctgattgtcgacgttctctcacgactgccacatcactcatccgcggtcattacggctgcttcgacgctgctgaccgaactcttctccaacaaaggttccggcactttgttcaagaacgccgaacgcatgctgcgggtcagatcgctcgacaaactggatcagggcaggttggtggatcttgtcaacgcttccttcggcaagaaactgcgggatgactacctcgcttccttgcgtcctcggctgcacagtatctacgtgtcggaaggatataacgcggccgcgatcctcaccatggagcccgttcttggcggtactccctatttggataaattcgtcgtctcttcttcaagacagggccagggcagcgggcagatgctgtgggagtgccttagacgtgaccttcagactttattctggcgctcccgtgtcaccaacccgatcaacccctggtacttcaagcatagtgatggctcgttcagcaacaaacagtggatcttcttctggttcggtctggcggatattcgcgatagttacgagttggtgaaccacgcgaaaggcctgcctgattcgttccacaagccggcctctgatcctggctct

SEQ ID NO: 17120 - DNA, 1602 bp, Artificial Sequence
  Description of Artificial Sequence: Synthetic coding sequence
atggcaacagccctcatggctgtggttttacgggctgctgccgtagcgccccggttgaggggccgcgggggtaccgggggtgctaggcggctgtcctgtggcgccagacgccgggctgcgcggggcacctcgcctgggcgtcggctgagtaccgcctggtctcagcctcagccccccccagaggaatatgccggcgccgacgatgtgagtcaatctcctgttgctgaggaaccctcatgggtcccatcacctcgcccaccagtcccgcacgagagccctgaacctccatctgggcgttcccttgtgcagagagacattcaggcattccttaaccagtgtggcgcctcccctggcgaagcccgtcactggctgactcagttccagacatgtcaccacagtgcagataaacccttcgccgtaatcgaggtcgacgaggaagtacttaagtgccagcaaggagtctcctccctggcgtttgcactggcctttcttcagaggatggacatgaaacccctggtcgtcctcgggcttcctgcgcctacagccccgtccgggtgcctgtctttttgggaggccaaggcccagctcgccaagagctgcaaggtgcttgtggacgccttgcgtcataatgccgccgctgccgtccccttttttggtggcgggtccgtcttgcgggccgctgagcctgctccgcatgccagttacggcggcattgtgtccgttgagacagatcttctacaatggtgtctggaatctggatcaatccctattctgtgtcccattggggagaccgcggcgagaaggtctgtgttactggactctctggaagtgacggccagtctcgcaaaggctttgcgacccaccaagataatctttctgaataatactggggggctgagggactcaagccacaaagtgctcagcaacgtcaacctccctgccgacctggatttggtgtgcaatgccgaatgggtgtctactaaggaacgtcagcagatgcgcctgattgtggatgtgctgagccgcctgcctcatcactccagtgccgtgattaccgctgctagtacactccttacagaactcttttcaaataaaggcagcggtacactctttaagaacgccgaacgaatgctccgcgtccgtagcctggacaagcttgatcaggggaggcttgttgatttggtgaatgccagctttggcaagaaattgagagatgactacttggcatccctccggccgagactacacagcatttatgtcagcgaggggtacaacgccgcggctattctcacaatggagccagtcctgggcggaaccccatacttggacaagttcgtggtatcaagcagtaggcagggtcagggcagcggacagatgttatgggagtgcttgagaagggatctgcaaactctcttttggcgttctagggtcactaacccgatcaacccgtggtattttaagcactccgacggctcttttagcaataagcagtggattttcttctggtttggacttgcagacattcgcgacagctacgaattagtcaaccatgcaaaaggcctacctgacagtttccacaagcctgcctctgatcctggctca

SEQ ID NO: 17121 - DNA, 1602 bp, Artificial Sequence
  Description of Artificial Sequence: Synthetic coding sequence
atggccacagcgctgatggctgttgttctgcgcgccgcagccgtcgcacctaggttgcgggggcgggggggaactggaggggccagaaggctttcttgtggggcccggcggagagcggctagggggacatcccctggacggcggctctctactgcttggtcccagccgcagccaccccctgaagaatatgctggggcagatgatgtttcacagagtcctgtggccgaagaacccagttgggtcccatctccccggccccctgtgccacacgaatcacctgaaccccccagtgggcggtcactcgttcagcgggatatacaggcattcttaaaccagtgtggagcgtctcccggagaagcgcgccattggctgacacagtttcaaacttgccaccactccgctgataaacccttcgctgtcattgaggttgatgaagaagtactcaaatgtcagcagggggtttcttctttagctttcgctttagcctttctacagcggatggatatgaagccccttgttgtcttggggctcccagcgcctacagctccttcgggatgtctctctttctgggaagccaaagcacaactagccaaatcctgtaaagtgctcgtagacgccctcaggcataacgcagccgccgccgtgccctttttcggaggagggtccgtacttagggccgccgaacctgcgccccacgcgtcctatgggggaatagtttcagtggaaacagacctcctccagtggtgtctcgagtctgggagtatccccatcctctgccccatcggagaaacagctgcccggagaagtgtcctcctcgactcacttgaagtaacagcctcactcgcaaaagccctgcggccaactaaaattatcttcttaaataacacaggggggctccgggactccagtcacaaggtcctatctaacgtgaatcttccagctgatctggatctcgtctgcaacgcagaatgggtgagtactaaggaacgccagcaaatgagactcatagtggatgtgctgagtcgacttccccatcactcctctgcagtgatcacagcagcttccacactcctcacagaactcttctccaataaagggtcaggaacactcttcaaaaacgccgaacggatgttacgcgtcaggtcactcgataaattagatcagggaagactggtagatcttgtgaacgctagtttcggaaaaaaactcagagatgattatctggccagtttgaggcctaggctgcactctatatatgtgtctgaagggtacaacgccgcagcaattcttactatggaacccgtgttaggaggaactccctatctagataagtttgttgtctcttcttcacggcagggacaggggtccggacagatgctgtgggaatgccttagaagggatctacagactctcttttggaggtcccgcgtgactaaccctataaatccttggtacttcaaacatagtgatgggtctttctccaacaagcagtggatattcttttggttcgggcttgcggatatccgagactcctacgagttggtgaatcacgccaagggactccctgattccttccacaagcccgcctccgatcccgggtcc

SEQ ID NO: 17122 - DNA, 1602 bp, Artificial Sequence
  Description of Artificial Sequence: Synthetic coding sequence
atggctactgcgctgatggcagtggtcctgagggccgctgcagtggctccacgtctgagaggcagagggggcactggaggcgcccgtagactgtcttgtggcgcccggcgtcgcgccgctagaggtacaagcccaggacgccgccttagcacggcttggtctcaaccacaaccaccacctgaggagtacgctggagctgatgacgtgtcacagtcccccgtcgctgaggaaccatcttgggttccaagccctagacccccagttcctcatgaaagccccgagccacccagcgggagatcactcgtccagcgcgatattcaagcctttctcaaccaatgtggcgcctctcccggagaagctagacattggctcactcagtttcagacatgtcaccacagtgctgacaagccgttcgcagtgattgaagtggacgaagaagtactcaagtgtcagcagggggtgagcagcctggcatttgctcttgcctttctccaaaggatggatatgaaacctctggtggttctggggttaccagcacctaccgcaccttcaggctgcctcagcttttgggaagccaaggcacagctggctaagagctgtaaagtgctggtggatgctctcaggcacaatgccgcagctgctgtgccattcttcggcggcggaagcgtcctcagagccgccgaacctgctcctcacgccagctatggcggcatagtctctgtggaaaccgatctgctccagtggtgcttggagagcggatctatccccatcttgtgcccaatcggcgaaacagcagctagaagatctgttcttcttgatagcctggaagtcaccgcttcactcgctaaagccctcaggccaacaaaaatcatcttcctgaacaacacaggtggcctgagggactcatctcataaggtcctgtccaacgtgaacctgcctgctgatcttgacctggtgtgtaacgcagaatgggtgtccactaaagaacgtcagcagatgaggctgatagtggacgtgttgtcacgcctcccgcaccatagctcggcggtaattaccgcggcttctaccctgctgaccgagctgttcagcaacaaggggagcggaaccctgttcaagaatgcagaaagaatgctaagggtgaggagcctggacaagcttgaccaagggcgtttagttgacctggtgaacgctagtttcggcaaaaagctgagagatgactatttggctagccttcggcctcgcttgcactcaatatatgtatccgagggatacaatgccgccgctatcctgaccatggaacccgtgctcggcggaactccatacttggacaaattcgtcgttagtagctccaggcaaggccaagggagcggacagatgttgtgggagtgtctccgcagggatctgcaaactctgttttggagaagtagggttacaaaccccattaacccttggtacttcaaacacagcgacgggagcttcagcaacaaacaatggatcttcttctggtttggattagctgatattagagacagctacgaactagtaaatcacgcaaagggattacccgattcttttcataagccagctagcgatccaggcagt

SEQ ID NO: 17123 - DNA, 1602 bp, Artificial Sequence
  Description of Artificial Sequence: Synthetic coding sequence
atggctacggctctcatggcagtggtgctgagggcagccgctgttgccccccggcttcggggccgaggtgggacaggaggggcgcggaggctgagctgcggcgctcgtaggcgagcagcgagaggtacttcccctggaagaagactctctaccgcatggtcacagccacagccgcccccagaggaatatgctggggcagatgacgtgtctcagtcgccagtcgccgaagagcctagttgggtgccaagtcctcgcccacctgtccctcacgagtctccagagccacccagcggcaggtcacttgttcagcgcgatatccaggctttcctgaaccagtgtggggcatctcctggtgaggctcgtcactggttgactcagtttcagacttgtcaccactcagcagataaacccttcgctgttatcgaggtagacgaggaggtgctgaaatgccagcagggcgtgtcttcattggcctttgccttggcattcttgcagcgcatggatatgaaaccactggtagtgttgggcctgcctgctccgactgccccgagcggctgcttaagtttctgggaagcgaaagctcaattggccaagtcctgcaaagtgttggttgacgctcttcggcacaatgcagctgcggctgtcccgttttttgggggaggcagcgttctgagagccgccgagccagcacctcatgctagttatggcggtatcgtctctgtggagactgacctgttgcagtggtgtctggagtcgggcagcatcccaattctgtgccctataggcgagacagcggctcgccgctcggtgctcttggatagcctcgaagtgaccgcctccttagccaaagccttgaggcccacgaagataatcttcctgaataacactggtggcctcagggattcgtctcacaaggtgctctcaaatgtaaacctgccagcagacctggacctggtgtgtaatgcagaatgggtaagcaccaaagagcgccagcagatgcggttaattgtggacgtgctgagccgccttccccaccattcgagcgccgtgataactgccgctagcacattgcttaccgaactgttcagcaacaaaggctcagggaccttattcaagaacgcagagcggatgcttcgcgttagatccctggacaagctggaccagggaagactcgttgacctcgtgaacgcctcatttgggaaaaagctccgcgacgactatctggcttccttgcggccgagactgcactctatttacgtgagtgagggatacaatgcggctgctatcctgactatggagcccgtgcttggcggaacaccttacttagacaaatttgtggtatcaagttcccggcaggggcagggctccggccagatgctctgggagtgtctgaggagagatttgcagacgctcttctggagatcgagggtgactaatccgatcaacccctggtactttaagcacagcgacggtagcttctccaacaaacagtggatttttttttggtttggactcgccgacatacgcgactcatacgagcttgtgaaccatgccaagggcttgcccgattccttccacaaaccagcctcggaccctgggtca

SEQ ID NO: 17124 - DNA, 1602 bp, Artificial Sequence
  Description of Artificial Sequence: Synthetic coding sequence
atggcaactgctctcatggccgtggtactccgggccgccgcagtggccccgcgcctgcgaggcaggggaggcacaggcggcgctaggcgtttgtcgtgtggggcccggagacgcgccgccaggggcacctcaccgggtcgaagactcagcacagcctggtcccagccacagccaccccccgaggagtatgcgggcgctgacgacgtgagtcaatccccagtcgctgaagaaccgtcctgggtcccatcgcctcgcccaccagtgcctcacgagtccccagaacctccgagtggtcggtccctcgtccaaagggacattcaggcgttcctgaaccagtgtggagcttcgccaggcgaagcccggcattggctgacgcagttccagacctgtcatcacagcgcagacaaaccatttgccgtcatcgaggtcgacgaggaggtgctaaagtgtcagcagggtgtttcctccctggcatttgctctggccttcctgcagagaatggacatgaaacccctcgttgtactggggctgcctgcccccacggcaccaagtggctgtctgagcttttgggaggcaaaggcgcagctggctaaatcctgcaaggttttagttgatgccctgaggcataacgctgccgctgcagtacccttttttggcggaggctcagtgctgagagccgccgagccagccccccatgccagctatggaggtatcgtgagcgtggaaaccgacttactccagtggtgtctggagagtggttcaatccctatactttgtccgatcggggagactgccgctcgtcgtagcgttctgctggatagtctcgaagtgacagcctccctggctaaagctctgcggcccacgaagataattttccttaacaatacgggtggcctgcgcgatagttcccataaggtgctgtcaaacgtgaacctcccagccgatctcgacctggtttgtaacgccgagtgggtgtcaactaaagagcgacaacagatgcgactgatcgtggatgttctgtctaggctgccgcaccatagtagtgccgtgattaccgccgccagcaccctgctgacagagctgtttagcaacaaggggagtggcaccctgtttaaaaacgcggaacgcatgctgcgggtgagatccctggacaaattggatcagggacgcctggtggacctggtaaacgcttcattcggtaaaaaactcagggatgactatctcgcctccctccggccccgcctgcactccatctacgtctccgaggggtacaatgcagccgctatactcaccatggaaccggtcctagggggtacaccgtacttggataagttcgtggtttcatccagcagacaagggcaaggctctggacagatgttgtgggagtgcctgaggcgggatctgcagacactgttctggagatcccgagtgaccaatcctatcaacccctggtactttaagcattcagatggttctttcagcaataaacagtggatctttttttggttcggactggcggacatacgggacagttatgagctggtgaaccatgccaagggtctgcctgatagtttccacaagcctgccagcgatcctggcagc

SEQ ID NO: 17125 - DNA, 1602 bp, Artificial Sequence
  Description of Artificial Sequence: Synthetic coding sequence
atggcgactgctctaatggcagtggtgctacgggctgctgccgtggccccccgtctccgaggacggggaggaaccggcggcgccagacgtctctcgtgcggcgccagacgccgtgccgcgcgtggcacaagccccgggcgccgactgagcaccgcctggtctcaaccgcagccgcctccagaagaatatgcgggggcagatgatgtctcgcagtcgccagtcgccgaggagccctcatgggtcccgagcccgcgtccccctgtaccccatgagagcccagaacctccgtcgggtcgttccctggtgcagcgggacatacaagccttccttaatcagtgcggtgcctccccaggcgaggctcgccactggctcacgcaatttcagacttgccatcattctgccgacaaaccatttgccgtaattgaagtggatgaggaggtgttaaaatgccagcaaggcgtaagcagtctcgcgttcgccctcgccttcctgcaacgcatggacatgaagccactggtggtgctcggactaccagcacccaccgcgccctccggctgcctttccttttgggaggccaaagcacagttagccaagtcgtgcaaagtgttggtggatgcattaagacacaatgccgccgccgcggtgcccttcttcggcggcggttcggtgctgagagcagccgaacccgctccacacgcctcttatggaggtatcgtctctgtcgagactgatttgctgcagtggtgcctcgagagcggttcaatacccatcctgtgcccgatcggggagaccgcagcacgccgttcagtccttctagattccctggaggttaccgctagccttgctaaagcattgcgccccacgaaaataattttcttgaacaatacaggaggattgcgggacagttcgcataaggttttgagtaatgtcaacttgccggccgacctggatctcgtatgtaatgcggagtgggtgagcaccaaggagcgacagcagatgcgtctgatagtcgacgtgctgagccgactgccacaccattccagcgctgtcatcaccgcggcctccactttactgaccgagctattcagcaacaagggaagcggtaccctctttaagaatgcagagcgtatgcttcgagttcggtcgctggacaaactcgatcagggacggctggttgacttggtgaatgcttcgttcggcaaaaaactccgcgatgactacctggcgagcctgcggccccgcctccattcgatctatgtgtcggaaggctacaatgcagcggctatcctgactatggaacccgtcttgggtggaacgccctacctggataagtttgtggtgagtagcagcagacagggacaaggaagtggccagatgctgtgggagtgtttgcgccgggatttacaaaccctgttctggcgcagccgggtgaccaaccccattaatccctggtacttcaagcattcagatgggtctttcagtaacaagcagtggatttttttctggtttggccttgcggatatccgagattcctacgaactagtgaaccacgccaagggactgccagattcatttcacaagccagcatcggacccaggctct

SEQ ID NO: 17126 - DNA, 1602 bp, Artificial Sequence
  Description of Artificial Sequence: Synthetic coding sequence
atggctaccgcattgatggccgtagtgctccgtgctgccgctgtggctcccagacttagaggtcgcggcggcacaggcggagcacgtcgtctttcttgcggcgctcgccgccgtgctgcaaggggcacaagtcctggtcgcaggctgtcaacagcctggtctcaacctcagcctcctcccgaagagtacgccggagccgatgatgtttcccagagccccgtggctgaagagccctcttgggtccccagcccacgtccccccgtgcctcacgagtcccctgaacctccttctggtagatcattggtgcagcgtgacatccaggccttcttgaaccagtgtggcgcttccccaggtgaggcaagacactggcttacacaattccaaacttgccaccactctgctgataagcctttcgctgttatcgaagtggacgaagaagtccttaagtgtcaacagggagtctcttctctcgccttcgcccttgcattcctgcagagaatggacatgaaaccactcgtcgtcctgggcttgcccgccccaactgctccttccggttgtttgtccttctgggaagctaaagctcagctcgctaagtcctgcaaggttctcgtggatgccctgcgccacaacgccgccgcagcagttcccttttttggcggcggttccgttttgagagccgctgagccagcacctcacgcttcttacggaggaattgtttctgtcgagacagatctgctgcaatggtgcctcgagtcaggctctatccccatcctgtgccctatcggagaaactgccgcccgtcgttccgtgcttctggactcactcgaggtgacagcatctttggctaaagccctgaggcctacaaagatcatcttccttaataatacaggcggccttcgcgatagctcccacaaggttctctcaaatgtgaatctgccagctgacctggacctggtctgtaatgccgagtgggtgagtactaaagaaagacagcaaatgcgcttgatcgtggatgtactgtctaggctccctcaccacagttccgctgtcatcactgccgcatctaccctgctgaccgaactgttctctaataagggcagcggcactctctttaagaacgcagagcgtatgttgcgcgttagaagcctggacaagttggatcaaggtcgtctggtagacctggtgaacgctagttttggcaaaaagctgcgtgacgattacctggccagcctccgcccccgtcttcattctatctatgtcagtgagggatataacgctgccgccatcctgactatggagcccgtcttgggaggcaccccttatctggacaaattcgtggttagtagcagtcgccagggacagggcagcggacagatgctgtgggaatgtctgcgcagggacctgcaaacacttttctggcgttcccgtgtgactaacccaatcaacccctggtatttcaagcatagcgatggttctttttctaacaaacagtggatcttcttctggtttggattggccgacatcagagattcctacgaactggtcaaccacgctaaaggtcttcctgactccttccacaagcccgccagcgatcccggaagc

SEQ ID NO: 17127 - DNA, 1602 bp, Artificial Sequence
  Description of Artificial Sequence: Synthetic coding sequence
atggccacagcactcatggcggtcgtcctgcgggcagctgcagtggctccccgcttgagaggaagaggaggcactggtggcgcccggcggctgtcttgtggagcacggagaagagctgcacgagggacttctcccggcaggagactctctactgcatggagccagccccaacctcctcccgaagaatatgcgggagcggacgatgtgagccagtctcctgtcgcagaagaacctagttgggtacctagccccagacctcccgtgccccacgagtcccccgagccgccttctgggcggtcactggtgcaaagagacatccaggcattcctgaaccagtgcggcgcatcaccaggcgaagcacgacactggctgacccagttccagacctgtcatcacagtgctgacaagccttttgccgtgatcgaggtagacgaagaagtgctcaaatgccagcagggcgtgagcagcctggcgtttgcccttgcgttcctgcaacgcatggatatgaagcctcttgtcgtgctcggactgcccgcgccgaccgcccccagcgggtgcctgtccttttgggaggctaaagcccaacttgctaagtcctgcaaagttctggtggatgcactccgtcacaacgccgcggctgcagttccattttttggggggggatcagtactgcgcgcagctgagcccgccccccatgcgagctacggcggaatagtgtccgtggagaccgacctgctgcagtggtgccttgagagtgggagcatcccaatactgtgccccattggagagaccgctgcccggcgttccgttcttcttgacagcctggaggtcacggcttcactggccaaggctctgcgtcccacaaagatcatctttctgaacaacactggtggcctgcgggattcttctcacaaagtgctgagcaacgttaacctgcctgcagacctggatctggtttgcaacgccgagtgggtgagcaccaaggaaagacagcaaatgaggctgatcgttgatgttttgagcagactgccacaccattcgagcgcggtgatcactgccgcgtcaacactgttaacggaactattctccaataaggggtctggcaccctgtttaaaaatgctgaacggatgttgagggttcgttccctggacaaactggaccagggtcggctggtggatctggtaaatgcatccttcggcaaaaaactgagggatgattatctggcatccctacggcctaggctgcactctatctatgtttcagagggttacaatgctgcagccattctgaccatggaacctgtattaggaggaaccccgtatctcgacaaatttgtagtttcatcatctcgccagggccaaggatcaggccagatgctgtgggagtgtctgagacgcgacctgcaaaccctgttttggagaagccgcgtgactaatccaataaacccttggtatttcaagcatagcgacggcagcttctcaaataaacagtggatttttttttggtttgggctggctgacattagagattcctacgagcttgtgaatcatgccaaaggccttcccgattccttccacaagcctgctagtgacccgggaagc

SEQ ID NO: 17128 - DNA, 1602 bp, Artificial Sequence
  Description of Artificial Sequence: Synthetic coding sequence
atggcaaccgctctgatggctgtggtcctgagagccgcggcagtggcaccacgacttcgaggacgtggaggcaccggaggcgcgcgtagactgtcttgtggggccaggaggcgtgccgcccgaggcacaagtcctgggaggaggcttagcactgcttggtcacaaccacagcctccacccgaggagtacgcaggcgccgacgacgtttcacaatcaccggtggcggaggaaccctcatgggtgccgagcccgcgcccccctgtgcctcatgaatcccctgagccccccagtgggaggtcattggtccagcgtgatatccaggcattccttaatcaatgcggcgcttcgcctggtgaggccaggcattggctcactcaattccaaacctgccatcattcggctgacaaacccttcgccgtgattgaggtcgatgaggaagtgcttaaatgtcagcagggagtttccagcctggctttcgccctggcattcttgcagcgcatggacatgaaacccctggtcgtcctcgggcttcctgcacctacagctccctctggatgtctctccttctgggaggcaaaagctcaactcgccaagtcttgcaaggtcctggttgacgcactgcggcacaatgccgctgcagctgtaccattttttggaggtggatctgtcctcagggcagctgagccggctccacacgcttcctatgggggaatcgtctctgttgagactgacctcctccagtggtgcctggagagtggaagcattcccatcttgtgtcccataggggaaactgccgcgagacgtagcgtgctcctcgattccttggaggtgaccgcttcactggcaaaagccctgcgtcctaccaaaataatattcctaaataataccgggggtctccgcgatagttcacataaggtcttatcgaatgtgaaccttccagccgatctggacctggtttgcaatgcggaatgggtgtccactaaggaaaggcaacagatgaggctgatagtggacgttctgtcaaggttaccacaccattcaagcgctgttatcacggcagcttcaacccttctcactgaactcttctccaacaagggctccggcacattattcaagaatgccgaacgaatgctccgggtccgatcactagacaagctggatcagggtaggctagtcgaccttgtgaatgcgtccttcggaaagaaacttagggatgactatctggccagcctgcgaccgcgtcttcattcgatctacgtcagcgaaggttacaatgccgcagcgatcctgaccatggaacccgtgctcggcggtacaccttatcttgacaagttcgtggtcagctctagtagacagggtcaggggagtggccagatgctgtgggaatgtctgagaagggatctgcagaccctgttctggagaagtagagtgaccaatcccatcaacccgtggtatttcaagcacagtgatggctcatttagcaacaaacagtggatatttttctggtttggactcgccgatattagggactcctatgaattagtgaaccatgcaaagggactgcccgactctttccacaagcccgcctcagaccctgggtcc

SEQ ID NO: 17129 - DNA, 1602 bp, Artificial Sequence
  Description of Artificial Sequence: Synthetic coding sequence
atggcgaccgctctgatggctgtggtcctccgtgccgcggccgttgcgccacggttgagaggaagaggtggcactggtggagcacggcggctgtcgtgtggggctcggagacgggccgccaggggaacgtcccctggtcgccggttgtcgaccgcgtggagtcagccgcagccgccccctgaagagtatgccggggctgacgatgtgtcccagtcgccggtcgcggaagaaccatcctgggttccgtcgcctagacctccggtgccacacgaatcgccagagccgccctctggaaggtccctcgtgcaacgcgatatccaagccttcctgaaccagtgcggcgcctccccaggagaggccaggcactggctgacccagttccagacttgtcaccatagcgccgataaaccatttgccgtgattgaagtggacgaggaggtgctgaaatgccagcagggagtctcttcactggcgtttgctctggcattcctgcaacgcatggatatgaagccgctggtggtcctgggcttgccagcaccaaccgccccgagcggatgcctgtccttctgggaagcgaaggcacaacttgccaagtcgtgcaaggtcctcgtggatgccttgaggcataacgccgccgctgcggtcccgttcttcggaggaggaagcgtcttgagagcggcagagccagcaccgcatgcgtcatacggtggcatcgtgtcagtggagactgacctgcttcagtggtgcctcgagtcgggatcaatcccgatcctctgcccgatcggagagacggccgctcgccggtcagtgctgctcgactcgctggaagtgacggcaagcctggctaaggccctgcgaccaaccaaaatcattttccttaataacaccggggggctccgggattcctcacataaggtcctgtccaatgttaaccttcctgcggatctggatcttgtctgtaacgccgaatgggtgagcactaaggaacgccaacagatgcgcctcatcgtggatgtgctgtctcgcctcccgcaccactcaagcgcagtaatcactgccgcctcgaccctgcttaccgaactgttttcgaacaaaggctccggaaccctctttaagaatgcagaacgcatgcttcgggtgagatccctggacaagttggaccaaggacgcctcgtcgacttggtgaacgctagcttcggaaagaagctcagagacgactacctggcctcactgcgcccgcgcctccactcgatctacgtgtccgagggctacaatgccgcagcaattctcactatggagccggtgctgggaggcactccgtacctggacaaattcgtggtgtcaagctcgcggcagggacaagggagcgggcagatgctgtgggaatgcctccggcgcgacctccagaccctgttctggcgatccagagtgactaatcccatcaacccctggtacttcaagcactcggacggaagtttctcgaacaagcaatggatctttttctggtttggcctcgctgacatccgcgattcctacgaactggtcaatcatgcgaaaggtctgcctgacagcttccacaagcctgcgtccgaccccggcagc

SEQ ID NO: 17130 - DNA, 1602 bp, Artificial Sequence
  Description of Artificial Sequence: Synthetic coding sequence
atggccacagcactgatggccgtagtgctgcgcgctgccgcagtggcacctcgcctgcggggaaggggaggaacaggaggcgcaaggcgactgagctgcggggcccggcgaagggctgcacgcgggaccagcccagggcgccggctgagcaccgcgtggagccagccccagcccccccctgaagaatatgccggcgcggacgatgtttcacagtcccccgtggctgaggaacccagctgggttccatcccccagaccgcccgtcccacacgagagtccagaaccacctagtgggaggtctcttgtgcaaagggacatccaggcgttccttaatcagtgtggcgccagccccggcgaggcacgccactggctcacccaattccagacctgtcatcacagtgctgacaagccttttgcagtgatcgaggtggatgaggaagtgctcaaatgccagcagggagtcagcagtttggcctttgcgcttgcttttcttcaacgcatggacatgaagccactggtggtgctggggctgcccgcacccaccgctccctcaggctgcctgagcttttgggaggctaaggcacagctggcaaagtcttgcaaagttctggtagacgctcttagacataacgccgcagcagccgttccattcttcggaggggggtctgtcctgagggctgctgagcctgccccgcacgcttcctacggtggaatcgtatctgtggagaccgatctgctccagtggtgcctcgagagcggatccattccaattttatgtccaatcggggagacagccgccaggcgcagcgtgttactggactcactcgaggtcacggcctcgcttgccaaggctctgaggccaactaagattatcttcctgaataataccgggggcttaagggactcttcgcacaaagtcttatccaacgtaaacctacctgctgacttagaccttgtttgcaacgcggagtgggtttctacaaaggaacgccagcaaatgcgactaatcgtggacgtcttgagtcggttgccccaccactcatccgcggtgatcactgctgcctccactctgctgactgaattattcagtaacaaaggcagcggcactctcttcaagaatgctgagcggatgttgcgggttcgctctctcgacaagttggatcaggggcggctggtggatttggtgaacgcttcatttggaaagaaactgagagatgattacttagcctcattgagacctcggttgcatagcatctacgtcagtgagggttataacgccgctgcgatactcaccatggagccggtgcttggcggcaccccttacctggacaaattcgtggtgtcttccagccggcagggccaggggagcggccaaatgctctgggaatgtctgagacgggacttgcagacactgttttggcgcagtcgggtgacaaacccaatcaatccgtggtatttcaagcacagcgatggctccttttccaataaacaatggattttcttctggttcggccttgccgatatacgcgattcttacgaactggtcaatcacgctaagggactccctgattcattccacaagcccgctagcgaccctgggagt

SEQ ID NO: 17131 - DNA, 1602 bp, Artificial Sequence
  Description of Artificial Sequence: Synthetic coding sequence
atggccacggccttgatggccgtggtactgagagctgccgcggtagctcctcgcttgagaggaaggggcggaaccgggggagcaagacggcttagctgcggggcccgaaggcgagctgctagaggtacctcccctggacggcggctgagcactgcttggtcacagccccagccgccacccgaagagtacgccggcgccgatgatgtctcacagtcccccgtggcggaggaaccctcttgggtaccctccccacgtcccccagttccccatgagtcacccgaaccgccatctgggaggagcttagtccagcgagatatccaggccttcttaaatcagtgtggggcctccccaggcgaagccaggcactggctgactcagttccaaacttgccaccactctgctgataaaccattcgccgtgatagaggtcgacgaggaggtgctcaagtgccaacagggcgtgtcctcactggcattcgcactagcattcctgcagaggatggacatgaagcctctggtggttcttggcctccctgccccaacagccccttccgggtgtctgagcttctgggaagccaaagcccagctggccaaatcatgtaaggtcctcgtggacgccttgcggcataatgctgccgccgcggtgcccttctttggaggcggctctgtgctgagagcagcagagcccgctcctcacgctagctatggaggaatcgtcagcgtggaaactgacctgctgcaatggtgcctagagtctggaagcatccctattctgtgccccatcggcgagacagcagctagaaggtctgtgctgctggactccctggaggtcacggcctccctcgcaaaagcgctcaggcctacgaagatcattttcctgaataatactggcggtcttagagattcctcacacaaagtgctgtccaacgtgaacctgcccgcggatctggatctggtgtgtaacgccgaatgggtgtcgactaaggaaagacagcagatgagactgatcgtggatgttctgtctagacttccccaccatagtagcgccgtgatcactgcagcttccacactgttaactgagctgttctccaacaaggggtccggaaccctgttcaagaacgcggagcggatgctgagagtgagatctctggataagctggaccagggccggctggtagatctcgtgaatgcgtcattcggaaaaaaactgcgggacgactacctcgccagcctgaggcctagattacattccatctacgtatcggaaggatacaatgccgccgctattttaaccatggagcctgtgctgggcggaactccctacttggacaaattcgttgtcagctcttcccggcaggggcagggaagtggacagatgctctgggagtgtctgagacgcgatttgcagacactgttttggaggtcgcgcgttacaaatccaatcaacccatggtacttcaaacactcggacgggagcttcagcaataagcagtggatttttttttggttcggcttagcggacatccgggactcatacgagctcgtgaaccatgctaagggactccccgactcttttcataagcctgcaagcgaccccggctcc

SEQ ID NO: 17132 - DNA, 1602 bp, Artificial Sequence
  Description of Artificial Sequence: Synthetic coding sequence
atggccaccgcgctcatggccgtcgtgctcagagccgctgccgttgctccaagactgaggggccggggaggcacaggcggtgcccggagactaagctgcggggcgcggcggcgcgccgctagaggaacttcaccagggcggcggctcagcaccgcatggtcccagccacagcctccaccagaagaatatgccggtgccgacgatgtgtcgcagtcccccgtggcagaggagcctagctgggtgcccagccctcgcccccccgtgccacatgagagccctgagcctccaagcggacggtccttggtacagcgagatatccaggcctttcttaaccaatgcggagcaagccctggagaggccagacattggctcactcaattccagacgtgccatcacagtgccgacaaaccgttcgcggtcatcgaggtcgatgaggaggtcttgaaatgccagcagggtgtgagcagtctcgccttcgcactagcttttctccaacgcatggacatgaagccactggtggttctgggactccctgcccctacagccccctctggttgtctgtcattctgggaagccaaggcgcaactggccaagagctgtaaggtccttgtagacgccttacgtcacaacgccgctgctgcggttccattcttcggtgggggtagtgtgctgcgggcggcggaacccgcgcctcatgcttcttatggcggcatcgtcagcgtggagaccgaccttctgcagtggtgtctcgagtccggatctatccctattctgtgtcccatcggcgaaactgctgcccgtcgctccgtgcttttagatagcctggaggtgaccgcaagcctcgctaaagcgctgcgccctaccaagattatctttttgaataatacgggagggctgcgggattcttcgcacaaagtcctcagcaatgtgaatctccctgcggatctggatctggtgtgcaatgctgagtgggtgtcaactaaggagaggcagcagatgcgcctgattgtagacgtcttgtcgagactgccccaccatagctctgccgtgatcactgccgcaagtacattgctgacagagctatttagtaataagggtagcggcacccttttcaagaacgcagagcgcatgctcagagttcgcagcctggacaagctggaccagggccgcctggttgacctcgtgaatgcttcttttggaaagaagctaagagacgactacctcgctagcctgaggcccaggctgcactcaatatacgtgagtgagggatacaatgccgctgcgattcttaccatggagcctgtgcttggaggtactccatacctggataagttcgttgtgtccagctcgagacagggacagggcagcggacagatgctgtgggagtgtttgcggagggatctgcagaccctgttctggaggtccagagttaccaacccaatcaatccatggtacttcaagcactccgacggttctttcagcaacaagcagtggatttttttctggtttggcctggctgacatcagagattcctatgagctggttaatcacgccaaggggctgcctgatagcttccataaacctgcctcggacccagggtca

SEQ ID NO: 17133 - DNA, 1602 bp, Artificial Sequence
  Description of Artificial Sequence: Synthetic coding sequence
atggcaacagcactgatggcagttgtgttacgagcggcggctgtcgcaccaagactccggggcaggggtgggactggcggggctaggcgtctgagctgcggagcacggcggcgcgcagccagaggaacctcccccgggcgtaggttgtccacagcttggtcacagccccagccgcccccggaggaatacgctggggccgacgatgtctctcagtctccagtcgcggaggaacctagctgggtcccatcacccaggccccccgtgccacacgaatcacccgaacccccctctggccggagcctggtacagcgcgatatacaggcgttcttaaatcagtgcggggccagtccaggcgaggcccgtcattggcttacccagttccaaacgtgtcatcattcagccgataaacccttcgcagtgattgaagttgatgaggaagtccttaagtgccagcagggcgtcagttccctagcttttgccctcgcatttttgcaaagaatggacatgaagccactggtggtcctgggcttgcccgcacctacggcaccgtccggctgtctgtcattctgggaagcgaaggcgcagctggcaaaatcttgcaaagtacttgtggacgctctgcggcacaacgcagctgcggcggtgccttttttcgggggcggctccgtcctccgcgctgcagagccggctccccatgcaagttacgggggaattgtgagcgttgaaaccgatctcctccagtggtgcttggagtctggatctatccctattctgtgccctatcggcgaaaccgctgccagaagaagcgtgttgctcgactctttggaagtgaccgcatccctggcgaaggctctaagacccaccaagatcatcttcctcaacaacaccggtggactgagggattccagccacaaagtgttgagcaatgttaacctacccgcggacttggacctggtgtgtaacgcagaatgggtttctaccaaggagcgccaacagatgaggctcattgttgacgtactgtctcgactgcctcatcactcttccgctgttatcaccgcggccagtaccctactcacagagctgttctctaacaagggctctggcaccctgtttaaaaacgccgagaggatgttacgcgtgcgttcactagacaagctggatcagggcagactcgtggacctggtcaacgcatcctttgggaagaagctgagggacgactatctcgcctctttaaggcctcggctgcactctatctatgtgagcgaaggatacaatgcagccgctatcttgacaatggaaccagtactgggtggcacaccctacctcgacaagttcgtggtctcctcttctcggcagggccagggatctggccagatgctatgggaatgcctgcggcgggatctgcagactctattctggcgctctagagtgaccaaccccattaatccctggtactttaagcacagtgacgggtcctttagtaacaaacagtggattttcttctggttcggcctggcggatatcagagatagctacgagctcgtgaaccatgctaagggactgcccgactctttccacaaaccagccagtgatccaggttct

SEQ ID NO: 17134 - DNA, 1602 bp, Artificial Sequence
  Description of Artificial Sequence: Synthetic coding sequence
atggccacagcactaatggccgtcgtcctcagggctgcagcagttgcacccagattgaggggaagaggggggactggaggtgctagacgcctttcgtgcggagctcgccgaagggctgctcggggaacatcgccaggccgacggttgagcactgcatggtcgcagcctcagccgccccctgaggagtacgccggagctgacgatgtgtcccagagtcccgtggctgaagagccatcatgggtgccttcgccccgaccacccgtcccgcacgagagcccagaacccccgtctgggagatcactcgtgcagagggacatccaagcctttttaaaccagtgtggcgcctctccgggagaggctcgccactggctgacccaattccagacctgccatcactcagccgacaagccttttgccgttatcgaagttgacgaggaggtgttgaaatgccaacagggggttagtagcttggctttcgctctcgcattcctccagcggatggacatgaagccactggtagtgttaggcttgccggcccctaccgccccgagtggctgtctgtccttttgggaggccaaagcccagttagcaaagtcttgcaaagtgctagtggatgcgctgcggcataacgcagctgcagccgttccctttttcggaggcggtagtgtgctacgcgcggctgaaccagcaccgcacgcatcttacggtggaatagtgagcgtggagactgatctgctccagtggtgcctggaatccgggtcgattccaatcttgtgccccattggagagacagccgcccgcaggtccgtgctactcgacagcctagaggttacagctagcctcgccaaagccctgcgaccaactaaaattatcttcctaaataatactggaggcctccgcgactcctctcacaaagtcctttccaacgtcaatctacctgctgacctggatcttgtgtgtaatgccgaatgggtgtctacaaaggagagacaacagatgaggctcatcgtggacgtgctgtcacgccttcctcaccactccagtgctgttattaccgctgccagtacactgctgaccgaattgtttagcaacaagggctcagggacactgttcaagaacgcggagaggatgctgcgcgtgaggagtctggataaactcgatcaaggtagactcgtggacctcgtaaatgcctcctttggtaagaagctacgggacgattatttggcatctctgaggccgagattacactcgatttacgtaagcgagggctataatgccgcggcgatcctgactatggaaccggtcttaggagggactccctacctcgacaagttcgtggtgagctcttcccgccaggggcaaggctcgggacaaatgctctgggaatgcctcagacgagatcttcagacgctattttggaggtcccgcgttactaaccctataaacccctggtactttaagcactctgacggctccttttccaacaaacagtggatctttttctggttcgggttggcggacatccgggacagctacgagctagtgaatcacgcaaagggactgcccgatagcttccataaaccagcttctgatcctgggagt

SEQ ID NO: 17135 - DNA, 1602 bp, Artificial Sequence
  Description of Artificial Sequence: Synthetic coding sequence
atggccactgcactaatggccgtggtgctgagagctgccgcggtggccccaaggctgagaggcaggggcggcacaggcggcgctaggcggctgtcttgcggtgccagaaggcgcgcagctcgtggtaccagtcctggacgaagattaagcaccgcctggtctcagcctcagcctcccccggaggagtacgccggggcggacgacgtgtcccagtcccctgtggcagaggaacccagttgggtccccagtcctagaccgcctgtgcctcacgaatctcccgagccacctagtggaagatccttagtacagcgggatatacaggccttcttaaaccaatgtggcgcctcaccaggggaggccaggcactggctcacccagttccagacgtgtcaccactctgccgacaagccattcgctgtcatcgaggttgatgaagaggtgcttaaatgtcaacaaggagtgtcaagtctggcctttgctctggcattcctccaacgcatggacatgaaacccctcgtggtgcttgggctacctgcccctaccgcgcccagcggctgccttagcttctgggaggctaaggcccagcttgccaagtcctgcaaggttcttgtggacgctttgcgacataatgctgccgccgctgtgcctttttttggcggtggttctgtgctaagggccgcagagccggcgcctcacgcatcatacggcggtattgtgtctgttgagaccgacttattacagtggtgtttggagtccgggagcatacctattctctgtcccattggggagaccgcggcacggcgctccgtgctcctggattctcttgaagtgacagcgtcactcgctaaagccctgcgtccaaccaaaattatctttctcaataacaccggaggactgagggacagttctcacaaggtgctgagtaatgtcaacttgcctgcggatctggatcttgtctgtaacgcagagtgggtatcaaccaaggagcgtcagcaaatgagacttatcgtcgatgtcctaagtcgattaccacatcattcctcagccgtgatcacagcagctagcaccctgcttactgaactgttttctaacaagggcagcgggactttgtttaaaaacgcggagcgcatgctcagggtgcgttccctggacaagctcgatcaaggacgcctcgttgacctcgtcaacgcctcattcggcaaaaagctgagagacgactacctggccagccttcgccctcgtcttcactcaatctacgtgtcagagggctacaacgcggctgctatcttgacaatggagccagtcctgggggggacaccatatctcgacaaatttgtagttagcagctcaagacagggtcagggcagtggacagatgttatgggaatgcctccggcgggatctgcaaaccctcttctggaggagccgggtgacaaatccgatcaacccttggtacttcaagcattctgacggaagcttctccaacaagcagtggattttcttctggttcggcctggccgatatccgggatagctacgaactcgtgaatcatgccaaggggttacctgattcattccataaacccgctagtgaccctgggtca

SEQ ID NO: 17136 - DNA, 1602 bp, Artificial Sequence
  Description of Artificial Sequence: Synthetic coding sequence
atggccactgccctcatggcagtcgtcttgcgggcggccgccgtcgccccaaggcttcgaggccggggtgggaccgggggcgccagaaggctgtcttgtggggccaggagaagagcagctcggggtacctctcccggtagaaggctgtctaccgcttggagtcagccacaacccccaccagaggaatacgccggcgcggacgatgtatcacagagtccggtagcggaggaaccctcttgggtgccatctcctcgaccccccgttccccacgaaagtcccgagcctccctccggccggtctctggttcagcgagatattcaagcctttttaaaccagtgtggcgcctctccgggagaagcaaggcactggctcacccagtttcagacgtgtcatcacagtgctgataaaccattcgcagtcattgaagtcgacgaggaggtgctgaaatgtcagcagggagtgtccagcctagcatttgctctcgccttcctacaaagaatggacatgaaaccattagtggtacttggccttcctgcccctaccgccccgagtgggtgtctgtcgttctgggaagccaaagcccagctggcaaagagttgcaaagtacttgtcgatgccctgaggcacaatgcggcggcggctgtgcccttctttggagggggaagcgtcctgcgtgctgcggagcctgctccccacgccagttatgggggaatcgtttctgtcgagacagatctcttgcagtggtgtctcgagtccggttctatcccaattttgtgcccgatcggcgagacagccgctagacggtcagtcctgctagactctttggaggttacagccagcctcgcgaaagctctcagaccaaccaaaattattttcctcaataacaccggggggctccgggactcctcacacaaagtgctgagcaacgtgaacttgcctgcagatcttgacctcgtgtgtaatgcagaatgggtgtcaaccaaggagaggcaacagatgcggctgattgtagatgttttatccagactgcctcaccattcttcagcagtgattacagccgcctcaactctactgactgagctgttttctaacaaaggcagcgggacactgtttaagaatgcagagcgcatgctgcgtgtgaggtctctggataagctggaccaggggcgcctcgttgatctcgtcaacgcaagctttgggaagaaactgcgagatgattatctcgcgtctctgcgaccgagactccactcgatatacgttagcgagggatataatgccgcagctatcctcactatggagccagtgttaggaggcactccgtatcttgacaaattcgtggtgtcttcatctcgacagggacaaggcagtggtcaaatgctgtgggagtgcctcagaagggatctacagacattgttctggagatctcgagtaactaaccctataaacccctggtacttcaagcacagcgatgggtcattttcgaacaagcagtggatatttttctggtttggcttggcagacattcgcgacagctacgagctggtgaatcacgctaagggcctccccgacagcttccataagcctgcttctgacccaggctca

SEQ ID NO: 17137 - DNA, 1602 bp, Artificial Sequence
  Description of Artificial Sequence: Synthetic coding sequence
atggcaacggcgctgatggctgttgtactgcgcgcggcagcggttgcccctagattgcgaggccgtggcggaacgggtggggccagacgcctcagctgcggagccagaaggcgagctgcgcgtggaaccagcccaggtcgccgtctgtcaaccgcatggagccagccacaacctccgcctgaagagtatgccggtgcggatgacgtgagccagtcccctgttgccgaggaaccaagctgggtaccttccccgaggcctccggtccctcatgagtccccagagcctccaagtggcaggagtctggttcagcgcgatatacaagcttttctgaatcagtgtggagcttccccaggcgaagcccgtcactggttgacccaattccagacgtgtcatcattcagcggataaaccttttgccgtcatcgaagtggacgaggaggtcttgaaatgccagcaaggtgtgagcagcctcgccttcgcgctagctttcctgcagcgcatggacatgaaaccattggtcgttctgggcctgcctgctccaacagccccatctggttgcctgtccttctgggaagcaaaagctcagttagcaaaatcatgtaaggttttggtggacgccctgcgtcacaatgctgcggctgcagtcccattctttggcggtggttcagttctgcgtgcagctgaaccggcgccgcatgcgtcgtatggtggcatcgtcagtgtggaaaccgacttgctgcaatggtgccttgaatccggaagcatcccgatcctgtgtcccatcggcgaaaccgcggctcggcgcagcgtactgttggatagcctggaggttacggcaagccttgcaaaggcactgcgaccgaccaagattatttttctgaacaatacgggtggtctgcgtgactcctctcataaagtgctgagcaacgtaaacctgcctgctgaccttgatctggtgtgtaacgctgaatgggtctccaccaaggaacgccagcagatgagattgatcgttgatgtgctgtcccgactgcctcaccatagcagcgcggtaatcactgctgcttccacgctgctgactgaactgttcagcaataagggttccgggaccctgtttaagaacgcagaacgcatgctgcgggtacggagcctggataaactggatcagggtcgcttggttgacctggtgaacgcctcgttcgggaaaaagctgcgagacgactatctcgctagtcttcgccctcggctccacagtatttacgtgagcgagggttataacgcagcggccatactcaccatggaaccggtgctgggtggtaccccatacctggacaagtttgttgttagttcgtcccgtcaaggccagggcagcggccagatgctgtgggagtgcctgcgccgtgacctccaaaccctcttctggcgctctcgagtcacgaacccaataaatccttggtacttcaagcactcagacggatccttttcgaataagcagtggattttcttctggttcggcctggcggatataagagactcttacgaattagttaaccatgccaagggtctgccggattcgttccacaagcctgccagcgatccaggtagc

SEQ ID NO: 17138 - DNA, 1602 bp, Artificial Sequence
  Description of Artificial Sequence: Synthetic coding sequence
atggctaccgcgctaatggctgtagtgctgagagccgcggctgttgccccacgcttgaggggccgcggggggaccggaggagcccggcgactgtcttgcggcgcccgaaggcgggccgcgcgaggaacttccccagggcggcgcctctcaacggcctggagccaaccccaaccacctccagaagaatacgcaggcgcggacgatgtgagccagagtccggtagccgaggagccctcatgggtgccttcccctcgtcccccggtgccacacgaatcacctgaaccaccaagtgggagaagcctggttcagagggacatccaggcattccttaaccagtgtggggcttctcctggagaagctcgacactggctgacccagttccagacgtgccaccattcagcagataagccattcgcagtgatcgaagttgatgaggaagtgctgaagtgccagcagggcgtttccagcctcgcatttgccctagcttttttacaacgtatggacatgaaacctctagtggtactaggccttcccgcccccacggccccgtcaggatgcctaagtttctgggaagcaaaggctcagctggcgaagtcttgcaaggtgctggtggatgcccttcgccacaatgccgcagctgcagttccgttctttggtggaggctccgtgctacgggctgctgagccggccccacacgcgtcttacggggggatcgtaagtgtggagacagacctcctacagtggtgcttggaatctggaagcattccgatactgtgcccgataggggagacagccgcacgcaggagcgtgcttttggattccctcgaagttacagccagcttggccaaggccctaaggcctacaaagataatatttctgaataatactggcgggctgcgcgacagctcgcataaggtactatctaatgtgaacctgccggcggatctggacttggtgtgcaatgccgaatgggtatcgaccaaagagagacagcagatgcgattgatcgtagatgttctgagcaggcttccacaccatagttctgcggtgatcacggccgcctcaaccttattgaccgaactcttctcaaataagggcagtggtacattattcaaaaatgccgaaaggatgctgcgcgtgagaagtcttgacaaattggaccaagggcgcctggtggacttggtaaatgcctcatttgggaagaagctgagagatgactacctggcctctttacggccaagactgcactctatctacgtcagtgaagggtataacgcggccgctatcttgactatggagcctgtgctaggaggcaccccctatctggacaagttcgtggtgagcagctcacgccagggccagggaagcggacagatgctgtgggagtgtctccgccgcgatctgcagactctgttctggcgaagcagagtgactaaccctataaatccatggtattttaaacacagcgatggtagtttctcaaacaaacagtggattttcttttggtttggcctggcagatattcgggattcttatgaactggtcaaccacgccaaagggttgccggattcatttcacaaacctgccagtgaccccgggagt

SEQ ID NO: 17139 - DNA, 1602 bp, Artificial Sequence
  Description of Artificial Sequence: Synthetic coding sequence
atggcaactgcattaatggcagtagtactccgagctgcagctgttgctccaaggttaagaggaagaggaggaacaggaggtgctagaagattaagttgtggagctagacgtagagctgcaagaggaactagtcctggtagaagattatctacagcttggtcacaacctcaaccaccacctgaagaatatgctggtgctgatgatgtaagtcagtcacctgttgcagaagagccatcatgggttccaagtcctagacctccagttccacacgaatctccagaaccacctagtggtagatcattggttcaaagagatattcaagcatttcttaatcaatgtggagcatccccaggagaagcaagacattggttaactcaatttcaaacttgtcatcattcagcagataaaccattcgctgtaattgaagttgatgaagaagttttaaagtgtcaacaaggagttagtagtctagcttttgcacttgcatttttgcaaagaatggatatgaaaccacttgtggtattaggattaccagctccaacagcaccaagcgggtgtctctcattttgggaagctaaagctcaattagcaaaatcttgtaaagtcttagttgatgcattaagacataatgctgctgctgctgttccatttttcggaggaggatcagtgcttagagctgctgaacctgctccacatgcttcatatggaggtatagtatcagtagaaacagaccttttacaatggtgtttggaatcaggatctattccaatactttgtcctattggagaaacagctgctagacgatcagtattattagattcattagaagttacagcatctttagctaaagcattaagaccaacaaaaattatttttctcaataatacaggaggattaagagatagttcacataaagtacttagtaatgttaatcttccagctgatcttgatttggtatgtaatgcagaatgggtttcaacaaaagaacgacaacaaatgagattaatagtagatgttctttcacgtcttccacatcattcatcagctgttattacagcagcatcaacacttttaactgaattattttcaaataaaggaagtggaacactttttaaaaatgccgaaagaatgcttagagttagatcacttgataaattagatcaaggtagacttgttgatttagttaacgcatcatttggaaagaaacttagagacgactatttagcttctctaagaccaagattacattccatatatgtatcagaaggatataacgcagcagctattttaacaatggagccagttcttggtggtactccatatttagataaatttgttgtttcttcatcaagacaaggacaaggatcaggacaaatgttatgggagtgtctaagaagagatttacaaacattattttggagatcaagagtaactaatcctataaacccatggtatttcaaacattcagatggatctttttcaaataagcaatggatttttttttggtttggtcttgctgatattagagattcttatgaattagttaatcatgctaaaggtttgccagattctttccataaaccagcttcagatcctggatca

SEQ ID NO: 17140 - DNA, 1602 bp, Artificial Sequence
  Description of Artificial Sequence: Synthetic coding sequence
atggccactgcactgatggcggttgtcctccgggccgcagcagttgcccctagacttcgcgggaggggagggacggggggtgcccgccgcctgtcctgtggcgcccggcgacgcgcagcgagaggcacgagcccagggcgccggctctcaactgcctggtcgcaaccccaacccccacctgaggagtatgctggggctgatgatgtgagccagagcccagttgccgaagagccgtcatgggtcccatctccccggcctcctgtgccccacgagtctcctgagccacctagcggccgttccctggtgcagagggacatacaggcctttctcaatcaatgcggagcatccccgggtgaagctcggcattggcttacccagttccagacttgtcatcattccgccgataagccattcgccgtgatcgaggtggacgaggaggtcctgaagtgtcagcagggcgtgagctctcttgcatttgcactggccttcctgcagcggatggatatgaagcctctggtggtgctcggcttaccagccccaacggctccttcagggtgcctgtctttctgggaggccaaggcacagctggccaagtcttgtaaagtgctggtggacgcgttaagacacaatgccgctgctgcagtgcccttctttgggggtggaagtgtgttacgtgctgctgaaccagctcctcacgcctcttatggaggcattgtgtccgtggagaccgacctgctccagtggtgtctagaaagcggaagtatccccatcctctgtccgataggagagactgctgcacggcgatccgtactgttagacagcctggaagtgacagcttctctggctaaggcactacgcccaacaaaaattatcttcctgaataatactggcggtctgagagacagctcacataaggtcttgtcaaatgtgaacctgccagccgaccttgacctggtatgtaatgccgagtgggtgtccacaaaagaaaggcagcaaatgcggctgattgtcgacgtgctatctagactcccccaccacagctcggctgtgatcaccgctgcgtccacattactgacggaactttttagcaataagggttcagggactctttttaaaaatgccgaacgaatgctgcgcgtcagatcccttgacaagctggaccaaggccgcttagttgacctggtcaacgcgtcatttgggaagaaactgcgcgacgactacctggcctcacttcgtcccagactccactcaatctatgtgtccgaaggatacaacgctgctgccatcctgacaatggagcctgtcctaggtggcactccatacttggacaaattcgttgtctctagcagtcggcagggccagggatccggacagatgctctgggaatgtctcagacgggatttacagacacttttttggcgaagcagagtgacaaatcccatcaacccttggtattttaagcactctgatgggagtttttcaaataaacagtggattttcttctggttcgggttggccgacatcagagatagttacgagctggtcaatcacgccaaaggcctgcctgactcgtttcacaaacctgctagcgatcctggatcc

SEQ ID NO: 17141 - DNA, 1602 bp, Artificial Sequence
  Description of Artificial Sequence: Synthetic coding sequence
atggcaactgcccttatggcagtagttctgagggctgccgcagttgctccaaggctgcgcggccgcggcggtactggcggtgctcgccgcctgagttgtggtgcccgcaggagagctgcacgcggcacctcccctggccgcaggttgtcaacggcatggtctcagccacagccaccccccgaagagtacgcgggagctgatgatgtgtcacagtcacccgtcgccgaagagccctcctgggtcccgagtccccgcccaccagtcccacacgaaagccctgagcctccatctggaagaagtttggtccagagggatattcaggccttccttaatcagtgtggtgcctctccgggcgaggcgaggcactggctgactcagtttcagacttgtcaccattctgctgacaagccgttcgcagttatcgaagttgatgaggaggtcctcaagtgccagcagggcgtctcatcactcgccttcgcacttgcgttccttcaaaggatggacatgaagccacttgttgttctcggtctccccgcacccacagccccttccggctgccttagtttctgggaggctaaggcgcaattggctaaaagctgtaaagtcctcgttgacgctctgaggcacaatgccgccgctgcagttccttttttcggaggaggttccgtgctcagagccgctgaaccagccccccatgcaagctatggaggaattgtcagtgtggagacggatcttctgcaatggtgcctggagtctggcagtattcccatcctgtgcccgattggagaaacggcagctcgccgctccgttttgctggactccctggaagtgactgcatcattggccaaagctcttcgcccgactaagataatcttcttgaacaacaccggaggtctgagggactcatcacacaaggtcctctccaacgtcaatcttccagccgatctggacctcgtttgcaatgcggaatgggtctctactaaggaacgccagcaaatgaggttgatcgttgacgtgctgagtcgcttgcctcatcattccagtgccgtcatcacagcggcctccactctgctcactgagctcttcagcaacaagggcagtggcaccctgtttaagaacgcagagcgcatgctcagggtaaggtcacttgataaactggatcaaggtcgcctggtggacttggtcaacgctagtttcggaaagaagctccgcgatgactatctggcctccctgagaccacgcttgcactctatctatgtctcagaaggatacaacgctgcagctatcctgactatggagcccgtgctgggcggaaccccttacctggacaagtttgttgtttcctcttctcgccagggccagggcagcggccaaatgctctgggaatgccttaggagggacctccagacacttttctggaggtcaagagttaccaacccgataaacccgtggtacttcaaacactctgacggatcattcagcaacaagcaatggatcttcttctggtttggcctggctgatatcagagatagttacgagttggtcaatcacgcaaaaggtctccccgactccttccacaagcctgcaagtgacccgggaagc

SEQ ID NO: 17142 - DNA, 1602 bp, Artificial Sequence
  Description of Artificial Sequence: Synthetic coding sequence
atggccaccgccctcatggcggtggtccttagggccgccgccgtcgcaccccggcttaggggccgggggggaacaggcggggcccgacgccttagctgtggggctagacggcgcgctgctcggggcacatcccctggacggaggctgtctacagcctggagccaaccccagccccctccagaagagtacgctggcgctgacgacgtctcccagagcccagtggccgaagaaccaagctgggtgccctctccaaggcccccagtaccgcacgagtctcctgagccacccagtgggcgatccctggtgcagagggacattcaggctttcctcaaccagtgtggagcatctcctggagaggctagacactggctgacccagtttcagacctgtcaccacagtgccgacaagcccttcgccgtgatcgaagtggacgaagaagtactgaagtgtcagcagggcgtgtcttctctggccttcgccctggcattcctgcagcgcatggatatgaagcctcttgtcgtgcttgggcttcctgccccaaccgcaccaagcgggtgcctgagtttttgggaagctaaggctcagctggctaaatcctgtaaagtcctggtggacgccctcagacataatgcagccgcagctgtcccatttttcggcggaggcagcgtgctgcgggctgcggagccggcaccacacgcgagttacggaggtatcgtctccgtggagaccgacctcctgcagtggtgtctcgaatcaggctccattccgattctgtgccctattggtgaaaccgctgcaaggcgatctgtgctgctggattccctggaggtgacagctagcctggccaaagctctgagaccaactaagatcatattcctgaataatactggcggattgagagactcatcccataaggtgctgtctaatgtgaatctgcccgcggatctcgatctcgtgtgtaacgcagagtgggtttctacaaaggagaggcaacaaatgagacttattgtggatgtcctctcaaggctgcctcatcacagcagtgccgtcattactgcggcctctacactcctgacggagctcttcagcaataaggggagtgggaccctcttcaagaatgctgagagaatgcttcgggtccggtccctcgacaaacttgaccaggggcgcctggtggatctggtgaacgctagctttggtaaaaaactgagagatgattacctcgcatccttgcggccgcgcctgcactcaatatatgtctctgaagggtacaatgcagccgccatccttaccatggaaccagtgctcggcggcacaccttacctggacaagtttgtggtcagcagttcccgacagggtcaaggcagcgggcaaatgctttgggagtgcctccggcgagatctgcaaaccctgttctggcggtcacgagtgactaatccaattaatccatggtactttaagcatagcgacggatccttctccaataagcagtggatcttcttctggttcggcctggcagatatccgagactcttatgagctggtaaaccatgctaaaggcctgccagattccttccataaacccgcttcagatcctggatca

SEQ ID NO: 17143 - DNA, 1602 bp, Artificial Sequence
  Description of Artificial Sequence: Synthetic coding sequence
atggcaaccgcattaatggctgtcgtccttagagctgcagcggttgcccccagactgcgcggacgtggcggtacaggcggagctcggcgtctatcatgcggtgcccgcagacgagctgcacgaggaacatcaccaggacgacggctcagcaccgcttggtctcaaccacaacctccgcctgaagaatacgctggtgcagatgacgtgtcacaatcgcctgtggcagaagagccatcatgggtcccttcaccgcggccaccagttccacatgagtcacctgaaccaccgtccggtcgctcccttgtccaacgtgacatacaggcatttctcaaccaatgcggagcttcaccgggagaggccagacattggttgacgcagttccaaacgtgtcatcatagtgcagataaacctttcgcagttatagaagttgacgaagaggtcctaaaatgtcaacagggtgtgtcaagccttgcattcgccttagcattccttcaaagaatggatatgaagcctcttgtcgttcttggattgccagctccaacagcaccgagtggttgtctttcattttgggaagcaaaagcgcaattggcgaagtcatgtaaagttcttgtcgatgcgttgcgacataatgcagccgccgccgtaccattctttggaggaggaagtgtcttacgtgcagcagaaccagcacctcacgcatcctatggaggcatcgtatcagttgagacagatctgctgcaatggtgtttagaatctggatcaattcctatcctttgtccaataggagagactgctgctcgtagaagcgttttgttggattcacttgaagtcactgcttctcttgctaaggctttacgaccgactaaaatcatttttcttaataatacgggaggactgcgagactcctctcacaaagtgctttcgaatgtaaacttgcccgcagatttagatttggtgtgcaatgcggaatgggtttcaacgaaggagcgccaacaaatgcgtttaatcgttgacgtcttgtctcgcttaccacatcatagctctgcggtcataacagctgctagcacactcctgacagagctgttttcaaacaaaggctctggaactctattcaaaaatgctgaacggatgcttcgagttcgatctttggataagctggaccaaggaagactcgttgatctggttaacgcttctttcggcaaaaaactacgtgatgattatctagcatcactacgtccaagattgcactcgatctacgtgtcggaaggatataatgctgccgccatactgacaatggaaccagtgcttggcggaacaccttatctggacaaatttgtcgtctcctcttcccgtcaaggacaaggttctgggcagatgttgtgggagtgcctgagaagagaccttcaaacgctcttttggcgttcgcgtgtgaccaatccaatcaacccatggtactttaaacactctgacggatctttttcgaataaacaatggatcttcttctggttcggtcttgcagatattcgagactcttacgagttggttaaccatgctaaagggttgccagattccttccataaaccagcttctgacccgggctca

SEQ ID NO: 17144 - DNA, 1602 bp, Artificial Sequence
  Description of Artificial Sequence: Synthetic coding sequence
atggccactgctctgatggccgtggtattaagagctgccgcagtggcccctagactcagaggacgagggggcaccggtggcgcaagaaggttatcctgcggggccaggcgcagggctgctaggggcactagcccaggacgtagactctccactgcttggtcccagccacagccacccccagaggaatacgccggggccgacgatgtctctcagagtcccgtggctgaagaaccatcctgggttccttctcccagacctcccgttcctcacgaaagtcctgagccaccatctggcagatccctggtccagagggatattcaagcctttcttaaccagtgcggcgcttcccccggtgaggctcgccactggctaacacagttccagacctgtcatcattccgctgataagccttttgcagtcatagaggttgacgaggaagtattgaagtgtcaacagggcgtaagctctctggccttcgctcttgccttcctgcagaggatggatatgaaaccactggtggttctggggctgcctgcccccactgctcccagcggttgtctgtcattctgggaagccaaggctcaactggctaagtcctgcaaggttctggtcgacgcactgagacacaatgcagccgctgctgtcccttttttcggcggaggcagcgtcctgagagctgctgagcctgctccccatgcttcatacggaggaatagtaagtgtggagaccgatctccttcagtggtgcctggaatcaggaagcatccctattttatgccctatcggcgaaaccgcagcccgcagatccgttctgctagatagcctggaagtcacagcaagcctggctaaagcattgcggccaaccaaaatcatctttctaaataacacaggtggcctgcgcgactccagtcacaaggtcctctccaacgtaaacctgcccgcagatctcgacctggtttgtaacgcagaatgggtttccactaaggaaagacagcagatgcggctgatagtggatgtgttgagtcgactgccccatcattcttccgctgtcataacagcagccagcactcttctcacagagctgtttagcaacaagggttccgggactctgttcaagaatgccgagagaatgctgagggtgcgctctctagacaaactggatcaggggagactagtggacctggtgaatgcttcctttggcaagaagctacgggacgactatctggctagcctacgaccccgcctgcactcaatttatgtgtccgaaggatataatgccgccgccattctaaccatggaaccagtcctgggaggaaccccatatctggacaagttcgtggttagtagttctcgtcaggggcaggggagtgggcagatgctgtgggaatgcttgcgacgtgacctccagaccctcttttggcgctcaagggtgaccaaccccatcaacccctggtactttaaacacagcgatggcagtttttctaataagcagtggatcttcttctggttcgggctggcagacatccgggacagttatgagctggtcaaccacgccaagggcctgcctgattccttccataagcctgcctctgatcccggaagt

SEQ ID NO: 17145 - DNA, 1602 bp, Artificial Sequence
  Description of Artificial Sequence: Synthetic coding sequence
atggccacggcactgatggcagtggtgttgagagcggccgcagtggcgcccagactgagggggcgtgggggaacgggcggcgcccgccggctctcctgcggcgccaggcggagggcagcaagaggtacttcccctgggagaagactgagcacagcctggtcccaacctcagccgccccccgaggagtacgctggggctgatgatgtctcccagtcccctgttgcggaggagccaagctgggtgcctagtccacggccccctgtgcctcacgagagccctgaacccccttctggcagaagccttgtgcagagagatatccaggcgtttctcaaccagtgcggggcctcccccggagaggcaagacactggctgacccagtttcagacatgccatcacagcgccgataaaccatttgctgtcatagaggtggacgaagaagtgctcaagtgtcagcagggtgtgtcatctttagcttttgcactggcgtttctgcaacggatggacatgaagccattggttgtgctcggactacctgcccccaccgccccaagtggctgcctatcgttttgggaggcaaaagcgcagcttgctaagtcatgcaaagtgctggtggatgccctgcgccataacgctgcggctgctgttcccttttttgggggagggtcagtgctccgtgcagcggaacccgcccctcacgcttcgtacggtgggatcgttagcgtcgagactgacctccttcagtggtgtcttgaatccggctccatccccatactttgcccgattggtgagacagcagcccgtcggtcagtcctcctcgactcgctggaagtaaccgcctccctcgccaaagcgcttaggcctactaagatcatcttcctgaataatactggagggctccgagacagctcccacaaggtgctgtctaatgttaacctccctgccgacctcgacctggtctgcaatgccgagtgggtcagtaccaaagagaggcagcagatgcgattaatcgtggacgtgctcagccggcttcctcatcacagtagcgctgtgatcaccgccgcttctactctgctcaccgaattgtttagcaacaagggctcaggaacactgttcaagaatgctgagcgcatgctgagagttcggagtcttgataagttagaccaggggcgcttggtcgatctggttaacgcgtcctttggaaaaaagctgcgggacgattatctcgcatccttgcggccccggttgcacagcatctacgtgagtgaggggtataacgcggctgctatcctgactatggaacctgtgctaggaggaaccccataccttgacaaatttgtcgtgtcttcctcaagacagggacagggttcaggccaaatgctttgggagtgcctccgacgggatctccaaaccctcttttggcgcagccgcgttacaaatcccatcaatccttggtattttaagcattcggacggctctttctccaataagcagtggatcttcttttggttcgggctggcggacataagggattcatacgaactcgtcaatcacgcaaaaggtctgcctgattctttccataagccagcctccgatccaggtagt

SEQ ID NO: 17146 - DNA, 1602 bp, Artificial Sequence; identical to SEQ ID NO: 17134
  Description of Artificial Sequence: Synthetic coding sequence

SEQ ID NO: 17147 - DNA, 1602 bp, Artificial Sequence
  Description of Artificial Sequence: Synthetic coding sequence
atggccacagcactaatggctgtcgtcttgcgagcagcagccgtggcccctaggttaagaggacgggggggaactggaggagcccgcaggttgtcctgcggggccagacggcgggctgctaggggaacttcccccgggaggcgactgtcaacagcttggagtcagcctcagccacctccagaggagtatgctggggcggatgatgtttcgcagtctcccgtggctgaggaaccctcatgggtgccctcaccgaggccccccgtgcctcacgaatctcctgagcctccctctgggaggtctctggtgcagagggatatccaggcctttttaaatcagtgtggggcctccccaggggaagctcgacattggttaactcagttccagacttgccaccattctgcagataaaccatttgcagtaattgaagtcgatgaagaggtccttaaatgtcagcaaggagtatctagtcttgcatttgcattggcatttctgcagaggatggatatgaagccactcgtggtgttgggactgccagcccctacagccccatccggatgtctctccttttgggaagcaaaagcccagttagcaaagagttgtaaggtgctggttgatgctttgaggcataacgcagcggctgctgtgccattctttgggggaggatccgttcttagggcggctgaaccagctccacacgcatcttatggaggaatcgtttcagtcgaaactgatctcctgcagtggtgcctagaatctggaagtatccctatcctatgtcctatcggggaaacagctgcaagacggagtgtcttgcttgattccctcgaagtcactgcctcacttgccaaagcactaaggccaacaaaaattatcttccttaataacactggaggactccgggatagttctcacaaggtactgtccaacgtgaatttgccggctgatttggacttggtgtgcaatgctgaatgggtttctacaaaagagcgccagcagatgcggcttattgtagatgtcctctctcgactcccacaccatagttcagccgtgatcacggctgcatctactcttcttactgaactcttttctaacaaaggaagtgggacattattcaaaaacgccgaaaggatgttacgggtgcggtcgctcgataaattggatcagggaaggctagtggatcttgtcaatgcaagttttgggaaaaaactgcgggatgattatctggcctctctcaggccacggctacactctatatatgtgtctgaaggatacaacgccgctgctatactgacaatggaacccgtgctgggagggacgccctatttagataaatttgtggtctcctcttctcgccaggggcaggggtccgggcagatgctctgggaatgtcttcggcgggatctacagactcttttttggagaagtcgggtcacgaatcctattaatccttggtatttcaaacattccgacggatccttttctaataagcaatggatatttttttggttcgggctggcagacatacgggattcatatgaactagtcaaccacgctaagggactccctgactcatttcataaacctgccagtgatcccggatcc

SEQ ID NO: 17148 - DNA, 1602 bp, Artificial Sequence
  Description of Artificial Sequence: Synthetic coding sequence
atggccacagcattgatggccgttgtgctgagggcggcggctgtagctccaaggctgaggggacgggggggcactggtggcgcaagacggctctcatgtggagccagacgcagggctgcccggggtacttctccaggcaggcggctctcaaccgcctggtcccagccccagcctccgcctgaagagtatgctggcgcagatgacgtaagccaatcacctgttgcggaagaaccaagctgggtgccatctccaagaccacctgtgccccacgaaagcccggaaccgccgagtggtcggtccttggtgcagcgcgacatccaggcatttctgaatcagtgcggagcctctcctggcgaagctaggcactggctgactcagttccaaacttgtcaccatagcgccgacaaacccttcgccgtgatcgaagttgacgaggaggtgctgaaatgccagcaaggagtgagctccctcgccttcgcactggcttttctccaacgaatggatatgaagcccctcgttgtcctcggacttccggcacctacagctccgagcggatgtttgagcttttgggaggcgaaggcccaactggccaagtcctgcaaggtgttggtagacgcactcaggcacaatgccgcggccgccgtgccgttctttggaggtgggagcgtgcttcgggccgccgaaccggctccacatgcctcatacggtggcatcgtcagcgtagagacagacctgctgcagtggtgtctggagtctggaagcatccctatcctctgtccaattggagagacagccgcacgccgctctgttcttttggatagccttgaagtgacggccagtctcgcgaaagctctgaggcccacaaaaatcatctttcttaataacaccggcggtctgagggactctagtcataaagtactgtccaacgtgaatctgccagcggacctcgacctggtatgtaacgcagaatgggtcagcacaaaggagcggcagcagatgcggctgatcgtcgacgtgttgtcccggctgccacatcatagctctgccgtgataaccgcagcatccacgctgctcactgagctgttctccaataagggatccgggacgcttttcaaaaacgccgagagaatgcttcgcgttaggtccctcgacaagctggatcaaggacgactcgtggatctcgtgaacgcctctttcggcaagaagctgcgggatgattacctggccagcctcaggccgaggttgcatagtatctatgtgtcagagggctataacgctgctgcaatactcactatggaacctgtcctcggtgggaccccatacctcgacaagtttgtagtctccagctctcggcaggggcagggatccggtcagatgctgtgggagtgtctgaggcgcgacctgcagaccttgttctggcggtcccgggtgacaaacccaattaacccctggtactttaaacattccgacggttcattcagtaataaacaatggatcttcttctggttcggcctggcagacatacgggatagctacgagttggtgaatcacgcgaagggattgccagacagcttccacaaaccagctagtgacccaggatca

SEQ ID NO: 17149 - DNA, 1602 bp, Artificial Sequence
  Description of Artificial Sequence: Synthetic coding sequence
atggcgaccgcccttatggccgtcgtgctccgcgccgcggctgtggctcctaggctgcgcggccgcggcgggactgggggcgccaggcgcctctcctgtggggccagacgcagagctgcaagaggcactagccccggaaggcgcctcagtacggcttggtcccagcctcaacccccgcccgaggaatacgcgggtgcagacgacgtgtcccagagcccagtggctgaggagccttcttgggtgcctagcccgcgaccccccgttccgcacgagtctcctgaacccccttccggtcggagccttgtccagagagacatacaagctttcctgaaccaatgcggggccagccctggagaggctcggcattggctgactcaattccagacttgccaccatagcgccgacaaaccgttcgctgtcattgaagtcgacgaagaggtgctgaagtgtcagcagggagtaagctccttggcctttgctcttgccttccttcagcgcatggatatgaagccactggtcgtactgggactgcctgctccaactgctccatccgggtgcctgtctttctgggaagcaaaggcccagcttgcgaaatcatgcaaggttttggtcgatgccctgcggcataatgccgctgccgccgtacctttcttcggaggcggatcagtcctgagagccgcggaaccggctccgcacgcctcctacggtggtatagtgagtgtcgagacggacctcttgcagtggtgcctggagtccggcagtatacccatactctgcccaatcggcgagacggcagcccggcgcagcgtgctgttggattctctcgaggtgacagccagtctggccaaagctctcaggccaacaaagattatctttcttaataacaccggcgggctgagagattcatcacataaagtgttgagcaacgtgaacctgcccgcggatctggatctggtctgcaatgcagagtgggtgagtaccaaagagagacagcagatgagactcatcgtggatgtgctctctcgcctcccacatcatagcagtgccgtgataactgctgcatctacattgctcacagagcttttcagtaataaaggcagtgggacgctgttcaaaaacgcagagcgaatgcttcgagtccggtccctggacaagctggaccaaggaagactcgtcgacctggttaatgcctccttcggtaaaaagctcagggatgactatctggcctctctgaggcctaggctgcattccatctatgtgagcgagggttataacgccgccgctatactcaccatggaacccgtgctgggagggacaccatatttggataagtttgttgtatcctctagtcgccagggccaggggagcggacagatgctgtgggaatgcctgagaagagacctccagacattgttttggcggagccgagtaaccaatcctattaatccctggtacttcaagcactccgatggatcattctctaataagcagtggatatttttttggttcggcctggccgacattagggatagttatgaactggtcaaccacgcaaaggggctgccagactccttccataagccagcatctgatcctggaagt

SEQ ID NO: 17150 - DNA, 1602 bp, Artificial Sequence
  Description of Artificial Sequence: Synthetic coding sequence
atggctaccgcccttatggccgtcgtgctaagggctgccgcagtggctcccaggctccgaggtagggggggcaccggaggtgctcgtagattgtcatgcggtgctaggcggcgtgctgcaagaggtacctctcccggacgcagattaagtacagcttggtctcaaccacagccccctcccgaggagtatgcaggtgcggacgatgtttctcaatcccctgtagcagaggagccttcttgggtgccatcgcctagaccaccggttccccatgagtcgccagaaccaccttcaggtcgaagtttggtgcaacgcgatatacaggcattccttaaccaatgcggtgcatccccgggtgaagcaaggcattggttaacacaatttcaaacctgtcatcactcagcagataaacctttcgcggttattgaggtggatgaagaggtcttgaaatgccaacaaggtgttagctctctagcattcgcccttgcctttcttcaaagaatggatatgaaacctcttgttgtcttaggacttcctgctcccactgctccttcgggttgccttagtttctgggaggctaaggcccaattggcgaagtcttgtaaagtcctagttgacgctttgcgacataatgcagctgctgcagtgcccttttttggaggtggttctgttctccgtgccgctgagccagctccccatgcgagctatggtggaattgttagtgtggaaactgatctcctccagtggtgtctcgaatcaggttcgattccaatactttgccccattggagaaacggcagcccgacgtagcgtgcttcttgattctctggaagtaacggccagccttgccaaagccctgcggcctaccaagatcatctttctgaacaatacgggtggattaagagattctagccataaggtcctgagcaacgttaatcttccagctgatctcgacttagtttgcaatgctgagtgggtttcaacaaaggagcgacagcagatgagactaattgttgatgtgttgagcaggctaccacatcactcatcagctgttattactgctgcttctaccctgctaaccgagttgttctccaataagggatcaggaacattgtttaagaacgcagaaaggatgttgagagtgcgctcacttgacaaattagaccaaggacggcttgtcgatcttgtgaacgcttcctttgggaagaaactaagagatgactacttggcttctcttcgtcctcggctgcatagcatctatgtttctgagggatacaacgcagcagccattctcacaatggaaccagttcttggagggactccatatctggataagttcgtagtcagtagttcaaggcagggacagggatctggacaaatgttgtgggagtgtctgaggcgagatctccaaactctattttggcggtcccgtgttactaatccaattaacccttggtattttaaacacagtgatggttcctttagtaacaagcagtggattttcttttggtttggattagctgatatcagagactcttatgaactcgttaatcatgccaagggacttccagattcattccacaaacctgcttcagatcctggctcc

SEQ ID NO: 17151 - DNA, 1602 bp, Artificial Sequence
  Description of Artificial Sequence: Synthetic coding sequence
atggcgacagcactgatggcggtcgtattgagggccgctgctgtggcccctcgtctgcgaggacgtggcggcacgggcggagccaggcggttgagttgcggcgcgcgccgtagagctgcacgtgggacaagtcccggcagaaggctgtctactgcgtggtcccaacctcagcctcctccagaggaatatgcaggtgcggacgatgtttcacaaagccctgtggctgaagaaccttcatgggtaccttccccacggccgccggtgccgcacgagagtcctgaacctcctagcgggcgaagcctggttcaaagggatattcaggcgtttcttaatcagtgtggggcatcgcctggcgaagccagacattggcttacacaatttcagacatgtcatcattccgcagacaaaccctttgcagtgattgaagtcgatgaggaagtgttaaagtgtcagcagggagtgtctagccttgccttcgcattggcgttccttcaaagaatggacatgaagccgctcgtagtgttgggtttgccggcaccgacagccccgagcggatgtctgtctttctgggaagcaaaagcccaattagcgaaatcgtgtaaagttttggtagatgctttacgccacaacgcagccgctgccgttccgtttttcggaggtggatcagttttgagagcagctgaaccggcgccccatgcttcatatggggggatcgtttctgttgagactgacttgctccagtggtgcttggagtctggatcaattcctatcctgtgcccgattggtgaaacggcggcccgtcggagcgtgctgctggactcactggaagtaacagcttctctggctaaagcgcttcgccctactaagattatatttctaaataacacgggtggtttacgggattccagccataaggttctaagcaacgttaacctgcctgcggacctcgacctggtgtgcaacgccgaatgggtctcaacaaaggaacgccagcagatgcgcctgatcgttgacgtactgtcacgactgccgcaccacagtagtgcagttataacggcggcctctacgctgctgacagaactcttcagtaataaaggcagcgggactcttttcaagaacgccgaaagaatgttaagagtgagatccctggataaacttgatcaaggccggttggttgatttggtgaacgcatcttttggcaaaaaactgagagatgattatctggcctcccttagaccgaggctgcatagtatttatgtgagtgaaggatataatgccgcggcaattcttacgatggaacctgtgcttgggggtactccttatttagacaaatttgtcgtgtctagctctagacagggccaaggctctgggcaaatgttgtgggagtgtttaagaagggacctgcagacactgttctggcgaagtagagtgacgaacccgattaacccatggtattttaagcattcagatggcagtttttcgaacaaacaatggatttttttctggttcggactcgccgatattcgcgatagctatgagctagtaaaccatgcgaaaggcctaccagatagctttcataaacctgcgagtgacccggggtca

SEQ ID NO: 17152 - DNA, 1602 bp, Artificial Sequence
  Description of Artificial Sequence: Synthetic coding sequence
atggccacagccctgatggccgtcgtcctgagagctgcagcggtcgcaccccgtttgcggggacggggaggcaccggtggggcaaggagacttagttgcggtgctaggcgcagagcagcacgcggcaccagtccaggaaggcggctgagtaccgcctggtcccagccacaaccaccgcccgaggaatatgctggtgcagatgacgtctcccagagtccagtggcagaggagcccagctgggtaccctcacctcgcccccctgttccccacgagagtcccgagccgccaagcggtcggagcttggtacagagagacatacaggcatttctgaatcaatgcggtgcctcccctggcgaggcccggcattggctaacccagttccagacatgccaccacagcgcagacaagccattcgccgtcatcgaggtcgacgaggaagtcctgaaatgtcagcagggcgtcagcagcttggcctttgccctggcctttctgcagcgcatggatatgaagcctctggtggtgctggggctgccggcacctactgctccatccggatgtttgagcttttgggaagcaaaggctcagttagcaaagtcatgtaaggtgcttgttgatgccctacgccacaatgccgccgctgctgtccccttttttggggggggatctgtgcttagagccgctgaacccgcaccccatgctagttacggcggcattgtcagtgtggaaaccgacctactgcagtggtgtctcgagtccggtagtatcccaatattgtgcccgattggagaaacagcagcccgtcgctcagtcctgctggattctttggaagttacagcgtctctcgccaaagcgcttaggcccactaagatcatattcctaaataataccggcggccttcgggattcctcccataaggttctgtccaacgttaatttgcccgccgacctggacttggtatgcaacgcagagtgggtgagcaccaaggagagacaacagatgcggctcattgtagatgtactgagccgtctgccccaccactcttcagcagttataacagcagcgtccactctgctgacagagcttttttccaataaaggtagcggtaccctgttcaaaaatgccgaacgcatgctaagggtgaggtcgctggacaaactggatcagggccggttagtggatttggtcaatgcttcttttggaaagaagctgcgggacgactacctcgcctctctgagacctagattgcacagtatctatgtatcggaaggatacaatgcagcagccatcctgactatggaaccagtgctgggtggtacaccctaccttgataagttcgttgtctcttcttcccgacaaggtcagggatcaggacagatgctgtgggaatgtctacggcgcgatcttcagaccttattctggaggagccgggtgaccaatcctattaatccatggtacttcaagcactctgacggctctttctccaataaacaatggatctttttttggtttggcctggcggatattcgggactcttatgagctagtcaaccatgccaagggtctaccagacagcttccacaagcccgcctccgaccctggttcc

SEQ ID NO: 17153 - DNA, 1602 bp, Artificial Sequence
  Description of Artificial Sequence: Synthetic coding sequence
atggccactgcgttgatggcggtggtgctgcgggccgctgctgtagcaccacgcttgagaggccgcgggggaacaggcggcgccaggcggctttcctgcggagcccgaaggagagccgctcgagggacatccccagggagaagactgagcactgcatggtcgcagccacagcctcccccggaggagtatgcaggggccgacgacgtctctcagtccccggtggccgaagaaccttcatgggtgccaagccccagaccaccggtaccccacgagtctcctgaaccccctagcgggagaagtctggtgcaacgggacattcaggcattcttgaatcagtgtggcgccagtccaggtgaggccaggcactggctcactcagtttcagacatgccatcactcagcggacaagccatttgctgttatcgaagttgatgaggaggtcctgaaatgccagcagggcgtgtcctctttggcgtttgccctcgcgtttctgcagagaatggacatgaaacccctcgtcgttctgggccttccggcacccaccgcccccagtggatgcctgagcttctgggaggccaaggcgcaacttgcaaagtcctgtaaagtgcttgtagacgcactgcgccataatgcagcagccgcagtgccctttttcggcgggggaagcgtgctgcgagcagctgagcctgccccacatgcctcttatggcgggatcgtgagcgtcgaaactgaccttctgcagtggtgtctcgaaagcgggagtattcctattctctgcccaatcggcgagactgcggcccggcgaagcgtgctcctggattcactagaggttacagcttccttagccaaggcacttcggcccaccaagattatcttcttaaacaatacagggggcctgagggactcaagccacaaggtgctttcaaacgttaacctccccgccgatctggatctggtatgtaacgcggaatgggtgagtactaaagaacgccagcagatgcggttgattgtagacgtgctgagcagactcccccaccactcatcagccgtgataaccgccgcaagcaccctcctcacagagctcttttctaacaaaggatctgggactttgtttaaaaacgctgaaagaatgctacgagtgcgaagtctcgataagctagaccaggggcggttagttgacttagtcaatgcatctttcggcaaaaagttacgcgacgactatctggcgtcactgaggccacgcttgcattctatctacgtgtccgagggctacaacgctgctgcaatcctgacaatggagcccgtgttgggcggaaccccttatctcgataaatttgtggtgagtagcagcaggcaagggcaaggaagtggtcagatgctgtgggagtgtctcagaagggatcttcagaccttattctggagaagtagagtgacaaatccaattaacccgtggtactttaagcactccgatggttcgttttctaacaagcaatggatctttttttggtttggcctcgcagacattcgagacagctacgagcttgtgaatcacgcaaaaggtctccctgattccttccataaaccggcctctgaccccggtagc

SEQ ID NO: 17154 - DNA, 1602 bp, Artificial Sequence
  Description of Artificial Sequence: Synthetic coding sequence
atggccaccgcacttatggccgttgtactgcgggccgccgctgtggctccgcggcttcggggccgtggggggactgggggcgcgcgtcgacttagctgtggcgcacgtcgcagggcggcccgcggcacatctcccggtcgtcgtttgtccacagcctggtcacaaccccagccgccccccgaggagtatgctggagcagacgatgtatcgcagagcccagtggctgaagaaccttcatgggtgccttccccccggcctcccgtgccacacgaatccccagaacctccaagtggccggtcactcgtacaacgggatattcaagcatttctcaatcaatgcggggctagccccggtgaggccaggcattggttgactcagttccagacgtgtcaccactctgccgacaaaccgtttgctgtgatcgaggttgacgaggaggtgcttaaatgccaacaaggtgtgtcatcgctggccttcgctctggccttcctgcagcgtatggatatgaagcccttggttgtcttgggcctccccgctccaactgctccgtctggttgcctttcgttttgggaggctaaggctcaacttgccaaatcatgcaaagttcttgtggatgcccttcggcataacgccgctgcggctgtaccattttttggaggcgggtccgttctccgtgcagcagaaccagcgccacatgcttcttatggaggtatcgtgagcgtggagacggatcttttgcagtggtgtctggagagtggctcgattccaatcctgtgccctattggagagacggcagcgaggcgcagcgtcctcctagactcactggaggtgacagcgagcctagcgaaggcgttgcgccctacaaaaatcattttcttaaacaacacaggcgggctccgcgattcaagtcataaggtgctgtcaaacgtgaatctgcccgctgatctggacctcgtttgcaatgccgaatgggtctctactaaagaacgtcagcaaatgcgccttattgtcgatgtcttatctcgtctacctcaccactcatcggctgttataaccgcggcctccacccttttaaccgagttattcagtaacaagggttctgggaccctgttcaagaacgcggagagaatgttgcgtgtacgcagtcttgacaagttggaccaggggcgtcttgtggatctcgttaatgcctctttcggtaagaaactccgggacgattatctcgcttccctacgaccgcggctacatagcatatacgtgtctgagggttacaacgctgccgcgatattaacaatggagcccgtcctgggaggaaccccctatttggacaaatttgttgttagtagttcccgacaaggacagggatctggccaaatgctgtgggaatgccttcgtagggacctacaaacactcttctggcgttcacgagttaccaatcctatcaacccttggtatttcaagcatagcgatggatccttctcgaacaagcagtggattttcttttggtttggcctggcagatatccgagatagttatgagctcgtgaatcacgcaaagggcctgccggattctttccacaagcctgcaagcgaccccgggagt

SEQ ID NO: 17155 - DNA, 1602 bp, Artificial Sequence
  Description of Artificial Sequence: Synthetic coding sequence
atggccaccgccttgatggctgtggtgctccgggccgccgcggtggcacctcgcctcagggggagaggcggcaccggcggtgcccgtcgactgtcctgcggggccagacggcgggctgcccgcgggaccagccctggcagacgtctcagtactgcttggtcccagcctcaaccgcccccggaggaatacgccggcgccgacgacgtgtcgcaaagtcctgtcgcagaagagcctagctgggttccatcaccaaggcccccggtgccccatgaatcacctgagcctccctcaggccgctccctcgtgcagcgcgacattcaagccttcttgaatcagtgcggcgcaagccccggtgaagcccgccactggctgactcagttccagacttgtcaccactcagcagacaaaccttttgctgtgatcgaggtggacgaagaggttctgaaatgtcagcagggcgtgagttctctggcatttgcccttgccttcctacaacggatggatatgaagccattagtcgtgctgggactacctgctcccacagcaccatctggctgcctaagtttctgggaagcaaaagcgcagcttgcaaagtcatgcaaagttttggtggacgccctgagacataatgccgctgcagcagtgccattcttcgggggcgggtctgtgttgcgagccgctgagcctgcgccccacgccagctatggcggtatcgtgagcgtggagaccgacctgcttcagtggtgtttagagtccgggtctattcctattttatgccctatcggcgagacggcagctcgccgaagcgtattattggattctctcgaggttacggcgagcctagcaaaagcactgaggccaaccaaaatcattttcttgaacaacaccgggggactgcgcgatagcagccacaaagtcctctccaacgtcaacctgccagccgacctcgatctcgtctgtaatgctgagtgggtatctacaaaagagcgccaacagatgcggttgatcgtggacgttttatccagactcccccaccacagcagcgccgtaatcacagcggcttctactctcttgactgagctgttctcaaataagggatctggaacattgttcaagaatgccgagcgaatgctgcgggtgaggtccctggataaactcgaccagggaaggcttgtcgacttggtgaacgcatcattcggcaaaaaactaagagatgactatcttgccagcctgaggcctcgcttgcactctatctacgtgtcagaaggatataatgctgccgcaatactcacaatggagcccgtactcggaggtacgccctacctggataagttcgtagtatcttcttcgagacagggacagggaagcgggcagatgctctgggaatgtctgagaagggatctgcagaccctgttctggcgatcccgcgtgacaaatcctattaacccttggtacttcaagcacagcgacgggtcgttctctaataagcagtggatttttttttggttcggcttagcagacataagagactcttacgagctcgtgaaccatgcaaaaggactccctgacagcttccacaagccagcctccgaccctggatca

SEQ ID NO: 17156 - DNA, 1602 bp, Artificial Sequence
  Description of Artificial Sequence: Synthetic coding sequence
atggccactgcgctcatggccgttgttctgagggccgccgctgtagcacctcgtctgagaggcaggggcggcactgggggggcacggagactatcctgcggggcaaggcgtcgggcagcccgcggcacctcacccggacgccggctcagcaccgcctggtctcagccgcagcccccacctgaggagtacgcaggtgccgatgatgtgtcgcaaagcccagtggcagaagagccaagctgggtgccctcaccaaggccccccgtccctcacgaaagcccagagccaccttcgggacgatcgctggtgcagcgagatattcaagcatttctgaatcagtgtggtgcaagcccaggagaggcgaggcattggttgactcagttccagacctgccatcactcagccgataaaccctttgccgtgattgaagtagatgaggaggtcctaaaatgccagcagggtgtgagcagtctcgcatttgccctggcattcctgcagagaatggatatgaaaccactggttgtgcttggtctgccggctcccaccgccccttcgggttgtctaagcttctgggaggccaaagctcaactggctaaatcctgtaaagtcctggtggacgccctcagacacaacgctgcagctgccgtccctttctttggcggaggaagtgtcttacgtgctgctgaacccgccccccacgcatcctacggcggcattgtctcagtggaaacagatctcttacagtggtgcttggaatcaggcagtatccccattctttgtcctataggtgaaacggcagctcggagaagcgttctgctagattctctggaagtgactgccagtctggctaaggctctccgcccaacgaagataatcttcctgaataatactggggggctcagggacagtagtcacaaagtgctctcaaatgttaacctgcctgctgacctggaccttgtgtgcaatgcggaatgggtaagtaccaaggagaggcagcagatgcgcctgatcgttgatgttctgagccggctgccgcaccatagttccgccgtcattacagccgcaagcacactgttgactgaactatttagcaacaaggggtccggaaccttgttcaagaatgctgagcgcatgctgcgcgtgaggagtctggataagctggatcaagggcgcctggttgatttggtaaacgcatcgtttggcaaaaagctaagagacgattatttggcctcactgaggcctagactgcactcgatttacgtgagtgaaggttacaatgctgctgccatcctgactatggaacccgtcctggggggcaccccttacctagataagttcgtcgtaagttcgtctaggcagggtcagggcagtgggcagatgctgtgggaatgcctccgacgtgacctgcagacccttttctggaggagtagagtcacgaatcctattaacccttggtattttaaacacagcgatggctctttctctaacaaacagtggatattcttctggtttggcctcgctgatatacgagatagctacgaactggtcaaccacgccaagggcctgcctgatagttttcacaaaccggctagtgatcctggttcc

SEQ ID NO: 17157 - DNA, 1185 bp, Artificial Sequence
  Description of Artificial Sequence: Synthetic coding sequence
atgccgggaagatcatgcgtggcgctcgtgctcttggcagccgccgtgtcctgcgccgtcgcacaacacgctccaccttggacggaggactgccggaaatcaacctacccgccgagcggacctacgtacagaggcgccgtcccgtggtacaccattaacttggatctgccaccgtacaagagatggcatgagctgatgctggacaaagccccggtgcttaaagtgatagtgaactcactgaagaatatgatcaataccttcgtgccgtccggaaaaatcatgcaggtggtcgatgagaagctgcctgggttgctgggaaactttccgggtccgttcgaagaagaaatgaagggcatcgctgccgtgactgatatccctctgggtgaaatcatctcctttaacatcttttacgagctcttcacgatctgtacctcgatcgtcgccgaggacaagaagggccatctcatccacggacgcaacatggacttcggagtgttcctgggatggaacattaacaacgatacgtgggtgatcaccgagcagctgaagccgctcaccgtcaatcttgactttcagaggaacaataagactgtgttcaaagctagttccttcgccggctacgtgggaatgctcaccggttttaagccgggattgttttccctgaccctgaatgaacggttctcgatcaatgggggatacctcggcatcttggaatggatcctggggaaaaaagacgtgatgtggatcggatttctgacgcggactgtgttggaaaattccacctcgtacgaagaggccaagaacttgctgactaaaacgaagatcctggctccagcgtatttcatcctggggggaaaccaaagcggcgaagggtgtgtcatcacccgggaccgcaaggagtccctcgacgtgtacgaactggatgccaagcagggacggtggtacgtggtgcaaactaactacgaccggtggaaacacccattctttttggatgatcggcgcactccggccaaaatgtgcctcaaccggacctcgcaagagaacatatctttcgagactatgtacgacgttctgtcaaccaagcccgtgctgaacaagctgactgtctacaccacgctgatcgacgtgactaagggtcagttcgaaacctatctgcgggattgccctgacccatgcatcggatgg

SEQ ID NO: 17158 - DNA, 1185 bp, Artificial Sequence
  Description of Artificial Sequence: Synthetic coding sequence
atgccggggcgcagctgcgtggcactggtcctcctggcagcagccgtctcgtgcgccgtggcccaacatgccccaccttggactgaggactgtcggaaaagcacctacccgccatcgggccccacctacagaggcgcagtcccctggtataccatcaatcttgacctgcctccttacaagaggtggcacgaactgatgctggacaaggcccctgtcctgaaggtcattgtgaactccctcaagaatatgatcaacacctttgtcccctcggggaagatcatgcaggtggtggacgaaaaacttccaggcctgctggggaactttccgggcccgttcgaagaagaaatgaagggaatcgccgcagtcaccgacattcctttgggcgaaatcatttcatttaacatcttttacgaactgttcaccatctgcacctcaatcgtggcagaggacaaaaaaggccatctgattcacggacgcaacatggacttcggagtgttcctgggatggaacattaacaacgacacttgggtgatcaccgagcagctgaaaccgctgactgtgaacctggatttccagagaaacaacaagaccgtgttcaaggcgagcagcttcgcaggctatgtcggaatgctcaccggctttaagccgggactcttttcacttacgctgaatgaacgcttctccatcaatggtggttacctgggaattctcgagtggatcctgggtaagaaggatgtgatgtggatcggattcttgacgcgaaccgtgcttgagaacagcaccagctacgaggaagcgaagaacctgctgaccaagaccaagatccttgcacctgcctactttatcctgggaggaaatcaatcgggtgaagggtgcgtgatcactcgcgacagaaaagaatccttggacgtttatgaactcgatgcaaaacagggacggtggtacgtggtgcaaaccaactatgatcgctggaagcacccattcttccttgacgataggcggactccagcaaaaatgtgcttgaacagaacttcgcaggaaaacatctccttcgagactatgtacgacgtgctgtccactaaaccagtgctcaataagctgactgtgtacaccaccctgatcgacgtcactaagggtcagtttgaaacctacctccgcgattgcccggatccgtgcatcggatgg

SEQ ID NO: 17159 - DNA, 1185 bp, Artificial Sequence
  Description of Artificial Sequence: Synthetic coding sequence
atgcccggacgcagttgcgtagcccttgtcttgctggccgccgcggtttcctgcgctgtagcgcaacatgccccaccgtggaccgaagactgccgaaagtcaacgtatcccccgagcggcccaacctaccggggcgcggtcccctggtacacaataaatcttgatctgccgccttacaaaagatggcatgagttaatgttggacaaagcgccagtgctcaaggtgatcgtaaattccctgaagaacatgatcaacactttcgttccttcgggcaagattatgcaagtggtagatgagaagctgcccggcctgctgggaaacttccccggacctttcgaagaggagatgaaaggaatcgccgctgtaactgatattccacttggtgagattattagcttcaatatattctacgagctgttcaccatttgcacatcgattgtcgctgaggataagaagggtcatctaatccacggtcgtaacatggattttggtgtctttctgggctggaacataaataatgatacttgggtcatcaccgagcagctcaaacccctgactgttaacttagacttccaacgcaacaataaaactgtgtttaaagccagttccttcgccggatatgtgggaatgctgacgggcttcaagccaggacttttctcccttacactaaacgaacgtttctcgataaacggaggctatctcggtattctcgaatggattctaggcaagaaggatgtgatgtggatcggtttcttgacacgaactgtgctggaaaattccactagctacgaggaagccaagaaccttctgacaaaaacgaagatcctcgcccccgcctacttcatactaggaggaaaccagagcggagagggctgcgtgatcacacgagatcgcaaggaatccctggatgtatatgaactggatgccaagcagggcagatggtacgtggtgcagacaaactacgaccgatggaagcacccattttttctggatgaccgcaggacaccggccaagatgtgccttaataggaccagccaggagaacatctcgttcgagacaatgtacgacgtgctgtccaccaagccagtcttaaacaagctcaccgtttacacgacgctgatcgatgtgaccaagggccagttcgagacctatctgagagactgccccgacccgtgtatcggctgg

SEQ ID NO: 17160 - DNA, 1185 bp, Artificial Sequence
  Description of Artificial Sequence: Synthetic coding sequence
atgccgggccgctcatgcgttgctttggtgttgcttgccgcggccgtgtcgtgtgcggtggcacaacatgctccgccgtggaccgaggactgtcggaagagcacctacccgccttccggaccgacctaccggggcgcggtgccgtggtacaccatcaacttggacctgccgccctacaaaaggtggcatgaactgatgctcgataaggccccagttctcaaggtgattgtgaactcactgaaaaacatgatcaatacttttgtgccgtctggaaaaatcatgcaagttgtggatgaaaagctcccgggtctgcttggtaatttccctggacctttcgaagaggagatgaagggaattgccgctgtgactgatatcccgctgggtgagatcatctcctttaacatcttctacgaactgttcaccatctgcacctcaattgtggcggaagataagaagggccacttgatccacggaagaaatatggacttcggagtctttctggggtggaatatcaacaatgacacctgggtgatcaccgagcaattgaaaccactgaccgtgaacctcgactttcaaaggaacaataagacggtgtttaaggcctcgtccttcgccggatacgtgggaatgcttaccggattcaagccgggactgttctcgctgaccctcaacgaacgatttagcataaatgggggataccttgggatcctggaatggatcctgggtaagaaagacgtcatgtggattggcttcctcacccggaccgtgctcgagaacagcacctcttacgaggaagccaaaaatctgcttactaagactaagattctggcaccggcatacttcatcctgggcggaaaccagtcaggcgaaggatgcgtcatcacgcgggaccggaaggaaagcctggacgtctatgaactggatgcaaagcagggaagatggtatgtggttcaaaccaactacgatcggtggaaacacccgtttttcctggacgatcgccgcactccagccaagatgtgccttaatcgcacgtcccaggagaacatctcgttcgaaactatgtacgacgtgctgtccaccaagcctgtgttgaacaagctcactgtgtacacgaccctgatcgacgtgaccaagggacagttcgagacttatctgagggattgcccagacccgtgtatcggatgg

SEQ ID NO: 17161 - DNA, 1185 bp, Artificial Sequence
  Description of Artificial Sequence: Synthetic coding sequence
atgccgggaaggtcttgtgtagctctggttctcctggcagcagctgtctcttgtgccgtcgctcagcatgcacccccttggaccgaagactgcagaaagtctacctatccaccgagtggccctacctacagaggcgcagttccatggtacaccatcaacctcgatttgcctccctacaagagatggcacgaactgatgctggataaggcaccagtcctgaaagttatcgtaaacagtctgaagaacatgataaacacattcgtgccctcaggcaagattatgcaggtggtagatgagaagctccccggtctgctcggaaatttccccggccccttcgaagaggaaatgaagggcattgcagccgtgactgacatcccattgggagagattatttcatttaatattttctatgaactgttcactatctgcacctccatagtagctgaggacaagaagggacacctgattcacggcaggaatatggacttcggcgtgtttcttggatggaatatcaacaacgatacttgggtaatcacagagcaattgaagccgctcacggtaaacctcgactttcagcgcaacaacaaaactgtcttcaaagcctcttccttcgccggttacgtaggtatgctgaccggctttaagcctggacttttctctctgactctcaatgaacgcttctccatcaacggaggatatttgggaatcctggagtggatcctgggtaagaaagatgttatgtggatcggattcttgacaagaactgtcttggaaaattctacgagttacgaggaagccaagaatctgctgaccaaaacaaagattttggcgcccgcatacttcatcctgggtggtaatcagagtggtgagggttgtgtcatcactcgcgatcgcaaggagtctcttgacgtctacgagctggacgcaaagcaaggacgctggtatgtcgtgcaaaccaattacgacaggtggaaacaccctttcttcctggatgacaggcgcacccccgccaagatgtgcttgaacaggacctcacaggaaaatattagtttcgaaacgatgtacgacgtgttgtcaaccaagcccgtgctcaataagcttaccgtctacactacgctcatagatgtgactaagggccagtttgaaacgtatctgcgcgattgcccagacccttgcattggatgg

SEQ ID NO: 17162 - DNA, 1185 bp, Artificial Sequence
  Description of Artificial Sequence: Synthetic coding sequence
atgccaggcaggagctgtgtggctttggtccttctggcggcggcagtgtcctgtgcagtcgcgcagcatgctcccccctggacagaggattgccgtaaatccacatatcctccgagtggccctacgtatcgcggagctgtaccatggtacactattaatctggatcttccaccatacaagcggtggcatgagctgatgctcgacaaagcgcctgtgctgaaggttatagtcaactctctgaagaatatgataaacacattcgtccccagcggcaagattatgcaggtcgtggacgagaagctgccaggattgttaggtaacttcccgggaccatttgaggaggagatgaaaggcatcgctgccgtcaccgacattcctctgggcgagataatatctttcaatattttctacgagctttttaccatttgtacaagcattgtggctgaggataaaaagggtcatctgatccacgggcgaaacatggatttcggcgtgttcttgggttggaacattaataacgacacgtgggttataacggaacagttaaaacccttgacagtcaatctggactttcagaggaacaacaaaaccgttttcaaagccagttcctttgcaggctacgttggtatgctcacaggcttcaaaccaggcttattcagtttgactctaaatgagagattcagtataaacggcgggtatttgggaatcctggaatggatccttggaaaaaaagacgtgatgtggatcggattcctaacccgcaccgtgctggagaattcaaccagctatgaagaagccaagaatctgctaacaaagactaagattctcgcccctgcgtacttcatcctgggaggaaaccagagtggtgaaggctgcgtgattacgcgggacaggaaagagagcctggacgtgtacgaactcgatgcgaaacagggcagatggtacgtggtgcaaacgaattacgatagatggaagcatcctttcttcctcgatgatcgacgcaccccggctaaaatgtgtttgaatcgaaccagccaggaaaacatcagctttgaaaccatgtatgatgttctgtcgactaaaccggtgctcaacaaactaacagtatatacaacactgatcgatgtgacaaagggacaatttgagacttacttaagggattgtcctgatccgtgtatcggctgg

SEQ ID NO: 17163 - DNA, 1185 bp, Artificial Sequence
  Description of Artificial Sequence: Synthetic coding sequence
atgccgggaagatcatgtgtagcactcgttctgctcgctgccgcagtctcatgtgccgtcgcacagcatgcgcccccgtggaccgaagattgcaggaaatccacttaccccccatctggccctacttacaggggagccgtcccgtggtacaccatcaacctggacctgcccccatacaagcgctggcatgagctgatgcttgataaggcacctgtgctgaaagtgatcgtcaatagcctgaaaaacatgattaacaccttcgtgccatccggaaagattatgcaagtggtggacgaaaagctgcctgggcttcttggtaactttccgggtccttttgaagaggagatgaagggaatcgcagcagtgactgatatcccactcggtgaaatcatctcctttaacattttctacgaactttttacgatttgtactagcattgtcgccgaggacaagaagggacatctcattcatggcagaaacatggattttggtgtgtttttgggctggaacattaacaatgatacttgggtgatcactgagcaacttaaaccactcactgtgaaccttgatttccaacggaataacaaaaccgtctttaaagcgtcctcgtttgcaggatacgtcggtatgctgaccggttttaagccaggacttttctcgcttactctgaacgagcgcttttcaattaacggaggatacctcggcatactcgagtggattctgggaaagaaggatgtgatgtggatcggtttcctgacccgaactgtgcttgaaaattctaccagctacgaggaggctaagaacctgctgaccaagaccaaaatcttggcgccagcatactttatactcggtggcaatcaaagcggggagggttgcgtcattaccagggacaggaaggaatctttggatgtgtacgaactcgatgcaaagcaaggtagatggtacgtggtgcaaaccaactacgatcggtggaaacatccttttttcctggatgatcgaagaaccccagctaagatgtgtcttaaccgtacttcgcaggaaaacatttcctttgaaacgatgtacgatgtgttgagcaccaaacctgtgcttaacaagctcactgtctacaccaccctgatcgatgtgactaagggacaattcgaaacctatcttagggactgccccgacccttgtatagggtgg

SEQ ID NO: 17164 - DNA, 1185 bp, Artificial Sequence
  Description of Artificial Sequence: Synthetic coding sequence
atgcccgggagatcctgcgtggccctcgtgctgctcgcagcagcagtgtcctgcgctgtagcgcagcacgctccaccctggactgaggattgtcggaagtcaacctaccccccaagtggtccaacatatcgaggagctgtgccctggtataccatcaatctggatttgcctccgtacaagaggtggcatgaacttatgctggacaaggccccagtgctcaaggtgatcgttaacagtctcaaaaacatgattaatacattcgtgccttccggcaagattatgcaggtggtggatgagaagttacctgggttgttggggaactttccaggtcccttcgaggaagaaatgaaaggaatcgcagccgttacagacattcccctgggagagatcatatcctttaatatattctatgaactcttcacaatatgtaccagcatcgtggccgaggataagaagggtcatctgatccacgggaggaatatggacttcggggtctttcttggatggaacatcaacaatgatacttgggtaattacagagcagctgaagcctctgactgttaacttagattttcaaagaaacaataagaccgtgttcaaggccagctcttttgcaggctacgttggaatgcttactggatttaagcccggtctgtttagccttactctcaatgaaagattttccataaacggcggttacttaggaatcctggaatggattttgggtaagaaagatgttatgtggatcggattcctgacccgcactgtgctggagaactccacttcgtatgaggaggccaaaaaccttctgacgaaaactaagatccttgctcctgcctattttatcctggggggaaatcagagtggagagggatgtgtaataaccagggaccgcaaagaaagtctcgacgtctacgagctggacgccaaacaaggcaggtggtatgttgtccagacgaattacgatagatggaagcaccctttcttcttagatgataggcggacccctgcaaagatgtgtctcaatcgaacctctcaggaaaacatctcctttgagaccatgtatgatgtgctgagcactaagcccgtgcttaataaactgaccgtttacactaccctcatcgatgtgacaaagggacaatttgaaacatatctcagggattgccctgatccttgcattggctgg

SEQ ID NO: 17165 - DNA, 1185 bp, Artificial Sequence
  Description of Artificial Sequence: Synthetic coding sequence
atgccaggtcggtcctgtgtggcactcgtgttgttggcggcagcagtcagctgcgccgtggctcagcatgcacctccttggactgaggattgtaggaagagcacctacccaccatcggggccgacctaccggggcgccgtgccatggtacacgatcaatcttgaccttcccccttacaagcggtggcacgagctgatgctggacaaggcacccgtgctgaaggtgatcgtgaacagcttgaagaacatgataaacactttcgtcccttcaggtaagataatgcaggtggtggacgaaaagttgcctggcctgcttggaaacttcccaggtccatttgaagaagaaatgaaggggatagcagccgtgaccgatataccccttggagagataatctcctttaacatcttctacgaactttttaccatttgtacttccattgtggcagaagataagaagggtcacctgatccatggacgaaatatggattttggagtctttcttgggtggaacataaacaacgacacctgggtgataaccgagcagctgaaacccctcacggtgaatcttgacttccagagaaataacaagactgtgtttaaagcatcgtcgtttgctggctacgtgggaatgctgactgggtttaaacctgggcttttcagccttacccttaatgaacgcttttcgattaacgggggttacctgggaatacttgagtggatccttggtaagaaggatgtcatgtggatcggatttctgacccggaccgtccttgaaaacagcacctcgtacgaagaggcgaagaatcttctcactaagaccaaaatcctggcccctgcgtactttatactcggagggaaccagtcgggagaaggctgcgttatcacccgtgatcgcaaggaatcactcgatgtgtacgaacttgatgccaaacaaggaagatggtacgtggtccaaaccaactacgatcgctggaagcatccattctttctggacgataggcgcaccccggcaaagatgtgtctcaatcgcactagccaagaaaacatttccttcgaaactatgtacgatgtcctgagcactaagccagtgctcaacaagctgactgtgtacactaccctgattgacgtgaccaagggccaatttgaaacgtacctcagggattgtcccgatccgtgtatcggttgg

SEQ ID NO: 17166 - DNA, 1185 bp, Artificial Sequence
  Description of Artificial Sequence: Synthetic coding sequence
atgcccggcagatcatgcgtggcacttgtgcttctggcggcagcagtcagctgcgcggtggcacaacatgcaccaccctggactgaagattgtcggaaatccacctaccccccatccgggcctacctaccggggtgctgtgccctggtacacgatcaatcttgacctgcctccttacaagagatggcatgaattgatgcttgacaaggcccccgtactgaaggtcattgtgaactcactgaagaatatgatcaacacttttgtgcccagcggaaagatcatgcaagtcgtggatgaaaagctgccaggactgcttggaaacttccccggaccatttgaagaggagatgaagggaatcgcagcagtgaccgatattcctcttggagagattatcagctttaacattttctacgagctgtttactatttgtacgtcaatcgttgctgaagataagaaggggcatcttatccacggaaggaatatggactttggtgtgttcctcggttggaacataaacaacgatacctgggtgattacggagcagctcaagccacttaccgtgaacctggatttccaacggaataacaagactgtgtttaaggcaagttctttcgcgggttatgtcggtatgttgactggctttaagcctgggctgttctcgcttactcttaacgaaagattctcgattaacggtggatacctggggattctcgaatggattctggggaagaaagatgtcatgtggattggtttcctgacgcggaccgtccttgaaaacagcactagctacgaagaggcgaagaacctgctgaccaagacgaagattcttgcacctgcctatttcattttgggcggaaatcaatccggggagggttgtgtcatcaccagggatagaaaggaatcactggacgtctacgagttggacgccaaacaaggcaggtggtacgtggtccagactaactacgatcgttggaaacatcccttttttctggacgatcgaaggactccagccaaaatgtgtctgaaccgtacctcacaggaaaacatctccttcgaaaccatgtacgacgtcctttcgactaagccggtgcttaacaagctgactgtgtacaccactcttattgacgtgactaagggacagttcgaaacttatcttagagactgtccagatccttgtataggatgg

SEQ ID NO: 17167 - DNA, 1185 bp, Artificial Sequence
  Description of Artificial Sequence: Synthetic coding sequence
atgccaggccggtcttgtgtggctctggttctactggccgcggcggtgtcctgcgccgttgctcagcatgcccccccctggacggaggattgccggaaaagcacataccccccctcggggcccacttatcggggtgcggtaccttggtacaccataaacctagatcttcccccttacaaaagatggcacgaactcatgctagataaagcacctgtactgaaagtcatcgtaaattccctgaagaatatgattaataccttcgtaccgagcggtaagattatgcaggtcgtggatgaaaagctgccgggactcttaggcaattttccaggcccatttgaggaggagatgaaggggatagcagccgtgacggacatcccactaggggagataatctcctttaatatcttttatgaactgttcaccatatgtaccagtatcgtggctgaggataagaagggccacctcattcatggtcgcaatatggatttcggagtcttcctggggtggaacattaacaatgacacatgggtgatcactgagcagctgaaaccactcaccgtcaatcttgatttccagcgcaacaataagactgtgtttaaggcgagctccttcgccggttacgtgggaatgctcacaggctttaagcccggactctttagcctcaccctcaatgaacgcttctcaattaacggtgggtatctcggcatcctggaatggattttgggcaaaaaggatgtgatgtggattggcttcttgacacgcacagtgcttgagaatagcaccagttatgaagaggcaaaaaacttgttgaccaagactaagatccttgcacccgcatacttcattcttggcgggaatcaatcaggcgaaggatgcgtgatcacacgggaccgcaaggaatccctggatgtatacgagctggatgcaaaacaggggcggtggtatgtggtacagaccaactacgatcggtggaagcatccattttttctcgacgatcgccgaacaccagccaagatgtgcctcaatcggacctcccaggagaatatttcattcgaaacaatgtatgacgtgctgagcaccaagcccgtgttgaataagctgactgtctacacaacattaattgatgtaacaaagggccaatttgagacgtacctgcgcgattgcccagatccatgtattgggtgg

SEQ ID NO: 17168 - DNA, 1185 bp, Artificial Sequence
  Description of Artificial Sequence: Synthetic coding sequence
atgcccggaagatcgtgtgtggcattagtccttctggccgcggctgtctcctgtgccgtagcgcagcatgcacccccgtggaccgaggattgccgtaaatctacctacccaccctctggcccaacctataggggggcagtcccttggtatacaataaacctggatctacctccatacaagagatggcacgaactcatgctggacaaggctcctgtactcaaagttattgtgaactctctgaagaatatgataaacacgttcgttcctagcggcaaaatcatgcaagtggtggatgaaaagctgccaggcctccttggcaattttccaggcccgtttgaggaggagatgaaaggtatagctgctgtgactgacatacccctcggcgagataatcagttttaacatcttttatgaactcttcacgatctgtactagcattgtggcagaggataagaaggggcaccttattcatggcagaaacatggatttcggcgtcttccttggatggaatatcaataacgatacgtgggtaataaccgaacagctcaagcctctgacagtgaatcttgacttccagaggaacaacaagaccgtgttcaaggccagttctttcgccggctatgtgggcatgcttaccgggttcaagcccggactttttagcctcaccctcaatgaacgttttagtatcaacggtggttatctgggtatactggagtggatactgggtaagaaggacgtgatgtggatcggctttctaacgagaacggttctggagaactctacgagctatgaagaagcaaagaaccttcttactaaaactaaaatcctggcacctgcctattttatcctcggtggcaatcagtcaggcgagggatgtgtcataactagggatcggaaagaatccttggatgtgtatgaattggacgcaaagcagggcaggtggtatgtggttcaaactaactatgacagatggaaacatccgtttttcctagacgaccggagaaccccagcaaagatgtgtctgaataggacctcgcaggagaacatctcgtttgagaccatgtacgatgttttaagcactaagcccgtgctgaacaagctcaccgtttacacgacgctcatcgatgtgacaaagggtcagttcgaaacctacctgcgagactgcccggatccctgcattggttgg

SEQ ID NO: 17169 - DNA, 1185 bp, Artificial Sequence
  Description of Artificial Sequence: Synthetic coding sequence
atgccaggccgatcttgtgtggcgcttgttcttcttgctgcagccgtctcatgcgctgtggctcagcatgcccctccgtggacagaggactgtagaaaatcgacataccccccaagcggccctacttatcgcggcgccgtcccctggtatactatcaatttggatcttcccccctacaagcgttggcacgaactgatgctggataaagcccctgtgctaaaggtgatcgttaactctctcaagaacatgatcaatacattcgtgcctagcgggaaaatcatgcaggtggtggatgagaagctcccaggcttgctcgggaacttccccggcccatttgaggaggaaatgaaagggatagccgctgtgacagatattcctctgggcgagatcatttcattcaatattttctacgagctcttcaccatttgtactagcattgttgctgaagataaaaaagggcaccttatccacggccggaatatggatttcggggttttcctgggttggaacatcaacaacgatacatgggtgattactgagcaactgaaaccactgaccgtgaacctcgactttcagagaaataataaaacggtattcaaggccagtagctttgcggggtacgtgggcatgcttaccggttttaaacctggtctcttttctctgaccctgaatgagcggttctccattaacggaggataccttggaatattggagtggatcctggggaaaaaggatgtgatgtggatcggcttcctaacgagaactgtgttggaaaactcgacttcatatgaagaggcaaagaacctgctcaccaaaactaaaatactcgcgccagcttacttcattctgggcgggaaccaatccggcgaagggtgtgtaatcacaagagatcggaaggagagtctcgacgtgtatgagttagacgcgaaacaaggacgctggtatgtggtgcagaccaactatgaccggtggaagcacccattcttcctcgacgacaggcggacccccgccaaaatgtgcctgaatcgaaccagccaggagaatatcagcttcgaaactatgtatgacgttctatctacgaagccagtgctgaacaaacttacagtctacacaacactgattgacgtaacgaaagggcagttcgagacttatctgcgggactgtcctgacccctgcatcggatgg

SEQ ID NO: 17170 - DNA, 1185 bp, Artificial Sequence
  Description of Artificial Sequence: Synthetic coding sequence
atgcctggccgttcatgtgttgccctagtgcttctggccgcggccgtctcatgcgcggttgcccaacacgcacccccttggacggaagactgtagaaaatccacataccctccatccggaccaacttatagaggcgctgtgccatggtacacaatcaacctggatttaccgccctataagcggtggcacgagctgatgctggacaaggccccggtcttgaaggtaatcgtgaattctcttaaaaatatgattaacacatttgtgccatcgggcaaaatcatgcaggtggtggacgaaaagctgcccggactcttggggaacttccccgggccctttgaagaagaaatgaaggggatcgctgcagtgacagacatccctcttggcgaaattattagtttcaatattttctacgaactgttcactatctgcacctcaattgtcgcagaggacaagaaagggcacctgattcatggccgaaacatggacttcggagttttcctgggctggaacattaataacgatacatgggtcattacagagcaactcaagcctttgactgtgaacctcgattttcaacggaacaacaagaccgtctttaaggcctccagcttcgcaggatatgtaggcatgctgaccgggtttaaaccaggcctattcagtttgacccttaacgaaaggttttccatcaacggggggtaccttggcatcctggagtggattctaggcaagaaagacgttatgtggataggcttcctgacaaggaccgttctcgagaactccacaagctatgaggaagctaaaaacctcttaactaagacaaagatattggcccctgcctatttcatcttgggaggaaaccagtcaggagagggatgtgtgatcactcgcgatagaaaggagtccctggacgtgtatgagctggatgcaaaacagggaaggtggtacgtggtgcagacaaattacgaccggtggaagcacccattttttttagacgatcgccggactccagccaagatgtgcctgaatcgtaccagccaggaaaacatttcgtttgaaactatgtacgatgtgcttagtactaagcctgtgctgaacaaactcacagtttataccaccctgattgacgtgaccaaaggacaattcgaaacatatctgcgagattgccccgacccatgtataggatgg

SEQ ID NO: 17171 - DNA, 1185 bp, Artificial Sequence
  Description of Artificial Sequence: Synthetic coding sequence
atgcctgggagatcctgcgtcgcgttggtgctcttggcagccgctgtgtcatgtgcggtggcacaacacgcaccgccttggactgaggactgtagaaagtcaacttacccaccctcgggaccaacttaccggggagcggtgccttggtacaccattaacctggatctgcccccttacaaacggtggcacgaattgatgctggacaaggcccccgtgcttaaggtgatagtcaatagcctgaagaacatgatcaatacctttgttccatcgggtaagattatgcaggtggtagacgaaaaactgccggggctgctggggaattttccagggccttttgaggaggaaatgaaggggatcgccgccgtaacggatattcctcttggcgaaatcatctcattcaatatcttttacgagctcttcaccatttgcacttctattgtggcagaagataagaaaggtcatcttatccatggaaggaacatggacttcggagtgtttctgggatggaacataaacaatgatacttgggtaattaccgaacaactgaaacctctgacggtgaacctcgattttcagcgaaacaacaagactgttttcaaggcaagctcctttgcaggttacgtgggtatgctgactggattcaaacccggcctgttttcgctgactctgaacgagcggtttagtataaacggagggtatcttggtattctcgaatggatcctgggaaagaaggacgtcatgtggatcggtttccttactagaactgtgcttgaaaatagcacgtcatacgaagaagcaaagaacctcctcacgaaaactaaaatcttggcacccgcgtacttcatccttggtggcaatcaatcgggagagggctgtgtgattactcgcgatcggaaggaatcccttgacgtgtacgaactggatgcaaagcaaggacgttggtacgtggtccagaccaactacgatagatggaaacatccatttttcctggatgatcggcgcacccctgccaaaatgtgcctgaaccgcacgagccaagaaaacatatcttttgaaacgatgtatgatgtcctctccaccaaaccagtgctgaataaacttactgtgtacaccacccttattgacgtgaccaagggacagttcgaaacctacttgagggactgtccagatccctgtataggttgg

SEQ ID NO: 17172 - DNA, 1185 bp, Artificial Sequence
  Description of Artificial Sequence: Synthetic coding sequence
atgcccggcagatcctgtgttgcactcgtgctcctggctgctgccgtgtcctgtgcggtcgcccagcacgccccaccttggaccgaggactgccgcaagagcacatatcccccatccgggcccacatatcgaggagccgtcccctggtacaccattaacctggatttgccaccctataaacgatggcacgagctaatgctggacaaagccccagttttgaaggtgatagtcaactctcttaagaacatgatcaacacctttgtgccaagtgggaaaatcatgcaggtcgtggacgagaaactgccaggcttgctcggtaatttcccaggccccttcgaagaagaaatgaagggaatcgcggccgtaacagacattcctcttggggagattatttccttcaacatattctatgagctctttactatctgcacaagcatagtcgctgaagataaaaaaggccatctgattcacgggaggaatatggacttcggcgtctttcttggctggaacatcaacaatgatacatgggtgattacagaacagctgaaaccactgacggtaaatctggactttcagcggaacaacaagactgttttcaaagcttctagctttgcaggatacgtgggcatgctgactgggtttaagccaggtctctttagtctgaccttgaacgaaaggttttccattaacgggggttacctgggaatcctggagtggattctcggtaagaaggacgttatgtggatcgggttcctgacacggacggttctcgaaaattcaaccagttatgaagaggctaagaacttgctaacaaagaccaaaatactggcgccagcctactttatccttggcggtaatcagtccggagagggatgcgtcatcacacgagataggaaggaatctctggatgtgtacgagctcgacgcaaaacagggtcggtggtatgtggtccagaccaactacgacaggtggaagcacccgttcttcctggatgatcggcggaccccagcaaaaatgtgtctgaatagaacatcccaggaaaacatcagctttgagaccatgtacgacgtgcttagtactaagccggtgctcaacaagctgaccgtttataccacattgatcgatgtgaccaaggggcagttcgagacttatttgcgtgattgccctgacccttgtattggatgg

SEQ ID NO: 17173 - DNA, 1185 bp, Artificial Sequence
  Description of Artificial Sequence: Synthetic coding sequence
atgccagggaggagctgtgtggcactcgtgttactagccgccgcagtaagctgcgccgtggctcaacatgcccccccatggaccgaggattgcaggaagtcaacctatcctcccagcggacctacataccggggcgctgtcccctggtacacaattaatttggatcttcccccatacaaacgctggcacgagctgatgcttgataaggcacctgttctgaaggtgatcgtaaacagcctgaaaaacatgattaacacgtttgtcccctctggcaaaattatgcaggttgtggacgagaaattgccgggcctactggggaatttccctggaccgttcgaggaggaaatgaagggaattgccgccgtcactgatataccccttggcgagattattagttttaatatcttctatgaactgtttacaatatgtacttccatcgtagccgaagataagaaaggccaccttatccatggcaggaatatggactttggagtgtttttgggatggaatatcaacaacgacacctgggtgattaccgagcagttgaagcctctgaccgtcaatctagattttcagcgcaacaataaaactgtcttcaaggcctcttcgtttgcggggtacgtgggaatgctaaccggttttaagcccggactgtttagtctgaccctcaatgagagatttagtatcaacggcggctatcttggaattctcgaatggatactgggcaagaaggacgtgatgtggatcgggttcttgacccgcacagtactagaaaactccactagctatgaagaggcgaagaatctgctgacaaaaacgaaaatcctggcacctgcctatttcatacttggcggcaatcaatccggtgaggggtgcgtgatcacccgggatcgcaaggagtcattagacgtgtatgagctggacgccaagcagggaagatggtatgtggtgcaaacaaactatgacagatggaaacacccgtttttcttagacgacaggcggactcctgctaaaatgtgcctaaatcgcacatcccaggaaaacatatcatttgaaacgatgtatgatgtgttgtctactaaacctgtcctgaataaactcaccgtgtatactaccctgattgacgtcactaaggggcagtttgaaacctacttgcgggattgtccagacccctgcataggatgg

SEQ ID NO: 17174 - DNA, 1185 bp, Artificial Sequence
  Description of Artificial Sequence: Synthetic coding sequence
atgcctgggcgtagctgtgtggcacttgtgctccttgcagccgccgtgtcctgcgcagtggctcaacatgcgccgccctggaccgaagattgtagaaagagcacttaccccccgtccggtccaacgtacagaggcgccgtgccttggtacactatcaacctggaccttcccccttacaagcgttggcatgaactcatgcttgacaaggcaccagtcctgaaggtcatcgtgaactctcttaagaatatgatcaacacctttgtccctagcggaaagattatgcaggtggtggacgaaaaacttcctggactcctgggcaatttccctggaccctttgaagaagagatgaaggggattgcggctgtcacggatataccactgggagaaatcatttcatttaacatcttctacgagctcttcaccatttgtacgagcattgtggcagaggacaaaaaaggccatctcattcacggtcggaatatggatttcggagtgtttttgggatggaacattaacaatgatacctgggtgattaccgaacaactcaaacccctgactgttaacctcgatttccaacgcaataacaaaaccgtgttcaaggcctcctcgtttgcggggtacgtcggtatgctcactggatttaagccaggactgtttagtttgaccctgaatgaacgcttttcgattaacggtggctacttgggaatactggaatggatactcggtaaaaaggacgtaatgtggattggatttcttacccgcaccgtcctggaaaattccacttcgtacgaggaggcaaagaatcttctgacgaaaactaagatactggcccctgcttacttcattctgggaggtaatcaatcgggtgaggggtgcgtgataacgcgagatcggaaggaatcactcgatgtctacgaacttgatgcaaagcaagggagatggtatgtagttcagaccaactacgatagatggaagcacccctttttccttgatgatcgaagaactccagcaaagatgtgccttaaccggacttcccaggagaacataagttttgaaaccatgtacgacgtgctctcgactaagccagtgttgaacaaacttacggtttacaccaccctgatcgacgtgactaagggccagtttgagacttatctgcgggattgtcctgacccgtgtatcggatgg

SEQ ID NO: 17175 - DNA, 1185 bp, Artificial Sequence
  Description of Artificial Sequence: Synthetic coding sequence
atgcctgggaggtcgtgcgtcgcactcgtcctccttgctgcggctgtgtcctgcgcagtggcacagcatgccccgccctggactgaggactgcagaaagtcgacctaccccccgtccggaccgacctacagaggagccgttccgtggtacactatcaatctggacctcccgccttacaaacgttggcacgaactcatgttggacaaggccccagtgctgaaggtgatcgtgaattcgctgaagaatatgattaacaccttcgtgccgtcgggaaagatcatgcaagtggtggatgaaaagttgccgggactcctgggaaacttcccaggcccatttgaggaagagatgaaaggcattgccgccgtgacggatattcctctgggagaaatcatctcattcaacatcttctacgaactcttcaccatctgcacttccatcgtggccgaagataagaaaggccaccttatccacggaagaaacatggacttcggcgtgttcttgggctggaatatcaacaacgatacttgggtgatcaccgagcagctgaagccactcaccgtgaacctggattttcaacggaacaacaagactgtctttaaggcctcttctttcgccgggtacgtgggaatgctgaccggattcaaacctggtttgttcagcctgaccctcaacgagcggttttccattaacggaggctaccttggcatcctcgagtggatcttgggcaagaaagacgtgatgtggatcggattcctgacccgaactgtcctggagaactcaacctcctacgaagaggcgaagaacctgctgaccaaaaccaagatcctcgcaccggcgtactttatcctgggaggtaaccagtccggtgaaggctgcgtgatcactcgcgatcgcaaggaatcattggatgtgtacgaacttgacgcaaagcagggacgctggtacgtggtgcagactaactacgatagatggaagcatccatttttcctggatgaccgccggactccggcaaagatgtgcctgaaccgcaccagccaggagaacatctcgttcgaaaccatgtacgatgtgctgtcaactaagccagtcttgaacaagctgactgtgtatactactctgatcgatgtcactaaaggtcagtttgaaacctacctgcgcgactgcccggatccctgcatcggatgg

SEQ ID NO: 17176 - DNA, 1185 bp, Artificial Sequence
  Description of Artificial Sequence: Synthetic coding sequence
atgcccggcagaagctgtgtggccctggtgctcctggctgccgcagtgtcctgcgctgtagcccaacacgcacctccatggaccgaggattgtaggaagtccacgtacccaccttcaggccccacgtaccggggggcagtgccttggtacactatcaacctggacctgcccccttacaaacggtggcacgagttgatgctagacaaagccccagtactcaaagttatcgtcaattctttgaaaaacatgataaacacgtttgtaccttctgggaagataatgcaagtggtcgacgagaaactgccagggctgttgggcaacttccctggccccttcgaggaagaaatgaaggggatcgctgccgtaaccgatatccctctgggtgagatcatctcattcaacatattctatgaactgttcaccatttgcacctcaatcgtggcagaggacaaaaaggggcacctgatccatggacggaatatggattttggagtgttcctcggctggaatattaacaacgatacctgggtgatcactgagcagctcaagcccttaaccgtgaatctagactttcagaggaacaataaaaccgtgttcaaggccagttccttcgctggttacgtgggtatgttgacaggattcaaaccaggcctgttcagcttaacactcaatgagagattctccataaatggcggatatctgggtattctggaatggatcctgggaaagaaagatgttatgtggatagggtttttgactaggacggtcttggaaaacagtacttcctacgaggaggctaagaatctactgactaaaaccaaaatcctggctccggcatactttattctcgggggaaaccaaagcggagagggctgtgttatcaccagggaccgtaaggagtcgttagacgtctatgagctggatgcaaagcagggtaggtggtatgtggtgcagacgaactacgaccgttggaagcaccccttttttttggacgatcggcgaacaccagcgaaaatgtgtttaaatcgcacctctcaggagaatatttccttcgagacaatgtatgatgtactatcaaccaagcccgtccttaataagttaactgtctacaccaccctgatagatgtgactaaagggcaatttgaaacctacctgagggactgcccagatccttgtataggctgg

SEQ ID NO: 17177 - DNA, 1185 bp, Artificial Sequence
  Description of Artificial Sequence: Synthetic coding sequence
atgcccggaaggagttgcgtcgccttggtgcttctggctgcagccgtgtcgtgcgccgtggcacaacacgctccaccttggacagaggactgcagaaaaagcacataccctccttctggcccaacctaccgcggcgccgtgccctggtataccatcaacctcgatctgccaccctataagaggtggcatgagcttatgctggacaaggcgcctgtgctcaaggtcatcgtgaattccttaaagaacatgatcaatacctttgtcccgtcgggaaaaattatgcaggtcgtcgatgaaaaacttcccggactcctgggcaatttcccaggcccttttgaggaggagatgaaaggtattgcagcagttactgatattcctctcggggagattatctcttttaatattttctatgaattattcactatctgtacatctatcgtggcggaggacaaaaaaggccacctgatccacggtagaaatatggacttcggagtatttctgggatggaacattaacaatgacacctgggtgattaccgaacagctgaagcctctaacagtcaacctcgactttcagcggaataataagacagtttttaaggctagcagttttgctgggtatgtgggtatgctgactggatttaaacccggcctcttttcgctaactctcaatgaaaggttttctattaatggaggatacctcggcatcctggaatggatcttgggcaagaaggacgtgatgtggataggatttctgacccgaactgtcctcgagaattcaacaagctatgaagaggccaaaaacctgctgacaaagaccaagattctagcaccagcctacttcatccttggtgggaaccaatctggagaaggatgcgttataacaagagaccggaaggagtctctggacgtgtacgaactggacgcgaagcaggggcgctggtacgtcgtgcagaccaattacgatagatggaaacatccttttttcctagacgatagacggaccccagccaaaatgtgcctcaatcgtacatcacaggaaaacatcagcttcgaaactatgtatgatgttctttcaacgaaaccagtgctaaacaagctgactgtgtacaccacccttattgatgtgacaaagggtcagtttgagacatacctgcgcgattgtcctgatccgtgtataggttgg

SEQ ID NO: 17178 - DNA, 1185 bp, Artificial Sequence
  Description of Artificial Sequence: Synthetic coding sequence
atgcccgggagaagctgtgtcgcccttgtccttctggcggcagcggtgtcgtgcgccgtggcccaacacgcgccaccatggactgaagactgccggaagtccacctaccctccaagcggaccaacctaccgcggggccgtgccgtggtacaccatcaacctcgacctgccgccgtacaagcgctggcacgaactcatgctcgacaaagcccctgtgctgaaggtcatcgtgaactccctgaagaatatgatcaatacgtttgtccctagcggcaaaatcatgcaggtggtcgacgaaaaactgccgggattgctgggaaactttccgggaccgttcgaggaggaaatgaagggcatcgccgctgtgactgacatcccgctcggcgaaataatctcgttcaatatcttttacgaactgttcaccatctgtacttcgatagtcgccgaagataagaagggtcatttgatccacggacgcaacatggacttcggggtgtttcttgggtggaacattaacaacgacacctgggtgatcaccgaacagctgaaaccacttactgtgaacctggatttccagaggaacaataagaccgtcttcaaggcgtcctcctttgcaggctacgtcggcatgcttaccggcttcaagcccggcctcttttcgttgaccctcaatgagcgattcagcatcaatggaggatatctcggcatcctcgaatggattctgggaaagaaggatgtgatgtggatcgggttccttaccaggaccgtcctggaaaattcgaccagctacgaagaggccaaaaacctgctcaccaagactaagatcttggctccagcttacttcattctgggcggcaatcagtccggagaaggttgcgtgatcaccagagatcgcaaggaatcccttgatgtgtacgaactggacgccaagcagggccgctggtacgtggtgcaaactaactacgacagatggaagcacccgttcttcctggacgataggagaaccccggcaaagatgtgtctcaaccgcacttcgcaggaaaacatttctttcgaaaccatgtacgacgtcctgtcaaccaaaccagttctgaacaagctgaccgtgtacactactctcatcgacgtgaccaagggccaattcgagacttacctcagggactgtcctgatccgtgcatcggatgg

SEQ ID NO: 17179 - DNA, 1185 bp, Artificial Sequence
  Description of Artificial Sequence: Synthetic coding sequence
atgccgggtcgaagctgtgtggccttggtgctgctcgccgcagccgtgtcttgcgccgtggcacagcatgcgcctccatggaccgaggactgtaggaaatcgacttaccccccatccggtccgacctacaggggagcggtcccctggtacacgattaatcttgacctgccgccgtacaagcgctggcacgaactgatgctcgacaaagcccccgtgctcaaggtgatagtgaattccctgaagaacatgatcaacacgttcgtcccctccggcaagataatgcaagttgtggatgaaaagctcccggggctgttgggcaatttcccgggtccattcgaggaagagatgaagggaatcgccgctgtgactgacatcccgctgggagagatcatatcgttcaatatcttttacgagctgttcactatctgcacctcgatcgtggcagaggacaagaagggccacctcatccacggacgcaacatggatttcggagtgttcctgggatggaacatcaacaacgacacctgggtgattactgagcaactcaagccgttgaccgtgaacctggattttcaacgaaacaacaagaccgtgtttaaagcctccagcttcgccggatacgtgggtatgctgaccggcttcaaaccgggactcttttcactcactctgaatgaacggttctcgattaacggaggatacctgggcatcctcgagtggatcctgggaaagaaagatgtgatgtggatcggatttctcacccggactgtgctggaaaatagcacgtcctacgaagaagctaagaatctgcttaccaaaacgaagatccttgcgccagcgtatttcatccttggtggtaaccagtccggcgaggggtgcgtgatcacccgggatcgcaaggagagcctcgacgtctacgaactcgacgccaaacaagggcgttggtacgtggtccagactaactacgacagatggaagcacccattcttcctcgacgacagacgcaccccagctaagatgtgcctcaaccggacttcgcaggagaatatcagctttgaaaccatgtacgatgtcctctccaccaagcctgtgctgaataagttgacggtctataccactctgatcgacgtcaccaagggacagttcgagacttatctgcgagattgcccggacccgtgcatcggatgg

SEQ ID NO: 17180 - DNA, 1185 bp, Artificial Sequence
  Description of Artificial Sequence: Synthetic coding sequence
atgccgggtcgaagctgtgtggcgctggttctgctggctgccgcggtgtcgtgcgcagtggcgcagcacgccccaccgtggacggaagattgtcgcaagtccacgtatccgccaagcggtcctacatacagaggtgcagttccgtggtacaccattaatctggacctgccgccatacaaacgctggcacgagctgatgctggataaggccccggtgctgaaagttatcgttaacagcttgaaaaatatgattaatactttcgtgcctagcggtaagatcatgcaggttgttgatgagaaattaccgggtctgctcggcaatttcccagggccattcgaagaagaaatgaaaggcattgccgctgtgaccgatatccctctgggtgagatcatcagctttaacattttttacgagctgttcacgatatgcacttccattgtggccgaagacaaaaaaggccacctgattcacggacgtaacatggattttggagtcttcctgggttggaacatcaataatgatacatgggttataaccgagcagctgaagccactcaccgttaacctggactttcaacggaacaataaaacggtcttcaaagcctccagctttgctggctatgtgggtatgctgaccggtttcaagccagggctgttcagtttgacccttaatgagcgctttagcatcaacggtggttacctgggtattctggaatggatcctaggtaaaaaggacgttatgtggattggcttcctgacccgcactgttctggaaaacagcaccagctatgaagaagctaagaacctgctgaccaagactaagattctggccccagcttactttattctgggtggcaatcagagcggcgagggctgtgttatcactcgtgatagaaaagaaagcctggatgtgtacgaactggacgcaaagcagggacgctggtacgttgtccaaacgaattacgaccgatggaaacacccattctttttggatgaccgccgcacaccggccaagatgtgtcttaaccgtacttctcaagagaacatctcctttgagaccatgtatgatgttctgtcaacaaagccagttctgaacaaactgaccgtctacacgaccttgattgacgtgaccaaaggacagtttgaaacctacctgcgtgattgcccggatccttgcattggctgg

SEQ ID NO: 17181 - DNA, 1185 bp, Artificial Sequence
  Description of Artificial Sequence: Synthetic coding sequence
atgcctggaagatcctgtgtcgccctagtgctgttagcggccgccgtctcttgcgcggtggcgcagcacgcacctccatggacggaggactgtaggaagtctacctacccacccagtggacccacctaccgcggggccgtgccctggtatactatcaaccttgatctgcccccgtacaagagatggcatgagttgatgttagataaggctcctgtgcttaaggttattgtgaattcactgaaaaacatgattaacacctttgtgccctccgggaagattatgcaagttgtggatgaaaagctgcccggccttctcggaaattttcccgggcctttcgaggaagagatgaaaggcatcgcagcagtgactgatatccccctgggtgaaattattagcttcaatatattttacgagctttttaccatatgtacctcaatcgtggcagaggataagaagggccaccttatacatggccgcaatatggattttggagtgtttctgggatggaacatcaataacgacacctgggtgataactgagcagctaaagcctttgaccgtcaatctggacttccagcgcaacaacaaaactgtcttcaaggcctcctccttcgctggttacgttggaatgcttacgggattcaagcctggactgtttagcctcacactgaacgaaaggttctcaataaatggcgggtatctgggcatcctagagtggattctggggaagaaagacgtgatgtggattggctttttaacaagaaccgtgctcgaaaatagcacatcttacgaagaggccaagaatctcctgacgaaaaccaaaatcctcgctcctgcgtacttcattctaggcggcaaccagagcggggagggatgcgtaattacgcgtgaccgtaaagaatctctggacgtctatgagctggatgcaaaacagggacggtggtatgtggtgcagacaaactacgataggtggaagcacccattcttcctggatgataggagaacgcccgcaaaaatgtgcttgaacagaacctctcaggaaaacatctcctttgagacaatgtacgatgtactgtccactaagcccgtgctcaataagttgaccgtgtataccaccctcatcgatgtaacaaaaggacaatttgagacgtacctgcgagactgcccggacccctgcataggctgg

SEQ ID NO: 17182 - DNA, 1185 bp, Artificial Sequence
  Description of Artificial Sequence: Synthetic coding sequence
atgcctggccgcagctgcgtcgccttagtgctgttggccgcagccgtgtcctgcgcagtcgctcagcacgcacccccctggactgaagattgtcggaaaagcacttaccctccatcaggccctacctaccgcggcgccgtcccatggtatacaatcaatcttgacttacctccatacaagagatggcacgagctgatgcttgacaaggcacctgtcttgaaggtgatcgtcaacagcctgaaaaacatgattaacacctttgtgccatcagggaagattatgcaagttgttgatgagaaactgcccggtctgttaggcaatttccctggccctttcgaggaggaaatgaaaggcatcgccgctgtcaccgacatccctctgggagaaattataagctttaacatattttacgaactgttcactatatgcacctcaatcgttgcagaagacaaaaagggccacctcatacatggtagaaatatggattttggagtgttcctgggttggaacattaataacgacacatgggtgataaccgaacagctgaagccattaactgtcaacttggactttcagagaaataacaaaactgtgtttaaggcttctagtttcgctggttacgtcggaatgctcaccgggttcaagcctggcttatttagcctgactttgaatgaacgcttcagcatcaacggaggttatctaggcatattggaatggatactgggcaaaaaggacgtcatgtggattggtttccttacaaggactgtccttgaaaatagtaccagctatgaggaggccaagaacttactgaccaagaccaagattctggcccctgcctactttatcctcggcgggaaccagtccggagagggttgtgttatcacccgagaccgtaaagagagcctggacgtgtatgagttagatgctaagcagggacgatggtacgtcgttcagacaaactacgatcgatggaaacacccctttttcctagacgatcggagaacacccgccaaaatgtgtctgaataggactagtcaagagaacataagcttcgagacaatgtacgacgtattatccaccaaaccagtattgaacaagctgactgtatacacaaccctgatcgacgtgacaaaagggcagttcgaaacctacctgcgggattgtcccgacccatgcattggctgg

SEQ ID NO: 17183 - DNA, 1185 bp, Artificial Sequence
  Description of Artificial Sequence: Synthetic coding sequence
atgccgggtcgatcgtgtgtagcgttagtattattagcggcggcggtatcgtgtgcggttgcgcaacatgcgccgccgtggacggaagattgtcgtaaatcgacgtatccgccgtcgggtccgacgtatcgaggtgcggttccgtggtatacgataaatttagatttaccgccgtataaacgttggcatgaattaatgttagataaagcgccggttctaaaagtaatagttaattcgttaaaaaatatgataaatacgtttgtaccgtcgggtaaaataatgcaagtagtagatgaaaaactaccgggtctattaggtaattttccgggtccgtttgaagaagaaatgaaaggtatagcggcggtaacggatataccgctaggtgaaataatatcgtttaatatattttatgaattatttacgatatgtacgtcgatagtagcggaagataaaaaaggtcatttaatacatggtcgtaatatggattttggtgtttttctaggttggaatataaataatgatacgtgggttataacggaacaattaaaaccgttaacggtaaatttagattttcaacgtaataataaaacggtatttaaagcgtcgtcgtttgcgggttatgtaggtatgttaacgggttttaaaccgggtttattttcgttaacgttaaatgaacgattttcgataaatggtggttatttaggtatactagaatggatattaggtaaaaaagatgttatgtggataggttttctaacgcgtacggtattagaaaattcgacgtcgtatgaagaagcgaaaaatttactaacgaaaacgaaaatattagcgccggcgtattttatattaggtggtaatcaatcgggtgaaggttgtgtaataacgcgtgatcgaaaagaatcgttagatgtatatgaattagatgcgaaacaaggtcgatggtatgtagtacaaacgaattatgatcgatggaaacatccgttttttttagatgatcgtcgaacgccggcgaaaatgtgtttaaatcgaacgtcgcaagaaaatatatcgtttgaaacgatgtatgatgtattatcgacgaaaccggttttaaataaattaacggtatatacgacgctaatagatgtaacgaaaggtcaatttgaaacgtatttacgtgattgtccggatccgtgtataggttgg

SEQ ID NO: 17184 - DNA, 1185 bp, Artificial Sequence
  Description of Artificial Sequence: Synthetic coding sequence
atgcctggccgatcatgtgtggcccttgttcttcttgcagcagcagtgtcatgtgccgtggcccaacatgcaccaccgtggaccgaagattgtcggaagtccacttatcccccttccggacccacttatcggggagcagtgccttggtacacgattaatctcgatcttccaccatacaagcgttggcatgagcttatgctggataaggcacctgttctgaaagtgattgtgaactcactcaaaaacatgataaacacgtttgtgccatcgggtaagatcatgcaggtggtggatgagaagctccctggactgctgggtaactttcctggaccatttgaagaagagatgaaaggtatcgcagctgtgacggacattcctttgggcgagattatctccttcaacatattctacgaactttttaccatttgcacttctattgtggctgaagataagaaggggcatttgattcatggtaggaacatggactttggcgtctttctgggttggaatatcaataacgacacttgggtcattaccgaacagctcaagccccttaccgtcaatctcgattttcagcgaaataacaaaaccgtctttaaggcctcgagcttcgcgggctacgtgggaatgctgaccggcttcaagcctggactcttctcactgaccctgaacgaaaggtttagcattaacggtggctacttggggatcctggagtggattctcggtaagaaggacgtgatgtggattgggttccttacgagaactgtgctcgaaaactcgacttcctacgaggaggcaaagaaccttttgacgaaaaccaagatcctggctcccgcatactttatactggggggcaatcaatcaggcgaagggtgtgtgattaccagagatcgtaaggaatccctggatgtgtacgagctggatgccaaacagggccgttggtatgtcgtgcaaaccaactacgacagatggaagcacccttttttcttggacgatcgccgcactcccgcaaaaatgtgcctcaacagaaccagccaggagaatatctcgttcgaaactatgtacgatgtcctgtcaactaagcccgtcctgaacaagttgactgtctacaccacgcttattgacgttactaagggtcaattcgaaacttatctccgagattgtccagacccatgcatcggatgg

SEQ ID NO: 17185 - DNA, 1185 bp, Artificial Sequence
  Description of Artificial Sequence: Synthetic coding sequence
atgcccggtaggagctgcgtggcactggtgcttttggctgctgccgtcagctgtgccgtggcacagcacgcacctccttggacagaagactgtaggaagagtacctatccgccatcgggcccgacatacaggggtgctgtgccatggtacactattaacctcgatctgcctccctataagcgttggcatgagctgatgctcgacaaagcaccagtcctgaaagttattgtcaactcccttaagaacatgatcaacactttcgtgccgtctggaaaaatcatgcaggtggtggatgaaaagctccctggcctgctaggcaatttccctggcccattcgaggaagaaatgaaaggcatcgccgctgtgacagatattcccctcggagagattatcagctttaacatattttacgaactcttcactatatgcaccagcattgtggcagaggataaaaagggccacttgattcatggccgcaacatggacttcggagtcttcctgggttggaacatcaacaacgacacctgggtcatcaccgagcaactgaagccactcaccgtgaacctcgattttcagcggaacaataagaccgttttcaaagcgtcttcctttgccggttacgttggcatgctgacgggcttcaagccgggtctgttttctctgactttaaatgagaggttttcaattaacggaggctaccttggaattcttgagtggatactgggcaaaaaggacgtgatgtggatcgggtttctgacccgcacagtactggaaaattcgacatcatacgaggaggcaaagaacttacttacaaagacaaagatccttgctccggcttacttcatcctgggaggaaatcaaagtggagagggttgtgtgatcactagagaccggaaagaaagcctggacgtttatgaacttgacgctaaacagggtcgttggtacgtggtgcaaacaaactatgacagatggaagcatcccttcttcctcgacgaccgccgcactccagctaaaatgtgcctgaacaggacgtcccaggaaaatatttcctttgaaaccatgtacgatgtgctctcaaccaagcccgtgctcaataagctcactgtctatactacattgatagacgtgaccaaaggccaatttgagacttatctccgggattgccctgatccatgtatcggatgg

SEQ ID NO: 17186 - DNA, 1185 bp, Artificial Sequence
  Description of Artificial Sequence: Synthetic coding sequence
atgcccggtagatcttgtgtggctttggtgcttcttgccgcagccgtctcttgtgccgtcgcccagcacgcacccccttggaccgaggattgcaggaagtccacttaccccccatcagggcctacataccgaggggcggtcccatggtatacaattaatctggacctgccaccttacaagcggtggcacgagctgatgctcgataaggccccagtcttgaaggtcatcgtcaattccctgaagaacatgataaatacattcgttccgtctggcaaaatcatgcaggtggtagatgagaagctgcctggcctgctgggtaactttccgggacccttcgaagaggagatgaaaggaatcgctgcggtgacagatataccgcttggagagatcatctctttcaacattttctatgaattgtttactatatgcactagcattgtcgccgaggacaaaaagggacatctcattcacggacggaacatggatttcggagtttttctcggctggaacattaacaacgacacttgggtgatcactgagcagctgaagccgcttaccgtaaacctggacttccaaaggaacaataaaactgtttttaaggctagttcttttgctggctatgtcggcatgctgacaggtttcaagcccggactcttttcattgacacttaacgagcgattctctatcaacggaggttatttgggaatcctcgaatggatactggggaagaaagatgtgatgtggatcggtttcctgacacgcactgttctcgaaaactccaccagttatgaggaggccaagaatctcctgaccaaaaccaagatcctggcccccgcatacttcatcctgggcggcaaccagtctggggaaggatgcgtaatcacaagagacagaaaagaaagcttggatgtgtacgagttggacgcaaagcaaggcaggtggtacgtggtccagacgaattatgataggtggaaacacccattttttcttgacgaccgaaggacgcctgccaagatgtgcctgaatcgcacctctcaggagaatatctcctttgagacgatgtacgacgtcctgagtaccaaacccgtgctgaacaaattgacagtctacaccaccctgatcgacgtgacaaaaggtcagttcgagacatatcttcgggactgtcctgacccctgcatcggatgg

SEQ ID NO: 17187 - DNA, 1185 bp, Artificial Sequence
  Description of Artificial Sequence: Synthetic coding sequence
atgcccggaagatcatgtgtggccctggtgctgctcgcggcagccgtcagctgcgctgtggcacagcacgctccgccatggaccgaagattgcagaaaatccacttacccgccttctggccccacttaccgcggagctgtgccgtggtacaccatcaacctcgacctgcctccttacaagcggtggcacgaactcatgttggacaaagcaccagtgctgaaggtgatcgtgaactcactgaagaacatgatcaatacgttcgtgccaagcgggaagattatgcaagtcgtcgatgagaaattgccagggctgctgggaaacttcccgggaccgttcgaggaagagatgaaggggattgccgcagtgacggatatcccactcggagaaatcatctccttcaacatcttctacgaacttttcaccatctgcacttcgatcgtcgccgaggacaaaaagggccatctgatccacggcaggaacatggacttcggcgtgttcctgggatggaacattaacaatgatacttgggtcattactgaacagctgaagccccttaccgtgaacttggattttcagcgcaacaataagactgttttcaaggcgtcgtcgtttgctggttacgtgggaatgctcacgggattcaaacctgggctgttttctctcacccttaatgaacggttttcgatcaatggaggatatctgggcatcctggaatggatcctgggaaagaaggatgtcatgtggatcggatttctgactaggaccgtgctggaaaattccaccagctacgaggaggctaagaatctcttgaccaagacgaagatcctggcgccagcctactttatcctgggaggaaaccaatcaggagaaggctgtgtgatcacccgcgatcgaaaagagtcactggacgtgtacgaactggacgcgaagcagggcaggtggtacgtcgtgcagactaattacgaccgctggaagcacccgttcttcctggacgaccgcagaacgccggccaagatgtgcctgaaccggaccagccaggaaaacatctccttcgagactatgtacgacgtcctgtcaactaaaccggtgttgaataagctgactgtctacactactctcattgacgtgactaagggacagttcgaaacttacctccgcgattgccctgatccttgcatcgggtgg

SEQ ID NO: 17188 - DNA, 1185 bp, Artificial Sequence
  Description of Artificial Sequence: Synthetic coding sequence
atgccaggaaggtcgtgcgtggcgctcgtgcttctggccgccgccgtctcctgcgcagtggcgcagcatgctcctccgtggaccgaggactgccggaagagcacctaccccccatccggtcctacctaccggggtgccgtcccgtggtacactatcaaccttgacctccccccgtacaagaggtggcacgagctgatgctcgataaggcacctgtgctcaaagtgatcgtgaactcgttgaagaacatgatcaatactttcgtgccgtcgggtaagatcatgcaggtcgtggatgaaaaactccctggactgctcggtaacttcccgggaccgttcgaagaagagatgaaaggtatcgccgccgtgacggacatccctctgggggaaatcatctcgttcaatatcttctacgaacttttcactatctgtacctccatcgtcgctgaggacaaaaaggggcatctgatccacggacgcaacatggacttcggagtgttcctgggctggaatatcaacaatgatacttgggtgatcaccgaacagctgaagccgctcactgtcaatctcgatttccagagaaacaacaaaactgtctttaaggcttcgagctttgccggatacgtcggcatgctgacggggttcaagccgggcctgttctccctgacgctcaatgaacggttctcaattaacggaggttatctcggaatcctggagtggatcctcgggaagaaggacgtgatgtggatcgggttcctgacccggactgtgttggagaactcgacttcctacgaggaggcgaagaaccttctgactaaaaccaagattttggcccctgcctactttatcctcggaggaaaccagagcggcgaggggtgcgtgatcacccgcgaccgaaaagagagcctggacgtgtacgaactcgacgccaagcagggacgctggtacgtggtccagaccaattacgaccgctggaagcacccattcttcctggacgatagacgtactccagccaaaatgtgtctcaaccggacctcacaagaaaacatcagcttcgaaactatgtacgatgtgctctccaccaaaccggtgctcaacaagctgactgtctacaccaccctgatcgatgtgaccaagggacaattcgaaacgtacctgcgggattgcccggacccctgcattggttgg

SEQ ID NO: 17189 - DNA, 1185 bp, Artificial Sequence
  Description of Artificial Sequence: Synthetic coding sequence
atgcccggaaggtcttgtgtggcacttgtcctgcttgccgccgcagtttcctgtgcagtggcacagcatgccccaccctggactgaggactgtagaaagagcacctacccgcccagcggcccaacttacagaggagccgtgccttggtacacaattaacctggaccttccaccttacaaaaggtggcacgaattaatgctcgataaagcccccgttcttaaggtcatcgtgaattctcttaagaacatgataaatacattcgttccctcaggcaaaattatgcaggtcgtggatgaaaagcttcccggtttactggggaacttcccaggtccctttgaagaagagatgaaaggaatcgctgcagtgacagatatcccattgggtgaaattatctcattcaatatattctatgagttattcaccatctgtacaagtatcgtggcggaagacaagaaaggccatttgatacacggtcgtaatatggactttggcgtttttttaggctggaacattaataatgatacctgggtgatcaccgagcaactgaaacctctgacagtcaacctggacttccaaagaaacaataaaacggtttttaaggcgtccagcttcgctggctacgtggggatgctgaccggctttaagcccggtttgttcagcctgactctcaacgaacgcttcagcatcaatggagggtacctgggcattcttgaatggattctcggcaaaaaagatgtgatgtggatcgggttcttaacacgcacggtgctggagaatagcacctcatacgaggaggcaaagaatctgctaacgaaaactaagatcttagcacctgcgtacttcattcttggcggcaaccaaagtggggagggctgtgtgatcacccgcgacagaaaggaatctttggatgtgtatgaactggacgccaagcaaggacggtggtacgtggtgcaaaccaactatgacagatggaagcacccctttttcctcgacgaccgcaggacacctgctaaaatgtgtttgaacaggacgtcccaggaaaacatttcattcgaaactatgtacgacgtgctgtccaccaaacctgtgttaaacaaactgacagtgtatacaaccctcattgatgttactaaggggcagtttgagacttatttgagagactgtccagacccctgcatcgggtgg

SEQ ID NO: 17190 - DNA, 1185 bp, Artificial Sequence
  Description of Artificial Sequence: Synthetic coding sequence
atgccgggccgaagctgcgtggcgcttgtgctgttagctgccgcagtctcctgtgcggtggcccagcacgctcccccgtggaccgaggactgtcgtaaatccacgtaccccccttctggccccacgtaccgcggcgctgtgccatggtatactattaatctggaccttcccccctacaaacggtggcacgagttgatgcttgataaagctccggtgcttaaggtcattgtgaacagtttgaagaatatgattaatacattcgtcccgtccgggaagattatgcaggttgtagatgagaagctaccaggtttgctgggcaatttcccgggaccattcgaagaggaaatgaaggggatcgcggcggtaacggatattccactcggagaaatcatttcttttaatattttctacgagctctttactatctgcacctccatcgtagcagaggacaagaagggtcaccttatccacggacgcaacatggatttcggcgtcttcttgggatggaatatcaataacgatacgtgggtgatcactgagcaactcaagcctcttaccgtgaacttggacttccagcgtaataataaaacagtctttaaggcttcaagcttcgcaggatatgtcggcatgcttacaggtttcaagcccggcttgttctccctaacactgaatgagcgcttcagtattaacggcgggtacctcggcatccttgagtggatcttgggcaagaaggacgtcatgtggataggtttcctgacgcgaactgtactagagaactcgacatcgtacgaagaggctaagaatcttctaaccaagacaaaaattcttgcacctgcttatttcatcctcgggggaaaccagagcggtgaaggttgtgtgatcaccagagaccgtaaggagagtctcgatgtctacgagcttgacgctaaacagggtcggtggtatgtagtgcaaactaattatgaccgttggaaacatccatttttcctagacgaccgtaggacgcctgcgaagatgtgcctaaatcggacttctcaagagaatatcagcttcgagactatgtacgacgtcctctctaccaaacccgtcctgaataaactgacagtgtacaccacactcattgacgtcaccaaaggtcagtttgaaacatacctgcgtgattgtccagacccctgcatcggttgg

SEQ ID NO: 17191 - DNA, 1185 bp, Artificial Sequence
  Description of Artificial Sequence: Synthetic coding sequence
atgcctgggcggtcttgcgtggccctcgtcttactggccgctgccgtgagttgcgcagtagcacaacacgcaccgccctggaccgaagactgtagaaaaagtacctaccccccatctgggccaacatatcgaggtgccgtgccctggtacaccatcaacttggatctcccgccatacaaaagatggcatgaactcatgctggacaaggctcctgtgctgaaggtaatcgtgaatagcctaaaaaatatgattaatacttttgtgccaagcgggaagataatgcaggtagtggatgaaaaattacccggtctgttgggaaacttccccggcccctttgaagaagaaatgaagggaatcgcagccgtaactgatataccgctcggtgagatcatttcctttaatatcttctatgagctttttacgatctgcacatctatcgttgcagaggataaaaagggacacttgattcatggtagaaatatggacttcggggtgtttctcggatggaatatcaataatgatacttgggtcataaccgagcagcttaagcctttaacagtgaaccttgatttccagcgaaacaataagacggtgtttaaagctagtagtttcgcgggttatgtcgggatgcttaccggattcaaacccggcctcttttctctcactttaaatgaaaggttcagcataaatggagggtatctgggcatactggagtggatactgggcaagaaagacgttatgtggataggcttccttactcggaccgtgctggagaattccacaagctatgaggaagccaagaacctcctgacaaagaccaagatccttgctcctgcttactttatcctagggggtaaccagtccggcgagggctgcgtcattactagagatcgaaaggaatctctagatgtgtacgagcttgatgcaaagcagggaaggtggtatgtcgtccagacaaactatgatcggtggaaacaccctttttttttagatgatcggcggacgcccgccaagatgtgtctcaatcggacttcacaagagaatatctcgttcgaaaccatgtacgacgtactctccacaaagcccgtgctgaataaactcactgtgtatacgactctcattgacgtcaccaaaggtcagttcgagacttacctgagggactgtcccgacccttgcatcggctgg

SEQ ID NO: 17192 - DNA, 1185 bp, Artificial Sequence
  Description of Artificial Sequence: Synthetic coding sequence
atgcccggacggtcatgcgtggcattggtgttgctggcggctgccgttagttgcgcagttgcgcagcacgctcccccgtggacggaggactgccggaagagcacctatcccccttctggcccaacgtacagaggtgcagtcccttggtacaccataaacctggatctccccccctacaagaggtggcacgaactgatgctggacaaggctcctgtgttgaaagtgattgtgaatagcctcaaaaacatgatcaacacttttgtgcccagtggcaagataatgcaggtcgtggacgaaaagctgcctggactgcttgggaacttccccggccctttcgaagaggaaatgaaaggcatcgcagcagtcaccgacatcccgctgggcgaaattatatcctttaacatcttttacgagctcttcaccatttgcacctctattgtggccgaagacaaaaaaggacacctcattcatggacgcaatatggattttggcgtgtttctcggctggaacatcaacaatgatacctgggtgattaccgagcagctgaaacccttgacagtcaacctcgatttccagagaaacaacaagaccgtttttaaggcaagttcttttgccgggtatgtgggaatgctgaccgggttcaagccaggattgttttcactgaccctgaacgagagattttctattaacgggggatacctgggaatccttgagtggatcctgggtaaaaaagatgtcatgtggatcggcttcctcacccggaccgtcttggagaactctacttcctatgaagaagcaaagaacttgctgacaaagaccaagatcctggcccctgcatattttatccttggaggcaaccaaagcggcgaaggatgtgtgatcacacgggatagaaaagaatccctggatgtttatgaactcgacgccaagcaagggcgttggtacgttgttcagacaaactatgaccgctggaagcaccctttcttcctggatgatcgtagaacccctgctaagatgtgcctgaacaggaccagccaagagaatatcagtttcgaaacaatgtacgacgtccttagcaccaaacccgtcctgaataagctgaccgtttacactaccctcattgacgtcacgaaaggacagtttgaaacatacttaagggactgcccagacccatgtatcgggtgg

SEQ ID NO: 17193 - DNA, 1185 bp, Artificial Sequence; identical to SEQ ID NO: 17169
  Description of Artificial Sequence: Synthetic coding sequence

SEQ ID NO: 17194 - DNA, 1185 bp, Artificial Sequence
  Description of Artificial Sequence: Synthetic coding sequence
atgcccggaaggtcctgtgtcgcactggttcttctcgccgcagccgtgagctgtgccgtcgcgcaacatgccccgccctggacggaggattgtcggaagtcaacctaccccccttccgggcctacctacaggggtgccgtcccgtggtacactattaaccttgatctgcccccctacaagcgatggcatgaattgatgttggataaggcccctgtgctgaaggtgattgtgaattcgctcaagaatatgattaacaccttcgtgcccagcgggaagataatgcaagtcgtcgatgaaaaactccccggtctgctgggtaactttccaggtccatttgaggaagaaatgaagggaattgctgcggtgactgatattccactgggcgagatcatttcgttcaacatcttttacgagctcttcaccatctgcacgagcattgtggcagaagataagaagggacaccttatccatgggagaaatatggattttggagtgtttcttgggtggaacattaacaacgatacctgggtgatcaccgaacaactcaaacctctgactgtcaacctggactttcagcgcaataacaaaactgtgttcaaggcctcatcctttgcaggttacgtgggcatgcttacgggcttcaagcccggtctgttctcgcttactcttaacgaacggttttcaatcaacggtggctacctgggtatccttgagtggatcctgggtaagaaagatgtgatgtggatcggcttcttgacccgaactgtgctcgagaattcgacctcctacgaggaagccaagaacctgcttactaagaccaagatccttgcacctgcatacttcatccttggaggaaatcaatcaggagagggatgtgtgattacgagggaccggaaagaatccctggatgtgtatgaacttgatgccaagcaagggcgctggtacgtggtgcaaaccaactacgatcggtggaagcacccctttttcctcgacgatagacggacgccagcgaagatgtgtttgaaccgcacctcacaggaaaacatctcgtttgaaactatgtatgacgtgctctcgaccaagcctgtgcttaacaaacttactgtctacaccaccctgattgacgtcaccaagggccaatttgagacgtacctgagggactgtccagacccatgtattggatgg

SEQ ID NO: 17195 - DNA, 1185 bp, Artificial Sequence
  Description of Artificial Sequence: Synthetic coding sequence
atgcccggccgttcctgtgttgcactagttctgctggccgctgccgtgtcatgtgctgtggcccagcatgccccaccatggaccgaggactgccggaagagcacgtacccaccgagcgggccaacctaccggggtgcggttccttggtataccatcaacctggaccttcctccatataaacggtggcacgagctcatgcttgacaaggcccccgtgctcaaggtgatcgtgaacagtttaaagaacatgatcaatacatttgtccctagcggaaagatcatgcaggtcgtcgacgagaaactaccggggctgcttggaaacttccccgggccttttgaggaggagatgaaggggattgccgctgtgacggatattccgctgggggagattatcagctttaatatcttctatgagctcttcactatttgtacaagcattgttgccgaggacaagaagggtcacttgattcatggaagaaacatggacttcggagtcttcctcggttggaacatcaataacgacacttgggttataactgagcagttgaaacccctgaccgtgaatctggactttcagcgaaataataagaccgtgtttaaggcaagtagttttgccggctatgtgggaatgctgacgggttttaagccaggccttttttctcttaccctgaacgaaaggtttagcataaacggagggtacctgggaatcctggagtggattttaggcaagaaggatgtcatgtggattgggtttctcactcgtacagtcctggagaactcaacatcctatgaagaggctaaaaacctgttaaccaagaccaaaattctagctcctgcgtacttcatcctggggggaaaccagagcggcgaggggtgcgtgattacacgggatcgcaaagagtccctcgacgtctacgagctggacgctaagcaaggaaggtggtacgtggtgcagacaaactatgatagatggaaacaccctttctttctagacgaccgacgcacgcccgccaaaatgtgtctaaacaggacttcgcaggagaatatcagtttcgaaaccatgtacgatgtgctgtccacgaagcccgtcctaaacaaactcaccgtatataccacactgatcgatgtgacgaagggtcaattcgagacctacctacgagattgtcccgatccctgtatagggtgg

SEQ ID NO: 17196 - DNA, 1185 bp, Artificial Sequence
  Description of Artificial Sequence: Synthetic coding sequence
atgcctggacggtcatgcgtggcgcttgtgctcctggccgccgcagtgtcctgcgctgtcgcacagcatgccccgccctggactgaggattgccgaaaatcgacctacccgccgagcggaccgacctacagaggtgcggttccgtggtacactatcaacctcgacttgccgccgtataagagatggcacgagctgatgctcgataaggctccagtgctgaaggtgatcgtgaactcgctgaagaacatgattaacactttcgtccctagcggaaagatcatgcaggtggtggacgagaagctgcctggactgctgggaaactttcctggacccttcgaagaagagatgaaggggatcgccgccgtgaccgacatccctctgggcgagatcatcagcttcaacattttctacgagctcttcactatttgcactagcatcgtcgcggaggacaaaaaaggccacctgatccatgggcggaatatggacttcggggttttcctcggctggaatatcaataacgatacctgggtcatcactgagcagctgaagccactgacggtgaacctcgatttccagcggaataacaagaccgtctttaaggcctcatccttcgcaggatacgtgggcatgctgactggattcaagccgggactcttttcactgaccctcaacgaaagattttcaattaacggtggatacctgggcatcctggaatggatccttggtaagaaagacgtgatgtggattggctttctgactcggactgtgctcgaaaactcgacttcgtatgaagaggccaaaaacctgctgaccaagactaagatcctggccccggcctacttcatcttgggcggtaaccagtccggagagggctgtgtcatcactcgggataggaaggaatcactggatgtgtacgagctcgacgcaaagcagggaagatggtatgtggtccaaactaattacgatcgctggaagcatcctttctttctggatgaccgccgtaccccggcgaaaatgtgcttgaaccggacctcgcaggagaacatttccttcgagactatgtacgacgttctcagcaccaaaccagttctcaacaagctgaccgtctacactaccctgattgatgttactaagggccaattcgaaacttacttgcgcgattgccccgatccgtgtattggatgg

SEQ ID NO: 17197 - DNA, 1185 bp, Artificial Sequence
  Description of Artificial Sequence: Synthetic coding sequence
atgcctggcaggtcctgtgtggccttggtgcttcttgccgccgcagtgtcgtgtgcggtcgcccagcacgcccctccttggaccgaggactgtcggaagagcacctaccctccctccggcccaacctacagaggtgccgtgccctggtacaccattaacttggacctgcccccgtacaagagatggcatgaattgatgcttgataaggcccctgtgctgaaggtgattgtcaactcacttaagaacatgattaacacgtttgtccctagcgggaagattatgcaggtggtggatgagaagctgcctggactgctgggaaacttcccaggtccatttgaagaggaaatgaagggaattgcagcagtgaccgacatccccctcggtgagattatcagctttaacatattctacgaacttttcactatttgcaccagcatagtcgccgaggataagaaaggtcatcttatccatggtcgtaacatggattttggtgtttttctgggatggaatatcaataacgatacctgggtaattacggagcaacttaaacctcttactgtcaatctggatttccaaagaaataacaagaccgtgttcaaagcctcgagctttgcgggatacgtgggcatgctgactggctttaagccaggactgtttagcctcaccctcaacgaacggttcagcatcaacggtgggtatctcggaatacttgaatggatacttgggaagaaggatgtgatgtggattggatttctcactagaactgttcttgaaaattcgacctcctacgaagaggcgaagaaccttctgactaagaccaagattcttgcacctgcatactttattctgggaggaaatcagtcaggtgagggatgcgtcatcactcgcgacagaaaggaatccttggatgtctacgaactggacgccaaacagggtcgatggtatgtggtccagaccaactacgataggtggaagcacccttttttcttggacgatcgcaggacgcctgctaagatgtgcctcaaccgcacttcacaagagaatatctcgtttgaaaccatgtacgatgtgcttagcacgaagcccgtcttgaataagctcaccgtttacactacgcttattgatgtgactaagggtcagtttgaaacgtacctgcgggattgcccggacccatgtataggctgg

SEQ ID NO: 17198 - DNA, 1185 bp, Artificial Sequence
  Description of Artificial Sequence: Synthetic coding sequence
atgcccggaagaagttgcgtggccctagtcctcctggcagcagcagtgtcatgcgctgtggcccaacatgcacccccctggacagaagattgccggaagtcgacatacccaccctccgggcctacatataggggagccgttccttggtacaccataaatctggacttgcccccctataagcgatggcacgaattaatgcttgataaggccccagtgctgaaagtgatagtcaactccctcaaaaatatgattaatacatttgtgccgagtggaaagatcatgcaggtggtggatgagaagctaccagggctccttggcaacttcccggggcccttcgaggaggagatgaaggggattgccgcagttaccgacattcctctcggagaaattatttcctttaatattttttatgaactttttaccatttgtacatctattgtggccgaggataaaaagggtcatctgattcatggtcgcaatatggactttggcgtctttctcggatggaatattaataacgacacatgggttatcaccgagcagctgaaacctctaaccgtgaatcttgattttcagaggaacaacaagacagtcttcaaagctagctcctttgcagggtacgtgggtatgcttaccggctttaagcctggactattctcactgacccttaacgaacgtttttcaatcaacggcggatacttaggcatcttggaatggatactcggcaagaaagacgtgatgtggattggattcctgacgaggactgttcttgagaattctaccagctatgaagaagcaaagaatctgttgacgaagaccaagattctggcaccggcctactttatacttgggggcaatcagtctggcgaaggttgtgttatcactagagatcgaaaggagagcctggatgtgtacgaactggatgccaagcaaggcaggtggtatgtggtgcagactaattacgatcgctggaagcacccattcttcctcgacgaccgtcgcacaccagccaagatgtgtctaaacagaacctcccaggagaatatttctttcgagacaatgtatgacgttttaagcaccaaacctgtgctcaacaaactcaccgtgtataccacattgatcgatgttaccaaggggcagtttgaaacctacctgcgtgactgcccagatccctgtatcggctgg

SEQ ID NO: 17199 - DNA, 1185 bp, Artificial Sequence
  Description of Artificial Sequence: Synthetic coding sequence
atgccagggcgctcctgcgtggcgctcgtgttgctggctgcagcagtgtcgtgtgcagtggcccaacatgccccaccctggaccgaggactgtaggaagtcgacctatccaccatcaggtccgacttacaggggtgcggttccatggtacaccatcaatctggatctccctccatataagaggtggcatgaacttatgctggataaagcacctgtccttaaggtgattgtcaactcactcaagaacatgattaacacctttgtcccttcgggtaaaatcatgcaggttgtggatgaaaagctgcctgggcttctgggcaactttccaggtccatttgaggaggagatgaagggaattgcagcagtgaccgacattcccctcggagagattatctcatttaacatcttctatgagctgtttaccatctgtacgtccattgtggcagaagataagaaaggccacctgatacatggaagaaacatggattttggagtattcctcggatggaacatcaacaatgatacttgggtgattaccgaacagctgaaaccgctgaccgtgaacctggactttcaacgtaacaataagaccgtgttcaaggcatcatcatttgccgggtatgtcggaatgctcaccggatttaagcctgggcttttctcactgacgctcaatgagcggttttcaattaacggaggatacctgggtattcttgaatggatactggggaaaaaagacgtcatgtggataggttttttgactagaactgtcttggaaaacagcaccagctacgaagaagcaaagaatctccttactaaaaccaagattctggcgccagcatacttcatcctgggaggaaaccagtccggcgagggatgtgtgatcactagagatagaaaagagtcgctggatgtctacgaacttgatgcaaaacaaggtcggtggtacgtggtgcaaactaattacgatcgctggaaacatccgtttttcctggacgatagacgaaccccagcaaagatgtgtctcaaccgcacttcccaggaaaacatctcgttcgaaactatgtatgatgtgctttcgacgaagccggtgttgaacaagctgactgtgtacaccacgctgattgacgtgaccaaggggcaatttgaaacttacttgcgggactgtccagacccatgcatcgggtgg

SEQ ID NO: 17200 - DNA, 1185 bp, Artificial Sequence
  Description of Artificial Sequence: Synthetic coding sequence
atgcctggaagatcatgtgtcgcactggtcctcctggccgccgccgtgtcttgtgccgtggcccagcacgcaccaccatggacagaggattgtcgcaaatctacgtatcctcctagtgggcccacttaccggggggccgttccctggtacacaatcaatctcgatctcccaccttataaaaggtggcatgaactgatgttggataaagctcctgtgcttaaagtcatagttaattctctgaagaatatgataaacacattcgtcccaagtgggaaaataatgcaggtcgtagatgaaaaattgcctggattactcgggaatttccccggacctttcgaagaagagatgaaagggatcgccgctgtgactgatatcccactaggagaaatcatctcatttaacatattctatgaactgttcactatctgcacttccatagtcgccgaagataaaaaggggcaccttattcacgggaggaacatggactttggggtgtttctgggatggaatatcaacaatgatacttgggtaattactgaacagctcaaacccctgactgtcaacctggatttccagcgcaacaataaaacagtgttcaaggcttcatcttttgcagggtatgtcggaatgttaacagggttcaaacctgggctcttctcgttaacattaaacgaaaggttttctataaatgggggatatctgggaattctggaatggatactggggaaaaaagacgtcatgtggatcggattcctgacaaggactgtgctcgaaaactctacaagttatgaagaagctaaaaaccttcttacaaaaactaaaatactggctccagcatatttcatacttggggggaatcagtctggagaagggtgtgtcattacaagggaccggaaagaatctctcgacgtgtatgaactcgatgcaaaacaggggagatggtatgtggtgcagacaaattatgataggtggaaacatcccttcttccttgacgaccgccggactcccgctaaaatgtgcctgaacaggacttcacaggagaacatttcattcgagacaatgtatgatgttctatctacaaaaccagtgctgaataaactaacagtatatactactctgatcgatgtgacaaaaggacagttcgaaacatatctccgcgactgccctgacccctgcatcggatgg

SEQ ID NO: 17201 - DNA, 1185 bp, Artificial Sequence
  Description of Artificial Sequence: Synthetic coding sequence
atgcccggtcgatcttgcgtggcccttgtactcctagcagccgccgtgtcctgcgctgttgcccagcatgccccaccgtggacagaagactgtcgcaagagtacctacccccccagtggacctacctatcgcggcgccgtgccatggtatacgattaacctggatctgccgccatacaaaaggtggcatgaactgatgctcgacaaagcgcccgtgctaaaggtgatagtgaacagtctcaagaatatgataaataccttcgtgccatcgggaaagattatgcaggttgtggatgagaagctgccaggactgcttggcaacttcccaggtccttttgaggaagaaatgaagggaatcgctgccgtgacagacattcctctcggcgaaatcatatctttcaatattttctacgagctgtttactatctgcacgagcatcgtggcagaggacaagaaagggcacctcatccatgggagaaacatggattttggagttttcctcggttggaacatcaacaatgatacctgggtcataactgagcaacttaagccactgacagtgaatttggactttcagaggaataacaagactgtgttcaaggccagctctttcgctgggtatgtcggaatgttgactgggtttaagcctggtctcttcagtctcacgttaaatgaacgattttccatcaatggcgggtacctggggattctggagtggattctgggcaaaaaagacgtgatgtggattggcttcttgactcgcaccgtattggagaacagtacatcgtacgaggaggctaaaaatttactgaccaaaactaaaattctggctccagcctactttatccttggagggaaccagagcggcgaaggctgcgtcatcactcgggacagaaaggaatcattagacgtgtatgagcttgatgccaagcagggccgctggtacgtggtacaaacaaattacgaccgatggaagcacccattttttctggatgataggcgcacccccgccaagatgtgtttaaacaggaccagccaggagaacatctccttcgagacaatgtacgacgttctatccacaaagccggtgctgaacaagcttacagtgtacacaacactaatcgacgttaccaagggacaatttgaaacatatctccgggactgcccggatccctgtataggatgg

SEQ ID NO: 17202 - DNA, 1185 bp, Artificial Sequence
  Description of Artificial Sequence: Synthetic coding sequence
atgcctggacgctcgtgtgtcgcactggtgcttctggctgcagccgtctcctgtgcggtcgctcaacatgcgcccccttggaccgaggactgtcgcaagtcgacctaccctccctcagggcccacctacagaggcgccgtgccttggtacacgattaacctggatcttcctccatacaagagatggcacgagctgatgcttgacaaggccccagtccttaaggtgattgtgaattccctgaaaaacatgattaacacgttcgtgccatcaggcaagataatgcaagtggtcgatgagaaacttcccggtctgctgggtaactttccgggaccttttgaggaagaaatgaaaggtatcgcagctgtgactgacatccctcttggggagattatctctttcaacattttctacgaactttttaccatttgtacctccattgttgcagaggacaagaagggacaccttatccatggaagaaacatggactttggcgtatttctgggttggaacattaacaacgacacttgggtcataaccgagcaacttaagccattgactgtcaatcttgactttcaacggaacaataagaccgtgtttaaggcgtccagctttgccgggtatgtggggatgctgactggtttcaagcctggcctcttttcccttaccttgaacgagaggtttagcataaacgggggatacctgggaatcctggaatggattctgggaaaaaaggatgtcatgtggatcgggtttctgacccggaccgtcctcgaaaattcgacctcatacgaagaggccaaaaacctcctcaccaagactaagattctcgcacctgcatacttcatacttggtgggaatcagtccggggaaggatgcgtgattacccgcgaccgcaaagaatcgcttgatgtgtacgaactcgacgcaaagcagggcaggtggtacgtggtgcagactaattacgatagatggaagcatccgttttttctcgacgatcggagaaccccggctaaaatgtgtctgaatcggacttcccaagagaacatttccttcgaaactatgtacgacgttctttcgaccaagcccgtgctcaacaaactgacggtgtacactacccttatcgacgtaactaagggacaattcgaaacgtaccttagagactgtccagatccatgcattggttgg

SEQ ID NO: 17203 - DNA, 1185 bp, Artificial Sequence
  Description of Artificial Sequence: Synthetic coding sequence
atgcctggccgttcctgtgtggcattggtgctcctggcagccgccgtttcctgtgctgtggctcaacacgcaccaccatggaccgaagattgtcgaaagtctacgtaccctccaagcgggcccacatatagaggagccgtgccctggtacactatcaatctagacctgcctccgtacaaaagatggcacgagcttatgctggataaagcccccgtcctcaaagttatcgtcaactctctgaagaatatgataaacacctttgtcccttcaggtaaaattatgcaagttgtcgatgagaagctgccaggcctcttgggcaactttccaggcccgttcgaggaagaaatgaagggtatcgcggcagtgaccgatatacccctcggcgaaattatcagctttaacatcttctatgagctcttcaccatatgtacttctattgtggccgaagacaaaaaaggtcatctcatccacgggcgaaatatggatttcggcgtgttcctcggatggaacatcaataatgatacctgggttataacagaacagctgaaacccctgacagttaacctggacttccagcggaataacaagaccgtgtttaaagcctcgagcttcgcgggctacgtgggcatgttgacagggtttaagccagggctcttttctctcacgctgaacgaacgattctccatcaatggcggctatctgggtatcctggagtggattcttggtaaaaaagatgtgatgtggattggtttcctgacccggaccgttctggaaaatagtactagttacgaagaagcgaaaaatctgctgacaaagacaaaaatcctggctccagcatacttcattcttggaggaaaccaatcgggagaggggtgtgtgataacccgcgaccggaaggaaagcttggatgtctacgagcttgacgctaaacagggccgatggtacgtggtgcagaccaattacgacaggtggaagcatccatttttcctcgatgacaggaggactcctgccaagatgtgtttgaaccgcacctcgcaggagaacatcagttttgaaaccatgtatgacgtcctgagcacgaagcctgtactgaacaagctgaccgtttacaccaccttaattgatgttaccaaggggcagttcgaaacctacctccgggactgccccgacccttgcatagggtgg

SEQ ID NO: 17204 - DNA, 1185 bp, Artificial Sequence
  Description of Artificial Sequence: Synthetic coding sequence
atgccaggtcgcagctgcgtggcactagtgcttctggccgcagcagtgtcctgtgccgtggcacagcacgcccctccttggaccgaagactgcaggaagtcaacttatcctcctagcggcccaacatatagaggcgcagttccgtggtataccattaatctggacctgcctccatataaacgatggcacgaacttatgttggataaagcaccagtgctgaaggtcatagtgaatagtctgaaaaatatgatcaacactttcgtcccctctggcaagattatgcaggtggtagatgaaaaactccccggtctgctggggaacttcccggggcctttcgaggaggagatgaagggtatcgccgccgtgaccgacatccctttaggggaaatcatcagttttaatattttctatgagctgttcacaatatgcacctcaattgtcgccgaggataagaaagggcaccttatccatggccgcaatatggacttcggagtctttctaggctggaatattaacaatgacacttgggttatcaccgagcagcttaaacccctgacagttaacctggactttcagaggaacaataaaaccgtgtttaaggcgtcctcctttgccggctacgtggggatgttgacgggttttaagcctggactcttttccctcacacttaatgaaaggttttccattaacggtggctatctgggaatcctggagtggattctaggtaagaaggatgtcatgtggattgggttccttactcgcactgtcctggagaattcaacttcttatgaagaggcgaaaaatctgttgacaaagacgaaaattctcgcaccagcatacttcatcctgggtggaaatcaatccggggaaggatgtgtgattaccagggatcgtaaagagagcctggacgtctacgagctagacgctaaacagggacgatggtatgtggttcagacaaattatgaccgatggaagcacccgttcttccttgatgacaggcgtacccccgcaaagatgtgtctgaaccgaaccagccaggagaatatcagcttcgagaccatgtacgacgttctctccacgaaaccagtactgaataagctcaccgtgtacactaccctgattgacgtgactaaaggacagtttgagacttatctcagagactgtcctgatccctgtattggctgg

SEQ ID NO: 17205 - DNA, 1185 bp, Artificial Sequence
  Description of Artificial Sequence: Synthetic coding sequence
atgccggggagatcctgcgtggccctggtgttgcttgccgccgccgtctcttgcgctgtggcccaacatgccccaccctggaccgaggactgtcgaaagtctacttacccgccgtcgggacctacttaccggggcgcagtcccttggtacaccatcaacctcgatctgccaccctataagaggtggcatgagctgatgcttgacaaagcgccagtactgaaagtcatcgtgaattcgctgaagaatatgataaacacctttgtcccttccggaaagattatgcaagtggtggatgaaaagctgcccgggcttctcggaaactttccgggaccgttcgaggaggagatgaaggggatcgcagccgtgactgacattccgctgggagagatcatcagcttcaatatcttttacgaactgttcacgatctgcacctcgatcgttgccgaagataagaagggtcaccttattcacggccggaacatggattttggtgtgttcctggggtggaacatcaataacgacacttgggtgatcactgagcagttgaagccgctcactgtgaacctcgatttccaacgaaacaataagacggtctttaaagcgtcaagtttcgctggatacgttggcatgttgaccggcttcaaacccggcctcttctcactcactctgaacgagaggttttccatcaacggaggctaccttgggatcttggagtggatcctgggtaagaaagatgtgatgtggatcggatttctgacgcgcaccgtcctcgagaatagcaccagctacgaagaagccaaaaacctgctgaccaagacgaagatccttgctcccgcgtatttcattctgggaggcaaccaatcaggcgagggatgtgtcattactagggacagaaaggaatcattggacgtctacgaattggatgcgaagcagggaagatggtacgtggtgcagactaattacgaccggtggaagcatccgttcttcctcgacgataggcgcaccccggctaagatgtgtctcaacagaacctctcaagagaacatctcgttcgaaacgatgtacgacgtgctctcgacgaaaccagtcctgaataagctgaccgtctacactaccttgatcgacgtgactaaaggacagttcgaaacttacctccgcgattgcccggacccatgcatcgggtgg

SEQ ID NO: 17206 - DNA, 1185 bp, Artificial Sequence
  Description of Artificial Sequence: Synthetic coding sequence
atgccaggccggtcttgcgtggcccttgtgctcctggccgcggccgtcagttgcgcggtggcccaacacgcccccccctggaccgaggattgccgtaagtccacatacccacccagtgggcctacatatcggggtgccgtgccttggtacacgattaacctggacctgcctccatacaagaggtggcacgagttgatgctagacaaagccccagtcctgaaggttatagtcaattctctgaaaaacatgatcaatactttcgtgccaagtggaaaaatcatgcaagtagtcgatgagaagctgccgggactgctagggaactttcccggtccctttgaggaggaaatgaaggggatcgcagcggtaaccgatattccattgggcgagatcattagctttaacatcttctatgagctcttcaccatttgcacttccattgtggcggaggataagaagggtcatttgattcacggacgcaatatggacttcggcgtgtttctcggctggaatatcaacaacgatacatgggttatcacagaacagctcaagcctctcactgtcaacctagatttccaacgtaacaataagacagttttcaaagcctcgtctttcgccggatatgtgggtatgctgactggcttcaagcctggcctgttcagcctaactctgaatgaaaggttctccattaatggaggatatctcggcatactggaatggatattaggaaaaaaggatgtgatgtggattgggttcctgacgcggaccgttttggaaaattcaacatcttatgaggaggcaaagaacttgttgactaagacaaagatcctcgcaccagcttatttcatcctgggcggcaatcaaagcggagagggttgtgttattacccgggaccgcaaagagtccctcgacgtgtacgaactggatgccaagcagggtagatggtatgtagttcagactaattatgaccgctggaagcatccattcttcctagacgatcgtcggacgccagcaaaaatgtgtctgaaccggaccagccaggagaatatttcctttgagactatgtatgacgttttgagcacaaaacctgtcttaaacaaacttaccgtctatactacactcatagatgtcactaaaggacagttcgagacatatttgcgcgactgccccgacccctgcatcggttgg

SEQ ID NO: 17207 - DNA, 1185 bp, Artificial Sequence
  Description of Artificial Sequence: Synthetic coding sequence
atgccagggcgaagttgtgtggcactggtactgctcgccgccgccgtcagttgtgctgtggcacagcatgcaccaccgtggactgaagactgtcgaaaatccacatatcctccttcagggcctacttaccggggggccgtaccttggtacacaatcaacttagatctgccaccctacaaacggtggcatgaactcatgctcgataaagctcctgtgctgaaagtgatcgtcaattccctcaaaaatatgattaatacatttgtgcccagtgggaaaatcatgcaggtcgtggacgaaaaacttccagggctcctgggaaactttccagggcccttcgaagaagaaatgaaaggaattgcggctgtaactgatatccctcttggagaaataatttcttttaacattttctatgaactcttcactatctgtacttctatagttgctgaagacaaaaaaggacacttgattcatgggaggaacatggattttggagtatttctcgggtggaatattaacaacgatacatgggtgattactgaacagctcaaacctctaacagtaaatcttgacttccagaggaataacaaaacagtattcaaagcgtcctctttcgccggatatgttgggatgcttactggatttaaacctgggttgttttcgcttactcttaatgagaggttcagtatcaacggaggatatttggggatcctcgagtggatcctcggaaaaaaggatgtgatgtggatcgggtttctcacacggactgttctcgaaaattcaactagttatgaggaagcaaaaaatctccttacaaaaacaaagatacttgcacccgcttatttcatcctgggaggaaatcagtcaggagaggggtgcgtaatcactagagatcggaaagaaagtctggacgtgtatgagctggatgccaaacagggaagatggtatgtagtccagactaactatgatagatggaaacaccccttttttcttgacgataggcggacacccgctaaaatgtgtcttaaccggacatcacaggaaaacatatcgtttgaaacaatgtatgatgtcctgtcaactaaacccgtgctgaataaacttactgtctacactacactgatcgacgtgacaaaagggcagttcgaaacttatctccgggattgtcccgacccatgcattggatgg

SEQ ID NO: 17208 - DNA, 1185 bp, Artificial Sequence
  Description of Artificial Sequence: Synthetic coding sequence
atgcctgggcgctcgtgcgtcgcccttgtgctgctggccgcggctgtctcctgcgcggtggcgcagcacgcgccgccatggactgaggactgtagaaaaagcacctacccaccgtccggcccgacttaccgaggagcagtgccttggtacaccatcaacctcgacttgcccccctacaaacgctggcatgagctgatgctcgataaggccccggtgctgaaggtgatcgtgaactccctcaagaacatgatcaacacttttgtcccgtccggaaagattatgcaagtcgtcgatgaaaagctccctgggctgctggggaactttccgggaccgtttgaggaagagatgaaaggaatcgccgccgtgaccgacatcccactgggcgaaatcatctcgttcaatatcttttacgaactgtttaccatttgcacctcgatcgtggctgaggataagaagggccacctgatccatgggaggaatatggactttggagtctttctcggatggaacattaacaacgatacgtgggtgatcaccgaacagctcaaaccgctgactgtgaacctcgacttccaacgcaataacaaaactgtgttcaaagcctcgagcttcgccgggtacgtcggtatgttgacggggttcaagccaggactcttctccctgaccctgaatgagagattctcgatcaatggaggctacctgggcatcctggagtggatcctggggaagaaggacgtcatgtggatcggattcctgactcggacggtgctcgagaactccacctcctacgaggaagcaaaaaacctgcttaccaagaccaagatccttgcaccggcctacttcatcctcggcgggaatcagtcaggtgaagggtgcgttattactcgcgaccggaaagaaagcctggatgtctacgaactggacgccaagcaaggacgctggtacgtggttcagaccaattacgataggtggaaacacccgttcttcctggacgaccgccggactccggccaagatgtgtctgaaccgcacctcccaggaaaacatcagctttgaaaccatgtacgacgtcctgtcgacgaaaccggtcctgaacaaactcactgtgtacactactctgatcgacgtgactaagggacaattcgaaacctacctgcgtgactgcccggatccttgcatcggctgg

SEQ ID NO: 17209 - DNA, 1185 bp, Artificial Sequence
  Description of Artificial Sequence: Synthetic coding sequence
atgccagggcgttcctgcgtggctctggtattgcttgctgcagcagtgagttgtgctgtggcacagcacgctcccccctggactgaggattgcaggaagtccacatatcctcccagcgggcccacctaccggggcgccgtaccctggtacaccatcaacttggatctacctccttacaaacggtggcacgaactcatgctggataaagctcctgtgctgaaagttatagtgaactctcttaaaaatatgatcaatacctttgttccatccggaaagatcatgcaggtggtagacgagaagctgcccggactgttgggaaactttcccggacctttcgaagaggagatgaaggggatagccgcagtgacggatattcccctgggcgaaattatatccttcaacattttttatgaactgtttaccatatgcactagcatagtggcggaggataaaaaaggccatttgatccacggtaggaatatggattttggagtctttctaggctggaatatcaataacgacacctgggtgatcacagaacaattgaaacccctgacggtgaacctcgatttccagagaaacaataaaaccgtgtttaaggcttcatcgttcgcaggatacgtaggaatgctgaccggatttaagcctggactttttagcctgaccttaaatgaacgcttctctatcaacgggggctaccttggaattctggaatggatcttaggcaaaaaagatgtaatgtggataggatttcttactagaacggtgctggagaattcaacatcctacgaagaggcaaagaacctgttgacaaagactaagattttggctccagcttacttcatcctaggcgggaatcagtccggcgaagggtgcgtgatcacccgcgaccggaaagaaagccttgacgtctatgagctggacgctaaacaggggcgatggtatgtggtacagaccaactatgatcgctggaagcatccatttttcctggacgaccggaggacgcccgccaagatgtgtctgaataggacatcccaggaaaacatctcattcgagaccatgtacgatgtgctctcaacaaagccagtcctgaataaactgaccgtttacaccactctcatcgacgtcaccaaagggcagttcgagacctacctgcgcgactgtcctgacccctgcataggctgg

SEQ ID NO: 17210 - DNA, 1185 bp, Artificial Sequence
  Description of Artificial Sequence: Synthetic coding sequence
atgcccggaaggtcttgcgtcgctctggtgcttctcgcagccgccgtatcctgcgccgtggcacagcacgcccccccatggactgaagattgtcgcaaatcaacctacccccccagcgggcccacatacaggggagccgtgccttggtatacaatcaacttggacctgcccccctacaaacgctggcatgagttgatgctggacaaggcacctgtgctcaaggtgattgtgaactccttgaagaatatgatcaatacttttgtgccttccggaaagattatgcaggtcgtggatgagaagctccccggcttgctgggcaacttcccgggtccattcgaggaggagatgaaaggcattgcagccgtgacagacatcccactgggagagatcatctccttcaacatcttctacgaactcttcaccatatgtacaagcatagtagccgaagacaagaaggggcacctgatccatgggaggaatatggactttggagtcttcttaggctggaacattaataacgacacatgggtgattactgagcagttaaagccactgacagtgaatctcgatttccaaaggaataacaagactgtgttcaaagcaagttcattcgctggatacgtcggaatgctgaccgggttcaagcctgggcttttctcccttacactaaacgagaggttttctataaacggtgggtatctcggtatcttggaatggatcctcggaaagaaggacgttatgtggataggcttcctgactcggacggtgctggagaattctacctcttatgaggaggccaagaacctcttaaccaaaacaaaaattctggcgcccgcttattttatcctcggggggaatcagtcgggagagggatgcgtcatcactcgggataggaaggagtcacttgacgtttacgagctggatgccaagcagggcaggtggtatgtagtgcagactaattacgacaggtggaagcatcctttttttctcgatgacagaagaactccggctaagatgtgccttaaccgcacctctcaggaaaatatttcatttgaaaccatgtacgatgtcctttccaccaaacctgtcctgaataagctgaccgtttacactaccctgattgatgtgactaagggtcagtttgaaacataccttcgcgattgtcccgacccttgcatcggatgg

SEQ ID NO: 17211 - DNA, 1185 bp, Artificial Sequence
  Description of Artificial Sequence: Synthetic coding sequence
atgcccggccgctcttgtgtagccctagtactgctggcagcggccgtcagctgcgcagtggctcagcacgctccaccgtggacagaagactgcaggaagagcacctaccctccctcggggccaacgtatagaggagccgtgccatggtacactatcaacctggacttacccccttataagaggtggcatgagctgatgctggataaggccccggtacttaaggtcatagtgaactcactcaaaaacatgattaatacgttcgtgccaagcgggaaaattatgcaagttgttgacgagaagttgccaggactgctggggaattttccagggcccttcgaagaggagatgaagggcattgcagctgtcacagacattcctcttggcgagataataagctttaacatattctatgaactgttcacaatctgtacctccatcgtggcagaggacaaaaagggacacctcatacatgggcgcaatatggattttggagtcttcctgggctggaatatcaataatgatacttgggtcatcaccgagcagctaaagcctctgacagtgaacttggactttcaacgaaataataagaccgtgttcaaggcctcttccttcgctggatatgttgggatgcttactggctttaaacccggcttatttagtcttactcttaatgagcgcttctccattaatgggggatatctgggaattctggagtggatcctcggaaaaaaagatgtgatgtggattggattcctcaccaggacggtgttagagaacagtacctcttatgaggaggctaaaaatctccttaccaagacgaagattttagccccggcctactttatcctgggaggaaaccagtctggagaaggctgtgtaataacccgagataggaaagagagcctcgacgtctatgagctcgatgccaagcagggcaggtggtatgtggttcagaccaattacgatcgctggaagcaccccttctttctggatgacagacgcactcctgcaaaaatgtgtctgaacaggacctcccaagaaaatatctcatttgagaccatgtatgatgtactgagtacaaaaccggttttgaataaactcactgtctacacaacactgattgacgtaacaaaaggccagtttgaaacatacctgcgggactgcccagatccctgcatcggatgg

SEQ ID NO: 17212 - DNA, 1185 bp, Artificial Sequence
  Description of Artificial Sequence: Synthetic coding sequence
atgccaggccgctcatgcgtcgccctagtgctgttggcggccgctgtgagctgcgcagttgcccagcacgctcctccatggaccgaagattgtcgcaaatccacttatcctccatcaggccctacttatcggggcgcagtcccgtggtataccatcaacctcgacctgcctccctacaagcgttggcatgagcttatgctggataaggccccagttctcaaagtcatcgtgaacagcctgaagaacatgattaacaccttcgtgcccagcggcaaaattatgcaagtcgtggacgagaaactgcctggtttactgggcaacttcccaggccctttcgaagaagagatgaagggcattgccgccgttaccgatataccactgggcgagatcattagctttaacattttctacgaattgttcactatctgcacctctatcgtcgcagaagacaagaaagggcatctgattcacggacgaaatatggatttcggcgtcttcttgggctggaacattaataacgatacatgggtcattaccgagcaattgaagccacttactgtgaatctggacttccagaggaataataaaacggtctttaaggcctcctccttcgcaggctacgtaggaatgctgaccggattcaagcccgggctattctctctcaccttgaacgagcggtttagcatcaacggcgggtatctgggcatcctggagtggatactgggcaaaaaggatgtaatgtggataggattccttactcggaccgtgctagagaattcaacatcttatgaagaagcgaagaatcttctgacgaagacaaaaatattggctccagcttacttcattttgggcggcaatcagtccggggaagggtgtgtcatcaccagggacagaaaagagtctctggatgtgtatgagctggatgcgaaacaaggacggtggtacgtggtgcaaactaactatgaccgatggaaacaccctttctttctcgacgacaggcgcacccctgccaagatgtgcctgaatagaacctcgcaagaaaacatcagctttgagaccatgtacgatgtattgtcaaccaagcctgtgctgaataagctgaccgtctacacaacactgatcgacgtcaccaaaggccagttcgagacatacctccgcgactgccctgatccatgcatcgggtgg

SEQ ID NO: 17213 - DNA, 1185 bp, Artificial Sequence
  Description of Artificial Sequence: Synthetic coding sequence
atgccgggccgatcgtgtgttgcactggtgttactggccgctgcagtgagctgcgcggtagcgcaacacgccccaccatggacagaagactgcagaaagtcgacttatccacctagtggaccgacctatcggggagccgtcccctggtacacaattaatctggacctcccaccgtataagagatggcacgaactgatgcttgataaagcaccagtcctgaaagtgatcgtgaactccctcaaaaacatgatcaatacctttgtgcctagtggcaaaataatgcaggttgtcgacgaaaagttaccggggctcctggggaatttccccggccccttcgaggaagagatgaaaggtatcgctgccgtgaccgacattcccctcggtgagataatttctttcaatatcttctacgaactattcacgatctgcacctctattgtggccgaggataagaaaggccacttaatccatgggaggaacatggactttggcgtcttcctggggtggaatatcaacaacgatacctgggtaattactgagcagctgaagccattaactgtaaatctggactttcaacgaaacaataaaactgtgtttaaggcctctagctttgctggctatgtgggcatgttgaccggctttaaacccggtctcttttccttgacgctgaacgagagattttccattaatggggggtatcttggtattctggagtggatcttgggtaagaaggacgtaatgtggattggtttcttgactcgcactgttctggagaattctacgtcttacgaggaggctaaaaaccttctaaccaaaacaaagatccttgctccagcatactttatcctggggggaaaccagagcggagaagggtgtgtgattacccgcgataggaaagaaagtctggatgtatacgaattggacgcaaagcagggcaggtggtacgtggttcagacaaattacgacagatggaaacatcctttcttcttggacgatcgccgtacgcccgccaagatgtgcctgaataggacttcacaggagaacatcagctttgagacgatgtatgacgtgcttagtacaaaacctgtcctgaacaaactcaccgtatacacaaccctaatcgatgtgactaaggggcagtttgagacctatctcagagattgtcctgatccgtgcattgggtgg

SEQ ID NO: 17214 - DNA, 1185 bp, Artificial Sequence
  Description of Artificial Sequence: Synthetic coding sequence
atgccgggtcggtcctgcgtcgcccttgtgctgctcgccgccgcagtgtcgtgcgcggtggctcaacatgcgccaccgtggactgaggactgccgcaagtcaacttacccgccgtcgggaccaacgtaccgcggagccgttccgtggtacaccatcaaccttgatttgcccccctacaagcgatggcatgaacttatgctggacaaggcaccagtcctgaaggtgattgtgaactcgctgaagaatatgatcaataccttcgtccccagcggcaagatcatgcaagtggtggacgagaaactcccgggcttgctgggcaattttccaggtcctttcgaagaagaaatgaaaggaatcgccgcggtcactgatatcccactgggagagatcatctcctttaacatcttctacgaactgttcacgatctgtaccagcatcgtggctgaggataaaaagggccacctcattcacggaaggaacatggactttggggtgttcctggggtggaacatcaacaatgacacttgggtgatcactgaacagcttaagcctctcactgtcaatctggatttccaacgcaacaacaagaccgtgtttaaggccagctccttcgcaggatacgtggggatgctgacgggattcaaaccgggactgttttccctgactctgaatgaacgcttttcaatcaacggcggctacctcggaattctggagtggatcctgggaaagaaggatgtcatgtggattgggttcctcaccagaaccgtgttggagaattctacttcgtatgaggaggcgaaaaacctcttgactaagaccaagattctcgctccagcatacttcatcctcggaggtaaccagtcaggagaaggttgcgttatcacccgcgacaggaaggaaagcctcgatgtgtacgaactggacgccaagcagggacggtggtacgtggtgcagaccaactacgacagatggaagcacccgttcttcctcgacgatcggcggaccccggccaaaatgtgcctgaatagaacttcccaggagaacatcagtttcgagactatgtacgatgtgctgtcgaccaaaccggtcctgaacaaactgaccgtctacaccactctcatcgacgtcacgaagggccagttcgaaacctatctgcgggactgtcctgacccttgcatcggatgg

SEQ ID NO: 17215 - DNA, 1185 bp, Artificial Sequence
  Description of Artificial Sequence: Synthetic coding sequence
atgcctggccggtcatgcgtggctctggtgctgctggccgcggcagtcagctgcgctgtagcccagcatgcgcccccatggaccgaggactgtagaaagtccacttacccgccttcgggcccaacgtacagaggtgccgtgccgtggtataccataaacctcgatctcccaccgtacaaacgctggcacgaactgatgctggacaaagcaccggtcctgaaggtgatcgtcaattcgctcaagaatatgattaacaccttcgtcccttcgggaaaaatcatgcaggtggtggatgaaaagctcccgggactgcttggcaacttccctggcccatttgaggaggaaatgaagggaatcgccgccgtgactgatatcccattgggagagatcatcagcttcaacatcttctacgaactcttcacgatctgtacttctatcgtggcggaggacaagaaaggacacctgatccacggaagaaacatggacttcggagtgttcctcggatggaacatcaacaacgacacttgggttatcacggagcagctgaagccgctgaccgtgaatctcgatttccaacggaataacaaaaccgtgtttaaggcttcatcatttgccggttacgtgggaatgctgaccggtttcaagcctggccttttttcgctcactctcaatgagcgattcagcatcaatggcgggtacctgggcatccttgagtggatccttgggaagaaggacgtgatgtggatcgggttccttactcgaacggtgttggaaaattcgacctcgtacgaagaagccaagaacttgctgaccaagactaagatcttggctccggcctactttattctggggggaaaccaatccggtgaggggtgtgtcattaccagagatcgcaaggaatccttggatgtctacgaactggacgcgaagcagggacggtggtacgtggtgcagaccaactacgaccggtggaaacatccgttcttcctggacgacaggcgcactccagccaagatgtgtttgaaccgcacctctcaagaaaacatctcatttgaaacgatgtatgacgtcctctccaccaagccggtgctgaataagctgaccgtatacactactctcatcgatgtgactaaaggtcagttcgaaacctacctgagagactgccccgatccgtgcataggctgg

SEQ ID NO: 17216 - DNA, 1185 bp, Artificial Sequence
  Description of Artificial Sequence: Synthetic coding sequence
atgccaggccgcagctgcgttgccttggtcctcctcgcggctgcagtttcttgtgccgtggctcagcacgccccgccttggactgaggattgccgtaagtctacctaccctccatcagggcctacataccgcggagccgtgccctggtatactatcaacttggacttgcccccgtacaagaggtggcacgaactgatgctggacaaggccccagtgttgaaagtcatcgtgaatagcctcaaaaatatgataaacacattcgttcctagtggcaagatcatgcaagttgtggacgaaaagctcccggggctgctcggaaacttccccggaccatttgaggaggagatgaagggcattgcggccgttactgacattcctttaggcgaaattatctcattcaacatcttttacgagctgtttacaatctgtacatcaattgttgccgaagataagaaggggcatctcattcacggtaggaacatggactttggggttttcttggggtggaatattaacaacgatacgtgggttatcacggagcagctcaagccccttactgtgaatcttgactttcaacgaaacaataagactgtgttcaaagcctctagcttcgcaggatatgtggggatgctgacgggctttaagcccggccttttcagcctgactctgaacgagaggttttcgattaatgggggctatctaggcatacttgagtggatactgggaaaaaaagatgttatgtggatcggctttctaacacggaccgttctggagaattctacctcttacgaagaggccaagaatctcttgactaagacaaagattctggcgcctgcttatttcattctgggaggtaaccagagcggcgaggggtgtgtaataactcgtgacagaaaagagagcctggatgtgtacgagctggatgccaaacaggggcggtggtatgtcgtccagacgaactacgaccgctggaagcaccctttcttcttggatgatagacgaaccccagcaaagatgtgtctgaatagaacaagccaggaaaacatttcttttgaaactatgtatgacgttctcagtaccaagccagttctgaataagctcaccgtttacaccacccttatcgatgtgactaaagggcagtttgagacatacctgagggactgccctgacccttgtattggttgg

SEQ ID NO: 17217 - DNA, 1185 bp, Artificial Sequence
  Description of Artificial Sequence: Synthetic coding sequence
atgcccggcaggtcctgtgtggcactcgtccttcttgccgcagccgtttcctgcgcggtggcccagcacgcgcctccgtggacagaggactgtcggaagagtacatatccaccttcaggcccaacctacaggggcgctgttccgtggtacacgatcaaccttgacctgcctccttataagaggtggcacgagctcatgctcgacaaggcgccagtgttgaaggttattgttaacagcctcaaaaatatgatcaacaccttcgtgccctcagggaagatcatgcaagttgttgacgagaaactccctgggctgctgggcaatttccctggcccattcgaggaggaaatgaaaggaatagcagctgtgaccgatatccctctcggggagattatcagcttcaatatcttttatgaactgtttactatctgcacttcaatagtcgcggaagacaagaaggggcacctcatacacgggagaaacatggatttcggggtattcctgggttggaatattaacaatgatacctgggtcattactgagcaacttaagccactgacagtcaacctggatttccagcggaacaataagacggtgttcaaggcttctagtttcgccgggtacgttggaatgttgaccggttttaaacccggtctgttcagcctcacgctgaacgaaagattttccatcaacggtggatatctcgggattttggaatggattttgggaaagaaagatgtcatgtggattggattcctgactcggactgttctggaaaactccacatcatatgaggaagcaaagaacttgctgaccaagaccaagattctcgcccccgcttacttcatactgggcggtaatcagtcaggcgaggggtgtgttatcaccagggaccggaaagaatcactcgacgtctacgaactggacgccaagcagggaaggtggtacgtggtacagactaactacgatcggtggaagcaccctttttttcttgacgacagacggactcccgctaaaatgtgtcttaacaggacttcccaggaaaatatttcttttgaaactatgtacgacgtgttgtctacaaaacccgttctgaataagcttacagtgtatacaaccctcattgatgttacaaaaggccagttcgagacgtacctgagagactgtccagatccctgtatcggatgg

SEQ ID NO: 17218 - DNA, 1185 bp, Artificial Sequence
  Description of Artificial Sequence: Synthetic coding sequence
atgccaggaagaagttgtgttgcacttgttcttttagctgctgccgtttcctgtgctgttgcacaacatgctcctccatggacagaagattgtagaaagtcaacttatccaccatctggtccaacctatagaggagctgttccttggtatacaattaatttagatttaccaccttataaaagatggcatgaactaatgttagataaggctccagtcttaaaggttatagttaattctcttaaaaatatgattaatacttttgttccatcaggaaaaattatgcaagttgttgatgaaaaattaccaggtttattaggaaatttccctggtccatttgaagaagaaatgaaaggtattgcagcagtaactgatataccattaggagaaataatctcatttaatattttttacgaactttttactatttgtacttccattgtagctgaagataagaaggggcatttaattcatgggcgtaatatggattttggtgtctttttaggatggaatattaataatgatacatgggtaattactgaacaattaaaaccacttaccgttaatcttgatttccaacgaaataataaaacagtatttaaagctagttctttcgcaggatatgttggtatgcttactggatttaaaccaggattattttcattaacacttaacgaaagattttcaattaatggaggatatcttggtattcttgaatggattttaggaaaaaaagatgtaatgtggattggatttttaacaagaacagtacttgaaaattcaacttcatatgaggaggctaagaatttattgactaaaacgaagatattagctccagcatattttattttaggaggaaatcaaagtggagaaggttgtgttataactagagatagaaaggagagtcttgatgtttacgaactcgatgcaaagcaaggaagatggtatgtagttcaaactaattatgatagatggaaacatccattttttctcgatgatagaagaactccagcaaaaatgtgtcttaatagaacttcacaggaaaatatatcctttgagactatgtatgacgttttatccactaaaccagtactaaataaattaacagtttatactaccttaattgacgttactaagggacaattcgaaacgtatcttagagattgtccagatccttgtattggatgg

SEQ ID NO: 17219 - DNA, 1185 bp, Artificial Sequence
  Description of Artificial Sequence: Synthetic coding sequence
atgccaggcaggtcgtgcgttgctttggtccttttggcggctgctgtcagctgtgcagttgcccagcacgctcctccttggactgaagattgccgtaaatctacatatcctccatctggtcctacatatcgaggcgcagttccgtggtatacaatcaacttggatcttccaccttataaacgatggcacgaacttatgctcgacaaggcaccagttctcaaagttattgtcaacagtcttaaaaacatgattaacacttttgttcctagtgggaaaattatgcaggtcgtcgatgaaaaactgccaggtcttttaggcaactttcctggaccattcgaggaagagatgaaaggtatcgcagcagttaccgatatccctctaggtgaaattattagtttcaacattttttacgagctgttcactatctgcacgagtatagttgctgaagataagaaaggacaccttatccatggacgtaatatggactttggggttttccttggttggaatatcaacaatgatacatgggtcatcaccgaacaattgaaacctcttacagtgaaccttgattttcaacgaaataataaaactgtttttaaggctagcagttttgcgggttacgtaggtatgctgactggattcaagcctgggcttttttcacttacacttaacgaaagattctcaatcaacggaggatatcttgggatccttgaatggattctgggcaaaaaagatgtcatgtggattggctttctcactaggacggttctggagaattctacaagctacgaggaagctaagaatctcctcacaaaaactaaaatcttggctcctgcttattttattttaggggggaaccaatccggggagggttgcgtgatcactagggataggaaggagtctttggatgtttatgagttggatgcaaagcaaggtaggtggtatgtggtgcaaacgaattatgataggtggaaacatccattttttttggatgatagacgtactcccgcaaaaatgtgtctcaatagaacaagtcaagaaaatatctcatttgaaaccatgtacgatgtattatccacaaaaccagtacttaataaactcacggtttatactacattgattgatgttactaaagggcaatttgaaacctacctaagagactgcccggatccgtgcatcgggtgg

SEQ ID NO: 17220 - DNA, 1185 bp, Artificial Sequence
  Description of Artificial Sequence: Synthetic coding sequence
atgccgggacgaagctgcgtcgccctagtgctgctggccgcagccgtgtcttgtgctgttgcacaacacgcaccaccttggactgaagattgcaggaagagcacatacccaccctctggccccacgtatcgtggagcagtcccatggtacaccatcaacttggaccttccgccctacaagaggtggcacgagttgatgctcgataaagcccctgtcctcaaggtgatcgtcaactccctgaagaacatgatcaatacgtttgttcccagcggaaaaattatgcaagtcgtggacgaaaagctgccaggcctgttgggaaattttcccggtccttttgaggaggagatgaagggaatcgcagcggtgacagacatcccactaggcgagataataagctttaatatcttctatgagctctttacaatatgcacatccatcgtggcagaagacaagaaaggccacctcattcatggccgcaacatggatttcggtgtctttctgggctggaacatcaataacgacacttgggttatcacggaacagcttaagccactcactgtaaacctagactttcagcggaacaataaaaccgtcttcaaggcctcaagttttgccgggtatgtaggcatgctaacaggctttaaaccgggtctctttagcctcacactaaacgagcggttcagtattaacggaggctacctgggtatcttggagtggatactagggaagaaagacgtgatgtggataggattcctcactagaaccgtgttggagaactccacaagctatgaagaggccaagaaccttcttactaaaactaagatcttggccccagcctacttcatccttggaggaaatcagtctggggaaggctgcgtgattacacgtgacagaaaggagtctctcgacgtctacgagctcgatgcgaagcaggggagatggtatgttgtccagaccaattatgaccgctggaaacacccattttttctggatgacaggagaactccagcaaaaatgtgcctaaaccgtacgtctcaggagaacatcagctttgaaactatgtacgatgtgctgagcacaaagcccgtcctgaacaaactaactgtctacactaccctgatagatgtgacaaaaggacagtttgagacgtatctgcgagactgtccagacccatgcatcggctgg

SEQ ID NO: 17221 - DNA, 1185 bp, Artificial Sequence
  Description of Artificial Sequence: Synthetic coding sequence
atgcccgggagatcatgcgtcgccctggtcctcctggccgccgcggtttcatgcgcagtggcacagcacgctccaccctggactgaagattgtcgcaagtccacgtatccaccttcgggtcctacctaccgcggggcggtcccttggtacaccatcaatctggatcttcccccgtacaaaagatggcatgagttgatgctggataaggcgccggtgctcaaggtgatcgtcaacagccttaagaatatgattaacacttttgtgccttcgggcaagatcatgcaagtcgtggacgaaaagctgcctggcctgcttggaaatttccctggtccgttcgaagaggagatgaaagggatcgccgccgtgaccgacatcccgctcggagaaatcatctcgttcaatatcttctacgaactcttcactatttgcacctcgattgtggctgaggacaagaaaggacacctgattcatgggcgtaacatggacttcggcgtgttccttggatggaatatcaacaacgacacttgggtgatcaccgaacagctgaaacctctcaccgtcaacctggatttccaaaggaacaacaaaactgtgttcaaggcctcctcatttgcgggctacgttggtatgcttaccggattcaagcccggactgttttcactgaccctgaacgaacggttctcgatcaatggaggttacttgggaattctggaatggatcctgggcaagaaagacgtgatgtggatcggtttcctgactcggaccgtgttggagaactccacgtcttacgaggaggcgaaaaacctgctgactaagaccaagatcctcgccccggcttacttcatactcgggggaaaccagtcaggagagggatgcgtgatcactcgcgatcgcaaggaatccctggacgtgtacgaactggacgcgaagcagggacggtggtatgtcgtccagactaattacgataggtggaagcacccgtttttcctcgacgaccggaggactccggcgaaaatgtgcctgaacaggacttcccaagagaacatttccttcgaaaccatgtacgacgtgctgtccacgaaaccggtgttgaacaagctgacggtgtacactacccttatcgatgtcacgaagggtcaatttgaaacttatctgcgggattgtccggacccatgcatcgggtgg

SEQ ID NO: 17222 - DNA, 1185 bp, Artificial Sequence
  Description of Artificial Sequence: Synthetic coding sequence
atgccggggaggtcatgcgtggccctggtgttgctggccgcagcggtttcatgtgcagtggcacaacatgccccaccgtggaccgaagattgcagaaagtccacctacccaccctcgggacctacgtatcgcggagcggtgccgtggtacaccattaatctggacttgcctccctacaagcggtggcacgaactgatgctcgacaaggcaccagtccttaaagtcatcgtgaattcactcaagaatatgatcaacaccttcgtcccgtcaggtaagatcatgcaagtggtcgacgaaaaacttccagggctcctcggaaacttcccgggaccgtttgaagaggaaatgaaggggatcgcagcggtgacggatatcccattgggggagattatctcattcaatatcttctacgaactgttcaccatctgtacttcgatcgtggccgaggacaagaagggacaccttatccacggtcgcaacatggacttcggcgtctttctgggatggaatatcaacaacgatacctgggtgattaccgagcagctgaaacccctgactgtgaacctggacttccagcgaaacaataagaccgtattcaaagcgtccagcttcgcggggtacgtcggaatgctgaccggtttcaaaccaggcctgttctcgctgactctgaacgagcggttctcaatcaacggcgggtacctggggattctcgagtggatcctcggaaagaaagacgtgatgtggattggtttcttgaccagaactgtgttggaaaactcaacttcctacgaagaggccaaaaatctgcttaccaaaactaagatcctggcaccggcttactttatcctgggtggcaaccagtcgggggaaggatgtgtgatcactagagatcgcaaggagtcgctggacgtgtacgaactcgacgcgaaacaaggcagatggtatgtcgtgcagaccaactacgatcggtggaagcatccattctttctggacgatcgcagaacccctgctaaaatgtgcctcaaccggacctcccaagagaatatctcctttgaaacgatgtacgatgtgctgtccactaaaccggtcttgaacaagttgaccgtgtacacgactcttatcgacgtaaccaagggacagttcgaaacctacttgcgggattgcccggacccttgcatcggctgg

SEQ ID NO: 17223 - DNA, 1185 bp, Artificial Sequence
  Description of Artificial Sequence: Synthetic coding sequence
atgcccggtaggagctgtgtcgccctcgtgctgcttgcagccgccgtgtcgtgtgcggtcgcccagcatgcacctccgtggaccgaggactgcaggaagtcgacctaccccccgtcgggaccaacttacagaggcgcagttccctggtacacgatcaatctggacctccccccgtacaagagatggcacgaactgatgcttgataaggcaccggtgctgaaagtgattgtgaacagccttaagaacatgatcaacacttttgttccctcgggcaagataatgcaggttgtggatgaaaaactgcctggacttttggggaactttcctggacctttcgaggaggagatgaaaggcatcgctgcggtgacggatattcctctcggagagatcatttcctttaacatcttttacgaactgttcaccatctgcacctccattgtggcagaggacaaaaagggacacctgattcatggtcgcaatatggactttggagtgtttctggggtggaacattaacaatgacacttgggtcattactgaacagttgaagcctctgactgtgaaccttgactttcaacgcaataacaagacggtgttcaaagcatcgtctttcgctggctatgtcggtatgctgactggcttcaagcctgggcttttcagccttactctgaacgaacgcttcagcattaatggcggttatctgggaatactggagtggatacttgggaaaaaagacgtgatgtggatcggatttctcactagaactgtgctcgaaaactccacctcgtacgaagaagctaaaaaccttctcaccaagacgaaaatcctggcacccgcgtacttcatactgggaggaaatcaatccggtgagggttgcgtcatcactcgggatagaaaggaatccttggatgtgtacgaactcgatgccaagcagggcagatggtatgtcgttcaaaccaattacgacaggtggaagcatccttttttcctggacgatagacgcactccagcaaaaatgtgtctgaatagaaccagccaagagaacatttcgtttgaaaccatgtacgatgtcctttccacgaagcctgtgcttaacaagctcaccgtgtacacgacccttattgatgtgaccaaaggtcaattcgaaacctaccttagggattgtccagatccatgtattggatgg

SEQ ID NO: 17224 - DNA, 1185 bp, Artificial Sequence
  Description of Artificial Sequence: Synthetic coding sequence
atgccagggcgctcatgcgtcgcactggttctgttggccgctgctgtgtcatgtgccgtcgctcaacacgcgcctccctggacggaagattgtcgcaaaagcacttacccaccgtctggccctacttacaggggtgccgtgccatggtatactatcaacctggatcttcccccctacaaacgctggcacgagcttatgctggacaaggctccagtgttgaaggtcattgtgaactctctgaagaatatgattaacacattcgtgcctagtggaaaaataatgcaggtggtggacgagaagctccccgggctgctgggcaacttcccaggtccatttgaggaggaaatgaagggcattgcagcagtcactgacatcccactgggtgagatcatcagtttcaacatattttatgaactttttactatctgcacatcaattgtcgccgaagacaaaaaaggacacctgatccacgggcgaaacatggacttcggcgtctttctggggtggaacataaataacgatacctgggtgattacagaacaactgaaaccgctcaccgtgaaccttgactttcagcggaataataagaccgtgttcaaagcttcatcttttgcaggatatgtggggatgctcaccggatttaaacccggcctcttttccctcaccctcaatgagcggttttcaatcaacggggggtatctcgggatcctggagtggatccttgggaagaaagacgttatgtggattggttttctcacccgcacggttttggagaactccactagttacgaggaggctaagaaccttttgaccaagactaagatactcgcaccagcatattttatcctgggcggtaaccagtccggagaaggatgtgtcatcaccagagaccgaaaagaaagtctggatgtatatgagctggatgcgaaacaaggccgatggtatgtggtgcagacaaactacgacaggtggaagcatcccttttttttggatgaccggagaacacccgccaagatgtgcctcaataggacctcccaagaaaatattagtttcgaaacgatgtacgacgttctgagcaccaagcctgtgctgaacaaacttaccgtctacaccaccctgatcgatgtcaccaaaggacagtttgaaacatatctcagggactgtccagatccctgtattggctgg

SEQ ID NO: 17225 - DNA, 1185 bp, Artificial Sequence
  Description of Artificial Sequence: Synthetic coding sequence
atgccgggtaggtcttgtgtcgcccttgttctgctggcagcagcggtcagctgtgcagtcgctcagcatgccccaccctggacagaagactgtagaaagtcgacctacccaccctcaggccccacatatcgaggcgcggtaccctggtacaccataaacctcgaccttcctccctacaaacgatggcatgaactaatgcttgacaaggcacctgtgctgaaagtgattgtaaattcactgaagaacatgatcaacacatttgtcccgagcggcaagattatgcaggtggttgatgaaaaactgcccggccttttgggcaacttccccggcccgtttgaggaagaaatgaaggggatagcagccgtcacagatatccccctcggagaaataatctctttcaatatcttctacgagctgtttaccatttgcacaagcatcgtcgcagaagacaaaaaggggcacctgatccatgggcggaatatggactttggcgtttttctaggttggaatattaacaacgacacatgggtcattacagaacaattgaaacctttgaccgtgaatctggactttcaaaggaataacaaaacagtgttcaaggcaagttcattcgctggatatgtgggaatgctaactggattcaagccagggctgttctcattgaccctgaacgagagattttcaattaacggcggttacctggggatactcgagtggatcctggggaagaaggacgtcatgtggataggctttctcacgcgcacagtcctcgagaattcaacaagctacgaagaagccaagaacttactgacaaagaccaagatactggcacccgcctactttatcttgggagggaaccaatctggggaaggatgcgtgatcacccgcgatcgcaaagaaagtctagacgtttacgagctagacgcaaaacaaggcaggtggtacgtggtgcagacaaactacgacaggtggaagcatcccttctttctggatgacagacggacgcccgctaagatgtgtctaaatagaacttcacaagagaacatttcttttgagacaatgtacgacgtgctttccaccaaaccggtgcttaataaactgacagtgtacacaacactcatcgacgtgaccaaaggacaattcgaaacatacctccgggactgtccagacccgtgcatcggctgg

SEQ ID NO: 17226 - DNA, 1185 bp, Artificial Sequence
  Description of Artificial Sequence: Synthetic coding sequence
atgccagggcgctcctgtgtcgcgctcgtgttgctggctgccgccgtgtcatgcgccgttgctcaacacgcgccaccctggaccgaagattgccgcaaatcgacttatccaccatcaggaccaacttaccgcggggccgtcccgtggtacacgatcaatctggacttgccaccatacaagcgctggcatgaacttatgctggacaaggcgcctgtcctcaaggtgatagtgaactcgttgaagaatatgatcaacacttttgtgccttcgggtaaaatcatgcaggtggtggacgaaaagctccctggcctcctgggcaacttccccggacctttcgaggaggaaatgaagggaatcgccgcagtcactgatattccgctgggtgagatcatctcgttcaacatcttttacgagctcttcaccatttgcacctccatcgtcgccgaggacaagaaggggcacttgatccacggacgcaatatggacttcggcgtgttcctggggtggaacattaacaacgacacttgggtgatcaccgaacagctcaaacctctgaccgtcaatctcgactttcaacggaacaataagaccgtgttcaaggcctcatccttcgctggatacgtcgggatgctgaccggattcaaaccgggacttttttcactgaccctcaacgagcgtttctcgatcaatggtggctacctgggtattcttgaatggatcctgggtaaaaaggatgtcatgtggatcggatttcttactcgcaccgtgcttgagaactccacttcatacgaggaggcgaagaacctgctcaccaagaccaagatcctcgcgccagcctactttatcctgggaggaaaccaaagcggcgagggctgtgtgatcaccagagatcggaaagagtcccttgacgtgtacgaacttgatgctaaacaagggagatggtacgtcgtgcagaccaactacgaccgctggaagcatccattcttccttgacgatcggagaacccctgccaaaatgtgtttgaaccggaccagccaagaaaacatctcgttcgaaaccatgtacgacgtgctttcgaccaaaccggtgctgaataagctgaccgtgtacactaccctgattgacgtgactaaagggcagttcgagacttacttgcgggattgcccggatccgtgcattggctgg

SEQ ID NO: 17227 - DNA, 1185 bp, Artificial Sequence
  Description of Artificial Sequence: Synthetic coding sequence
atgcctgggagatcgtgtgtggcacttgtgctgctggcagcagcagtgtcttgtgcagtggcacagcatgcaccgccttggacggaagattgccgaaagtcaacgtatccgccgtcagggccaacttaccgcggtgccgtgccctggtacaccatcaatcttgatctgcctccatacaagcggtggcatgaactcatgttggataaagcaccagtgcttaaggtgatcgtgaactccttgaagaacatgattaacacgtttgtcccttcaggcaagatcatgcaagtggtggatgaaaagctgccaggtctgttggggaattttcccggacccttcgaggaggaaatgaaaggtattgccgcggtcaccgacattccgctgggtgaaatcatctcgtttaacattttctacgaactctttaccatctgtacttcaattgtggcggaagataagaaagggcaccttattcacggccgcaatatggattttggcgtgtttctgggatggaacattaacaacgacacttgggtgattaccgaacagcttaagcccctgaccgtgaatctggactttcagaggaacaacaagaccgtctttaaagccagctcctttgcaggctacgtgggaatgctgacgggtttcaagccaggactgttcagccttactctgaatgagcgcttctcgatcaacggaggataccttggcattcttgagtggattcttggaaagaaggatgtcatgtggattggttttcttactagaaccgtgctggaaaactctacttcgtacgaggaagctaagaatctccttactaagaccaagattctggcgcctgcatacttcatccttggtggtaaccaatcaggtgaagggtgtgtcattactcgggaccgtaaagagtcgcttgatgtgtacgagctcgatgctaaacaaggacgatggtacgtggtgcaaaccaattacgatcggtggaagcaccctttctttttggatgatagacggacgcccgcaaaaatgtgtttgaacaggacttcccaagagaatatcagctttgagacgatgtacgacgtgctgtcaaccaagccagtgctgaacaaactgactgtgtacactaccctgattgacgtgactaagggccagttcgaaacctatctgagggattgtcctgatccgtgcatcggatgg

SEQ ID NO: 17228 - DNA, 1185 bp, Artificial Sequence
  Description of Artificial Sequence: Synthetic coding sequence
atgccggggcgttcatgtgtggctcttgtattgctggccgcagcagtatcatgtgccgtcgcccaacatgcaccaccatggacggaagattgtcgcaagagtacttatccaccgtccggtcctacttatagaggagctgtaccttggtacacaattaatctggatctcccaccatacaagagatggcatgaattgatgctagataaagctcccgttttgaaagtgattgttaactccctgaaaaatatgattaatacatttgtcccttccggcaaaatcatgcaagtcgttgatgaaaagcttccaggattgttgggaaattttccgggaccatttgaagaggagatgaaaggaatcgcagcagttaccgacatcccattgggagaaattatctcgtttaatattttctacgagttgtttaccatttgtacatctattgtggctgaagataaaaagggacacctgattcatggacgaaatatggattttggtgtgtttctagggtggaatataaataatgacacttgggtcattactgaacaacttaagcctctaacagtaaatttagattttcaaagaaataacaaaactgtttttaaggcttcttcgttcgcaggatatgttggtatgttgaccggatttaaaccaggactcttctcgcttactttgaatgaaagattttcaataaatggaggatatcttggaattttggaatggattttggggaagaaggatgtcatgtggattggttttctgacgaggacagtgctggagaacagtacttcttatgaggaagccaaaaacctgctcacaaagaccaagatcctcgcaccagcctactttattctcggtggaaatcaatctggtgaaggctgcgttattaccagagatagaaaggaatcgcttgatgtctacgaactcgatgcaaagcagggacgatggtatgtggtccaaactaactatgatcgttggaaacacccgtttttccttgatgatcgtcgaaccccagccaaaatgtgtctcaacagaacatcccaagagaatatcagtttcgaaacaatgtatgatgtactctcaacaaaacctgtgctcaataagttgactgtgtacactactttgattgacgtaacgaaaggacaatttgaaacatatttacgcgactgcccagacccgtgtatcggatgg

SEQ ID NO: 17229 - DNA, 1185 bp, Artificial Sequence
  Description of Artificial Sequence: Synthetic coding sequence
atgccagggcgctcgtgtgtggcactggtccttctggcagcagcagtgtcctgtgccgtcgcacaacatgctccgccatggaccgaggactgcaggaagtcgacctacccaccatccggccctacctacaggggagcagttccttggtacacgattaacctggacctgcctccatataagagatggcacgagctgatgcttgacaaggcgccagtcctcaaggtgattgtgaacagcctgaagaacatgataaacacctttgtcccctccggtaagataatgcaggtggtcgatgaaaaacttcccgggcttcttggcaactttcctggtccctttgaagaagagatgaagggaatcgcagcagtcacggacattcccctgggcgaaatcatttcatttaacatcttctacgaattgtttaccatctgtacctctatagtggccgaggacaaaaagggtcatctcattcatggaaggaatatggactttggtgtctttcttggttggaacattaacaatgatacctgggtcatcaccgaacaactgaagcccctgactgtgaacctggactttcagcgcaacaacaagactgtgttcaaggcgagcagcttcgctggttacgtgggtatgcttaccggatttaagcctggactgttttcactgactctgaacgaaagattttcgattaacgggggttacctgggaatcctggaatggatcctgggtaagaaagatgtcatgtggattggctttcttacgagaactgtcctggaaaactcaacttcgtatgaagaggcaaagaatctcctgaccaaaactaagatccttgcacctgcgtactttattctgggagggaaccaatcgggtgaggggtgtgtgataacccgcgaccggaaagagtcgctggatgtgtatgagctcgatgcaaaacaagggagatggtacgtggttcaaactaactacgatcgctggaagcacccgttttttcttgacgatcgcagaaccccggccaaaatgtgcttgaatcgcacgtcacaggaaaacatttcctttgagactatgtacgatgtcctttctaccaagcctgtgcttaacaagctcaccgtctacaccactcttatcgatgtcaccaagggacaattcgaaacctaccttcgggactgcccagatccgtgtatcggctgg

SEQ ID NO: 17230 - DNA, 1185 bp, Artificial Sequence
  Description of Artificial Sequence: Synthetic coding sequence
atgccgggacggtcgtgtgtggcgctggtgctcctcgcagctgcagtgtcctgcgcagtcgcacagcatgcacccccgtggacggaagattgccgcaagtccacttaccctccttcagggccaacttacagaggtgctgtcccatggtacaccattaatctggatctccctccatacaaaaggtggcacgagctgatgctggacaaggcacctgtccttaaggtcatagtcaactctctgaagaacatgattaacacttttgtcccatccgggaagattatgcaggtggtggacgagaagctgccaggattgctgggaaactttcctggtcctttcgaggaagaaatgaagggtattgccgccgtcaccgacatcccactgggagagatcatctcattcaatatcttctacgaattgttcacgatctgtacgtctattgtcgcagaagataagaagggacatctgatacacggccggaacatggactttggagtattcctgggctggaacattaacaatgatacttgggtgatcactgagcaactgaaacctctcacggtcaatctcgactttcaacgtaacaacaagaccgtgtttaaggcttcgtccttcgccggatacgtggggatgctcactggattcaaacctggattgttctcccttactctcaatgagcgtttttccatcaacggcggttaccttggaatccttgaatggatcctgggaaagaaggatgtgatgtggattggttttctgaccagaacggtgctcgaaaactcgacctcatatgaagaggcgaagaatcttctgaccaagaccaagattcttgcacctgcctacttcattctgggtgggaaccaatctggagaaggttgcgtgattacccgagatcggaaggaatcactggatgtgtatgagttggatgcgaagcagggaagatggtacgtggtgcaaacgaattacgaccgctggaaacatccattctttctcgacgacaggcggacgccggcaaagatgtgcctgaaccggacttcgcaagaaaacatttcctttgaaaccatgtacgatgtgctcagcacgaagcccgtgctgaataaacttactgtctacactacccttatagatgttactaagggacagtttgaaacctaccttcgggattgtcctgacccctgtattggttgg

SEQ ID NO: 17231 - DNA, 1185 bp, Artificial Sequence
  Description of Artificial Sequence: Synthetic coding sequence
atgccaggacggtcatgcgtggctttggtgctgctggccgctgctgtgagctgcgctgtcgcgcaacacgctccgccttggaccgaggactgcaggaaatcgacctacccgccgtcaggacctacctacaggggagcagtgccatggtacactatcaatttggatctgcctccgtacaagcgctggcatgagctgatgctggataaggctccggtgctcaaggtgatcgtcaactcgctgaagaacatgatcaacacctttgtgccgtcgggtaagatcatgcaggtggtcgacgaaaagctgccgggcctcctgggcaacttcccgggaccattcgaagaagaaatgaaggggatcgccgccgtgaccgacatcccgctgggagagatcatctcattcaacatcttttacgagttgttcacgatctgcacttccattgtggccgaagataagaagggtcacttgatccacggcagaaatatggacttcggtgtgttcctgggatggaacattaacaatgatacctgggtgatcaccgaacagcttaagccactgactgtgaatctggatttccaacgtaacaacaaaactgtgttcaaggcgtcctcctttgcaggatacgtcggaatgctgacgggatttaagccaggactctttagtctcacccttaatgaaagattctccatcaacggaggctacctgggaatcttggaatggatcctgggtaaaaaggatgtgatgtggatcgggtttctgaccagaaccgtccttgagaattcgacttcgtacgaggaagccaaaaatcttttgactaagactaaaatcctggcccctgcttacttcattctcggaggaaatcaaagcggagagggatgcgtcatcacccgagataggaaggagtccttggatgtgtacgagcttgacgccaagcagggacgctggtacgtggtccaaaccaactacgaccggtggaagcatccgttcttcctcgacgatcgccgcaccccagcaaagatgtgtctcaaccggacctcacaggaaaacatctcgttcgagactatgtacgacgtgctctccactaagccggtgttgaataagttgaccgtgtacaccaccttgatcgacgtgacgaaaggtcagttcgaaacttatctgagagactgcccggacccgtgcatcggatgg

SEQ ID NO: 17232 - DNA, 1185 bp, Artificial Sequence
  Description of Artificial Sequence: Synthetic coding sequence
atgccagggcgttcctgcgtggcactggtgctgctcgcagctgccgtgtcctgcgccgtagcacagcatgcacccccatggactgaagattgtcgcaaaagcacctacccgccttcgggccccacttacaggggggccgtaccgtggtacactataaacttggacctcccgccgtataagcggtggcatgagctgatgctcgacaaagcgccggtcctgaaggtcatcgttaacagcctgaagaacatgatcaacaccttcgtgcccagcggaaaaatcatgcaagtggtggacgaaaaactcccgggcttgctggggaacttcccaggtccgtttgaagaggaaatgaaaggaatcgccgcggttacggacattcctcttggagaaatcatatcattcaatatcttctatgaactgtttactatctgcacctctatcgtggccgaagataagaagggacacctcatccacggaagaaatatggacttcggagtgttcctcggctggaacatcaacaacgatacttgggtgatcactgagcagctcaagccattgaccgtgaacctggactttcagcgcaataacaagaccgtgttcaaggcatcctcctttgccgggtacgtgggaatgctgacgggattcaagcctggactgttctcgctgactcttaatgaacgcttctccatcaacggagggtacctcggcatcctggagtggattcttggtaagaaagacgtcatgtggattggcttcctgaccaggacggtgctggaaaactctacttcgtacgaggaggcgaaaaatctgctcactaagactaaaatcctggctcctgcgtactttatcctcggaggaaatcagtcgggcgagggctgcgtgattaccagggaccggaaggaatcgctggatgtctatgagctggacgcaaaacaaggacgatggtacgtggtccagaccaattacgatcgatggaagcacccgttcttcttggatgacaggcgcacccccgccaaaatgtgtctgaatagaacgtcacaagagaacattagctttgagactatgtacgatgtcctgagcaccaagcctgtgctcaataagctgactgtctacaccacgctgatcgacgtcactaagggacagttcgaaacttacctccgcgattgcccggacccatgcatcggatgg

SEQ ID NO: 17233 - DNA, 1185 bp, Artificial Sequence
  Description of Artificial Sequence: Synthetic coding sequence
atgcctggccgatcctgcgtggcactggtgctactggccgcagccgtgagctgcgcagtggcgcagcatgctccaccatggactgaagattgcaggaaaagcacgtatccgccctccggaccaacctaccgaggcgcggtaccttggtatacaataaatcttgaccttcccccttacaaacgatggcacgaattgatgttggataaggcccctgtattaaaggtgatagtgaactccctgaaaaatatgatcaatacattcgtcccctccgggaagatcatgcaagtcgttgacgagaaactcccaggcctgctggggaattttcctggtccgtttgaggaagaaatgaaagggatcgctgcagtcaccgatatccctctgggcgaaattattagctttaatatcttttatgaacttttcacgatctgcacaagcatagtcgccgaggacaaaaagggtcacttaatccacggacgtaacatggatttcggggtgttcttggggtggaacatcaataacgatacctgggtaattaccgagcagcttaaacctctcaccgttaatctcgacttccagcgaaataataaaaccgtctttaaggcttcctccttcgcaggctacgtcggaatgcttactggattcaagccagggttattctctttgactcttaatgagagattttccattaacggtggatacctcgggattttggaatggattctcggcaagaaggatgttatgtggatcggctttcttacgcgaacagtactggagaactcaacatcatatgaagaggccaaaaatctacttacaaagactaagatcctggccccagcttatttcattctgggtggaaatcagtctggtgagggatgtgtgattacccgagaccgaaaggaaagtctcgacgtgtacgagctggatgccaaacagggccgatggtacgtggtgcagaccaactatgatagatggaaacatccctttttcctggacgaccgtaggaccccggcaaaaatgtgtctgaatagaacgagccaggagaatatctcattcgaaaccatgtacgacgtgctgtctacgaaaccggttctcaacaagctaacagtttatacgactctgatcgacgtaaccaaaggccagtttgagacttatctgagggattgtcccgacccttgcatcggctgg

SEQ ID NO: 17234 - DNA, 1185 bp, Artificial Sequence
  Description of Artificial Sequence: Synthetic coding sequence
atgcctggccgctcttgtgtggccctggtgctgctggctgctgctgtaagctgcgctgttgcacagcacgcacctccatggaccgaggactgtcggaagtcaacgtaccctccctctggtcccacttacaggggggccgtgccttggtacaccattaaccttgacttgcctccatacaagagatggcacgagttgatgctcgacaaggcacccgtgctgaaagtgatagttaatagtctcaaaaatatgataaatacattcgtgccatcagggaagattatgcaggtcgttgacgaaaagctgccagggcttctcggcaacttcccagggcctttcgaggaggaaatgaaaggtatagcggccgtcacagatatccccttgggcgaaattatttctttcaatattttttacgagctgtttaccatttgtaccagcatagtggccgaggacaagaaaggtcatttgattcacggtaggaatatggactttggggttttcctgggatggaatatcaacaatgatacttgggttataaccgaacaactgaaaccccttaccgtgaacctggattttcagagaaataataaaaccgtgttcaaagcgagttcttttgccgggtacgtcggcatgcttacaggttttaagccaggactgtttagcctaacactgaacgaacgctttagcatcaacggtggctacctgggcatcctggaatggattctgggaaaaaaggatgtgatgtggattggttttctgaccagaacagtccttgagaactccaccagttacgaggaagccaaaaacctactgacgaagaccaagatccttgcgccagcgtactttatcctgggaggcaatcagtcaggggagggctgcgtcataacaagagatcgcaaggagtccctcgatgtgtatgagctcgatgctaaacaaggtaggtggtacgtggtccagacgaattatgaccggtggaaacatccattctttctggatgaccggcgcacgcctgcgaagatgtgcctcaaccggacatctcaggagaatatctctttcgaaaccatgtacgacgtgttgagcacaaaaccagttttgaataaactaaccgtgtacacgaccctaatcgatgttactaagggccagttcgagacatacctccgggactgcccggacccatgtatcggctgg

SEQ ID NO: 17235 - DNA, 1185 bp, Artificial Sequence
  Description of Artificial Sequence: Synthetic coding sequence
atgcctgggcgaagctgtgtggcattggtacttctcgccgctgcagtgtcctgtgccgtggctcagcacgctcctccatggacagaagattgccgcaagtccacctacccgcctagcggaccaacttatagaggggcagtaccctggtacacaattaatctggatctcccaccatacaagcgctggcatgaactaatgcttgacaaggcccccgtgcttaaggtgatcgtgaattcactgaaaaacatgattaatacctttgtgccatctggtaaaatcatgcaggtggtcgatgaaaaactccctggacttttaggtaacttccccggtccgtttgaggaggaaatgaagggaattgctgcagttaccgatatccctctcggtgagatcattagctttaatattttctacgaattattcactatttgcacaagtatcgtggctgaggacaaaaaaggccaccttattcacggccggaacatggattttggcgtgttccttggctggaatatcaataacgatacctgggtcatcaccgaacagttgaagccactcactgtgaaccttgactttcagaggaacaacaaaacagtgttcaaagcttccagttttgctgggtacgtaggcatgctcactgggtttaaacctgggctcttctcccttacactcaacgagagattctccataaacggcggctacctcgggatactcgaatggattcttggcaaaaaggacgttatgtggatcggattcctgacccggaccgtattggagaattcgactagctacgaagaggccaagaatctgcttactaaaaccaagatcctcgctccagcttactttatcctagggggaaaccagagcggcgaaggctgcgtgatcacccgggacaggaaagagtccctcgatgtgtatgagcttgatgcgaaacaaggacgatggtacgtggtccagactaattacgaccggtggaaacacccatttttcctggacgatcgccggacgccagcaaaaatgtgcttgaatcgcacatcacaagaaaacatcagcttcgagacaatgtatgatgtgttgagtaccaagccagtgctgaacaagctgacagtttacactactttgatagatgtgacgaagggacagttcgagacttacttaagggattgtcccgatccctgtatcgggtgg

SEQ ID NO: 17236 - DNA, 1185 bp, Artificial Sequence
  Description of Artificial Sequence: Synthetic coding sequence
atgcccggtcgctcctgcgtcgcattggtgctgctcgcggccgctgtctcttgcgccgttgcgcagcacgcgccaccctggacggaggattgcagaaaatcgacttaccctccctcggggcctacatatcgcggcgcggttccctggtacaccatcaacttggatttgccgccctacaagcgctggcatgaactcatgctggataaggcccccgtcctcaaggtcattgttaacagcctgaagaatatgatcaataccttcgtcccttcgggtaagattatgcaggttgtcgacgagaaactccccggtctgctgggcaacttcccgggtccctttgaagaagaaatgaagggtatcgctgccgtcacagacattccactgggcgagatcatttcgtttaacatcttctacgaactgtttaccatctgtacctcgattgtcgctgaagataaaaagggccacttgatccatggccggaacatggatttcggggtgttcctgggctggaacattaacaacgacacctgggtcataaccgagcagcttaagccgctcactgtcaatcttgacttccagcgcaacaacaagaccgtgttcaaggctagttcttttgctggttacgtcggcatgctaaccggtttcaagcctgggcttttttctctaaccctcaacgagcgtttctccattaatggcggttacctcggcatcttggagtggatcctgggtaagaaagacgttatgtggatcggcttcctgacacgtaccgttttggagaactcgacttcatacgaagaggccaagaacctcttaaccaagacaaagatcctggcaccggcatatttcatcctgggcggtaaccagagtggagaagggtgcgttatcacacgggaccgaaaggagtcgttggacgtttacgaactagacgccaagcagggacgctggtacgtagtgcaaaccaactacgaccgctggaagcacccgttcttccttgacgaccgccgtactcctgctaagatgtgtctgaaccgcacctcccaggagaacatcagtttcgagacgatgtacgacgtcttgagcactaaaccggttcttaacaaactgactgtttacaccaccctgattgatgtcactaagggacagttcgagacttacctgcgtgactgtccggacccctgcattggctgg

SEQ ID NO: 17237 - DNA, 1185 bp, Artificial Sequence
  Description of Artificial Sequence: Synthetic coding sequence
atgccaggccgttcctgtgtggccctggtgctccttgcagcagccgtgagctgtgcggtcgcacaacacgcgcctccatggactgaggactgccgaaagtcaacctacccaccaagtggacctacttaccggggcgcagtaccctggtacaccattaacttggaccttccgccctacaaacgatggcatgaactgatgttggataaggcccctgttcttaaggtgatcgtgaattcccttaagaacatgatcaatacctttgtcccatccgggaagattatgcaggtggttgatgaaaagctgcccggcctgctcggcaatttcccgggtcctttcgaagaagaaatgaaagggattgcagcggttaccgacattcccttgggagagattatctcgttcaacatcttttacgaactgtttaccatttgtacctcaatcgtggccgaggacaaaaaaggacatctgattcatggaagaaacatggattttggggtctttcttggatggaacatcaacaacgatacttgggtcataactgaacagctcaaacctcttactgtgaaccttgactttcaaaggaataacaagaccgtgtttaaggcatcatcgtttgccgggtacgtgggaatgcttactgggtttaagcctggtctgttctccctgaccctcaacgagagattttcgattaatggaggataccttggaatccttgagtggatattggggaaaaaagatgtcatgtggatcgggttccttacccggactgttctggagaactccacttcatatgaggaagccaagaacctcctgactaagactaagattcttgctcccgcatatttcattctcggagggaatcagagcggcgaaggatgtgttataacccgcgatagaaaggaatcgctggatgtgtacgaactcgatgccaagcaaggtcgatggtacgtggtccaaactaattacgaccggtggaagcacccttttttcttggatgatcgtcgcaccccagctaagatgtgcctgaacagaacgagtcaggaaaacatctctttcgagacgatgtacgacgtgctgtctacgaaacccgtgcttaacaagctgactgtgtacaccacccttattgatgtgaccaaaggacaatttgaaacttacttgcgcgactgtcctgatccatgcatcggttgg

SEQ ID NO: 17238 - DNA, 1185 bp, Artificial Sequence
  Description of Artificial Sequence: Synthetic coding sequence
atgcctggacggtcatgtgtggcgttggttctactggcagcagcggttagttgtgcggtggctcagcatgcacctccctggacagaggattgtcgtaaatccacatatccgcctagcgggcctacgtacagaggcgctgtaccgtggtataccataaatttggatttgcccccctataagagatggcacgagcttatgttggacaaagctccggtactcaaagtcattgttaattccttgaaaaacatgatcaacacgtttgtccctagtggcaagataatgcaagtagtggatgaaaaacttcctggactgcttggcaattttcctggcccatttgaagaggaaatgaagggaattgctgcagtgacggatataccgttaggagaaattatctcgttcaatattttctacgaattatttactatatgcacatctatcgtggcggaagacaaaaaaggtcacttaatccatggacggaacatggattttggcgtgttcctcggctggaatatcaacaatgatacgtgggttattacggaacaactgaaaccgcttactgtgaatctggatttccagcgcaataataagactgtctttaaagcaagttcatttgcaggatatgtcggtatgctaactggcttcaaacctggcctgttttctctgacgctcaacgaaaggttctcaatcaacggcgggtatcttggcattttagaatggattctgggaaagaaagatgtaatgtggattggattcctgacaaggacagttttggaaaattcaacgtcttatgaagaggccaagaatctcctgacaaaaaccaaaatccttgccccagcttattttatcttggggggaaatcaatccggggaggggtgtgtgatcacgcgggaccgcaaagaaagcctcgatgtttatgagcttgatgctaagcagggaagatggtacgtagtacagacgaactatgatagatggaagcacccattttttttggatgacagacgcaccccagcgaagatgtgcctgaacaggacgtcacaggaaaacatttcgttcgaaactatgtacgatgtactttcgacaaaacctgtgttaaacaaattaacagtctatacgacgctgattgatgttaccaaagggcaatttgaaacataccttcgtgattgtccagatccgtgcatcggatgg

SEQ ID NO: 17239 - DNA, 1185 bp, Artificial Sequence
  Description of Artificial Sequence: Synthetic coding sequence
atgcccggcagatcctgcgtggctcttgtgctgctcgcagcagcagtgagttgcgccgtggctcagcacgccccaccctggactgaggattgtaggaagagcacgtacccaccttccgggccaacctatcgtggtgcggtgccatggtacaccattaacttggatctgccaccatacaagcgatggcacgagctgatgcttgataaggcccccgtgttgaaggttattgtgaattcacttaagaatatgatcaatacttttgtgccctctggtaaaatcatgcaggtggtcgacgagaaactgccaggccttctgggtaacttccctggccccttcgaggaggagatgaaaggtatcgccgctgtgactgatatccccttgggcgagataatcagttttaacatcttctatgaacttttcaccatatgtacttctattgtggccgaagacaaaaagggccacctcattcatgggcggaatatggatttcggggtgttcctgggttggaacataaacaatgacacctgggttattacagagcagctgaaaccattaaccgtgaacctagacttccagagaaataacaagactgtgtttaaggcgtcctccttcgcgggatatgtcggcatgttgactggcttcaagcctggcctgtttagtctcactttgaatgaacgcttcagcattaatggggggtatctcgggattttggagtggatactcggaaaaaaagatgtgatgtggattggattcctaacgcgaaccgtgttggaaaatagcactagctatgaagaggccaaaaacctgctcacaaagactaagattctggccccagcctattttattctcggagggaatcaatcaggagagggctgcgttatcactagagataggaaggagtctctcgacgtgtacgagctggacgctaagcagggtcgttggtatgtggttcaaaccaattacgatcgatggaaacaccctttctttctagacgaccggcgcacaccagcaaaaatgtgcctgaaccgcacctcacaggaaaatatcagcttcgagaccatgtacgacgtgctctctactaagcccgtgctgaataagttgaccgtgtacacgaccctgatagatgtgactaaaggccagttcgagacctacctccgcgattgtcctgatccctgcattggttgg

SEQ ID NO: 17240 - DNA, 1185 bp, Artificial Sequence
  Description of Artificial Sequence: Synthetic coding sequence
atgccgggcaggtcgtgcgtggctctggttttgctggctgccgccgtgtcatgcgcagtcgcccagcacgccccgccatggaccgaggattgtcggaaatccacctaccccccgtctggtccgacgtaccggggcgctgtgccgtggtacactatcaatctggacttgccgccctacaagaggtggcacgaactcatgctcgacaaagcccctgtgttgaaggtgatcgtcaattcccttaagaacatgatcaacacgttcgttccttccgggaagatcatgcaggtcgtggacgagaagctgccgggactgctggggaacttcccgggaccgttcgaagaagaaatgaagggaatcgcagcggtcactgacatcccgttgggggaaatcatcagcttcaacatcttctacgagctgtttaccatctgcacctcaatcgtggcagaggacaagaagggacatctgatccacggacggaatatggatttcggagtgttcctgggatggaatatcaacaacgacacctgggtgatcactgagcaactgaaaccgctgaccgtgaaccttgacttccagagaaacaacaagaccgtgttcaaggcgtcatcgttcgctggatacgtgggcatgttgaccggattcaagcctggattgttctcactgactctcaacgaacggttttctatcaacggtggctatctcgggatcttggaatggattctgggcaagaaagacgtgatgtggatcggtttcctgacccgaaccgtgctggagaacagcactagctacgaggaggcgaagaatctgctcaccaagactaagattctggcgccagcctacttcatccttggaggaaaccaatccggcgagggctgcgtgatcactcgcgatcgcaaggaatccctggatgtgtatgaactcgacgctaagcagggccggtggtacgtggttcagaccaactacgaccgctggaagcatccatttttcctcgatgacaggagaaccccggcaaagatgtgtctgaacagaacttcacaagagaacatctctttcgagactatgtacgatgtgctgtcgaccaagccggtgcttaacaagctgaccgtttacaccaccctgatcgatgtgactaaaggacaattcgaaacctacctgcgcgactgtccggatccttgcatcggttgg

SEQ ID NO: 17241 - DNA, 1185 bp, Artificial Sequence
  Description of Artificial Sequence: Synthetic coding sequence
atgcccggccgaagctgtgtggcactggtgctgcttgccgcagcagtgtcgtgtgcggtggcacaacatgcccctccctggaccgaggattgtcgtaagagcacttacccaccttctggccctacttacagaggagcagtgccctggtataccatcaacttggatctgccaccctacaagcgctggcatgaactgatgcttgacaaggccccagtgctgaaggtcatagtgaacagcttgaagaacatgattaacacctttgtgccttccggaaagattatgcaggtcgtggacgaaaagctccctggactccttggtaactttccaggcccctttgaagaagaaatgaagggcattgccgctgtcacggacatacctctgggtgaaatcatttccttcaacattttctacgagcttttcactatctgtaccagcatcgtcgcagaggacaagaaagggcaccttatacacggacgtaacatggacttcggggtctttctgggatggaacattaacaatgatacttgggtgatcactgaacagcttaagccacttactgtgaacctggacttccagagaaacaataagaccgtgttcaaggctagctcgtttgcaggttacgtgggaatgcttactgggtttaagccaggtctgtttagcctgaccctgaacgagcggttctccattaacggcggctacctcggtatcctcgaatggattcttggcaaaaaggacgtcatgtggatcggatttcttacgagaaccgtgcttgaaaactccacctcctacgaagaagcgaaaaacttgcttactaagactaagatcctggctccagcatactttatccttggaggtaatcaatcaggagaaggttgtgttattactcgggatagaaaggagagccttgatgtttacgagctggatgcgaagcaagggcgttggtatgtggttcagaccaattacgaccggtggaaacacccatttttcctcgacgaccgcagaacccctgcaaagatgtgtttgaacagaacttcacaggagaacatatccttcgagactatgtacgatgtgttgtcgaccaagcccgttctcaataaacttaccgtttacactaccctgatcgatgtcacgaaggggcagtttgaaacctacttgcgagattgtccagacccttgcatcggttgg

SEQ ID NO: 17242 - DNA, 1185 bp, Artificial Sequence
  Description of Artificial Sequence: Synthetic coding sequence
atgccaggcagatcttgcgtggccctggtactgctggcagccgccgtatcctgtgccgtggctcagcatgcccccccttggaccgaggactgtaggaagagcacttacccaccttctggtccaacttacaggggcgctgttccttggtacaccatcaacctggacttgcctccctataaaaggtggcatgagctgatgttggataaggcccctgttctgaaagtgatcgttaacagcttgaaaaacatgatcaacacctttgtgcctagtggcaaaataatgcaagtggttgatgagaaacttcctggacttcttggcaatttcccaggtccatttgaggaggagatgaagggaattgctgcagtaacagacatcccactcggcgaaataattagtttcaacatcttctacgaactctttacaatctgtactagcatagttgctgaagacaagaaaggtcacctcatacatggcagaaatatggactttggagttttccttggatggaatatcaacaacgacacttgggtcatcaccgagcagctcaaaccactcactgttaacctggatttccagaggaacaataagactgtcttcaaggctagcagcttcgcaggctacgtgggtatgttgacaggattcaagcccggattgttcagccttacccttaatgagcgtttttctattaacggcggctacttgggcatccttgagtggattttgggcaagaaagacgtgatgtggattggatttctgaccagaaccgttttggagaactccacctcttatgaggaggctaagaacctgctcacaaaaactaaaatccttgctccagcttatttcatccttggcggtaaccagtctggcgagggttgtgtgattacccgtgatcgtaaggagtcactggatgtttatgaactggacgctaaacaaggaagatggtacgtggtgcagaccaattacgaccgctggaaacatcccttctttctcgacgaccgtcgcacccctgctaagatgtgtctgaataggacttcccaagaaaatatctcattcgaaactatgtacgatgtgctcagtaccaagcctgtgttgaataagttgacagtgtatactaccctgatcgacgtcactaagggccaatttgaaacctacctcagggactgccccgacccctgtattggctgg

SEQ ID NO: 17243 - DNA, 1185 bp, Artificial Sequence
  Description of Artificial Sequence: Synthetic coding sequence
atgcccggaaggtcgtgtgttgcgcttgtgctgcttgcagccgcagtctcctgtgcagtggcacagcatgcgcctccttggaccgaagattgccgtaagtcaacttacccaccctcaggccccacttacagaggtgcggtcccttggtacactataaaccttgatctccctccttacaaacggtggcatgaactgatgcttgataaggcacccgtcctgaaagtgattgtgaactccctcaagaacatgatcaataccttcgtcccatccggaaagatcatgcaagttgtcgatgagaaattgcccggccttctgggtaatttcccaggacctttcgaagaggaaatgaaaggaattgcagctgtgaccgacattcccctgggagaaatcatatcgttcaatatcttttacgagctttttacgatatgtacctcgatcgtcgcggaggataagaaaggacatctgattcatggcagaaacatggattttggagtctttctgggctggaacattaacaacgatacctgggtcatcactgaacaactgaaaccgttgactgtcaaccttgacttccaacgcaataacaagaccgttttcaaggcaagctcgtttgctggatacgtcggtatgctgactggttttaagcccggtcttttttccttgacccttaatgaaaggtttagcatcaacggaggttacctggggatcctggagtggattcttggcaagaaggacgtcatgtggatcggatttctcacccgaaccgtgctggaaaactcaacctcgtacgaagaggcgaaaaatctcctgactaaaactaagatacttgcccctgcatactttatcttgggcggaaaccagtcgggagaaggatgcgtgatcaccagggaccggaaggagtcattggatgtgtacgagcttgatgcaaagcagggtcggtggtacgttgtccaaactaattacgatagatggaagcatcctttctttctggatgacagaagaactcccgcgaagatgtgtctgaatcgcacctcacaggagaacatttcattcgaaactatgtacgacgtgctcagcactaaaccagtgctgaataagttgaccgtgtacaccactctgattgacgtgaccaagggccaatttgagacgtacctcagggattgtcctgatccatgcatcgggtgg

SEQ ID NO: 17244 - DNA, 1185 bp, Artificial Sequence
  Description of Artificial Sequence: Synthetic coding sequence
atgcctggtagatcctgcgtagctctggtgctgctcgcagctgccgtgagttgtgccgttgcacagcatgccccaccatggactgaggattgtcggaaatctacataccctccgtctggtcctacctatagaggtgccgtcccatggtatacaatcaacctagatctcccgccttacaaacggtggcatgaacttatgctggacaaggcccccgtgctgaaggtgattgtcaacagtctcaaaaatatgatcaacacctttgtgccctctggcaaaattatgcaggtcgtagatgaaaagttgcccggactcctgggcaactttccaggaccatttgaagaggagatgaagggcatcgccgcagtcactgacattccccttggggagataattagtttcaacatcttttacgagctttttaccatttgtacaagcattgtggctgaagataagaagggccacctgatccacggaagaaacatggattttggtgtctttctcggctggaacattaacaacgatacatgggtaatcacggagcagctgaagcccctcaccgtgaacctggattttcagagaaacaacaagactgtatttaaagcctcttctttcgcaggctacgtaggcatgcttacaggatttaaacccggattgttctctcttaccctgaatgaacgtttctcaattaatggcgggtatctgggaattctcgaatggatcttggggaagaaggatgtcatgtggataggattcctgactcggactgtgctggagaatagtacaagctatgaggaggccaagaaccttttgaccaagacaaagatattagccccggcctatttcatcttgggcggcaatcagagcggtgaaggctgtgttataaccagggaccgcaaggagtcccttgatgtatatgagttggatgcaaaacaggggcgctggtatgtggtccagacaaattatgatcgctggaagcatcccttctttcttgatgatcgccgcacaccagccaagatgtgtctgaataggacttcccaggagaatattagcttcgaaactatgtatgacgtactgtcaactaaacctgttctcaacaagctgaccgtctacaccacacttatcgatgttacaaaaggccagtttgaaacctatctgcgtgattgtccagatccctgtatcggttgg

SEQ ID NO: 17245 - DNA, 1185 bp, Artificial Sequence
  Description of Artificial Sequence: Synthetic coding sequence
atgccaggccgaagttgcgtggcgctggtattactggcggcagccgtgtcatgcgctgtggcacagcacgcgcccccatggacggaagattgtagaaaaagcacctatcctccttctggacctacatacagaggggccgtgccgtggtacacgataaatttggacttgccaccttataaaaggtggcatgaactgatgctggacaaagccccagttctgaaagtgatagtcaacagcctgaagaatatgattaacacatttgttcccagtgggaagattatgcaagttgtggatgaaaagcttcccggattgttgggtaattttccgggcccattcgaagaggagatgaagggaatcgcagctgttaccgatatcccactgggcgaaattatctccttcaacattttctacgagctgttcaccatttgcaccagcatcgttgccgaagataagaagggccatctcatccatggcaggaatatggactttggggtgttcttggggtggaacataaacaatgatacatgggttatcaccgagcagttgaaaccacttaccgtcaacctcgatttccagaggaacaacaagaccgtgtttaaggcctcttcctttgccgggtatgtagggatgctaacaggttttaagccaggtctgttctctctcacgctgaacgaacgatttagcattaatggaggctatctaggtatcctggaatggattctaggtaagaaggacgtgatgtggattggcttcctcacgagaacagtgttggaaaattccaccagctatgaagaggcgaaaaacctgctcactaaaactaaaattttggcacctgcatatttcatcctcggcggcaaccagagcggcgagggctgcgtcattacaagagaccgaaaagaatcattagacgtgtacgagctcgacgccaaacagggaaggtggtatgtcgtccagacaaattacgatcggtggaagcaccctttctttttggatgataggagaacaccagccaaaatgtgcttgaacagaacatctcaggagaatattagctttgaaactatgtatgacgttctgagcaccaaacctgtgctgaacaagcttacagtgtatactactttaattgatgtcacaaaagggcaatttgaaacttacctgagagactgtcccgatccctgcattgggtgg

SEQ ID NO: 17246 - DNA, 1185 bp, Artificial Sequence
  Description of Artificial Sequence: Synthetic coding sequence
atgcccgggcggagctgcgtggcactggtgttgctcgcagcggccgtctcgtgtgctgtcgcccagcacgcacctccttggactgaagattgccgtaagtctacttatccccccagtggtcctacctacagaggagccgtcccctggtacactatcaaccttgacctgccgccatacaagagatggcacgagctcatgctggataaagcgccagtgttgaaagtgatagtgaattcactgaagaatatgatcaacacattcgttcctagtggaaaaataatgcaggtggtcgatgagaagctacctggccttctgggtaattttccaggacccttcgaggaagagatgaagggtatcgcagccgtaacggacatccccttgggcgagatcataagcttcaatattttctacgagctctttaccatttgcacgtccatcgtggctgaggataaaaaaggccatctgatccacggaagaaatatggatttcggggtctttttggggtggaatattaataatgatacctgggtcattactgaacaattaaaacctttgacagttaatcttgatttccagcgtaataataaaacggttttcaaggccagcagctttgccgggtatgtaggtatgctgaccgggttcaaaccgggactgttctcattgaccctaaacgagcgattctcaatcaatggcggctacctcgggatcctcgagtggattctgggtaagaaggatgttatgtggataggatttctgacacggaccgtattggaaaatagcacctcctatgaggaggctaagaatctgttgaccaaaacaaaaatcctagcccctgcctactttattctcggaggtaatcagtccggggaagggtgcgtaattacccgagaccgcaaggagtccttggacgtctatgagctggacgcaaagcagggtaggtggtacgtggtccagaccaactacgacaggtggaaacatccctttttcctggacgacaggcggacacccgcaaaaatgtgcctaaacaggaccagccaggaaaatatctcattcgagactatgtatgatgtgctcagtaccaagcccgtgctaaacaagctaacagtgtataccacattgatagacgttaccaaaggtcagttcgagacttacctgcgggactgccctgacccctgcattggatgg

SEQ ID NO: 17247 - DNA, 1185 bp, Artificial Sequence
  Description of Artificial Sequence: Synthetic coding sequence
atgcccggcaggtcctgcgtcgccttggtgctgcttgcggctgctgtgtcctgcgcggtggctcaacacgcaccaccctggaccgaggattgcaggaaatctacctatccaccatccggacccacatataggggagcagtaccctggtatacaatcaacctggatctgcctccctataagagatggcacgagcttatgctggacaaggccccagtgttgaaagtgattgtgaatagtctcaaaaatatgatcaacacatttgttccttcagggaagatcatgcaggttgtggacgagaaacttcctggtctgttggggaatttccccggacccttcgaggaggaaatgaagggcattgcagccgtgactgatatccctctgggcgagattatctcttttaatatcttttacgagctgttcacgatttgcacctccatcgtggctgaggacaagaaggggcatctcatccacggccggaacatggacttcggagtgttcctgggctggaacatcaataacgatacgtgggtgatcactgagcagctcaaaccgctgaccgttaacctggatttccagcggaacaacaagaccgtcttcaaggccagctcttttgccggctacgttggcatgctgactgggttcaaaccaggtctgttttcactcaccttgaatgaaagattctctattaatggaggataccttgggatcctggaatggattttgggcaaaaaggacgtaatgtggattggctttttgaccaggactgtgctggaaaactcaacttcatacgaagaggcgaagaatctgctcaccaagaccaagatattggctccagcatattttatactcggaggcaatcagtctggagagggctgtgtcattacaagggatagaaaggaaagcttggatgtttacgagcttgacgctaagcaggggcggtggtacgtggtccagaccaactatgatcgctggaagcaccctttctttttggacgacaggagaactccagcaaagatgtgccttaaccgcaccagtcaggagaatattagtttcgaaacaatgtacgacgtgctctccacaaagcccgtactgaacaagctgacagtctataccaccctgatagacgtgactaaaggccagttcgaaacgtacctgcgagactgccccgatccttgtatcggctgg

SEQ ID NO: 17248 - DNA, 1185 bp, Artificial Sequence
  Description of Artificial Sequence: Synthetic coding sequence
atgccgggccggagttgcgtcgccctggtgctgttggcagccgcagtgtcgtgtgccgtggcacagcacgccccgccgtggactgaggattgccggaagagcacttatccgccttccggaccaacttatcgcggggctgttccctggtacactatcaacctcgatctgcctccgtacaagcgctggcatgaactgatgttggacaaagcgccggtgcttaaggtcatcgtcaattcactgaagaacatgatcaacaccttcgtgccgtcgggaaagatcatgcaagtggtggatgaaaaactgcctggattgctggggaactttcctgggccgttcgaggaggaaatgaagggaattgcggcggtgactgacattccacttggagaaattatctcattcaatatcttctacgagctgttcaccatctgcacctcgattgtggcggaagataaaaaaggacacctgatccacggcagaaatatggactttggagtattcctcggatggaacatcaacaatgatacctgggtgatcactgagcagctgaagccattgaccgtgaatctggattttcaacgcaataataagaccgtctttaaagcctcgtcctttgctggatacgtgggtatgctgaccggattcaagccaggcctcttctctctgactcttaacgaacgattcagcatcaacggcggctacctgggcatcctcgaatggatactcggaaaaaaggatgtcatgtggatcggcttcctgactcgcaccgtgctggaaaacagcacttcatacgaagaggcaaaaaacctcctcaccaagacgaagattctcgctccagcctacttcatcctgggagggaatcaatccggtgaaggatgcgtcatcaccagagacagaaaggaatcgctggatgtgtacgaactggacgccaagcagggacggtggtacgtggtccagaccaactacgacaggtggaagcatccgttctttcttgacgaccgcaggactcccgccaagatgtgcctcaaccggacgtcccaggagaacatcagcttcgagacgatgtacgacgtgctctccaccaagccagttctgaacaagctgaccgtctacaccactctcatcgacgtgacgaaaggtcagttcgagacttacctccgggactgccccgacccgtgtatcggttgg

SEQ ID NO: 17249 - DNA, 1185 bp, Artificial Sequence
  Description of Artificial Sequence: Synthetic coding sequence
atgccaggccgatcttgtgtggccctggtcctcttagcagcagccgtgagctgcgctgtggcccaacacgctcctccctggactgaggactgcaggaaaagcacctacccccctagtggaccgacatatcggggggcagtgccatggtatacaataaaccttgatctgcctccctacaagagatggcacgaattaatgctggacaaagcaccagtcctgaaagttatagtcaatagtctgaagaacatgatcaacactttcgtgccgtctggcaaaatcatgcaggtcgtggatgaaaagctgccaggactgcttggcaactttccagggccgttcgaagaggagatgaaagggatcgccgcagtgaccgacataccattaggggagataatctcatttaatatcttctacgagctgttcactatctgcacctcgatagtggccgaggacaagaaaggacatctgatacacggtcggaatatggatttcggggtcttcctgggatggaatattaacaacgacacatgggtcatcacagagcagctgaagcccctgaccgtcaacctcgacttccagaggaacaataagacggtattcaaggcctcttccttcgctggctacgttggtatgctcaccgggttcaaaccaggcctgttctcgctcacactgaacgagcggttctcaattaacggtggctacctgggtatactggagtggattctgggcaaaaaggatgtgatgtggatcggctttcttacgcggaccgtgctggagaactctacctcgtatgaggaagctaagaatctattaaccaaaaccaaaattctagcacccgcctacttcatcctcgggggaaatcagtctggcgaaggatgtgtcatcactcgcgatagaaaggagagcctagatgtatatgagttagatgccaagcagggccgatggtacgtcgtgcagaccaactacgataggtggaaacatcccttcttccttgacgacaggaggactcccgccaaaatgtgtctgaatcggacctctcaggagaacatctcctttgagactatgtacgacgttctgtctaccaaacctgtccttaacaagcttaccgtctataccacactcattgatgtaactaagggacagttcgaaacctacctgagagactgtccggatccgtgcatcgggtgg

SEQ ID NO: 17250 - DNA, 1185 bp, Artificial Sequence
  Description of Artificial Sequence: Synthetic coding sequence
atgcctggaagaagctgtgttgctctcgtgttactggccgctgcagtgagctgcgccgtggcgcagcatgccccaccctggaccgaggactgtcggaagagcacgtatccccccagcggacccacatacaggggagccgtaccttggtatacaatcaatctggatttgcccccatacaaacgttggcatgagcttatgctggacaaggccccagtgttaaaggttattgtgaactctctgaagaatatgatcaatacattcgtcccctctgggaaaattatgcaggtagttgatgagaagttaccagggctacttggtaactttccagggccatttgaagaagaaatgaaaggtatagccgccgttactgacatacccctgggggagatcatctctttcaatattttctacgaactctttacaatctgtacttcaatcgttgcagaggataaaaagggtcatttaattcacgggaggaatatggatttcggagtattcttggggtggaatatcaacaatgatacttgggtgatcacagagcagttgaagcccctgacggtaaatttggattttcagcgaaataacaaaacggtgttcaaggcttcttctttcgcgggttacgtgggcatgctgaccgggtttaagcctggcctgttctcactgaccctgaacgagcggttcagtattaatggaggctatctcggcatattggagtggatactgggaaagaaagacgtgatgtggatcggcttcctgacaaggactgtcctggagaattctacctcttacgaggaggccaagaacttactgacaaagaccaaaatcctggctccggcatatttcatcctcggaggtaaccagtccggcgaaggttgcgttatcacaagagaccggaaagagagccttgatgtgtacgagctggatgctaaacagggcaggtggtacgtagtgcagaccaattatgatcggtggaaacacccattcttccttgatgatagacggaccccagctaaaatgtgtctcaacaggacctctcaggaaaacatcagctttgagacaatgtacgatgtgctgtccaccaagcctgtgttgaacaagctaaccgtctataccacgctcatcgacgtaacaaaaggtcagtttgagacgtacctgagagattgccccgatccttgtatcggatgg

SEQ ID NO: 17251 - DNA, 1185 bp, Artificial Sequence
  Description of Artificial Sequence: Synthetic coding sequence
atgccaggacggtcctgcgttgcactggtgctgctagcagctgccgtcagttgcgcagtagcacagcacgcccccccttggacagaagactgcaggaaatcgacctatccacccagcggaccgacataccggggggctgtaccctggtacactatcaacttagatctgcccccatacaaacggtggcacgaactgatgctggataaggctcccgttttaaaagtgatcgtcaacagcctgaaaaatatgataaacacctttgtacccagcgggaaaatcatgcaggtggtggacgaaaagctgcctggactgcttggaaattttcccggccccttcgaggaggagatgaagggaattgccgctgtgaccgacataccacttggagagatcatttcattcaacatcttctacgagctgtttacaatctgcacctccattgtcgctgaggacaaaaaaggccatctgatacacggcagaaacatggactttggagtctttttgggctggaacatcaataacgatacttgggtgatcacagaacagttgaaacctcttacagtcaaccttgactttcaaagaaacaacaaaaccgtgtttaaggccagctcctttgccgggtacgtggggatgctgaccggattcaagcccggactgtttagcctgaccctgaatgaaagattcagcatcaacggcggctatcttggaatacttgagtggattcttggaaaaaaggatgtcatgtggattggattcctcaccagaaccgtcctggagaactctacttcatatgaagaggcaaagaacctgctcaccaaaacaaaaatcctcgcgcccgcttactttatcttgggaggcaaccagtcaggcgaagggtgcgtcataaccagggacagaaaggaatcactagacgtttacgagcttgacgcaaaacaagggagatggtatgtggtccagactaactatgatagatggaaacatcccttcttcctggatgatcgccgtacaccagccaagatgtgtctcaacaggacctcccaggaaaacattagttttgaaactatgtacgatgtgctgtccaccaagccggttctaaacaaactgaccgtgtacacaactctcatcgatgtgactaaagggcagttcgaaacatacctgcgagactgtccagatccgtgtatcggttgg

SEQ ID NO: 17252 - DNA, 1185 bp, Artificial Sequence
  Description of Artificial Sequence: Synthetic coding sequence
atgccagggaggagctgcgttgccctcgtcctcctcgccgcggcagtgtcttgtgccgtagctcagcatgcacctccttggacagaagactgccgaaaaagtacatatcccccaagcggaccgacgtatcgcggggccgttccgtggtacaccataaaccttgatttacccccttacaagagatggcacgaactcatgcttgacaaggctccggtcctcaaggttattgtcaacagccttaagaatatgattaacacatttgtgccatcgggcaagatcatgcaggtagtcgatgaaaagctcccaggactgctgggtaacttccccggcccgtttgaggaagaaatgaaagggatcgccgccgtaacggacatccccctgggcgagatcataagctttaacatcttttacgaactgttcaccatctgcacttcaattgtcgccgaggacaagaaaggtcacctcatccacggacgcaatatggactttggggtgttcctgggctggaatataaataacgacacttgggtcatcacagagcagcttaagccactgaccgtgaatctggattttcagcgcaacaataaaacggtgttcaaggcgagcagctttgccggttatgttggcatgttgaccggatttaagcctggtctttttagcttgacccttaatgagcgattcagcattaacggaggctatttgggcatactcgagtggatactagggaagaaagacgtgatgtggattggatttcttacacgaaccgtcctagagaattctacaagctacgaggaggcgaaaaacctcctcacaaagacaaagatcttggctcctgcttatttcatcctggggggtaaccagtctggagagggctgcgtcattacccgtgatagaaaggaatccctggacgtctacgagctggatgccaaacagggaagatggtacgtcgtacaaacgaattacgacaggtggaagcaccccttctttctcgatgacaggcgcacccccgccaagatgtgtcttaatagaacctcacaagaaaatatttcttttgaaaccatgtatgatgtgttaagcaccaagcctgtgctcaataagctcacagtgtacacaaccttaatcgacgtgacgaaagggcagtttgaaacttatctgagagactgcccggacccatgtattggctgg

SEQ ID NO: 17253 - DNA, 1185 bp, Artificial Sequence
  Description of Artificial Sequence: Synthetic coding sequence
atgccgggtcgttcatgcgtggcccttgtgctgctggcagctgctgtgtcctgtgccgtggcccagcacgccccaccctggactgaagattgtaggaagtcaacctatccaccttctggtccgacttataggggtgccgtgccctggtatacaatcaatctggatctgccgccatacaaacgctggcacgagctgatgctggacaaggcccccgtattgaaggtaatagtgaactctctgaagaacatgatcaacaccttcgtcccgagtggaaagataatgcaagtcgttgatgaaaaactgccagggctgctgggaaactttccggggcctttcgaagaggagatgaaaggcattgccgccgttaccgatattcctctgggcgagattatctctttcaatatcttctatgaattgtttactatctgcactagcatcgttgccgaggataagaagggccacctcatccatgggcggaatatggatttcggagtgttccttggctggaacatcaacaacgatacttgggtgatcactgagcagctgaaaccactcacggtgaacctcgactttcaacgtaacaacaagaccgtgtttaaggcctccagttttgccgggtacgttggcatgctcacaggatttaaaccgggacttttttcattgactctcaatgaacgctttagtatcaacggtgggtacctgggcatcctggagtggatactaggcaagaaggatgtgatgtggatcggattcctaactagaactgtcctggaaaattcaaccagctacgaagaagcgaagaacttactgactaaaacaaaaatattagcaccggcttacttcatcctcggtggaaatcaatcaggcgaaggatgcgtcatcacaagggaccggaaagaaagccttgatgtgtacgaactggatgctaagcaaggaagatggtatgtggtgcaaacaaattatgatcgctggaagcacccattttttcttgatgacagaagaacccccgccaaaatgtgtctcaataggacaagccaggagaacatctcttttgaaaccatgtatgatgtcttgagtactaagcctgtgctgaataaactgaccgtgtatacgactctgatcgacgtaaccaaagggcaatttgagacatatttacgggactgcccggatccctgcattggttgg

SEQ ID NO: 17254 - DNA, 1185 bp, Artificial Sequence
  Description of Artificial Sequence: Synthetic coding sequence
atgcctggacgctcctgtgttgctctggtgctcttagccgcagctgtctcatgtgctgtggctcagcatgctccaccttggactgaggattgtcgaaaatcaacctaccctcctagtgggcctacatatagaggtgctgttccctggtacactattaatcttgatttgcccccttataaaaggtggcatgaactgatgcttgataaggctcccgtgttaaaggttatcgtcaattctttaaagaatatgataaacactttcgttccttctgggaaaattatgcaagttgttgatgaaaagcttcccggattgttaggtaacttccctggccccttcgaggaggagatgaaagggatcgcagctgttactgatattccgctgggcgagatcatttcttttaacattttttacgagctattcacaatttgcacaagtatcgttgctgaagataaaaagggacatcttatccacggccgaaatatggactttggtgtttttctcggttggaacattaataacgatacttgggttatcacggagcagctcaagcctttgactgttaatctcgactttcaaagaaataacaaaacagtgtttaaagcctcttcattcgctggttatgttggaatgcttactggttttaaacccggcctctttagtctcacacttaacgagaggttcagtataaatggtggatatctgggaatccttgaatggatcctgggaaagaaggatgttatgtggataggtttcttgactagaactgttcttgagaattcaacaagctatgaggaggccaaaaacttattgactaagaccaagattcttgcacccgcatactttattctgggtggaaatcagtccggagagggttgcgttattactagagaccgaaaggaatccctggatgtttacgaacttgatgcgaagcaagggcgttggtatgtcgttcagacaaactacgataggtggaagcacccattctttctagatgaccgtcgaacccccgcaaagatgtgtttaaaccggacaagtcaggagaatatctcatttgagacaatgtacgatgtcctctccaccaaaccagtattgaacaaattgaccgtttatacaactcttatcgatgtcactaagggacaatttgagacgtatctgcgtgattgccccgacccctgtattggctgg

SEQ ID NO: 17255 - DNA, 1185 bp, Artificial Sequence
  Description of Artificial Sequence: Synthetic coding sequence
atgcctgggcgctcgtgtgtggctctggtgctcctggccgctgcagtctcgtgcgcagtggcacagcatgcccccccttggaccgaggactgtcgcaaaagcacttatcccccttcgggtccaacataccgcggcgccgtaccttggtacacaattaaccttgatttgcctccatacaaacgctggcacgagctgatgttggataaagccccagtactcaaggtgatcgtgaacagccttaaaaacatgatcaatacatttgtaccatcggggaaaattatgcaggtggtggatgaaaaactccctgggctgctaggtaactttcctggaccctttgaagaggagatgaaaggtattgccgccgtgactgatatccccctgggcgaaatcatttccttcaacatcttctatgaactgtttaccatttgtacgtccattgtcgccgaggataagaagggccacctgattcacggaaggaacatggatttcggagtgtttcttggttggaatatcaataacgatacatgggtaatcactgagcagttgaagccgctcaccgtgaatctggactttcagcggaataacaagactgtgtttaaagcttcctccttcgccggctatgtgggcatgctaacaggcttcaaacctggacttttcagcctgacgttgaatgagcggttcagtataaacggcggatatctcggcatattggaatggatcctcggaaagaaggatgtgatgtggattggtttcctgactcggacggtcctagaaaattcaaccagctacgaggaagcgaagaacctcttaacaaaaaccaagatactcgctcctgcctacttcatccttggcggtaaccaaagcggcgagggatgcgtcattactcgggatcgaaaggaaagtctcgacgtctatgagctggatgcaaagcagggccgctggtacgtggttcagaccaattatgacagatggaagcatccatttttcctcgacgaccgccgcacccctgccaagatgtgccttaatcgcactagccaggagaatatctcgtttgagacaatgtacgacgtgctctccactaaaccggttctgaataaactcacggtttacactacactgatcgatgtgacgaagggacagtttgagacatacctcagggattgcccagacccatgtattggctgg

SEQ ID NO: 17256 - DNA, 1185 bp, Artificial Sequence
  Description of Artificial Sequence: Synthetic coding sequence
atgcctggcagaagctgtgttgcactggtgctgctggctgccgccgtctcctgcgcggtcgcccagcacgcgcccccatggacagaggactgccgaaagtctacttaccccccatcagggcccacatacagaggcgctgtaccgtggtacactattaacctagatttaccaccctataaacggtggcatgagctgatgcttgataaggcacccgtgctgaaagtgatcgtgaactcactgaaaaacatgattaacacgtttgttcccagcgggaagataatgcaggtggtggacgaaaagctgcccggattgttggggaattttcccggcccttttgaagaagaaatgaaaggtatcgccgcagttacagacataccccttggtgaaattatctcctttaatatcttctacgaattgtttacaatttgtacatcgatcgttgccgaggataaaaaggggcatcttattcacggtcgtaatatggatttcggggtttttctcgggtggaacattaataatgatacctgggtgatcacagagcagctgaagcctcttacggtgaatctagacttccaaaggaataacaagaccgtgttcaaggcctcatccttcgcggggtacgtgggtatgcttaccggattcaaacccggattatttagcttaacattgaacgaacggtttagtatcaacggggggtacctggggattctggagtggatcctgggcaagaaggacgtgatgtggattggctttctcactcgtaccgtactggagaattccaccagctacgaagaggccaagaatctgctcactaagactaagattctggcccccgcttatttcatattaggtggtaaccagtcaggcgaaggatgcgtgataacccgtgatcggaaggaaagtctggacgtttacgagcttgacgccaaacaaggtaggtggtatgtcgtccagacgaactacgacagatggaaacatccttttttcctcgatgataggcggacacccgccaagatgtgtctcaatagaacgagccaagaaaacatctcgtttgaaacgatgtatgacgtgttgtctactaagcctgtattaaacaaactgacagtgtacactactctgatcgatgtgacgaaggggcagttcgaaacctacctacgcgattgtcctgatccttgcattggctgg

SEQ ID NO: 17257 - DNA, 1185 bp, Artificial Sequence
  Description of Artificial Sequence: Synthetic coding sequence
atgcctggcagaagttgcgttgccctggtgctcctggcagcagccgtcagctgcgcagttgctcaacacgccccaccatggaccgaggattgcaggaagagtacatacccgccttctgggcccacataccgaggtgctgtgccttggtacactatcaatttggacttgcctccgtataaacggtggcacgaactgatgttggacaaggcccccgttcttaaggtgatcgtgaactcactgaagaacatgatcaacacctttgtgccttccgggaagattatgcaggtcgtggacgagaagctgcccgggctcctgggcaattttccaggcccctttgaggaggagatgaagggcatcgccgcagtgacagacattccgctcggtgagattatctcgtttaacattttttacgaactcttcacaatatgtacatccatcgtggccgaagacaaaaagggtcacctaatccatggtaggaacatggatttcggcgtgtttctggggtggaacataaacaacgacacctgggtaatcacagagcagctgaagccactgacagttaatctagattttcaacgaaacaacaaaacggtcttcaaggcgagtagctttgcaggatatgtggggatgctgacaggatttaaacctggcctctttagccttacacttaacgagaggttcagcataaatggcgggtacctggggattctggagtggattttaggcaagaaagacgtaatgtggattggcttccttacccggaccgtgttagaaaactctacctcatacgaggaagccaaaaatctcctaacaaagaccaagatcctggcccccgcgtactttatcttgggcggaaatcagtccggagagggctgcgtgattacaagagacaggaaggagagcctggacgtctatgaattggacgcgaagcaggggcggtggtatgtggtacagaccaattatgaccggtggaagcatccgttcttccttgacgacagacgtaccccagctaagatgtgtttgaaccgaacgagccaagagaatatctccttcgagacaatgtacgatgtgctgtctactaaacctgttctgaacaaactcacggtgtataccactttaatcgacgtcaccaagggccagtttgagacctatctaagagattgtcctgatccatgcataggttgg

SEQ ID NO: 17258 - DNA, 1185 bp, Artificial Sequence
  Description of Artificial Sequence: Synthetic coding sequence
atgcctggaagatcatgtgttgcattagttttacttgcagctgctgtatcatgtgcagtagctcaacatgcaccaccatggacagaagattgtagaaaatcaacgtatcctccaagtggtccaacatatagaggtgctgttccatggtataccattaatcttgatttgccaccatacaagcgatggcatgaattaatgttagataaggctccagttttaaaagttattgtcaactctcttaaaaatatgattaatacgttcgtgccaagtggtaaaataatgcaagttgttgatgaaaaattaccaggacttcttggaaattttccaggaccatttgaagaagaaatgaaaggtattgcagcagtaacagatattccattaggagaaattatttcttttaatattttctatgaactttttacaatctgtacttcaattgttgctgaagataaaaaaggacatctaattcatggaagaaatatggactttggagtttttttaggatggaatattaacaatgatacttgggttattacagaacaattaaaacctcttacggttaacttagattttcaacgaaataataaaacggtttttaaagcatcatcatttgcaggttatgtaggtatgcttacaggatttaaaccaggacttttctcacttacattaaatgaacgattttctattaatggaggatatctaggaatattagaatggattctcggaaagaaagatgtaatgtggattggatttcttacaagaacagtattagaaaattctactagttacgaagaagctaaaaacttattaacaaaaactaaaattctagctccagcttattttattttaggtggaaatcaaagtggggaaggatgtgttattaccagagatagaaaagaaagtttagatgtttatgaattagatgctaaacaaggtagatggtatgtagtacaaacaaattatgatcgatggaaacacccatttttcttggacgaccgaagaactcctgcaaaaatgtgtcttaatcgtacatctcaagagaatatttctttcgaaactatgtatgatgttctttcaactaaaccagttttgaataaattgacagtctatacaacacttattgacgttacaaaaggacagtttgaaacatatcttagagattgtccagatccatgtattggatgg

SEQ ID NO: 17259 - DNA, 1185 bp, Artificial Sequence
  Description of Artificial Sequence: Synthetic coding sequence
atgcccggtcggagctgtgtggccctggttttgttggctgctgccgttagctgtgcagtggcacagcatgctcccccatggacagaagattgccgaaagtccacttatcctccatccgggcctacctatcgaggtgcagttccctggtatacaatcaacctcgaccttcccccctacaagagatggcacgaattgatgctggataaagcacctgtcctgaaagtgatcgtcaatagcctgaagaatatgataaatacatttgttcctagtggcaagatcatgcaggttgtggatgaaaaactccccgggctgttgggcaatttcccaggcccatttgaggaagaaatgaagggcatcgccgccgttaccgatatcccgctgggggaaataatctccttcaacatcttctacgagctatttactatatgtacctccattgtggctgaggacaagaaagggcatttgattcatggtcgcaacatggatttcggggtgtttctgggatggaacatcaacaatgatacctgggtgattacggagcagctgaaacccctcacagtgaacctcgactttcagagaaacaacaaaacagtgtttaaggcgagctccttcgcgggctacgtgggcatgctgactggtttcaagcctggcctgttttccctcacgctcaatgagcggttcagtataaacgggggatacctgggcatactggagtggattctgggcaaaaaggatgtcatgtggatcggtttcttgactcgaaccgttctggagaactctacgtcctacgaagaagctaaaaacctcctaaccaagactaaaatactggctccagcctattttatcctgggcggaaatcagtctggcgagggctgcgtgatcacaagggaccgcaaagaatctcttgatgtgtatgagctggacgctaagcagggccggtggtacgtcgtgcagaccaattacgaccgttggaagcacccattcttcctggatgaccggaggacccccgcaaagatgtgcctgaaccgtacctctcaggagaacatttcctttgagaccatgtacgacgtactgagtactaaaccagtgctgaacaagttgacagtctacacaaccttgatcgatgtgaccaaggggcagttcgagacatacctgagggattgccccgatccatgtatagggtgg

SEQ ID NO: 17260 - DNA, 1185 bp, Artificial Sequence
  Description of Artificial Sequence: Synthetic coding sequence
atgcccggacgcagttgcgtggccctggtgctcctagctgccgcggtctcgtgtgctgtggcgcagcacgctcctccttggactgaggattgccgcaaatctacctaccccccctcgggtccgacttaccgcggagccgttccatggtatacaatcaatcttgatttacccccgtacaaaagatggcacgaactcatgcttgataaagcacctgtgctcaaagttatcgtgaactcccttaaaaacatgatcaatacttttgtccccagtggcaagatcatgcaggtagtcgatgagaaactgcccggtttgctcgggaatttccctgggccctttgaggaagagatgaaaggcatcgccgccgtgaccgatatccccctgggggagatcatatctttcaacatcttttacgaattgttcactatctgcaccagcatcgttgctgaggacaaaaagggtcatctgatccacggtcgtaacatggactttggcgtgttcttaggctggaatatcaacaacgatacatgggtcatcaccgaacagctcaagcccctgacagtgaaccttgacttccagcgcaataataaaacggtgttcaaagcttcttccttcgcaggatatgtgggtatgctcacaggattcaagcccggcctgtttagtctcactttgaacgagaggttcagcatcaacggcggatatctgggtatcctggagtggattctcgggaaaaaggatgtaatgtggatcggattcctgacccggacagttctggagaactcaacctcttatgaggaggccaagaacctgttgaccaagacaaagatcctggctcctgcttactttattctgggaggcaaccagtcaggggagggatgtgtgatcaccagagatcgaaaagagtccctcgacgtgtacgaacttgatgccaaacagggcaggtggtatgtcgttcagaccaactatgaccggtggaaacacccatttttcctggacgaccggagaacaccagcgaagatgtgcctgaaccggacatctcaggagaatatatcttttgagaccatgtacgatgtactgtcaacgaagcctgtcctcaacaaacttactgtatacactaccctcatagatgtgacaaaagggcagtttgaaacctatctaagggattgcccagatccctgcatcggatgg

SEQ ID NO: 17261 - DNA, 1185 bp, Artificial Sequence
  Description of Artificial Sequence: Synthetic coding sequence
atgccggggcgatcgtgtgtcgctcttgtcctgcttgcagcggcggtttcgtgcgcggtggcccaacacgcgccaccgtggactgaagattgcagaaagagcacctaccccccgtccggaccaacctaccgtggtgccgtgccgtggtacaccatcaacctggacctgcccccctataagcgctggcatgagttgatgttagacaaggccccggttttgaaggtcatcgttaacagcctgaagaatatgattaacaccttcgtcccttcgggcaagatcatgcaggtcgtagacgagaagctgcctggtcttctgggcaacttccccggaccgttcgaggaggagatgaaaggcatcgccgcagtcactgatatcccgctcggtgagatcatttccttcaatatcttctacgagctcttcaccatctgcacctcgatcgtcgccgaggacaagaagggtcacctcattcacggtcggaatatggattttggcgtcttcctcggatggaacatcaataacgatacttgggtgatcacggaacagctcaagcctctgacagtgaacctcgatttccaacggaacaataagactgttttcaaagccagcagttttgctgggtacgtaggaatgcttacgggcttcaagcctggtttgttttccctgaccctgaacgaacggtttagcatcaacggaggctacctgggcatcctggagtggatcctcggaaagaaggatgtgatgtggatcggctttttgacgcgcaccgtgctcgagaacagtacgtcgtatgaagaggccaagaacctgctaactaagaccaagattctcgccccagcttactttattctcggaggcaaccaaagcggcgagggctgcgttattactcgcgatcgcaaggagagtcttgacgtttatgagctcgacgccaagcagggcagatggtacgtggtccaaactaactacgacaggtggaagcatccgttcttcctcgacgatcgccgcaccccagccaagatgtgcttgaaccgtacctcacaggagaacatctctttcgagaccatgtacgatgtgctgtccaccaaaccggtgctgaacaagctaacagtctacacgaccctcatcgacgtcaccaagggccaattcgaaacatatcttagagactgccccgatccctgcatcggctgg

SEQ ID NO: 17262 - DNA, 1185 bp, Artificial Sequence
  Description of Artificial Sequence: Synthetic coding sequence
atgccaggacgaagctgtgttgccctggtcttgctagcggccgcagtgtcatgtgcagtggcccagcatgctcctccttggacagaagattgccgaaagtcaacttatcctccctcaggacccacataccggggggctgtgccttggtacaccattaacctcgatttgccaccgtataaaaggtggcacgagcttatgctggataaagcccccgtccttaaagttatcgttaacagcctgaagaatatgataaacacatttgtgccttcaggcaagatcatgcaggtggtggacgagaaattgccaggactgctcgggaactttcccggccccttcgaggaagaaatgaaaggaattgcagctgtgacggacatccctctcggggagatcatcagcttcaacatattttacgagttgtttacaatctgcacatcaatcgtggccgaagataagaaggggcacctcatccacggccggaacatggacttcggggtgttcctgggttggaatatcaacaatgacacctgggtgatcaccgagcagctgaaacctctgactgtgaacctagatttccagagaaacaataaaacagtcttcaaggcctcctcatttgcaggctatgtcgggatgctaacaggattcaagcctggtttgttttctttgacacttaatgaacgcttttcaatcaacggaggctacttgggaatccttgagtggatacttgggaaaaaggacgtgatgtggattggattcttgacccggacggtactggaaaacagcaccagctacgaagaggccaagaacttgctcaccaagactaaaatattggcccccgcctatttcattctggggggtaaccagtcgggagaaggatgtgtgattacccgagatagaaaggagtccctggatgtctacgaactggatgctaaacagggtcggtggtatgttgtgcaaacaaactatgaccggtggaagcaccccttttttctggatgacaggcggacgcctgccaagatgtgtttaaatcggacctcccaagagaacatctcttttgagacaatgtatgacgtgctgtctacaaaacctgtgttgaacaagttgacggtatataccactttgatcgacgtcactaagggccagttcgaaacttacctgcgggactgccccgacccatgtatcggctgg

SEQ ID NO: 17263 - DNA, 1185 bp, Artificial Sequence
  Description of Artificial Sequence: Synthetic coding sequence
atgccgggaagaagctgcgttgcactggtgttgctggctgctgccgtctcgtgcgctgtcgctcagcatgcccctccttggaccgaagactgtaggaagtctacgtatcctccttccggtcccacataccgaggcgccgtgccatggtacaccatcaacttggacttgccaccctacaaacgctggcacgaattaatgctggataaggctccagtactgaaggttattgtaaactctttgaagaatatgataaatacctttgttcccagcgggaaaataatgcaggtggtggatgagaaattgccaggactgctcgggaactttcctggtccctttgaagaagaaatgaagggaattgccgccgtgactgatatcccactgggggaaattattagcttcaacatcttctacgagctattcactatctgtacatctattgttgcagaggacaagaaaggacatcttatccacgggcggaacatggattttggcgtattcctggggtggaacattaataatgatacctgggtcattacagaacagctgaaacccctgacagtcaatcttgacttccagaggaacaataagaccgttttcaaggcatctagcttcgcaggctatgtcggcatgctgacagggtttaagccagggctgttcagccttacacttaacgagaggttctccatcaacggaggctacctgggcattctagaatggatcctcggcaaaaaggacgtgatgtggatcggttttttgacacggacagtgttggagaatagcacttcctacgaagaagccaagaacctgttgacaaagacgaaaatactggcacctgcctatttcatcctgggggggaatcagtcaggcgaaggttgcgtgattacaagagatcggaaggaaagtttggatgtatacgaactagatgccaagcaggggagatggtacgtcgtgcagacaaattacgaccgttggaagcatccattcttcttggacgatagacggacacccgctaaaatgtgcctcaatcgcacaagccaggagaatataagctttgagacaatgtacgacgttctgtcaaccaaacccgtcctgaacaagctgacagtgtataccaccttaattgatgtgactaaaggccaatttgagacttacctccgggactgtccagatccctgcatcggatgg

SEQ ID NO: 17264 - DNA, 1185 bp, Artificial Sequence
  Description of Artificial Sequence: Synthetic coding sequence
atgcccggtcggtcttgtgtggccctcgtacttctggctgctgccgtaagctgtgcggtcgcacagcacgctcctccctggacggaagactgtcggaagtccacctaccccccctccgggcccacatatcgaggcgcggtgccctggtacaccatcaacctggatctgccaccgtataagcggtggcacgaacttatgttggataaggcccccgtcctgaaagtaatcgttaattccctcaagaatatgatcaatacattcgttccgagcggcaaaatcatgcaggtggttgacgagaagctgccgggcctcctgggaaacttccctggcccattcgaggaagaaatgaaaggcatagcagccgtaacagacataccccttggcgaaattatctcttttaacatattttatgaactgttcactatctgtaccagcattgtagccgaggacaagaaagggcacctcatacatgggaggaatatggacttcggagttttccttgggtggaatatcaataatgacacgtgggtgataactgagcagttgaagccgctcacagtgaacttggactttcagagaaacaataagactgtgtttaaggcttctagcttcgctgggtacgtgggcatgctcaccggcttcaaacccggcctgttcagtctgacactgaacgagaggttcagtattaatggagggtatctgggtatcctggagtggatccttggtaagaaggacgttatgtggattggatttctgacccggactgttctcgagaattccacgagctatgaggaggcgaagaatctgcttaccaagaccaaaatactggcaccggcatacttcattctcggcggaaatcaatctggtgaggggtgcgtgattactcgcgaccggaaggagtcccttgacgtgtatgaactggacgcaaagcaagggcggtggtatgttgtgcagacaaactacgatagatggaagcatccctttttcctggatgatcgacgcacacctgctaagatgtgtttgaatcggacctctcaggaaaacataagcttcgagaccatgtatgacgtcctgtctacaaagcctgttcttaacaagcttactgtctacacaactctgatcgatgttactaaggggcagtttgaaacctatctgagggactgcccggacccatgcataggctgg

SEQ ID NO: 17265 - DNA, 1185 bp, Artificial Sequence
  Description of Artificial Sequence: Synthetic coding sequence
atgccaggccgcagctgtgttgctctggtgctgctagctgcggccgtttcttgtgctgtggcacaacacgcaccgccatggaccgaggattgccgcaagagcacctatccgccaagcggccctacgtaccgcggcgcagttccgtggtatacaattaacttggatctgcctccatacaaacgttggcatgagctcatgctcgacaaggcacctgttctgaaagtgatcgtgaacagcttaaagaacatgatcaacacctttgtcccttccggtaaaatcatgcaagtcgtggatgaaaagctgccggggctgctgggaaacttcccagggccatttgaagaggagatgaaaggcattgcagctgtgacggacattccgctgggggagatcattagcttcaatatcttctacgagctgtttaccatttgcaccagtattgtagcagaagataaaaagggacacctgatccacggtcgtaatatggattttggtgtgttcctgggttggaacattaacaacgacacttgggtaatcacggagcagctgaaacctttgactgttaatctagattttcagaggaacaataagacggtgtttaaagcctcttcttttgcgggctatgtcggaatgctaaccggctttaaaccaggcctgttttctctgacgctgaatgagaggttcagcatcaatggtggctatctgggcatcctggaatggatcctggggaaaaaggatgttatgtggattggcttccttacccgaaccgtgctggaaaattccacttcttatgaagaagcaaagaacctgctgactaaaactaaaattctggccccagcctattttatcctgggtggtaaccagagcggtgagggctgcgtgatcacgcgtgaccgtaaagaaagtctggatgtttacgagctggatgcgaagcaaggtagatggtatgtggtgcagactaactacgaccgttggaaacacccattcttcctggacgaccgccggaccccagccaagatgtgtctgaatcgcaccagccaagagaacatctctttcgagaccatgtacgacgtcctgagcaccaagcctgtcctgaacaagctcactgtgtacaccaccctgattgacgtgactaaaggtcaatttgagacttacctgcgcgattgcccggatccttgcatcggctgg

SEQ ID NO: 17266 - DNA, 1185 bp, Artificial Sequence
  Description of Artificial Sequence: Synthetic coding sequence
atgccgggtagatcttgtgttgcactagttcttctggcggccgcagtatcgtgcgcagtagcgcaacatgctcctccatggactgaagattgcagaaagtcgacatatcccccgagtggacctacttacagaggagccgtcccttggtatacaataaacttagacctcccaccgtacaaacggtggcatgaattaatgctcgataaagctccagtcctaaaagtcatcgttaattcattgaaaaatatgattaatacttttgtaccatcgggaaagattatgcaagttgtggatgaaaagctccctggattacttggaaatttcccaggtccctttgaggaagagatgaagggcatagccgcagtaacagatattccactgggagagattattagtttcaatatcttctatgaactgtttacaatttgcactagtattgtagctgaagataaaaaaggacacctgatccatggacgtaacatggattttggagtgtttctaggatggaatattaataatgatacatgggttataacagagcaattgaagccactgacagttaatctggacttccagagaaacaataaaactgtttttaaagcatcttcgtttgctggatatgtgggaatgctcacaggttttaaacctggtttgttttcgctcactctcaatgagcgattttcgatcaatggtggatatttgggaatcttggagtggattctaggtaaaaaggatgttatgtggattggatttcttactcgtaccgtattagaaaactcaacaagttatgaagaggccaagaatctactcacgaaaactaagatacttgccccagcatatttcatcttgggaggaaatcaatcaggagagggatgtgttatcacaagagatcgtaaagaatccttggatgtctatgagcttgatgcgaaacagggacgttggtatgtggttcagactaattatgatcggtggaaacatccattttttctggatgatagacgaacccctgcaaagatgtgcttgaatagaacatctcaagaaaacatctcatttgaaactatgtatgatgtcttgtcgacgaaacctgttttaaataaactcacagtctacacaacgttgattgatgttacaaagggacagttcgaaacatatcttcgagattgcccagatccatgcattggttgg

SEQ ID NO: 17267 - DNA, 1185 bp, Artificial Sequence
  Description of Artificial Sequence: Synthetic coding sequence
atgccagggcgctcatgcgtggcgttggtgctgctcgctgcagcggtatcttgcgcagtcgcacagcatgctcccccttggaccgaggactgcaggaagtccacatatccaccgtccggccccacctaccgtggagccgtaccttggtacactataaatctggacctgcccccttacaagagatggcacgaactaatgttggataaggcccctgttttgaaagtgattgtcaacagcctcaaaaatatgattaatactttcgtgccaagcggtaaaattatgcaagtagtagatgaaaagctgcctggcctcctcggcaactttcctgggccgttcgaggaggagatgaagggcatcgctgctgtgactgatattccacttggggagattatctcgttcaatatattttacgaattgttcacgatctgcacgtccattgtagccgaagataaaaaaggacatctaatccacggacggaatatggacttcggagtgttccttggatggaatattaacaatgatacatgggttataactgagcagttgaagcccttgacagtgaacttggattttcagagaaataacaagacagtgtttaaagccagtagcttcgccgggtatgttggaatgctgaccgggttcaagccaggtctgttttcactgaccttgaatgaacgcttctcaatcaacggtggctaccttggaattttagagtggatcctggggaaaaaagatgtcatgtggataggatttttgacaagaactgttctggaaaactctacctcctacgaagaggcaaaaaatcttctcacgaaaaccaagatactcgcaccagcctattttatccttgggggtaaccagtctggggaaggatgtgtcattacccgtgatcgcaaagagtctctggatgtgtacgaactggatgcgaagcagggccggtggtacgtggttcaaactaattacgaccgctggaagcatccgttcttcctggatgacaggagaacccctgctaagatgtgtctgaatcggacctcccaagagaacatcagtttcgagactatgtatgacgttttgagtactaagccggtcctgaataaacttactgtttatacaactttgatagacgtcactaagggccaattcgagacctacctacgcgattgtcctgacccatgtattggctgg

SEQ ID NO: 17268 - DNA, 1185 bp, Artificial Sequence
  Description of Artificial Sequence: Synthetic coding sequence
atgcccggccggtcctgcgtcgccctagttctcctcgccgccgctgtgtcttgcgccgtggcgcagcacgctccaccttggacagaggactgcaggaagagcacttaccctccaagtggtcctacatatcggggggcggttccatggtacactatcaatctggatcttccaccatataagagatggcatgaactaatgctagacaaggcacccgtgttgaaagtcatagtaaattcattgaagaacatgataaacaccttcgtcccgtccggcaagatcatgcaagtggtcgacgagaagctgccaggacttcttggaaattttcctggcccattcgaagaagagatgaagggaatagcagccgtgactgatatccccctgggggagatcatctcttttaacattttctacgagctgtttactatctgtacgtccatcgtggcagaggataaaaaagggcatttgatccacggtcgaaatatggacttcggtgtattcctcggatggaatattaacaatgacacctgggtgattacagagcagttgaagcctctgaccgtcaatctcgattttcagcgtaacaataaaactgtattcaaggcttctagttttgcagggtacgttggcatgctcacgggtttcaaacccggcctgttcagcttgacccttaatgagcgtttctccatcaacggcgggtacttaggcatcctagagtggatcctgggtaagaaagacgttatgtggatagggtttctcacccgaactgtcttagaaaatagtacatcttacgaagaagcaaaaaatctgctaactaagaccaagatcctggcaccggcctatttcatcctggggggcaaccagtctggcgagggatgtgtcattaccagagaccggaaagaatcattggatgtctatgaacttgacgccaagcaagggaggtggtacgttgtccagacaaactacgaccggtggaagcaccctttcttcctggacgaccgaaggacaccggccaaaatgtgtctgaatcggacgtctcaagagaacatcagcttcgaaacaatgtatgatgtcctctccacaaagcctgtgctcaataagctgaccgtatacaccacactgatcgacgtgaccaaaggccagttcgagacctacctgcgtgattgtcctgatccctgtataggatgg

SEQ ID NO: 17269 - DNA, 1185 bp, Artificial Sequence
  Description of Artificial Sequence: Synthetic coding sequence
atgccgggccgcagttgcgtggccctcgttctgttagccgcggcagtatcctgcgcggtggcccagcatgctccaccctggactgaagattgtaggaagtcgacatatcctcccagcgggccaacttatcggggggctgtgccttggtatactatcaacctggatctcccgccctataaacgatggcatgagctgatgctggacaaagcaccagttttgaaagtcatcgtgaattccctgaagaatatgatcaatacgttcgtccccagcggcaagattatgcaagtggttgatgaaaaactgcccggcttgctgggcaattttcctgggccgtttgaggaggaaatgaaagggatagctgccgtgacagacatccctctcggagagatcatttcttttaacatcttttacgaattgttcactatctgtacgagcattgttgctgaggacaaaaagggccacctgattcatgggaggaatatggatttcggcgtattccttggttggaatataaataacgacacctgggtcattaccgaacagctgaaacccctaacagtgaatctggatttccagcgaaacaacaagactgtctttaaagcgtctagctttgcaggctatgtggggatgcttacgggcttcaaacccggattgttctcactgaccctcaacgaacggtttagtattaatggtggatacctcggcatactggaatggatattaggtaaaaaagacgtgatgtggattggatttctcacacgtacagtccttgagaacagtacctcctatgaagaagcaaagaacctcctgacgaagacgaaaatcttggcgcctgcatattttatcctggggggcaatcagagcggtgagggatgtgtgatcaccagggatagaaaagagagcctggatgtgtacgagcttgacgcgaagcagggcagatggtacgttgtgcagacaaactacgaccggtggaagcaccccttctttttagatgacaggaggaccccggctaagatgtgtctgaatcgcaccagccaggaaaatattagtttcgagacaatgtacgatgtcctgagcaccaaacccgtcctaaataagttgaccgtttatactacgcttattgacgtaactaaaggtcagttcgagacttatctgcgagactgtccagacccatgcattggctgg

SEQ ID NO: 17270 - DNA, 1185 bp, Artificial Sequence
  Description of Artificial Sequence: Synthetic coding sequence
atgccgggtagaagctgcgtggctctggtgctgctcgcagccgctgtgtcctgtgcggttgctcagcatgcgccgccttggactgaggactgtcgaaagtcgacttatcccccctccggtcccacctatcgtggggctgtgccctggtacaccatcaatctcgacctccctccgtacaagcgctggcacgagctcatgctggataaagcacctgtactgaaggtcattgtgaatagcctgaaaaacatgatcaatacattcgtaccgagtggaaagataatgcaggtggtcgatgagaagctgccaggtctcctggggaatttcccaggccccttcgaggaggagatgaaagggatcgcggccgtgacggacataccactcggcgaaatcatcagcttcaatattttctatgaattattcaccatctgtacctctattgtcgctgaggacaagaagggccacctgatccacggtcgcaatatggacttcggcgtctttctcggctggaacattaataatgacacgtgggtgatcaccgagcaacttaagccgctgaccgtcaacctggacttccagcgcaataacaaaacggtatttaaggcttcgtccttcgctggctacgtaggcatgttgaccgggttcaagccaggattattttcactgacactaaacgagcggttctccatcaatggtggctacttgggtattctggagtggattctgggaaaaaaagacgtcatgtggattgggtttctcaccaggacggtgctggaaaactcgactagctacgaggaggcaaagaatctcttgaccaagaccaagatcctggcccctgcttacttcatcctgggaggcaatcagagcggcgagggttgcgtcatcacacgcgatcgtaaggagagcctggatgtgtatgaactggacgcgaaacaaggccggtggtacgtggttcagacaaactacgatcgttggaagcatcccttctttctcgatgatcgccgaactccggccaagatgtgcctgaatcgaacctcgcaggagaacatctcatttgaaacgatgtatgacgtcctctcaacgaaacccgtgctgaacaagttgaccgtgtacacaacgcttattgatgtcacaaagggccagttcgagacataccttagggattgtccagatccctgcatcggatgg

SEQ ID NO: 17271 - DNA, 1185 bp, Artificial Sequence
  Description of Artificial Sequence: Synthetic coding sequence
atgcccggccggtcctgtgtcgccctggtgctcctggctgccgccgtctcttgcgccgtggcacagcacgcaccgccatggactgaggactgtcgaaaaagtacctacccgccatccggtccaacatatcgaggagccgttccctggtatacaatcaacttagacctacctccttataagaggtggcatgagctaatgctcgataaggcaccagtgttgaaggtgatcgtgaatagcttgaaaaacatgattaacactttcgtaccctccggaaagatcatgcaggtcgtcgatgagaaactccctggattactgggaaattttcctggtccattcgaggaagagatgaagggcatcgccgccgtcactgatattcccttgggtgagatcatcagtttcaatattttttacgaactcttcactatctgcacaagcatcgtggccgaggacaaaaaagggcacttgattcacggtagaaacatggactttggagtgttcctgggatggaatattaataacgatacgtgggtaattaccgaacagctgaagcccctaaccgtaaatctggacttccagcgcaataacaaaacggtcttcaaggctagctcgttcgccggatatgtcggaatgctgacggggtttaagccaggcttgttttctttaaccctaaatgaaaggttcagtatcaacgggggttacctcggcattctggagtggatcctaggcaagaaagacgtgatgtggataggattcctcaccagaaccgtcctggaaaattcaaccagttatgaggaggccaaaaatctcctcaccaaaactaagatactggctcccgcttatttcattctgggaggcaaccagagtggggaaggatgtgtgatcactagggaccgcaaggaatcactagacgtgtatgaacttgatgctaaacagggtagatggtacgttgttcagaccaattatgatcgctggaaacatcctttctttctggacgataggcgaacgcccgcaaaaatgtgtctgaatcgcacatctcaagagaacatatcttttgagaccatgtacgatgtcctgagtaccaaaccggttcttaataagctcacagtgtacacaacattaattgacgtcacaaaagggcagtttgaaacttatctacgggattgcccagacccctgtatcggctgg

SEQ ID NO: 17272 - DNA, 1185 bp, Artificial Sequence
  Description of Artificial Sequence: Synthetic coding sequence
atgcccggcagatcctgcgtcgccttggtcctgttggcagccgccgtgagttgtgcagtggctcagcacgcccctccctggacagaggactgccggaagtcaacttatcctccttctggacccacctaccggggggctgtgccatggtatactatcaatctggatctgcccccatataagagatggcacgaacttatgttggacaaggcacccgttttgaaggttatagtcaactctctgaagaacatgatcaatacatttgttccgtcagggaagatcatgcaagttgtggacgagaaactccccggactgctcggaaactttccagggcctttcgaggaagaaatgaagggcatagcagcggtgaccgatattcctcttggagaaattatcagtttcaatattttttatgaattattcaccatctgtactagcatcgtggctgaagataagaagggacatttgatacacggccgtaacatggattttggcgtgtttctgggctggaatattaacaacgacacatgggtgatcactgaacagctaaaacctctaaccgtaaacctggacttccagcgtaataacaaaacagtctttaaagcttcatcttttgcaggctatgtgggtatgctgacgggattcaagccagggctattctctctgaccctgaatgaaagatttagcattaatgggggctacctggggatactggagtggattctggggaagaaggacgtgatgtggatcggctttttgactcgcactgtgctggagaattccacatcatacgaagaagccaaaaatctattgactaaaacgaaaatcctggcccccgcctactttatactgggaggcaatcagagcggggagggctgcgtaataacaagggatagaaaggaatcactggacgtgtacgagttggatgctaagcagggtcgctggtacgtggttcagacgaattacgaccgctggaagcacccattttttctggatgataggcggacccccgctaagatgtgccttaacagaacctcacaggaaaacatctcttttgagaccatgtacgatgtactgagcaccaagccagtgctgaataagttgacggtgtataccacactgatagatgtaacgaagggtcagtttgagacatacctgcgtgactgtccggatccctgcattggctgg

SEQ ID NO: 17273 - DNA, 1185 bp, Artificial Sequence
  Description of Artificial Sequence: Synthetic coding sequence
atgcctggacgcagctgcgttgcacttgtgctgctcgctgccgcagtgagttgcgcggtggctcagcacgcgccaccgtggactgaagattgtcggaaaagtacctatcccccaagcgggccaacttataggggcgccgtgccctggtatacgattaatctggacctccccccatataagcgatggcatgagcttatgctggacaaggcccccgttctgaaggtgatcgtcaacagcctcaaaaatatgatcaacactttcgtacctagcggaaagattatgcaagtagtcgatgaaaagctacctggcctgctgggtaactttcctgggccttttgaagaggagatgaagggaatcgcagcagttactgacatccctctgggggaaatcatttccttcaacatcttttatgagctctttacaatctgcacgtcaatagtggctgaggataaaaagggccaccttattcacggtcgaaacatggatttcggagtctttttaggctggaacattaacaatgacacctgggtgattactgagcagctaaagcccttgactgtgaacttggattttcagcgaaacaacaagaccgttttcaaagcaagttcattcgctggctatgtaggcatgctaacaggctttaagcctggcctatttagtctaactttgaacgagcgcttttccatcaatgggggctatctgggcattttggagtggattctgggtaaaaaagatgtgatgtggataggctttttaactaggacggtgctggagaatagcaccagttacgaagaagcaaaaaacctcctaacaaagactaagattttggctccagcctacttcatactcggcggtaaccagtccggtgaaggatgcgtgataacacgggacaggaaggaatcactggatgtgtatgagctcgacgccaaacagggacgctggtatgtggttcagactaattatgatagatggaaacatcccttctttcttgacgatcggagaacccccgcgaagatgtgtcttaacaggaccagtcaagagaatatctctttcgaaacaatgtacgatgtgttgagcaccaaaccagtccttaacaagttaacagtttacacgacgctgatagacgtcacgaagggacagtttgaaacatacttgagggattgccctgacccttgtatcgggtgg

SEQ ID NO: 17274 - DNA, 1185 bp, Artificial Sequence
  Description of Artificial Sequence: Synthetic coding sequence
atgcctggaagaagttgtgtggccctggttttgctggccgctgcagtctcttgtgccgttgcccagcacgccccaccttggaccgaggactgcaggaagtctacatatcctccaagcggcccaacctacagaggtgctgttccttggtacactatcaacttggatctgcccccctacaagcgttggcacgagcttatgctggacaaggcaccagtgttgaaagtcatcgtcaatagcttgaagaacatgattaacacattcgtcccttctggaaaaattatgcaagttgtggatgaaaagctgccaggactgttgggcaatttccccggacctttcgaggaagagatgaagggtatcgcagccgtgacagacatcccccttggtgagatcatctccttcaacatcttctacgaactcttcacaatatgtacctctatcgtggctgaggacaagaagggtcacctgattcacggacgtaacatggacttcggtgtcttccttggctggaatattaacaacgatacttgggtaatcacagaacagctgaagcctctgactgtaaatcttgacttccagcgcaacaacaaaactgtattcaaagctagctcctttgctggttatgtgggcatgctgactggattcaaacccggcctgtttagtctgaccctgaacgaacgcttttccatcaacggaggttacctgggcatcctggagtggatcctgggtaagaaggacgtaatgtggatcggatttctgacccgtacagtgctggaaaattcaacaagctacgaagaggctaagaacttgctgaccaagacaaaaatcttggcacccgcctacttcattctgggcggaaaccagtctggtgaaggttgtgtgattactcgcgatcgtaaagaaagcctcgacgtatacgaactcgatgctaagcaaggccgctggtacgtggtgcagaccaattacgaccgctggaagcaccccttttttctggacgaccgtaggactccagctaagatgtgcttgaacagaaccagtcaggaaaacatcagttttgagacaatgtacgacgtcctgagtaccaagcctgtgctgaacaaacttactgtgtacaccactctgatagacgtgaccaagggtcaattcgaaacatacctgagagactgtcctgatccatgcattggatgg

SEQ ID NO: 17275 - DNA, 1185 bp, Artificial Sequence
  Description of Artificial Sequence: Synthetic coding sequence
atgccgggtcgttcgtgtgtagcgttagttctactagcggcggcggtttcgtgtgcggtagcgcaacatgcgccgccgtggacggaagattgtcgtaaatcgacgtatccgccgtcgggtccgacgtatcgaggtgcggtaccgtggtatacgataaatttagatctaccgccgtataaacgttggcatgaactaatgttagataaagcgccggtactaaaagttatagttaattcgctaaaaaatatgataaatacgtttgttccgtcgggtaaaataatgcaagtagtagatgaaaaattaccgggtttattaggtaattttccgggtccgtttgaagaagaaatgaaaggtatagcggcggtaacggatataccgttaggtgaaataatatcgtttaatatattttatgaattatttacgatatgtacgtcgatagtagcggaagataaaaaaggtcatctaatacatggtcgtaatatggattttggtgtttttttaggttggaatataaataatgatacgtgggtaataacggaacaattaaaaccgttaacggttaatttagattttcaacgtaataataaaacggtatttaaagcgtcgtcgtttgcgggttatgtaggtatgttaacgggttttaaaccgggtttattttcgctaacgttaaatgaacgtttttcgataaatggtggttatctaggtatattagaatggatattaggtaaaaaagatgtaatgtggataggttttttaacgcgtacggtactagaaaattcgacgtcgtatgaagaagcgaaaaatttattaacgaaaacgaaaatactagcgccggcgtattttatactaggtggtaatcaatcgggtgaaggttgtgtaataacgcgagatcgtaaagaatcgttagatgtatatgaactagatgcgaaacaaggtcgttggtatgtagtacaaacgaattatgatcgttggaaacatccgttttttttagatgatcgacgaacgccggcgaaaatgtgtttaaatcgtacgtcgcaagaaaatatatcgtttgaaacgatgtatgatgttctatcgacgaaaccggttctaaataaattaacggtatatacgacgttaatagatgtaacgaaaggtcaatttgaaacgtatctacgtgattgtccggatccgtgtataggttgg

SEQ ID NO: 17276 - DNA, 1185 bp, Artificial Sequence
  Description of Artificial Sequence: Synthetic coding sequence
atgccgggcaggtcttgcgtagcgttagttctgcttgcagcagcagtcagttgcgctgtagcgcagcatgcacccccgtggacggaagattgccggaaatctacataccctccttccggacctacataccgcggagctgttccgtggtatacaattaatttagatctgccgccttacaaacgttggcatgagctaatgcttgataaagctccagtacttaaagtcatcgtgaattcacttaaaaacatgatcaatacatttgtcccttctgggaaaataatgcaggttgtggatgaaaaactgccgggcttgctaggtaacttcccaggaccgtttgaagaggaaatgaaaggaatagcggctgttacagacattccattaggagaaattattagctttaatatattttacgagctgtttacaatctgtactagtatcgttgccgaagataagaaaggtcatctcattcacgggcgcaatatggactttggagtctttctggggtggaatattaataatgatacatgggttatcacggaacagcttaagcccttaaccgtaaacttagatttccagcgcaataataaaactgttttcaaagcgagctcatttgcaggttatgtaggaatgctgacaggctttaaaccgggacttttttctcttacgcttaacgaaagattttccattaatggaggttatcttggtattctggaatggatccttggcaaaaaagacgtcatgtggataggatttcttacccgtacggtgctcgaaaactcaacttcctatgaagaggccaaaaatcttttgacaaaaacaaaaatactagccccggcctattttattttgggtggaaatcaaagcggtgaagggtgcgtaatcacccgtgataggaaagaatctcttgatgtctatgaactggacgcgaaacaaggtcgatggtatgtagttcagaccaattatgatcgttggaaacatcctttttttttggatgatagacgtacgcctgcgaaaatgtgcctcaaccgcacgtctcaggaaaacatttcatttgaaacaatgtatgatgtactgagcacaaagccggtgcttaataaattgacggtctacaccacgttaattgacgttacgaagggacagtttgagacatatcttagagactgtcctgacccttgtattggatgg

SEQ ID NO: 17277 - DNA, 1185 bp, Artificial Sequence
  Description of Artificial Sequence: Synthetic coding sequence
atgcccggacgcagttgcgtggccctcgtattgctagctgcggccgtgtcttgtgctgtggcgcaacatgcaccaccttggacggaggactgccgcaagtctacatacccaccatccggcccaacctatcgaggagccgtgccatggtatacaatcaacctggacttgcccccgtacaaacgctggcatgaactgatgttagataaagccccggttctgaaggtcatcgtgaactctttgaagaatatgataaacactttcgtgcctagcggtaagattatgcaagttgtggatgaaaaactgccaggtctgctcgggaactttcctggccctttcgaggaggagatgaaggggatcgctgccgtaacagatattcccctgggtgaaatcatcagtttcaacatcttttacgaactgtttaccatctgtacatccatcgtagccgaagacaaaaagggccacctcatccacggacggaacatggattttggggtgttcctaggctggaacatcaataacgacacctgggttatcacagaacagctcaagccactgaccgttaatctggatttccagcgcaacaacaagacagtgtttaaggcatcatccttcgccggctatgtggggatgcttacgggctttaagcccggtctgttcagcttgacgttgaacgaaagattctctatcaacggtggttatcttggtattctggagtggattctgggaaagaaggatgtcatgtggattgggtttctgacacgcactgtgcttgagaacagtacatcttatgaggaggccaagaatctgcttactaaaacaaaaatattggcacctgcctatttcatcctaggagggaaccagagcggagagggctgtgtgattacccgggaccgtaaagaatctctcgacgtttacgagcttgacgctaagcagggtcgctggtacgtggttcaaacaaactatgaccgatggaaacacccgttcttcctggatgaccgacgcaccccagcgaaaatgtgcctgaatcgcacatcgcaggaaaatatatccttcgagaccatgtacgatgtcttgtctacgaaacctgtgcttaataaactgacggtttatacgacactgattgacgtcactaaaggccaatttgagacgtatctgagggactgtcccgatccatgcattgggtgg

SEQ ID NO: 17278 - DNA, 1185 bp, Artificial Sequence
  Description of Artificial Sequence: Synthetic coding sequence
atgcccggccgcagctgtgtagccctggtcctcctggctgcagccgtgtcctgcgcagttgctcagcacgcccccccatggacggaggactgtagaaagagcacatatccaccttcaggtccaacatatcgcggggccgtgccatggtatacaataaacctcgacctgcctccttacaaaagatggcatgaacttatgcttgacaaagctcctgtgctgaaagtgattgtgaacagcttgaagaacatgatcaacactttcgtcccttcaggcaaaattatgcaggtagtggacgaaaagttgccgggactgctggggaactttcccggcccattcgaagaggaaatgaagggaatcgccgccgttaccgatataccgttaggagaaatcatttcattcaacatattctatgagctttttacgatctgcacttctatcgtagcggaagacaagaagggacatctgattcacggtcgtaatatggacttcggcgtttttctggggtggaacataaataatgacacttgggtaatcaccgagcagttaaagccactgacagtgaatctggactttcagagaaacaataagaccgtctttaaagcatcttcgttcgccgggtatgtgggtatgctgactggattcaaacctggcctgttttcactgacactgaacgaaagattttcaatcaacggtggatacttgggcattttagagtggattctgggcaagaaggatgtgatgtggatcggatttctcacacgtactgttctcgaaaatagcacctcttatgaagaagccaaaaacctgctgaccaagacaaagattttggctcctgcctacttcattctcggggggaaccaatccggagagggctgcgtcatcaccagagaccgcaaggaaagcctggacgtctatgaactcgacgctaagcagggacggtggtatgtcgtgcagaccaactacgaccgctggaagcacccattttttctagacgacaggcggactcccgctaagatgtgtcttaataggacctcacaggagaatattagttttgagactatgtatgacgtgctatccaccaaacccgtccttaataagctgactgtgtacacaacgcttatcgacgtcacaaagggccaattcgaaacatatctgagagactgtccggacccttgcataggatgg

SEQ ID NO: 17279 - DNA, 1185 bp, Artificial Sequence
  Description of Artificial Sequence: Synthetic coding sequence
atgcccggacgcagttgcgttgccctggtgcttctggcggctgctgtaagctgtgccgtggcacagcacgcccccccgtggacagaggactgccggaagagtacttatccccccagtggtccaacctatcgcggggccgtcccttggtacaccattaacctggaccttcctccctataagagatggcacgagttgatgctagataaggctccagttttaaaggtgatcgtaaacagtctgaaaaacatgatcaatactttcgtcccatctggtaagatcatgcaggtggtggatgaaaagttgccaggcctccttgggaacttccccgggcccttcgaagaggagatgaaggggatagccgctgtcactgatatcccactgggggaaatcatttcctttaatattttttacgaactctttaccatatgcacaagcattgtggctgaagacaagaagggacacctcattcacggcaggaatatggactttggagttttcttggggtggaatatcaataatgacacatgggtgatcactgaacagttgaagcctttgacagtaaatctcgatttccagagaaacaataaaacggtgttcaaggcctctagctttgcaggatacgtagggatgctgaccggcttcaagcccggtttgttctcactaactctgaacgagaggttttctataaacggggggtaccttggtatcttggaatggatcctggggaagaaggacgtaatgtggattgggtttctgacacggaccgttctggagaatagtaccagctacgaggaggcgaaaaacttactgactaaaaccaagattctcgcccccgcctatttcatactcggcggcaaccagagcggcgagggttgcgtgatcacccgggacaggaaggagagtctggatgtgtacgaattagatgccaagcagggcaggtggtacgtggttcagactaactacgatcgatggaaacatcctttctttctggacgatcggcggacccccgcgaagatgtgccttaaccgaactagtcaggagaacatctcttttgagaccatgtatgacgtgctcagcaccaagcccgtcctgaacaaactgaccgtgtatacaaccttgatcgatgtgaccaagggccagtttgaaacttatctacgggattgcccagatccgtgtattggctgg

SEQ ID NO: 17280 - DNA, 1185 bp, Artificial Sequence
  Description of Artificial Sequence: Synthetic coding sequence
atgcccgggcgtagttgcgtcgctctggtattattggccgccgccgtttcttgtgctgtcgctcaacacgcgcctccttggacagaagactgccggaagtctacttatcccccatccggtcctacctatcggggagccgtgccctggtacaccattaaccttgatctgccaccatataagcgatggcacgaacttatgctggataaagcacccgtccttaaggtgattgtcaacagtctgaagaacatgatcaatacattcgttccatcagggaagatcatgcaggtggtcgatgagaagttgcctggcctattgggtaattttccaggcccattcgaggaggaaatgaagggtatagccgctgtgaccgacattcctctgggggaaattatcagcttcaacattttctacgaattattcacaatttgcacgagcatagtagccgaagataagaagggacatctcatccacgggaggaatatggacttcggcgtgttcttaggatggaacattaataacgatacatgggtgatcactgaacagctgaaaccactgacagtgaaccttgattttcagaggaacaataaaacagtattcaaggcgtcgtcattcgccggctatgtaggtatgctgacaggattcaaacccggcctattttcactgactttgaatgagagattctcaattaacggcggttatctgggaattctggagtggatattgggaaaaaaagatgtaatgtggatcgggtttctaactcgcactgtactggagaattctaccagttacgaagaggccaaaaaccttctgaccaagaccaagatcctggcgcctgcctatttcattcttggcggtaatcaaagcggcgagggatgcgtcatcactcgcgatagaaaggagagcttggatgtatatgagctggacgcgaaacaagggcggtggtatgttgtgcagacaaattacgacagatggaaacatccgttcttcctggatgaccgtagaactccagccaaaatgtgtcttaatcgcacgtcacaggagaacatctcttttgaaaccatgtacgacgtgcttagcaccaaaccagtgcttaataaactcactgtgtacacgacgctgatcgacgttacgaagggtcagtttgaaacctatttacgtgattgtccagatccttgtattggctgg

SEQ ID NO: 17281 - DNA, 1185 bp, Artificial Sequence
  Description of Artificial Sequence: Synthetic coding sequence
atgcccgggaggagctgcgtggctctggtactgttggcagctgctgtgtcatgcgccgtggctcagcacgcccctccatggaccgaggactgtcgcaagagcacttaccccccatctggcccaacctatcggggcgccgtcccttggtatactatcaatctagatctaccaccctataaacgctggcacgagctaatgctggacaaggccccagttttaaaggttatcgtgaactctttaaagaatatgataaacacttttgtgcccagcggcaaaataatgcaagtcgtggatgagaaactaccaggcctcttagggaatttcccaggcccttttgaagaggaaatgaagggcatcgccgcagtgaccgacatccctctgggcgagattatcagcttcaacatcttttacgaacttttcacaatttgtacttccatagtggccgaggataaaaaagggcatttaattcatggccggaacatggatttcggagtgttcctaggctggaacatcaacaacgacacctgggtcattactgaacagttgaagcctctcactgtcaatttggatttccagaggaataataagaccgtgttcaaggcctcctcttttgcaggctacgtcggaatgcttacaggctttaagccagggctctttagtctcacactgaacgagcgattctctatcaacgggggttatttaggcattctggagtggatattggggaaaaaagacgtgatgtggatcgggttcttaacccgcacagtgttagaaaatagcacttcctacgaggaagctaagaacctgctgaccaagaccaagattttagctccagcatactttattctcggcggcaatcagtcaggcgaaggctgcgttatcacaagagaccgaaaagaatctctggatgtttatgagctggacgctaagcagggcaggtggtatgtcgtgcagaccaattatgataggtggaaacaccctttctttctggatgatcgcaggactcccgccaaaatgtgtctcaaccgcacatctcaggagaatatcagttttgaaactatgtatgatgtgctttctaccaagccagtgttgaacaagctgacagtttacacaactttaattgacgtcaccaaggggcaatttgagacttacctccgcgactgccccgatccctgcatcggctgg

SEQ ID NO: 17282 - DNA, 1185 bp, Artificial Sequence
  Description of Artificial Sequence: Synthetic coding sequence
atgccagggcggtcttgcgtggccctcgtcctgctcgccgctgccgtttcttgcgccgtcgctcagcatgcgcctccatggacagaagattgtcgtaaaagtacataccccccatccgggcctacatacaggggagccgtgccttggtatacaatcaatctggatctccccccttataagcgctggcatgaactcatgctcgataaggcccccgtcttaaaagtcatagtgaattccctcaaaaatatgatcaatactttcgtgccttcagggaagataatgcaggtggtggacgaaaaacttcccggactgctgggaaactttcctgggccctttgaggaagagatgaaggggatcgctgcagtaacagatatccctttgggggaaataatctcttttaacatcttctatgaacttttcacaatttgtacttctattgtggcagaagataaaaaaggacaccttatccatgggcgtaatatggattttggagtttttttaggatggaacattaacaatgacacatgggtgataacagaacagctaaaacctcttactgtaaatctagattttcagagaaacaacaaaacagtgttcaaagcctcttcctttgccgggtatgtagggatgctaacaggattcaagccagggctgtttagtttaacacttaacgaaagattctctatcaatggggggtacctcggaatcctggaatggattttaggaaagaaagatgtaatgtggataggatttctcacacgcacagtcttagaaaattccactagttatgaagaagctaaaaacttgttgacaaaaactaaaatcttagcaccagcctatttcatcctggggggaaaccaatcaggggaaggatgcgtgataactagagatcggaaggaaagtctagacgtatatgagcttgacgcaaaacaggggcgttggtatgttgtgcagacgaactacgatcgatggaaacatccattctttcttgacgataggagaactccagccaagatgtgtctaaatcggacttcacaggagaatatttcatttgaaactatgtatgatgttctgtccactaagccagtgctgaataaacttactgtctatactacactcatcgatgttactaagggacagtttgaaacatatcttcgagattgccccgatccatgtataggatgg

SEQ ID NO: 17283 - DNA, 1185 bp, Artificial Sequence
  Description of Artificial Sequence: Synthetic coding sequence
atgccgggccgcagttgtgttgccctggtgcttttggcagccgcagtgtcctgtgcggtagcacagcatgccccgccctggaccgaggattgccgcaagtccacttacccacctagcggccctacctaccggggcgccgtcccttggtacaccataaacctggacttgcctccatataaacgatggcacgaactgatgctggataaggctccagttctgaaagtgattgtgaactccctgaagaatatgattaacacttttgtgccgagcggcaagatcatgcaagtggttgacgagaagcttcccggactgctgggcaacttccccgggccctttgaggaagaaatgaaaggcatcgcggctgtgaccgacattcctctcggagagattatctcattcaatattttctacgaattgtttaccatctgcacttcaatagtggcggaggataaaaaagggcacttaatacacggtcgaaatatggacttcggggtgtttcttggctggaacataaataatgatacatgggtgatcacagagcagctgaagcccctgacagtgaacttggatttccagagaaataataagaccgtattcaaggcatctagcttcgcgggttacgtgggaatgctcaccggattcaaacctggcctgttttcccttaccctaaatgagcggttcagtattaacggtggatacctaggcatcctagaatggattcttggcaagaaggatgtgatgtggatcggcttcctcacaaggacggtcctcgaaaatagcacttcctacgaggaagccaagaacctactgacaaaaactaaaatcctggctcctgcatactttatcctgggcggcaatcaaagtggtgaggggtgtgtaatcactcgagaccgaaaagagtcccttgatgtttatgaactggacgccaagcagggccgctggtatgttgtgcaaacgaactatgatagatggaaacaccctttctttcttgatgatcgaaggaccccagcaaagatgtgcctgaaccggacaagccaagagaacataagctttgagaccatgtatgacgtgttgagtacaaagcctgtgttaaataagcttacggtatatacaacactgattgacgttacaaaaggccaattcgagacctatctccgagattgcccagacccttgcataggatgg

SEQ ID NO: 17284 - DNA, 1185 bp, Artificial Sequence
  Description of Artificial Sequence: Synthetic coding sequence
atgccaggccgatcctgtgtggccctggtgttgctagccgccgctgtctcttgcgcagttgcgcagcacgcccccccatggactgaggactgtcggaagtcaacttaccctccttccggacctacttaccgtggcgcggtgccctggtataccatcaacctagacttacccccctacaaacgttggcatgaactcatgctcgataaagccccggtattaaaagtgatcgttaactccctgaagaacatgatcaatacctttgtcccatccgggaaaattatgcaggttgtggatgaaaaactgccgggcctgttggggaattttccaggcccattcgaggaggagatgaaaggcatcgctgccgtcacagatatcccgctgggcgagattatctcgtttaacattttttacgaactttttaccatatgtacctccatcgttgctgaagataagaaggggcaccttattcatggcagaaacatggactttggcgtgttcttaggctggaatattaataatgatacctgggttatcacggagcagctgaagccactcactgtgaacctggacttccagaggaacaacaagacagttttcaaggcctccagctttgcgggatacgtagggatgctgaccggctttaaaccaggcctcttctccctgaccctcaatgagagatttagtattaatgggggatacctgggtatcctggagtggatcctcgggaaaaaagacgtgatgtggatcgggttcttaacacggaccgtactggagaacagtaccagttacgaagaagctaagaacctgttgaccaaaaccaagatcctggcgcctgcatacttcatactcgggggcaatcaatcgggcgagggctgtgtcattacccgcgaccgcaaggaatctctggacgtttatgagctggatgcgaaacaaggaagatggtacgtggtgcagacgaattatgatcgatggaagcaccccttcttcctcgacgatcgccggactccggcaaagatgtgtcttaaccggacaagccaggagaatattagtttcgagaccatgtacgacgttctcagtaccaagccagtacttaataaattgacggtgtacacgacactgattgatgtcacaaagggccaatttgagacttatctaagagattgtccagatccctgtattggctgg

SEQ ID NO: 17285 - DNA, 1185 bp, Artificial Sequence
  Description of Artificial Sequence: Synthetic coding sequence
atgccaggcaggtcgtgcgtggctcttgtccttttggccgcagcagtgtcgtgcgctgtggcacaacatgccccgccttggaccgaggattgtcgaaagtcgacctacccgccctctgggccaacctaccgtggggccgttccctggtatacaatcaacttggatttgccgccatataaaaggtggcacgaactgatgttagataaggcccctgtacttaaggtcattgtaaacagtcttaagaacatgatcaatacattcgtgccgtctggaaaaatcatgcaggtcgtcgacgaaaaactgcctggattactaggtaacttcccaggtccattcgaggaagagatgaaggggatagcggccgtaacggatatacctttgggggaaattatctcgttcaatatattctacgagttgttcacaatttgtacttccatcgtggcagaggataaaaaaggacatctaattcacggccgaaacatggatttcggagtgttcctaggatggaacataaacaatgacacatgggtcattaccgaacaactcaagcctttgaccgtaaatttggacttccaaaggaacaacaaaactgtgtttaaggcttcatctttcgccggatacgtagggatgctaacgggttttaaacccggacttttcagtttgacgctcaacgagagattttccattaatggcggctacctaggcatacttgagtggatcttgggtaagaaggacgtcatgtggattggtttcctgacccgtacggttcttgagaacagcacttcctacgaggaagccaagaacctgctgacaaaaacaaaaatattagctccagcgtacttcatcctgggcggaaatcagagcggcgagggctgtgttatcacgcgagaccgtaaggagtcacttgatgtctacgaattagatgcgaaacagggcagatggtacgtagtccagactaattatgaccggtggaagcaccccttttttctcgatgatcggagaactcccgcaaagatgtgtctgaaccgcaccagccaggaaaacatctctttcgaaaccatgtatgacgtcttgtcgaccaaaccagtattaaacaagctgacggtatatactacccttattgacgtaacaaaagggcaatttgaaacttacctacgagactgcccagacccatgcatcggttgg

SEQ ID NO: 17286 - DNA, 1185 bp, Artificial Sequence
  Description of Artificial Sequence: Synthetic coding sequence
atgcccgggcggtcatgcgtggctttggtactcctggccgctgccgttagctgcgctgtggcacagcatgcccccccatggacagaggactgcagaaagagtacctaccccccaagcggaccaacctaccgcggcgcagtgccttggtatactatcaatcttgacttgcctccatacaagaggtggcacgagcttatgctcgataaagctccagtcttaaaagtgatagtgaattctctgaaaaatatgataaatacattcgtcccatctggaaagatcatgcaagtggtcgatgaaaaactccctggactgctgggaaacttccccgggccctttgaagaagagatgaagggaatcgcagcagtgactgacattcccttgggcgaaattattagtttcaacatcttttacgagctgtttactatttgtacctccatcgtggcagaagataaaaaggggcatctgatccatggaaggaacatggacttcggagtctttttgggctggaacatcaataacgacacctgggtaatcaccgagcagctaaaaccactcacagtcaacctcgactttcagagaaacaataaaaccgtgtttaaggccagcagctttgccggatatgtcggcatgctaaccggatttaaacccggactgttctcgctgacattgaacgagcggtttagtatcaacggaggctacttggggatcctcgagtggatcttggggaagaaggatgtcatgtggattgggtttctgacccgtacagtcctggagaacagcacgagttacgaggaggcgaaaaacctgctgaccaagacgaagatcctggcacccgcgtactttatccttggcggaaatcagtcaggagagggttgcgtcattaccagggatcgcaaagaatcccttgacgtttatgaactcgacgcaaaacaggggcgatggtatgtggtgcaaacaaactacgacagatggaagcacccgttttttctggacgacaggagaacccccgctaaaatgtgcctcaacaggaccagccaggaaaacataagctttgaaactatgtacgacgttctttcgacaaagcctgttctgaacaagctgaccgtttacaccacccttatagatgttactaagggccaattcgaaacttatctgagagactgccccgacccctgtattggttgg

SEQ ID NO: 17287 - DNA, 1185 bp, Artificial Sequence
  Description of Artificial Sequence: Synthetic coding sequence
atgcccggccggtcgtgtgtagccctcgttctgctggccgcagccgtgagctgcgccgtggcacaacacgctcctccatggactgaggactgcagaaagtctacttaccccccaagcggtcctacctataggggcgcagtcccctggtatacaatcaatttggacctccctccgtacaagaggtggcacgagttaatgttagataaggcccccgtgctaaaggtgattgtgaatagtctgaagaacatgatcaatacctttgtgcctagcggaaagatcatgcaagtggtggacgaaaagctccctggcctgctcggaaatttccctgggccttttgaagaagagatgaaaggcatcgcagctgttactgatatccctctgggcgagattatatccttcaatattttctatgaactctttaccatctgcacatcaattgtggccgaagacaagaaggggcatttgattcacggccgaaatatggactttggcgtgtttctggggtggaatatcaacaacgacacatgggtcataaccgagcagcttaaacctctaaccgtgaacttagactttcagaggaataataaaacagtttttaaggcctcaagcttcgccggttacgtaggaatgctaaccgggttcaaaccaggtctcttctccctgaccctcaatgagaggttttctattaatggggggtaccttggtatcctggagtggattctgggtaagaaggatgtcatgtggatcgggttcctcaccagaacggtgctcgaaaattcgaccagttatgaggaagctaagaatctgctaaccaaaacaaagatccttgcacccgcgtactttattctgggcgggaaccaatctggagagggatgcgttattaccagagatcgcaaggaaagtctcgacgtttacgaactggacgcaaagcagggaaggtggtacgttgttcagaccaactatgataggtggaagcacccattcttcctggacgatcgccgaacacccgcaaaaatgtgtctgaataggacgtcacaggagaacatttcctttgaaacaatgtacgatgtgctgtcaactaagccagtactcaacaagctgacagtttacaccacgctcatagatgtcacgaaagggcagtttgagacatatctgcgggattgccccgacccttgcatcggatgg

SEQ ID NO: 17288 - DNA, 1185 bp, Artificial Sequence
  Description of Artificial Sequence: Synthetic coding sequence
atgccggggcgatcctgcgtcgccttggtgctgctggccgcggccgtgagctgtgccgtcgctcagcacgctcctccatggacagaagactgcaggaaatcaacctaccctccctccggacccacttaccgaggggctgttccatggtatacgatcaacctcgatctgccaccatacaagaggtggcacgaactcatgctggataaggctcctgtcctgaaagttatagtcaattccctgaagaacatgatcaacacgttcgtgccgagcggcaagattatgcaagtcgttgacgagaagctgccgggcctattaggcaattttcctggcccgtttgaggaggagatgaaaggaatcgccgccgtgaccgacatcccgctgggtgaaatcatttcatttaatatcttttatgagctctttaccatatgcacctctattgtagccgaggacaagaaggggcatctgattcacggccgaaacatggacttcggcgtgtttttgggttggaacatcaataacgacacctgggtgattaccgaacaactgaagccactcactgtgaatcttgatttccagcgtaacaacaagacggtctttaaggctagctccttcgcgggctacgtgggaatgctgacagggttcaagccaggattgtttagcctgacgttgaatgagcgattcagtatcaacggggggtatctcgggatccttgaatggattttgggcaagaaggacgtcatgtggattggctttctcacccgaacagtcctggagaattcaacttcatacgaagaggcaaaaaacctcctgactaagaccaaaattttggctcctgcttacttcatccttggcggaaatcagtcaggcgaagggtgcgtgatcactagggatagaaaggaaagtttggacgtgtacgaactggacgcgaagcagggtcgctggtacgtggttcagacaaattacgatcgttggaaacacccgttcttcttggacgacaggcggactccagccaagatgtgcttgaaccgcacatctcaggagaatatcagctttgaaactatgtacgatgtgctgagcaccaagccagtactcaacaagctaacagtgtatactaccctgattgacgttacaaagggccaattcgaaacctatcttcgggattgtccagacccatgcatcggctgg

SEQ ID NO: 17289 - DNA, 1185 bp, Artificial Sequence
  Description of Artificial Sequence: Synthetic coding sequence
atgccaggaagatcatgcgttgctctggtgctcctggcagccgcagtcagttgtgctgttgctcagcatgcgccaccttggacagaggattgcagaaaatcgacataccctcccagtgggcccacctacaggggagcagtgccctggtacacaattaacctggacctgcctccttataaacgctggcatgaactgatgttggataaagccccggtgctcaaagtaattgtgaactctttaaagaatatgatcaatacattcgtaccaagcggcaaaatcatgcaagtggtggacgagaagctgcccggactcctggggaatttcccagggcccttcgaagaggagatgaagggcatagctgcggtgaccgacatacctctgggtgagattatttcttttaacattttttacgagctgtttaccatttgcactagtattgtagcggaggacaaaaaaggccatctcatccacggtcggaatatggacttcggcgtgttcctggggtggaacattaataacgacacctgggtaataacggaacagctgaagcccctcacggtcaatctggatttccaaagaaacaataagaccgtttttaaggcttcctccttcgcaggctatgtgggcatgctgaccggctttaagcccggactcttctctttaaccctgaacgagcgcttctccataaatggcggatatctgggcatcttagaatggatcctcgggaaaaaggatgtgatgtggatcgggtttctcacgagaacagtgctggagaatagtaccagttatgaggaagcgaagaatctgctgaccaagacaaaaatactcgccccagcctattttattctcggagggaatcaatctggggaaggatgtgtgataacacgggaccgaaaggaaagtctggacgtgtacgaactcgacgccaagcagggcagatggtatgttgtacaaacgaactatgacaggtggaagcatcctttcttcctggacgatcgccgaacaccggctaagatgtgcctcaatcgaaccagccaggagaacatcagttttgaaactatgtacgacgtactgtccacaaagccagtattaaacaagctgactgtctacaccacactcatcgacgtgactaaggggcagtttgaaacatacctgagagactgtcccgatccgtgcatcggctgg

SEQ ID NO: 17290 - DNA, 1185 bp, Artificial Sequence
  Description of Artificial Sequence: Synthetic coding sequence
atgcccggcagaagctgcgtagcgctcgtcctcctggccgcagctgtcagctgtgccgtcgcccagcacgccccaccttggaccgaggactgtagaaaatctacgtatccgcccagtggacctacgtaccggggcgcggtgccctggtacacaattaatctcgaccttccaccctataaacgttggcacgaattgatgttggacaaggcacccgtgctgaaggtcatcgtgaatagcttgaaaaacatgataaatacattcgttccctcaggcaaaattatgcaggtggtggatgaaaagctgccgggcctactgggcaatttccctgggccctttgaggaagagatgaaaggaattgctgctgtaacggacattccgcttggtgagataatttccttcaatattttctatgagctctttacaatctgtacctccattgtggccgaggataagaaaggacacttgatccatggccgcaatatggattttggggtgttccttggctggaacatcaacaatgatacatgggtgatcactgagcagctcaaacctttgacagttaatctggattttcagagaaataataaaacggtatttaaggcctcctctttcgcagggtatgtgggaatgctgactggttttaaacccgggctttttagcttaactctcaacgaacgtttcagcatcaacggaggctatctgggaatccttgagtggatcctgggcaagaaggatgtgatgtggattggtttcttaacacggaccgtgctggagaatagtacgtcgtacgaggaggccaaaaacctcctaaccaaaactaaaattctggccccagcttatttcatcttggggggcaaccagtctggagaaggctgcgtcattacgagagatcgcaaagaatcgctcgacgtctatgagctggatgctaagcaggggcgatggtacgtcgttcaaaccaactacgaccgttggaagcacccattctttctggatgatcgtaggactccagcaaagatgtgcctgaatagaacaagccaagaaaatatctccttcgagactatgtacgacgtcttgagtacaaagccagttttaaataagctgactgtctacacaacattgatcgatgtcacaaagggccaattcgagacctaccttagagattgccctgatccatgcatcggctgg

SEQ ID NO: 17291 - DNA, 1185 bp, Artificial Sequence
  Description of Artificial Sequence: Synthetic coding sequence
atgccagggcgaagttgcgtcgcactggtattattagccgctgctgtttcatgtgctgtagcccagcacgctcccccatggacagaagattgtaggaaaagtacatatcctccctctggacccacatatcggggagcagtcccatggtatacaataaacttggatctccctccctataaaaggtggcatgaactgatgcttgataaagcacccgtcttaaaagtcattgtaaattccctgaaaaacatgatcaatacattcgttccatctggaaaaatcatgcaggtcgtcgatgagaaacttcccggactcctggggaattttcccggaccatttgaggaagaaatgaaggggatagccgcagttactgatatacctctcggagagatcatttcatttaatatattctatgaactctttacgatttgcacatctattgtggccgaagacaaaaaaggacatctcatccatggacggaacatggatttcggagtgttcttagggtggaatatcaacaatgatacatgggtgatcacagaacagcttaaacccctgacagtcaacctggattttcagcggaacaataaaacagtattcaaagcatctagtttcgctgggtacgtggggatgctcacagggttcaaacccggacttttcagtctaactctcaacgaacggttcagtattaacggaggataccttggaattcttgagtggatacttggaaaaaaagatgtgatgtggattggattcctgacacgtacagtactggaaaactctactagttatgaagaggcaaaaaacctcctaacaaaaactaaaatacttgctcccgcttattttatcctgggggggaaccagtccggagaaggatgcgtgattacgcgggaccggaaagaaagtcttgatgtttatgaactagatgccaaacaggggaggtggtatgtggtgcagactaactacgatcgatggaaacaccccttcttcctcgatgataggcgcacacctgccaaaatgtgcctcaacaggacaagtcaggaaaatatatcattcgaaacaatgtacgatgttctgagtacaaaacctgtcctaaacaaactcactgtatatacaacactcatcgatgtcacaaaggggcagttcgagacatatctcagagattgccccgatccctgcataggatgg

SEQ ID NO: 17292 - DNA, 1185 bp, Artificial Sequence
  Description of Artificial Sequence: Synthetic coding sequence
atgcccggcaggtcttgcgttgctcttgtgctgctggcagccgccgtctcatgtgccgttgctcagcatgctcctccctggacagaggattgtcgtaaaagtacctacccccccagcggacctacctatagaggcgccgttccctggtatacgataaatcttgacctgcccccatacaaaaggtggcacgagctgatgttagacaaggcacctgtcctgaaggtgatagtaaacagcctaaagaatatgattaacacattcgtcccctcagggaaaattatgcaggtcgttgatgagaaattgcctggactcctgggtaacttccccggcccgttcgaagaagaaatgaagggaatcgccgccgtgaccgatatcccactcggggaaattatcagcttcaacatcttctacgagctgtttacaatatgcacatcaattgtggctgaggataaaaagggacacctgatacatggacgcaatatggattttggcgttttcctcgggtggaacataaataatgatacttgggtgatcacagaacagcttaagcctctgactgtgaatttggactttcagagaaataataagacagtgtttaaagccagttcattcgctgggtacgttggaatgcttacaggctttaaaccaggactgttcagtcttacattgaacgagcgctttagtatcaacggcgggtatctgggcatcctggagtggatcctcggtaagaaagatgtgatgtggatcgggttcttaactcggacagtgttggaaaacagcaccagttacgaagaagcaaaaaacctgctgaccaaaactaagattctcgctcccgcgtatttcattctcggtgggaaccagagtggagaagggtgtgttattactagggaccgaaaggaatccctcgacgtctatgaattggacgcaaagcaggggcgatggtatgtggtacaaaccaactacgacagatggaagcaccccttctttctggacgatcggcggacaccagctaagatgtgtctcaataggacatcccaggaaaatatcagctttgaaaccatgtacgacgtcctctcaaccaaacccgttttaaacaaactgacagtctacacaactctgattgacgtgaccaagggacagttcgaaacctatctgcgggattgccccgatccctgtatcggttgg

SEQ ID NO: 17293 - DNA, 1185 bp, Artificial Sequence
  Description of Artificial Sequence: Synthetic coding sequence
atgccgggaagaagctgtgtagcgctggtgctgttggccgctgccgtgtcatgcgccgtggcccagcatgctccgccttggactgaggactgccggaagagcacctaccctccttccggccctacttatagaggggctgtcccatggtataccattaatctggacctcccaccctacaaacgatggcatgagctgatgctggacaaggcccccgtgttgaaggtgattgtgaattccctgaagaacatgatcaacacctttgttcctagcgggaaaataatgcaagtagtggatgagaagctgcccggactgcttggaaatttccctggcccttttgaagaagagatgaaaggtatcgcagcggtgactgacatccctcttggggagataattagtttcaatatattctatgaactgttcaccatttgcacctcaatcgtggctgaagacaagaaaggacacctcattcatggtcggaatatggacttcggtgtgtttttgggttggaatattaataacgatacctgggtgataacagaacagctgaagcccctgaccgtgaatctggacttccagcgaaacaataagaccgtctttaaagcatcttcatttgcagggtacgttggcatgctgaccggctttaaacccgggttgtttagcctcaccctgaacgagcggttctccatcaatggggggtatctcggcattctggaatggattctcgggaaaaaggatgtaatgtggataggcttcttgactaggacggtgctggaaaacagtacatcatatgaggaagctaagaatcttctgacaaaaactaaaattctggctccagcttacttcatcttgggggggaatcagagcggggagggctgcgtgattaccagggatcgcaaggaatcccttgacgtatacgagctggacgcgaaacagggacgctggtatgtagtgcagaccaactatgacagatggaagcatccgttctttctcgacgacagacggactcccgctaagatgtgtctcaatcggacctcccaggagaatatatcatttgagactatgtacgacgtgctgtccaccaagccagtcctcaataagctgactgtatacacgactctcatcgatgtgaccaaagggcaatttgagacttacctccgcgattgtcccgatccctgcattggatgg

SEQ ID NO: 17294 - DNA, 1185 bp, Artificial Sequence; identical to SEQ ID NO: 17262
  Description of Artificial Sequence: Synthetic coding sequence

SEQ ID NO: 17295 - DNA, 1185 bp, Artificial Sequence
  Description of Artificial Sequence: Synthetic coding sequence
atgccaggcaggtcctgtgtggctctggttctgctggccgccgcagtctcctgcgctgtagctcaacacgcaccgccttggactgaggattgccgcaagtctacctacccgccgagcggacctacatacaggggcgctgttccctggtacactataaacctcgatttgcccccttataaacgctggcacgagctcatgctggacaaggcacctgtcctcaaggtcattgtgaatagtctcaagaatatgattaacacattcgttcctagcggcaagattatgcaggtggtggatgaaaaactgcccggacttctgggtaattttcccggccccttcgaagaggaaatgaagggcatcgccgcagtgaccgacatccctctcggcgagataatttcattcaacatattttacgagctgtttactatctgcacctctatcgtggctgaggataaaaaaggccacctgattcatggtagaaacatggatttcggtgtgtttctcggatggaacattaataacgacacctgggttatcacggaacagttgaaaccactgacagtgaaccttgactttcagcgcaacaacaagacagtatttaaagcatcctcctttgcaggttatgtcggtatgttgacaggcttcaagccaggtctcttttccctgactttgaatgaaaggtttagcattaacggcggttatctgggcattctcgagtggatccttggcaaaaaggatgtgatgtggatcggttttcttacaaggaccgtcctggagaactcaacgtcttacgaggaggccaagaatcttctgactaagacaaagatcctggcaccggcatactttatcctcggtggcaatcagagcggagaaggctgcgttatcacccgcgacaggaaggaatctctcgacgtgtacgagctcgatgccaagcagggccgctggtacgtggtgcagaccaactacgatagatggaaacaccccttctttctggatgacaggcgcacacccgcgaagatgtgccttaacaggacgtcacaagagaatatatcttttgagacaatgtacgacgtcctgtcaactaagcctgtgctgaacaaattgacagtgtatactactctcatcgacgtgacaaaaggtcagtttgagacctacctcagagactgccctgacccctgcatcggttgg

SEQ ID NO: 17296 - DNA, 723 bp, Artificial Sequence
  Description of Artificial Sequence: Synthetic coding sequence
atgtcgatgctgttctacacgctcatcaccgcttttctcattggaatccaggcagaaccgcacagcgaatccaacgtgccggcgggccataccatcccacaggcccattggactaaactgcagcatagccttgacaccgccctccggcgggcccggagcgccccagccgctgctattgcagcccgggttgctggacaaacccggaacatcaccgtggaccctagactgttcaagaagcgccggctgcggagccctcgtgtgttgttttcgacgcagccgccacgcgaagccgccgacactcaggatctggacttcgaagtgggaggcgcagcacccttcaatcggacccatagaagcaagcgaagctcatcgcacccaatctttcatcggggggagttcagcgtgtgcgactcggtgtccgtgtgggttggagataagacgaccgcgacggacatcaaaggcaaggaggtgatggtgctgggagaagtgaatatcaacaattcagtgttcaaacagtacttttttgaaactaagtgccgcgatcctaacccggtggatagcggttgccgcgggatcgattcgaagcactggaattcatactgcacgactacccacaccttcgtcaaggcgctcaccatggatggtaaacaagcagcttggcggttcatccgcattgatacggcctgcgtgtgtgtgctctcccgaaaagcagtgcggagggca

SEQ ID NO: 17297 - DNA, 723 bp, Artificial Sequence
  Description of Artificial Sequence: Synthetic coding sequence
atgtctatgttattttacaccttaatcaccgccttcctgattggcattcaagctgaacctcacagtgaaagtaacgtgcctgcaggacatacgatccctcaggctcactggactaaactgcagcactccctggacactgccctgcggagagcacgatctgccccagccgcagcgatcgcagctcgggtcgcaggacagacacggaatatcacagttgatcctagacttttcaaaaagcggagactgaggtcgccgcgcgtcctgttttctacacaacccccccgggaggccgccgacacgcaggatttagatttcgaagtgggcggagccgctccatttaatcgtactcataggtcgaagagatcctcttcccacccaatatttcatcgtggggagttcagcgtgtgcgattcagttagtgtctgggtcggcgacaagaccaccgctacagacatcaagggcaaggaagtaatggtgctcggagaagtcaatatcaacaactccgtcttcaagcaatacttctttgagaccaagtgtcgcgatcccaaccctgtggacagtggatgtcggggaatagactccaaacactggaattcctattgcacaacaactcatacatttgtgaaagcgctgactatggacggaaagcaggcagcttggaggtttatacggatagacacggcctgcgtgtgcgtgttgtcacgtaaggctgtaaggagagct

SEQ ID NO: 17298 - DNA, 723 bp, Artificial Sequence
  Description of Artificial Sequence: Synthetic coding sequence
atgtcaatgctgttctataccttgatcacagcttttctgataggcattcaggcagagcctcactcagaatccaacgtccctgcagggcacacgataccccaggcccattggactaaactccagcacagtctggatacagcactacggagagcgaggtcagcccccgccgccgccatagctgcccgggtggcaggacagaccagaaatatcactgtggacccacgcctcttcaaaaagcgaaggctgaggtctccccgcgtgttgttctccacccaaccgcctcgcgaagccgcagacactcaggatctggatttcgaagtcgggggcgctgctccctttaaccggactcataggagtaaacgctcttcttcccacccaatcttccataggggtgaattctcagtctgcgacagtgtgtccgtttgggtgggagacaagactaccgccacggatatcaagggcaaagaagtgatggtcttaggagaggtaaacattaataacagtgtattcaagcaatacttttttgaaacgaaatgccgggaccccaatccagtggacagcggctgccgaggtattgatagtaagcactggaattcatactgtacaactacacatactttcgtgaaggctctgactatggatggcaagcaagccgcatggcgtttcatccggattgacacggcttgcgtgtgtgtcctgtctcgcaaggcagtgaggcgggct

SEQ ID NO: 17299 - DNA, 723 bp, Artificial Sequence
  Description of Artificial Sequence: Synthetic coding sequence
atgtcaatgttgttctacacgttgatcactgcctttttgatcggaatccaagccgagccacatagcgaatcaaacgtcccggcaggacatactatccctcaggcccactggaccaaattgcagcattcactggacaccgcactgagacgggcccggtcagccccagctgcagcaatcgccgcgcgggtggcaggtcagacccgcaacattaccgtggaccccagactctttaagaagcgcagactgcgcagcccgagagtgcttttcagcactcagccgcccagagaggctgccgatacccaagacctggactttgaagtgggcggggccgcccctttcaatcggacccatcggtcgaagcggtcctcgagccaccctatcttccatagaggcgaattctccgtctgcgattcggtgtccgtgtgggtcggagataagactaccgccactgacatcaagggaaaggaggtcatggtcctcggtgaggtgaatatcaataactccgtgttcaagcagtacttcttcgagactaagtgccgcgatcccaacccggtcgatagcggatgtcgaggtatcgactcgaagcattggaactcgtactgcacgactacccatacttttgtgaaggcgctgaccatggatggaaaacaagccgcatggcgctttattcggatcgatactgcctgtgtgtgcgtcctctccagaaaagccgtgagaagagct

SEQ ID NO: 17300 - DNA, 723 bp, Artificial Sequence
  Description of Artificial Sequence: Synthetic coding sequence
atgagcatgctcttctatacccttataactgcattccttattggaatccaggcagaaccacattctgaaagcaacgtgccagcagggcataccattccacaggcccattggacaaagcttcaacactctcttgatacagcgctgagacgggcgaggagcgcccccgctgctgctattgctgcccgcgtcgccggacagaccaggaatattactgtagatccccgacttttcaaaaaacgaagattacgaagtccacgcgtgcttttttccactcaaccccccagagaagccgcagatactcaggaccttgatttcgaggttgggggtgccgccccttttaatcgtactcatcgttcaaagaggtcaagttcccatccaatttttcataggggagagttttctgtttgcgattccgtttcagtttgggtcggcgacaagaccaccgccacagatattaagggaaaggaggttatggttttgggtgaggtcaacatcaacaattccgtgtttaagcaatactttttcgaaaccaagtgtagggatccgaatcctgttgatagcgggtgtcgcgggatcgattctaagcattggaattcctactgcacaactacacatactttcgttaaggccctcacgatggacgggaaacaagctgcttggcggttcataagaatagacactgcttgtgtttgtgttctctccaggaaggccgtgaggagggct

SEQ ID NO: 17301 - DNA, 723 bp, Artificial Sequence
  Description of Artificial Sequence: Synthetic coding sequence
atgtcaatgttattttatactcttataacagcattccttattggaattcaagcagaaccacattcagaatcaaacgttccagctggacatacaattccacaagcacattggactaaattacagcatagtttagatacagctcttagaagagctagaagtgcaccagcagctgcaattgcagctagagtcgcagggcaaacaagaaatataaccgtagatcctcgactttttaaaaagcgtagattacgttcacctagagtattattttctactcaaccaccaagagaagctgcagacacacaagatttagatttcgaagttggtggagcagctccatttaatagaactcatagatcaaaaagaagtagtagtcatcctattttccatagaggagaatttagtgtatgcgatagtgtatctgtctgggttggagataaaactactgctactgatataaagggaaaagaagtaatggtattgggtgaagtcaatattaataattcagtttttaagcaatattttttcgaaactaaatgtagagatccaaacccagttgattcaggatgtagaggaatagattctaaacattggaattcatattgtactactacacatacatttgtaaaagctcttactatggatggtaaacaagcagcttggagattcattcgtattgacactgcatgtgtttgtgtactttctcgtaaagcagtaagaagagct

SEQ ID NO: 17302 - DNA, 723 bp, Artificial Sequence
  Description of Artificial Sequence: Synthetic coding sequence
atgtccatgcttttctacacgctcatcaccgcctttttgatcggaatccaggcggagccacactcggagagcaacgtcccagctggacacaccattcctcaagctcattggacgaaactccagcatagcctcgataccgccctgcgtagggcgaggagcgccccggccgctgcaatcgccgcacgcgtggcgggccaaacccgaaatatcacggtggacccgcgcctcttcaagaagaggcgcctgcggtccccgcgggtcctcttctcgacccagccacctcgcgaagcagccgacactcaagacctcgactttgaagtgggaggagccgccccctttaatcggacccaccgctctaaacgctcctcatcgcaccctattttccatcgaggagaattctcagtgtgcgattccgtctcggtgtgggtgggtgataagactactgcaaccgacatcaaggggaaggaagtcatggttctgggcgaggtcaacatcaacaactcggtgttcaaacagtatttcttcgaaaccaagtgcagagatccgaatccggtggactcaggctgcaggggcattgatagcaagcactggaactcgtactgtactacgacgcacacgttcgtgaaagccctgactatggacggaaaacaggctgcatggcgctttatcagaatagatactgcatgtgtgtgcgttctctcccgcaaggcggtgcgccgcgcg

SEQ ID NO: 17303 - DNA, 723 bp, Artificial Sequence
  Description of Artificial Sequence: Synthetic coding sequence
atgagtatgctgttttatacactgattaccgcttttctgatcggcatccaagccgaacctcacagcgagagtaacgtgcccgccggacataccatcccacaagcacattggacaaagctgcaacatagcctagataccgccctgcggcgcgcccgctcagcaccggctgcggcaattgccgctcgagtggctggacaaacgcgcaatataactgtggaccccagactcttcaaaaagcggcggttgaggagccccagagtcctgtttagcacccagcccccacgcgaagcggctgatacccaggatctggactttgaagtgggtggcgctgcccctttcaatagaactcatcggtcaaagcggtcaagcagtcatccgatctttcaccggggagagttctcggtgtgcgattctgtaagtgtctgggtgggtgataaaactaccgctacagatattaagggcaaagaagttatggtgttgggagaggtaaacatcaataacagtgtgtttaagcaatattttttcgaaacaaaatgtagggaccccaacccagttgacagcgggtgcaggggaatcgactcaaaacactggaactcctactgtacaaccactcacacctttgttaaggccctgacgatggatggtaaacaagcagcttggagattcatccggatcgacaccgcttgcgtctgcgtgcttagtagaaaggccgtacgtagagca

SEQ ID NO: 17304 - DNA, 723 bp, Artificial Sequence
  Description of Artificial Sequence: Synthetic coding sequence
atgtcgatgctgttctacacccttatcactgcttttttgattggcattcaggccgagcctcattccgaaagcaacgtccccgcaggccacaccatcccacaggcacactggacgaagctccaacactccttggacactgcgctccggcgcgcccgctcggcaccggcagcggccattgcggcgagagtggccggtcagactagaaatatcactgtggatccccggctgttcaaaaagcgtaggcttcggagcccgcgggtgctgttctcgactcagccgcctagggaggccgcagacactcaggacttggacttcgaggtgggtggagccgctccgttcaatagaacccacaggagcaagagaagctcctcccacccgatcttccatagaggagaattctcggtgtgtgattcggtgtccgtctgggtcggagacaagaccaccgccacggacatcaagggtaaggaagtgatggtgcttggagaggtgaatatcaataactcagtctttaagcagtacttttttgaaaccaagtgccgggatccaaacccggtggactccggctgtaggggaatcgattcaaaacactggaactcctattgcacgactactcacacttttgtgaaggcgttgaccatggacggaaagcaggcggcttggcgcttcattcggatcgacacggcttgcgtgtgcgtcctgtcgaggaaagccgtgcggagagca

SEQ ID NO: 17305 - DNA, 723 bp, Artificial Sequence
  Description of Artificial Sequence: Synthetic coding sequence
atgagtatgttgttttatacattgattactgccttcctgatcggaatccaggcagagccccatagcgagtcaaacgttccagcaggacacacaataccccaggcccattggacaaaactacaacactcgctcgacaccgcattgagacgtgctcgctcggccccagccgcagctatcgccgctagggtggccggccagaccaggaatattacagtggaccccaggttgttcaaaaagcgtagactgcgctccccccgcgttttgttttcaacgcaacctcctcgggaagctgctgatacccaggatctggacttcgaagtcggaggggccgccccattcaatcgtacccaccgctccaagaggagttcctcccatccaatattccataggggcgaatttagcgtctgtgactctgtgtcagtttgggtgggggataaaaccacggctaccgatattaaaggcaaggaggtaatggtgctcggtgaggtcaatataaataattcagtgttcaaacaatattttttcgagacgaagtgcagggatccaaacccggtggactccggttgcaggggaattgatagtaagcattggaacagctactgtactaccacacacacttttgtcaaggccctgaccatggacgggaagcaggcagcctggcgtttcatccgtatcgacacggcgtgtgtgtgtgttctgagccgaaaagcagtgcgccgcgcc

SEQ ID NO: 17306 - DNA, 723 bp, Artificial Sequence
  Description of Artificial Sequence: Synthetic coding sequence
atgagcatgctcttctatactctgatcactgcctttcttatcggtatacaagccgagcctcattccgagagcaatgtgcctgccgggcacaccataccacaggctcactggacaaaattgcagcactccctcgacaccgctctgcggcgagctaggtccgccccggccgcagccattgcagctagggtcgccggtcaaactcggaatattacagtcgaccctcggctatttaaaaagagaaggcttaggtctccacgtgttttattttctacacagcccccacgcgaagccgccgacacacaagacctcgacttcgaggtagggggagccgctcctttcaatcgcacacaccgctctaaaagaagttcaagtcatcccatctttcaccgcggcgagtttagcgtctgtgacagtgtgtctgtgtgggtcggagacaagaccactgccaccgacatcaaagggaaagaggtgatggtgttaggcgaagtgaacatcaacaatagcgtctttaagcagtatttctttgagacgaagtgccgcgacccgaatccggttgacagcggatgcagaggcatcgattccaaacactggaacagctattgcacaaccacgcatacgtttgtgaaagcccttacgatggacggtaaacaggctgcatggcgctttatacgcatcgacaccgcctgcgtgtgcgtgctgtcccggaaggccgtgcggagggct

SEQ ID NO: 17307 - DNA, 723 bp, Artificial Sequence
  Description of Artificial Sequence: Synthetic coding sequence
atgagcatgcttttctatacgctgattaccgccttcctgattggcattcaggcagaaccacactcagagtccaatgtaccagctggtcatactattccccaagcccactggactaaactgcagcactctcttgacactgctctgcggagggctagaagcgccccagcagccgcaattgccgctcgcgtggcaggccaaacacgcaatataacagtggaccccagacttttcaaaaagcgaaggctgcgctctccacgcgttttgtttagcacacagcctccacgcgaggccgcagatacccaggacctggatttcgaagtgggtggagcagcgccgtttaatcgcacccaccggagcaaaagaagcagttcccatcccatttttcacaggggagagttcagcgtgtgcgattccgtgagcgtgtgggtgggagataaaactaccgctacagacattaagggtaaggaggtaatggtcctgggggaggtcaatattaacaactccgtgttcaagcaatatttcttcgagacaaagtgtcgcgacccaaacccagtagactcaggttgtcggggtatcgattccaagcattggaacagctactgtaccaccacccatacattcgtgaaagctctgacaatggacgggaaacaagcggcctggcggttcatccgcattgacaccgcgtgtgtgtgcgtgctgtcccgcaaagctgtgaggcgggcc

SEQ ID NO: 17308 - DNA, 723 bp, Artificial Sequence
  Description of Artificial Sequence: Synthetic coding sequence
atgtcaatgttgttttacactctgatcactgccttcctcattggtatccaagctgaaccccactcagaatcgaacgtgccggccggccacaccatcccacaggcgcattggaccaagctgcaacactcgcttgacaccgccctcagacgcgcccgatcggccccagcggcagccattgcagcccgggtcgctggacagactcgcaatatcactgtcgacccaagactgtttaagaagcgcagattgcgttcgcctagggtgctgttttccactcaaccgccgcgggaagcagcagatacccaggatctcgacttcgaggtcggaggagctgctccgttcaataggacccatcggtccaaacgctcctcctcccacccgatattccacagaggagaattcagcgtctgcgattcagtttctgtgtgggtaggtgacaaaacgacggccaccgacattaaggggaaggaggtgatggtcctgggcgaggtgaacatcaacaactcagtgttcaaacagtatttctttgaaactaagtgtcgcgatcctaaccctgtggactctgggtgtcgcggaatcgacagcaagcattggaatagctactgcactaccacccacacgtttgtgaaggcgctcaccatggatggtaagcaggcagcgtggcggttcatccgaatcgacaccgcatgcgtatgcgtgctgtcccgaaaagctgtgaggcgggca

SEQ ID NO: 17309 - DNA, 723 bp, Artificial Sequence
  Description of Artificial Sequence: Synthetic coding sequence
atgtctatgctcttttacaccctgattacggcattcctgatcggaatccaggccgagccacattcagagtcgaacgttccagccgggcacactatcccccaagcacattggaccaagctgcagcattccctcgacactgccctgcggcgagcccggagcgccccggcggctgctatcgccgcaagagtggcaggacagactagaaatattacggtggatcctagattgtttaaaaaacggcggcttcggtcgccgcgcgtcctcttcagcactcagccgccacgcgaggccgctgatacccaagacctcgactttgaagtcggaggggctgccccgttcaacagaacccaccggtcaaaacgctcatccagccaccctatcttccaccgcggcgaattctcggtctgtgattcagtctccgtgtgggtgggcgacaagaccaccgcgaccgacatcaagggaaaggaagtgatggtgttgggagaggtgaacattaacaattccgtgttcaagcagtacttcttcgaaaccaagtgcagggaccccaacccggtggattccggatgcaggggtatcgactcgaagcattggaattcgtactgtaccactactcacacttttgtgaaggccctgactatggatggcaagcaagcggcctggcgcttcatccgcatcgacaccgcgtgcgtgtgcgtcctgagccggaaagcagtccgtcgcgcg

SEQ ID NO: 17310 - DNA, 723 bp, Artificial Sequence
  Description of Artificial Sequence: Synthetic coding sequence
atgtccatgctcttctacaccctcatcaccgcattccttattggcatccaggccgagccccacagcgagtctaacgtccccgctggccacaccattcctcaggcccactggacaaagcttcagcattccttggacaccgccctgaggcgcgcccggagcgcccccgccgccgcaatcgccgcgcgggtcgccgggcagacacggaatatcactgtggatccaaggttatttaagaagaggagattgaggagcccgagggtgttgttctccacgcagcctcctcgcgaggcagccgacacccaggacttggattttgaagtcggtggggccgcaccattcaaccgcactcaccggagcaagcgttcatcctctcacccaatttttcaccgaggcgagtttagtgtgtgcgatagtgttagtgtatgggtgggagacaagacaactgccacagatatcaaagggaaggaggtgatggtgctcggggaggtgaatatcaataacagtgtctttaagcagtactttttcgaaaccaagtgcagagacccaaatcctgtggattctgggtgcagagggattgactcaaaacattggaatagctattgtaccacaacacacaccttcgtgaaagcactgacaatggatgggaaacaggcagcctggagattcatccggatcgatacagcgtgcgtttgcgtgctctcccgaaaggccgtccggcgcgcg

SEQ ID NO: 17311 - DNA, 723 bp, Artificial Sequence
  Description of Artificial Sequence: Synthetic coding sequence
atgtcgatgctgttttacactctgattacggcatttctcattgggattcaggcagagcctcactcggaaagcaatgtcccagcaggacatactattcctcaggcacactggactaagttgcaacattccctggataccgctcttaggagagcacgatccgccccagcagcagcaatagccgcaagagtggcaggacaaacccgtaacattactgtggatccccgtctgtttaagaaacgccggctgcgctccccccgcgtgttgttctccacccagccccctagagaagcagcagacacccaagacctggactttgaagttgggggcgccgcacccttcaatcgaacccaccggtccaagcggtcgtcgtcacatcctatctttcatcgtggtgaattttcggtgtgtgattcggtgtcggtgtgggtcggcgataaaactactgctacggacattaaaggaaaggaggtgatggtcttgggagaagtgaacatcaacaattccgtgttcaagcagtacttttttgaaactaagtgtcgggacccgaaccctgtcgactccggttgtcgaggaatcgactcaaagcattggaactcctactgtaccactacccacactttcgtcaaggcactgacgatggacggtaagcaagctgcatggagattcatccgaatagacaccgcatgtgtctgtgtgctctccaggaaagcggtgagaagagcc

SEQ ID NO: 17312 - DNA, 723 bp, Artificial Sequence
  Description of Artificial Sequence: Synthetic coding sequence
atgtcgatgctcttttacaccttgatcacggccttcctgatcggaatccaggcggaaccacattcggagagcaacgttccagctggacacactatccctcaagcacactggactaaactgcaacattctctcgacacggcactgcgtcgagcacgatcggcaccagcagctgctattgcagctcgggtggcggggcaaacccgcaacattacggtcgaccctcggctgtttaagaagcgtcgccttcggtcgcctagagtcctttttagcactcagcccccgagagaggccgcggatactcaggacctggatttcgaagtgggaggcgctgcaccttttaaccgcacccatcggtcgaagcgttcctcgagccatcctattttccatcggggagaatttagcgtgtgcgactccgtgtccgtgtgggtgggtgataagaccactgcaaccgacattaagggcaaggaagtgatggtcttgggtgaagtcaacattaacaactcggtgttcaagcaatacttcttcgaaaccaagtgtagggatcctaatcccgtggattccggatgcaggggcattgattcaaaacattggaactcatactgtactaccactcatacgttcgtgaaggcactgactatggacggaaagcaggcagcatggcggtttatccggattgacaccgcatgtgtgtgtgtcctttcgaggaaagccgtgcggagagcg

SEQ ID NO: 17313 - DNA, 723 bp, Artificial Sequence
  Description of Artificial Sequence: Synthetic coding sequence
atgtccatgctattctacacactgataactgcctttttgatcgggattcaggcagagccccacagcgaatccaacgtgccagccggccataccatcccacaagcccactggactaaactgcagcattctcttgacacggccctccgtagagccagatctgcgcccgccgcggctatcgctgctagagtggccggccagacacggaacatcactgtcgacccaaggctgtttaagaaacggcgcctccgatcaccacgggttctcttcagcacacaacccccccgggaggctgctgatacccaggacctggatttcgaagtaggtggggctgccccattcaacaggacgcaccgatccaaacggtcttcctctcaccctatatttcaccggggcgaattttctgtttgtgacagcgtgagtgtttgggtcggcgacaagaccaccgctactgatatcaaggggaaggaagtgatggtcctgggcgaagtaaatattaataacagcgttttcaaacaatacttttttgagacaaagtgtagggacccaaatcccgttgacagtggttgtcgcgggatcgatagtaaacattggaacagctattgcaccacgacccatacattcgtgaaagccctgacaatggatgggaaacaggccgcttggagatttatccgcatagacaccgcatgcgtgtgcgtgctgagcaggaaagccgtgcgtcgcgca

SEQ ID NO: 17314 - DNA, 723 bp, Artificial Sequence
  Description of Artificial Sequence: Synthetic coding sequence
atgtccatgcttttctatacactgatcaccgcctttctaattggaattcaggccgaaccacactccgaaagcaacgttccagcgggccacacaatccctcaggctcactggacaaagctccagcatagtttagataccgcgctccgacgtgctcgcagcgccccagctgctgcgatagcagcacgtgttgctggtcaaactaggaatatcactgtggaccctagactgtttaagaagagacggttgcgctccccgcgggtgctattcagcacccagccaccccgggaagccgctgatactcaagatcttgacttcgaagttggtggcgcagctccattcaatagaacacacaggagcaagcgaagttcttcccatcctatcttccatcgcggagaattctctgtctgtgattccgtgagcgtgtgggtcggggataaaaccacagctaccgatattaaggggaaggaggtgatggtactgggtgaggtgaatatcaataacagtgtgttcaagcagtacttcttcgaaaccaaatgcagagaccccaacccagtggatagtggctgccgtggtattgacagtaagcactggaactcttactgcactaccacacatacctttgtgaaggcactcaccatggacggcaagcaggcagcatggaggtttatccgtatagatactgcctgtgtgtgtgtgctcagtagaaaagcagtgaggagagcc

SEQ ID NO: 17315 - DNA, 723 bp, Artificial Sequence
  Description of Artificial Sequence: Synthetic coding sequence
atgagtatgctgttttacactcttatcactgcctttcttattggcattcaggcagagccacacagcgagtctaatgtcccagcaggccacactattccacaagcccattggaccaaattgcagcattcactggacactgcactcaggagagcgagatctgcccccgcggctgccattgcggccagggtggccggacagacccggaacataacggttgatcctcgattgtttaagaagcgccgcctccggtcccctagagtactgttttccacccaacctccacgagaagctgcagatacccaagatctggactttgaagtgggcggggcagctcctttcaaccgcacccatcgttcgaaaagatcatcgagccatcctatcttccatcgaggtgagttctctgtctgcgattccgtgtcggtgtgggtgggagacaagacgaccgccaccgacatcaagggaaaggaagtaatggtgctcggtgaagtcaatatcaacaactccgtctttaaacaatacttcttcgaaactaagtgtagggatccgaatccagtggattccggatgtcgcggtatagattcaaagcactggaactcgtactgtacgacgactcatacctttgtgaaggcacttacgatggatggaaagcaagcagcatggagatttatccggattgacactgcatgtgtctgcgtgctgagccgcaaagcagtgaggcgcgcg

SEQ ID NO: 17316 - DNA, 723 bp, Artificial Sequence
  Description of Artificial Sequence: Synthetic coding sequence
atgtcaatgttgttttacaccctcatcaccgcgtttcttattgggattcaagcagaaccacattcagaatccaacgtgccggccgggcataccattcctcaagcacattggactaagctgcagcattcacttgatactgcactccggcgagctcgctctgcacccgcagcggcaattgcggcgcgcgtggcaggacaaactcggaacatcacggttgacccacggcttttcaagaagagacgcctgaggtcacctcgagtgttgttctccacccaacctcctagagaggcagcagatactcaagatttggactttgaggtgggcggagcggccccttttaaccgaacgcaccgtagcaagcgttcttcatcgcaccctatattccatagaggtgaattttccgtctgtgattcggtatcggtctgggtgggtgataagactacggccaccgacataaaagggaaagaagtcatggtgcttggtgaggtgaatatcaataactccgtgtttaagcagtacttttttgaaaccaagtgtcgtgaccctaatccggtggattcaggctgtagaggtatcgattccaagcactggaacagctactgcaccactacccacaccttcgtcaaagcactcaccatggatgggaagcaagctgcatggagattcattcgcatcgacacggcctgtgtgtgcgtgcttagccggaaggctgtccgtcgggca

SEQ ID NO: 17317 - DNA, 723 bp, Artificial Sequence
  Description of Artificial Sequence: Synthetic coding sequence
atgagcatgctgttctacaccttgatcaccgcgttcctgatcggtatccaggcagaaccgcactccgaatccaacgtgccagctggacacactattccgcaagcgcattggactaaactgcagcattcgttggacactgcgcttcggcgagcccgctccgcaccggcagcagccatcgcggcacgcgtcgctggccagactcggaacatcaccgtggatccgcgcttgtttaagaagcggagattgcggtcgcctcgtgtcctcttctccactcagccgccaagggaggccgcggacacgcaggatctggatttcgaggtcggaggagccgccccgttcaatcgcacccataggtcaaaacgctcgtcgtcacatccgatctttcacaggggagaattcagcgtgtgcgactcagtcagcgtgtgggttggcgataagaccactgccacggacatcaaggggaaggaggtgatggtgttgggcgaagtgaatatcaacaactccgtgttcaagcaatacttcttcgagactaagtgcagagatccgaatcctgtggactcaggctgccggggaatcgactcgaagcattggaactcctactgcactactacccatacgtttgtcaaggcactgaccatggacggcaaacaagcggcctggcgcttcatccggatcgacactgcctgcgtctgcgttctgtccaggaaggcggtgcggcgggcc

SEQ ID NO: 17318 - DNA, 723 bp, Artificial Sequence
  Description of Artificial Sequence: Synthetic coding sequence
atgtccatgctgttttacaccctgatcactgcattccttataggaattcaggccgaaccgcactccgaatcgaatgtgccagcgggacatactatccctcaggcacactggaccaagctccagcattccctcgacacggcgcttcggagagctcgctccgcccccgccgccgctatcgcagcgcgggtggccgggcagacccgcaatatcactgtcgacccaagactctttaagaagcggcggctccgctcacctagggtgctgttttccactcagccaccgagagaagctgccgatacccaggacctggattttgaagtgggcggagccgcaccattcaaccggactcaccggtctaaaagatcatcctcccatcccatcttccaccgaggagagttctcggtgtgcgactcggtgtcggtgtgggtcggagacaagactactgccaccgacattaagggaaaggaggttatggtgttgggcgaggtgaatatcaataactccgtgttcaaacaatacttctttgaaactaagtgcagagatccgaatcctgttgattcgggttgccgggggatcgacagcaagcactggaacagctactgcaccaccactcacaccttcgtgaaggccttgactatggacggaaagcaggcagcatggcggtttatccgcattgacactgcctgcgtgtgtgtgctctcgcgaaaggccgtgcgccgcgcc

SEQ ID NO: 17319 - DNA, 723 bp, Artificial Sequence
  Description of Artificial Sequence: Synthetic coding sequence
atgtccatgctcttctacacgctgatcaccgcattcctgattggaatccaggctgagccacatagcgagtcgaacgtccctgcaggacacaccatcccgcaagcccattggactaagctccagcattcgctggacaccgcgcttcggcgagctagatctgcacctgcagcagcaatagccgcgcgcgtggcaggtcaaaccagaaatatcaccgtcgaccctaggctgttcaagaaacgccgactccgctcgccaagagtgctcttttccacccagccaccaagagaagccgcagatacgcaagatcttgatttcgaggtgggtggtgcggctccgtttaacagaacccataggtccaagagatcatcttctcatcccatttttcacagaggcgagtttagcgtatgtgattcagtcagcgtctgggttggagacaaaactactgcaactgacataaaagggaaggaagtgatggttctcggcgaagtgaacatcaataactcagtctttaagcagtactttttcgaaacgaagtgtcgggacccaaaccctgtggactcgggatgccgtggtattgattccaaacattggaattcctactgcacgaccactcatacttttgtcaaagcgctgacgatggatggcaaacaagcagcctggaggttcataaggattgataccgcatgcgtgtgtgtgctgagccggaaggccgtccgtcgggct

SEQ ID NO: 17320 - DNA, 723 bp, Artificial Sequence
  Description of Artificial Sequence: Synthetic coding sequence
atgtcaatgctgttctacactctgatcaccgcatttctgatcggaatccaagcggaaccacacagtgagagcaacgtccctgcaggtcatactattcctcaggctcattggaccaaattgcagcattccttggacacggcgttgcgtagggcgcggtcagcaccagcggccgccatagcagcaagagtggctggtcaaactcggaacattaccgtagatcctcggctcttcaagaaacgccgccttagatcgcctcgagtgcttttctccacgcagccgccacgggaagcggcagacactcaagacctcgattttgaggtgggtggagccgctccattcaatagaactcatagaagcaaacgctcctcgagccatcccatttttcacagaggtgagtttagcgtgtgtgactcggtttctgtctgggtcggcgacaagaccaccgcaaccgatatcaagggaaaagaagtgatggttttgggggaagtgaacattaacaactccgtgttcaaacagtacttctttgaaactaagtgcagggatcccaatccggtggactccgggtgcaggggcattgattccaagcactggaacagctactgtaccacgacccatacgtttgtgaaggcacttaccatggatggtaaacaagcagcatggcgcttcattcggatcgatactgcttgtgtgtgtgttctgtcgaggaaggctgtgagacgggca

SEQ ID NO: 17321 - DNA, 723 bp, Artificial Sequence
  Description of Artificial Sequence: Synthetic coding sequence
atgtcaatgttattttatactttgattacagcttttctgataggtatccaagcagaaccacattccgaatcaaatgtccctgctggacataccattccacaagctcattggactaagctacaacattcactggacactgcactaagaagagctagaagcgcaccggcagcggcaatcgccgcaagagtggcgggtcaaacaagaaatattaccgttgatccgcgtttgttcaaaaaacgaaggttgaggtccccgcgcgtcctcttcagcacgcagcctccaagagaagctgcagatacgcaagatttggattttgaagtcggaggagctgctccgttcaatagaacacaccgttctaagcgttccagttcacatcctatcttccataggggagaattttcagtttgtgactctgttagtgtatgggtgggagataaaacaacagcaacagacattaaaggcaaagaggtaatggtcctcggcgaggttaatatcaataactcagttttcaagcagtacttctttgagactaagtgtcgtgatccaaatccggtcgattcaggttgcagaggcattgatagtaaacattggaattcatactgtaccaccacccatacctttgttaaggcactcacaatggatggtaaacaagctgcgtggaggttcattcgtattgatactgcatgcgtctgtgttttatccagaaaagctgtcaggagagct

SEQ ID NO: 17322 - DNA, 723 bp, Artificial Sequence
  Description of Artificial Sequence: Synthetic coding sequence
atgtcgatgctattctatacactgattaccgcattccttattgggatccaggcggagccacacagtgagtctaacgtgccagcgggtcacacaattccacaggcccactggaccaagctccaacactctttggacaccgcccttaggcgggcccggtctgcaccggcggccgctatagcggcccgagtcgctggccaaacacgcaatattaccgtcgatcccagattgtttaagaagcgccggttgcggagccctcgggtgctgttctccacccagcctccacgcgaagcagctgatacccaagatcttgatttcgaggtcgggggggccgctcccttcaaccggactcacagatcgaaacgaagttcatctcaccccattttccaccgtggtgaattttctgtttgcgacagcgttagcgtgtgggtgggcgataagacaactgccacagatattaaaggaaaagaagtgatggtactgggagaggtaaatattaataactcagtgtttaaacagtatttttttgagacaaaatgcagagatcctaatccagtcgactccgggtgtcgggggatcgactccaagcattggaattcctactgtacgactactcacacatttgttaaggccctcacgatggacgggaaacaagccgcgtggcgttttatacggatagacacggcctgtgtctgcgtcctaagccgaaaggcagttcgacgggct

SEQ ID NO: 17323 - DNA, 723 bp, Artificial Sequence
  Description of Artificial Sequence: Synthetic coding sequence
atgtcaatgctgttttacaccctcatcaccgcgttcctgattggtatccaagcagaacctcactccgaatcaaacgtccccgcgggtcacacgatcccacaggcacattggactaagttgcaacatagcttggatactgcacttcggagagcacgaagcgcaccagcagccgcaatcgcagcaagggtggccggacagacccgaaacattactgtggaccctcggcttttcaagaaaaggagactgcgcagccctagagtgttgttttcgacccaacctccaagagaggcagcagacacccaggacctggattttgaggttggcggtgccgcacctttcaatcggactcatcgttccaagagaagcagcagccatcctatctttcacagaggagagttttcggtgtgtgactcagtcagcgtttgggtcggggataagaccaccgccactgacataaaagggaaggaagtgatggtgcttggagaagtgaacattaacaactcggtgttcaaacaatacttcttcgagacgaaatgccgcgatccaaaccctgtcgattcgggatgtcgaggaatagactcgaaacattggaactcatactgcaccactacccatacctttgtcaaggcccttaccatggacgggaaacaagcagcctggcgatttatcaggattgataccgcgtgtgtgtgtgtgctgtcccgcaaggcggtgcggagagcc

SEQ ID NO: 17324 - DNA, 723 bp, Artificial Sequence
  Description of Artificial Sequence: Synthetic coding sequence
atgtcaatgctgttttacacccttatcaccgcatttctgataggcatccaggctgagcctcactccgagagcaacgttcctgcgggacataccatacctcaagcgcattggactaagctccaacattcattggataccgcgctgcgacgcgccagatcggcaccagccgcagcaattgccgcgcgggtcgcagggcagaccagaaacatcactgtggatccacgtcttttcaagaaaaggaggctgaggtcgccaagggtgctgttctcgactcagcctccaagagaagcagcagatacccaagaccttgactttgaggtgggaggtgcggccccctttaatcgaacccatcgttccaagcgaagctcgtcgcaccccatcttccataggggagagttttcagtgtgtgattccgtttccgtgtgggtgggtgataaaactactgccaccgacatcaagggtaaggaagtgatggttcttggcgaagtgaacattaacaactcggtgtttaagcaatacttttttgaaaccaaatgcagagatcctaaccccgtggatagcgggtgtcggggcattgattcgaaacattggaattcatactgcaccaccacccacaccttcgtcaaggctctgacgatggatggtaaacaggcagcatggcgttttatcagaatcgatactgcatgcgtgtgcgtgctcagtcgtaaggccgtgagaagagca

SEQ ID NO: 17325 - DNA, 723 bp, Artificial Sequence
  Description of Artificial Sequence: Synthetic coding sequence
atgtcgatgctattttatacgttaataacggcgtttttaataggtatacaagcggaaccgcattcggaatcgaatgtaccggcgggtcatacgataccgcaagcgcattggacgaaactacaacattcgttagatacggcgctacgtcgagcgcgatcggcgccggcggcggcgatagcggcgcgagtagcgggtcaaacgcgtaatataacggtagatccgcgtctatttaaaaaacgtcgtttacgatcgccgcgtgttctattttcgacgcaaccgccgcgtgaagcggcggatacgcaagatttagattttgaagtaggtggtgcggcgccgtttaatcgtacgcatcgttcgaaacgttcgtcgtcgcatccgatatttcatcgaggtgaattttcggtttgtgattcggtttcggtatgggtaggtgataaaacgacggcgacggatataaaaggtaaagaagttatggttctaggtgaagttaatataaataattcggtttttaaacaatatttttttgaaacgaaatgtcgagatccgaatccggtagattcgggttgtcgaggtatagattcgaaacattggaattcgtattgtacgacgacgcatacgtttgtaaaagcgttaacgatggatggtaaacaagcggcgtggcgttttatacgaatagatacggcgtgtgtatgtgttttatcgcgtaaagcggtacgtcgtgcg

SEQ ID NO: 17326 - DNA, 723 bp, Artificial Sequence
  Description of Artificial Sequence: Synthetic coding sequence
atgtccatgcttttctacactctcatcaccgcattcctgatcgggattcaggcagagccgcactccgagtcaaacgtgccagcgggccatactataccgcaggcgcattggaccaagctccaacactcactggacaccgctctgcgtagagccagatcagctcccgcggccgcgatcgctgcgcgcgtggccggacaaacccgcaacattactgtggatcctagactgttcaaaaaacgcaggttgcgctcgccaagagtccttttcagcactcagccccctcgcgaagctgctgacactcaggatctggatttcgaagttgggggtgccgcaccgtttaacaggacccaccgttctaagcgcagctcgagccacccaatctttcacagaggagagttcagcgtgtgcgactcagtctcggtgtgggtgggagacaaaaccactgcgaccgacattaagggaaaggaagtgatggttctcggggaagtgaatatcaacaactccgtctttaaacaatacttcttcgaaaccaagtgtcgggatcctaatccggttgactccggatgccgaggcatcgactcgaagcattggaattcctactgcaccaccacccacactttcgtgaaggcgctgacgatggatgggaagcaggccgcttggaggttcatcagaatcgatacggcctgtgtctgcgtcctgtcccgcaaggccgtgcgacgcgcg

SEQ ID NO: 17327 - DNA, 723 bp, Artificial Sequence
  Description of Artificial Sequence: Synthetic coding sequence
atgtccatgttgttttacaccttgatcactgcattcttaattgggattcaggccgagcctcacagtgaatctaacgtgcccgcagggcacactattcctcaggcacactggacgaaactacagcattctctcgatacggccttacgcagggcacgctccgctcccgctgccgctattgctgctcgggttgcaggccagacgaggaatatcactgtagacccccgtttatttaagaaaaggagattgaggtctcctagagtcttatttagtactcagccccctagggaggccgctgacacacaagacctcgactttgaagtgggaggggctgctccatttaaccggacacacagaagtaagaggtcaagtagccaccctatattccaccgcggagagttctcagtgtgtgatagtgtgagtgtgtgggtgggtgacaagaccaccgctactgatataaagggaaaggaggttatggtgctgggagaggtgaatataaacaattccgtgttcaagcagtacttttttgagactaaatgcagagatccaaatccggtggatagcggctgccgcggcatcgatagcaaacactggaacagctattgtacaacaacgcacacatttgtgaaggccctgaccatggacggaaaacaggctgcttggagatttattcgaattgatacagcttgtgtgtgtgtcctgtcaagaaaggccgtgcggcgagcc

SEQ ID NO: 17328 - DNA, 723 bp, Artificial Sequence; identical to SEQ ID NO: 17298
  Description of Artificial Sequence: Synthetic coding sequence

SEQ ID NO: 17329 - DNA, 723 bp, Artificial Sequence
  Description of Artificial Sequence: Synthetic coding sequence
atgtcaatgttgttttatactttaattaccgcgtttctcattggcattcaggccgagccgcattctgaatccaacgtgcctgcggggcacacaatcccccaagcgcactggactaaactacagcattctctagacacggccttgcgacgggcccggagtgcaccagccgcggccattgctgctcgcgtcgccggccagacaaggaacattactgtggaccccaggctcttcaagaagaggcggctgcgttcaccacgggtcctattcagtacccagccccccagggaggctgccgatacccaggacctagacttcgaagttggcggggctgcgccatttaaccgcacacacagaagcaaacggagtagttcgcatcctatcttccacaggggagaattttctgtgtgtgattccgtgagtgtatgggtgggggacaagaccacagccactgacattaaagggaaggaagtgatggtattgggtgaagtcaacattaataactctgttttcaaacagtatttttttgagacgaagtgccgcgacccaaatccggtggattcaggctgtcgcggtattgactcaaaacattggaacagctactgcactaccacacacacatttgtgaaggctttgaccatggacgggaagcaggctgcctggcgcttcatacgaatcgacacagcgtgtgtatgcgtcctgagtaggaaagcagtccggagagcc

SEQ ID NO: 17330 - DNA, 723 bp, Artificial Sequence
  Description of Artificial Sequence: Synthetic coding sequence
atgagcatgctcttctacactttgatcaccgcgtttttaattgggattcaagctgaaccccactccgagtctaatgtgcctgcaggtcataccatcccgcaagctcactggacgaagttacagcactcgttggatacggccctccgcagggcccgctcggcaccggcagcggcgatcgccgcgagggttgctggccagacgagaaacattaccgttgacccacgactcttcaagaagaggcgacttcgctctccccgggtcttgttcagtacacaacctccaagggaggccgcggatacacaggacttggacttcgaagtaggcggtgccgctccctttaaccgtacgcaccgttccaaacggtcaagctcccatccgatcttccatcgcggtgaattctcagtttgtgatagtgtctcggtttgggtcggagataagaccacggcgacggacattaaaggaaaggaggtgatggttcttggggaggtgaacatcaacaactccgttttcaaacaatatttttttgagacgaagtgccgcgaccccaatcctgtggacagcggatgccggggaattgacagtaagcattggaattcctattgtacgactactcataccttcgtgaaggctctgaccatggatggcaagcaggccgcctggcgattcatccgtatcgacaccgcctgtgtgtgtgtgctgtcgcggaaggcagtgcgaagagca

SEQ ID NO: 17331 - DNA, 723 bp, Artificial Sequence
  Description of Artificial Sequence: Synthetic coding sequence
atgagtatgttgttctataccttaataacagcattcctcattggcatacaggccgagccccactctgagtccaacgtccccgcaggacacacaatcccacaagcccattggacgaaactgcaacactccttggacactgcactgcggcgggctcgtagtgcacccgctgctgcaatagctgctagagtggctggccagacacgtaacatcaccgtggatcccaggctgtttaagaaaaggcgactaaggtcccctcgggtcctcttctcaacccaaccccctcgggaggcggcagatacacaagatctcgattttgaggtgggcggtgcagctcccttcaacagaacccaccgctcgaaacggagttccagccatcctatttttcacaggggtgagttcagcgtctgcgactctgtaagcgtgtgggtaggcgacaaaaccactgcgaccgacataaaaggaaaagaggtcatggtgcttggcgaagtcaatataaataacagcgtgtttaagcagtacttctttgaaactaaatgccgggaccctaatccagtggattcaggttgtcgcgggatagactctaaacactggaacagctactgcacaacgacccatacctttgtaaaggcccttactatggatggaaaacaggcagcttggcgctttattcgcattgacacggcttgcgtctgcgtgctctcacggaaggcagtccggcgagcg

SEQ ID NO: 17332 - DNA, 723 bp, Artificial Sequence
  Description of Artificial Sequence: Synthetic coding sequence
atgagcatgttgttttataccctcataacggccttcctgattggcatccaggcagagccccacagtgagtcaaacgtgcctgccggacacacaatcccacaggcacactggacaaaattgcaacatagcctggataccgcccttcgaagagcgcggtctgcaccagcagccgcaattgccgctagagtggccggccagactaggaatatcaccgtggatccacggctgttcaagaagcgaaggctacgaagtccacgtgtacttttcagtactcagcctcccagggaagccgcagacacccaggacctagatttcgaggtggggggggccgctcccttcaaccggacgcacaggtcaaaaagatctagcagccaccctatatttcaccgaggggaattcagtgtgtgtgactccgtctctgtctgggtgggcgataagaccactgcaacagacatcaagggtaaagaggtgatggtcctgggtgaggtcaatatcaacaacagcgtgtttaaacagtattttttcgaaactaagtgccgagatcctaacccagttgattccggctgcaggggtatcgatagcaagcattggaactcatattgcacaaccactcacacttttgtgaaagctctgaccatggatggtaagcaggccgcctggcggttcattcgaatcgatactgcttgcgtatgtgttttgagcaggaaagcagtgcggcgggcg

SEQ ID NO: 17333 - DNA, 723 bp, Artificial Sequence
  Description of Artificial Sequence: Synthetic coding sequence
atgtccatgctcttttatacactgatcaccgctttcttgatcggcatacaggcggaacctcacagcgaatctaacgtgcctgctgggcacactatccctcaggctcattggaccaagctgcagcactctttggacacagctcttaggagggccaggagcgcaccagctgctgctattgccgcacgggttgccggacagacccgtaatatcacagtggatccccgactctttaagaagagacggttaaggtctcccagggtccttttcagtacccagcccccgagagaagctgcagatactcaggacctggacttcgaagttgggggagccgcaccattcaacagaacccaccggagcaaaagatccagctcccaccctatttttcatcgaggggagttttcagtgtgtgactccgtctccgtgtgggtgggcgataaaactactgctaccgatatcaagggcaaggaggtaatggtgcttggggaggtcaatataaacaacagcgtgtttaagcagtactttttcgagaccaagtgcagagaccccaaccctgttgattccgggtgccgcggcattgacagcaagcattggaatagctactgcacaacaacacatacctttgtaaaggctctgacaatggatggtaagcaggcagcctggagatttatacggattgataccgcttgcgtgtgcgtgctcagccggaaagcagttagacgcgcc

SEQ ID NO: 17334 - DNA, 723 bp, Artificial Sequence
  Description of Artificial Sequence: Synthetic coding sequence
atgagcatgctgttctacaccctgataaccgccttcttaattggcatccaagccgagccccacagcgaaagtaatgtaccggccggtcacaccataccccaagcgcattggacgaaactgcagcactctctggacacagctctgcgccgagcccgttctgctcctgcggcggctattgctgcccgggtcgccggacaaacacgcaacattaccgtcgatcccagactctttaagaagcgaaggctgcggagccccagggtcctattttcaactcagcccccaagggaggccgccgatacccaagacctggatttcgaggtgggtggggctgcgcctttcaatcgaacacacagaagcaaaaggtcaagctcacatcccattttccatcgaggcgaatttagcgtctgtgatagtgttagtgtctgggtcggcgacaagactacagccacagatatcaaggggaaggaggtgatggttctgggcgaggtgaatataaacaattctgtgtttaaacagtatttctttgaaacgaagtgccgggaccccaatcctgtcgactctggctgtcggggcattgatagcaagcattggaactcctactgcacaaccacacatacgttcgttaaggctttaactatggatggtaagcaggcagcctggcgatttattcggatcgacaccgcttgcgtatgtgtgctatctaggaaagccgtgagacgagcc

SEQ ID NO: 17335 - DNA, 723 bp, Artificial Sequence
  Description of Artificial Sequence: Synthetic coding sequence
atgtcgatgcttttctacactttgatcaccgcgttcctcattggaattcaggcagaaccgcattccgagtccaacgtacctgcgggccatactattccccaggcccactggactaaactgcaacattccctggacaccgcactgcggcgcgcacggtccgccccagccgcagcaatagccgcacgcgtggcaggtcagacccgcaacataactgtggaccctcgtcttttcaagaaacggagactccggtcgccccgggtgctcttcagcactcagccaccccgtgaagcggcggatactcaagatctcgactttgaagtgggaggggcagcaccttttaacaggacgcatagatccaagagatcctcgtcacaccccatctttcatcgaggagaattttcagtttgtgattctgtgtccgtgtgggtgggtgataagacgacggcaactgatatcaagggtaaggaggtcatggtgctcggagaggtcaacattaacaactcggtctttaagcaatacttttttgaaaccaagtgtcgcgatccaaaccctgtcgatagcggttgtagaggtattgatagcaaacattggaactcgtactgtaccaccactcatacctttgtgaaagctctcactatggacggaaagcaagcggcatggcggtttatcagaatcgacaccgcatgtgtgtgtgttttgtcccgaaaggccgtccggagggca

SEQ ID NO: 17336 - DNA, 723 bp, Artificial Sequence
  Description of Artificial Sequence: Synthetic coding sequence
atgtctatgctgttctacaccctgatcacggcctttctgatcggaatccaggcggaaccacactcagagagcaatgtcccagcagggcatactataccgcaggcacactggaccaagctgcagcattccctcgacactgccctgagacgggcccggtccgcgcccgcggccgccatcgccgcccgggttgccggccaaactcggaacatcaccgtcgacccccggctgttcaagaagcggcgactgagatcgccgcgggtgttgttctcgacccagccgccgcgggaggccgctgatacccaagatctggatttcgaagtgggaggagcagcacctttcaaccgcacccaccggtccaagagatcatcctcacacccaatctttcatagaggagaattctcggtgtgcgactcggtcagcgtgtgggtgggagataagacgaccgcgaccgatatcaaaggaaaggaggttatggtgctcggcgaagtgaatatcaataacagcgtgtttaaacaatacttcttcgagactaagtgccgggacccgaatcccgtggatagcggatgccgcgggatcgattcgaagcattggaactcatactgcactactactcacacgttcgtaaaggctttgactatggatggaaaacaagctgcttggagattcatccggatcgacaccgcctgtgtctgtgtgctctcccgcaaagcagtgcggcgagcc

SEQ ID NO: 17337 - DNA, 723 bp, Artificial Sequence
  Description of Artificial Sequence: Synthetic coding sequence
atgtccatgctgttttacactctgattacagccttcctaatcggcatccaggcagaacctcatagtgagtctaatgtccccgcaggccacacaataccacaggctcattggactaagttgcagcattccctggacacagcattgaggagagctcgctctgccccagctgccgctatagccgcaagagtggcaggtcaaaccaggaatattacggtggacccccgcctttttaagaagagaaggttgcgaagtccaagggtgctgttctccacacagcctccacgggaggccgccgatacgcaggacctagacttcgaagtgggaggtgccgcccccttcaacaggacgcaccgttctaagcggagttccagtcatcctatattccacaggggggaatttagtgtctgcgacagtgtatctgtatgggtcggcgataagaccactgccaccgacatcaagggcaaggaggtaatggtgcttggggaggtaaatattaataacagcgtttttaaacagtacttctttgagaccaaatgccgcgatcccaatcccgtcgattctggttgtagaggcattgacagtaagcattggaattcttactgtacgacaacccatacgtttgtcaaggctctgaccatggacggtaaacaagccgcttggcggtttatcagaatcgacacagcctgcgtgtgtgtcctttctaggaaggcagtccgcagggcc

SEQ ID NO: 17338 - DNA, 723 bp, Artificial Sequence
  Description of Artificial Sequence: Synthetic coding sequence
atgtcgatgcttttctataccctcataaccgcttttctgataggcatccaagccgagcctcattcggagtccaatgtgccagcgggtcataccattcctcaagcccactggaccaaattgcaacacagcctcgacaccgccctgcgcagagcaagatccgcgcctgcagcagctatcgccgctagggtcgccggacaaactaggaatatcaccgtggatcctcggctctttaagaaaagacgattgcgatctcctcgagtcctgttttcgacccagccaccacgggaagctgcagatacgcaggatcttgactttgaggtgggtggagcagccccttttaacagaactcatcggtcgaagcgttccagctcccatccgatttttcataggggggaattttcagtgtgcgatagtgtctcggtttgggtgggggataaaaccactgcaactgacattaagggtaaggaagtgatggtgctcggtgaagtcaacataaacaactcagtgtttaaacagtacttcttcgaaaccaagtgtcgcgacccaaaccctgtggattctggatgccggggaatcgatagcaagcactggaactcatactgtaccaccacccatacttttgtgaaagcgctgaccatggatggaaagcaagcagcatggaggttcataagaatcgataccgcatgcgtgtgtgtgctgtcgcggaaggcagtacggagagct

SEQ ID NO: 17339 - DNA, 723 bp, Artificial Sequence
  Description of Artificial Sequence: Synthetic coding sequence
atgagcatgttgttttacacgctgatcaccgcattcctcatcgggatccaggccgagccgcactcggagtcaaatgtgccggccgggcacactatccctcaagcccattggactaagctgcagcactcccttgacacggcactgagaagagctaggtcagccccggcggccgccatcgccgcgagagtggctggacagacccggaacattaccgtcgatccgcggctcttcaagaagaggagactgagatcgccgcgcgtgctgttcagcactcagccgccccgggaggcggctgacactcaagacctcgacttcgaggtggggggagccgcgccgttcaatcgcacccacagatcgaaacgatcatcgtcccacccaatcttccaccggggtgaattcagcgtttgtgactcagtgtctgtgtgggtcggggataagactaccgcgaccgatatcaagggaaaggaagtgatggtgctgggcgaagtgaacatcaataacagtgtgtttaagcaatactttttcgaaactaaatgcagagatccgaaccctgtcgactcgggctgcagaggtattgactcgaagcactggaacagctactgcactaccacccatactttcgtgaaggcgctgaccatggacggcaagcaagcggcgtggcgcttcatccgcatcgacactgcctgcgtatgtgtgctctcacgcaaggcggtgcgccgtgca

SEQ ID NO: 17340 - DNA, 723 bp, Artificial Sequence
  Description of Artificial Sequence: Synthetic coding sequence
atgtcgatgctcttctatacactaattaccgcgttcttgattggcattcaggcagagccgcacagcgaatcaaacgtgccggctggtcacaccatcccgcaggctcattggaccaaactccaacattcattggacacagctttgcgtcgtgccagatccgcccccgcagctgcaattgcagctcgagtagccggacagacgcgtaacataaccgttgaccctcgcctgttcaagaaacgacggcttaggagccctagagtgctgttttccacccagccgccaagggaagctgcagacacacaggacctcgacttcgaagtgggaggtgcggcccccttcaaccgcacccatcggtcaaagagatcttcctcccatcctatcttccacaggggggaattttctgtctgcgattccgtcagcgtgtgggtcggggataagacaactgcgacagatatcaaggggaaggaggtgatggtcctgggagaggtcaatataaacaattccgtttttaaacaatacttctttgaaaccaaatgccgtgaccctaatccagtagattctggctgcagaggtattgactccaaacactggaactcctattgcactaccacgcacacctttgtaaaggcgttaaccatggacgggaaacaggctgcctggcgctttatcagaatcgacaccgcgtgtgtgtgcgttctctctaggaaggccgtgcggcgagca

SEQ ID NO: 17341 - DNA, 723 bp, Artificial Sequence
  Description of Artificial Sequence: Synthetic coding sequence
atgtctatgcttttttatactcttataacagctttcttgatcggtatccaagcagagccccactcagaatctaacgttcctgctggtcacacaatcccccaagcacactggaccaaactgcagcacagcctcgacacagctctgcgccgcgctcgttcagccccagccgcggccatcgccgcacgggtagcaggccagaccaggaatatcacagtcgaccctcgcctgtttaagaagcggaggctcaggtctcctcgggtgctgttcagcacacaaccccctcgtgaggccgctgatacccaagaccttgactttgaggtgggcggggctgccccttttaataggactcaccgcagcaaaaggtccagctcacacccaatctttcatagaggggagttcagcgtatgtgatagcgtctccgtctgggtcggggataaaacaactgctacagacatcaagggcaaagaagtgatggttctgggggaggttaacatcaacaacagtgtcttcaagcaatactttttcgaaaccaaatgcagggatcccaaccctgtggatagtgggtgcaggggaattgacagtaaacactggaactcttattgcacaaccacccacaccttcgtcaaagccctgacaatggatggtaagcaggcggcttggagattcataagaatcgataccgcatgtgtatgcgtgctcagcagaaaggccgttcgtcgggcc

SEQ ID NO: 17342 - DNA, 723 bp, Artificial Sequence
  Description of Artificial Sequence: Synthetic coding sequence
atgagcatgctgttctatacgctgatcaccgccttcctgatcggaattcaggcggaaccgcatagcgagtcaaatgtgccagcaggacatacgatccctcaggcccattggacgaaactgcagcacagcttagacacggcgctgcggcgggcgcgctctgcaccggccgcggcaattgccgcccgggtggctggtcagacccgaaatattaccgtggatcctcgactgttcaagaagaggagattacgctccccgcgagtgctgttttcgacacagcccccccgcgaggccgccgatacccaggatctggattttgaagtgggcggagccgccccctttaaccgcacacaccggagcaagcgctcgtcttcgcatccgatattccaccgcggagagttcagcgtgtgcgactccgtgtctgtgtgggttggagataagactactgccactgacattaagggtaaagaagtcatggtgctgggcgaggtcaacataaacaacagtgtcttcaagcagtacttttttgagaccaagtgtagagatccgaatcctgtggattctggatgtcgcggcatagatagcaaacattggaattcatactgtactacgacacacacctttgtaaaggcgttgacgatggatggaaagcaggcggcgtggcgctttattcgcatagacactgcttgcgtgtgcgttctgagtaggaaggcagtgcggagggct

SEQ ID NO: 17343 - DNA, 723 bp, Artificial Sequence
  Description of Artificial Sequence: Synthetic coding sequence
atgtcgatgctcttctatacgctcatcactgcctttctgattggaatccaggcggagccacactcagagtcaaacgtgccagccggacataccatcccacaggcacactggactaagttgcagcactcactggataccgccctcaggcgcgcgcggagcgcgcctgccgcggcaatcgcagcccgggtggctggccagacccgtaacattactgtggacccacgcttgttcaagaaaaggcggttgaggagcccgcgcgtgcttttctcgacgcaaccccctcgcgaggcggctgatactcaagacctcgattttgaggtcggaggagccgccccgttcaacagaacgcatcgctcgaagcgctcaagcagccatcctattttccaccggggagagttcagcgtgtgtgactcggtgtcagtgtgggtcggcgacaagaccactgcgaccgacatcaagggcaaggaggtcatggtgctgggagaagtcaacatcaataactcggttttcaagcagtactttttcgagactaagtgccgagatccgaatccggtggattccggatgtagagggatcgattctaagcattggaactcttactgcaccaccactcacacttttgtgaaagcactgaccatggacgggaagcaagcagcatggcggttcattcgcatcgataccgcatgcgtgtgtgtcttgagccgcaaagccgtgcggcgagca

SEQ ID NO: 17344 - DNA, 723 bp, Artificial Sequence
  Description of Artificial Sequence: Synthetic coding sequence
atgtcaatgctcttctacaccctcatcactgcgttcctgatcggtatccaggcagaaccgcacagcgaatcgaacgtccccgccggacatactatccctcaggcccactggaccaagctgcagcactccctggacactgctttgaggagagcacggagcgccccggctgcggcaatcgccgcgagggtggctgggcagactaggaacatcactgtcgacccccggcttttcaaaaaacggagactgcgctcgcccagagtgctcttctcaacccagcctccacgcgaagcagcagatacccaggatctggacttcgaagtaggtggagctgccccattcaaccgcacccacagatcaaagcgctcctcatcgcatccgatctttcatcgcggtgagttctcagtgtgcgattccgtgtcggtgtgggtgggagacaagaccaccgctaccgacatcaagggaaaggaagtcatggtcctcggagaggtcaatatcaataactccgtgttcaaacagtacttcttcgagactaagtgtcgggatcctaacccagtggactcgggatgtcgcggaatcgactcgaagcattggaattcttattgcaccacgacccataccttcgttaaagcgctcaccatggatggaaagcaggcggcttggcgcttcattaggatcgacaccgcctgcgtctgcgtgctgtcgcggaaggcagtccggcgggcc

SEQ ID NO: 17345 - DNA, 723 bp, Artificial Sequence
  Description of Artificial Sequence: Synthetic coding sequence
atgagtatgcttttttatacattaatcactgccttcctgattgggattcaggcagagccccacagcgaaagcaacgtccccgctggacacactattccacaggcccattggaccaagttacagcactctttggacactgctctaaggcgcgctcggagtgccccagcagcagccatcgcagcacgggtagcagggcagactcgaaacataacagtggatcccaggctgtttaaaaagcggagactacggtctccccgggtgctcttcagcacccaacctcctagggaggcagctgatactcaggaccttgatttcgaggtgggtggcgctgctccttttaaccgtactcatcggtcaaagcggagctcttcccacccaatatttcatagaggtgagttcagcgtctgtgactctgtttcagtttgggtgggcgataaaactactgccacagatataaagggcaaggaggttatggtgctcggagaggtcaacatcaataatagtgtcttcaagcagtattttttcgagacaaagtgccgcgatccaaatccagtggattcaggttgtcgagggattgattctaagcactggaatagctactgcaccaccacacacacatttgtcaaggccctgactatggacggcaagcaggctgcttggcggtttatcaggattgacacagcatgtgtttgcgtactgagcaggaaggccgtgcgacgggct

SEQ ID NO: 17346 - DNA, 723 bp, Artificial Sequence
  Description of Artificial Sequence: Synthetic coding sequence
atgtctatgcttttctatacactcataacagctttcctgatagggatccaggcagaacctcattccgaatccaatgtgcctgccggacacactatcccacaggcccattggacaaaactccagcactccctcgatacagccctccggcgcgcccgatctgcccccgcagccgcgattgccgcacgggttgccgggcagacaagaaatataacagtggatcctaggctctttaaaaaacgccgcctaagatcacctagggttctcttttctactcagccaccacgagaagccgccgatactcaggatctcgatttcgaagttggaggagcagcaccatttaacaggactcataggtctaaacggtcttcttcccacccaattttccaccggggggagttcagtgtgtgtgatagtgtttctgtctgggtgggggataaaactactgcaacagatatcaaagggaaagaggtgatggtgctgggagaggtcaatatcaacaattctgtctttaagcagtatttcttcgaaacaaagtgcagggatcccaaccctgtggattctgggtgtcggggaatagattctaaacactggaattcatattgtactactacacatactttcgtgaaagcccttacaatggatgggaagcaggctgcctggaggtttatccgaattgatactgcctgcgtgtgtgtcttgtcccgcaaagctgtgcggagggct

SEQ ID NO: 17347 - DNA, 723 bp, Artificial Sequence
  Description of Artificial Sequence: Synthetic coding sequence
atgtctatgttgttctatactctcatcacagccttcttgattggcatccaggctgaaccacactccgagagcaatgttcccgcaggccacaccattcctcaagcacattggaccaaattgcagcactccctggacactgctctcagaagggctaggtcagctccggcagcagctatcgctgccagagttgctggtcagaccagaaatataaccgtggaccctagactgttcaaaaagagaagattgcgcagtcccagggtcctgttctctacccagcctccaagggaggccgccgacacccaggaccttgattttgaggtaggcggcgcggctccatttaataggactcacagatctaaaaggtccagctcccacccgatctttcacagaggcgagttttctgtttgcgattctgtgtccgtgtgggtaggtgataagaccactgccaccgatattaagggaaaagaggttatggttctcggtgaagtcaacattaacaatagtgtattcaagcagtatttctttgagacaaagtgcagagaccctaatcctgtcgacagcggctgccgcggaatagacagtaagcactggaattcttactgcactactactcacacattcgtaaaggcgcttacaatggatggaaaacaagctgcttggcgcttcattcgcattgatacggcctgtgtgtgcgtactgagtcgcaaagcagttaggcgcgcg

SEQ ID NO: 17348 - DNA, 723 bp, Artificial Sequence
  Description of Artificial Sequence: Synthetic coding sequence
atgagtatgctcttttacacgctgattacagcttttctgattggcattcaggcagagccccacagcgagagcaacgttcctgctgggcacactatcccacaggctcactggaccaagctgcagcattctctggacacggcccttcgacgggcgagatccgcacctgccgcagcaatcgcagccagggtggcaggacagaccagaaacataacagtggacccgcgactcttcaaaaaaagaaggctgagatcgccccgggttctgttctccacacagcctccacgcgaggcggcggatacccaagatctcgacttcgaagtgggtggagccgcacccttcaacaggacccaccgctcaaaaaggtcctccagtcaccctatattccaccgcggagagtttagtgtatgcgacagtgttagtgtgtgggtcggcgataagacaacagccactgacatcaaaggaaaagaggtgatggttctgggcgaggtaaacatcaacaattctgtgtttaagcagtatttttttgaaaccaaatgtagggaccccaaccccgtggatagcggatgccgcggcatagatagcaagcattggaacagctattgcacaaccacgcatacgtttgtgaaagcactcacgatggacggaaaacaggccgcttggaggtttatacggattgataccgcctgcgtatgcgtgctgtctcggaaagctgtccggcgggct

SEQ ID NO: 17349 - DNA, 723 bp, Artificial Sequence
  Description of Artificial Sequence: Synthetic coding sequence
atgtcaatgcttttttatacacttattacagcgtttttgattggcatccaggcggagccacatagcgaatctaacgtcccagcgggacatacaattcctcaggcgcattggacgaaacttcagcacagcctggatacagctctacgccgggccagatcagctccggccgcggcaattgcagcgcgtgttgcgggacagacgcgtaatattaccgttgatccgaggttgtttaagaagagaaggttgcgctctccgcgagtattgtttagcacgcaaccgccgcgcgaagcggcggatacccaggatcttgattttgaggtcgggggagctgcgccgtttaatagaacgcaccgctctaaaagaagctcctcgcatccgatttttcatagaggagaattttcggtgtgcgattcagtttcggtctgggttggagataagacaaccgcgacagatattaaaggcaaagaagtaatggttcttggagaggttaatatcaataactcagtatttaaacagtattttttcgagacgaaatgtcgcgatcccaacccggttgattcaggttgcagaggtattgacagcaaacactggaacagctattgcacaacaacgcacacgttcgttaaagccttaaccatggatggcaagcaggcagcgtggagatttataagaatagacacggcgtgtgtctgcgttctttctcgtaaagctgtaaggcgtgct

SEQ ID NO: 17350 - DNA, 723 bp, Artificial Sequence
  Description of Artificial Sequence: Synthetic coding sequence
atgtcaatgctgttctacactctcatcactgctttcctgattggcatccaggccgagccgcactcggaatcaaatgtgccggcaggccacaccataccacaggctcattggactaagttgcaacattcgctggacaccgcactgcgccgggcccggtccgcacctgctgcggccattgctgccagggtggcgggacagacccgcaacatcaccgtcgacccaagacttttcaaaaagcgcagacttaggtcgccgcgggtactcttctcgactcaaccgccgcgggaggcggccgatacccaggacctggacttcgaggtgggaggagcagccccgtttaacagaacccaccgcagcaaacgctcctcttcacatcccatctttcacagaggagagttctccgtctgtgattccgtctcagtgtgggtgggagacaagacgaccgccaccgacataaaaggaaaggaagtgatggtgttgggagaagtcaatatcaacaattccgtgttcaagcaatactttttcgaaactaagtgccgggatcccaatcctgttgattcggggtgccggggcatcgactcaaaacactggaactcctactgcactaccactcacactttcgtgaaagcactgaccatggatggaaagcaggctgcctggcgctttatccgaatcgacacggcctgtgtctgcgtgctgtccaggaaagcggttagacgcgcc

SEQ ID NO: 17351 - DNA, 723 bp, Artificial Sequence
  Description of Artificial Sequence: Synthetic coding sequence
atgtctatgctcttttacacattaattaccgctttccttattggcattcaggctgaacctcatagcgagagtaatgtcccggccggacatacgattccccaggctcactggactaagctacaacatagtctcgacactgccctacggagggcccgctctgccccagcagcagcaatagctgccagggtggccgggcagactagaaatatcactgtcgacccccggctgttcaagaagcgcagacttcgctcccctagggttctcttctcaacgcagccaccaagggaagcggctgacacccaagacctagatttcgaggtaggtggtgcagctccatttaacagaacacatcgctcgaaaagaagctcaagccacccgatcttccatcgtggcgagttcagtgtgtgcgactcggtgagcgtatgggtgggagataagacaacagctacagacattaagggcaaggaagtgatggtgcttggggaagtcaatatcaacaatagcgttttcaagcagtatttcttcgagacaaagtgccgggaccccaatcccgtggacagcggatgtagaggcatcgattctaagcattggaacagttactgcactaccacacataccttcgtcaaagccctgaccatggatggtaagcaggccgcctggaggttcatccggatcgacacagcctgcgtgtgtgttctttctagaaaagccgttagaagggcc

SEQ ID NO: 17352 - DNA, 723 bp, Artificial Sequence
  Description of Artificial Sequence: Synthetic coding sequence
atgtcaatgcttttctacaccctcataaccgcatttctgatcggaatccaagcagaaccacactcagaatcgaacgtgcctgcaggacataccataccccaagcgcattggaccaagctgcagcactccctggatactgcactgcgacgggcccgcagcgctcccgccgcggcaattgcagcaagggtcgctggacaaacccgtaatatcactgtcgatccgcgactgttcaagaagagaaggcttagatccccacgggtcctgttttcaactcagccccctcgcgaagcagctgacacccaagatctggattttgaggttggaggcgccgcaccctttaaccggactcaccgaagcaagagatcctcgagccatccaattttccacagaggagaatttagcgtgtgtgacagcgtgtcggtttgggtgggtgataaaaccactgcaaccgacattaaaggaaaagaggtgatggttctgggcgaagtcaacatcaacaattccgtgtttaagcagtacttcttcgaaaccaagtgcagggatcctaatcctgtcgattccggttgtcgagggattgactcgaagcattggaactcctactgtaccactactcatacgtttgtgaaggcactcaccatggacggaaagcaggcggcatggagatttatccgcatagataccgcctgtgtctgtgtcctgtcaaggaaagcagtgaggcgggcg

SEQ ID NO: 17353 - DNA, 723 bp, Artificial Sequence
  Description of Artificial Sequence: Synthetic coding sequence
atgtccatgctgttctacactctgattacagccttcctgattggcatacaagcagaacctcactccgagagtaacgtccctgcggggcacacaattccacaggctcattggacgaagctacagcacagtctggacacagccctgcggcgagccaggtcagcccctgcagccgccatcgccgctagagtggccggacagacgaggaatatcacagtcgacccgcgcctgtttaaaaaacgcaggctcagatccccacgcgttctattctccacccaacctcccagggaagccgctgatacgcaggacctggattttgaagtaggcggtgcagccccctttaaccggacgcaccgatccaaacgttcatcatcccaccctatcttccatagaggcgaattctctgtttgtgactctgtgtccgtgtgggttggcgataagactactgcgaccgacatcaaggggaaagaagtcatggtgctgggagaagtcaatatcaataatagtgtttttaagcagtacttctttgaaaccaaatgccgggaccccaaccccgtcgactctggatgcagagggatcgatagtaaacactggaactcgtactgtacgacaacgcacacctttgtaaaggccctcaccatggatgggaagcaggccgcgtggcgatttattaggatcgacacagcctgtgtctgcgtgctgtcaagaaaggctgtaagacgagcc

SEQ ID NO: 17354 - DNA, 723 bp, Artificial Sequence
  Description of Artificial Sequence: Synthetic coding sequence
atgagcatgttgttttacactctcatcaccgcgtttcttataggcatacaagctgagccccattccgagtccaacgtccctgccgggcatactatcccgcaggctcattggaccaaattgcaacactcgcttgacaccgcactgcggcgtgccaggtctgcaccagcagcggccattgcggcacgagtggcgggacagactcgcaacataaccgttgatcctagacttttcaaaaagcgccgtctgaggtcccctagagtgcttttctccactcaacctccacgcgaagcggctgatacgcaggatctggatttcgaagtgggaggtgccgcacctttcaacaggactcatagaagcaagcgctcgagctcacatcccattttccaccgaggtgaattttcggtgtgcgattctgtgtccgtgtgggtcggtgataaaacgaccgccaccgatatcaaaggtaaagaagtgatggttctgggcgaggtgaacataaacaactcagtgttcaagcaatacttttttgaaaccaaatgtcgggacccgaatcccgtggatagcggatgccgcgggattgacagtaagcactggaattcctactgtaccacgacccatacgtttgtgaaggctctcactatggatggaaagcaggcggcatggagattcattcgaatagacaccgcatgtgtgtgtgtgctctcaagaaaggcagtgcgccgcgca

SEQ ID NO: 17355 - DNA, 723 bp, Artificial Sequence
  Description of Artificial Sequence: Synthetic coding sequence
atgagtatgctgttctacactctgatcacagccttcctgatcggaatccaggccgaaccccacagcgagtcaaacgttcccgccggccacactatccctcaggctcattggactaagttgcagcacagtttggacaccgccttgagacgcgctcgttcagccccagctgctgctatagctgcaagagtagccggtcagacacgtaacatcaccgtagatccccgcctctttaaaaaaaggcgtctgagatctcccagggtgctcttcagcacccagcccccaagggaggcagctgacacccaagacctggacttcgaagtaggaggtgccgcccccttcaaccgtacacacagaagcaagaggtccagttcccatcccattttccatcgcggagagttttccgtgtgcgatagtgtgtccgtgtgggtcggagataagaccactgccactgacattaaaggaaaagaggtgatggttctgggtgaggttaatatcaacaactccgtgttcaagcagtacttcttcgagacaaagtgccgtgatccaaaccccgtggacagcggttgccgtggtattgactcaaaacattggaattcttactgcacaactacccacaccttcgtgaaggccctgactatggacggcaaacaggctgcttggcgctttatcaggatcgacacagcttgtgtttgcgtgctttcaagaaaagccgtgaggcgcgct

SEQ ID NO: 17356 - DNA, 723 bp, Artificial Sequence
  Description of Artificial Sequence: Synthetic coding sequence
atgtcgatgctgttttacaccctgataactgcgtttttgatcggcattcaagcagagccacatagcgaatcgaatgtgcctgcagggcacacgatcccacaggctcactggactaaacttcaacattccctcgataccgctctcagacgtgcaagaagcgcgcccgctgcagcaatcgcagcgcgagtcgccggacaaactcgcaatatcaccgtcgaccctagactcttcaaaaagcgtcgcctgcggtccccgagggtgctgttttccactcagcccccgcgcgaggccgcagacacccaggatctggattttgaagtggggggagccgcaccctttaacaggacccatagatcaaagagatcgtcctcccaccctatctttcatcgcggggaattttccgtgtgtgactcggtcagcgtgtgggtgggagataagactaccgcaaccgatatcaagggtaaagaagtcatggtgctgggagaagtcaatatcaacaactccgtctttaagcaatactttttcgaaaccaaatgtcgagatcctaatcctgtggattcgggttgtagaggtatcgatagcaaacattggaattcgtactgcaccacgactcacacctttgtgaaagcacttacgatggacggcaagcaggctgcctggagattcattcgcattgatactgcatgcgtttgcgtgctttcaaggaaagcagtcaggcgcgct

SEQ ID NO: 17357 - DNA, 723 bp, Artificial Sequence
  Description of Artificial Sequence: Synthetic coding sequence
atgtcaatgctcttctacactctgattactgcgttcttgattggtatccaagctgagccgcactcagagtcaaacgtcccagcaggtcatactatccctcaagcgcattggacgaagctccagcactccttggacactgcactgagacgggcccgatcggctcctgcggccgcaattgccgcgcgagtcgcgggtcagactcggaacattaccgtcgatccacgactcttcaagaagcgccgtcttaggagccctcgtgtgctgttctctacccagccaccgagggaagccgccgatacgcaggacctggattttgaggtcggcggcgcagcaccctttaatcggacccatcgaagcaaaagatctagctcgcatcccatctttcataggggagaattttcggtgtgtgattcggtgtcagtgtgggttggagataagactaccgccaccgacattaagggaaaggaagtgatggtcctgggtgaagtgaacattaacaactccgtgtttaagcaatacttcttcgagactaaatgcagggaccctaatcccgttgatagcggttgcagaggcatagatagcaaacactggaattcgtactgtactactacgcacacgtttgtgaaggcacttactatggatggaaaacaagcagcgtggagattcataagaatcgacaccgcatgtgtgtgtgtcctttcgcggaaagctgtgcgaagagca

SEQ ID NO: 17358 - DNA, 723 bp, Artificial Sequence
  Description of Artificial Sequence: Synthetic coding sequence
atgtcaatgctgttctataccctgatcacggccttcctgatcggtattcaggccgagccgcattcagagagcaacgtccccgcaggtcatactatacctcaggcacactggactaagctccaacatagcctggataccgcattgcgccgcgcacgcagcgcgccagccgcggctatcgctgcgcgcgtcgcgggtcagacccgcaacattacggtcgacccacgcctgttcaagaaacgccgcctaaggtcccctcgcgtcttattctccacccaaccgccaagagaggcggctgacacgcaggacctagatttcgaagttggtggtgcggcaccatttaatcgtacccaccgcagcaaaaggagctcctcccaccctattttccaccgtggtgaatttagcgtctgcgactccgtaagcgtttgggttggcgataaaacgactgcaaccgatattaaaggcaaggaggtcatggttctgggcgaggtgaatatcaacaatagcgtcttcaagcagtacttcttcgaaacgaaatgtagggacccgaatccagtggattcggggtgtcgcggaattgactcgaaacattggaattcttattgcacaactactcatacatttgtgaaggcgttaacgatggacgggaagcaggctgcctggcgcttcattcgcatagacaccgcgtgtgtctgcgtactctcccgcaaggccgtgcgccgggct

SEQ ID NO: 17359 - DNA, 723 bp, Artificial Sequence
  Description of Artificial Sequence: Synthetic coding sequence
atgtcgatgctgttttacacccttattacggcctttctcatcggcatacaggctgaacctcattctgagtcaaacgtgccggctggccatacaataccccaggcacattggacaaagctgcagcactctttagatacagctcttcggcgggcaaggagcgcaccagctgcagccatagctgcccgggtggctggccagacccggaacattacagtggatccgcggttgttcaagaaaaggaggcttcggtcaccccgagttctgttcagcactcagcccccccgcgaggccgcagatacgcaggacctagattttgaggtgggcggagctgctccattcaaccgcacacaccggtccaagcgctccagctcccaccccattttccacagaggggagttttctgtgtgcgacagcgtgtccgtgtgggtcggagataagacgaccgccaccgacatcaaaggaaaagaggttatggttctgggcgaagtgaacattaataactcagtcttcaaacaatacttttttgaaaccaagtgtcgagatcccaaccccgttgatagcggctgccgtggtatagactctaagcattggaattcatactgtaccaccacccacactttcgtaaaagctctgacaatggacggcaagcaggccgcttggaggtttattcgtattgataccgcctgcgtttgtgttctgtccagaaaggccgtccgtcgggct

SEQ ID NO: 17360 - DNA, 723 bp, Artificial Sequence
  Description of Artificial Sequence: Synthetic coding sequence
atgtccatgctgttctacaccctgataaccgcttttttaatcggtatccaggccgagcctcactctgagtccaacgtgcctgcgggccacacaatccctcaagcccattggacgaaattgcagcactctctggacactgccctgcggagagctcgaagcgcccccgctgccgctatcgcagcccgcgtggccggtcaaacgaggaacattactgtggacccacgcctctttaaaaaaagaagattgcggtctcccagggttctgttcagtacccaaccgcctcgtgaagctgctgacactcaagacctggatttcgaggtcggcggagcagctcctttcaaccgtacccataggtcgaaacggagctctagccacccaatctttcatcgcggtgaattctccgtgtgtgattccgtgagcgtctgggtgggagacaagacaaccgctacagacataaaaggcaaagaagtaatggtcctgggagaggtgaatatcaacaacagtgtgttcaagcagtatttttttgaaaccaaatgtcgcgatccgaaccctgttgatagtggctgtaggggtatcgattctaaacactggaactcatactgcaccaccactcatacttttgttaaggctctcaccatggacggtaagcaagctgcatggaggtttatcaggatcgacacagcctgcgtctgcgtcctgagtcggaaggcagtaagacgcgca

SEQ ID NO: 17361 - DNA, 723 bp, Artificial Sequence
  Description of Artificial Sequence: Synthetic coding sequence
atgtcaatgctcttctacactcttataacggcctttctcatcggaattcaagcagaaccacattccgaatccaacgtgcccgcgggccatactatacctcaggcacattggaccaaactgcagcacagcctggataccgcacttcgcagagcacggtcagcacctgccgcggccattgctgcaagagtggcgggacagactaggaatatcacggtcgatccgagactgtttaagaagcgaagattgcgatctccccgcgtcctcttttcgacccagcccccaagagaagcagcggacactcaggatctggatttcgaggtgggaggcgctgcacctttcaaccggacccataggtccaaacgctcatcatcgcacccaatctttcatagaggagaattttccgtctgtgatagcgtgtcggtgtgggtgggcgataagactaccgccaccgatatcaaggggaaggaggtgatggtgctgggcgaggtcaatatcaataacagcgtgtttaagcaatactttttcgaaaccaaatgtcgggacccaaatcctgtggactcagggtgccgggggattgatagcaagcattggaactcatactgcaccactacccatacttttgtgaaggcactgacgatggacgggaaacaggccgcatggcggtttatacggatcgataccgcgtgtgtgtgtgtgctttcaagaaaggccgtgcgcagagca

SEQ ID NO: 17362 - DNA, 723 bp, Artificial Sequence
  Description of Artificial Sequence: Synthetic coding sequence
atgagtatgctgttctacaccttgatcaccgcttttctgatcggcatccaggctgaaccccattccgaaagcaacgtgcccgccgggcacacaattcctcaggctcactggacgaagctgcagcattccctggacaccgcgctgcgccgggctagatccgcccccgccgctgcgattgccgcgcgagtggctggtcaaacaagaaacataactgtagacccccgactgtttaagaaacgacgccttcggtctcctcgggtcctgttcagtactcagcctccaagggaggccgccgacactcaggacctggacttcgaggtgggcggtgccgccccatttaatcggacgcaccgcagcaaacgaagctcctctcatccaatatttcatcgaggggagtttagcgtgtgcgactctgtgagtgtgtgggtgggcgataagactaccgccaccgatataaaaggcaaggaggttatggtgctaggtgaggtgaacataaataacagcgtcttcaagcagtatttttttgagaccaaatgccgagatccgaatccggtggacagcggttgtagggggattgatagcaagcattggaatagctattgtaccaccacacacacattcgtgaaagcactgacaatggacgggaagcaggcggcatggcgatttattcggatagacactgcgtgcgtttgtgtacttagccgtaaagctgtacgccgggcc

SEQ ID NO: 17363 - DNA, 723 bp, Artificial Sequence
  Description of Artificial Sequence: Synthetic coding sequence
atgagcatgctgttctataccttgataaccgctttcttgattggcatccaggcggagccacacagtgaatctaacgttcccgccggacacaccataccccaggcgcattggactaagctgcagcattctctggacaccgccctgcgtcgagctagatctgcccccgcagcagcaatcgcagctcgggtcgccggacagacgcgaaatattaccgtggatccccgcctgttcaagaaacgccgcctacgatccccacgagtgctcttcagcacccaacccccccgggaagccgctgatacacaagatttagattttgaagtcggcggagccgccccattcaacagaactcaccgctctaagcgctcctccagccatcctattttccacaggggcgaattctctgtctgtgacagcgtttccgtgtgggtgggggacaagacgactgcaactgatattaagggaaaggaggtaatggtgttgggagaagtgaatataaacaactctgtcttcaaacagtacttcttcgagaccaagtgtagagacccgaaccctgttgacagcggttgtcggggcattgacagcaagcattggaacagctactgcacgacaacacacacttttgttaaggccctcacaatggatggcaaacaggccgcatggagatttatacgcattgacaccgcttgtgtgtgcgttctatcgagaaaggcagtgaggcgcgcc

SEQ ID NO: 17364 - DNA, 723 bp, Artificial Sequence
  Description of Artificial Sequence: Synthetic coding sequence
atgagtatgctcttttacacccttatcaccgcatttttgatcgggattcaggcagagccccactcggaatctaacgtccccgcaggacataccattccgcaggcccactggactaaacttcaacattcgctggatacggcattgagaagagcgcggtccgcacctgcagcagccattgcggcgcgggtggctgggcaaactagaaacatcaccgtcgatcctcggctcttcaaaaagagacggctgagatcaccccgcgtgctttttagcacccagcccccaagagaggctgccgatacgcaggaccttgatttcgaagtgggaggtgctgctccattcaatagaacccatcggtcgaaaaggagctccagccatcctattttccatagaggggaatttagcgtgtgtgactccgtgtccgtttgggtcggagataagactacggcgactgacataaagggaaaggaagtgatggtactgggagaagtgaatatcaacaactccgtctttaagcagtatttctttgaaaccaagtgccgagatcctaatcctgtggatagtggttgtagagggattgactccaaacattggaactcgtactgtactaccactcacactttcgtgaaggccctgactatggatggtaagcaggcagcctggcgcttcattcgaattgacaccgcatgtgtgtgcgtcctgtcacgaaaagcggtccgccgtgca

SEQ ID NO: 17365 - DNA, 723 bp, Artificial Sequence
  Description of Artificial Sequence: Synthetic coding sequence
atgtccatgctcttttatactttgatcaccgcttttctgatcggcatccaggctgagcctcattcggagagcaacgtcccggccggccacacgatcccccaagcccattggactaagctgcagcattcgcttgacaccgcccttaggcgcgcccggtcagcgcctgctgctgcaatcgcagcgcgcgtcgccggtcagacgcggaacatcaccgtcgaccctcgtctattcaaaaagcgccggctgagaagtcctcgggttctgttttcgacccagcccccccgtgaggcggccgacactcaggacctggatttcgaggtcggcggtgccgcgcctttcaaccgaactcatagatccaagcgtagcagcagccaccctatcttccatcgcggcgaattctctgtgtgtgactccgtctcggtctgggttggggacaagacgacagcaaccgatattaaaggcaaggaggtcatggtcctcggggaggtgaacatcaacaactccgttttcaagcagtattttttcgaaaccaagtgccgcgatcccaaccctgtcgactctggttgtcgtggtatcgattccaagcattggaactcctactgcactaccactcatactttcgttaaggccctcacgatggacggcaagcaggcagcctggcgtttcatacgtatcgacacagcgtgtgtttgcgtcctgtcccggaaggccgtgcgccgggcg

SEQ ID NO: 17366 - DNA, 723 bp, Artificial Sequence
  Description of Artificial Sequence: Synthetic coding sequence
atgtctatgcttttctatacactaatcacagcatttctgatcggaattcaggccgagccacattcggaatctaatgtacctgctgggcacactataccccaggcccattggactaaactccagcattctctcgatacagcactgaggagagcccggtctgctcctgccgccgctatcgctgctcgggtagcagggcagacacgaaacatcacagttgatcccagactgtttaaaaaacggaggctccgctcgccacgggtcctattctccactcagcccccaagagaagctgcagatacacaggatcttgatttcgaagtaggaggggcagcaccatttaacaggacacatagatccaaacggagttcatcacatcccatttttcaccgcggggagttttcagtgtgtgatagtgtgtccgtatgggtgggagataaaactacagcgacagatatcaaaggaaaggaagtaatggtgctgggagaggtgaatattaacaactccgtttttaaacagtattttttcgaaacaaagtgtagggatcccaatcctgttgattcgggatgtagagggatagactcaaagcactggaactcttattgcacaacgacacatacatttgttaaagccctcactatggatggaaagcaagccgcctggcggtttataagaattgatacagcctgtgtgtgtgtactgtctagaaaggccgtgcggcgcgct

SEQ ID NO: 17367 - DNA, 723 bp, Artificial Sequence
  Description of Artificial Sequence: Synthetic coding sequence
atgtccatgctgttttacaccctgattactgccttcctcatcggaatccaggctgagccccatagcgaatcgaacgtcccagcggggcacactatcccccaagcacattggaccaagctccagcactcacttgacaccgccctgcggcgagctagatctgccccagctgctgcgatcgcggcgagagtcgccggacagactcggaacatcacggtggatccgcgactcttcaagaaaagaaggctgcgctcacctcgggtcctgttctcgacccagccaccgcgggaggccgcagatacccaagaccttgatttcgaagtgggtggagcggcaccgttcaaccgcacccaccggtcaaaacgaagctcctcacatccgatctttcaccgcggagaattttcggtatgcgacagcgtgtcggtgtgggtgggcgacaagacgactgccaccgacatcaaggggaaggaggtgatggtgctcggggaagtgaatatcaataacagcgtgttcaaacaatacttcttcgagactaagtgccgggatccgaatccagttgattccggttgtcggggcattgacagtaagcattggaatagttactgcaccactactcacacgtttgtgaaagcgctgactatggacggaaagcaggctgcctggagattcatcaggatcgatactgcttgcgtctgtgtattgtcacgcaaagcagttaggagggcg

SEQ ID NO: 17368 - DNA, 723 bp, Artificial Sequence
  Description of Artificial Sequence: Synthetic coding sequence
atgtccatgcttttctacacactcatcacagccttcttgatcggtatccaggccgaaccacatagtgaaagcaatgtgcccgcaggacacacaatcccccaggctcactggaccaagcttcagcattccctggacaccgccctgcggagagccaggtcagcacccgccgccgccattgcagcacgggtcgctgggcagacccggaatattaccgtggatcctaggctcttcaagaagcggcgactgaggagcccccgcgtgctgtttagtacccaaccccccagagaagccgcagatacacaggatctggacttcgaagttgggggcgcggccccgttcaatcggactcaccggtctaaaaggtcaagctctcacccaattttccacagaggcgaattcagtgtgtgcgacagcgtctctgtgtgggtaggggataaaaccacggccaccgacatcaagggcaaagaagtgatggtgctcggagaggtgaacatcaataactccgtcttcaagcaatattttttcgagactaagtgccgcgacccaaaccccgtggactctggctgcagagggatagatagtaagcactggaactcatattgtaccaccacccacacttttgtgaaagcattgaccatggacgggaagcaagccgcgtggagattcataagaatcgatacggcgtgcgtttgcgtgttgtcccggaaggccgtccgccgggct

SEQ ID NO: 17369 - DNA, 723 bp, Artificial Sequence
  Description of Artificial Sequence: Synthetic coding sequence
atgtcaatgctgttctatactttaatcaccgcttttctgatcggcatacaggcagagcctcactccgagagcaacgtgccagctgggcacactattcctcaggcacactggacgaaacttcagcattccctcgacaccgctctgagaagagcaaggagtgcccctgcagccgcaattgccgcaagggttgccgggcagacccggaacattacagtcgaccctaggctgttcaagaaaaggcgcttgaggtctccgcgcgtgctcttttccacccagcctcctcgagaggctgcagatacgcaggacttggacttcgaggtagggggcgcagctccctttaaccgcacacaccgatcaaagcgcagcagttcccaccctatatttcatcggggtgagttctccgtgtgtgactctgtgtccgtgtgggtcggagacaagacgacagccacggacataaaggggaaagaagtaatggtgctcggcgaggtgaatatcaataattccgtattcaagcagtacttcttcgaaacgaaatgtcgagatccaaatcctgtggattcaggatgcagaggaatcgattcaaaacattggaatagctactgcactaccacacatacattcgtgaaggcgctgaccatggacggtaagcaggccgcatggaggtttatccgaatcgacactgcctgcgtgtgcgtgctttcgaggaaggcagtaaggcgggcc

SEQ ID NO: 17370 - DNA, 723 bp, Artificial Sequence
  Description of Artificial Sequence: Synthetic coding sequence
atgtccatgttgttctacacgttgattacagcattcctgatcggtattcaggctgaaccccacagcgagagtaacgttccggctggtcatacaattccccaggcacattggacaaagctccaacactccctggacacagccctgcggcgcgcccggtccgctcctgctgcggctatcgcggcacgcgtggctgggcagacaaggaatatcacagtagacccgcgacttttcaaaaaaagacgcctgaggagtccacgcgttcttttctccacgcagcccccacgagaagccgccgacacccaggacctcgatttcgaagtggggggggcagcccccttcaatagaactcatcgctcaaaaaggtcatctagccatccaattttccacaggggcgagttctcagtgtgtgacagtgtgagtgtgtgggtgggcgacaagacaacagccacagacatcaagggcaaggaagtgatggtcctgggtgaggttaatatcaacaatagcgtttttaagcaatacttctttgaaacaaaatgtcgggacccaaacccggtggattcagggtgtaggggaattgatagtaagcactggaattcttactgtacaaccactcacactttcgtgaaggcgctgacgatggatggtaagcaggcggcctggagattcatccgaattgacacagcttgcgtctgcgttctgtcacggaaagccgtgcggcgagct

SEQ ID NO: 17371 - DNA, 723 bp, Artificial Sequence
  Description of Artificial Sequence: Synthetic coding sequence
atgtcaatgctattttatactctgataactgcttttctgattgggatccaggctgagccccacagcgaatcgaacgtaccagcggggcataccataccgcaggctcattggacaaaattgcagcactctctcgacaccgctttaaggagagcccggtcagcgccggccgcggccatcgctgcacgcgtagcgggccaaacacggaatataactgtggaccctcgtctgttcaaaaagcggaggctccgatcgccccgggtgctgttctccacccagccacctcgggaggcagctgacacccaggatttggattttgaggttggtggtgccgctccattcaaccgcacccatcgcagcaagcggagcagctcacatcccatcttccacagaggagagttttctgtatgcgactcggtctcagtgtgggtgggagataagactacagctactgacatcaaaggtaaggaagtgatggtgcttggggaagtgaacatcaacaacagcgttttcaaacagtacttctttgaaactaagtgtagagatccgaacccagtggattccggctgccgtggtatcgattctaagcactggaatagctactgcactaccacccacacatttgtcaaggccctgaccatggatgggaaacaggccgcttggcggtttattagaatcgacactgcctgtgtgtgtgtgctgagtcggaaagctgtgagacgggcg

SEQ ID NO: 17372 - DNA, 723 bp, Artificial Sequence
  Description of Artificial Sequence: Synthetic coding sequence
atgagcatgctgttctacacactcattacagccttcctgataggcattcaagcagaacctcattctgagagcaatgttcccgccgggcacactataccgcaggcccactggacgaaactgcagcattctctggacacagccctgcgaagggcaaggtccgctcctgcagccgccatagccgccagagtggctgggcagacaaggaacattactgtggaccccaggctattcaagaaacgcaggctccgctctccgcgcgtgctgtttagcacccagcctccaagggaagccgccgatactcaggatctggattttgaagttggcggggctgctccgtttaatcgcacacacagaagcaagagaagttcctctcacccgattttccatcgtggcgaattttctgtctgtgatagtgtctccgtctgggtcggggataaaactactgcgacagatatcaaggggaaggaagttatggtgctgggcgaagtgaatatcaataactcagttttcaagcagtatttcttcgaaactaagtgccgggaccctaaccctgtagacagcggatgtcggggtatagatagtaagcattggaactcatactgtaccactacacacacatttgtgaaggcgcttactatggacggaaagcaggctgcctggcgatttatccgtatcgacactgcctgcgtgtgtgtgctgtcacgtaaggccgtgcgccgcgcc

SEQ ID NO: 17373 - DNA, 723 bp, Artificial Sequence
  Description of Artificial Sequence: Synthetic coding sequence
atgagcatgctgttttacaccttgatcaccgctttcctcattggaatacaggctgaaccgcattccgagtccaacgtaccagctggccacacgatcccacaggcacactggaccaaactgcaacattcactggacaccgctctccggcgcgccagatccgctccagcggctgcaatagctgcccgtgtcgccgggcaaacccgcaatatcactgtggacccgaggctgttcaagaaaagacgcctgcggtcacctcgcgtgcttttttcgacccagccgcctagagaggcggccgatactcaggatcttgactttgaggtcgggggagccgcgcctttcaatcgcactcacaggtcaaaacgatccagctcacacccgatcttccacagaggagaattttcggtgtgcgactccgtgagcgtgtgggtgggagacaaaactaccgcgactgacatcaagggtaaggaagtgatggtgctcggagaggtgaatatcaacaacagcgtgttcaagcaatactttttcgaaacgaaatgcagggatccaaaccccgtggactccgggtgcagaggcatcgacagcaagcattggaactcttactgcacgactactcatacgttcgtgaaagccttgaccatggatggaaagcaggcagcctggcgcttcattcgcattgatactgcctgtgtctgtgtcttgtcgcgcaaggccgtgaggcgcgct

SEQ ID NO: 17374 - DNA, 723 bp, Artificial Sequence
  Description of Artificial Sequence: Synthetic coding sequence
atgtcgatgctgttctacactctcattactgcctttcttatcggaatacaggcagaaccacattccgaaagcaatgtaccggctggacatactatcccacaggcccactggacgaaactccagcactcactggatactgcactgcggcgagcacggtcggcgccggctgccgccattgcggctcgcgtggccggacagacccggaacatcacggtggatccccgcttgttcaagaagaggagactccggtcaccgagagtcctcttttccactcaacctccgcgcgaggctgccgacacccaagatctcgatttcgaggtgggaggtgctgcgcctttcaaccgcactcacaggtccaagagatcatcgtcccatccaatctttcacaggggggagttctccgtgtgcgactcagtctcggtgtgggtaggcgacaagaccaccgcgactgatatcaaggggaaggaagtcatggtgctgggcgaagtgaacatcaataacagcgtattcaaacaatacttctttgaaactaagtgccgcgaccctaacccagtggactcgggctgccgggggattgacagcaagcactggaattcatactgtactacgacgcataccttcgtgaaagccttgaccatggacggaaagcaggccgcatggcggtttatcagaatcgataccgcgtgtgtctgcgtcctcagtcggaaagccgtgcggcgcgca

SEQ ID NO: 17375 - DNA, 723 bp, Artificial Sequence
  Description of Artificial Sequence: Synthetic coding sequence
atgagcatgttgttctatactctcattactgcatttcttattggaatccaagcggagccacattcggaatctaacgtgcctgcgggtcataccataccccaagcacattggactaagctccagcactcactcgatactgcacttcgtcgcgcacgatccgcaccagcagcagcaatcgccgcccgggtcgcaggtcaaactcggaacatcaccgtggaccctaggctgtttaagaagcgccgactcaggtcgcctagggtgctttttagcactcagcctcctcgcgaagcggcagacacccaagatcttgattttgaagtcggcggtgcagccccgtttaaccgtacccataggagcaagagaagctcatcccatccaattttccacagaggcgagttctcggtctgtgattcggtgtcagtgtgggtgggtgataaaaccactgcaactgacataaagggaaaagaagtaatggtgcttggagaagtcaacattaacaactcagttttcaaacaatacttttttgaaaccaagtgtagagatccaaacccagtggattcgggctgtagagggatcgattccaagcattggaactcctactgtaccactacccacacttttgtgaaggcactgactatggacggaaagcaggcggcgtggagatttatccggattgacaccgcgtgtgtgtgtgtgctctcccggaaggcagttagacgggca

SEQ ID NO: 17376 - DNA, 723 bp, Artificial Sequence
  Description of Artificial Sequence: Synthetic coding sequence
atgtcaatgctgttctacactcttataacagccttccttattggtatccaggctgagcctcactccgaaagcaacgtcccggctggccacacgatcccgcaggcacactggacaaaactacagcactcactggatacggcacttcgtcgcgcgagatcagcccccgctgccgccattgccgctagggtcgcaggccagacacgcaatatcaccgttgatcctcggttgtttaagaagcgcagactgcggagcccccgcgtgcttttcagtacccaaccacccagggaggccgcagacacccaagacctggactttgaagtaggtggggccgctcccttcaatcgcacccacaggtccaagagaagcagctcgcatcctatcttccatcgcggagaattctctgtctgcgacagcgtgtcagtatgggtgggagacaagacaaccgctaccgacatcaaagggaaggaggtcatggtgctgggcgaagtgaacattaataactctgtcttcaaacagtattttttcgagacaaagtgccgggatccaaatccggtagattcggggtgtagggggatcgactctaaacactggaactcttactgcacaaccactcatacattcgtgaaagccctcaccatggacggcaagcaggctgcttggaggttcattcggatcgacacggcttgcgtgtgcgttctctccagaaaggccgtacgacgcgcc

SEQ ID NO: 17377 - DNA, 723 bp, Artificial Sequence
  Description of Artificial Sequence: Synthetic coding sequence
atgtcgatgctgttctatacactcattaccgcctttctgataggcatccaggccgaaccacactccgagtctaacgtgccggctggacatactataccacaggcgcactggaccaagttacagcatagcttagacaccgcactgcggagggctagatctgcacctgctgctgccatcgccgccagagtagctggccagacacggaacattaccgttgatccacgtttattcaagaaacgtcgactccgctcccctcgagtgctgttttcaacccaaccacccagggaggccgctgatactcaggatctcgactttgaggtcggcggtgcagccccattcaacagaacacatagatccaaacgttcctcaagccaccccatttttcaccggggtgagttcagtgtttgtgactcggtgagcgtgtgggtgggggacaagacaaccgctacagacattaagggcaaggaggttatggtcctgggtgaagttaacattaataactcagtattcaaacagtatttttttgagacaaaatgtagggatcctaaccccgtggacagcggttgtagaggcatcgatagcaagcattggaattcatactgcactactacccatacattcgtaaaggctcttaccatggacggcaagcaggccgcctggcgcttcatcaggatcgacactgcatgtgtgtgtgtactgagccgcaaggctgtacggagagca

SEQ ID NO: 17378 - DNA, 723 bp, Artificial Sequence
  Description of Artificial Sequence: Synthetic coding sequence
atgagtatgctcttttacacgctgattactgccttcctgattggtatccaggctgagcctcattcggaaagcaatgttcctgccgggcacactatcccacaggcacattggaccaaactacaacacagcttagacacagcactgaggcgtgcccgatcagcaccggctgccgccatcgcagctcgagttgccggacagaccaggaatattaccgtggacccccgcttattcaagaagaggcgattgcgaagtccccgtgtcctgttctctacgcagccgcccagagaagccgcggacacgcaggacctggactttgaagtgggcggtgccgccccattcaatcgtacccacagatccaagcgatcaagttcccaccctatttttcatagaggggaattctctgtctgtgactcggtaagcgtttgggtcggagacaaaactaccgcaacggatataaagggaaaagaggtcatggtgttgggtgaggtgaacattaataactccgttttcaagcagtactttttcgagaccaaatgtagagacccgaacccggttgatagtgggtgtaggggcattgactccaaacactggaatagttattgcacgaccacccatacatttgttaaagccctgaccatggacggaaagcaagctgcttggcgttttatcagaatcgatacagcctgcgtgtgtgtcctcagccgaaaggccgtgcgacgggcc

SEQ ID NO: 17379 - DNA, 723 bp, Artificial Sequence
  Description of Artificial Sequence: Synthetic coding sequence
atgtcaatgcttttctacacactgatcacggctttcctcatcggtattcaggctgagccccactcagagtctaacgtcccagccggccacactattccccaagcgcattggaccaaactgcagcacagcctggatacagccctgagaagagctaggagtgctccagcagcagctattgccgcgcgggttgctggccagacgcgcaatattacagttgatcccaggctcttcaaaaagcgaaggctgcgaagtcccagagtactcttttcaactcaaccaccacgggaggccgctgatacccaggacctggattttgaggtaggcggtgccgctccatttaacagaacccacaggagtaagcgaagtagctctcacccaatattccatcgaggagaatttagcgtgtgtgatagtgtgtctgtgtgggtgggcgacaagacaaccgcaacagatataaagggtaaagaggtgatggtgctgggtgaggtgaacatcaacaattcagtgttcaagcaatacttctttgagactaagtgtcgagatcctaatcctgtggactctggctgtaggggcatcgatagcaagcactggaacagttactgtacgacaactcacacatttgtgaaggccttgacaatggacggcaagcaggcggcctggagatttatccgaattgataccgcttgcgtctgtgtcctctctcgcaaggctgttcgccgagca

SEQ ID NO: 17380 - DNA, 723 bp, Artificial Sequence
  Description of Artificial Sequence: Synthetic coding sequence
atgtcgatgctcttttacaccctcatcactgcctttcttatcggtattcaggctgagccgcactccgagtcaaatgtgccagccggacacaccatcccccaggcccactggactaagctgcaacatagcctggacactgcgttgcggcgcgcccgctccgctccagctgccgccatcgctgcgcgcgtcgcagggcagaccaggaacatcacggtggacccccggcttttcaagaagagaaggcttagatcgccgagggtcctgttttcgactcaaccacctcgcgaggcggcggacactcaggatctggatttcgaggtcggtggagcggccccattcaacagaactcaccgcagcaagcggtcgtccagccacccgatctttcaccggggagagttctcggtctgcgactccgtgtcagtgtgggtcggggacaagactaccgcgaccgacatcaagggaaaggaggtcatggtgctgggagaagtgaacattaacaactccgttttcaagcaatacttcttcgaaaccaagtgccgcgatccaaaccccgtggattcagggtgtagaggcatcgacagcaaacattggaacagctattgcacgactactcacaccttcgtcaaggccctgactatggacgggaagcaggcggcgtggcgctttatccggatcgataccgcttgtgtgtgcgtcctgtcgcggaaagcggtgcgccgcgcc

SEQ ID NO: 17381 - DNA, 723 bp, Artificial Sequence
  Description of Artificial Sequence: Synthetic coding sequence
atgtccatgctgttctacactcttatcactgccttccttatcggaatccaggctgaacctcacagcgaatccaacgtgccagccggacacactatcccgcaggcgcactggaccaaactccaacactcgcttgacaccgcactcagaagggcgcgcagcgccccagcggcagccatcgccgctcgggtggccggacaaacccgcaatatcactgtggacccgaggttgtttaagaagcgccgcctgagatcgccgcgcgttctgttcagcactcaacccccacgggaggcggcagacacccaagacctcgatttcgaagttggaggcgcggcgccattcaaccgaacccatcggtcgaagcggtcctcctcccaccccattttccatcgcggcgagttttcagtgtgtgatagcgtgagcgtgtgggtgggcgacaagaccaccgccaccgacatcaaaggtaaagaggtgatggtgctgggggaagtgaacattaacaactcggttttcaagcagtacttctttgaaacgaagtgccgcgacccaaacccagtggattcgggttgccggggcattgattcgaaacactggaactcctactgtaccactacccatacctttgtgaaggccctgactatggatggcaaacaagctgcgtggcgcttcatccgcatcgacaccgcgtgcgtgtgcgtcctgagcagaaaggctgtgcgcagggca

SEQ ID NO: 17382 - DNA, 723 bp, Artificial Sequence
  Description of Artificial Sequence: Synthetic coding sequence
atgtcgatgctgttttatacattgatcacagcatttctcattggcatacaagccgagccccactctgagagcaacgtccccgccgggcacaccatcccccaggcccactggaccaaacttcaacacagcctggatactgcactgagacgggcccggagcgcacctgctgcagctattgcggctcgcgttgcggggcagacccggaatattacggtggatccacgactgtttaagaagagacgcctgcgctccccacgggtgctgttcagcacccagcccccacgggaggcagccgatacccaggaccttgactttgaggtcggaggcgcagccccattcaatcggacccatagatctaaaaggagtagtagtcacccgatttttcacaggggagagtttagcgtgtgtgatagtgtaagcgtctgggtgggagataaaacaacagccacagacattaagggaaaggaggtcatggtgcttggggaagtgaacatcaacaactccgtcttcaaacagtacttttttgagactaaatgtagagaccccaacccagtagattccggatgtcgcggcattgacagtaaacactggaatagttattgcacaactacacatacattcgtcaaggctctgacaatggatgggaaacaggctgcatggagatttattcggattgacacagcctgtgtgtgtgtgttgagtagaaaagcagtaagacgggct

SEQ ID NO: 17383 - DNA, 1911 bp, Artificial Sequence
  Description of Artificial Sequence: Synthetic coding sequence
atgtccgaacgcaaagaaggtagaggtaaagggaaaggcaaaaagaaggagcgcggatccggaaagaagcctgaatccgctgcgggaagccagtcaccagcactgcccccaagactcaaggagatgaagtcccaggaatcggcagccggaagcaagctcgtcctgcggtgcgagacttcaagcgaatactcgtccctgcgttttaagtggttcaaaaatggaaatgagctgaacagaaagaataagcctcagaacattaagatacaaaagaagcctggtaagtccgaacttcgaatcaacaaggcctctctcgcagactccggagagtacatgtgtaaagtgatctccaagctggggaacgattcagcaagcgcgaacattaccatcgtggaatcgaatgaaatcatcacggggatgcccgcctcgactgaaggcgcatacgtgagctccgaatcacccattagaatttccgtgtcgactgaaggtgcaaacacctcctcctccacgtccaccagcactaccggaacttcgcacctggtgaaatgcgcggagaaggaaaagaccttttgcgtgaacggcggggaatgttttatggtcaaggatctttcgaatcccagcaggtacctgtgcaagtgtcccaacgaattcactggggataggtgtcagaattacgtgatggcctcgttttacaaggcagaggaactgtaccaaaagagagtgcttaccatcaccggaatatgtatcgcacttttggtggtcggcataatgtgcgtggtggcgtactgtaagactaagaagcagcgaaagaagctccacgacagactccgccagtcccttaggtcagaacgcaacaacatgatgaacattgcaaacggtccacatcatccaaacccgccacctgaaaacgtccaacttgtgaaccagtacgtctccaaaaacgttatttcatcagaacatatcgtggagcgagaagctgaaacttccttttcaacctcgcattacacctcgaccgcacatcattccaccaccgtgactcagaccccctcgcattcgtggtcgaacggtcatactgaatccattctgtcggaatcccactcggtgattgtgatgtccagcgtggaaaactcacgccactcctcccctactggaggccctagaggacgcctgaacggtactggagggcctagggaatgtaattcctttcttagacatgctcgcgagactccagattcctaccgagattccccacattcagagcgttacgtgtcggcaatgaccacgccagcccgtatgtcgcccgtggattttcatactcctagctcacccaaatcacctccatctgaaatgagccctccagtgtcgtcgatgaccgtctccatgccatcaatggcggtgtcgccattcatggaggaagagcgaccacttcttttggtgacccctcccagacttcgtgaaaagaagttcgatcatcatcctcagcaattttcgagctttcatcataaccctgcccacgattcgaactcactccccgcgtcgcctcttagaatcgtggaggatgaagaatacgagactacgcaggaatacgagcccgcacaagagcctgtgaaaaagctggcaaattcccgtcgggcaaagcgtaccaagccaaacggccatattgccaacagactggaagttgattcgaacacttcttctcagagctccaattccgaatccgaaaccgaagatgaacgtgtgggtgaggacacgcccttccttggaattcaaaaccctttggcagcatcgctggaagcaactccagcattcagactggcagatagcaggaccaatccagctggtcgattctcgactcaagaagagattcaagcaaggcttagcagcgtgattgcaaatcaagatcctattgcggtg

SEQ ID NO: 17384 - DNA, 1911 bp, Artificial Sequence
  Description of Artificial Sequence: Synthetic coding sequence
atgtcggaacgtaaagaaggtagaggcaaaggtaagggtaaaaagaaagaacgtgggagtggtaagaaacccgaatctgctgcagggtcgcagtcccccgcactcccaccccggctgaaagagatgaagtcccaggaaagcgcggcaggatctaagctggtgctacgctgtgagacgtcctccgaatattcttctcttcggtttaaatggttcaaaaacggtaacgagctgaaccgtaagaacaagccacaaaacataaagatccaaaagaagccgggcaagtctgaactgcgcattaacaaggcctcgctggccgattctggagagtatatgtgtaaagtgatatctaagctgggcaacgactccgcttcagccaacatcacaatcgttgaaagcaacgagattattaccggaatgccagcttctaccgaaggcgcctacgtgtcctcagaaagccccatacgaatctcggtgagtaccgagggggctaatacttctagttctacctctactagtacaaccggaacgagccaccttgtcaagtgcgcagagaaagagaagaccttttgtgtgaacggtggtgaatgttttatggttaaagatctgtcgaatccaagtaggtatctgtgtaaatgcccaaatgaatttacaggagatcggtgtcagaactacgtcatggcctctttctataaggccgaggagctctatcagaagcgggtgctcaccatcactggaatttgcatcgctctcctggtggtcgggattatgtgcgtagtggcatactgtaaaaccaaaaagcagcgcaagaaactgcatgaccgactgcgccagagtctgcgctccgagagaaataacatgatgaatattgccaatggcccacatcatcctaatcctccaccggaaaacgtccagctggttaaccaatatgtcagcaagaacgtcatcagttcagagcatattgttgagcgcgaggcggagacgtcttttagcacatcccactacacaagcactgcacaccactccaccacagttacccaaacccctagtcactcatggtctaatggccacacagagagtattctgagtgagtcacactccgtgatcgtaatgagcagcgtggaaaattcacggcattcatctcccactggaggtcccaggggccgccttaatggcaccggcggtcctcgcgaatgcaattcatttctgcggcacgcccgcgaaacacccgacagttatcgggactcgccacatagtgaacggtatgtgtcggccatgacaacaccagctagaatgagtcctgtggattttcatacgcccagctctcctaagtccccacctagcgagatgagccctccagtttcatcaatgactgtgagtatgcccagcatggctgttagcccattcatggaagaagagcgaccactgctgctggtaactccaccgcgcctgcgcgaaaaaaaattcgaccatcaccctcaacagttctcctcgtttcatcataatcctgcccatgattccaattcgttacccgcaagccccttaagaatcgtggaggatgaggaatacgaaaccacccaggagtacgagccggctcaggaaccagttaagaagctagcaaatagtcgacgcgctaagagaaccaagcccaatggccatattgccaataggctggaggtagacagcaacacctcctctcagtcaagtaactctgagtccgagaccgaagatgagcgggttggggaggatacaccattcctgggtatacaaaacccgcttgcggcatcgctggaagcgacacctgcctttaggctagccgacagcagaaccaaccccgctggccgattctccactcaagaagagatccaggcgcgtctcagctcggtcattgcgaatcaggaccccattgccgtg

SEQ ID NO: 17385 - DNA, 1911 bp, Artificial Sequence
  Description of Artificial Sequence: Synthetic coding sequence
atgtcagagaggaaggaggggcgcggtaaaggaaagggtaagaagaaagagcgaggcagtgggaagaagccagagagtgccgctgggtcgcagtctcccgctctgcctccccgattgaaggaaatgaaatcgcaagagagcgctgcgggctccaagctggtcctccggtgcgagacctcaagtgaatattcctcactgcggttcaagtggttcaagaacggaaatgagcttaacaggaagaataagccccagaatatcaagatccagaaaaaacccggcaagagcgagctccgaatcaacaaggcctctctcgctgactcaggtgaatacatgtgcaaagtgatctctaagctcgggaacgacagtgcgtctgccaatataaccattgtggagtccaacgagatcatcactggcatgcctgcttctaccgagggggcctatgtgagcagtgagtctccaatacggatttcagtatcaaccgagggagccaacacttcctcatcaacgtcaacttccacaactggtacgagccacctcgtgaaatgtgccgagaaggaaaagaccttttgcgtcaatggtggcgaatgtttcatggttaaggacctgtccaacccctcacgctatctttgcaaatgccccaacgagttcacgggggataggtgccaaaactacgtgatggcttctttctacaaggccgaggagttgtatcagaagcgggtgttgaccatcacaggcatatgtatcgcactgcttgtcgtgggaattatgtgcgtcgtggcctactgcaagactaagaagcagcgcaaaaaactccacgaccgtctacgccagtctcttcggtctgaaaggaataatatgatgaacatcgcaaatgggcctcaccaccctaaccccccccctgagaatgtccagctggttaaccagtacgtgagcaagaacgtgatcagcagcgagcatattgtagagagggaggccgagacaagcttcagcaccagtcattacacatctactgcccaccacagtacaacagtgacacagacaccaagccactcttggtcaaatggacatacagaatcaatcctgagcgagtcacattcggtgatagttatgtcttccgtcgagaattctagacactccagtcccactgggggcccacgcgggcgattgaacggaactggcggtcctagagagtgtaatagcttcctgagacacgcacgtgagacccccgacagctaccgcgactccccgcattcagaaaggtatgtaagcgccatgacgactcccgcacgtatgagtccggtcgacttccatacgccaagttctcccaagtcacctccctccgaaatgagtccacctgtttcatcgatgacagtttctatgccttcgatggccgtgtcaccttttatggaagaggaacggccactgctcctcgtcacccctcctcgtctgcgcgaaaaaaaatttgaccaccacccccagcaatttagcagctttcatcacaaccccgctcacgattccaactccctgcccgccagcccgttgcgtatcgtagaggatgaggaatatgaaacgacacaggaatacgagcctgcgcaggagcccgtgaagaagttggctaattctcggagagccaaaagaaccaagccaaacgggcatatcgctaaccggctggaggtggattccaatacatcctcacagtcctctaacagcgaaagcgagacagaggatgaacgggtgggagaggatacacccttcttgggcatccagaacccattagcggcctccttagaggcaacccccgccttcagactggcagattcccggacaaacccagcagggcgcttctcaacgcaggaagaaatccaggcacgcttaagttcagtcattgccaaccaagacccgattgcagtg

SEQ ID NO: 17386 - DNA, 1911 bp, Artificial Sequence
  Description of Artificial Sequence: Synthetic coding sequence
atgagtgagcgcaaggagggcagaggcaaggggaaaggcaagaaaaaggaacgggggtccgggaaaaaacctgaaagcgctgcgggtagccagagccctgcattgcccccaagacttaaggagatgaaatctcaggagagtgcagccggtagcaaactcgtcttacgctgtgagacatctagtgaatattcaagcctgcgtttcaaatggtttaaaaacgggaacgagctgaaccgaaaaaataaaccccagaatatcaaaatacagaaaaagccaggcaagtctgagctgcggatcaataaagcttctctggcggactcaggagagtacatgtgtaaagttatatctaagctggggaacgactccgcctccgccaatattactatcgttgaaagtaatgaaattattactggcatgcccgcttctactgaaggtgcatatgtgtctagtgaatcacccatccgcatcagcgtcagtacagaaggcgccaacacaagcagtagcacgtcaacttcgaccaccgggaccagccatttagttaagtgcgcggagaaggaaaagacgttctgtgttaacggcggggaatgttttatggtgaaggacctctcaaatcccagcaggtatctgtgcaagtgtcccaatgaatttactggggatagatgccaaaactacgtcatggccagcttctataaggcagaagagctgtatcagaaacgagtgctgaccattacaggtatatgcattgccctgctggtcgtgggaatcatgtgcgttgtcgcatactgcaaaaccaagaagcaaaggaaaaagttacacgatagacttagacaatctttaaggagcgaaaggaacaacatgatgaatatagccaatggtccccatcatcccaatcccccacccgaaaacgtccaattggttaaccagtacgtatctaagaatgtgatctcttccgaacacattgtagagagggaagccgagacctcatttagtacctcccactatacgagtaccgctcaccatagtacaacggtgacacagacaccatcacattcttggtcgaacggtcacaccgagtctattctgtccgaatctcactccgtcattgtgatgtcatcagtcgagaattctagacacagcagcccaactggaggtccccgggggagactcaatggaacagggggtcctcgggagtgtaattcttttctccggcacgctcgtgaaactcccgactcctatagggattcgccacattcggaacgttatgtatctgcaatgacaactcccgccaggatgagtcccgtggattttcacacgccatccagcccgaagagcccaccctccgaaatgagcccccccgtgagctcaatgacggtctctatgccaagtatggcagtgtcccccttcatggaggaggagcggcccttgttgttggtcaccccccctcggctgagagaaaagaaattcgatcaccacccccaacaattctccagtttccatcataatcctgctcacgactccaacagtttacctgcctcgcccctccgcattgtcgaagacgaggagtacgaaacaacccaagagtatgaacctgcccaagagcctgttaagaaactggccaatagtcggcgggccaaaagaacgaaacctaacggccatattgcaaatcgtctggaggtcgattcaaacacatcctcccagtccagtaactctgagtcagaaaccgaggatgagagagttggagaggatacacccttccttggaatccagaatccactggctgccagcctggaagcaactccggcattccggttagcagattcaagaacaaaccccgctggacgatttagcactcaggaggaaatccaggccagactgtccagtgtgatagccaaccaagatccgatcgctgtg

SEQ ID NO: 17387 - DNA, 1911 bp, Artificial Sequence
  Description of Artificial Sequence: Synthetic coding sequence
atgtcagagagaaaagaaggtcgcggcaaaggcaagggtaagaaaaaagaaaggggctctggcaagaaaccagaatctgctgcagggagccaatcaccagctcttccaccacgcctgaaggaaatgaagagccaggagtcggcggctgggtcaaagttggtgcttcggtgtgagacaagttcagaatactcatctctgaggtttaagtggtttaagaatggcaatgagctcaaccggaagaataaacctcaaaatattaaaatccaaaaaaagccgggtaaatcggaactgaggatcaataaggcctctctcgcggattcgggcgaatacatgtgcaaggtgatttcaaaacttggaaacgactccgccagcgcaaacattacaatcgtcgagagcaatgagatcataactggtatgccagccagcactgagggggcctacgtttcctccgaatcacctattcgaatttccgtgtcaactgagggggcaaatacttccagctcaactagtacatcaactactgggacatcacacctcgtgaagtgtgccgagaaggaaaagacgttctgcgtcaacgggggggagtgcttcatggtcaaggacctgtccaatcctagcagatatctctgcaaatgtcccaatgaatttaccggagatcgttgccagaactatgtcatggcctccttctacaaagcggaggaactttaccagaagcgcgtcctgaccattactggtatttgtattgcactccttgtagtgggcatcatgtgtgtcgtggcctactgtaagaccaagaaacagaggaaaaaattacacgataggctgaggcagtccctgagaagtgaaaggaacaatatgatgaatattgccaacggtcctcatcatcccaacccaccacccgagaacgtacagcttgtgaatcagtacgtgagtaagaatgtgatctcttcagagcacatagtcgagcgcgaggccgaaaccagtttctccactagccactacacctctactgctcaccacagtactaccgtgacacaaacaccttcccatagttggtctaacggccataccgaatctatcctgtccgaaagtcacagcgtgattgtgatgagcagcgtagagaacagccggcattccagccctaccggagggcctagaggtcggctgaacggcacgggcggtccacgggaatgcaacagtttcctccggcacgctagagaaacccctgactcctatagggacagccctcatagtgaaagatatgtgtctgctatgacgacaccagcaaggatgtctcctgtggattttcacaccccaagttcaccaaaaagcccgccatccgaaatgtcacccccggtgagttccatgaccgtctcaatgccatctatggcagtatcaccttttatggaggaagagcggcctctgctgttagttacgccaccacgcctgcgcgagaaaaaatttgaccaccaccctcaacagttctcctccttccatcacaatcctgctcatgactcgaactccctgccagcctctcccctgcggatcgtggaggacgaagagtatgagactacccaagagtacgagcctgcccaggaacctgtcaaaaaacttgccaatagtaggagagctaaacgcacaaaacccaatggacacatcgcgaaccgactcgaggtggacagtaacacatcttctcagagcagcaattctgagtctgaaacggaagatgagagagtgggcgaagatacaccctttttggggattcagaatcctttggccgcaagtctcgaggccacgcccgcattccggttagccgactctagaaccaatcctgctggaagattcagcacccaggaggaaattcaggctcggttgtcatccgtgatcgcaaatcaggatccaatagccgta

SEQ ID NO: 17388 - DNA, 1911 bp, Artificial Sequence
  Description of Artificial Sequence: Synthetic coding sequence
atgtccgaacggaaagaaggccgaggcaaagggaaaggaaaaaagaaggagcgtggttcaggtaagaagcctgaatcagcagcgggctcccagagccccgcactgcctccacggctgaaggagatgaaaagtcaggagtccgcagccggctccaagctagtcctgcggtgcgaaacatcctctgaatacagctccttgcgattcaaatggtttaagaacgggaacgagctgaacagaaaaaacaaacctcagaatattaaaattcagaagaaacctgggaaatccgagctgcggattaataaagcttcactagccgatagcggcgaatacatgtgtaaggtgatctctaaactgggaaacgactcagcatcggcaaatatcaccatcgtggagagcaacgagatcatcactggaatgcccgcgagtaccgagggggcatacgtcagttctgaaagcccgatccgcatttcagtgtcaaccgaaggggctaacaccagttcctcaacctccacctctacaaccggcacttctcacctggtcaagtgcgcagaaaaagagaagactttttgcgtaaatggcggagagtgtttcatggtcaaagacttaagtaatccctctagatatctttgtaaatgtccaaatgaatttacaggcgataggtgccagaactacgttatggcctccttctataaggcggaagaactgtatcagaaaagggttctcactatcacgggcatctgtatcgctctgttggtggtgggcatcatgtgcgtcgtcgcctactgtaagacaaaaaagcagagaaaaaaacttcatgataggctaaggcaatcgctgcgttctgagcgaaacaacatgatgaacatcgccaacgggcctcatcatcccaatccaccgcccgagaacgtgcaactggtcaaccaatacgtctctaagaacgtaatctcttccgaacacattgttgagcgtgaggcggaaacttcatttagcaccagccactatacaagcactgcccaccatagtacgacggtcacacagacacccagtcattcttggagtaatggacacaccgaatccatcctgtccgaatcccatagtgtgatagtgatgtctagtgtggagaatagtagacactcgtctcctacgggtggtccccgcggccgcttgaatgggaccggtggacctcgggaatgcaacagctttcttagacacgcgcgggaaacccccgacagctatcgcgactctccccatagtgaacggtacgttagcgccatgacaacccctgcccggatgtccccagtggattttcataccccttccagcccgaagagcccaccctcagagatgagtccacccgtatcttcaatgacagtgtctatgccatccatggccgtatctcccttcatggaagaagagagacccctcctgctcgtgacaccaccccgactccgagagaagaagtttgatcaccatcctcaacagttttcaagttttcaccacaatccggcacacgactctaatagcctgccagccagtcccctacgcattgtggaggatgaagagtatgaaacaacacaggagtacgaacccgcacaggaacccgtgaagaaacttgccaactcccgtagggctaagcggacaaaaccgaacggacatatcgccaataggcttgaggtcgatagtaacacttctagccagtcatccaattcagagagcgaaaccgaagatgagagggtcggagaggacaccccctttcttggcatccagaaccctctcgccgcctctctggaagccacacccgctttcaggctggcagactcaagaactaatccagcagggaggttcagtacacaggaggagatccaggctaggctgtcatccgtcatcgctaaccaggatccgatcgccgtc

SEQ ID NO: 17389 - DNA, 1911 bp, Artificial Sequence
  Description of Artificial Sequence: Synthetic coding sequence
atgagcgagcgcaaggaaggaagaggcaaaggcaaaggaaagaaaaaggaaagggggagcggaaagaaaccagagagcgccgccggatctcaatcaccagctctaccgcctagactgaaggagatgaagtctcaggaatccgcagccggcagcaagcttgttttgcggtgcgaaacatcaagcgagtattcgagtctccgtttcaaatggttcaaaaatgggaatgaactgaataggaagaacaagccacaaaacataaagatccaaaaaaagccgggaaaaagcgagctgcgcatcaacaaagctagtttagctgactccggcgaatacatgtgcaaggtgattagcaagctcggaaatgactctgcctcggccaacataacaattgtggagtctaatgagattattaccggcatgccagcaagtaccgaaggcgcttatgtgtcttccgagtcccctatccggatctccgtcagcacagaaggagcaaacactagtagcagtacttcaacttctacaactggcacctcccatctcgtaaagtgtgccgagaaagagaaaactttttgcgtaaacgggggtgagtgcttcatggtaaaggatctcagtaatccttcgcgttatttgtgcaaatgccctaatgagttcaccggggatcggtgccagaactacgttatggcatcgttctataaagccgaggagctctaccagaagagagtactcaccattacaggaatatgtattgcactgctcgtagtcggcatcatgtgtgttgtagcttactgtaaaacgaagaagcagagaaagaagctgcatgacaggctcaggcagtctctgaggagcgaacgaaacaatatgatgaatattgcaaacggacctcatcatccaaatccccctcccgagaatgtccagctcgtgaaccagtatgtgtcaaaaaatgtgatttccagtgaacatatcgtggagagagaggccgagacctcctttagcacctcccactacacctcaactgctcatcattcaaccacagtgacacagacacccagtcattcatggagtaatggacacactgagtctatactgagtgagtcccactctgtgatagtcatgagctctgtggaaaacagtcggcattcgtcaccaacaggaggcccccggggccgcctcaatgggaccggtggccctcgcgagtgcaattcatttcttcgtcacgctagggagactcccgacagctaccgggattcaccgcactcagagcgttacgtgagcgcgatgaccacccccgcccggatgtctcccgttgactttcatactccttcttcaccaaaaagccccccttctgagatgagccccccagtgagttccatgacagtcagcatgccaagcatggcagtaagtccctttatggaggaggagcggcccctccttttagttaccccccctcgcttgagggaaaagaagttcgaccaccatcctcagcagtttagctccttccaccacaacccagcccacgattccaactctctaccagcgtccccactgcgcatcgtggaagacgaggaatatgagaccacccaggaatacgagcccgcccaggagcccgttaaaaagctcgctaattctagacgagccaaacggacgaaacccaacgggcatatcgcaaaccgtctggaggtcgactccaacacttcctcccagagttcaaattccgaatccgagaccgaagatgagagagtcggggaggacaccccatttttaggaatccaaaaccctctggctgcgtctttggaggccacccctgcattccgtttagccgacagtcggacaaatccagccgggcgattctccacccaggaggagatccaggcccggttgagttcagtcatagccaaccaagacccgatcgccgtg

SEQ ID NO: 17390 - DNA, 1911 bp, Artificial Sequence
  Description of Artificial Sequence: Synthetic coding sequence
atgtcggaacgtaaggagggccgcggcaagggcaagggaaagaaaaaggaaagagggagcggaaagaaaccagagtccgcagcaggtagccaaagccccgccctaccgccccgtctgaaagagatgaagagtcaggagtctgcggccggatcgaagctagtcctgagatgtgagacgtctagtgagtatagctcgctccgctttaagtggttcaagaacgggaacgaactgaaccgcaagaacaagcctcagaatattaagatacaaaagaagcctggaaagagtgagctgcgcatcaataaggccagtttggctgattccggagaatacatgtgcaaggtgattagcaagctgggaaacgattcagccagcgccaatatcacgatcgttgaatcgaacgaaattattacgggaatgcccgcatccacggagggagcctacgtgagctcggagagcccgattcggatctccgtgagtactgagggtgctaacacgagctcctcaaccagcactagcacaacaggaacgtcgcacttagtgaagtgtgcggagaaggagaagacgttctgcgtgaacggaggagaatgttttatggtcaaggacctgagtaaccccagtcgctatctgtgcaaatgcccgaacgaattcaccggtgaccgctgtcagaattatgtcatggcatcgttctataaggccgaggagctgtatcagaagcgtgtgcttacaatcaccggcatctgcatagcgttgctggtcgtcggtatcatgtgcgtggttgcatattgcaagacaaagaaacaacgcaaaaagctacacgacagactacggcaatccttaagaagcgaacgaaacaatatgatgaatatcgcaaatggtccccatcatcccaatccccctccagagaatgtccagctggttaatcagtacgtgtcaaagaatgtcatctcgtccgagcacatcgtcgagcgggaggcagagaccagcttctccaccagtcactacacaagtacggcccaccactcgacgacggttacgcagacgccctctcacagttggagcaacggtcatacggaatcaatcctgtcagagtcccatagtgtgatagtcatgagcagtgtggaaaactcgaggcactccagtccgacaggcggaccacggggcagacttaacggcaccggtggaccacgcgaatgcaattctttcctgcgtcatgcgcgtgagacccccgactcgtaccgcgatagcccgcattcggagcgatatgtgagcgcgatgacaacgcccgcgcgcatgtccccggtcgactttcacacaccaagcagccctaaatcccctcctagcgagatgagcccgcccgtgagcagcatgacggtgtcgatgccatccatggccgtctcgcccttcatggaggaggaacgaccactgctgttagtaacgcccccacgtttgcgtgagaagaagtttgaccatcatccacagcagttcagctcattccaccacaatcccgcccacgattcgaacagcctgccggctagcccccttcgcattgtcgaagatgaagaatacgaaaccacgcaggagtacgaaccagcccaggaaccagtgaaaaaattggccaactcccggcgggccaagcggacgaaaccgaatggacacatcgccaaccggctggaggtcgatagtaatacatcttcccagtctagcaactctgaaagcgaaacggaagacgaaagagtgggagaggatacgccatttctgggcattcagaatccgttggcagccagcctagaggcaacgcccgccttccgcctggccgatagccgcacaaacccggcgggtcgcttctccactcaagaagagatacaggcgagactgtccagtgtgatcgccaatcaagatccaattgccgtc

SEQ ID NO: 17391 - DNA, 1911 bp, Artificial Sequence
  Description of Artificial Sequence: Synthetic coding sequence
atgtccgagagaaaagaaggacggggtaaaggaaagggaaaaaagaaagagcgcggatccggcaaaaagccagagtcggcggcgggatcacagtcaccggccctccctccacgcctgaaggagatgaagtcccaagagtctgccgccggctcgaagctggtcctccggtgcgagacttcatccgaatactcatccctgcggttcaaatggttcaaaaacggtaacgagctgaatagaaagaataagcctcaaaacatcaagatccagaagaagccgggaaagtcagagctgcgaatcaacaaggcgtcattggccgacagcggggagtacatgtgcaaagtgatctcaaagctgggaaacgactccgcatcggcaaacattaccatcgtcgaatcaaatgaaatcattactggcatgccggcctcgactgagggagcctacgtctcctccgagtcgccaatccgcatctcagtgagcaccgagggagctaatacttcctcgtccaccagcacgtcaaccactggaaccagccatctggtgaaatgtgctgagaaggaaaagaccttctgtgtgaacggaggagaatgcttcatggtgaaggatctgtcaaatccatccagatatttgtgtaagtgtccgaacgagttcactggagatagatgccagaattacgtgatggcatccttctacaaggctgaagagttgtaccagaaacgagtgttgacgatcaccggcatctgcatcgcactgctggtggtgggaatcatgtgcgtggtggcctactgtaagacgaagaagcagcggaaaaagttgcacgatagacttcgccagtcgcttaggagcgagaggaataacatgatgaatattgcgaacggccctcatcaccctaacccaccacccgaaaatgtgcagctggtgaaccaatacgtttcaaagaatgtgatctccagcgagcacatcgtggagcgggaagctgaaacttccttttcaacctcccattacacctccactgcccaccactcgactaccgtcacccaaaccccgagccattcctggtcgaacggtcataccgagtcaatcctgtctgaatcacacagcgtcatcgtgatgtcgtctgtcgagaattcgaggcactcctcaccgaccggcggaccgcgcggacgcctgaatggaactggtggaccacgcgaatgcaactcgttcctccggcacgcacgggagacgccggattcctacagagactcgccgcacagcgaacgctacgtctccgcaatgactacccccgcccggatgtcgccagtcgacttccacaccccgtcgtcgcctaagtccccgccgagcgaaatgagcccgccggtgtcgtcaatgactgtgtcaatgccgtccatggctgtgtcccccttcatggaagaggaacgccctctgctgctcgttactccaccgaggctcagagagaaaaagtttgaccaccaccctcaacagttctcatcattccatcataacccggctcacgattcaaattcgctcccggcgtcccctctgaggattgtggaggacgaagagtacgaaaccactcaggaatacgaaccagctcaggaacctgtgaaaaagttggcaaacagccgccgcgccaagagaaccaagccgaacgggcacattgcgaaccggctggaggtggactctaacacctcatcgcaatcatccaattccgaatccgaaaccgaggacgaaagggtgggagaagataccccgttccttggtattcaaaatccgctggccgcaagcctggaagcgacgccagcgttccggttggcggactcgcggactaacccggcgggacggtttagcactcaggaggaaattcaggcccggctttcgagcgtgatcgcaaaccaggatcccatcgctgtc

SEQ ID NO: 17392 - DNA, 1911 bp, Artificial Sequence
  Description of Artificial Sequence: Synthetic coding sequence
atgtcagaaagaaaagaaggtcgaggtaaaggaaaaggtaaaaaaaaagaaagaggttctggaaaaaaaccagaatcagcagctggatcacaatcaccagcacttccaccacgtcttaaagaaatgaaaagtcaagaatcagctgcaggttcaaaacttgttttaagatgtgaaacttcatcagaatattcatctttaagattcaagtggtttaaaaatggaaatgaattaaatagaaaaaataaacctcaaaatattaaaattcaaaaaaaacctggaaaaagtgagttaagaattaataaggctagtttagctgatagtggagaatatatgtgtaaagttatatcaaaattgggtaatgatagtgcttctgcaaatataacaattgttgaatcaaatgaaattattacaggaatgcctgcaagtactgaaggtgcttatgtttcttcagaatcaccaattagaatttctgtaagtacagaaggtgctaatacaagctcatcaacttctacatcaactactggaacaagtcatcttgttaaatgtgctgaaaaagaaaagactttttgtgtaaatggaggagaatgctttatggttaaggacttatctaatccttctaggtatttatgtaaatgtccaaatgaatttactggagatcgttgtcaaaattatgttatggcttcattttataaagccgaagagctttatcaaaaaagagttttaactataacagggatttgtattgctcttttagtggttggtattatgtgtgttgttgcatattgcaaaacaaaaaaacaaagaaagaaacttcatgaccgattgagacaatctttaagatcagaaagaaataacatgatgaatattgctaatggacctcaccatccaaatccaccaccagagaatgttcaattagtgaatcaatatgtttctaaaaatgtcatatctagtgaacatattgttgaaagagaagcagaaactagtttttctacatcacattatactagtacagcacatcattcaacaacagttacacaaactccatcacattcatggtcaaatggacatacagaatcaatcttgtctgaatcacatagtgttattgttatgtcatctgttgaaaattcaaggcattcatctcctacaggaggaccaagaggaagattaaatggaactggaggacctagagaatgtaattcattccttagacatgctagagaaactccagattcatatagagattcaccacacagtgaaagatatgtttcagcaatgacaacaccagcaagaatgagtccagtagattttcacacaccatcatcaccaaagtcaccaccatctgaaatgtcaccacctgtttctagtatgactgtttcaatgccaagtatggcagtttcaccttttatggaagaagaaagacctttacttttagttacaccaccaagattaagagaaaaaaaattcgatcatcatccacaacaattcagttcatttcaccataatccagcacatgattctaattctttacctgcttcaccattaagaattgtcgaagatgaagaatatgaaactacccaagaatatgaaccagctcaagaacctgttaaaaaacttgctaattcaagaagagcaaaaagaacgaaacctaacggacatatagcaaatcgattggaagttgactctaatacatcctcgcaatctagcaactcagaaagtgaaacagaagatgagagagtaggagaagacactccatttcttggaattcaaaatccacttgctgcaagtttagaagctacaccagcattcagattagctgatagtagaactaatccagcaggacgtttttcaacgcaagaagaaattcaagctagactttcttcagtaattgccaatcaagatccaattgcagtg

SEQ ID NO: 17393 - DNA, 1911 bp, Artificial Sequence
  Description of Artificial Sequence: Synthetic coding sequence
atgtctgagaggaaagaggggcgcggcaagggcaagggcaagaagaaggagcgcggatccggaaaaaaacccgaaagtgccgcaggctcccagagccccgccctgccgcctaggctgaaggaaatgaaaagccaggaatctgccgccggttccaagctggtgctccgatgcgagacatcctcagagtacagctccttgcggtttaagtggttcaagaatggtaacgagcttaatcgcaagaataaaccacaaaacatcaaaattcaaaagaagccaggcaagtcagagctgaggattaataaggctagcttggccgacagtggcgaatacatgtgcaaggtcatatcaaaactggggaacgattctgcgtccgccaatattactattgtggagtccaatgagatcataacaggaatgcccgcaagcacagagggtgcttatgtgtctagcgagtcccctatcaggatcagtgtgagtacagagggggcaaatacaagttctagcactagcacgtccacaaccggcactagtcatttggtgaagtgcgcagagaaggagaagacattttgcgttaacggaggagaatgcttcatggtgaaagatcttagtaatcccagccgatatctctgtaagtgtccaaacgagttcacgggagacagatgccagaactacgtgatggcgtccttttacaaggcggaagagctctaccaaaagagagtgctcactattacaggcatctgtattgcactccttgttgtaggcatcatgtgtgtggttgcgtactgtaagacgaaaaagcagagaaagaaactgcatgaccgactgaggcagagtttgagatctgaaaggaataacatgatgaacatcgctaacgggccccatcaccctaatcccccccccgaaaacgtgcagctggtgaaccaatacgtgagtaagaacgtgatttcctctgaacacatcgtcgaaagagaggctgagacatcatttagcacaagccactatacatcaaccgcacatcactccacgacagttacccagactccgtctcactcttggtctaacggacatacagagtccattctttccgaaagccactctgtcattgtgatgagctccgtcgaaaattcacggcattcaagtccaaccggcgggcctcgggggaggttgaacggcactgggggcccccgggagtgtaattcattcctgcggcacgccagagaaactcccgattcatacagggattctcctcactccgaacgctatgtcagcgccatgaccacccctgctcggatgtcccccgtcgacttccacacccccagcagccccaaatccccaccaagtgagatgtctccaccagtgagctctatgacagtgtcaatgccctctatggccgtgtctcctttcatggaggaggaacggcccctgctcctggtgacgccaccccgcttgcgagagaagaagttcgaccaccaccctcagcagttttcttcatttcatcacaaccccgcacatgactccaatagcttgcctgccagtcccctgagaatcgtcgaggacgaagaatatgagactacgcaggagtacgaaccggcccaggaacccgtgaagaagcttgctaattccagaagggctaaacgcaccaagccgaatggtcacatcgctaatcgcctcgaggtcgattctaatacatcatctcagagctctaattctgagtcagagaccgaggatgagagggttggcgaagatactccgttcctgggaatccaaaaccccctggcagcgagtctcgaagctacaccagcgtttcgcctcgctgactcccggaccaacccagctggtcgcttttccacccaagaagaaattcaagcaaggctgtcctccgttatcgccaatcaagatccgatcgcagtg

SEQ ID NO: 17394 - DNA, 1911 bp, Artificial Sequence
  Description of Artificial Sequence: Synthetic coding sequence
atgagcgaacgcaaagagggacggggaaagggaaaaggcaagaagaaggaaagggggtcgggaaagaagccggaatcggcggcggggagccaatcaccagcactcccaccgcggcttaaagagatgaaatcgcaggaaagcgctgctggatcgaaactggtgcttaggtgcgagacttcttcggaatattcgtccttgcgcttcaagtggttcaagaatggcaacgagctgaaccgcaagaataagccacaaaacatcaaaattcagaagaagcccggtaaatctgagttgagaatcaacaaagcctcgctggcggactccggcgaatacatgtgcaaggtgatctcgaagctggggaatgactcagcctcggccaacatcactatcgtggagtcgaacgagattatcactggaatgccagcatcgaccgagggggcgtatgtctcgtcggaatcccctatcagaatctccgtgagcacggagggtgctaacaccagctcatcgacttccacctcaaccaccggaacttcccatctggtcaagtgcgcagaaaaagaaaagaccttctgcgtcaatggaggagaatgcttcatggttaaggatctgagcaacccgagccgatacctgtgcaagtgtccaaacgaattcaccggagacagatgtcagaactacgtgatggcctcattctacaaggcagaggaactgtaccagaagcgggtgctcaccatcaccggcatctgcatcgcgctcctcgtcgttggtattatgtgtgtggtggcgtactgtaaaaccaagaaacaacggaagaagctgcacgacagacttcgccagtctctgaggtccgaacggaacaatatgatgaatattgctaacggtccacatcaccccaacccgccgccggagaatgtgcaactggtgaaccagtacgtcagcaagaacgttatctcatcagagcacatcgtggaaagagaggccgagactagcttctcgacgtcccactacacctcgactgcacaccattccactactgtcactcagactccaagccattcctggtcgaatggccacactgagtccatcctctcggaaagccactcggtgatcgtgatgtcgtcagtcgagaacagcaggcatagctcaccaacgggaggcccacgcggtcgcctgaatggaaccggagggccgagggagtgcaactcattcctccgtcatgcccgagaaacccctgattcgtaccgcgactctccgcactcggaaagatacgtgtcggcaatgacgaccccggcaagaatgtctccagttgacttccatactcccagctcccctaagtccccgccatctgaaatgtcccctcccgtctcttctatgacggtttctatgccgtctatggctgtgtccccgtttatggaagaagagcgccccttgctgttggtcactccgcctcgcttgcgggaaaagaaatttgaccaccacccgcagcagttctccagctttcatcacaaccccgcgcacgattccaattcgctccctgcctccccgctcagaatcgtcgaggacgaggagtacgaaaccactcaggaatacgagccggcccaagagccagtgaagaagctggccaattcacggcgggccaagaggaccaagccaaacggacatatcgcgaatcgattggaggtggattcaaacacctcgtcccaatcctcgaactccgaatcagaaactgaagatgaacgtgtgggagaggacactccgtttctggggattcagaaccctcttgccgcatcgctggaggccacccccgcgttccggctggccgattcccgcaccaatccggccggacggttctcgacccaggaagaaatccaagcgcgcctgagctcggtcatagcgaatcaagatcctattgcagtg

SEQ ID NO: 17395 - DNA, 1911 bp, Artificial Sequence
  Description of Artificial Sequence: Synthetic coding sequence
atgtccgaacgcaaagaagggcggggaaaagggaaagggaagaagaaagaaagggggtcaggaaaaaagcctgaatcagctgctggatctcagtcaccagccctacctcctcggctcaaagaaatgaagagtcaggaaagtgctgccgggagtaagctcgtgctccgatgtgaaacatcttcagagtattcttccttacggttcaagtggttcaagaatgggaacgagctgaatagaaaaaacaaacctcagaacataaagatccagaaaaaacctggaaaatccgagcttcggatcaataaagcttccctagccgatagtggagaatatatgtgcaaagtcatctcaaaactcgggaatgatagtgcgtccgccaacatcacaatagtggaatctaacgaaataataacaggaatgcccgcctcaacagagggggcctatgtctcctcggagtctcccatcagaataagtgtctctacagaaggagccaatacttcaagttcgacttctacatcaacaacaggaacatcccacctagtaaaatgtgccgaaaaagagaagacattttgtgtgaatgggggggaatgtttcatggtgaaggatttgtctaacccatcccggtatttatgcaagtgccccaacgagttcacaggagataggtgtcaaaattacgtgatggcttcgttctacaaagccgaggaactgtaccagaaacgggtgctgactatcacagggatctgcatagctctattggttgttgggataatgtgtgttgttgcatattgcaaaactaagaagcagaggaaaaaattacacgaccggctgagacagtccctccgctctgaacggaacaacatgatgaacatcgccaacgggccccaccacccaaatcctcccccagaaaatgttcagcttgttaatcagtacgtttcaaagaatgtgatttcttctgaacatatcgttgaaagagaggccgaaactagtttttctacttctcattacactagtactgcccatcattccacaacagtgactcagactccatctcattcttggtctaatggacacactgaatccatattatccgaatcccactcagtcatagtcatgagtagtgtggaaaatagtcgccattcctcacctactggaggaccccggggaagattaaacggaacagggggacccagagaatgcaattcgtttctacggcatgcccgggaaactcctgattcataccgggactcccctcactcagaacggtatgtctctgcaatgacaactccagccaggatgtctcctgtggattttcacacaccttcttcccctaagtcacctccatcggaaatgtctccgcctgtctcttcaatgactgtgtctatgccatctatggctgtgtctccatttatggaggaagaacgtcctctcttattagttactccccctcggctgcgcgagaaaaaattcgatcaccaccctcaacagttctccagtttccatcacaatcctgcgcatgattctaactctctacccgcttctcctctgaggatagtcgaagatgaagagtatgagacaacacaggaatacgaaccagctcaggaacccgtcaaaaaactggccaacagtcgaagagcaaaacgaacaaaacccaacgggcatatcgcaaaccgactcgaagtcgattctaacacatcatcccagtcttctaattctgaatcagaaactgaagatgaacgggtcggggaggatacaccatttttagggatccagaatcccttagccgctagtcttgaggcaactcctgcctttagactggccgattctaggactaaccctgccgggcggttctcaactcaggaagagatacaggcccgtctctcatcagtgatagccaatcaggatcccattgccgtt

SEQ ID NO: 17396 - DNA, 1911 bp, Artificial Sequence
  Description of Artificial Sequence: Synthetic coding sequence
atgtctgaacgcaaggaggggcggggaaagggcaaaggaaagaaaaaggagaggggtagcggaaagaaaccagaatccgccgctggtagccaatcgccggctcttccaccgcgcctgaaggagatgaagagccaggaatcagccgctggatcgaagctggtgctgcggtgcgaaacctcaagcgaatactcatccctccgcttcaagtggttcaagaatggaaacgagctgaacaggaagaacaaaccacagaatatcaagattcagaagaagccaggaaaatcggagctgaggatcaataaggcctcgctggccgactccggagagtacatgtgcaaggtcatcagcaagctcgggaacgactcggcttccgcaaatatcaccatcgtggaatcaaacgaaatcatcaccggaatgcctgccagcaccgaaggagcctacgtgagctcggaaagcccaatccgcattagcgtgtcgactgaaggggctaacactagctcgtccacctccaccagcacgaccgggacctcgcacctcgtcaagtgcgccgaaaaggaaaagactttctgcgtcaacggcggcgaatgtttcatggtcaaggacctctccaacccctcgcgatacttgtgcaaatgtccaaacgagttcaccggagatcggtgccaaaactacgtgatggccagcttctataaggcggaggaactgtaccagaagagagtgctgactatcaccggcatctgcatcgcgctgctggttgtcggaatcatgtgcgtcgtggcatactgcaagactaagaagcagcgcaaaaagctccatgatcggcttagacagtcgctgaggtcagaaagaaataacatgatgaatatcgcgaacggacctcatcacccgaacccaccacccgagaacgtgcagctggtgaaccagtatgtctcgaaaaatgtcatctcctcggagcatattgtggagcgggaggccgagacttcattttcgaccagccattacacttcaactgcccaccactcgactaccgtcacccagactccgtcccatagttggtcgaacggccacacggagtccatcctctccgaatcgcactccgttatcgtgatgtcgtcggtggagaatagccgacactcatcgcccaccggcggaccgaggggacgcctgaacggaaccggaggcccccgcgaatgcaactccttcttgaggcatgctagagaaacccctgatagctaccgggactcgccacattcagagcggtatgtgtcggcgatgaccactccggctcggatgtcaccggttgatttccataccccttcttcccccaagtccccgccgtcggaaatgtcaccccccgtgtcgagcatgaccgtgtcaatgccgtccatggccgtgtccccgttcatggaagaggaaagaccgctgttgctcgtgaccccgcctagactccgcgaaaagaagttcgaccatcatccacagcagtttagcagctttcaccacaacccggcccatgactccaattcgctgcctgccagccctctgcggatcgttgaagatgaagaatacgagacgacccaggagtacgaacctgcgcaagaaccagtcaagaaactggcgaattcacggcgcgcgaagcggactaagcctaatggacacatcgctaacaggctggaggtcgactcgaacacgagcagccagtcgtcgaacagtgagtcggagactgaagatgagcgtgtgggagaggacacccctttcttgggtattcaaaatcctcttgccgccagcctggaggccactccggccttccgtctggcggactcccggaccaacccagcggggagattctcaactcaggaagagatccaggcccgcctctcaagcgtgatcgccaatcaggaccctattgcggtc

SEQ ID NO: 17397 - DNA, 1911 bp, Artificial Sequence
  Description of Artificial Sequence: Synthetic coding sequence
atgtccgaaaggaaggaaggccgaggtaaggggaagggaaaaaagaaggagcgcggtagcgggaagaagcctgagtcggccgcagggagccaatcccccgccctgccgccacgcctgaaggaaatgaagtctcaggaatcagcagcaggatccaagctggtgcttcggtgcgaaacgtctagcgagtactcgtcactgcgctttaagtggttcaagaatggaaatgagctgaacaggaaaaacaaacctcaaaacatcaagatccaaaagaaacctggtaagtccgagcttcggataaacaaggcatcacttgccgactccggagaatacatgtgtaaggtgatatccaagctgggaaacgattcggcatcagccaatatcacgattgtcgagtcaaacgagatcattactggaatgccggcgtccaccgagggtgcatacgtctcctccgaatcacccattaggatttcggtgagcaccgaaggcgcgaatacttcgagcagcacctccacctccactaccggtacctcgcatcttgtgaagtgtgccgagaaggaaaagactttctgtgtgaatggaggcgaatgttttatggtcaaggatctctcaaacccttccagatacctgtgtaaatgtcctaatgaatttaccggtgatcggtgtcagaattacgtgatggcgtccttttacaaggcagaagaactttaccaaaaaagggttcttactatcaccggcatttgtattgcattgctcgtggtcggaatcatgtgcgtcgtggcgtattgtaaaacgaagaaacaacggaaaaaactccatgatagacttcggcaatcgcttcggtccgagcggaataacatgatgaacattgccaatggacctcatcatccgaatcctccacctgaaaatgtccaactcgtgaatcagtacgtctccaaaaacgtgatctcgtcggagcacattgtggagagggaagcagagactagcttttcaacctctcactacacttcaaccgcacatcattcgactaccgtgacgcaaactccttcgcattcatggtccaacggtcataccgaaagcatcctgagtgagtcacattccgtgatagtgatgagcagcgtggagaattcgagacactcctcgccaaccggaggaccccgcggtcgtctgaacggaactggtggtccaagagaatgtaactcctttcttagacacgcaagggaaacccccgatagctacagggattcgcctcactccgaaagatacgtgagcgcgatgaccactccagcaagaatgtcacctgtcgatttccatacgccctcctcaccaaagtcaccaccttcggagatgagcccccctgtgtcctcgatgaccgtctccatgccttcgatggcagtctcgcccttcatggaggaggaaagaccccttcttcttgtgactccacctagacttagagaaaagaagttcgatcatcatccacaacaattttcctctttccaccataaccccgcgcacgattcaaattcccttccagcctcgcccctgagaatcgtggaagatgaggaatatgagactacccaagagtacgagccagcccaagagcctgtgaaaaaactcgcaaactccaggagagccaagcgcactaagcctaacggacatattgcaaatcgtctggaagtggattcgaacacttccagccagtcgtcgaatagcgaatctgagactgaagatgagagggtgggcgaggacaccccgtttctgggaattcagaacccgctcgcagcctcgttggaagcaacgcctgcatttcgcctggccgatagccgaaccaaccctgccggtaggttctccacccaagaagagattcaagccagactttcctccgtgatcgcaaatcaagacccaattgcagtg

SEQ ID NO: 17398 - DNA, 1911 bp, Artificial Sequence
  Description of Artificial Sequence: Synthetic coding sequence
atgagcgaaagaaaagagggccgcggaaaggggaaaggtaagaaaaaggaaagaggcagcggaaaaaaacctgagtccgcagccggaagccagtcaccagccctgccacctaggcttaaggaaatgaagagtcaagaatccgccgctggaagcaaactcgtgctgagatgcgagacatcttcagagtacagctcgctgcgttttaagtggttcaaaaacggcaacgaacttaaccgaaaaaacaagccacagaatataaagattcagaagaagcctggcaagtcagaactgcgcatcaacaaagcttcactggcggactcaggagaatacatgtgcaaagttatcagtaaactgggcaacgacagtgcatcagccaacattactatcgtagagtcaaacgagatcatcacgggcatgccggcttctacggagggggcgtatgtgagcagcgagtctcctatccgaatctcagtgagtaccgaaggcgccaacacaagctccagcaccagcacttcgaccacaggtacaagccatctcgtgaaatgtgctgaaaaggagaagacattctgtgtcaacggaggcgagtgcttcatggtgaaagatctgagtaacccctcacgctacctctgcaagtgtcctaacgaattcacaggtgaccgctgccagaactacgtcatggcttctttctacaaggctgaagagctgtaccagaaacgcgtactgacaatcacaggaatctgtatcgccttactggtggtcggaatcatgtgcgtcgttgcttactgcaaaaccaagaaacagcgtaagaaactccatgatagactgaggcaatctcttaggagcgaacgcaataacatgatgaacatagctaatggcccccaccaccctaatcctccacccgaaaacgtccagctggtgaaccaatatgtctccaagaacgtcatctcaagtgagcacatcgtcgagagggaggcggaaacttccttctccaccagccactacaccagcaccgcacaccactctaccacagtcacacagacgccctcccattcttggtcaaatggacacacagagagcatattaagcgaatcacacagcgtcatcgtgatgagctcagtagagaacagtcgccattccagtcctacaggcggcccccgaggcaggctgaacggcaccggcggccctcgagagtgcaacagctttctgagacacgctcgcgagacaccagactcctatagggactctccacacagcgagagatatgtgtcggctatgaccacaccagcacgaatgtccccagtcgattttcacacacccagctctccaaagtcgcctccttctgagatgagccctcccgtaagcagcatgactgtgtccatgccaagcatggcagtctcaccatttatggaggaggaaaggccacttcttctggtaactcccccaaggctccgtgagaagaaatttgatcatcacccccagcagtttagtagctttcaccataacccagctcatgactcaaacagcttgccggcttctcctctgagaatcgtggaagacgaggaatatgagacaactcaggagtacgagcccgcccaagagcccgttaagaagctggctaatagcaggcgtgcaaaacgaactaagcccaacggccacattgccaacagactcgaggtcgattctaacacaagcagccagagctccaatagcgagtctgagacagaggacgagagagttggcgaagacaccccattcctgggtatccagaacccactcgcagctagtctggaggctactcccgcttttcggctggccgactccaggacaaatccagctgggcgtttcagtacgcaggaggaaattcaggctcgtctttctagtgtcatcgccaatcaagatccaatagccgtg

SEQ ID NO: 17399 - DNA, 1911 bp, Artificial Sequence
  Description of Artificial Sequence: Synthetic coding sequence
atgtccgaacggaaggagggcaggggaaaaggaaagggtaagaagaaggagcggggttccggaaagaaaccggaatcagccgctggttcgcagagcccagcgctgccaccacgcctgaaggaaatgaagtcacaagagtcggccgcaggaagcaagctggtcttgaggtgcgagacttcgtcagaatacagcagcctgcgctttaagtggttcaagaatggcaacgaactgaaccggaagaacaagccccagaacatcaagatccagaagaagcctggaaaatcagaactgcgcatcaacaaggcttccctggcggactccggggagtatatgtgcaaagtcatctccaagttgggaaacgactccgcctcggctaacatcaccatagtggagagcaatgaaatcatcactggaatgccggcgtcaaccgaaggagcctacgtctcctccgaatcacctatccgcattagtgtgagcacggagggagccaatacttcctcgagcacctctactagcaccactggcacctcacacctcgtgaagtgcgcggaaaaagagaaaactttctgcgtcaacggcggggaatgttttatggtgaaagaccttagcaatccgtcgcggtacctgtgcaaatgtcctaatgaattcaccggggaccgatgccagaactacgtcatggcttccttctacaaggctgaagagttgtaccaaaagagggtgctgaccatcaccggaatttgcatcgcgctgcttgtggtgggaatcatgtgcgtcgtggcctactgtaaaactaagaagcagagaaagaaactgcacgaccgcctgcgacagagcctgcggtccgagcgcaacaacatgatgaacattgccaacggaccgcaccatccaaaccctccgccggaaaatgttcagctggtgaaccagtacgtgtccaagaatgtcatctcatcagaacacatcgtggaacgggaggccgagactagcttctcgaccagccattatacctcgactgcacaccactcgaccacggtgactcaaactccctctcactcgtggtcaaacggccacactgagtccatcctttccgaatctcactcagtgatcgtgatgtcgtctgtggagaacagccgccactcctcaccgactggcggaccgcgcggccggctcaatggaaccgggggcccgcgggagtgcaattcgttcctcagacatgcacgggaaactccggactcgtaccgcgattcgccccattccgaaagatacgtgagcgcgatgaccactccagcccggatgtcgccggtcgacttccacaccccatcctcgcctaaatcaccaccgagcgagatgtccccgccggtgtcgtccatgacggtatccatgcctagcatggcggttagcccctttatggaagaagaacgcccactgctcctcgtcaccccgcccagactcagggagaagaaattcgatcaccatccacagcaattttcaagtttccatcataatcctgcacatgactcgaactccctcccagcctcgccgttgaggattgtggaggatgaagagtacgagacgacccaagaatacgagccagcccaggaaccagtcaagaagctcgcaaattcacgccgggccaaaagaaccaagccgaatgggcacattgcaaatagactggaggtggattcgaacacctcgtcgcagagctcaaacagcgaatccgaaacggaggacgagcgtgtgggagaagataccccgtttctgggaatccagaaccccctcgcggcatcgcttgaggcgactcctgccttccgcctggcagattccagaactaaccctgccggtcgcttcagcacccaagaagaaatccaggctagactctcgtccgtgatcgctaaccaagacccgatcgccgtc

SEQ ID NO: 17400 - DNA, 1911 bp, Artificial Sequence
  Description of Artificial Sequence: Synthetic coding sequence
atgtccgagcggaaagagggaaggggaaaggggaagggcaagaagaaggagcgggggtccggcaaaaaacccgaatcggccgcgggatcccagtcccccgcgttgccccctcggctgaaggagatgaagagccaggagagtgctgcgggaagcaagctggtactccgctgcgagacaagttctgaatactctagcttgcgcttcaaatggtttaagaacggaaatgaactgaaccgcaagaataagcctcaaaatattaagatccaaaagaagcctggcaaatctgaactacggataaacaaggcctctcttgctgattctggtgagtatatgtgcaaagtgatctccaaactggggaacgattccgccagtgccaacattaccatcgtggagagcaacgagatcattacaggcatgccggcgagcacagaaggggcttacgttagctcagagagtcctataagaatcagcgtgtccactgaaggcgcgaatacttcttcatcgacttccacgagtacgacggggacttcacaccttgtcaaatgtgcggaaaaggaaaagacattctgtgtaaacggcggagagtgctttatggtcaaagatctgtctaacccatctaggtatctgtgtaagtgccccaatgagtttactggtgataggtgtcagaattatgtgatggcgtcgttctacaaagccgaggagctctaccaaaagagggtgttgaccataactggaatttgcattgctctactggtggtgggcataatgtgtgtagttgcatattgtaagactaaaaagcagaggaaaaaactgcatgatcgcctgcgacaaagcttgcgatcagagcgcaacaatatgatgaacatcgccaacggtccacatcacccaaaccccccacctgaaaacgtccaactggttaatcagtacgtgtccaagaatgtcatctctagtgaacacatcgtggagagagaggctgagactagctttagcacgagtcactatacatctaccgctcatcattcaacgaccgtgactcagacgccatcccacagctggtccaacggccacacagagtctattctgagcgaatcacactcagtgattgtgatgtcctctgtggaaaactcccggcattcttcaccgaccggaggacccaggggacggctgaatgggaccggagggccgcgagagtgtaattctttcctgaggcatgctagggaaacaccagattcctatcgagattctccacactctgaaaggtacgtgtcagcgatgacaacccccgcacgaatgtcccccgtagattttcacactccttcttcaccgaaatccccaccatctgagatgtcaccacctgtgagttcgatgacagtgagcatgccaagtatggctgtgagtccatttatggaggaagaaaggcccctgctgttagtcacaccacctcgactcagggagaagaaatttgatcaccatccacagcagtttagctcatttcaccacaaccccgcacatgactcaaactctctgccagcttccccgttgagaatcgtcgaagatgaagagtacgagaccacccaggagtatgaacccgcccaggagcctgttaagaagctggccaacagtaggcgggctaaaaggactaaacccaacggccacatcgctaaccggttagaggtagattcaaacacatcttcccagtctagcaatagcgaatctgagacagaggacgaacgcgtgggcgaagatacacctttccttggcatccagaaccctctggctgcatccttggaagctacaccagctttcaggctcgccgatagtcgtacaaacccagcaggaaggttttccactcaggaagaaattcaggctcgactttcctcggttatcgccaatcaggacccaatcgcagtc

SEQ ID NO: 17401 - DNA, 1911 bp, Artificial Sequence
  Description of Artificial Sequence: Synthetic coding sequence
atgagcgaaagaaaggagggacgcggcaaaggcaaaggaaagaagaaggaacggggctcaggaaagaaaccagaatcagccgccggatcacaatctcctgcgctgccccccaggcttaaggagatgaagtcccaggagtccgctgccgggtcgaagctcgtgctgaggtgtgaaacttcgtccgagtacagctccctgagattcaagtggtttaagaatggaaacgaacttaaccgtaagaataagccccaaaacatcaaaatccagaagaagcccggaaaatcggaactgcggattaacaaagcctcactggctgacagcggagagtacatgtgcaaggtgatctcaaagctcggcaacgattcagcttcggccaatatcactatcgtcgaatcgaatgagatcatcactggtatgccggcttccaccgagggtgcgtacgtgagctccgagtcaccaatccgcatcagcgtgtcgacggaaggagcaaacacttcgtcctcaacctccacctcgaccaccggaaccagccatctggtgaaatgcgccgagaaggaaaagactttctgcgtgaacggaggagaatgcttcatggtcaaggatctgtcgaacccatcccgttacctgtgcaagtgcccaaacgaattcaccggagatcggtgtcagaactacgtgatggccagcttctacaaagcagaggaactgtaccagaaaagagtcctgaccatcaccggaatttgtatcgcgctgctcgtggtgggcatcatgtgcgtagtggcctactgcaagaccaaaaaacagagaaagaaactccacgatcgcctccggcagtcactccgcagcgaacgcaataacatgatgaacatcgcaaacggaccgcaccatccgaatccaccgccggagaacgtgcagctggtaaaccagtacgtgtcgaagaacgtcatctcctccgaacatatcgtggaacgcgaagccgaaacctctttcagcaccagccactacacctccaccgcccaccactcgaccaccgtgacgcaaaccccttcccattcgtggtccaatgggcacaccgagtccatcttgagcgagtcacactccgttatcgtcatgtcctcggtcgaaaactcgcgccattcctcgccgaccggaggcccgagaggccgccttaacggaaccggaggaccgcgggaatgcaattcgttcctgcggcacgccagggaaacccctgactcgtaccgcgactccccccactcggaaaggtacgtgagcgcaatgaccacgccagctcgaatgtcccccgtcgacttccataccccttcgtcaccgaaaagccctccaagcgagatgagcccgccagtctcaagcatgaccgtctccatgccgtccatggctgtctcgccttttatggaggaagagcggccacttctcctggtgactccgcctcggctcagggagaagaagtttgatcatcacccacagcaattttctagcttccaccataacccggcacacgactcgaattcgctccctgcatcgccgctgcgcatcgtggaggacgaggagtacgagactacgcaggagtacgagcctgcacaggaaccggtgaagaagctggcgaactcccgacgggcaaaaagaactaagccgaacggacatatcgctaataggctcgaggtggactcaaacacctcgtcccagtcatccaactccgaatccgaaactgaggacgaaagagtgggcgaggacacgccgttcctgggtatccagaatcctctggctgcctcgctggaggcgactccggcattccgcctggcggactcccggaccaacccagcgggacgcttttcaacccaggaggaaatccaggcccggctctcgtcagtgatcgcgaatcaagacccgatcgcggtg

SEQ ID NO: 17402 - DNA, 1911 bp, Artificial Sequence
  Description of Artificial Sequence: Synthetic coding sequence
atgagcgagagaaaggaggggcgaggaaaaggaaagggcaagaagaaagagaggggctcgggcaaaaaacctgagtccgcggccggatcacagagtccagctctcccgccacggctgaaagagatgaagtcacaggagagcgcggccggaagcaaactcgttcttaggtgtgaaacatcttccgagtattcctccttaaggtttaagtggttcaagaatggcaacgaactcaacaggaagaacaaaccacagaatatcaagatccagaagaaaccaggcaagtccgagcttcgaattaataaagcctcgctggcggactcaggggaatatatgtgcaaggtcatcagcaaacttgggaacgactccgcatccgccaacattacaatcgtggaaagcaacgagataatcacgggcatgccagcgagcacagagggcgcctatgtctcctccgagtcgcccatcaggatcagcgtttccaccgagggagccaacacctcttcatcaacctcaacaagcactacagggacaagccacctagttaagtgtgcagaaaaggagaaaaccttctgtgtcaacggcggagagtgtttcatggtcaaagatctgtctaatccgtccaggtatctatgtaaatgcccgaatgagttcactggggaccgatgccaaaactacgtcatggcaagcttctacaaggctgaagagttatatcagaagcgagtgctgaccatcaccggcatctgcatcgccctcctagtcgtcggaatcatgtgcgtcgtagcctactgcaagaccaaaaaacaaagaaagaagttgcacgataggctaagacagtcactacgcagcgagagaaataacatgatgaatatagccaatggccctcatcaccccaaccctccccctgaaaatgtccagttggtcaatcagtacgttagtaagaacgtgatcagctctgaacatatcgtggaacgcgaggcagaaacatcattctcaaccagccattacactagcacagcccaccactctactaccgtcacccagaccccatcccattcatggtcaaatgggcacacagaaagcatccttagtgagtcccactccgtaatcgtcatgtcaagtgtggaaaattccagacactcttcacccaccggcggaccacgggggaggctgaacggaaccggtggacctcgggagtgtaatagttttcttcggcacgccagagagacgccggactcatatcgagactccccgcactccgaacgctatgtaagcgccatgactactccggccaggatgagtcccgttgacttccacacacccagctctcccaagtctccgccctctgaaatgagccctccggtatcctcaatgaccgtgtccatgccttcaatggcagtgagtccattcatggaggaagaacggcccttgctgttggtcacccctccgcgtctgcgcgagaagaagttcgaccaccacccacaacagttctcatctttccaccataaccccgcccacgacagcaacagtcttccagctagcccgctgaggattgttgaagatgaggaatacgagaccacgcaggagtatgagcccgcccaggaacctgtcaaaaaattggctaatagccgcagagccaaaaggactaagccaaacggtcatattgccaatcgactggaagtcgactcgaacacatcttcgcaatcgtctaatagtgagagtgaaacagaagacgagcgcgttggcgaagacacacctttcctgggcattcagaaccctctggcagcgagcctggaagccacaccagcattccggctggccgactctcgcacgaatcccgctggcagattttccactcaggaagaaatacaagcccgcctatcttccgtgattgctaatcaggaccccatcgcggtt

SEQ ID NO: 17403 - DNA, 1911 bp, Artificial Sequence
  Description of Artificial Sequence: Synthetic coding sequence
atgtccgagcgtaaagaggggcgaggcaaaggcaagggtaagaagaaagagcgcggtagcgggaagaagcctgagagcgctgccggtagccagagcccggctctgccccctcgactgaaagagatgaagtcacaggagtccgcggctggtagcaaactggtgctacgttgcgagacgagcagcgagtactcaagcctgcgtttcaagtggtttaagaatggcaacgagctgaatcgcaagaacaagcctcagaacataaagatccagaagaaaccggggaagtccgagctgcgcatcaacaaagcgagcctggcagacagcggcgagtatatgtgtaaagttatctccaagctgggtaacgactccgcttctgccaatattaccattgttgaatccaatgaaataattacgggcatgccggcaagcacagagggcgcatacgttagcagcgaatcccctatccgtataagcgtcagcacggaaggtgcaaacaccagcagctccacgagcaccagcactacgggtaccagccatttagttaagtgcgctgagaaggaaaaaaccttctgtgttaatggtggtgaatgcttcatggttaaagacctaagcaacccttcccgctacctttgtaaatgccccaacgaatttactggagatcgttgccagaactacgtaatggcatccttctacaaagctgaggaactgtaccagaaacgtgtgctgaccattacgggtatctgtattgcgttgctggtggtaggcattatgtgcgtagtggcatactgtaaaactaagaaacaaagaaaaaagctgcatgaccgcctgcgccagagcctgcgctcggaacgcaataacatgatgaatatcgcaaatggacctcatcatccgaatcctccacctgagaatgtgcagctggtcaaccagtacgtttctaagaacgtgatcagcagcgagcatatcgttgaacgggaagcggaaactagcttctctacgagtcactataccagtaccgctcaccacagcacaactgtcacacagactccatcccactcctggagcaacgggcacacagaatctattctgtctgagagccacagcgtgatagtgatgagcagcgtggaaaactctcgccactctagcccgaccggcggtcctcggggaaggctgaacggtaccggcggcccgcgcgagtgtaactctttcctgcgccatgcgcgggagacccctgacagctacagggactctccacactccgagcgctacgtttccgcgatgaccaccccggcccgcatgtccccagttgacttccatactccgtcttctccgaagtcccctccttctgaaatgtcccctccagtgtcctccatgactgtgagcatgccaagcatggccgtctctccgttcatggaggaagaacgtccgttgctgttggtcactccaccccgtctgcgagagaagaagtttgatcatcacccacaacagttcagctcatttcatcacaacccagcgcatgattcgaatagcctgcccgcctctcctctgcggattgttgaggatgaagaatacgaaaccacccaggaatatgaaccggctcaagagccggttaaaaaactggcgaactcacgtcgcgcgaaacgcacgaagcctaacggtcacatcgctaaccgtctggaagttgacagcaataccagcagccaaagctcgaacagtgagagcgagaccgaggacgagagagtgggcgaggacaccccatttctgggtattcaaaacccattagcagcgagcctggaagcaactccggcatttcgcctggcagatagtcgcaccaaccctgctggaagattttccacccaagaggagatccaggcgagattgagctctgttatcgcaaatcaggatccaatcgccgtt

SEQ ID NO: 17404 - DNA, 1911 bp, Artificial Sequence
  Description of Artificial Sequence: Synthetic coding sequence
atgtcggaacggaaggagggtcggggcaaaggaaagggcaaaaagaaggagcgcggtagcggcaagaagcccgaatcggccgccggatctcagtctcccgccctcccccctcgtctgaaagagatgaagtctcaagagtccgctgcaggatctaaactcgtgctgcgatgcgagactagtagcgaatattcctcgctcagattcaagtggttcaaaaacggtaacgaactgaataggaaaaacaaacctcagaatatcaaaattcaaaaaaaaccaggaaagtctgaattaaggatcaacaaggccagcttggccgattcgggtgaatacatgtgtaaggtcatatccaaactcggtaatgatagtgcttctgccaacattaccatcgtagaaagcaatgagattattaccggcatgccagccagtacagaaggtgcttacgtgagttcagaaagtcctatacgcatctcggtctcaacagaaggcgcaaatacctcgtctagtacctctacctcaacaaccggcacaagccatctcgtcaagtgcgcagaaaaggagaagaccttttgtgtgaacggcggagagtgctttatggtgaaggacctgtcgaacccgagccgttatctgtgcaaatgcccaaatgagttcacaggagaccgatgtcagaattatgtcatggcatctttttacaaggcagaggaactgtaccagaagcgggtgctgacaatcacaggaatctgcattgctctgctggtggtgggaatcatgtgtgtggtggcctactgcaagacaaaaaagcagcgcaaaaagctgcacgatagactccgacagagtttgaggtccgaacgtaacaacatgatgaacatcgctaatggtcctcatcacccaaatcccccaccagagaatgttcagctggtgaaccaatacgtttccaagaatgtgataagcagcgagcacatagtggaacgcgaggcggagaccagcttctctaccagtcattacacatccacggcgcaccactccacaaccgtgacacaaacaccctcacacagctggtcaaatgggcatactgaatcaatcctgagcgagtcacactccgtcatcgtgatgagctcggttgagaattcccgccactccagcccaaccggtggcccaaggggacgtctgaacggtactggcggcccaagagaatgtaactccttcctgcgtcatgctcgagagacccctgattcttacagggattcgccccactctgaacgctatgtatcagctatgaccacaccagctcgcatgtcacccgtagacttccatacaccatcgtcaccaaaatccccgccgagcgagatgagccccccagtgtcttcaatgacagtctcaatgccatccatggcagtgtctccctttatggaagaggaaaggccacttctcctggttacaccaccaaggctgcgtgaaaagaagtttgatcaccacccacagcagtttagcagctttcaccacaatccggcccacgactccaacagcctgccagcctctcctctccgcatcgtcgaggatgaggagtacgagaccacccaggagtatgagcccgcgcaggagccggtgaaaaagttggcgaacagcagacgtgcaaaaaggacgaagccaaatgggcatattgctaatagactggaggtcgatagcaacaccagttcccagagtagtaattccgaatcagaaaccgaagatgaaagagtgggcgaagacactccattcctgggcattcagaaccctctggctgcatcactcgaagccacgcccgctttcaggctggctgactccagaactaaccccgccgggcggtttagtactcaggaagaaattcaggcgcgactatctagcgttattgctaatcaggacccaatcgcggtg

SEQ ID NO: 17405 - DNA, 1911 bp, Artificial Sequence
  Description of Artificial Sequence: Synthetic coding sequence
atgtccgagcgcaaagaagggcggggtaagggtaagggcaagaaaaaagagcgaggctcaggaaagaagcctgaatcagcagcgggatctcaatcgcccgcgctgcctccgcgccttaaagagatgaaaagccaggaatccgcagcgggaagcaaactggtgctccggtgcgagacttcatccgaatacagcagcctgcggttcaagtggtttaagaacgggaacgagctcaaccgcaagaacaaaccacagaacatcaagatccaaaagaagcccggcaagtcagaattgcggatcaacaaggcttccctggctgacagcggagagtatatgtgcaaggtcatttcgaagctcggaaatgactctgccagcgctaatatcaccatcgtggaatcgaatgagatcataaccgggatgcccgcgtccaccgagggcgcctacgtgagctccgaatccccgattcgcatttcggttagcaccgagggagcgaatacctcttcgtcaacttccacctcaactaccgggactagccacctcgtcaagtgtgccgagaaggaaaagacgttctgcgttaatggaggagaatgttttatggttaaggatctgtccaatccttcgcggtacctttgtaagtgccccaacgaattcactggagatcgctgccaaaactacgttatggcctcgttctacaaggctgaggagctgtaccagaagagggtgctgaccatcaccggtatctgcatcgccctcctggtggtggggatcatgtgcgtcgtggcctactgcaagaccaaaaagcaacggaagaagctccacgacagacttagacagagcctgagatccgagcgcaacaacatgatgaatatcgcaaacgggcctcatcaccccaatcccccaccggagaatgtgcaactggtgaaccagtacgtgtccaagaatgtcatctcatccgagcacattgttgaacgcgaagcggagacttctttttccacttcccactacacttcgactgcgcaccactccacgaccgtcacccagactccctcccactcatggtcgaacgggcatactgaatcgatcctcagcgagtcccattcggtcatcgtgatgtcatcggtggagaacagccgacactcctcaccgactggcggaccgcggggccggctgaatggaaccggtggcccgcgggaatgcaacagcttcctccgccacgcgcgagaaaccccagactcctaccgcgattcaccgcattccgaacgctacgtctcggcaatgaccactccggcccgcatgtcgccagtggatttccataccccgtcctctccgaagagcccgccatccgaaatgtcgccaccagtgtcgtcgatgactgtctccatgccatcaatggcggtgtccccgttcatggaggaggaacggccactccttttggtgactccaccacgccttcgggaaaagaagttcgaccatcacccgcagcagtttagctcgttccaccacaaccctgcacatgactctaactcgctgcctgcgtcccccttgagaatcgtggaggatgaggagtacgaaaccacccaagaatacgagccagcccaggaaccggtcaaaaaactcgcaaactcccgcagagcaaaacggaccaagccgaatggccacattgcaaatcgcttggaagtcgactccaacacctcctcgcaaagctcaaactcggagagcgaaactgaagatgagcgggtgggtgaagatactccattcctcggaatccaaaaccctctggcagcttctctggaggcaacgccggcttttagactggcagacagccgcacgaacccagccgggagattttcgacccaggaggaaatccaggctaggctgagctcagtgatcgctaaccaggaccctatcgcggtg

SEQ ID NO: 17406 - DNA, 1911 bp, Artificial Sequence
  Description of Artificial Sequence: Synthetic coding sequence
atgtcagaaaggaaggaaggccgcgggaagggcaaggggaaaaagaaggaaaggggatcaggtaagaaacctgagtcggccgcggggagccagtctcctgcactgccacctcggctgaaggaaatgaagtcccaggagtccgctgcaggatccaagctagtgctccgttgtgaaacaagctctgagtatagttcactgagattcaaatggtttaaaaacgggaatgaactgaataggaagaataagccccagaatatcaaaattcagaaaaagcccggtaaatctgagttaaggattaacaaggccagcctggccgacagtggagaatacatgtgtaaagtgatctcaaaactaggcaacgattctgcctccgccaatattacgattgtggaatcaaatgagataatcaccggtatgccggctagtactgaaggagcgtatgtttcctctgagtcccctataaggataagcgtgtccactgaaggagcaaacacaagcagctccacttcgacgagtaccaccggcacctcacatctcgttaagtgcgccgagaaggagaagaccttctgtgtgaatggcggagagtgctttatggtcaaagatctgagcaacccttcccgctacctctgcaaatgcccaaacgaattcacaggtgaccggtgccaaaactacgttatggcgagtttttacaaggctgaggagctgtatcagaagcgcgtgttgaccattactggaatatgcatcgcgctattggtagttgggataatgtgtgtcgtcgcatactgcaaaaccaaaaagcagcgcaagaaacttcatgatcgcttgagacagagcctgcggagcgaacgtaataacatgatgaacattgctaatggtccacaccatcccaaccccccccctgaaaatgtccagctagttaatcagtacgtttcaaagaacgtgatctccagtgagcacatagtggagagagaggcggaaacgagtttcagtacatcccactacacttcaaccgctcatcactcgaccacagtcacgcagacaccaagccatagctggtccaacggacacaccgaatccattctgagtgagagccattctgtaattgtgatgagctctgtagagaactcaaggcacagcagccctacggggggacccagaggaagactgaatggtaccggtggaccacgagagtgtaacagctttctccgccacgcacgagagacccctgactcctatagggatagtccccactctgaacgttatgtgtctgccatgacaacaccagcccggatgtcccctgtggattttcacactcctagcagtccaaagtctccccctagcgaaatgtcacctcccgtttcctcaatgaccgtgtctatgcctagcatggccgtctccccgtttatggaggaagagagacctctgctgctggtgacccctccacgcctcagagagaagaaatttgaccatcatccacagcagttctcatcttttcatcacaaccccgctcacgatagtaattccttacccgcctccccacttagaatcgttgaggacgaggagtacgaaaccacgcaggagtacgagccagcccaggagccagtaaagaaattagcgaattcacggagggctaagcggacgaaacccaacggtcacatcgctaaccggttagaggtggactcgaacacttccagccagtccagtaacagtgagagcgagactgaagatgaaagagtcggggaagacacacctttcctgggcatccagaacccactggctgcctctttggaggccactccagccttccgcctggcggactctcgtacaaatccagctggccgattttctacccaagaggaaatccaggcccggctgtcatctgtcattgccaatcaggacccaattgcagtg

SEQ ID NO: 17407 - DNA, 1911 bp, Artificial Sequence
  Description of Artificial Sequence: Synthetic coding sequence
atgtccgaacgtaaggagggtcgaggcaagggtaaggggaaaaagaaagaaagaggttctggcaagaagcccgaatcggcggcaggctcgcaaagcccagcgctgccaccgaggctgaaggagatgaagagccaggagagcgcagcaggatcgaagctcgtgcttcggtgtgaaacctcgagcgaatacagcagcttgcggttcaagtggttcaaaaacggcaatgagctgaaccgtaagaataagccccagaacatcaaaattcaaaagaagccgggaaagtcggaacttcggattaacaaagcatcgttggcggatagcggggagtacatgtgcaaggttatcagcaaactgggaaatgactccgcatcggccaatatcacgatcgtggaatcgaacgagatcataacgggaatgcctgcatcgaccgagggcgcatacgtttcgtcggaatcgccaatccgtatttccgtctcaaccgaaggtgcaaatacttcctcatccacttcaacttcgactactggcaccagccatctcgtgaagtgcgcagaaaaggaaaagacgttttgcgtgaacgggggagaatgtttcatggtgaaagacctctcaaatccatcaagatacctgtgtaagtgtccgaacgaattcactggtgatagatgccagaattacgtgatggcatcgttctacaaagccgaggaattgtatcaaaagcgcgtgctgaccattactgggatatgtattgcgctgctggtcgttggcataatgtgtgtcgtggcatactgtaagactaagaagcagagaaaaaagctccatgaccggctgagacagtcactgcgctccgaacgaaacaatatgatgaatattgctaacggcccacatcacccaaatcctccacccgaaaacgtgcagttggtcaaccagtacgtgtccaaaaatgtcatttcaagcgagcatattgtcgagcgtgaggcagagacttcgttttcgacctctcattacacttcgaccgcacatcacagcacgactgtgacgcaaactccttctcactcctggagcaatggtcacactgaatccattctttccgaatcacattcagtgatcgtgatgtcgtcggtggaaaattcacggcactcgtccccaactggagggccacgcggtcgacttaacggaaccggcggaccaagagaatgtaactcatttctgcggcatgccagagaaacccccgactcgtacagagattcaccacatagcgagaggtatgtgagcgcaatgactacgcctgcccggatgtcaccagtcgatttccataccccatcctcgcctaaatcccctccttcagaaatgtcacctcctgtgtcctccatgaccgtctccatgccttcaatggccgtgtcgccttttatggaggaagaacgacctctgttgcttgttacccctccaagattgagggagaagaagtttgaccatcacccacaacaatttagctcctttcatcataacccagcccatgacagcaactcgcttcccgcaagcccacttcgcattgtcgaggatgaggaatacgaaactacccaggaatacgaaccagcacaagaaccagtgaaaaaacttgctaacagcaggcgtgcgaagcgcaccaagccgaatgggcatattgctaaccgtcttgaggtcgattcaaacacctctagccaatcgtccaactcggaatccgagacggaggatgagagagtcggagaagataccccttttctcggaattcagaatcctctggccgcatcgctggaggcaacccctgcatttcggctggctgattcccgcaccaacccggcaggacgtttttcaacgcaggaggagattcaagctcgcctgtcgagcgtcatcgcaaaccaagatccaatcgcagtg

SEQ ID NO: 17408 - DNA, 1911 bp, Artificial Sequence
  Description of Artificial Sequence: Synthetic coding sequence
atgtccgagcgtaaggaggggcgaggtaagggaaaagggaagaagaaggagcgaggatctggcaaaaagcctgagtcagcggccggaagccaaagtcccgctcttcctcctcggctcaaggaaatgaagagccaagaatcagcagcaggatcaaaacttgtgctccgctgtgaaacctcaagcgagtactcctcacttagatttaagtggtttaagaatggaaatgaacttaaccggaagaacaagcctcaaaacataaagattcaaaagaagcccggaaagtccgaacttcgcatcaacaaggcctcgcttgcagattcgggagaatacatgtgcaaagtgatatcgaagctgggaaacgacagtgcaagcgctaatatcaccatagttgagtcgaacgaaatcattactgggatgcccgcaagcactgagggagcttacgtgtccagcgagtccccaattcgcatttccgtgtcgactgagggggccaacacttcgagctcgacctccacgagcactactggaacctctcatctggtgaagtgcgccgaaaaggaaaagactttttgcgtgaacggcggtgaatgttttatggtgaaggacctctccaatccgtcgagatacctgtgtaaatgccccaatgagtttactggtgataggtgtcagaactatgtcatggcgtccttttacaaagcagaagagctctaccaaaagagggtgctgacgattactgggatctgtattgccctgctggtggtgggtattatgtgcgttgtggcatactgtaagacgaaaaagcagaggaagaagctgcacgaccggcttcgccagtcgcttcggtcagagcggaacaatatgatgaatatagcaaacgggccacatcatcctaaccctccccctgagaacgtgcagctggtgaatcagtacgtgtccaagaacgtaatttcgtcggagcatatcgtcgagagagaagcagaaacctccttctcaacctcgcattatacttcgaccgcacatcactccaccaccgtgactcaaaccccttcgcattcctggtctaacggtcatactgaatctattctttcggaaagccattcggtgatcgtgatgagcagcgtggaaaattcaagacattcctcgcctacggggggaccaagaggacggctgaacggaactggtgggcccagggagtgtaattccttccttcggcatgcgcgcgagacgccagattcctaccgcgattccccgcactccgaaagatacgtgtcagcgatgactacgccagccaggatgtcccctgtggatttccatactccttcctcacctaaatcgcccccttcggaaatgtccccaccggtgtcaagcatgaccgtgtcgatgccttcgatggccgtgagcccatttatggaggaagaacgcccacttcttcttgtgactccacctagactgagagaaaagaagttcgatcatcacccacaacagttctcctcgtttcatcacaacccagctcacgactcaaattcgctcccagcatcgccgctgcgcatcgtggaagatgaggagtacgaaaccactcaagaatacgaaccggcgcaagaacccgtgaagaaactcgcgaactccagaagggcaaaacgcactaaacccaatgggcatattgcgaatcgtctggaagtggacagcaatacctcgagccaatcgtcaaactcagaatcggaaaccgaagatgaacgggtgggggaagataccccttttctgggaatccaaaaccctctggcggcctcattggaagcgactccagcgtttagattggcagacagccggaccaacccagcaggtcgttttagcactcaggaagagattcaggctagattgtcgtcggtgattgcaaaccaggatccgatagcagtg

SEQ ID NO: 17409 - DNA, 1911 bp, Artificial Sequence
  Description of Artificial Sequence: Synthetic coding sequence
atgagcgaaaggaaagaaggtaggggcaaaggcaaaggtaagaagaaagaaagaggcagtggaaagaaacctgaaagcgctgccgggagtcaatcccccgcccttccaccacggctgaaagagatgaaaagccaagagagcgctgcaggttccaagttggtgttaagatgtgaaacatcgtctgagtatagctctctgcgatttaagtggttcaagaacggtaatgaactcaacagaaagaataagccccagaatataaagattcagaaaaaaccggggaaaagcgaattgcgcattaataaggctagcctggctgactccggagaatacatgtgcaaggtcatctctaaactgggaaatgatagcgcaagcgctaacatcactatcgtggagtccaatgagattattaccggcatgcccgcctctactgagggcgcctacgtttctagcgagtccccaatcaggatttcagtgagcacagagggcgccaatacgagttcctcaacctccaccagtaccaccggtacttcccacctcgttaaatgtgctgaaaaggaaaaaactttctgcgttaacgggggagagtgtttcatggtgaaggatctgtcaaatccgtctcgatatctatgtaagtgccccaatgagttcaccggcgatagatgtcagaattacgttatggccagcttttacaaagccgaggaactgtatcagaaaagggtgttaacaattaccggcatttgcatcgcattgctggtcgttggcatcatgtgcgtggtggcctattgtaagaccaagaaacaaagaaagaagctccatgacagattacgccagagcttgcggagtgagcggaacaacatgatgaatatcgccaacgggcctcaccacccaaatccaccccctgagaatgtacaattggttaaccaatatgtgtcaaaaaatgttatttcctcagagcatattgtggaacgggaggctgagacctccttctccaccagtcattatacgagcaccgcgcaccatagcacaaccgtgacccagacgccaagtcacagttggtctaacggccacacagagagcattctgtctgaaagtcattccgtgatcgtgatgtcctcggtggagaactccaggcattcgagcccaactggtgggcctcgagggcgcctgaatggtaccggagggcctcgggagtgcaacagcttcctgcggcacgcccgagagacccccgactcctatagagattcccctcattctgaacgatacgtttccgccatgactacgcctgctcggatgagcccagtggactttcataccccatcctctcctaagagtccaccaagtgagatgagcccgcccgtctcttccatgacggtaagtatgccttcaatggcagtttcacctttcatggaagaagaaaggcccctcctgcttgtcaccccccctcggttaagagagaaaaagttcgatcaccatccacagcagttttcgagcttccatcacaatccggcgcatgacagcaactctctcccagcctctcctcttaggattgtggaggacgaagagtacgagactacacaggaatatgagccagcacaggagccggtcaagaaactggcgaactctaggcgcgccaaaaggaccaagcctaatgggcatatcgctaacaggctggaggtcgatagcaatacatcttctcagagctctaactctgaatctgaaactgaagatgagcgagtgggagaggatacaccatttcttgggatccagaacccgctagcagcgagcctggaagcaacccctgctttcagattggcggactccaggacaaacccggccggccggttctccacccaggaggaaatccaggcgagattaagttcagtgattgccaatcaggatcccattgcagtc

SEQ ID NO: 17410 - DNA, 1911 bp, Artificial Sequence
  Description of Artificial Sequence: Synthetic coding sequence
atgagcgaacgcaaggagggacggggaaaagggaagggcaagaagaaggaacgcggctcaggaaagaagcccgagtctgccgctggatcgcaaagccccgcactgccgcccagattgaaggaaatgaagtcgcaggaaagcgcagcaggatcaaaattggtgctgcgctgcgagacttcctcagagtactcctcactgcgcttcaagtggttcaagaacggaaatgagttgaaccgcaagaacaaaccgcaaaacatcaagatccagaaaaagcccggaaagtccgaactgcggataaacaaagcgtctctcgctgactcgggggagtacatgtgcaaagtgatctccaaattgggtaacgacagtgcgagcgcgaatatcaccatcgtggaatctaatgagattatcaccggaatgccggccagcacggagggcgcgtacgtgtcctcagaatcgccaatcagaatctcagtgagcactgagggtgccaacacttcatcatccactagcacctctacgaccggtaccagccacctggtgaagtgcgcggagaaggaaaagaccttttgcgtcaacggaggagagtgcttcatggtgaaggacctcagcaatccgtcgcgctacctctgtaaatgcccgaacgaattcaccggagatcgctgtcagaattacgtgatggcgtcattctacaaagcagaagagctgtaccagaagcgggtcctgactatcacgggcatctgcattgctcttctggtcgtcggcatcatgtgtgtggtggcatattgcaagaccaagaagcagcggaagaaacttcatgatcgcttgcgccaaagcctccgctctgaacggaataacatgatgaatatcgccaacgggccacaccaccccaacccgccgccggaaaatgtgcagctggtgaaccagtacgtctcgaagaacgtgatctcgtcggaacatatcgtggagagagaagcagaaacttccttctcgacgagccactatacgtccactgctcaccatagcaccaccgtgacccaaactccgtcccattcctggtcaaacgggcacacggaatcgatcctgagcgaatcccactccgtcatcgtgatgtcgtcagtggagaactcacgacattcctcccctaccggaggaccaaggggacggctgaatggcactggtggcccgcgcgagtgtaatagcttcctgcgacatgcgcgcgagactcccgactcctaccgggactccccacactcggaacggtacgtgagcgcgatgactactccggccagaatgtccccagtggactttcataccccatcgtccccgaagtcccctccttcagaaatgtcgccgccagtgtccagcatgaccgtgagcatgccatcaatggccgtgtcgcctttcatggaggaggaaaggccactcctgctggtcactccaccgagactccgggagaagaagttcgaccaccatccacagcagttctcgtcgttccaccacaatcccgcacatgactcgaactccctgcctgccagcccactgcgcatcgtggaggacgaggagtacgaaaccactcaagagtatgagccggcccaagaacctgtgaagaagctcgcgaattcgaggagagctaagcggaccaagcccaatggacacatcgcaaaccggctcgaagtggattcgaacacttcctcgcagtccagcaacagcgagagcgaaactgaagatgaaagagttggcgaggacacccctttcttgggaatacagaatccgctggcggcctcactggaggcaaccccggctttccgccttgccgatagccgcacgaacccagcaggacggtttagtactcaagaagaaattcaggcgcggcttagctcggtcatcgcgaatcaagatcctatcgccgtc

SEQ ID NO: 17411 - DNA, 1911 bp, Artificial Sequence
  Description of Artificial Sequence: Synthetic coding sequence
atgtccgagcgcaaggaggggcgaggcaaagggaaaggcaaaaagaaagagagaggatcaggaaaaaagcctgaaagcgcagcaggctctcaaagtccagctctgccccctcgcctcaaagaaatgaaatctcaggaaagtgctgccggcagcaaactcgttctgcgttgtgagacatccagcgaatactcttcccttagattcaaatggtttaagaatgggaacgagctcaacaggaaaaataagccccagaacattaagattcaaaagaagccgggcaaaagcgaactccggatcaataaagcttcattggcagacagcggcgagtatatgtgcaaggtgattagcaagttaggaaatgattccgcctctgcaaatatcacaatagttgagtctaatgaaattatcaccggtatgcccgcaagtacagaaggcgcatacgtgtcgtctgagagtccaattaggatttcagttagtacagagggggccaatactagcagttctaccagtacatcaaccacgggcacttcacacctggtgaagtgcgccgagaaagaaaagactttttgcgttaatggaggggaatgcttcatggttaaggacctgtccaatccgtctaggtacttatgcaaatgtcccaacgagtttactggcgacaggtgccagaattatgttatggccagtttctacaaggcggaggagctgtatcagaaacgcgttctaaccatcacaggcatctgtatagctctgcttgtcgtaggaatcatgtgtgtggttgcatattgtaagacgaaaaagcagaggaagaagctgcacgatagattgcgccaatcccttcggtcagagcggaataatatgatgaacatcgcaaatggcccccatcatcccaacccccccccggagaacgttcagcttgtcaatcagtatgtctccaagaatgtcatcagttccgaacatattgtggagagggaagccgagacttcattttcgacttcacactataccagcactgctcatcacagcaccaccgtgacacagacgccctcacattcctggtctaatggtcacacggaatcgattctgagcgagtctcattccgttattgttatgtcctccgtggaaaatagccgccacagttctcccaccgggggcccccgcggtagactaaatggtacaggtgggcctcgggagtgtaactccttcctacggcatgcacgtgaaacaccagactcttatagagactctccccactccgagcgatacgtcagtgcaatgacgactccagcacgaatgtcaccggtcgactttcacacgccctcttctcctaaatctccgccctcagagatgagtcctccagtgtccagcatgacagtgagcatgccctcaatggcagtgagtccctttatggaagaagaacgccctttgctgctggtgacaccaccgcgtttaagagagaagaagtttgaccatcaccctcagcagttttcatcctttcatcacaaccctgcccatgactctaatagcctccccgcaagcccactgaggatcgtggaggacgaagagtatgagaccacccaagagtacgagcccgcacaggaaccagtcaagaaactggctaacagcagacgtgcgaagagaactaaacccaacggccatatagccaatcggcttgaagtcgacagtaacacgtccagtcagtcctcgaactcggagtcagaaacggaagacgaacgagtcggagaggataccccatttctcggcatccaaaatccactggccgcctctctggaagctacacccgcttttcgtctcgctgacagtcggactaaccctgctggtagattttctacacaggaagagatccaggcgagactgagtagcgttatcgccaaccaggaccctatcgcagta

SEQ ID NO: 17412 - DNA, 1911 bp, Artificial Sequence
  Description of Artificial Sequence: Synthetic coding sequence
atgagcgaaagaaaagagggtcgaggtaaaggtaagggaaagaagaaggagaggggatcggggaagaagcctgaaagcgcagcgggatctcaatcgcccgctcttcctccacgactgaaggagatgaagtcccaagagtccgcagccggaagcaagctggtgctgcggtgtgaaacgtcatccgaatactcctcgctcaggttcaagtggtttaagaatggaaacgagctgaatcgtaaaaacaagcctcagaacatcaaaattcaaaagaaacccggaaagagcgagctgaggattaacaaggcctcgctggccgactcgggagaatacatgtgtaaggtcatctcaaaacttggaaacgattcggcaagcgcaaacattaccatcgttgagtccaacgagatcattactggaatgccggcctccaccgaaggagcatacgtgtccagcgagtcaccaattcgtatatctgtgtcaaccgagggagcaaacacctcatcatccacttccacctcgactactgggacctcgcatctggtgaagtgcgcagagaaggaaaagactttttgtgtgaatggtggagaatgctttatggtcaaggacctttccaatccttctcgctacctgtgtaaatgtccgaacgaatttaccggagacagatgccaaaactacgtgatggcatccttctacaaggcggaagaactgtatcagaaaagagtcctgaccatcactggtatttgtattgcccttcttgtggtgggcataatgtgcgtggtggcgtactgtaaaaccaagaagcaacgtaagaagctgcatgaccgcctgcgacagtcacttcgaagcgaaaggaataacatgatgaatatcgcgaacggaccacatcacccgaacccgccacccgaaaacgtgcaattggtcaaccaatacgtctcgaagaatgtcatttcgtcagagcatattgtcgaacgcgaagcagagacttcgttctccacttcgcattacacctcaaccgcccaccattccactaccgtgactcaaactccgtcacattcctggtcaaacgggcacaccgagtccatcttgagcgaatcccattccgtgattgtgatgtcatccgtcgaaaactccagacactcgagccctaccgggggccctcgcggaaggcttaacggaaccggtggtcctagggagtgtaacagtttccttagacatgcacgcgaaactcccgatagttacagagactccccccactcggagcgctacgttagcgcaatgaccacccctgcacggatgtcgccagtcgattttcataccccaagctcgcctaaatcccctccttcggagatgtccccacccgtgtcctccatgacggtgtcgatgccaagtatggcagtcagcccttttatggaagaggaaagacctctgctgcttgtcactccgccacggctgcgtgaaaagaagttcgatcatcatcctcagcaattttcctcgtttcatcataatcctgcacatgactcgaactcccttcctgccagtccgctgcggattgtggaagatgaggaatacgagactactcaagaatacgaacctgcacaagaacccgtgaagaaattggccaacagccggcgagctaagcgaaccaaaccaaacggccatatcgccaatagacttgaagtcgattccaacacgagcagccaatcgagcaactcagaatcggaaactgaagatgagagggtcggggaagatactccatttttgggtattcagaacccactcgcagcgtccctggaagccactccagcatttcggcttgcagactccaggactaatcccgccgggcggttctcaacccaagaggaaatccaagcccggctctcgtcggtgatagcgaaccaggacccaatcgctgtc

SEQ ID NO: 17413 - DNA, 1911 bp, Artificial Sequence
  Description of Artificial Sequence: Synthetic coding sequence
atgtccgagaggaaagaagggcgggggaagggcaagggaaagaagaaggaacggggttcaggcaagaagcctgaaagcgccgctggttctcagagcccagcattacctccacgcctaaaggagatgaagagccaagagagcgcagctggcagtaagttggtacttaggtgtgagacctcttcagaatattcctctctgcggtttaagtggttcaagaacggaaatgagcttaataggaaaaacaaaccccagaatattaaaattcaaaagaagcccggcaagtccgaactgcgaataaataaggcgtccctggcagattccggagagtatatgtgcaaggtgatctcgaagctaggtaatgacagcgcctccgcgaatattacgatcgtggagtctaacgagataatcaccggaatgccggcgtctactgaaggggcctatgtatcctccgagagccccattagaatctctgtgagtacagagggggccaacacatccagctctacaagtacaagcacaacgggcacctcccatctggtgaagtgtgccgagaaggagaagaccttctgcgtgaacggaggagaatgctttatggtgaaggatctgagtaacccctcgaggtatctgtgtaaatgtcccaatgaatttacaggagacaggtgccagaactacgttatggcctcgttctacaaagctgaagagctttatcagaagcgcgtcttaaccatcaccggcatctgtatagcgttgcttgtggtgggcattatgtgcgtcgttgcctattgcaaaaccaaaaagcaacgcaagaaactgcacgaccgactgaggcaaagtctaaggtcggagaggaataatatgatgaatattgccaacggcccacatcacccaaacccccctcctgagaacgtacaactggtgaaccagtatgtcagtaagaatgtaatttcctctgagcatattgtggagagagaggctgagacgagcttctccacctcacactatactagcactgctcaccactcaactacagtcacgcagactccctcacacagctggtccaatggccacactgaatcaatcctgtcggaaagccacagtgtcatcgtcatgagcagcgtggagaactcccggcatagtagccctaccggcggacccagaggacgcctgaatggcaccgggggaccaagggagtgtaatagctttctaaggcatgcaagggagactcccgatagttatagggactcaccacactccgaacgttatgtatccgccatgaccactcctgctcggatgagccctgtcgacttccatacaccatcatcacccaagagtcccccatccgagatgagcccacctgtgagctcaatgacagtctccatgccctcaatggctgtcagcccatttatggaggaggaacggccccttttgctggtcacgcccccacgcctacgtgaaaagaagttcgatcaccacccacaacagttctcatcttttcaccacaaccccgcgcacgattctaactcactgcctgcttcacctctgcgcatagtcgaggacgaagaatatgagaccacacaggagtacgagcccgcccaagaacctgttaagaaattggctaatagcaggcgcgccaagagaaccaagccaaacggtcatatcgcaaataggctcgaagtggatagtaacactagctcccaatccagcaattccgaatctgagacagaagatgaacgagtgggtgaggatacaccattcctggggatacagaatcctctcgccgcgtctcttgaggcaacacctgccttcagactcgccgatagccgcactaatccagccggacgcttcagtacacaggaggaaattcaggcccgactgtctagcgtcatcgctaatcaggatccaatcgcggtt

SEQ ID NO: 17414 - DNA, 1911 bp, Artificial Sequence
  Description of Artificial Sequence: Synthetic coding sequence
atgtccgagcggaaggaagggaggggtaaaggaaagggaaagaagaaagagcggggctccggcaagaaaccggagagcgctgcggggtctcagtcacctgccctgccccctcggctgaaggagatgaaaagtcaggagtcagcagccgggagcaagctcgtattgagatgcgaaacgtcttccgaatactcgtccctgaggtttaaatggtttaagaacggtaacgaactcaaccggaaaaacaagccccagaacatcaagatccagaagaaaccgggcaagagtgagctccgaattaataaagcatccctcgccgacagcggcgagtacatgtgtaaagtgataagtaagctgggcaatgattcagcttcggcgaatatcaccatcgtcgagagcaatgagatcattaccggaatgcctgcatctaccgaaggggcctacgtgagtagcgagtccccaatcagaattagcgtgagcacggagggagccaatacttcttcatctacatcgactagcactaccggaacctcacacctggtgaaatgtgccgagaaagagaagaccttctgcgttaatggtggagagtgttttatggtcaaggacctctccaatccttcccgatatttgtgcaagtgccccaatgaattcacgggagacaggtgtcaaaactatgtgatggcttctttctataaggccgaggagctctatcagaagcgggtgttgaccatcaccggaatttgcattgccctgctagtggtcggaattatgtgcgtcgtagcttattgcaaaacaaagaagcagcggaaaaagctccatgaccgtctgcggcagtccctgcgcagcgagcggaataacatgatgaatatcgccaacgggcctcaccacccgaacccccctccagaaaacgtgcagctggtcaaccagtacgtaagtaagaacgtcatcagtagtgagcatatcgtggaacgtgaggccgaaacctccttctcaaccagtcactacacttctaccgcacatcattccaccaccgtgacacaaaccccctcgcactcatggagtaacggccacacagaatctatcctctctgaaagccactctgtcatcgtcatgagttcagtggagaacagtagacatagctcgcccactggcggtccccgagggagattgaacggcactggaggcccgagagagtgcaacagcttcctcagacacgctcgggagacgcctgatagctacagggactccccccattccgagcgctacgtgtcagcaatgactactcctgcacgaatgtcgccggtggatttccacaccccatcttcacctaaatcccccccctcagagatgagtcccccggtgtcctccatgacagtgagcatgccatctatggctgtgagcccttttatggaggaagagcgacccttgctgctggttactccccctcgactgagagagaagaaattcgatcatcacccacagcaattctcgtcttttcaccataatcctgctcatgattcaaattcactccctgcgagcccgcttcgtatcgttgaggacgaagagtatgaaacgacacaggagtatgaacctgcccaggagccagtaaaaaaactggcaaacagcaggagagccaagcgcactaagccaaatgggcacatagctaacaggctggaagtagatagtaatacatcttcccagtcttctaatagcgagtccgagaccgaagatgagagagtcggagaagatacgcccttccttggcattcagaaccccctggcagcttccttagaggcaacaccagccttccggctggccgactcccggaccaatccggctgggagatttagcacacaagaagagatccaagcccgtttgagctccgtgattgcaaaccaagacccaattgccgtt

SEQ ID NO: 17415 - DNA, 1911 bp, Artificial Sequence
  Description of Artificial Sequence: Synthetic coding sequence
atgtcagaacggaaagagggtcgggggaagggaaagggaaagaagaaggaacgcggatcgggaaagaagccagaatcggcggctggatcccagtccccggcccttccgccacgcttgaaggagatgaagtcccaggagtccgccgcgggatccaagctggtgctgcgctgcgaaactagcagtgagtactcgtcccttcgcttcaaatggtttaagaacgggaacgagctcaacagaaagaacaaaccacagaacatcaagatccagaaaaagccgggcaaatcggagctccggatcaacaaggccagcttggcggactccggcgagtacatgtgcaaggtcatctctaagctgggaaatgatagcgcgtccgctaacattaccatcgtcgaatcaaacgagatcattaccggtatgcctgcgagcacggaaggcgcatacgtgtcatccgaatcaccgatccgcatctctgtgtccaccgagggtgccaacacctcgtcatcaacttcaacctccacgactggcacctcccatctggtcaagtgcgcagaaaaggaaaagacgttctgcgttaacggtggcgaatgcttcatggttaaagacctttcaaacccctcacgctacctctgcaagtgccccaatgagttcaccggggatcgctgtcagaactatgtgatggcatccttctacaaggcagaagagctctaccaaaaacgcgttctgactattactggcatctgtatcgccctgctcgtcgtcggcatcatgtgcgtggtcgcatactgtaagacgaagaaacaacgcaaaaagctgcacgatcgcctccggcagtctctccgctccgaacgcaataacatgatgaatatcgccaatggcccacatcaccctaacccgccaccggaaaatgttcagctggtcaatcagtacgtgtcgaaaaacgtgatctcctccgagcacatcgtggaacgggaagcggaaaccagcttctctacctcccactacacctccaccgcgcaccacagcactaccgtcacgcagactccgtcccacagctggtcaaacggccataccgagtcaatcctcagtgagtcgcacagcgtgatcgtcatgtcgtcagtggaaaattcacggcacagctctcccacggggggtcctcggggacgactcaatggaactggcggacctagagaatgcaactcattcctgcggcacgcccgcgaaacccccgactcctacagggattcgcctcattcggagcgctacgtttccgcgatgaccactccggcacgcatgagcccggtggattttcacaccccttcgtccccgaagtcgccgccgtccgaaatgtccccaccggtgtcatctatgactgtctcgatgccgagtatggcagtgtcgccattcatggaagaggaacgccctctgctgctggtcactcccccaaggctgcgggaaaagaagttcgaccaccatccacaacagtttagctcatttcatcataacccggcgcatgacagcaactcactccccgccagcccgctgcggatcgtcgaggacgaagagtacgaaaccactcaggagtatgagcctgctcaggagcctgtgaaaaagctcgccaactcgcggcgcgccaagcgcacgaagccaaacgggcacatcgccaacagactggaggtggactccaacacgtcgtcgcagtccagcaacagcgaatcggaaaccgaagatgagagggtgggagaagatactccgttcctcggaatccaaaatccgctcgcagcctccttggaagcgactcccgcgttccgcctcgcggactcgcggaccaatccagctggccggttctcgactcaggaagagatccaggcccggctctcgtccgtcatcgccaatcaagaccctatcgcggtg

SEQ ID NO: 17416 - DNA, 1911 bp, Artificial Sequence
  Description of Artificial Sequence: Synthetic coding sequence
atgtccgaaagaaaggagggtagagggaaaggtaagggaaagaaaaaggaacggggatccggcaagaagcctgagagcgcggcaggttcacaatcaccggcgctgccgccacgtcttaaggagatgaaatcccaggaaagcgcagcaggttccaagctggttctcagatgtgaaacctcgagtgaatactcgtcgcttcgttttaagtggttcaaaaatggaaatgagcttaatcgaaagaacaagcctcagaacatcaagattcaaaagaagccaggtaaatctgagctgcggatcaataaagctagcttggcagatagcggagaatacatgtgtaaagtgatatccaagctcgggaatgatagcgcttccgccaacatcaccattgtggagtccaacgagattatcaccggcatgccagcttctaccgaaggggcatacgtgagctcggagtcgcccataaggatctccgtctcaaccgaaggagcaaacacttcgagctccacttcaaccagcactactggtacttcccatctggtgaaatgcgcagaaaaggaaaaaactttctgcgtaaatggaggtgagtgcttcatggtgaaggacttgtcgaacccatccagatacctttgtaagtgccccaatgaatttaccggtgaccgctgccaaaactacgttatggcatccttttacaaagcagaggaattgtaccagaagcgcgtcctgaccatcaccggaatatgtattgctcttcttgtggtgggtattatgtgcgtggtggcatattgtaagactaagaaacagagaaagaaacttcacgaccgactgaggcaatcactgagaagcgaaagaaacaacatgatgaatatcgcgaatggcccacatcatccaaacccgccccctgaaaacgtgcagcttgtcaatcagtacgttagcaagaatgtgataagctcggaacacattgtggaaagggaagcagagacgtcgttctcaacttcgcattatacctcgaccgcgcatcatagcaccaccgtgacccagacgccctcccattcatggtcgaacggacatacggagtcaattctttccgaatcacactccgtgatagtgatgtcgtccgtggaaaattcccgacattcatctccgactggaggacctaggggacgcttgaatggtaccgggggtccacgagagtgtaacagctttcttaggcacgcaagagaaacccctgattcataccgcgactcccctcatagcgaacggtacgtgtccgcgatgaccaccccagcacgcatgtcgccagtggatttccataccccttcgtcacctaagtcgccaccctcagagatgtcccctcctgtgtcctcaatgacggtgtcgatgccgagcatggctgtctcgccgtttatggaggaagaacgaccgctgcttttggtgactcctccgaggctgagagagaagaaatttgaccaccaccctcaacaattcagctcgtttcatcacaacccagcacatgattcgaacagcctcccagcatccccactccgaatagttgaggacgaagaatacgagactactcaggaatacgagccggcgcaggaaccagtcaagaagctcgcaaactcgcggcgagcaaaaaggaccaagcctaatggacatatcgcgaaccggctcgaagtggattctaatacttcgtcccaatcgtcgaattcggagagtgagactgaagatgaacgtgtcggagaagataccccatttctgggcattcaaaatcctctcgcagcatcccttgaagcaacccccgcattccgcctggccgactccaggaccaaccccgccgggcgtttctcaacccaagaggagattcaggcaaggctttcaagcgtcattgccaatcaagacccgatagcagtg

SEQ ID NO: 17417 - DNA, 1911 bp, Artificial Sequence
  Description of Artificial Sequence: Synthetic coding sequence
atgtcggagcgaaaggagggacgcggcaaagggaagggtaagaaaaaagagcgaggctccggcaagaagccggaatccgcagcgggatcccaatcaccagctcttccaccaaggctcaaggaaatgaaatcccaggaatcagcggccgggtcaaagctcgtcctgcggtgcgagacttcatccgaatactcgtcgctcaggttcaagtggttcaagaacggtaacgagcttaaccgcaagaacaaaccgcagaatatcaaaatccaaaagaagccgggaaaatcagaattgcggatcaataaggcgtcacttgcggactcgggagaatacatgtgcaaggtcatctcaaagctcggaaatgactccgcgtcggcaaacatcaccatcgtggagtctaatgaaatcatcacgggaatgcctgcttccactgaaggcgcctacgtctcctccgaatcgccgatccgcatctcagtcagcactgagggagcgaacacctcatcctccacttcaaccagcactaccggtacttcccacctcgtgaaatgcgccgaaaaggaaaaaaccttttgtgtgaacggaggtgaatgcttcatggtcaaggacctgagcaacccaagcagatacctctgcaagtgcccaaacgagttcactggcgaccgctgccagaactacgtgatggcatccttttacaaagcagaggagctctaccagaagcgggtgctgaccatcactggcatctgcatcgcgctccttgttgtgggcattatgtgcgtcgtcgcctactgcaagaccaaaaagcagagaaagaagctccacgatagactgcggcagtctcttaggtcggagcggaacaatatgatgaacatcgccaacggaccccatcatccgaacccaccaccggaaaacgtgcagctggtcaaccaatacgtgagtaaaaacgtgatttcgtcagaacacatcgtcgaacgggaggccgagacttcgttttccacctcgcactacacttccacggcccatcactcgaccactgtcactcagactccttctcatagctggtcgaatggccatactgaatccatcctgtcagagagccactcagtgatcgtgatgtcaagcgtggaaaactcacggcactcgtcgccgacgggcgggccgcgcggacgcttgaacggtaccggaggacctcgcgaatgcaactcgtttcttcgccatgcgcgcgaaaccccggactcctacagagatagcccgcactcggaacggtacgtgtcggccatgactactccggctaggatgtcaccagtcgacttccacactccgtcgtcgccaaagtcgccgccatccgagatgtccccgcctgtgagctccatgaccgtcagcatgccatccatggctgtgtcgccattcatggaagaggaaaggccgctgttgctcgtgaccccgccccggctgcgcgaaaagaagttcgaccaccacccacagcagttctctagcttccatcataaccccgcccatgattccaattcacttccagccagcccgctgagaatcgtggaagatgaagaatatgagactactcaggagtacgaacccgcccaggagccggtgaagaagctcgcgaacagcagaagagcaaaaagaacgaagccaaatggccacatcgccaaccggcttgaagtcgatagcaacacttcctcgcaatcgtcaaactccgagagcgaaaccgaggatgaacgcgtgggggaggatactccgttcctgggaatccagaatccgctcgcggctagccttgaagcaactccggctttccgcctcgcggatagccgcaccaatccggcgggcagattttcgactcaagaagaaattcaggcacggctttcgtccgtgatcgccaaccaggacccaatcgcagtg

SEQ ID NO: 17418 - DNA, 1911 bp, Artificial Sequence
  Description of Artificial Sequence: Synthetic coding sequence
atgtctgagagaaaggaaggcaggggcaagggcaaaggaaaaaaaaaggagcgcggatccggcaagaagcctgaatctgctgcaggatctcagtcacctgctctgcctcctaggctcaaggaaatgaagagtcaggaaagcgccgccggaagcaagctggtgctcaggtgtgaaaccagctcagaatatagcagccttagattcaagtggtttaaaaacggaaatgagctgaacaggaaaaacaaaccccagaacatcaaaatccaaaaaaagcctggcaaatctgaacttcgtatcaacaaggcatctttagcagatagcggagagtacatgtgtaaggttattagcaaactgggaaacgactctgcaagcgctaatattacaattgtcgaatccaacgagataatcaccggcatgcctgcctctacagaaggcgcatatgtgagttccgaatctcccatcaggatcagtgtgtctactgagggcgcaaacacctcaagctccacaagcacaagcaccacaggcacctcacacctcgtaaaatgtgccgagaaggaaaagaccttttgtgtgaacggcggggagtgctttatggtgaaggatttaagtaatcccagccgttacctttgcaaatgccccaacgagttcaccggcgaccggtgtcagaactacgtcatggcttctttctataaagctgaggaactctaccagaagagggtgctgacaatcaccggcatttgcatcgcactcctggtcgtcggaattatgtgcgtggtggcctactgcaagacaaaaaagcagaggaagaagctgcatgaccgccttagacagtctctgcgatccgaaagaaataatatgatgaacatcgctaatggccctcaccaccccaaccccccccctgagaacgtgcaactggttaatcagtatgttagcaagaatgtaatcagctcagagcatatcgtggagagggaagcggaaactagtttttctactagtcactacacatcaaccgctcaccactccacaactgtcacccaaacgccctcccattcctggtcgaatggccacacagagagcatcctgagcgagtctcacagtgtcatcgtaatgtcttcagtggaaaacagccgccacagctctccaactggaggacccagggggagacttaacggcactggtgggccgcgtgagtgcaacagtttcctgagacacgcgagagagacgcctgactcttatcgtgactcgccccatagcgagcgatatgtaagtgcaatgaccacaccggccagaatgagtccggtggattttcacaccccctcatcacctaagagcccacctagcgaaatgtcacctcctgtgagtagcatgacagtgagcatgccttccatggccgtcagcccttttatggaggaagaaaggccacttctcctagtgacccccccaagactcagagaaaaaaagttcgaccatcaccctcagcaattctcctcttttcaccacaatccggctcacgactccaacagcctgccagcttcacccttgcgaattgttgaagacgaagagtacgagactactcaagagtatgagcctgcccaggagccagtgaagaagctggcaaatagccgcagagctaagcggaccaaacccaacggtcatattgccaacagactggaagtagatagcaacaccagcagccaatcgagtaatagtgagagtgagactgaggacgagagagtaggcgaggacaccccattccttggtatccagaacccactggctgccagcctcgaggcaacccctgctttcagactggccgacagcagaactaatccagccggaagatttagcacacaggaggaaatccaggcacgtcttagcagcgtgattgccaaccaagacccaatcgccgtt

SEQ ID NO: 17419 - DNA, 1911 bp, Artificial Sequence
  Description of Artificial Sequence: Synthetic coding sequence
atgtctgagaggaaggagggtagaggcaagggcaagggtaagaaaaaggagaggggtagtggaaagaagcccgagtctgccgccggaagccaatctcctgccctgccccctagattgaaagagatgaaaagtcaggaatctgctgcaggttctaagctggtgctccgctgcgaaacctcttccgagtactcatctttgcgttttaagtggttcaagaacggtaacgaactgaataggaagaacaagcctcagaacattaaaatccagaaaaagcccggaaagtctgaacttaggattaacaaggcctccttggctgactcaggcgagtatatgtgcaaggtcataagcaaactcggtaacgatagcgctagtgccaacattacaattgtggagtccaacgagatcataacaggaatgccagcatcaactgaaggagcctatgtctccagcgagtccccaattcgtatctctgtttccactgagggagctaatactagcagctctactagtactagcacaactggcaccagtcacctggtgaagtgtgcagagaaggagaagacattttgcgttaacggtggtgaatgctttatggtgaaggatctcagtaacccctccagatatctgtgcaaatgcccaaatgagttcacaggcgataggtgccaaaattacgtaatggcctccttttacaaggccgaagagctctatcagaagcgcgtcctgaccattaccggaatctgcatcgcactcctcgtggtcggtatcatgtgtgtggtggcctactgtaaaaccaaaaaacagagaaagaagttgcatgacaggctgagacagagtctgaggagcgagaggaacaatatgatgaacatcgctaacggacctcaccatcctaaccctccacctgaaaatgtgcagctcgttaatcaatatgtttctaaaaacgtcataagcagtgagcacatcgtggagagagaggccgagacaagtttctcaaccagccactatacctcaacagcccaccattccacaaccgtaacccaaacaccctcccatagctggtcaaacggccacactgagagtatcctctccgagtctcatagcgtgatcgtgatgtcctcagtcgagaattcccgtcacagttcccccacaggtggtcctagaggacgtctgaatggaacaggtggacctagagagtgcaacagttttctgcgtcacgcccgcgaaacccccgattcataccgtgattctccacactctgagaggtacgtgtcagctatgaccacacccgctagaatgtctccagtcgacttccacaccccaagcagtcccaaaagtccaccttccgaaatgagcccccctgtgtcttccatgaccgtttccatgccctctatggccgtttcccctttcatggaagaggaaagacccctgctgttggtgacaccccccagactgcgtgagaagaagttcgaccaccacccccagcaattctcttcttttcaccacaaccccgcacacgattccaattccttgcctgcctccccactgagaatcgtggaagacgaggagtatgagaccacccaagaatacgagcctgcccaagagccagtaaagaaactggctaacagtcgtcgcgcaaagcgtaccaagcccaacggacatatcgcaaacaggctcgaagtggacagcaacacttcatcccagagtagcaactcagagtctgagactgaggacgaacgcgtcggcgaggacactcccttccttggcatccagaatcccctggctgccagtcttgaggcaactcctgcatttaggctggcagattctagaaccaacccagcaggtcgtttctccacacaagaggagattcaagcccgtttgtccagcgttattgctaatcaagaccccattgcagtg

SEQ ID NO: 17420 - DNA, 1911 bp, Artificial Sequence
  Description of Artificial Sequence: Synthetic coding sequence
atgtcagaacggaaggagggccggggaaaaggtaagggaaagaagaaagaaagggggtcgggaaaaaaaccggaatcagctgccggcagccagagccccgccctcccccctcggttgaaagagatgaagtcacaggagtccgctgcagggagcaagttggtgcttcgctgcgagacctcctccgagtactcaagcttaagattcaaatggttcaagaacgggaacgagctgaaccgaaagaataaacctcagaatatcaaaattcaaaagaaaccgggaaaatccgaacttcggataaataaagcatccctggcagactctggtgagtatatgtgtaaggtaatctctaagttgggcaacgacagtgcctctgcgaacatcaccattgtggagtcaaacgagattataacaggcatgccggcctcgaccgagggtgcgtacgtctcttccgagtccccaattcgcatctccgtgagcacagagggtgcgaacacctcatcgtccacaagcaccagcactactgggacctctcacctggttaagtgtgcggaaaaggagaagacattttgcgtgaacggtggtgagtgtttcatggtaaaggacctgtccaatccaagtcggtatttatgcaagtgtccgaacgaatttaccggtgaccgctgtcaaaactatgttatggcatctttctacaaggccgaggagctctaccagaaacgggtgttgactatcaccggaatctgtatcgccctcctggtggttgggatcatgtgcgtcgtagcctactgcaagactaaaaagcagagaaaaaagctgcacgaccgactaagacagtccctgcgctctgagcgaaacaacatgatgaacattgcaaacgggcctcaccacccaaacccgccaccagaaaatgtccaattggtgaatcagtacgtttcaaagaacgtcatctccagtgagcacattgttgagcgggaagcagagactagtttctccactagccactataccagcacggcccaccactctacaaccgtaacacagacccctagccattcttggtcaaacgggcacaccgaaagcatcctatccgaaagccatagtgtgattgtgatgtcatcagtggagaattccagacacagctctccaaccggaggacctagaggacgactgaacggaacaggcggcccacgggaatgcaattctttcctgaggcacgcccgcgagactccagacagttaccgggatagcccccattctgaaagatacgtgtcagctatgaccacacccgcccggatgtctccagtggacttccacacaccttctagtcccaaaagcccgccttcagagatgtccccccccgtgagcagcatgacagtatccatgccttccatggctgtgtcgccttttatggaggaggaacgccctctgctccttgtcactccaccccgcttacgggaaaaaaagtttgaccaccatcctcagcagtttagcagcttccaccataatcccgcgcatgattcaaacagtcttccggcctccccgctgcgaattgtcgaagacgaagaatatgagaccacgcaggagtatgaacctgcccaggagccagtcaagaaattagcaaactctcggagggcaaaacggactaagccaaatggccacattgctaacaggctagaggtggactctaatacaagctcccaatctagtaatagtgagtctgagactgaagacgagcgagttggagaggatactccctttctaggtatccagaacccactggccgcttctcttgaggccacccccgcctttaggttagcagatagtcgcacaaatcccgccggacgattttcaacccaggaggaaatccaggccaggttgagtagtgtgatcgcaaatcaggatcccattgccgtg

SEQ ID NO: 17421 - DNA, 1911 bp, Artificial Sequence
  Description of Artificial Sequence: Synthetic coding sequence
atgtctgaaaggaaggaaggacggggcaaaggaaagggaaagaagaaggaaagagggtcaggaaagaagccagagtccgcagcaggaagccagtcccctgcattgccccccagacttaaagaaatgaagtcccaagaatccgcagcaggtagtaaactcgtgctccgatgcgagacgtcgtcggaatatagctcgctgagattcaaatggtttaagaacggaaatgaacttaatagaaagaataagccgcaaaacattaagattcaaaagaagcctggcaagtccgaactgcggattaacaaagcaagcctggccgattcaggagaatacatgtgcaaggtgatttccaaactgggaaacgactcggctagcgcgaacattactattgtcgaaagtaatgagattatcaccggtatgcccgcgagcactgagggcgcatacgtgtcgtcggaatcgccaataagaatctccgtttcaaccgaaggtgcgaatacttcaagctccaccagcacctcgaccaccggtacttcacacctggtcaagtgcgccgaaaaggaaaagaccttttgtgtcaatgggggagaatgctttatggtcaaggacctctcgaaccctagcaggtacctttgtaaatgtccaaacgaattcactggtgaccggtgtcagaactacgtgatggcatcgttttacaaagcagaagaactgtaccagaagcgggtgcttacgattactggtatctgtatcgcacttctggtggtcggcatcatgtgtgtggttgcatactgtaagactaaaaagcagcggaaaaagctccatgatcggctgcggcaatcgcttcgctccgaaagaaacaacatgatgaacatcgcgaacggacctcatcacccaaacccccctcccgagaacgtccagctcgtaaaccaatacgtaagcaaaaacgtgatttcctccgaacatattgtcgagcgagaggcagaaaccagcttttcaacttcacactacacttccactgcgcatcattcgaccacggtgactcagactccgtcgcattcgtggtcaaatggacacaccgagagtatcctgtcggaatcgcatagcgtgattgtcatgagttcggtggagaactcacggcactccagtccgactggaggacccagaggccgtcttaatggaaccggaggtcctcgggaatgcaattccttcctccggcatgcccgggaaacccctgacagctaccgtgacagcccacatagcgaacgctatgtcagcgcaatgaccaccccagctaggatgtcccctgtggactttcacacgccaagctcccctaagagcccgccctcagagatgtctccaccagtctcgtccatgacggtgtccatgccctcgatggcggtgtcaccctttatggaggaagaacgccctcttctgttggtgacccctcccaggcttcgcgagaagaaatttgatcatcatccccaacaattttcttcattccaccataaccctgcgcacgattcaaactcgttgccagcatcaccgcttaggatcgtggaagatgaggagtacgaaaccacccaggagtacgaaccagcgcaggaacctgtcaagaaacttgcgaactcgagacgagccaagcggaccaaacctaatggtcatatagcaaaccgtctggaggtggatagcaataccagctcgcaatcttccaatagcgagtcggaaaccgaggatgaaagggtgggtgaagataccccattcctgggtattcaaaatccacttgcagcatccctcgaagcgactcctgcgttccgtctggctgatagcagaactaacccagcaggtagattctccacccaagaggagattcaggcccgcctgtcctcagtgatagcaaaccaagatcccatcgccgtg

SEQ ID NO: 17422 - DNA, 1911 bp, Artificial Sequence
  Description of Artificial Sequence: Synthetic coding sequence
atgagcgagaggaaagaagggagagggaaaggcaaaggtaaaaagaaggagcgggggtcaggcaagaagcccgagagtgcggctgggtcccagagtcccgcgctgcctccccgtttgaaagaaatgaaatcacaggaatccgccgccggtagtaagctagtgctgcgatgcgaaactagcagcgagtattcctcgctgagattcaagtggttcaagaatgggaacgaacttaatagaaaaaacaagcctcagaatatcaagattcagaagaaaccagggaaatccgagctgcggataaacaaagcctctctggccgactcgggggagtatatgtgtaaagtcatctctaaattaggtaatgattctgcctcagcgaatataacaatcgtggaaagtaatgaaataataaccggcatgcccgccagcacagaaggggcatacgtgtcatcggagtcaccgatcagaataagcgtttccacagagggtgccaacacgtcttctagtaccagtacctcaacaaccgggactagtcacttggtaaagtgcgctgagaaagaaaagacgttttgcgtgaatggcggagaatgcttcatggttaaggacttgagcaatcccagcagatacctctgcaagtgtcctaacgagtttaccggcgaccgttgtcagaattacgttatggcgtccttctataaggctgaggagctttatcagaaacgagttctcacaattaccggcatttgcattgcgctgttggttgtgggcataatgtgcgtggtcgcttattgcaagaccaaaaagcagcgtaagaaactccacgatcgactaaggcagtccctgcgatcggaaagaaacaacatgatgaacatcgcaaatggtccacaccatcccaatccaccccctgaaaatgtgcaactggtgaaccagtatgtcagcaagaacgtcatctcctctgagcatatagtggagagagaagctgagacatctttttcaacctcacactatacctctaccgctcaccattccacaactgtcacccagactcccagtcactcttggagcaatggacacaccgagagcattctcagtgagtcgcactccgtgatcgtgatgtcctccgtggagaacagcaggcactctagtccaactggagggccacggggtaggctaaacggaacaggcggcccaagagagtgcaattccttcctgcgacatgcccgtgaaacacccgactcgtatcgagactcgcctcatagcgagcgatacgtctccgccatgaccacaccagcccgaatgagtcctgtggactttcataccccatcaagcccaaagtctccccctagcgagatgagcccaccagtgtctagtatgactgtgagcatgccctctatggcagtgagtccattcatggaagaggaaaggccgctgctgctggtgactccccctcggctgagggagaaaaaattcgatcatcatcctcagcagtttagttcttttcaccataaccccgcacatgactccaacagtttacctgcctcgccgctccgaatcgtcgaagacgaagagtacgaaaccacgcaggagtatgaacccgcccaggagcccgttaagaaactggccaactccagacgggctaaaaggactaagccgaatggtcacatcgctaaccgcctggaggttgacagtaatacaagtagccagtcaagcaatagcgagagtgagacggaggatgaacgtgtcggcgaagacaccccattcttgggtatacagaatccactggccgcatcattggaggcaacgccagctttccgtttggccgattcaaggactaatccagccggacgtttttctacacaggaagaaatccaggctagactctcctctgtcatagcaaaccaggaccctattgcggta

SEQ ID NO: 17423 - DNA, 1911 bp, Artificial Sequence
  Description of Artificial Sequence: Synthetic coding sequence
atgtccgagcggaaggagggtcgcggcaagggcaagggcaaaaaaaaagaacggggctcagggaaaaagccggagagcgctgccggctcccagtctcccgctcttcccccaagacttaaggaaatgaaaagccaagagtcagctgcaggttctaaactggtgcttaggtgcgagactagctccgaatacagttccctgaggtttaagtggttcaagaacggaaacgaactgaaccggaaaaataagccccagaatattaagatccagaaaaaacccggtaagtccgagctccgaatcaacaaggcgtcccttgctgactctggcgagtatatgtgtaaagtgatttccaagttggggaacgacagcgcttcagccaatatcacaattgtagagtctaatgaaatcatcacaggcatgcccgccagtacagaaggcgcatacgtgtctagtgagtcacctatcaggatatccgtatctaccgaaggagctaacacatcgtcctcaacttccacgtcgacaaccggtacttcccatcttgtgaagtgcgccgagaaagagaagaccttctgcgtaaacgggggagaatgttttatggtgaaggacctgtccaatccctcccgctatttatgcaagtgccccaacgagttcaccggtgaccggtgccagaattatgtgatggctagcttctacaaagccgaagagttgtaccagaagagagtgctgacgattaccggtatttgtatcgctcttctggtggttggaatcatgtgtgtcgttgcctactgtaaaacgaagaagcagcgcaagaagctgcacgatcgtctgcggcagtctctccggagcgaacgaaataatatgatgaatattgccaatggcccacaccatccaaaccccccccccgagaacgtacagctggttaaccaatacgtcagcaagaatgttatctcatctgagcacatcgtcgagagggaggcagagactagttttagtacctcacactacaccagtacggctcaccacagtactacagtgacacaaaccccctcccacagttggtcaaacgggcacaccgagagcatcctttccgaatcccattccgtaattgtgatgagtagcgtggagaattctcgtcactcgtccccgactggcggaccgcgcggcagactaaatggcaccggcggaccgcgggaatgtaactcatttctgcggcatgcccgcgagacaccagactcctaccgggactctccccactccgagcggtacgtctctgctatgacaacccccgccaggatgtctccagtagattttcacactccttcttctcctaagtcaccgcccagtgagatgagcccaccagtgagcagcatgacagtttccatgccttccatggctgtgtctcctttcatggaagaggaaaggcccctgctgcttgttaccccaccccgcctccgggagaagaagttcgatcaccatccccagcagttttcatcctttcaccacaaccccgctcatgacagtaacagcttacccgcgagccccctacgtatcgtggaagacgaggaatatgaaaccactcaagagtatgagcctgcccaagaaccagttaaaaagttggctaactcacgccgggcgaaacggactaaacccaatgggcacatcgctaatcgactagaggtggatagcaacactagttctcagtcgtctaacagtgagtccgaaacagaggatgagcgggtaggggaagacactccgtttttaggtattcaaaaccctctggctgcttccttagaagcgaccccggcatttcggctggccgattctagaacgaaccccgctggcaggttctcaactcaggaagagattcaggcacgactgagtagtgtaattgcgaatcaggatcctatcgctgta

SEQ ID NO: 17424 - DNA, 1911 bp, Artificial Sequence
  Description of Artificial Sequence: Synthetic coding sequence
atgtccgagagaaaagaaggacgaggcaagggaaaaggaaagaaaaaagagagaggcagtgggaaaaagcccgagagcgctgctggctctcaatctccagctctgcctccccggctgaaggaaatgaagagccaggagagcgcagccggcagcaaactggttttacgatgtgagacctccagtgaatacagcagcctccgctttaagtggttcaaaaacggaaacgaactgaataggaaaaataagccacagaacattaagatccagaaaaaacccggcaaatcggagctgcgaattaacaaggcctcactagccgactcaggagaatacatgtgtaaggtcatctcaaagctcggcaacgacagcgcttccgctaacattactattgtggagtccaacgaaatcatcaccggcatgcccgcttccactgagggcgcatacgtgagctctgagagcccgattagaatttccgtgagtacagaaggcgctaatacttccagctccacaagtacttctacgactggcacctcacatcttgtgaagtgcgccgaaaaagagaagaccttttgtgtcaatggcggggagtgttttatggtgaaggacttgtccaacccaagcagatacctttgcaagtgccccaacgagtttactggagacagatgtcagaactacgtgatggcctccttctacaaagccgaggagctttatcagaaacgggtgttaaccataacgggaatctgcatcgccctgttagttgtggggataatgtgcgttgtagcgtactgcaagacgaagaagcaaaggaagaagctccacgatcggctgaggcagtcacttagaagcgagcggaacaatatgatgaacatcgccaacggccctcaccatcctaatccccctccagagaatgttcagctcgtgaaccagtatgtcagcaagaatgtcatctccagcgaacatattgtggagcgcgaggccgagacgtctttcagcacgtcccattatacttcaactgctcatcattctactacagtgactcagactccttcacattcttggtccaatggacataccgagtccatcttgtctgaaagtcattctgtgattgtaatgtctagcgttgaaaactccagacactcctccccgactggcggacctcgaggtcgcttaaatggtactgggggaccacgggaatgtaactctttcctcagacacgccagagaaactcctgatagttacagagattcaccacattccgagcgatatgtctctgctatgacaactccagcaaggatgagccctgtcgacttccacaccccatcctccccaaagtcaccgccaagcgagatgagccctcctgtgtcctccatgacagtgtcaatgccgtccatggccgtgagtccatttatggaggaagagcgtccgctcctcttggtcacacccccacggctgagggaaaagaaatttgaccatcacccccagcagttcagctctttccaccataatcctgcacatgattccaacagccttccagcaagtcctttgagaatcgtagaggacgaagagtacgagacgacgcaggaatatgaacccgctcaagagccggtgaaaaagctggctaacagtagacgcgctaaacgcacaaaaccgaatggccatattgcaaaccggctggaggttgattctaatactagcagtcagagttccaactccgagagtgagactgaagacgagagggtaggggaggacaccccgtttttgggaatccaaaacccactcgccgcttcactggaggccacccccgctttccgcttggctgactcccgaaccaaccccgcgggaagattttcaacacaagaggagatccaggcccgtctgtcttctgtgatagctaaccaagacccaatagcggta

SEQ ID NO: 17425 - DNA, 1911 bp, Artificial Sequence
  Description of Artificial Sequence: Synthetic coding sequence
atgtcagagcgaaaggaaggacgaggtaagggaaagggtaagaagaaggagcgcggcagcggcaagaaacctgaatccgcagcagggtctcagtcccctgccttgcctcccaggttgaaggagatgaagtcacaggaatcagcggcgggcagcaaattagtgctgaggtgcgaaacaagcagtgagtacagttccctgagattcaaatggtttaaaaacggcaacgagttgaaccggaagaacaagccgcaaaacatcaaaatccaaaagaagcctggtaagtcagagctgcggatcaacaaagcgtcacttgccgactcaggtgaatatatgtgtaaggttatttccaagcttggtaatgattcagcatctgctaacattactatagtcgagtcaaacgaaataataacgggaatgccagcgagcacagagggggcctatgtctctagcgagagtcctatacgtatcagcgtgtccacagagggggcaaatacctccagcagcacctccacatcaaccacaggcacgtcccacttggtcaaatgtgctgagaaggagaaaactttttgcgttaatggtggagagtgtttcatggtgaaggacctttccaatcccagtcgctacttgtgtaaatgccccaatgaattcactggggacagatgtcagaattacgttatggcctcgttctataaggccgaagagctctaccaaaagcgagtactgactatcactgggatctgcatagccttgctggtggtcggaattatgtgcgtggttgcatattgtaaaacaaagaagcaacgaaaaaaactgcatgataggctgcgccagtcactgcgtagcgaacgtaacaacatgatgaacatcgcaaatggcccgcatcatccaaatcctcctccggagaacgtgcagctggtgaaccaatatgtgtcaaagaatgttatatcttcagagcatattgtagaacgcgaagcagaaacttccttttcaacctcccattataccagtaccgcacaccacagcacaaccgtcactcagacaccttcccattcctggagtaacggacacacggagagtatcctgtcggagagccacagcgtgatcgttatgagtagtgtggagaattcacgccacagcagtccgactggcggcccccgcgggcgtctaaacgggactggaggaccccgcgaatgcaatagtttcctgaggcacgctagggaaacccctgattcataccgggactcaccacactcagagcgctatgtgagtgcaatgacaacaccagctcggatgagccctgtggacttccacacgcccagttctcctaaaagccctccatccgaaatgtctcctccggtaagctctatgacggtgtcaatgccctcaatggcggtttccccttttatggaggaggagaggcccctgctgctcgtgaccccaccccgactgagggagaaaaagttcgaccaccacccccaacagttctcatcatttcaccacaatcccgcacacgactctaacagtcttccggcgagcccattgcgcatcgtcgaggacgaagagtacgagaccactcaggaatatgagccggctcaggagcccgtgaagaagctggccaactcccgacgggctaagcgtacaaagcctaatgggcacatagccaataggctagaggttgactcaaacacttcctctcagtcgtctaattcagagagcgagacagaggacgagagggtgggggaagatacacctttccttggcatccaaaatcccttggctgcgagtctggaagccaccccagctttcaggctggcagattctagaacaaacccagccggccgattctctacacaagaagagatacaggcgaggctctcatccgttatcgccaaccaggatcctatcgccgtg

SEQ ID NO: 17426 - DNA, 1911 bp, Artificial Sequence
  Description of Artificial Sequence: Synthetic coding sequence
atgtccgaacgtaaggagggtcggggcaaaggtaagggaaaaaaaaaggaaagaggcagcgggaaaaaacccgagagcgctgccggatctcagtcccccgccctaccacctcggctcaaagagatgaagagccaagaatcagctgctgggtctaagttagtcctcagatgcgagacctcatcagaatactcttcattgcgcttcaaatggttcaagaacggcaatgagctgaataggaagaacaagccacagaacataaagattcagaagaagcctggtaagagcgaactgaggataaacaaggccagcttagccgactccggggaatatatgtgtaaggtgatctctaagctgggaaatgattcagcctctgctaacattaccatagtcgagagcaatgagatcatcactggaatgccagcttccaccgagggagcctatgtgtcatccgagtctccaatccgcatttccgtctcaactgagggcgccaatacgtcttcatcaacaagcactagtactactgggacctctcatttagtgaagtgtgccgagaaggaaaaaactttctgtgtgaatgggggcgaatgcttcatggttaaagatttgagtaatcccagtcgttatctctgtaaatgcccaaatgagttcacgggcgaccggtgtcagaattacgttatggccagtttttacaaagctgaggagctgtatcaaaaaagagttctaaccatcacgggtatttgtatagctctgcttgtggtcgggattatgtgtgttgtagcttactgcaagactaaaaagcaacggaaaaaattacatgacaggctgaggcagtcactgcgctccgagcgcaacaacatgatgaatatagctaatggaccacaccacccgaaccccccccccgagaatgtccagctagtaaaccagtacgtgagcaagaatgtgatcagctccgagcatatcgtggaacgcgaagctgagacttccttttctacttcccattatacttctacggcacaccatagcactaccgtaactcaaacacctagtcattcttggagcaacgggcacacagagagcatcttgtccgaaagtcattcggtgattgtaatgagctcagttgagaattctcggcacagctcaccgacaggcggccctaggggcagactcaatggtaccggaggcccaagagagtgtaactctttcttgagacacgcacgggaaactcctgactcctatcgggattccccacatagcgagcgctacgtcagcgccatgacaacccccgccagaatgagtcccgttgattttcacacacccagctcccccaagtctcctccatctgaaatgtccccacccgtgagcagcatgaccgttagtatgccatccatggctgtctcgccatttatggaagaagagcgtcctttgctcctcgtaactccacctagactacgcgagaaaaaatttgaccatcatccccagcagttctcttcctttcaccacaatccagcccacgatagcaactctcttcccgcgagtccactgcggatagtggaggatgaggagtatgaaaccacccaggagtacgagccggcacaggagccagtgaagaaactggcgaactcgcgacgcgctaaaaggactaagcccaacgggcacatcgcaaataggctggaagtggattcgaacacctcatcgcagtcttccaacagcgagagcgaaacggaggacgagcgggttggcgaagacactccattcctcggaattcagaacccgctggccgcttctcttgaggcaacccccgcttttcgccttgccgatagtcggacgaaccccgctggccgctttagcacacaggaggagattcaggcaaggttaagcagcgtaattgcgaaccaagacccaatcgctgtt

SEQ ID NO: 17427 - DNA, 1911 bp, Artificial Sequence
  Description of Artificial Sequence: Synthetic coding sequence
atgtccgagagaaaagagggcaggggaaagggaaaggggaagaagaaggagcggggctccggaaaaaagcctgaatccgcagcaggatcgcagtctccggcgctgccgccaagactgaaggagatgaagtcacaggagtcggcggcgggatccaagctcgtgctgagatgcgaaacttccagcgagtactcgtcgctgagattcaaatggttcaagaacggaaatgagctgaacaggaagaacaaaccacagaacataaagatccaaaagaagcctggaaaaagcgaacttcggattaacaaggcttccttggctgattcaggggagtacatgtgcaaggtgatctccaagctgggaaacgattcggcgtcagcgaatatcacgatcgtcgaatcgaatgagatcatcactggaatgccggcctccacggaaggcgcctatgtgtcgtcggagtcccccatcagaatctccgtgtccaccgagggagcaaacacctcgtcgtcgacttcaactagcaccactgggacctcccacctggtgaagtgcgcggaaaaggaaaagacgttctgcgtcaacggaggcgaatgtttcatggtgaaggacctctcaaatccgagccggtacctgtgcaaatgtccaaacgagttcaccggagatcgctgccagaattacgtgatggcatcattttacaaagccgaagagctgtaccagaaacgggtcctgactatcactggcatctgcatcgccctcctggtcgtcggaatcatgtgcgtggtggcatactgcaagaccaagaagcagaggaagaaactgcacgaccgcctgagacagtcgctcagaagcgagaggaacaacatgatgaacatcgcgaacggaccacaccacccgaatccgccgcctgaaaacgtgcaactggtgaaccaatacgtgagcaaaaatgtcattagcagcgagcacatcgtggaaagggaagcggagacgagcttttctacctcgcactacacttccaccgcccatcattctaccaccgtgacccagactccgtcacactcatggtcgaatggtcatacggaatcgattctgtccgagagccactccgtcatcgtcatgtcgtcagtcgagaactcccggcactcaagcccgaccggaggcccccggggccggcttaatggaaccggagggccacgggagtgcaattccttcctgagacatgcaagagagactccagacagctacagggactccccacattccgagcggtatgtgtcagctatgactacgccggcacgcatgtccccagtggattttcacaccccgtcgtcgccaaaatcgcctccctcggagatgtcgccaccagtgtctagcatgactgtgtcgatgccgtccatggccgtgagcccgtttatggaagaagagcgcccacttttgctggtcaccccaccgcgcctccgggagaagaaattcgaccaccacccccagcagtttagctcattccatcataacccggcgcacgattcgaattcccttccggccagccccctgcgaatcgtggaggacgaggagtacgaaaccacccaagagtacgaacccgcccaagaaccggtgaaaaagctggccaattcgcgccgcgctaagaggaccaagccaaacggacacattgcgaataggctggaggtggacagcaacacctcaagccagtcatccaattcggagagcgagactgaggacgaacgcgtgggtgaagataccccattcctcggtatccagaacccgttggctgcatccctggaagcaactcccgcgtttcggctggcggactccagaactaacccagcgggacgcttttcgacgcaagaggagatccaggcccgcctgagctccgttatcgcgaatcaggaccctatcgcggtg

SEQ ID NO: 17428 - DNA, 1911 bp, Artificial Sequence
  Description of Artificial Sequence: Synthetic coding sequence
atgtctgagaggaaagaggggagggggaagggtaaagggaagaagaaggagcgaggctctggcaagaagcctgagagcgccgccggaagtcagtcacccgcgttgcctcctcgcctcaaggaaatgaagtcccaggaatccgccgccggatcgaagttagtgctgcggtgcgagacttcctcagaatacagctctctgaggtttaaatggttcaagaatgggaatgaacttaaccgtaagaataagcctcagaacatcaaaatccaaaaaaagccaggcaaaagtgaactgaggatcaataaggcctcattggctgacagcggagagtatatgtgcaaggtgatatccaagctcggtaacgatagcgctagtgccaatattaccatcgtggagtccaacgagatcattactggcatgcctgccagcactgagggagcttacgtcagtagcgagagccctatccgaatttctgtctcaactgagggtgcaaatacaagttcctccacctcaacaagcacaacagggacctcccaccttgtgaagtgcgccgagaaagaaaagacattctgtgtgaatgggggagaatgctttatggttaaggacttgagcaatccgagccgctatctttgcaagtgcccgaacgagtttacgggagacaggtgtcagaattacgttatggcttctttttacaaggcagaagaactatatcagaaacgggtgctcacgattaccggaatctgcatcgccctcctcgtggttggtattatgtgcgtcgtcgcatactgcaagactaaaaaacagagaaaaaagctgcacgaccggctgcggcagtcgttgaggtctgaaaggaataacatgatgaacatcgccaacggtccccatcaccctaatcccccaccggagaatgtgcaactggttaaccagtacgtttctaagaatgtcatctcgtccgagcacatcgtcgagcgggaggccgagacctctttcagtacctcacactatacgagtactgcccaccatagcacaaccgtgacgcaaactccctcgcactcttggagtaatggacacactgaaagcatcctgtccgaatcccactccgtgatcgtgatgtcttccgtcgaaaactccagacattcctctcccacaggtggacctaggggtcggctaaatggaaccggtggtccccgcgagtgcaacagtttcctgaggcatgcgcgggaaacaccagacagctaccgggatagtccgcattccgagcggtacgtctctgccatgactactcctgctcgaatgtctccagtcgatttccacacacccagcagcccaaagagtccgccatctgaaatgtcacctcccgtctctagcatgaccgtgtcaatgccatccatggcagttagtcctttcatggaggaggaacggcccttgctgttagtgactcctccccggctgcgggaaaagaagtttgaccatcaccctcagcagtttagctcattccaccacaaccccgcccacgatagcaactctcttcccgcttctccattacggatcgtcgaagacgaagagtatgaaacaactcaggagtatgaaccggcccaggagccagtaaaaaaattggctaacagccgtagagctaaacgcacgaagccaaatggacacattgcaaataggctggaggtagattcaaatacctcatctcagagctctaacagcgaaagtgagaccgaggacgaaagggtaggggaggacacccccttccttggtattcagaaccccctggctgcgagcctcgaggccactccagcttttcgtctggccgattcgagaacaaatccagccggacggttttccactcaggaggagattcaggcccgcctctcctccgtgatcgcgaatcaggaccccattgccgtg

SEQ ID NO: 17429 - DNA, 1911 bp, Artificial Sequence
  Description of Artificial Sequence: Synthetic coding sequence
atgtcggagagaaaagaaggtcgaggcaaagggaaaggaaagaagaaggaacgggggtcaggaaagaaacctgagtcggcggcagggagccagagcccagccctccctccaagactgaaagaaatgaagtcccaagaatccgcagcaggatcgaagctggtactgcgttgtgaaaccagctcggagtactcatccctgcggtttaagtggttcaaaaacggcaacgagctgaacaggaagaacaaacctcaaaacatcaagatccaaaagaagcccggtaagtcagagttgcgaattaacaaagcatccctggcagacagcggggaatacatgtgtaaggtcatatccaaactgggaaatgattcagcatccgcgaacattaccattgtggaaagtaacgagattatcacggggatgcctgccagcactgaaggtgcctacgtcagcagcgaatcaccaatcaggatttcggtgagcaccgaaggagcgaacaccagctcatcgacctccaccagcactaccggtacttcccatttggtgaaatgcgcagagaaggaaaagacgttttgtgtgaacggaggtgaatgttttatggtcaaggatcttagcaatccgtcgcggtacctgtgtaagtgtcctaatgagttcaccggagatagatgccagaattacgtgatggccagcttttacaaggccgaggaactgtaccaaaagcgcgttctcaccataaccggaatctgcatagcacttctggtggtgggtataatgtgcgtggtcgcttattgtaagactaagaaacaaagaaagaagttgcatgataggttgcggcagagccttcgatcagaacgaaacaacatgatgaacatcgccaatggaccccaccaccctaaccctcccccagagaatgtgcagcttgtcaaccaatatgtgtcgaagaatgtgattagctccgaacatattgtggaaagagaggccgaaaccagcttttcgacctcacattacacttccactgcgcaccattcaacgactgtgacgcagaccccgtctcattcgtggtcaaacggccacaccgagagcatcctttccgaatctcattccgtaattgtgatgagctcggtggaaaatagccgacatagctcgcctacgggtgggccacgaggcagattgaatggaaccggcggtccgcgggagtgcaattcctttctgcgacacgcgcgcgaaaccccggattcctacagggattcccctcattccgagagatacgtatcggcaatgactaccccagcgagaatgtccccagtggattttcatactcctagctcgcctaaatcccctccatcggagatgagcccacctgtttcgtcaatgaccgtgtcaatgccctcgatggcagtctcgccgttcatggaagaagaacgccctctgctccttgtcactccgcccagacttcgtgaaaagaaattcgaccatcacccccaacagttttcgtccttccaccataatcctgcacacgattctaactcgcttcccgcttcccctctcagaattgtggaggacgaggaatacgagactactcaggaatacgaaccggcacaggaacctgtgaagaagctggcaaattcgcgtcgagcaaagcgcacgaagccaaatgggcatatcgccaaccgcctcgaagtggactctaacacctcgtcgcaaagctcaaacagcgaatcagaaacggaagatgagagggtgggcgaggacacccctttcctgggaatccaaaatccccttgccgcatccctggaagcgactcctgcgttccgcctcgcagatagcagaactaacccagcaggtcgctttagcacccaagaagaaattcaggctagacttagctcagtgattgctaaccaagaccctattgcagtt

SEQ ID NO: 17430 - DNA, 1911 bp, Artificial Sequence
  Description of Artificial Sequence: Synthetic coding sequence
atgagtgaacggaaggaagggcgggggaaagggaaagggaaaaaaaaagaaagggggtcagggaaaaagcctgaatccgctgcagggagtcagtcgcccgccctacctccacggctcaaagagatgaaatctcaggaatctgcagctgggtccaaactcgttctccggtgtgaaacatcttccgaatattcaagtttaaggtttaagtggttcaaaaatggaaatgaactaaacagaaaaaataaaccccagaatataaaaatacagaaaaaacccggaaagagtgaactaagaatcaataaagcctcactagcggatagtggggaatatatgtgtaaagtaatatctaagctcggaaatgattctgcttctgctaatataacaatagtagaatccaatgaaataatcacagggatgcctgccagtactgaaggggcttatgtttcttccgagtcacctataagaatttccgttagtactgaaggggcgaacacgagttcaagtacatcaacatctacaacaggaacttctcatctggtcaaatgtgcggaaaaagaaaaaactttctgtgtcaatgggggggagtgtttcatggtgaaagatttatcgaacccatctcgctatctttgcaagtgccctaatgaatttacaggggatcgatgccagaactatgttatggcctcgttctataaagccgaagaactctatcaaaaacgggtccttacaattacaggaatctgtattgcacttctagttgtagggataatgtgtgtcgtagcctactgtaaaacaaaaaagcagagaaaaaaactacacgaccgcctgaggcagagtcttaggagtgaacggaataacatgatgaatatcgcaaatggaccccatcatccaaacccaccccccgaaaacgtgcagctagtcaatcaatacgtgtcgaaaaacgttatctcatctgaacatatagttgaacgagaagctgaaacatcttttagtacatcccactacacttctacagcgcaccattctactacagtaactcagacaccaagtcactcttggtctaacgggcacacagaatcaattctgtctgaatcccactcagtcatagttatgagttccgtggaaaattcacgacactcttcccccactgggggacctagagggaggctgaacggaactggggggcccagggaatgcaactcttttctgaggcatgcccgggaaacacctgattcctatcgagacagtcctcattctgaacggtatgtatctgccatgacgactccagctcggatgtctcctgtggatttccacactcccagttctcctaaatcccctcccagtgaaatgtcccctcccgtctcatcaatgacagttagtatgcccagtatggcagtctctccctttatggaagaagaacgccccttgctcctcgttactccacctcgactgagggaaaaaaaatttgatcatcatccacagcagtttagttcctttcaccacaatcctgctcatgatagtaatagtttacctgcatctcctctccgaatagtggaagatgaagaatatgaaactactcaggaatatgaaccagcccaggaacccgtgaaaaagctcgctaattctaggcgcgcaaaacgaacaaaaccaaacgggcacatcgccaaccggctggaagtggattctaacacatcctctcagtcatccaattcagaatctgaaacagaagatgaaagagtgggagaggacacaccattcttagggatccagaaccccctcgctgctagtctagaagccactcctgcttttcgactcgcagactcaaggactaaccctgccggacgattctcaacacaggaagagatacaagctcgcctgtcctctgtgatagcaaaccaggatcctatagccgtg

SEQ ID NO: 17431 - DNA, 1911 bp, Artificial Sequence
  Description of Artificial Sequence: Synthetic coding sequence
atgtcagaacgcaaggagggtcggggaaaggggaagggtaagaaaaaggaaagaggatccggtaaaaagcctgagtccgcagcaggtagccaatcaccggctctcccccctcgtcttaaggaaatgaaatcccaggaatcagcagcaggctcaaaacttgtgcttagatgtgaaacctcgagcgagtactccagcctgaggttcaaatggtttaagaatggaaacgagctgaatcgaaaaaacaagccacagaacatcaagattcaaaagaagccgggtaaatccgaactgaggatcaataaggcatcgctggcagattcgggagagtatatgtgtaaagtcatatccaagctcggaaacgactccgcatcggcaaacatcaccatcgttgaatccaacgagatcataaccggaatgcctgcatcaaccgaaggggcctacgtatcgtccgagtccccaatccgaatttccgttagtactgaaggagcaaatacttcatcctcgacctccacttccaccactgggaccagccacctggtgaagtgcgcggagaaggaaaagactttttgtgtgaacggaggcgagtgctttatggtcaaggacctgtccaacccttcgaggtacctgtgcaaatgtcctaatgagtttaccggcgatagatgtcaaaactacgtcatggcgagcttttacaaggctgaagaactttaccagaagagggtgcttactatcaccggcatttgcattgcacttttggttgtcggtattatgtgtgtggttgcctactgtaaaacgaagaaacaaagaaagaaactgcacgataggctgcgtcagagccttagatcagagcgtaacaatatgatgaatatcgcaaacggacctcaccaccccaatccccctcctgaaaatgtccaacttgtgaatcaatacgttagcaagaacgtcatttcatcggaacacattgtcgagcgggaagccgaaacctccttttccacttcacattacacctccactgcgcatcacagcaccactgtcactcagactcctagccactcctggtctaacggccataccgagtccatcctttcggaatcgcattctgtaatcgtgatgtcgagcgtggaaaattccagacattcatcccccactggaggccctaggggtcggcttaacggaaccggtggtccgcgcgaatgtaactctttcctgcgccatgcaagagagactcccgatagctaccgcgactccccccattcggaacgttatgtgagcgcaatgactactcccgctcgcatgagccctgtggactttcacactccatcaagcccgaagtcacctccctccgaaatgtcccctcctgtctcgagcatgacggtgtcgatgcctagcatggcagtgtcaccatttatggaggaggaacgtccgcttttgctggtgactccccctcgactgagggaaaagaaatttgatcatcatcctcagcagttctcgagcttccatcataatcctgcccatgactcgaactccctgcctgccagcccactgaggattgtggaagatgaagagtacgaaaccactcaagaatacgagcctgcacaagaacctgtgaagaagctcgcaaattcgcgacgggctaagaggaccaagcccaacggacatatcgctaaccgtctggaggtggattcgaacacttcgtctcaatcctccaactcggagtccgagactgaagatgaaagggtcggcgaggacacccccttcctggggattcaaaatccactcgcagcctccctcgaagcaaccccagcctttagactggctgattcccgaaccaacccagccggtcgcttctcaactcaggaggaaatacaagcaagactttctagcgtgattgctaatcaggatccaatcgccgtg

SEQ ID NO: 17432 - DNA, 1911 bp, Artificial Sequence
  Description of Artificial Sequence: Synthetic coding sequence
atgtcggaacgaaaagaaggtcgtggtaaaggtaaaggtaaaaaaaaagaacgaggttcgggtaaaaaaccggaatcggcggcgggttcgcaatcgccggcgttaccgccgcgattaaaagaaatgaaatcgcaagaatcggcggcgggttcgaaattagttttacgatgtgaaacgtcgtcggaatattcgtcgctacgatttaaatggtttaaaaatggtaatgaactaaatcgtaaaaataaaccgcaaaatataaaaatacaaaaaaaaccgggtaaatcggaattacgaataaataaagcgtcgttagcggattcgggtgaatatatgtgtaaagtaatatcgaaactaggtaatgattcggcgtcggcgaatataacgatagttgaatcgaatgaaataataacgggtatgccggcgtcgacggaaggtgcgtatgtatcgtcggaatcgccgatacgtatatcggtatcgacggaaggtgcgaatacgtcgtcgtcgacgtcgacgtcgacgacgggtacgtcgcatttagtaaaatgtgcggaaaaagaaaaaacgttttgtgttaatggtggtgaatgttttatggttaaagatctatcgaatccgtcgcgatatttatgtaaatgtccgaatgaatttacgggtgatcgttgtcaaaattatgttatggcgtcgttttataaagcggaagaactatatcaaaaacgagtattaacgataacgggtatatgtatagcgctattagtagtaggtataatgtgtgtagttgcgtattgtaaaacgaaaaaacaacgtaaaaaactacatgatcgtttacgtcaatcgttacgatcggaacgtaataatatgatgaatatagcgaatggtccgcatcatccgaatccgccgccggaaaatgtacaattagttaatcaatatgtatcgaaaaatgtaatatcgtcggaacatatagtagaacgagaagcggaaacgtcgttttcgacgtcgcattatacgtcgacggcgcatcattcgacgacggtaacgcaaacgccgtcgcattcgtggtcgaatggtcatacggaatcgatattatcggaatcgcattcggttatagtaatgtcgtcggtagaaaattcgcgtcattcgtcgccgacgggtggtccgcgtggtcgtttaaatggtacgggtggtccgcgtgaatgtaattcgtttttacgacatgcgcgtgaaacgccggattcgtatcgtgattcgccgcattcggaacgttatgtatcggcgatgacgacgccggcgcgaatgtcgccggttgattttcatacgccgtcgtcgccgaaatcgccgccgtcggaaatgtcgccgccggtatcgtcgatgacggtttcgatgccgtcgatggcggtttcgccgtttatggaagaagaacgtccgttattattagtaacgccgccgcgtttacgtgaaaaaaaatttgatcatcatccgcaacaattttcgtcgtttcatcataatccggcgcatgattcgaattcgctaccggcgtcgccgttacgtatagttgaagatgaagaatatgaaacgacgcaagaatatgaaccggcgcaagaaccggttaaaaaattagcgaattcgcgacgagcgaaacgaacgaaaccgaatggtcatatagcgaatcgactagaagttgattcgaatacgtcgtcgcaatcgtcgaattcggaatcggaaacggaagatgaacgagttggtgaagatacgccgtttttaggtatacaaaatccgttagcggcgtcgttagaagcgacgccggcgtttcgattagcggattcgcgtacgaatccggcgggtcgtttttcgacgcaagaagaaatacaagcgcgactatcgtcggtaatagcgaatcaagatccgatagcggtt

SEQ ID NO: 17433 - DNA, 1911 bp, Artificial Sequence
  Description of Artificial Sequence: Synthetic coding sequence
atgagcgaacgtaaggaaggtcggggaaaggggaaggggaagaagaaggaaaggggatccggtaagaagcctgaatcagcagcgggatcacaaagccccgctcttccgcctagactgaaggaaatgaagagccaagagtcggcagccggtagcaagttggtgctgaggtgcgagacttcgagcgagtatagctcgctgagatttaagtggttcaagaacggtaatgagttgaacagaaaaaacaaaccacagaacataaagattcaaaagaaacctggcaaatctgaacttcggatcaacaaagcgtcgctggcagactccggcgaatacatgtgtaaggtcatcagcaagctcgggaacgactcagccagcgcaaatatcaccattgtcgaatccaatgagattatcaccggaatgcctgcatcaaccgaaggcgcatacgtgtcaagcgaatccccgatcagaattagcgtctcgaccgagggagcaaacacctcatcatcgacttctacctccactaccggaacttcccacctcgtgaagtgtgcagagaaggagaaaacgttctgcgtgaacggtggggaatgctttatggtgaaggacctctcaaacccgagccgatacctgtgtaaatgtcctaatgaatttactggagataggtgtcagaactacgtgatggcttctttttacaaggcggaagaactttaccagaagcgggtgctgacgattacgggaatatgtattgcattgttggtggtgggcattatgtgtgtcgttgcttactgcaagacgaagaagcagcggaagaaactccatgacagattgcgccaatccctgagatcggaaaggaacaacatgatgaatatcgcgaatggccctcatcaccctaatcctcctccagaaaacgtccaacttgtcaaccaatacgtgtcgaagaacgtgatctccagcgaacacattgtggaaagagaagccgaaacctctttttccacttcccattacactagcacggcccaccattccactaccgtcacccaaaccccttcacactcgtggtcgaacggacataccgagtcaattctttccgagtcgcattcagtgatcgtgatgtcctcagtggaaaactcacgtcattcgagccccactggcggtcccagaggacgcctgaatggcaccggtggacctagagaatgtaactcgtttctgagacatgcaagagaaactccggacagctacagagattcgccccattccgaaaggtacgtttcggcaatgaccactccagcacgcatgtcgcctgtcgattttcatactcctagctcgccaaagtcgcctccatcggaaatgagcccacctgtgtcgtcaatgaccgtgtccatgcctagcatggccgtcagcccgttcatggaggaggagaggccactgcttcttgtgacgcccccgaggcttcgcgagaaaaagttcgatcatcatccacaacagttctcgtcgtttcatcataaccctgcacatgattcaaactcgctgcctgcctcaccactgaggatcgtggaagatgaagaatacgaaaccacccaggaatacgagccagcacaggaacccgtgaagaagctcgcgaactcacggcgagcaaagagaactaagcccaacgggcacatcgcaaacagacttgaggtggattccaacacctcgtcccagtcctcaaactcggagtccgaaaccgaggatgaaagagtgggagaagataccccttttctcgggatccaaaatcctcttgcagcttccttggaggcaaccccagcgttccgcctggccgatagccggactaaccctgcaggacgcttctcaacgcaggaagaaattcaagcacggctttctagcgtcatagcaaaccaagaccccattgcagtg

SEQ ID NO: 17434 - DNA, 1911 bp, Artificial Sequence
  Description of Artificial Sequence: Synthetic coding sequence
atgagtgagcgtaaagaaggccgtggcaagggcaaaggcaaaaaaaaagaacgcggctctggaaaaaaaccggaaagtgcagcaggcagtcaaagcccggcgctccctcctcgcctgaaagagatgaagagtcaggaatcagctgcgggatccaaacttgtgctgcggtgcgaaacatcatccgaatatagctcattacggtttaaatggtttaaaaacggtaacgaacttaatcgtaaaaacaagcctcaaaacattaaaattcagaaaaagccgggaaaatccgagctgagaattaacaaagcgtctctcgctgactctggcgagtatatgtgcaaggtcatcagcaaactggggaacgacagcgcgtccgccaacatcaccattgtagagagcaatgaaattattacaggaatgccagcgtcgaccgaaggtgcatatgtctcatcagaatccccaataaggatctctgtatcaacagaaggtgccaatacatcctcgtcaacttcgaccagcacaactgggacgagccatctcgttaaatgtgctgaaaaagaaaagactttctgtgtgaatggaggtgagtgttttatggtcaaagacctttcaaacccttctcgttatctttgtaaatgcccgaacgaatttacaggcgatcgctgtcagaattacgtgatggcatccttttacaaagccgaggagttatatcaaaaacgtgtccttacgataacaggaatttgcattgctctgctggttgttggtatcatgtgtgtagtggcatattgcaaaacaaaaaagcagaggaagaagctccatgaccggcttcgccagtctcttcgctctgaacgcaataatatgatgaacatcgcaaatgggccccaccatcctaatccaccaccggagaacgtacagctcgtcaaccaatatgtgtctaaaaatgttatttcatcagagcatattgtcgaacgcgaggctgagacctctttttcaacatctcattatacatctacagcacaccacagcacgactgtcactcaaacaccgtctcactcgtggtctaacggacatactgaaagcatcctgtctgagtctcattctgttatagtgatgagttcagtggagaattcgcgtcattcctcgcctacaggcggtccgagaggccgtcttaatggcacagggggtccgagagaatgtaatagctttctgcgtcatgcgagagaaactccagattcttatcgtgattcgccgcatagtgaaagatatgttagcgctatgaccacgccggctcgcatgtctccagtagatttccatacgccgtcgagccctaaatcaccgccgtctgaaatgtcacctccagtttcatcaatgacagttagcatgccttcaatggccgtgtcaccattcatggaagaggaaagaccccttttactcgttaccccgccgcgcttgcgcgaaaaaaagtttgaccatcatccgcagcagttcagctcctttcaccacaacccagcgcatgactcaaacagcttgccagcctcgccgctcagaattgttgaggatgaggaatacgaaacgacacaagagtatgaacctgcacaggagccggtcaaaaaactggcaaactctcggagagcaaagcgcacgaaaccgaacggccacattgccaatcgattagaagttgatagcaatacatcttcccaatcctcgaactcagagtccgaaacagaagatgaacgtgtgggggaagacacgccgtttctgggtattcagaatccgctggccgcatctcttgaggcaacaccggcatttcgattggcggatagccggacgaatcctgctggccgattttcaacacaagaggaaatccaggcgcggctgtcaagtgtcattgcgaatcaagacccgatcgccgtg

SEQ ID NO: 17435 - DNA, 1911 bp, Artificial Sequence
  Description of Artificial Sequence: Synthetic coding sequence
atgtcggagcggaaggaaggacgcggaaagggtaaggggaaaaagaaagagagaggatccggtaagaagccagaatcggcagccggctcccaatcacctgccctcccacctcgacttaaggaaatgaaatcccaagaatcggctgcgggttcaaaactggtcttgcgatgtgagacgtcatcggagtactcatcactcaggtttaagtggttcaaaaacggtaacgaactgaatcgtaaaaacaagcctcagaacattaagatccagaagaaaccaggaaaatccgagctgcgaattaacaaggcatcgcttgcagatagcggtgaatacatgtgtaaagtgatctcaaagctgggcaacgattcagcaagcgccaacattaccattgtggaatcgaacgagatcattaccggtatgcctgcgtccactgaaggagcatatgtctcctcagaatcgcctattaggatctcagtctcgacggaaggcgcgaatacgtcctcctccacctcaacctcgaccacgggaacttcccatctcgtgaagtgcgcagagaaagagaaaaccttctgtgtgaatggtggtgagtgttttatggtgaaagacctgagcaacccgtcgaggtacctgtgcaagtgtcctaatgaatttaccggggacagatgccagaactatgtgatggcttctttttacaaggcggaagaactttaccaaaagcgcgtacttaccattaccggaatctgcattgcccttctggtcgtgggaataatgtgtgtggtcgcatactgtaagaccaaaaagcagagaaagaagctccatgatagactgcgccagtcattgcgcagcgaacggaataacatgatgaacatcgcgaatggcccgcatcatccaaatccaccgcctgagaacgtgcaactcgtgaaccaatacgtgtcgaagaatgtcattagcagcgagcatattgtagagagagaggcagaaacttctttttcaacttcgcattacacttcgactgcgcatcactccactaccgtgacccagactccttcgcattcgtggtccaacggtcacaccgaatcgatactgtctgaatcccattcggtgattgtcatgtcgtcggtcgagaattcgagacattccagccccactggtggtccaagaggcagactcaacggtaccggtggcccccgtgagtgcaattccttcctgagacatgcaagagaaacccccgactcgtaccgcgattccccacactccgaacggtatgtgtccgcaatgaccacgccagcccggatgtccccagtggattttcacactccgtcatcgcctaagtcccctccctcggaaatgtccccacctgtgtcgtcgatgactgtgtcgatgcctagtatggccgtgtccccttttatggaagaagaaagacctcttctgctcgtgacccctccccgcctcagggaaaagaagtttgatcatcatccacaacaattttcgtcttttcatcataaccctgcacatgactcaaattcacttccagcgtcccccttgcgcatagttgaagatgaagagtatgaaaccacccaagagtacgagccagcccaagagcccgtgaagaaacttgcaaatagccgacgtgcaaagcggacgaaacctaatggacacatcgcaaatagactggaggtggattcaaatacttcctcgcaatcgtccaattccgagtccgaaaccgaagatgaacgcgtgggggaagatactcccttcctcggtatccaaaaccccctggcagcttcgcttgaagcaactccagcatttcgtttggctgattcacgaaccaatcccgccggaaggtttagcacccaagaagaaattcaggcgcgcctctcgtcagtgattgcaaaccaagaccccattgcagtg

SEQ ID NO: 17436 - DNA, 1911 bp, Artificial Sequence
  Description of Artificial Sequence: Synthetic coding sequence
atgtccgaacgcaaagaaggtcgcggtaaaggaaaagggaaaaagaaggaaagagggagcgggaagaaacccgagtccgcggccggctcccaatctccggcccttcctccacggttgaaagagatgaagtcccaggaatcggccgccggatcgaaactggttctgagatgcgagactagttcagaatatagtagtcttcgctttaagtggtttaaaaatggaaacgagcttaacaggaaaaataaacctcaaaacataaagatccaaaaaaagcctggcaagagtgagctaagaattaataaggcgtcattggctgattccggtgaatacatgtgtaaggtcattagtaagctcggaaatgactctgccagtgcaaatataaccattgtcgaatcgaacgaaatcattacaggaatgcccgcatccaccgagggtgcgtacgtttccagtgagtctcccattcgcatttccgtgtcaaccgaaggggcaaatacttcttcctcgaccagcactagcaccacggggaccagtcacttagttaagtgcgccgagaaagagaaaacattttgcgtgaacggaggagagtgctttatggtaaaagaccttagcaatccgtcaagatacttatgcaagtgccccaatgagttcactggtgacagatgccaaaattatgtaatggcctcattttacaaggctgaggagctttatcaaaaacgagtacttacgattacgggtatctgtattgccttgttagttgtgggtataatgtgcgttgtggcttactgcaaaactaagaaacaacggaagaagcttcatgatcggctccgtcaaagcctcagatctgagagaaacaacatgatgaacatcgctaacggtcctcatcatcctaacccacctcctgagaatgtccagttagttaaccaatacgtatccaagaatgtcatttcttccgagcacatagtggagagagaggctgaaacctctttttcaacctcacattacacgagtactgcacatcattccacaacagtcactcagacaccttctcattcatggtcaaatgggcataccgaatcaatactatcagaatcacatagtgtcatagtgatgtcttccgttgaaaacagcaggcattctagtcccaccggcggtcctaggggaaggttgaatggtactggcggtcctcgagaatgcaacagttttcttcggcatgcaagagagactccggattcatatagagatagtcctcattcagaaaggtatgtgagtgcgatgacaacaccagcacggatgtcacctgtggattttcacacaccatcaagtcctaagtccccaccgtcagagatgtctcccccagtttcctcaatgactgtttccatgcccagcatggcagtaagtccttttatggaggaggagagacctttgcttcttgtcactccccctagactaagggagaaaaagtttgatcaccacccgcagcaattttcttcattccaccataacccggcacatgattccaatagtttgcctgcttctcctttacgaatcgtggaagacgaagaatatgaaacaactcaggagtatgaaccagctcaggaaccggtcaagaagctggctaactcacgtcgtgcgaaaaggacaaaacctaacggtcatatcgcgaataggctggaagtggattccaacacatcatcacaatcctctaatagcgagtcagagactgaagatgagcgagtcggtgaagatactccattccttggtattcaaaaccctttggctgcaagcttggaggccactcctgcattcagacttgccgatagccgaaccaatccggccgggaggttttcgactcaagaagagattcaggctagattgtcatctgttatcgccaatcaagatccaatcgcagtt

SEQ ID NO: 17437 - DNA, 1911 bp, Artificial Sequence
  Description of Artificial Sequence: Synthetic coding sequence
atgtcagaacgcaaggaagggagaggtaagggaaaggggaagaaaaaagagagaggctcaggcaaaaagccagagtcagccgccggctcccaatcgcctgcacttccccctcgactgaaggaaatgaagtctcaagagtccgccgcaggctcgaaacttgtgctgcgttgcgaaacctccagcgaatactcgtcgctgagattcaaatggtttaagaatggtaatgagcttaacagaaagaataagccacagaacattaagattcaaaagaagccagggaagtctgagcttaggatcaataaagcatcacttgcagattccggggagtacatgtgtaaggtgatttcaaagctgggtaacgactctgcctcagcgaatatcaccattgtggaatcaaacgaaatcattactggaatgcctgcttcaaccgaaggggcatatgtctcatcggaaagcccaattcggatctctgtgtccaccgaaggagcaaatacctcgtcgtcaacctcgacttcgaccactggaacctcgcatttggtgaaatgtgcagagaaagaaaagacgttttgcgtcaatggaggtgaatgtttcatggtgaaggatctctcgaacccgtcccggtacttgtgcaaatgtccaaacgaatttactggtgatagatgtcagaattacgtgatggcttcgttctataaagcagaggagctgtaccaaaaaagagtgcttactattaccggcatctgtattgcactcctggtggtcggcatcatgtgcgtcgtggcctactgtaagactaagaagcaacgcaagaaacttcatgacagactccgacaatcactcagaagcgagcgcaacaatatgatgaacatcgcaaacggaccacaccatcccaaccctcctccggaaaatgtccagctggtcaaccagtacgttagcaagaatgtgatctcgtcagaacatattgtcgaacgagaggctgaaacctccttctccacttcgcattatacttcaaccgcacaccactcgaccaccgtcactcagacccctagccattcatggagcaatggccataccgagtcgatcctgtccgagtcccatagcgtgatcgtcatgtcctccgtcgaaaattcccggcattcctcgcctacgggaggtccaagaggacggctcaatggaactggaggaccgagagagtgcaactcgttcctccgtcatgcaagagaaactccagattcgtaccgtgactcaccacatagcgaaagatacgtgtcagcaatgaccactcccgcacgcatgagcccggtggattttcatacgccttcctcacctaagtctccgccctctgaaatgtcgccacccgtgtcgtcaatgacggtgtcaatgcctagtatggctgtgtcaccttttatggaagaggaacggccactgctgctcgtgacccctccaagacttagggagaagaagtttgatcatcaccctcagcagttttcttcgttccatcacaaccccgcccatgatagtaattcattgccggcttcccctctgcgaatcgtggaagatgaagagtatgaaaccacgcaagaatacgagccggcacaggaacccgtgaaaaaactggcaaatagccgccgcgcgaagcgcactaagcccaacggtcacattgcaaacaggcttgaagtggattcgaatacttcctcgcagtcgagcaactcagagtcagaaaccgaggatgagagagtgggtgaagatacccctttcttgggcattcaaaacccactcgcagcgtccctcgaggcgacccctgcctttagacttgccgatagccggactaatcctgcaggtcgtttttcgacccaagaggaaatccaggctcggctgtcctcggtgatcgcaaaccaagatcctattgcagtg

SEQ ID NO: 17438 - DNA, 1911 bp, Artificial Sequence
  Description of Artificial Sequence: Synthetic coding sequence
atgtcggagaggaaggaaggccggggaaaaggaaagggcaagaagaaggagaggggttctggtaagaagccggaatcagctgcaggatcccagagccccgctctgccgccccggctgaaggaaatgaaatcccaagagtcggcggcgggatcgaaactggtcctgaggtgcgagacttcgtcggaatactcatcgctgcgcttcaagtggtttaagaacggaaacgaattgaaccggaagaataaaccgcaaaacataaagatccaaaagaagccgggaaaatctgagctgagaataaacaaggcaagccttgcggattcaggtgaatacatgtgcaaggtgattagcaagctggggaatgacagcgcgtccgcaaacatcactatcgtggaatcaaacgagatcatcaccggaatgccggcaagcactgaaggagcctacgtgtcgtccgaaagccccatcagaatctccgtgtcgaccgaaggagccaacacctccagctccacctccacgtccaccactggaacttcgcacctcgtgaaatgcgccgagaaggaaaagactttctgcgtgaacggaggcgaatgcttcatggtgaaggacctgagcaacccgtcaagatacctgtgcaagtgcccgaacgaattcactggggatagatgccaaaactacgtgatggcttcattctacaaggcagaagagctgtaccagaaaagagtcctcaccatcactggcatttgcatcgccttgctggtggtgggtatcatgtgcgtggtcgcctactgtaagaccaagaagcagagaaaaaagctccatgaccgcctcaggcagtccctccggtcagaacgcaacaacatgatgaatatcgccaacggaccacatcatccgaacccgccgcctgaaaatgtgcagttggtcaaccaatacgtctcgaagaacgtgatctcgtcagaacatatcgtcgaaagagaggcggagacgagcttctccactagccactacacttcgaccgcgcatcattcgactactgtcacccagaccccgtcacattcctggtcgaacggacatactgagtcaatcctttcggaatcacatagcgtgatcgtgatgtcgagcgtggagaactccagacacagttcaccgactggtgggccacggggacgcttgaacggaaccggagggccaagggaatgtaattccttcctgcgccacgcacgcgagacgccggactcgtaccgagactcgccacactcagaacggtacgtgagcgccatgactaccccagcccggatgagccctgtggattttcataccccgagctcgccgaaatcgccgccatccgagatgtcgccacccgtgtcctccatgactgtgtcgatgccgagcatggccgtctcacctttcatggaggaagagcgcccacttcttctcgtgaccccgcctaggctgcgcgagaaaaagttcgaccaccacccgcagcagttctcatcgttccatcataatccggcccatgactcgaactcgctgccagcctcacctctccgcatcgtggaggatgaagaatatgagacgacccaggagtacgaacctgcccaggagccggttaagaaactggctaactcccggcgggcaaagagaactaagcctaatggtcacatcgccaaccggctggaagtcgattcgaacacctcgtcccagtcatccaattcggaatccgagactgaagatgagcgggtgggagaggatactccgttcctgggaatccagaacccgcttgccgcctcgctcgaggcaactcctgccttccgcctggccgattctcgcactaatcctgcgggacgcttttccacccaagaggaaatccaagcccgcctgtcctcggtgatcgcgaaccaagacccgatcgcagtg

SEQ ID NO: 17439 - DNA, 1911 bp, Artificial Sequence
  Description of Artificial Sequence: Synthetic coding sequence
atgagcgagaggaaagaagggcgggggaaggggaaagggaagaaaaaggaacggggatcaggaaagaagccggaatcggcagctggatcgcagtcgccagctctgccgccccgcttgaaggaaatgaaatcacaggagtcagccgcaggatcgaagttggtgctccgctgcgagacgtcgtccgagtactcctccttgcgcttcaagtggttcaagaacggtaatgaactgaacagaaagaacaagccacaaaacatcaagattcagaaaaagcccggaaaatcggagcttcggatcaacaaagcctcactcgcagactcgggtgaatacatgtgcaaggtgatctcgaagctcgggaacgactcagccagcgccaacatcactatcgtggaatcgaacgaaatcatcaccgggatgcctgctagcacggaaggggcctacgtgtcctcggaatcgcctatcagaatcagcgtctcaaccgaaggcgcgaatacttcctcctcaacttccacttccacgactggtacctcacatctggtcaagtgtgccgaaaaagaaaagaccttttgcgtgaacggcggcgaatgcttcatggtgaaagacctctcgaatccttccaggtacttgtgcaaatgcccgaacgagttcactggggaccgatgtcagaactacgtcatggcgtcgttctacaaggcagaggagctgtaccagaagcgcgtgttgactattactggcatttgtatcgctctgctcgtggtgggtatcatgtgcgttgtggcgtactgcaagacgaagaagcagcggaagaaactgcatgataggctgagacagagccttagatcggaacggaataacatgatgaacatcgccaacggaccgcaccacccgaatcctccgcctgagaatgtgcagctcgtgaaccaatacgtgtcgaaaaatgtgatctcctcagagcacattgtggaacgggaagcggaaactagcttcagtacctcacattatacctcaactgcacaccattcgactaccgtgacccagaccccgagccactcctggtccaacggacacaccgagtcaatcctctcagaaagccactcggtgatcgtgatgtcatccgtcgagaacagccgccattcaagccctactggcggaccaagaggacgcctcaacggaaccggagggccgcgggagtgcaactcgtttctgcgccatgcgcgagaaacccctgattcttatcgcgattcgccccactcagagcgctacgtgagcgccatgaccaccccggcacggatgagccctgtcgactttcacaccccctcctctccgaaaagcccaccgagcgaaatgagcccaccggtcagttcgatgactgtgtcgatgccctcgatggccgtgtccccattcatggaggaggaaaggcccctcctgctcgtcaccccaccgagactgcgggaaaagaagtttgatcatcatcctcagcagtttagctccttccatcacaacccggctcatgattcaaactcactgcctgcctcaccactgcggatcgtcgaggacgaagaatacgaaaccactcaagagtacgagccagctcaggaacctgtgaagaagctggccaattcgagacgcgcaaagcgcactaagccaaatggacacatcgcaaatcggctggaagtggatagcaacacctcctcccagtcctccaactcggaatcagagacggaggacgaacgcgtgggtgaggacacgcctttcctgggtatccaaaacccgctggccgccagcctcgaggcaactccggccttccggctggccgactcgcgcaccaaccccgcgggccgcttctccacccaagaggagatccaggccagactgagctccgtgatcgccaaccaagatccgatcgcagtc

SEQ ID NO: 17440 - DNA, 1911 bp, Artificial Sequence
  Description of Artificial Sequence: Synthetic coding sequence
atgagcgaaagaaaggaaggacgcggtaagggaaaaggaaaaaagaaggagcgcggctcaggaaagaagccggagtcagccgcaggctcgcagtccccggccctgcctccgaggctcaaagaaatgaagtctcaggagagcgctgctggcagcaagctggttctgcgctgcgaaacttcatcagagtacagctcgctccgttttaagtggtttaagaacggaaatgagctgaacagaaagaacaagcctcagaatatcaaaatccagaaaaaacccgggaaatccgaactgcggatcaataaggcttctctggccgacagcggtgaatacatgtgcaaagtgatctcaaaactgggtaacgattcagcctcggccaacattaccatcgtcgaatcaaacgaaatcatcacgggaatgccagcgagcactgaaggcgcctacgtgtccagcgagtcgccaatcagaatctccgtctccactgagggcgctaataccagctcctcaacgtctacctccaccactggcacgtcccacctggtgaagtgcgccgaaaaagaaaagactttctgtgtgaatggtggagaatgcttcatggtgaaggacctgtcgaatcctagccggtacctgtgtaaatgccctaatgaattcaccggggacagatgtcagaactacgttatggcttcattctacaaggccgaggaactctaccagaagcgcgtgctgaccatcacgggtatctgcatcgctttgctggtggtgggaatcatgtgcgtggtggcgtactgcaagaccaaaaagcagaggaaaaagctgcatgatagactgcgccaatcactccggtcggagcgcaataacatgatgaatatcgcaaacggcccgcatcaccctaacccgccaccggaaaacgtgcaactggtgaaccaatacgtgtccaaaaatgtgatcagcagcgagcatatcgtggagagggaggccgagacttccttctcgacctcacactacacttcgaccgctcaccattccactaccgtgactcagaccccgtcccacagttggtcgaatggacacactgaatcgatactgtcggaaagccattccgtgatagtcatgtcctctgtggagaattcacggcactcgtcgccgaccggtggaccacgcggaaggttgaacggaaccggaggcccgcgagaatgcaactcattccttcgccacgctcgggaaacgccggacagctaccgggattctccgcacagcgaacgctacgtgagtgcaatgaccactcctgcacgcatgtcgcctgtggattttcataccccatcatcccctaagtcacctccttcggagatgtcgcccccagttagctctatgaccgtgtcgatgccctcgatggcagtgtcaccattcatggaagaggaaagaccgcttctcctggtgactcctccaagactcagagagaaaaagtttgaccatcacccccaacagttcagcagcttccatcacaacccggcgcacgattcgaactcattgccggcatccccactgaggatcgtcgaagatgaggaatacgaaactactcaggagtacgaacctgcgcaggagccagtgaagaagctggcgaacagccgcagggcaaaacggacgaagccgaacggacacatcgcgaaccgccttgaagtggactccaacacttcatcccagtcgtcgaactccgagtcggaaactgaggacgaacgcgtgggagaagatactccgtttctcggaatccagaacccgctggcggccagcttggaggccacgccagcattcagactcgcagattccaggacgaacccagccggccggttctcaacgcaggaggaaattcaagcaagactgtctagcgtgatcgcgaaccaggacccgattgccgtc

SEQ ID NO: 17441 - DNA, 1911 bp, Artificial Sequence
  Description of Artificial Sequence: Synthetic coding sequence
atgagtgaaagaaaggaaggaaggggaaagggaaaggggaagaagaaggaacgtggaagcggtaagaaacctgagtcagctgccggatcacagtcccccgctctgcccccaagactcaaggaaatgaaatcacaagaaagcgccgcaggctcaaaacttgtgctgcgctgtgaaacctcaagcgaatattcgtcccttcgatttaagtggttcaagaacggaaacgagctgaacagaaagaataaaccacaaaacattaagatccaaaagaaaccagggaagtcagagctgagaattaacaaggcctcacttgcagacagcggagaatacatgtgcaaggtcatttccaaactcggaaacgatagcgcgtcggctaatatcactattgtggaatcaaacgagatcataacgggcatgcctgcctcgaccgagggggcatacgtcagctccgaatcgcctatcaggatatccgtgtccaccgagggagccaacacttcttcgtcaacctcaacctctaccactggaaccagtcacttggtgaagtgtgcagaaaaggaaaagactttttgtgtgaacggaggggagtgctttatggtcaaggatcttagcaacccctcgaggtacctttgtaagtgtcctaacgaatttaccggtgatcgctgtcagaattacgtgatggcctctttttacaaggcagaagaattgtaccagaaacgcgttcttaccatcaccggaatttgtattgccctgttggtggtgggcatcatgtgcgtcgtcgcgtactgcaaaactaagaagcaaaggaagaagttgcatgaccggctccgccaatctctgcgctcagaacgcaacaatatgatgaacatagcaaacggacctcatcaccctaatccacctcctgagaatgtgcagctcgtcaaccagtacgtgagcaagaatgtcattagcagcgagcatatagtcgaacgtgaggcagagacttcattctccacgtcgcattatacgtcgactgcgcaccattcgaccaccgttactcaaactccgtcccactcgtggagcaacggacatactgaatcaattctctcagagtcccacagcgtgatagtgatgagcagcgtggagaactcaaggcactcctccccaactggaggaccgcggggtagactcaatggaaccggaggacctcgagaatgcaatagctttctccggcacgcacgagaaacgccagattcctacagggattctccacatagcgagcggtacgtcagcgcaatgactactcctgcaagaatgtcccccgtggactttcacactccatctagcccgaagtcaccccctagcgagatgtccccaccagtctcatcgatgactgtgtccatgcctagcatggcagtgtcgccatttatggaagaagaaagacctcttctgctggtcactcctccacgacttcgtgagaaaaagttcgatcatcatccacagcagtttagcagctttcaccataacccggcccatgattcaaattccctgcccgcctcacctctgcgcatcgtggaagatgaagagtacgaaaccacccaggagtacgaaccagcacaggaacctgtgaaaaaacttgctaactcacggagagcaaagagaaccaaaccgaatggacacatagctaataggctggaggtcgactccaatacctcctcccaatcctctaattccgagtcggaaaccgaagatgagagagtgggagaggacaccccattcctgggaatacagaatcctctcgcggcctccctggaggccactcccgcatttcgactggcagacagccggacgaacccagccggaagattctcgactcaggaagaaatccaagcacgtctctcctcagttattgcgaatcaagatcccattgcagtg

SEQ ID NO: 17442 - DNA, 1911 bp, Artificial Sequence
  Description of Artificial Sequence: Synthetic coding sequence
atgagtgaacggaaggaaggcagaggcaagggcaagggaaagaaaaaggagcggggctccgggaagaaacccgagtctgccgcgggttcccagagccccgccttgccgcctagactcaaggaaatgaagagccaggagagcgcagcagggtcaaagctggtcttgagatgcgagacttccagcgagtattcctcacttagatttaagtggtttaagaatggcaacgagttgaatagaaagaacaagccccagaacattaaaatccagaagaagccagggaaatctgagctgcgaatcaataaggcgtcgctcgccgactccggggaatatatgtgcaaggtgataagcaagttagggaacgactcagcttccgccaacatcactatagtggagtcaaacgaaataattactgggatgccagccagtacagagggagcatacgtcagcagcgagagcccaatccgtatctctgtatcaacagagggcgctaacacgagctcttcaacgagtacctctactaccgggacttctcacctggtcaagtgtgccgaaaaggagaaaacgttctgcgtgaacggcggagaatgtttcatggtcaaagacttgtctaacccctccagatacctgtgcaaatgcccaaacgagtttactggggataggtgtcagaactacgtaatggctagtttttacaaggccgaggagctgtatcagaaacgagtcctgactatcaccggaatctgcattgcgctgctggtggtgggaatcatgtgtgtcgtagcctattgcaaaaccaagaagcagcggaagaaactccatgaccggctccggcagtcactgaggagtgaaagaaataatatgatgaacatcgccaacgggccccaccatccaaaccccccaccagaaaacgtccagctcgttaaccagtacgtgtctaaaaatgtaatttcttcagagcacatcgtggagagagaggcggagacttctttctctacctcacactacacgtctacagcccatcatagtaccactgtgactcagaccccgagccatagttggtccaacggtcacacagagtccatcctgtcagagagccatagcgttattgtgatgagcagcgtggaaaattcccgtcatagctctccaacaggcgggccacggggccgcctgaatggaaccggagggcctcgggagtgtaactccttcctgcgccatgcacgcgaaacacctgatagctatagagattcccctcatagtgagcgatatgtttcggcgatgactacgcccgctcgaatgagccctgtggatttccacacccccagctcccccaagtcccctccctccgaaatgagcccccccgtctcatctatgacagtgagtatgccctccatggccgtcagccccttcatggaagaagagcgaccgcttctcctcgtgaccccgccacggctgcgtgagaaaaaatttgatcaccaccctcagcagttcagctcattccatcataatcccgcacatgattcgaattctcttcctgcatctccccttaggatcgtggaagacgaggagtacgagaccacacaggaatatgaaccggcgcaagagcccgtgaagaagctcgcaaacagcaggcgggctaagcggaccaaacctaatggacacattgcaaacagactcgaggtggacagcaacacctcttcccaaagtagcaactccgagtctgaaaccgaggatgaacgggtaggggaggataccccattcctgggaattcagaaccctctggcagcatctcttgaggctaccccagcctttcggctggcggactctagaaccaatcctgctgggcgcttctcaacacaggaagagattcaagctaggctgtcaagtgtgattgcaaatcaggatcccattgctgtg

SEQ ID NO: 17443 - DNA, 1911 bp, Artificial Sequence
  Description of Artificial Sequence: Synthetic coding sequence
atgtctgaacgcaaggagggtcgcggcaagggaaagggaaaaaagaaagagcgcggctcaggaaagaaacctgaaagcgcagccggatcacagtccccggcactgccacccagactcaaagagatgaagagccaagaatcagctgctggttctaaactcgtcctgagatgcgagacctcatctgagtattccagcttgaggttcaaatggttcaagaacggtaatgagctgaacagaaaaaataagccccagaacatcaagatccagaaaaagcctggcaagtctgagctgaggattaacaaggcctctctggctgatagcggtgaatacatgtgtaaggtgatcagtaaacttggcaacgactcagcttccgctaacatcaccattgttgaatccaacgagatcattacaggtatgccagcttcaactgagggcgcatacgtgtcaagcgaaagtcctatcaggatctctgtctccacggagggcgcaaatacatcctcctccacttccaccagcacaaccggtacttcacatcttgtcaaatgtgcagaaaaggaaaaaacgttctgcgtgaatggtggtgaatgtttcatggtgaaggacctcagtaatccgtccaggtatctgtgcaaatgcccaaacgaattcaccggcgatcgctgccagaactacgtaatggcctctttttataaggccgaagagctttaccagaaaagggttctgacgattactggaatttgtattgccttgttggtggtgggcattatgtgcgtggtggcatactgcaagacaaagaagcagaggaagaagctgcatgataggctgaggcagagtctcaggagtgagagaaacaacatgatgaatatcgctaacggaccgcaccacccgaacccaccccccgagaatgtacaactggtgaatcaatacgttagcaaaaacgtcatttcttctgagcatatcgttgaacgcgaggccgagaccagtttttcaacttcccactacacctccaccgcccatcactccacgactgtcacccagacaccaagccacagctggtccaacggccacaccgagtcaattttgagtgagagtcatagtgtgatcgtgatgagctccgtggagaactctcgccacagtagcccgaccggcggaccacgcggtagactcaatggcacaggtggaccgagggaatgtaactctttcctcagacacgcccgcgagacaccagactcttacagagattcacctcactcagagagatacgtttctgccatgactactcctgcccgcatgtccccagtcgatttccacactccaagctctccgaaaagcccaccttccgaaatgtcccctcctgtctctagcatgactgtatctatgccttccatggcggtatccccattcatggaggaggagcgcccccttctgctggtcacacctcctcgcctgagagaaaaaaaattcgatcaccatccacaacagttctcttcctttcaccataaccctgctcatgactcaaattctctcccagcatctcctctcagaatcgtagaagacgaggagtacgaaactactcaggaatatgaacctgctcaggaacctgtgaagaagctcgccaactccaggagagccaagagaaccaaacccaacggacatatagcaaacagattggaagtggactctaacacctcctcccagtcatccaactccgaaagtgagacggaagatgagcgcgtgggagaagacacgccattcctgggtatccagaatccgctggccgccagccttgaagcaactcctgctttccgcctggctgatagcaggacgaaccccgctggtcgcttcagcacccaggaagaaatccaggcaagactgtcaagcgtgattgccaaccaggatccgatcgctgta

SEQ ID NO: 17444 - DNA, 1911 bp, Artificial Sequence
  Description of Artificial Sequence: Synthetic coding sequence
atgtctgagaggaaagaaggtcgcggaaaggggaagggaaagaagaaggagcgcggtagtggaaagaaacccgagagcgctgcaggctcccagtcacctgccctcccccctaggctcaaggagatgaaatcccaggaaagcgccgccgggagtaagctggtgctacgttgcgagacttcttcagagtatagctctttacggtttaaatggtttaagaatggcaacgaactcaatcggaagaacaaaccacagaatattaagattcagaagaaacctggaaagtcagaactgaggattaacaaagccagcctcgcagactccggcgaatacatgtgtaaagtgatatccaagttaggcaatgactccgcaagcgcaaatattactatagttgagagcaacgagatcataacaggaatgccggcgagtaccgagggcgcatatgtgtccagtgagagtccgattaggatttccgtgagtacggaaggcgctaatactagctcaagcacatccacttcaacaaccggaactagccatctcgtcaaatgcgcagagaaagaaaagacattctgtgtcaatggcggagagtgtttcatggtgaaagatctgtctaacccctctaggtatctgtgtaaatgtccaaacgagttcacaggggacagatgtcagaattatgtgatggcatcattctacaaggccgaggagctctatcagaaaagagtgctcacaatcactgggatctgcatcgctttactagtggttggcataatgtgtgtggttgcatattgtaagactaagaaacagcgtaagaaactgcacgatcggttaagacagagtctgaggtctgaacgtaataatatgatgaacatcgcaaacggcccacaccatccaaatcctccaccagaaaacgtacagctggtgaaccagtacgtttcaaagaacgtcatatcatccgagcatattgttgagcgtgaggccgaaaccagtttttccactagccattacacaagtaccgcacatcacagcactaccgtgacacaaacgcctagccacagctggtcaaatggacacacagagtccattttatcggagtcacatagtgtgatcgtgatgtctagtgtcgaaaactcacggcactcctctccaaccggagggccaaggggacgccttaacggcactgggggacctagggagtgtaattctttcctgagacatgctagggagaccccggattcctaccgggacagcccccattccgaacgatatgtctcagcaatgaccacgcccgcacggatgtctcctgttgactttcacacgccttcatccccgaaatcaccacccagcgagatgtcaccacccgtgtcttctatgaccgtatccatgccttcaatggccgtgagcccatttatggaggaagagcgacccctgctgttagtaaccccacctcgactgagagaaaagaaatttgaccatcatccccagcagttcagtagctttcaccacaatccagcgcacgactcgaattcgctgcccgccagtcccctcaggattgtcgaggacgaggagtatgaaactactcaggaatacgaacctgcccaagagccagttaagaagcttgccaattccagaagagcaaagcggaccaagcccaacggtcatatcgcaaatcgcctcgaggtcgactcaaataccagctctcaatcctccaactctgagagtgaaacagaagacgagagggtgggcgaagataccccattcctgggcatccagaaccccttggccgcgtccctcgaggcaacccccgcgttccgtctcgccgactctcgcaccaatcccgcaggaaggtttagcacacaagaagagatccaagcacgtctctcttccgtgatcgctaatcaggacccaatcgccgtc

SEQ ID NO: 17445 - DNA, 1911 bp, Artificial Sequence
  Description of Artificial Sequence: Synthetic coding sequence
atgagtgagcggaaggaagggcgcggcaaaggcaaaggtaagaagaaggagagagggagcggcaaaaaaccagagtccgctgccggctctcagagcccagccctgccaccacgactgaaagaaatgaagtcccaggaatccgccgccggaagtaagctagtcttacggtgtgaaacctcctcagaatattcttccctgcggttcaagtggttcaagaatggcaacgaactgaacaggaaaaacaagccccagaacattaagattcagaagaagccaggaaaatcagagcttcggatcaacaaggccagcctagctgatagtggcgaatatatgtgtaaggttattagcaagctaggcaatgactctgcaagcgcaaacattacaatagttgaaagcaacgagataattaccggtatgcccgcttccacagaaggcgcctacgtcagctccgaatcccctatccgtatttccgtttctactgaaggcgcaaacactagcagctccaccagtacaagtacaaccggcactagtcacctggtgaaatgtgccgaaaaggaaaagactttctgcgtgaatggtggagaatgtttcatggtgaaggatttaagtaatccttctagatatctgtgcaaatgtccaaacgaattcaccggcgataggtgtcagaattacgtgatggccagtttttacaaggctgaggaactgtaccagaaacgggttctgaccataactggcatatgcatcgctctccttgtagtgggaatcatgtgcgtggtggcatattgcaagacaaagaaacaacggaagaagctgcacgatagactgcgccagtctctgcgctctgagcggaataacatgatgaacatagcaaatggccctcaccaccccaatcctcccccagagaatgtgcagttagtgaatcagtacgtttctaagaatgtgatttcttctgaacacatcgtcgagagggaggctgagacctctttctccacctctcattatacaagcactgcacaccatagcaccactgtcactcagacaccctctcatagctggtctaacggtcatacagaaagcattctaagcgaatcacattcagttattgtgatgagctccgttgagaactctagacactcatcccccaccggcggacctcgtggcagattaaacggcaccggcgggcccagagagtgtaatagctttctacgacatgccagagaaactcccgacagctatcgagattctccacattccgagaggtacgtttccgctatgacaacccccgcccgaatgtcaccagtggattttcataccccaagtagtccaaagagtcctcccagcgagatgtctcctcccgtttcttccatgaccgtgagcatgccgtccatggctgtgagtcctttcatggaggaggagagacccctgctgctcgtgacacctccccggctgagagagaaaaagtttgatcaccaccctcaacagtttagttctttccatcataatccagcacacgacagcaattccttaccagcttctcccttgcgcattgttgaagacgaagaatacgaaacaacccaagagtacgagccagcacaggaaccagttaagaagctagctaactctagaagggccaaaagaactaagcccaacggccatattgctaacaggctagaagtggattctaacacttccagccaatcctccaattccgaatcagaaacagaggatgagcgggtgggcgaggacactccctttctgggaatacagaatccactggctgctagtctggaagctacccctgcatttcgtctggcagatagtaggactaaccccgctggccgtttttccacacaagaggagatccaggctaggctgagcagcgtcatagcaaaccaggaccctatcgctgtg

SEQ ID NO: 17446 - DNA, 1911 bp, Artificial Sequence
  Description of Artificial Sequence: Synthetic coding sequence
atgtcggaacggaaggaaggccggggaaagggtaagggaaaaaaaaaagagcgcggctctgggaagaagcctgagagcgcagctggctctcagtcccccgctctaccccccagactgaaagagatgaaatcacaggagtccgccgcaggcagcaagctggtcctgcgctgtgaaacctcttccgagtactctagccttagatttaaatggttcaagaacggtaatgaactcaatcgcaagaataagcctcagaacatcaagatccagaaaaagcctggtaagtccgaactccggattaacaaagcttctctggcagatagtggagagtacatgtgtaaggttatatcgaaactgggaaacgactccgccagcgccaatatcactatcgtggaatctaatgaaataatcactgggatgcccgcttccaccgagggggcctatgtgtcaagtgaatctccaatccgcatatctgtctccaccgaaggagccaacacaagttcgtccaccagtaccagtaccactggcaccagccacctcgtaaaatgcgctgagaaggagaaaacattttgcgtgaacggcggcgaatgttttatggtcaaggacctcagcaatccaagccgctatctttgcaaatgccccaatgagtttactggcgatcgctgccagaattatgtaatggcctcattttacaaagccgaggaactgtatcagaaaagagtgctgactataactggtatttgcatagccctattggtagtcggaattatgtgcgtggtggcttactgtaaaactaagaaacaaaggaaaaaactgcacgaccgtttgaggcagtcgttgcgctctgagcggaacaacatgatgaatatagcaaacggaccccaccatcccaatccacccccagagaacgttcagctggtgaaccagtacgtctctaagaacgtgataagttctgaacatattgtggagcgcgaagccgaaacctcattttccacgagccactatacgagtaccgctcaccacagcactacagtgactcaaaccccatcacattcttggagtaacggccataccgaaagtattcttagcgagagtcacagcgtcatcgtgatgtcttccgtggagaactctagacacagcagtcccacaggaggacccagaggcagacttaatgggacaggtggccctagagagtgcaactcttttttaagacacgcccgcgaaacacccgacagctaccgggactcacctcacagcgaacgctacgtcagcgccatgaccacgcccgcaaggatgagtccagtcgatttccatactccatcctcacctaagtcccctccatccgagatgtcgcctccggttagttctatgaccgtgtccatgccctcgatggccgtctccccgttcatggaggaggaacggccgctgctactggtgactcccccaaggctacgggagaaaaaatttgaccaccaccctcagcaattctcttcgtttcatcataatcccgctcacgatagcaactcactccctgcatcacctctgcggatcgtcgaagatgaggagtatgagaccacacaagagtatgagccggctcaagaacccgttaaaaagcttgccaattcacggagggctaagcgcaccaagccgaacggacacattgccaataggttggaagtggatagcaataccagttcacagtcttcaaattctgaaagtgaaactgaggacgaaagagtgggcgaagacactccattcctcggaattcaaaatcctcttgccgcgagcctggaggccactcccgcctttcgactggctgatagccgcaccaacccagccgggcggttctccacccaggaagaaatccaggcaagactcagctctgtgatcgctaaccaggatccaatcgctgta

SEQ ID NO: 17447 - DNA, 1911 bp, Artificial Sequence
  Description of Artificial Sequence: Synthetic coding sequence
atgtccgagaggaaagaaggacgcggaaagggaaagggcaagaagaaagaaaggggatcgggaaagaagccggagtccgccgccggaagccagtcgccggcgttgcctccgcggttgaaagaaatgaagtcccaagagagcgcagctggctccaagctcgtgctcagatgcgaaacttcctctgagtactcgtcgcttaggttcaagtggtttaagaacggaaatgaactgaaccgcaaaaacaagccgcaaaatatcaagatccagaaaaaaccaggcaagtctgaactgagaatcaacaaagcgtcgttggccgactcgggtgagtacatgtgtaaggtcatcagcaagctgggcaacgattcggccagcgccaacattaccatcgtagagtctaacgagatcatcaccggaatgccagcttccaccgagggcgcctacgtgtcctcagagagtccaatccgcatttccgtgtccactgagggagccaataccagctcctcaacctcgacttcgaccaccggtactagccacctggttaagtgcgcggaaaaggagaaaactttttgtgtgaatggcggagagtgtttcatggtgaaggatcttagcaatccgtcgcggtacctttgcaaatgcccaaacgaattcactggagacagatgtcagaactacgtcatggcatcattctacaaggcagaagaactgtaccagaagcgcgtcctgactattaccggaatctgcatcgcactcctggtcgtgggcatcatgtgcgtcgtggcctactgtaagaccaagaagcagcggaagaagctgcacgatcgactgcgccaatcgctccgctcagaacggaacaatatgatgaacattgcaaacggaccgcaccacccaaacccgcccccggagaatgtgcagttggtgaaccagtacgtctcgaagaacgtcatctcgagcgagcatatcgtcgagcgcgaagcagaaacttcattctcaacctcgcactacacttccactgcccatcattcaactactgtgacccaaaccccgagccactcttggtccaacgggcacaccgagtcaatcctgtcggagtcgcactcggtgatcgtcatgtcgtccgtggaaaactcacgccactcgtcccccactgggggaccgcgaggaagactgaatggcaccggaggacctcgcgaatgcaattccttcttgagacacgcgagagagacgccggactcctaccgcgactccccccactccgaacggtacgtgagcgcgatgactaccccggccagaatgagcccggtggacttccacactccatcgagcccgaaatcaccgccatccgagatgtccccgccggtgtcgagcatgaccgtctccatgccgagcatggccgtctcaccgttcatggaagaagagaggcctttgctcctcgtgactccaccgaggttgcgggagaaaaagttcgaccaccacccgcagcagttctcgtcatttcaccataatccggcccatgattcgaactccctccccgcatcgccactgagaatcgtggaagacgaagaatatgaaaccacccaggagtacgaacctgcccaggagccagtcaagaagctcgcaaactcaagaagagccaagagaaccaaacccaatggccacatcgcaaaccgcctcgaagtcgactccaacaccagctcccaatcctcgaacagcgaatctgaaaccgaagatgaaagagtgggagaggacactcctttcctggggattcaaaaccctctggcggccagcctggaggccacgcctgccttccgccttgcagattcacgcactaatcctgcggggagattctcaactcaggaagaaatccaggcccgcctgtcatcagtgattgctaaccaggatccgatcgccgtg

SEQ ID NO: 17448 - DNA, 1911 bp, Artificial Sequence
  Description of Artificial Sequence: Synthetic coding sequence
atgtccgagagaaaggaaggccggggtaagggaaagggcaagaagaaggagcgaggtagcggcaagaagcccgaatccgccgcgggctcgcagtcgccggcgctgcccccgagattgaaggagatgaagtcacaggaatcggccgcaggaagcaagctggtcctgcggtgtgaaacttcgagcgagtactcctcactgcggtttaagtggttcaagaatggtaacgaactgaaccggaaaaacaaaccacagaatatcaagatccagaagaagccgggtaagtccgaactgcgcatcaataaggcctcactggccgatagcggagaatacatgtgcaaggtgatctcgaaactgggcaacgattcggcctcggcgaacatcactatcgtcgaatccaacgaaatcatcactggtatgccagccagcactgagggagcctacgtgtcgagcgagtcacctatccgaatctccgtgtcaactgagggtgcaaacacgtcctcttccacgtccacctcgactaccgggacctcgcacctcgtcaaatgtgctgaaaaagaaaagacgttttgtgtgaatggcggagaatgcttcatggttaaggacctgagcaacccttcacgctacctctgcaagtgcccgaacgaattcacgggagacaggtgccagaactatgtgatggcatctttctataaggcggaggagttgtaccagaagcgtgtgctgactatcactggtatctgcatcgcactcctcgtcgtgggcatcatgtgcgtggtcgcctactgtaagaccaaaaagcagcgaaagaagctccatgaccggctgagacaatcgctgcggtcagaaagaaacaatatgatgaacattgcaaacggaccccatcatccaaacccgccgccagagaatgtgcaactcgtgaatcaatacgtgtcaaaaaacgtcatctcctcagaacacatcgttgaacgggaggcagagacttcgttctcgacctcccactacactagcaccgcgcaccattcgaccacggtgacccagaccccgtcgcattcgtggagcaacggtcacaccgaatccattctgtcagaatcccattccgtgatcgtgatgtcgtccgtcgagaactctcggcactcgtcgcctactggcggaccacgcggacggctgaacggaaccgggggtccccgcgagtgcaacagcttcctcagacacgcgcgcgagacgcctgactcctaccgcgactcgccacacagcgaacggtacgtgtcggcgatgaccactcctgcccggatgagcccggtagatttccataccccgagctcgcctaagtctccaccttcggagatgtcgcctcccgtctcgtctatgactgtgtccatgccgtccatggccgtcagcccattcatggaagaagaaagaccacttctgctggtgaccccaccacggctgagagaaaagaagttcgaccatcacccgcagcaattctcatcgttccaccacaatccggctcatgacagcaactcgctcccggcgagcccgctgaggatcgtggaggacgaggagtacgagactactcaggagtacgaaccggcccaagaaccggtcaagaaactcgccaactcgcgtagagcaaaacggactaaaccaaatggtcacatcgcgaatcgccttgaagtggactcgaacacctcgtcccagtcctcaaattcagaatcggaaaccgaagatgagcgcgtcggggaggacactccgttcttggggatccaaaacccactcgccgccagccttgaagccacgcccgcatttcgcctggcggactcacgcaccaatccggcagggaggttctcgacccaagaggaaatccaagcgagactctcgtcagtcatagctaatcaggacccgatcgcggtg

SEQ ID NO: 17449 - DNA, 1911 bp, Artificial Sequence
  Description of Artificial Sequence: Synthetic coding sequence
atgagcgaacggaaggaagggcgcggtaagggaaaaggaaagaagaaggagcgcggaagtggcaaaaagccggaatcagcggcaggaagccagtcgccagcgctgccgccgcggttgaaagagatgaaatcacaggaaagcgcggcgggctcgaaactggtgctgcgatgcgaaacctcgtccgaatactcgtcactgagattcaagtggttcaagaacggaaatgaactcaatcgcaagaataaaccccaaaacatcaagatccaaaagaaaccgggcaaatcggaactccggatcaataaggcgtccctggcggattccggggagtacatgtgtaaggtcatctctaagctgggcaacgactcagcctccgcaaacatcaccatcgtggagtccaacgagattatcaccggaatgccggcatcgacggagggcgcctacgtgtcgtccgagtcgccgatcaggatctcggtgtctaccgaaggtgccaacacctcaagctcaacctcgacttccactaccggaacgtcgcatttggttaagtgcgcagaaaaagaaaagaccttctgtgtgaacggaggtgaatgcttcatggtgaaagacctgtcaaatccaagcagatacctctgtaagtgcccgaatgaattcactggggaccggtgtcagaattacgttatggcctcattctacaaagcagaagaactgtaccagaagcgggtgctgactattaccggaatctgtatcgcgctgcttgtcgtggggatcatgtgcgtggtggcatactgcaagaccaagaagcaaagaaagaagttgcacgaccggctccgccaatcacttcgcagcgaacgcaacaacatgatgaatatcgcaaacgggcctcatcacccgaacccacctcccgaaaacgtgcagctggtcaaccaatacgtgtcaaaaaacgtgatctcgagcgaacacatcgtcgagagagaggccgagacttcgttttccacttcccattacacctccaccgcacaccattcgaccaccgttactcagaccccttcgcactcctggtcgaacgggcatactgagagcattctgtccgaatcgcattcggtgatcgtgatgagctccgtcgagaactcgcgccactcgagcccgactggaggaccaaggggacgtctcaatgggaccggaggaccgcgggaatgtaacagctttttgcgccacgcgagggagactcccgattcgtaccgagatagcccacactccgagagatacgtcagcgcgatgaccaccccagcgcggatgtcgccagtggacttccacaccccatcttctccaaaaagcccgccttccgaaatgtccccgccggtgtcgtcaatgaccgtctccatgccgtctatggcagtgtcccctttcatggaggaggaaagaccactccttctggtgaccccaccgaggctccgggagaagaagttcgatcaccaccctcagcagttctcatcttttcaccacaatcccgcacacgattcgaattccctgccggcctcgccactgagaatcgtggaggacgaggaatacgagactacccaagagtacgaacctgcacaggagccagtgaagaagctggccaattcacggagagcgaagagaaccaagccgaacggacacatcgccaatcggctggaggtcgacagcaacaccagctctcaaagctccaactccgagtcggaaaccgaggacgaacgcgttggagaggacaccccgttcctcggaattcagaaccccctggcggccagcctggaagccacgcctgcgttcaggctcgccgattcgcggactaaccctgctggacggttctcaactcaggaggagatccaagctcgcctgtcctcggtgatcgcaaatcaagacccgatagccgtg

SEQ ID NO: 17450 - DNA, 1911 bp, Artificial Sequence
  Description of Artificial Sequence: Synthetic coding sequence
atgtccgagcgcaaggagggcaggggcaagggcaagggaaaaaagaaagaacggggatccggcaaaaaaccagaatcggcagctggatcccagagcccagcgctgccgccccggctgaaggaaatgaagagccaggagagcgccgcgggaagcaaactcgtgctcaggtgcgaaacctccagcgagtactcatcccttcgctttaagtggttcaagaacggaaacgagctgaatcggaagaataaaccgcagaatatcaagattcaaaagaagcccggaaagtcagaacttcggatcaataaggcctcactcgctgacagcggagagtacatgtgtaaagtcatatcgaaactgggaaacgactcggcttcagcaaacataactattgtcgagtccaatgagatcatcactggaatgccggcctcgaccgaaggagcatacgtgtcctcggaaagcccgattcgcatctccgtgtcgactgaaggagcaaatacttcaagcagcacttcgacttcgaccaccggaacgtcgcaccttgtcaagtgcgccgaaaaagaaaagaccttctgtgtgaacggaggcgaatgcttcatggtgaaagacctgtctaacccgtcacggtatctttgcaagtgcccaaacgagttcaccggagatcggtgccagaactacgtgatggcttcattctacaaggccgaggagctgtatcagaaacgggtcctcacgatcaccgggatctgtatcgcactgctcgtggtcgggatcatgtgcgtggtggcttactgcaaaactaagaaacagagaaagaagttgcatgaccggcttcgccagtcactccgatcagaaaggaacaacatgatgaacatcgccaacgggcctcatcacccgaatcctccgcccgagaacgtgcagctggtcaaccaatatgtcagcaagaatgtgatctcatcggaacacatcgtcgagagagaggctgaaacttcgttctcaacctcacactacacttccaccgcacatcactcaactaccgtgacgcagaccccttcgcattcctggtccaacggacacactgaatcgatcctgtccgagtcacattccgtgatcgtcatgtcctcggtggagaactcgaggcactcgagcccgaccgggggaccgcgcggcagactgaatggtacgggcggacctagagaatgcaactcctttctccggcacgctagggaaactccggattcgtaccgggattcgccccattcggagcgctacgtgagcgctatgactaccccggcccgcatgagcccggtggatttccacaccccgtcctcacccaagtccccaccgtccgagatgtcgccgccagtgtcctcgatgacggtgagcatgccctcaatggcagtgtccccctttatggaagaggaacgcccgctgctgctcgtcactccgccgcgcctccgcgaaaagaagttcgaccaccatccgcaacaattctcctcattccaccacaatccggcacatgactccaacagcctgccggcgtccccgctgcggattgtcgaggacgaggagtacgaaaccacccaagagtacgaacccgcgcaagaaccggtcaaaaaactcgccaactcacggagagcaaagcggaccaagccgaacggacatatcgcgaatcgcctggaagtggactccaacacctcctcgcagtccagcaatagcgagtcggaaactgaagatgagagagtgggagaggacaccccatttcttggcatccagaacccactggccgcctccctcgaagccacccccgcgttccgcttggcagattcacggactaaccctgcgggacggttctccacccaggaagagattcaggcgaggctgtcctcagtgattgccaaccaggacccgattgccgtg

SEQ ID NO: 17451 - DNA, 1911 bp, Artificial Sequence
  Description of Artificial Sequence: Synthetic coding sequence
atgtctgaacgcaaggagggcaggggaaagggaaagggcaagaaaaaggaaagaggctcgggaaaaaagccagaatccgctgcgggctcccagtccccggccctgccgccgcgcctgaaggaaatgaaatcccaggaatccgccgccggaagcaaactggtgctgcgctgcgaaactagctcagagtactcctccctcagatttaagtggttcaaaaatggaaacgaattgaaccggaagaacaaaccccagaatatcaaaatccagaagaagccgggaaagagcgagctccggatcaacaaagccagcctggcagattcgggggagtacatgtgtaaggtgatcagcaagctgggtaacgactctgcgtcggccaatatcacgatcgtcgaatccaacgagattatcactgggatgccggcgtcaaccgagggagcctacgtttcctcagaatcaccaattcgcatctcggtgagcaccgaaggagccaacacgtcctcgagcacctctacctcaaccactggaactagccacctcgtgaaatgcgctgaaaaagaaaagactttctgcgtcaacggaggagaatgtttcatggtgaaggacttgtccaatccaagccgctacctgtgtaagtgcccgaacgagtttactggcgatcggtgccagaattacgtgatggccagcttctataaggccgaggagctgtatcaaaaacgcgtcttgactattactggcatctgcatcgcgctgctcgtggtaggaatcatgtgtgtggtggcctactgcaagaccaagaagcagcgaaagaagctccatgaccggctgcggcaatcattgcgaagtgaacgcaataacatgatgaacatcgccaatggcccccatcatccgaaccctccgccggagaacgttcagctggttaaccaatacgtcagtaagaatgtgatttcatcagagcatatcgtggaacgagaagccgaaacctcattctccactagccactacactagcactgcccaccactccactactgtcacccagaccccgtcgcatagctggagcaatgggcacactgagtccatcctgtcggagtcacactccgtgatcgtcatgtccagcgttgaaaattctcggcactcatctccaaccggaggaccacgcgggagactgaacggaaccggcggcccacgcgaatgcaactcgttcctcagacacgcgagagaaaccccggactcataccgggattccccgcattcggaaaggtacgtgtcggccatgaccactcccgctcgaatgtcaccggtcgatttccacactccttcatccccaaagagcccgccttcggagatgtccccgccagtgtcgtcgatgaccgtgtcaatgccgtccatggcggtcagccctttcatggaggaggaacgccctctcctgctcgtgactccaccgcgtctgcgggaaaagaagttcgaccaccacccacagcaattctcttcttttcatcacaatcccgcccatgactccaactcccttcccgccagccctctgcgcattgtggaggatgaggaatacgaaaccacgcaggagtacgagccggcccaggaaccagtcaaaaagctggctaatagccgacgcgctaagcggactaagccaaacgggcatatcgcaaaccggctcgaagtggactccaacacgagcagccaatctagcaactccgaaagcgaaacggaagatgagcgcgtgggagaggacactcccttcctgggtatccaaaatcctctggccgcgtcgctggaggccacccctgcgttccgcctggcggactcccgcactaatccggccggtcgcttttcaacgcaggaggaaatccaagcgcggctctcctcagtgatcgccaatcaggacccgatcgctgtg

SEQ ID NO: 17452 - DNA, 1911 bp, Artificial Sequence
  Description of Artificial Sequence: Synthetic coding sequence
atgtcggagaggaaggaaggacggggaaaggggaaaggtaaaaaaaaggagcgcggctccggcaagaagcctgaaagtgcagctggcagtcagagtcccgcactcccccccaggctaaaagagatgaagagccaggagtctgcagccggatccaaactagtcctacgatgtgaaacttcttccgagtactcgagcctgaggttcaagtggtttaagaacgggaacgagctgaaccgcaagaacaaaccccagaacatcaagatccaaaaaaaacctggaaagagcgagttaagaattaacaaagcatctctggccgactcaggagaatatatgtgcaaggtaatctcgaaattgggcaatgactccgcctccgccaacatcacgattgtcgaaagcaatgagataattacgggaatgcctgcttccacagagggggcttacgtgagctcagagtctcccatcaggatttcagtgtctaccgagggagcgaatacatcatctagcacctcgactagcacaacaggtactagtcacctggtcaagtgtgccgagaaggaaaagacgttttgcgtgaacggtggagaatgctttatggtgaaggatttgagcaacccttccagatacctttgcaagtgtcccaatgagttcaccggcgataggtgtcagaactacgttatggctagcttctacaaggctgaggagctgtaccagaagagagtcctcactatcactgggatttgcatcgcattgctagtggtcgggatcatgtgcgtcgtggcatattgtaaaaccaagaaacagaggaagaaattacatgatcggctgcgtcaatcgcttcgctcagaacgaaataatatgatgaatattgccaacggtccccatcaccctaaccccccacctgagaacgtacagcttgtgaaccagtacgttagcaagaacgtaatcagctccgagcatattgtggagcgtgaggccgaaacgagctttagcacatcacattacacgagcacggcgcaccactccacaactgttacccagactccgagccatagttggtcaaatggccataccgagtctatcctttctgagtcacacagcgtgatagtgatgtcgagcgtggagaatagtagacactcctctcccacgggggggcccagaggcaggctaaacgggactggcgggcccagagagtgcaacagtttcctccgccacgctagggagacccctgatagctatcgcgattctccccacagtgagcgctatgtgtctgccatgactaccccagcacgcatgtcaccagtcgacttccatactccgagctcacctaagtccccgcctagtgagatgtcgccgcctgtcagtagtatgactgtgagcatgcccagcatggccgtaagtccatttatggaggaagagaggcctttacttttagtcaccccgccacgtttgcgggaaaagaagttcgatcatcatccacagcagttctcaagctttcaccacaatcccgctcatgactctaatagcttgcccgcctccccacttaggatcgttgaggacgaggagtatgaaaccactcaagagtacgagccggctcaagagcctgtgaagaaattagcaaactctagacgagcaaagcgaacgaagcctaacggccacattgctaaccggctcgaggtggactccaatacctcctcccagtcatctaactctgagagtgagactgaggacgagagagtcggggaagacactccgtttctgggtatacagaatccgctcgcggcctccctggaagcaactcctgccttcaggctggctgacagtaggaccaaccctgcaggtcggttctcaactcaggaggaaatccaggcgcggctgtcctctgtgattgccaatcaggatcccatcgctgtg

SEQ ID NO: 17453 - DNA, 1911 bp, Artificial Sequence
  Description of Artificial Sequence: Synthetic coding sequence
atgtctgaaagaaaggaaggtcgaggtaaaggaaagggcaaaaagaaggagagaggtagcggaaagaagccggagtcagcggcaggatcccaatcgccagcactcccgccccggctcaaggagatgaagagccaagaaagcgcggcaggttcgaagctggtgcttcgctgtgaaacttcgtccgaatactcctcacttaggtttaagtggttcaagaacggaaacgagctgaataggaagaacaaacctcagaatatcaagatccaaaagaaacccggaaagtcggagctcaggatcaacaaggcctccttggccgactccggagagtatatgtgtaaggtgatctcgaaactcggaaatgactcggcctcagccaacatcactatcgtggaatccaacgagattatcaccggaatgcctgcatcgaccgagggtgcttacgtctccagcgaatcacctatcagaatttccgtgtcgacggaaggagcaaacacttcaagctcaacttcgacttccactaccggaacctcccatctcgtgaagtgcgcggaaaaggaaaagactttttgcgtgaacggaggagaatgctttatggtgaaggacctgtccaatccaagccgctacctttgcaagtgtcccaatgagtttaccggcgatcggtgtcagaactacgtgatggcgagcttttacaaagcagaagaattgtaccagaagagggtcttgactattactggaatctgcatagcactgctggttgtggggattatgtgtgtggttgcgtactgtaaaaccaagaaacagcggaagaaactgcacgaccggttgcgtcaaagccttcggtcagagcgtaataacatgatgaatattgcaaacgggccacatcaccctaatccacctcctgaaaacgttcagttggtgaaccagtatgtgtcgaagaatgtgattagcagtgaacatatagtagagagagaagcagaaacgtcattcagcacctcacattacacttcgaccgcgcatcattccaccaccgtgactcagactccgtcgcactcctggtcaaatggccacaccgaaagcatcctctccgaatcccactccgtgatcgtcatgtcgtcggtggagaactcgagacacagctcgcctaccggtggtcctcgagggagactgaacggtactggaggtcccagagagtgtaactcgttcctgcgccacgcccgtgaaacccctgattcctaccgggactccccccactcagaacggtacgtgtcggccatgactacccctgctcggatgtcccccgtggattttcacactcccagttcacctaaatcgccaccatccgaaatgtcacctcccgtgtcctctatgaccgtgtcgatgccttctatggcagtgtcaccgttcatggaggaggaaagacctctcctcctcgtcactccacctagactccgtgaaaagaaattcgatcaccatccccaacagttctcctcatttcaccataacccagcacatgactccaactcactgcctgccagccctcttagaattgttgaggatgaagagtatgaaaccactcaggaatacgagcccgcccaagaaccagtgaagaaacttgcaaattcgcgtagagccaaaaggaccaaacccaacggacatattgcaaatcggctcgaagtggactccaatacgagctcgcaaagcagtaacagcgagtcggaaaccgaagatgagcgggtgggggaggacactccttttctcgggatacaaaatcctcttgcagcttcacttgaagccaccccggcatttcgcttggcagatagcaggaccaaccctgcaggacggtttagcacccaagaagaaattcaggcacgactctcatcagtcattgcaaatcaagaccccattgcagtc

SEQ ID NO: 17454 - DNA, 1911 bp, Artificial Sequence
  Description of Artificial Sequence: Synthetic coding sequence
atgtccgaacgaaaagagggccggggcaaggggaaaggtaaaaagaaagagaggggatcaggaaagaagcctgagtcggcggctgggtcccaatcccccgccttaccgccgagattaaaagaaatgaagtctcaagaatccgcggcaggctcaaaactagtgctgagatgcgagacaagcagtgaatactcctctctgcgcttcaagtggttcaaaaatgggaacgagctgaacaggaaaaacaagcctcagaatattaagatccagaagaagcccggtaaaagtgaacttcgaatcaacaaggcatccctcgctgacagtggtgaatatatgtgtaaggtcatcagcaagctgggtaatgacagtgctagcgcaaacatcaccatcgtggagagcaacgagattatcacaggaatgcccgcctccaccgagggggcctatgttagctcagagagtccgataagaatttctgtgagcacagaaggcgccaatactagctctagtactagtacatctaccaccgggacctctcacttggtgaaatgcgcagagaaggagaagaccttttgcgttaatggaggcgaatgctttatggtgaaggatttgtctaacccttcccgctatctttgtaagtgccccaatgagtttaccggggaccggtgtcagaattacgtgatggccagtttttataaggccgaggagttatatcagaaacgagtgctgacaattacaggaatttgcattgccttgctggtcgtgggaatcatgtgcgtggtcgcatactgcaagactaagaagcagaggaagaagctccacgatcgactccgccagtcccttcgcagtgaaaggaataatatgatgaacatcgccaacggaccgcatcatcctaacccccctcctgaaaatgttcagttggtgaatcagtatgttagtaagaacgtgattagcagtgaacacatagtcgagcgggaggcagagacatccttcagtacatcgcattacacaagcactgcccaccattctactaccgttacacagactccaagccatagctggtcaaacggtcatactgagtcaatccttagtgagtctcactcggtgatcgtcatgagcagcgtagagaatagtcgacactctagccccaccggggggccccggggaaggctcaatgggaccggaggcccaagggaatgcaactcgttcctccggcacgcacgggagactcccgactcctatcgcgactccccacacagtgaacggtacgtcagtgctatgacaacgccagcccgaatgagccccgtagactttcatactccttcctccccaaaatcgcccccaagtgagatgtctcctcctgtcagctcaatgactgtgtcgatgccgtcaatggctgtaagtccgtttatggaggaggagcggcccctgctccttgtgactcctcccagacttagagaaaaaaaattcgaccatcacccacagcaattcagtagttttcaccacaatccggctcatgactcaaattccctgcccgcctcaccgttgcgcattgttgaagatgaggaatacgaaactactcaggagtacgagcctgctcaagaacctgtcaaaaaactcgcaaactccaggagagctaaaaggaccaagccaaatggccacattgcaaaccgtctcgaggtggactcaaacactagttcacagagctccaatagtgaaagcgagacagaagatgaacgagttggagaagatacacccttcctgggcattcagaatccgttggctgcctcactggaggctacccccgccttcaggttggcagactcgagaactaacccggcgggccgtttcagcacacaggaggaaatccaggcaaggttaagctccgttatcgctaatcaggatccgattgcagtc

SEQ ID NO: 17455 - DNA, 1911 bp, Artificial Sequence
  Description of Artificial Sequence: Synthetic coding sequence
atgtccgaacggaaggagggacgtggtaaggggaagggcaagaagaaggagcgtggctctggaaagaagcccgagtctgcagccggcagtcagtcacctgcgcttccacccagattgaaggaaatgaagtcccaggagagcgccgccggctcgaagctcgtgttgcgctgcgagacgtcttccgaatactccagcctgcgttttaagtggttcaagaatggtaacgaactcaaccgaaagaacaagcctcagaatatcaagatccaaaagaagcctgggaagagcgaactgcgcatcaacaaggcctctctcgccgacagcggcgagtacatgtgtaaggtcatctcgaagcttggaaatgacagtgcaagcgccaatatcaccattgtcgaaagtaacgagatcatcaccggcatgccagcctccacagagggcgcgtacgttagctcagagtctccgatacgcatttcggtctctaccgagggcgccaacacctcatcctccacctccacgtctactaccggaactagccacctagtgaagtgcgccgagaaggagaagactttttgtgtgaacggcggagagtgctttatggtgaaggatctgtccaaccccagtcgttacctgtgtaaatgtcctaacgagttcactggtgaccggtgccagaattacgtgatggcgtcgttctacaaggccgaggagctgtaccagaagcgggtccttacgatcaccggaatctgcatcgccttgttggtcgttggtatcatgtgcgttgttgcctactgtaagaccaaaaaacagcgcaaaaagctccacgacagactgcgacaatcattgcggagcgaacgcaacaatatgatgaacatcgctaacggccctcaccaccccaacccccccccggagaacgtccagctggtcaaccagtacgtatctaagaacgtaatcagctctgagcacatcgtggaacgcgaggccgagaccagcttctccacctcccattacacctccactgcccatcatagtaccaccgtcactcaaactccttcacattcatggtctaacggccacacagagtctatcctgagcgagtcacatagcgtcatcgttatgagctccgtcgaaaattcccgacacagctcccccaccggaggccctcgcggccgcctcaatggcaccggcggcccccgcgagtgtaattcgttcctacgtcacgcacgggagacccccgatagctaccgcgacagccctcactctgagcgttacgtgagcgccatgaccacccccgcccggatgtcgccggtcgatttccatacgccgagctcccctaagtcccctcccagcgaaatgagcccacctgtctcctcaatgaccgtatctatgccttcgatggccgtctccccttttatggaggaggagcgccccctacttcttgtcacgccgcctcgcctgcgtgagaagaagttcgatcatcatccccagcagttctcctcttttcaccacaacccggctcacgacagcaactcgcttcctgcctcccccttgcggattgtcgaggacgaggagtacgagaccacccaggaatacgagcccgctcaggaacctgttaagaagctggccaacagccggcgcgctaagcgcacaaaaccgaacggtcacatcgctaaccgccttgaagtcgacagcaacacctcctcgcagagctccaatagcgaatccgaaacggaggacgaacgtgtcggcgaggatactcccttcctcggtattcagaatcccttagccgcctccttggaggctaccccggcattccgtctcgccgacagccgtacgaacccagctggtcggttctccacgcaagaggagatacaggcacggctcagcagtgtgatcgcgaaccaggacccgattgccgtg

SEQ ID NO: 17456 - DNA, 1911 bp, Artificial Sequence
  Description of Artificial Sequence: Synthetic coding sequence
atgtccgaacgcaaggaggggagaggaaagggcaagggcaagaagaaggagagaggctccggtaaaaaacccgagtccgctgctggcagccaatctcctgcgctgcccccaaggctgaaggagatgaagtcccaggaaagcgccgctggttcaaaactcgtgctccgctgcgagacttcctcagaatactcctcactgaggtttaagtggttcaagaacgggaacgagctgaacagaaaaaacaagccacaaaacattaagatccagaagaagccgggaaagtcggagttgaggattaacaaagcctctctggccgattcaggagaatatatgtgcaaagtgatatccaagctcggaaacgatagcgcatccgctaatatcactattgtcgaatccaacgaaattataacgggaatgcccgctagcacggaaggcgcctacgtgtcttctgagtccccaataaggatcagcgtgtcaacggagggagcaaatacctcttcaagcacttccacttctacaaccggtacttctcatctagtaaagtgcgccgaaaaagaaaaaacattttgtgtgaacggcggtgagtgttttatggtgaaagacctctccaacccctctagatacctttgcaaatgccccaatgagttcacaggggatcgatgtcagaactatgttatggccagcttctacaaggccgaggaactataccagaagcgcgtgttaacaattactgggatatgtatagcgctgctggtcgtcgggattatgtgtgtggtggcctactgcaaaacaaagaagcaacgtaagaaactgcacgatagactcaggcagtccctgaggtccgagaggaataatatgatgaatatcgccaacggaccccatcatcccaacccccctcccgagaatgtgcagctggtcaaccaatacgtgtctaaaaatgtaatttcgtcagaacatatcgtggaaagagaggctgagacctctttctcaacgtctcattacacctctaccgcacatcattctacaaccgttacacagactccgagtcattcatggagcaatggtcacacggagtctattttatcggagtctcattctgtaatagtgatgagtagcgtcgagaactcacgtcattctagccccactggaggacctcggggaaggttgaatgggacggggggccccagagagtgcaattcattcctgaggcatgcccgcgagacgccggactcttaccgggattctccccactcagagaggtatgtatcggccatgaccacaccagcacgcatgtccccggtggactttcacacccctagctcgcccaagagccccccctctgaaatgtcaccaccggtcagcagcatgaccgtgtccatgccatctatggccgtcagcccatttatggaggaagagaggcccctcctcctggtcacaccacctcgcctgcgcgaaaaaaaattcgatcaccatccacagcagttttccagtttccatcacaaccctgctcacgattctaattcactcccagctagcccattgaggatcgtggaagacgaggaatatgaaacaacccaggaatacgagccagcacaggagcctgtaaagaaattggctaactccaggcgcgccaaaagaactaagccaaatgggcacatcgcaaatcgccttgaggtggactcgaatacctctagccagtccagcaactccgagtccgagactgaagatgaacgcgtgggtgaagataccccgttccttggtatccaaaaccccttagccgcatcactcgaagccactccagcttttcggctggccgactcccgcacaaacccggccgggcgctttagtactcaggaggagatccaggctaggctttcatccgtgatcgctaatcaggaccccatcgctgtc

SEQ ID NO: 17457 - DNA, 1911 bp, Artificial Sequence
  Description of Artificial Sequence: Synthetic coding sequence
atgtccgagcgcaaggaaggaagaggaaagggcaaaggaaaaaagaaggaacgaggaagcggaaaaaagcctgagtcggcagcgggaagccaatcccccgccctccctcctcggctcaaagagatgaagtcccaagaatccgctgccggttcgaagctcgtgttgagatgcgaaacgtcctccgagtactcgagcctgagatttaagtggtttaagaacggaaacgagcttaatcgaaagaataagcctcaaaacattaagatacagaaaaagcccggaaagagtgagctccgcatcaataaggcaagccttgcagactcgggagaatacatgtgtaaggtgatctcgaagctggggaacgactcagcctcggccaacattactattgtggaatcaaacgagatcattaccggaatgcctgcatcgaccgagggggcgtatgtgtcatcggagtccccaattagaattagcgtttcgaccgagggagcaaacacctcaagctccacgtcgactagcaccactggcacctcacatcttgtgaaatgtgcagaaaaagaaaaaaccttttgtgtaaatggaggagaatgtttcatggtcaaggatctctccaatccctcaagatacctttgtaagtgccccaatgaatttaccggtgaccggtgccagaactatgtgatggcgagcttctataaagcagaagaactgtaccagaaaagggtgctgaccataactgggatctgtattgcactccttgtggtcggtatcatgtgtgtcgtggcctactgtaaaactaaaaagcaacgtaagaaactccatgatagacttagacaatcactgagaagcgaaagaaataacatgatgaatattgcaaatggtccacaccatccaaacccaccaccagaaaacgtgcaactcgtgaaccagtacgtgagcaagaatgtaattagctcggaacacattgtggaaagggaagccgaaacgtctttctcaacttcgcattacacgtccactgcacatcattccaccaccgtgactcaaaccccttcgcattcatggtcaaatggacatactgaatcaattctgagcgaatcgcactcagtgatcgtcatgtccagcgtcgaaaattcaaggcacagctcacctaccggaggacctcgaggccgcctgaacggtaccggaggtcctcgcgaatgtaactctttcctgcgccatgctcgcgaaactccagattcgtaccgagacagcccgcactcagagaggtacgtgtcggccatgaccacccccgcaaggatgagcccggtcgattttcacactccgtcatcacccaagtctccaccaagcgagatgtcccctcctgtcagctccatgaccgtgtcaatgccaagcatggcagtgagcccttttatggaggaagagcggcctctccttcttgtgaccccaccacggctgagggaaaagaagttcgaccatcatccccagcagttttcttcctttcaccacaatccagcacatgattccaactcacttccagcatcccctctgagaatcgtggaagatgaagaatatgagacgacccaagaatacgagcctgcacaggagcctgtcaagaaactcgcaaatagcagacgcgccaaaagaactaagcctaacggacatattgctaacagacttgaggtcgatagcaacacctcatcgcaatcctccaactcggaaagcgaaaccgaggacgaacgggtgggtgaggacactccttttcttggaatacaaaacccgctggctgcatcgctggaggcgacccctgccttccggctcgccgattcaagaactaacccagcaggcagatttagcactcaagaagagattcaagccaggctgtcgtccgtgattgcaaatcaggatccaattgccgtg

SEQ ID NO: 17458 - DNA, 1911 bp, Artificial Sequence
  Description of Artificial Sequence: Synthetic coding sequence
atgtctgaaagaaaggaaggccgtggaaagggaaagggtaagaagaaagaacgaggttcgggaaaaaagccagaatccgcggcaggaagtcaatcacccgctttgccaccaagactaaaagaaatgaaatcccaggaatcagccgcaggctctaaacttgtactacgatgcgaaacctcatctgaatattcatcacttcgcttcaaatggttcaaaaatggaaacgaattgaatagaaaaaataaaccacaaaacattaagattcaaaaaaaaccaggtaaatctgaactgagaattaataaagctagtctagcagactcgggagaatatatgtgcaaagtcatatcgaagctcggaaacgattctgcatcggccaatattaccattgttgagtcgaatgaaattattacaggtatgccagcgtcgactgaaggggcctatgtatcatcggaatctccgattagaatctccgttagcaccgaaggtgcgaatacatcttctagcacatctacctcaacaacaggcacttctcacctcgtgaaatgtgcggaaaaggagaagacattttgcgtcaatggaggagaatgttttatggttaaagatctctcgaatccctctagatatttatgcaaatgtccaaatgaatttacaggcgaccgatgtcaaaattacgtgatggcgtcgttctataaggccgaggaattgtaccaaaaacgagttctgactattactggtatctgtatagctttgctcgtcgtaggaattatgtgtgttgttgcgtattgtaaaacgaaaaaacaacgaaagaagttgcatgaccgtttgcgtcaatccctccgttcggagagaaacaatatgatgaacatagctaatggtccacatcatccaaaccccccaccagagaatgttcaattggttaatcaatatgtcagtaagaatgtaatttctagtgagcatattgtggagcgagaggctgaaacatcctttagtacatcgcattacacctctacggcacatcattcaactacggtaacacagactccatctcactcctggtcaaatggacacactgaatcaatccttagcgaaagtcacagcgttatcgtgatgtctagtgttgaaaactccagacactctagtccgaccggtgggccaagggggcgactcaatggaacaggtggtccacgtgaatgtaatagttttctccgtcatgctcgagaaactccggattcttacagagactccccacacagcgaacgctatgtttcggctatgacaactccggcccgaatgtccccagtggactttcacacgccatcttccccaaaatcaccaccatcggagatgtctccaccagtatcttccatgacggttagtatgccatccatggcagtcagtccatttatggaagaagaacgcccattgttacttgttacgccgccacggctacgagaaaagaaatttgatcatcacccacagcaattttcctcattccatcataatccggcccacgatagcaatagcctcccagcgagtccccttcgtattgtagaagatgaagaatatgaaactactcaggaatatgaaccggcgcaggaaccagtgaagaaacttgctaatagtaggcgtgctaagcgaaccaagcctaacggacatatagctaatagacttgaggtagattccaatactagtagtcaaagttctaatagcgagagtgaaactgaagacgagcgcgtgggagaagatacaccattcttgggtattcagaaccccttggctgcaagcctggaagccactcctgcattcagactcgcagacagtcgtacgaatccggctggaagatttagcacccaggaagagatccaagctagattgtcgagcgttatcgctaaccaagatccgattgcagtg

SEQ ID NO: 17459 - DNA, 1911 bp, Artificial Sequence
  Description of Artificial Sequence: Synthetic coding sequence
atgtccgaacgtaaagagggccgaggaaaggggaaaggaaagaaaaaggaaaggggctctgggaagaagcctgagagcgcagccggaagtcaaagccctgccttacctccaaggttgaaggagatgaagagccaggagagtgccgctggaagcaaattagttctgcgttgcgagacaagttccgaatactcatccctgaggttcaagtggttcaaaaacggaaacgagctgaacagaaagaacaaaccacagaacattaaaattcagaagaaacccgggaagagcgagctgcggataaacaaagcatccctggcagattccggcgagtatatgtgcaaagtgatcagcaaactaggaaatgactctgcatccgctaacattaccatagtggaaagcaatgaaatcattaccggaatgccagcatctaccgagggcgcgtatgtgtcttccgagagccctatcagaatatccgtgtctaccgaaggagccaatacctctagttctacatctactagcaccacgggcaccagccacctggtgaagtgtgcagagaaggagaagacattctgcgtcaatggtggcgaatgcttcatggttaaggacctgtcaaatccatctaggtacttgtgtaagtgtcccaacgagttcaccggtgatcgatgccagaattatgttatggcttccttttacaaagccgaggaactctaccagaagagagtgctgacaatcacgggaatctgcatcgccctgttagttgtgggaatcatgtgtgttgtcgcctactgcaaaaccaagaaacaacgaaagaagctccacgacagactccgccagtccttgagaagtgaaagaaacaatatgatgaatatagccaatggacctcaccatcccaaccctccaccagagaacgttcagctagtcaaccagtatgtgtctaagaatgtgatttcaagtgagcacatagtcgagagagaagccgagacgagcttctcaacgagtcactacacctccactgcccatcactctacgactgtgacacagaccccgagccactcatggtccaacgggcacaccgagagtattctttcggaaagccactccgtcatcgtaatgtccagtgtagagaactccagacactcatcccccacgggtgggccacgcggccgactcaatggcaccggcgggcccagggaatgcaattcctttctgcgacacgcgagagaaacacccgattcgtatagggactcacctcacagtgaacgatacgtcagtgccatgacgaccccagctcgtatgtcacccgtggacttccacacaccatccagcccaaaatcaccccctagcgaaatgagtcctccagtgtcctctatgacagtctccatgcccagcatggccgtaagcccctttatggaagaagagaggcctctccttcttgtaacccctccccggctgagggaaaagaaatttgatcaccatccacagcagttttcctcttttcaccacaatccggcacatgacagcaattcgctgcctgcaagccctttaagaattgtggaggatgaagagtatgagacaacacaggagtatgaacccgctcaagagcccgtgaagaagctggcaaatagtaggagagccaagcgtaccaagcccaatggacacatagcgaaccgactggaagttgacagtaacacaagttcgcagtcttcgaactcagagagcgaaaccgaagacgagagagtgggggaagacactccctttttggggattcagaatccactagctgcctccctggaggcaactcccgctttccggctagctgacagcaggacgaacccggcaggtagattctccacccaggaagaaatccaggctaggttgagctctgtcatagcaaatcaggacccgatagcagtt

SEQ ID NO: 17460 - DNA, 1911 bp, Artificial Sequence
  Description of Artificial Sequence: Synthetic coding sequence
atgtcagagaggaaggaaggtcgcgggaagggaaagggcaagaagaaggaaagaggatccggtaagaagccagaatcggcagcagggagccagagcccagcccttcctcctagactgaaggagatgaagtcacaggaatctgctgcaggctcaaagctggtgctcaggtgtgaaacctcctccgagtactcctctcttcgttttaagtggttcaaaaacggaaacgaacttaataggaaaaacaagcctcagaatatcaagatacaaaagaagcctggtaagtcagaactgagaattaacaaggcctcgctcgccgattcgggtgagtacatgtgtaaggtcatttccaagctcggcaacgactccgcaagcgcgaacataactatagtggaatccaacgagattatcactggaatgccagcatcgaccgaaggtgcatacgtgtcctccgaatcccccattcggatttctgtctcaaccgagggagctaatacgtcctcctcaaccagcaccagcaccaccggtactagccatctggtgaagtgtgcagaaaaagaaaagacgttttgtgttaacggaggtgagtgctttatggtgaaggatctttctaatccttcgagatatctttgcaaatgtccgaacgagttcactggtgatagatgccagaattacgtgatggcttcgttttacaaggcggaagaactctaccagaaacgcgtgctgactataaccgggatttgtatagctctgctcgtcgtgggaattatgtgtgtggtcgcctactgcaagaccaaaaaacaaagaaagaagctgcatgatagacttagacaatcgcttcgctcggagagaaacaacatgatgaacattgcaaacggtcctcatcatcctaatcctccaccagagaacgtccaacttgtgaatcagtacgtgtcaaagaatgtgatcagctccgagcacatagtggaacgagaagcagaaacctcattctcgacgagccattatacctcgactgcgcatcattcaactactgtgacccaaactcctagccattcttggtcgaacgggcacaccgaatccattctttcagagagccatagcgtgatcgtcatgtcctcggtggaaaattccaggcattcaagccccaccggcggaccgcggggccgccttaatggtaccggtggtccgcgagaatgtaactcgtttctcagacatgcaagggaaacccccgattcgtatcgtgactcccctcatagcgagcggtacgtgtccgccatgaccactcctgctcggatgagcccagtggacttccacaccccttcgtcccccaaatcaccacccagcgaaatgtcgcccccagtgtcctcgatgactgtgtccatgccaagcatggcagtctcccccttcatggaggaagagcggcctctccttcttgtgaccccgccgagacttcgcgagaaaaagtttgaccatcatcctcaacagtttagcagctttcaccataaccctgcacacgatagcaactctctgccagcatcaccacttcgtattgtggaagatgaggagtacgaaacgacccaagagtacgagccagcacaagagccggtgaagaaactcgccaattcgagaagagcaaagcggactaagcccaatggacacattgctaacagactggaagtggatagcaatacctcatcgcaatcgagcaacagcgaatcggagactgaggatgagcgagtcggtgaggacacccctttccttggaatccagaatccactggcagcatccctcgaagcgactcccgcttttagactggcagattcgcgaactaatccagcaggccgtttcagcacccaggaagaaatccaagccagactttcttccgtcattgcgaaccaagatccaattgccgtg

SEQ ID NO: 17461 - DNA, 1911 bp, Artificial Sequence
  Description of Artificial Sequence: Synthetic coding sequence
atgtccgagcggaaagagggtcgagggaagggtaagggcaaaaagaaggagcggggatccggaaagaaaccggaatcggcggcgggatcccagtcgcctgccttgcctccaagactcaaggagatgaaatcccaggagtcggctgcgggctcgaagttggtgttgcgctgtgagacgtcgagcgaatactcctccctcagattcaagtggttcaagaacggaaacgaactgaatagaaagaacaagccacagaacatcaagatccagaaaaagcctggcaagtccgaactgcggatcaataaggcttcccttgcagactccggagaatacatgtgcaaagtgatttccaaactgggcaacgactcagcatccgccaatatcacgattgtcgaatcaaatgaaatcatcactggaatgccggcgtcaactgaaggagcgtacgttagcagcgaatccccaatcagaatctcggtgtccaccgaaggtgcaaacacttcatcatcgacctcgacctcgactactggcacctcgcatcttgtgaagtgcgctgagaaagaaaagactttctgtgtcaacgggggtgaatgcttcatggtgaaagacctgtcgaacccgtcaagatacctgtgtaagtgtccaaatgaattcactggggaccgatgccagaattacgtgatggcctcattctacaaggcggaggaactctatcagaagcgcgtcttgaccatcactggcatctgtattgctctgctcgtcgtgggaatcatgtgcgtggtggcatactgcaagactaaaaagcagcggaagaagctgcatgataggcttcggcagtccctgcgctcggagcggaacaacatgatgaacattgccaatggacctcaccacccaaacccgccgccagaaaacgtgcaattggtcaaccagtacgtctcgaaaaatgtgattagctccgagcacatcgtggagcgcgaggccgaaacctccttctccacttcgcactacacttcgaccgcccaccactcgactaccgtgactcagaccccttcgcactcgtggtccaacggacatactgaatcgatcttgtccgagagccattcagtcatcgtaatgtcaagcgtcgagaactcccgccattcatctccgactggagggccacgcgggcgcctgaatgggactgggggaccaagagaatgcaactcgttcctgagacatgcccgcgagactccggactcataccgcgatagcccgcactcggaacggtacgtgtccgctatgaccactcctgcccggatgtcgccggtggatttccatactccaagctcaccgaaatcgcccccgagcgagatgtcgccgccagtctcctcgatgaccgtgtcaatgccgtcgatggccgtgtcgccgttcatggaggaagagaggcctcttctgttggtgactccgccgcggctgcgggagaaaaagtttgatcatcacccccaacaattcagctccttccaccacaacccagcgcatgactcgaacagcctcccggcctcacccctgcggatcgtcgaggatgaggagtacgaaactacccaagagtacgaaccggctcaagaacctgtgaagaagctggccaattcccggcgagctaagagaaccaaaccgaacggacacatcgcgaatcggctcgaggtggactcaaacacttcgtctcagtcctccaattccgaatccgaaactgaagatgagcgcgtgggcgaggacaccccctttctcggaatccaaaatccgctcgcggcgtcgttggaagcgacgcctgcctttagacttgctgatagccggactaatccggcgggaagattttccacccaggaagagatccaggcgcggctctcctccgtcatcgccaatcaagaccccatcgcagtg

SEQ ID NO: 17462 - DNA, 1911 bp, Artificial Sequence; identical to SEQ ID NO: 17444
  Description of Artificial Sequence: Synthetic coding sequence

SEQ ID NO: 17463 - DNA, 1911 bp, Artificial Sequence
  Description of Artificial Sequence: Synthetic coding sequence
atgagtgagagaaaggagggtcgagggaagggaaaaggaaagaaaaaagagcggggcagcgggaagaaacctgagagcgcagcggggagccagtcacccgccctgccaccacggctcaaggaaatgaagagccaggagagcgcagcaggtagcaaactggttctgcggtgtgagaccagttctgagtatagttcactgcggttcaagtggtttaaaaacggaaacgagttgaaccggaagaacaagccacagaacatcaaaattcaaaagaagcccggtaagagcgagctgcgaattaataaggcctcactcgcggattctggggagtacatgtgtaaggtaatctcaaagttgggtaatgattccgcaagtgcaaatatcactatagtcgaatccaacgagattatcacaggcatgcccgcgtctacagaaggtgcctatgtctcctcagagtctcctattcggataagcgtgtccacggaaggggcaaacacctcaagctctacaagtacctctaccacaggcacttcacatttggtcaaatgtgccgagaaggaaaagacgttctgtgtgaacggcggagagtgttttatggtgaaagacttgtccaacccaagccggtatttgtgcaagtgcccgaatgaatttacaggcgatcggtgccagaactacgtgatggcatccttctacaaggctgaggagctgtaccagaagagagtgctgacaatcactgggatttgcattgccctgctggtggtcggcattatgtgcgtcgttgcgtattgtaagacaaagaagcagcgaaagaagttgcacgatcgactccgacaaagtttgaggtctgagaggaataatatgatgaacattgccaatggtcctcaccaccctaacccacctccagagaatgtgcagctggttaatcagtatgtctccaagaatgtgatcagctctgagcatattgtggagcgcgaggcggagacgagtttcagcaccagtcactatactagcacggctcatcacagcaccactgtcacccagacaccctcccacagctggtctaacgggcacaccgagagcatactgagcgaaagccacagcgtgatcgttatgtcctccgtggagaacagtcgccactccagtccaaccgggggacccaggggtcgacttaacggaaccggcggacctcgcgagtgtaacagtttcctgagacacgcccgcgagactcctgacagttatcgagattcccctcactccgagagatacgtgtccgccatgactacgcccgcacggatgagccctgtcgactttcatacccctagcagccccaagagtccaccctctgaaatgtctccgcctgtgagcagcatgactgtgagcatgccttctatggcagtgagcccctttatggaagaggaacggcccctcctcctggtgacccccccacgcctgagggaaaaaaaatttgaccatcacccgcagcagttctcttcctttcatcacaaccctgcccacgatagtaacagtctccccgccagtccattgcggattgtggaagatgaggaatacgagactacgcaggagtacgagcctgcccaggaaccagtgaaaaagctggccaacagccggagggccaagaggactaagcctaacggtcatattgccaatagactggaagtggattccaacaccagcagtcagagtagtaatagtgaaagcgagaccgaggatgaacgcgttggcgaagatacccctttcctggggattcaaaacccgctcgcagcatcactggaggctacaccggcgttcaggctggccgattccagaaccaaccccgctgggcggttctccacgcaggaagagatccaggcgcggctcagctccgtgattgcaaaccaggatcctatcgcagtg

SEQ ID NO: 17464 - DNA, 1911 bp, Artificial Sequence
  Description of Artificial Sequence: Synthetic coding sequence
atgtctgaaaggaaagaagggaggggcaagggcaaggggaaaaaaaaggaacggggatctgggaaaaagcccgagtccgcagcgggttcccaatcaccggcattgcctcctcggctgaaggagatgaagtcccaggagtcagcagcagggagcaagcttgtgctgcgctgtgaaacctctagcgaatatagtagcctccgctttaaatggtttaagaacggtaacgaattgaatcggaaaaataaaccgcagaacataaagattcagaaaaaaccgggcaaatccgagctcagaatcaacaaggcctccctcgcagactccggcgaatacatgtgtaaggtgatcagcaagctgggcaatgactccgcttctgcaaacataaccatcgttgaatccaatgagattatcacgggaatgcctgcctccaccgagggcgcttatgtgagctctgagtcccccatcaggataagcgtgagtacagaaggtgccaataccagctcatctactagtacgtccacgacaggcacatcccatctcgtgaaatgcgctgagaaagagaaaaccttctgtgtgaatgggggggaatgttttatggtcaaggatctgtctaacccgtcccgctatctctgtaaatgtcccaatgagtttactggagacagatgccagaactacgttatggctagcttttacaaggctgaggagctgtatcagaaaagagtgctgacaatcacaggtatttgcatcgctctgctggtcgtggggatcatgtgcgtggtagcctactgtaagactaaaaagcagaggaaaaaactgcacgacaggctgcggcagtcactccggagtgaacggaacaatatgatgaacatcgctaatgggccacaccatccaaaccccccccctgaaaatgtgcaacttgttaatcaatacgtgtccaaaaatgtgattagcagcgagcacattgttgaacgggaagctgagacttcttttagtacctctcattacaccagtaccgcccaccactcaaccactgtgactcagaccccaagccattcttggtccaacggacacacggaaagtatcttgtccgagtctcacagtgtgattgtcatgtcatcagtggaaaacagccgacactcatcaccgaccggaggtcctcgcggtagacttaatggcaccggtggccccagagagtgcaattctttcctgcgccacgctcgagagacaccggattcctatagggattcccctcacagtgaacggtatgtcagcgcgatgactacacccgccagaatgagtcctgtcgacttccacacaccaagctcccccaagagccctcccagcgagatgtccccccccgtgagttcaatgactgtcagcatgccgtctatggccgtcagcccattcatggaagaagagcggcctcttttgctcgttacccctcctcggcttcgggaaaagaagtttgatcaccacccacaacagttcagcagtttccatcacaatccggcacacgacagcaatagtcttcccgctagtcccctgaggatcgtagaggacgaggaatacgaaacgacacaagaatacgaacccgcccaagagccagtgaagaaacttgccaattctagaagagcaaaacgcacaaagcctaacggtcacatcgcaaatcggctggaagtggactcaaatacaagtagtcagagcagtaattccgagagtgagaccgaagatgagcgggtcggggaggacacacctttcctggggatccagaaccctctggctgcgtccctcgaagcaactcccgcatttcgccttgctgattcaaggactaatcccgccgggcgcttttctacacaggaagagatccaggctcgcttgagctctgtgattgctaaccaggacccaatcgcagtg

SEQ ID NO: 17465 - DNA, 1911 bp, Artificial Sequence
  Description of Artificial Sequence: Synthetic coding sequence
atgtctgaacggaaagaaggtcgggggaaggggaaaggcaaaaaaaaagaacgcggctcgggaaagaagcctgagtctgcagcgggcagccaaagtcctgccctgcctccccgcctgaaggagatgaagtcccaggagtcagccgcggggtccaaattggtgctgaggtgcgagacttcttccgagtactcctcgttgcgatttaagtggtttaagaatggcaatgaactcaatcgaaagaacaagccccagaatataaaaattcagaaaaagccgggcaaaagcgaactccgaattaataaggccagcctggctgacagcggtgagtacatgtgcaaggtgatatccaagctggggaacgatagtgcaagtgccaatatcacaatcgttgagagtaatgaaattatcaccggaatgcctgcgtccacagagggtgcatatgtctcttctgagagcccaatcaggatatccgtttctacggagggtgctaacacatcgtcatcaacatccactagcaccaccggaacctctcatttagtcaaatgcgcagagaaggagaagacattctgcgtgaatgggggggaatgctttatggtcaaggatctgagcaatccctcgaggtacctgtgtaagtgtcccaatgaatttaccggggacagatgccagaactacgtgatggcgtctttctataaggctgaggaactctaccaaaagcgtgtgctgacaatcactggtatttgtattgccctacttgtcgtggggatcatgtgcgtggtggcttactgtaagaccaagaagcagaggaagaaactacacgaccgcctgcgacagtctctgaggtcggagaggaataatatgatgaacatcgcgaacggccctcatcatccaaacccacctcccgaaaatgtacagcttgtgaaccagtatgttagcaaaaacgtcatttcctcggaacacatagtggaacgggaagcggagacctcctttagcactagccactataccagcactgcccaccacagcaccacggtgactcagacaccctcgcactcatggtcaaacggacacactgagagtatcttgtcagagagccactcagtgattgtgatgtcctccgttgaaaattcgagacatagctctcctaccggaggacctagaggacgccttaacggcacgggagggccccgagaatgcaatagcttccttagacatgcccgtgagacgcccgactcatatcgagatagcccgcactctgaacggtacgtctccgccatgacaacacctgcaagaatgagcccggtcgactttcacactccctcgtccccaaaatcccccccttctgagatgagtccccccgtgtcttcaatgacggtcagcatgccatccatggccgtgagcccatttatggaagaggagcggccacttctgctggttacacccccccgattacgggagaagaagtttgaccaccacccccagcaatttagttctttccatcataatccagcgcatgacagcaatagtttgccggctagccctctgaggatcgttgaggacgaggagtatgagacaacccaggagtacgagccagcacaggaacccgtgaagaagctggcaaattcccggcgggcgaagcggaccaaacctaacggacacatcgctaaccggctcgaggtggatagcaatacgtcttcacagtcttctaactctgagtctgagactgaggatgaacgggtcggcgaagacacacctttcttaggaatacaaaaccctctggccgccagcctggaggctactcccgcatttcgacttgctgattctcgcacaaaccctgcgggcaggttttcgacacaggaggaaatccaggctcggctttcaagcgtcatagcaaaccaggatcctatagccgtg

SEQ ID NO: 17466 - DNA, 1911 bp, Artificial Sequence
  Description of Artificial Sequence: Synthetic coding sequence
atgtccgagcggaaagaagggagagggaagggcaagggcaagaaaaaggagcgggggtcagggaagaaacccgaaagtgctgcgggatcccagtctccagcgctgccgccaaggctgaaggagatgaaatcccaagagtccgctgcaggttccaaactcgtactccgctgcgagaccagtagcgaatattcaagtctaagatttaaatggttcaaaaacggaaatgaactcaatcgaaaaaacaagccacagaatattaagatacaaaaaaagccaggtaagtccgaactgcgtatcaataaggcttctttggctgattccggtgagtacatgtgtaaagtcatatcgaagctgggcaacgactctgcaagtgccaatatcaccatcgtggaatctaacgagattataacggggatgcctgcgagcaccgaaggcgcgtacgttagctccgagagccccattcgtataagcgtatccaccgaaggagccaacacctccagttcaacaagcacctccacgacgggcacctcccatctggtcaaatgtgcggagaaggagaagacgttctgtgtgaatggcggcgaatgtttcatggtgaaagacctctccaatccttctcggtatctgtgcaaatgccccaatgaattcacaggtgatagatgccaaaattacgtaatggcctccttttataaagctgaggagctctatcagaagcgggtgctgacaattacaggcatatgtatcgctctccttgtggtggggatcatgtgcgtggtggcatactgcaaaacaaagaaacagaggaaaaagttgcacgatcgcttacggcaatccctgcgtagcgaaagaaacaacatgatgaacattgctaacggccctcatcatcccaaccccccacccgagaacgttcaactggtgaatcagtacgtctctaaaaatgtgatctcctccgaacacatcgtcgaacgcgaagccgaaacaagctttagcacaagtcactatacgtcaaccgcgcaccattccaccacagtgactcaaacgccaagtcattcctggagcaatggtcacaccgagagcattctgagcgagtcccattccgttattgtcatgagttctgtggagaattcacgacactcatccccaaccggcggccctcgcggtagactgaatggcacggggggacccagggagtgtaatagctttctgcgacacgctcgcgaaacgcccgacagttaccgggacagtccccacagtgagcgatatgtgagtgctatgacaacccccgccagaatgagtccagttgacttccacactccttcgtctccgaagtcaccgccttctgagatgtcaccccccgtgtcctcaatgaccgttagcatgccaagtatggccgtgtctccatttatggaggaggagcggcctctgcttctcgtgacaccacccaggctaagggagaaaaagtttgatcaccatccccagcaattcagttcattccatcataaccccgcccacgactccaactcgctgccagcttcccctctgagaattgtcgaggacgaggagtatgaaaccactcaggaatatgagcccgcccaggagccggtcaaaaagttggccaattctcgccgggcaaaacgaactaaaccaaatggccatattgcaaacaggctggaggtggacagcaatacttccagccagagctccaacagcgagagcgaaacagaagatgaacgggtcggggaggatactccattcttaggtattcaaaatcctctggcagcctctctcgaggccacaccagccttcaggctcgcagacagcaggaccaacccagctggtagattttcaacacaggaggagattcaagccagactgagctccgtaattgcaaaccaggacccaattgccgtg

SEQ ID NO: 17467 - DNA, 1911 bp, Artificial Sequence
  Description of Artificial Sequence: Synthetic coding sequence
atgtccgaacggaaggaaggcagaggaaagggaaagggcaagaagaaggaacgcgggtcaggtaagaagccagagtccgcggccggcagccaaagcccagcacttcctcctcggctcaaggagatgaaatcccaagaaagcgcggctggctcgaaacttgtgctccggtgtgaaacttcctcggaatacagcagcctgcggttcaagtggtttaagaatgggaacgagctgaaccgtaagaataagcctcagaacataaagattcaaaagaaaccgggcaaatcagaactgcggatcaataaggcgagcctggccgacagcggcgagtacatgtgcaaggtcattagcaaacttggtaatgattccgcatcggcaaacatcactattgtggagtcgaatgagattatcacgggaatgcctgccagcaccgaaggagcatatgtctcatctgagagcccgattcgaatttcagtgagcactgagggggcaaacacgtcctcctcgacctcaacttccactactggtacttcccatcttgtcaagtgcgcggaaaaagagaaaaccttctgtgtgaacggtggcgaatgttttatggtgaaggacctgtcaaatccatcaagatacctttgcaaatgcccaaacgaattcaccggcgaccgatgccagaactacgtgatggcatcattctataaggccgaagagttgtaccagaagagagttcttaccatcactggaatttgtatcgcactgctcgtggttggaataatgtgcgtcgtggcctactgtaagactaaaaagcagcgtaagaaactgcacgatagactgcggcaatcgcttcgcagcgaacgtaacaatatgatgaacatcgcaaatggtcctcaccaccctaaccctccgcccgaaaatgtgcaacttgtgaaccagtacgtgtccaaaaacgtgatctcatccgagcacatagtggaaagagaagccgaaacttccttctcaacgtcgcattatacttcaaccgcacaccactcaaccactgtgactcagactccaagccattcgtggtccaacggccataccgaatcgattctgtcggaatcacacagcgtcattgtcatgtcgagcgtggaaaacagcaggcatagctcgcctactggagggccccgcggtagacttaatggtaccggtggtccaagagaatgcaacagctttctgcgccacgctcgcgaaacccctgattcataccgggattcgccacatagcgaacgctacgtctccgcaatgactacccccgcccgcatgtcacctgtcgattttcacactccttcctcgccaaagtcaccgccctcagaaatgagcccgcctgtgtcgtcgatgaccgtgtccatgccttcaatggcagtgtcaccatttatggaagaggagcggccattgctgctcgtgaccccaccgaggcttagagaaaagaagtttgatcaccatccacaacaattttctagcttccatcataaccctgctcacgattccaattcgctgcccgcttcccctctgagaattgtggaggatgaagagtatgaaaccactcaagaatacgaaccagcccaggagcctgtcaagaaactcgcgaattcacgcagagcaaagcgaacgaagcctaatggacatatcgcaaatcgactcgaagtcgacagcaacactagctcacagtcgagcaactcggaatcggagactgaagatgaaagggtcggcgaggacacccccttcctcggcattcaaaaccccctggccgcgtctctggaggccacgccggcatttcgccttgcagactcgcgaactaacccagcaggtagattttccacccaggaagagattcaggcaagactgtcgtctgtcatcgcaaatcaagatcctattgcagtg

SEQ ID NO: 17468 - DNA, 1911 bp, Artificial Sequence
  Description of Artificial Sequence: Synthetic coding sequence
atgtccgagcgcaaagagggtcgaggcaaaggcaaaggaaagaagaaagagcgggggtccggaaagaagcccgagagtgccgcaggctcacaaagccctgcgctgccacctaggctaaaggaaatgaaatcacaggagtctgccgctggcagcaagttagtgctacgttgtgaaacatcctcggagtattcatccttgagattcaaatggttcaagaacggcaatgagctgaatcgcaagaataagccccaaaacatcaaaattcagaagaagcccgggaagtcggagctgcgtattaataaagcctctcttgccgattcgggggagtacatgtgtaaggttatcagtaagctcggaaatgactcagcttccgcgaatatcactatcgtggagtctaacgagattatcacgggcatgcccgcttcgaccgaaggcgcttacgtgagttcggagtcacctatccgcatttccgtctcaacggaaggggcaaatacttccagttctacctcaacttcaaccaccggtacgagccatctagtaaagtgtgccgagaaggagaagactttttgtgtgaacggtggggaatgctttatggtaaaggatttgagtaacccttctcggtatttgtgcaagtgtccgaatgaattcacaggcgaccggtgtcaaaactacgtgatggcctctttttataaggccgaggagttgtatcagaaacgtgtcctgaccatcaccgggatttgcattgcgcttctggtcgtgggaataatgtgcgtcgtggcctattgcaagaccaagaagcagcgtaaaaagctacacgacaggctacgacaatctctgcgttctgaacgaaacaacatgatgaatattgccaatggtccccaccacccaaacccgccacctgagaacgtccaactcgtcaatcagtacgtatccaagaacgtgatcagcagtgagcacatcgttgaacgggaggctgagacgtcattttctacgtcccactatactagcaccgctcatcatagcactacagtaactcagaccccgtcgcattcctggtccaatggtcatacagaatctatcctctctgagtcgcattcagtaatcgtcatgtcttccgtcgagaacagtcgacactctagcccaactggtggtcctcgtggacggctcaatgggaccggaggtcctcgtgagtgtaactcgttcttgcgccatgcccgggagactccggacagctatcgagatagcccacacagcgaaaggtatgttagtgcgatgactaccccagcacgcatgtcccctgttgacttccatacaccatcttcgcctaaaagcccaccgtcagagatgagtccgcccgtcagttcgatgaccgtgagcatgccctcgatggctgtcagcccatttatggaggaggaaagacctctgctgctcgtcactccccctcgactccgggagaagaaatttgatcatcatccccagcagtttagttcttttcatcataacccagcacatgatagtaacagtcttcctgcatcccccctgcgtatcgttgaggatgaggagtacgaaacaactcaagagtacgaacccgctcaggagcctgtgaagaaacttgctaacagtaggcgcgccaaacgtactaagcctaatggacatatcgctaatcggttagaggtggactctaatacgtcgagccaatcttcaaactcagagagcgaaactgaggatgagagagtgggagaggatacccccttccttggtatccaaaatcctctcgctgcaagcctcgaggcaactccagcatttcgactggcggactcgcgaacgaatccagccggtagattctccacgcaggaagaaattcaagcgagattgtcgtccgtcatagctaaccaggatcccatcgctgtg

SEQ ID NO: 17469 - DNA, 1911 bp, Artificial Sequence
  Description of Artificial Sequence: Synthetic coding sequence
atgagcgagaggaaggagggtcgcggtaaagggaaagggaaaaaaaaggagagaggctcggggaaaaaaccggagagtgctgctggctctcagagccccgcattgcctccacgcctgaaagagatgaaatcccaggagagtgctgcaggttccaagcttgttttgagatgtgaaacctcttcggagtattcttccttgaggtttaaatggttcaagaacggaaatgaactgaatagaaagaataagccacagaacattaagatacagaagaagcccggcaaatctgagcttaggataaataaggcatctctcgccgattccggggaatacatgtgtaaagttatctctaaacttggtaatgacagcgcctctgctaatatcaccatcgtggaatccaatgaaatcattactgggatgccagcatccacagagggagcctacgtgagcagcgaatccccgatcaggatctccgtttccacagaaggcgctaacacttcgagtagtaccagtacatctactactgggacttctcatttggtaaaatgcgccgagaaagaaaaaaccttctgcgtgaatggcggagagtgctttatggtaaaggatctgtcaaatccatctagatacttatgcaagtgtcccaatgagtttactggggataggtgtcagaattacgtgatggcttctttttacaaagccgaagagctgtatcagaagagagtgctaacaatcaccggcatttgcattgccctgctagtagtgggtattatgtgcgtggtagcttactgcaagacaaaaaagcagcggaaaaaattgcatgataggcttcgtcaatctttgcggtccgagagaaacaacatgatgaacattgcgaatggaccccatcaccctaatcctcctcccgaaaacgtgcagctggtaaaccagtacgtatctaaaaatgtgatttcaagcgagcacatcgtggaacgggaggctgagacaagtttcagcacatcccactacacaagtacggcccaccactctacaactgtcactcagaccccctctcactcttggtccaatggtcatacagaatccatcctgagcgaaagccatagcgtaatagtgatgtcatccgttgagaactccaggcactcctcccctaccggtgggccccgtggccggctgaacggtacgggcggcccacgcgaatgtaacagcttcctgcggcatgcaagggaaactccagacagttatagagactcaccgcattctgaaaggtatgtgagtgccatgaccacacccgcgagaatgtccccagtcgattttcatacaccttcatctccgaaaagtcccccttcagagatgtcccctcccgtgtcttctatgaccgtgtccatgcctagcatggcagttagccccttcatggaagaggagcgccccctcctgcttgtgactcctccaagactcagggagaaaaaattcgaccaccacccacagcagtttagttctttccatcacaaccccgcacacgattcaaactcgctgccggccagccctcttagaattgtagaagacgaggagtacgagaccacccaagagtacgaacctgctcaggagcccgtgaagaagcttgccaattcacgccgagctaagcgtaccaagccaaatggtcacatagcaaaccgattggaggtggatagcaacacttcctctcagtcctccaatagcgaaagcgaaaccgaagacgagagggttggagaagatacaccattccttggaattcagaaccctctggcggcctctctggaggcaacccctgctttcaggctggcagacagccgcacaaaccctgccggacgcttttcaactcaagaagaaattcaggcccgactaagcagcgtaatcgcaaaccaggatccgatcgctgtg

SEQ ID NO: 17470 - DNA, 1266 bp, Artificial Sequence
  Description of Artificial Sequence: Synthetic coding sequence
atgcgctggcggagagcaccacgacgatccggacggcctggtcctagggcacagcggccaggttctgcagcgagaagctccccacctctcccactgcttcctcttcttctcctgcttggaactgctgcacttgcacctggcgcagcagctggaaacgaggcagcaccagcaggagcatcagtgtgttactcctcaccaccatccgttggaagcgtccaagaacttgcacaacgcgccgctgtggtgattgagggaaaggtgcacccgcaacggcgccaacaaggagcactggataggaaggcggcagcagcagcgggtgaggccggcgcctggggcggtgaccgggagccgcctgcagcgggacctcgggcacttggacctcctgcagaagagccccttctcgcggcaaacggtacggtgccatcgtggccgactgcgccagtgcctagcgcaggagaaccgggcgaggaggccccctacctggtgaaagtgcatcaagtgtgggcagtcaaggcaggcggacttaagaaagattccctccttacggtgcgtctgggtacgtggggacatcctgcgtttccttcgtgtggtagactcaaagaggacagccgctatatctttttcatggaacctgatgcaaactccacgtccagagcgccagcagcattccgggcatcctttccacccctggagactggaagaaatcttaagaaggaggtgtcccgcgtgctttgcaagcgatgtgcacttccgcctcgtttgaaggaaatgaagtcgcaggaatcggcagcaggtagcaagctggtgctgcgatgtgaaacctcgtccgaatactcctccctcaggttcaaatggttcaagaatggaaacgagttgaatcgcaaaaacaagccacaaaacattaagatccaaaagaagcctggaaagtccgaactcagaatcaataaagcatctctcgccgattccggtgaatacatgtgtaaggtcatcagcaagctggggaatgattcggcttcagcaaacattactattgtcgaatcgaatgcaaccagcacctcaactactggtacctcgcatctggtgaagtgtgcggaaaaagagaaaaccttttgtgtgaatggtggtgaatgctttatggtcaaagatctgtctaacccttcaaggtacctgtgtaagtgtccaaacgaatttaccggcgatagatgtcagaattacgtgatggcgtcgttttactcgacctccaccccatttctcagcctgcctgag

SEQ ID NO: 17471 - DNA, 1266 bp, Artificial Sequence
  Description of Artificial Sequence: Synthetic coding sequence
atgcggtggagacgggccccacgaagatccggcagaccaggtcctcgggcccagaggccaggctctgctgcgcggtcatcaccacctctgcccttgctgccgctcttgctgttgctcgggaccgctgctctcgcccccggtgccgccgccggaaacgaagccgcacctgccggtgcatccgtgtgttattccagccccccgtccgttggctctgtgcaggagttggcccaacgggcggctgtagtgattgaaggaaaagtgcacccacaacgaaggcagcagggcgccctggatagaaaagccgctgccgccgccggcgaggcaggtgcatggggtggtgatagggagccaccagccgccggacctcgcgcacttgggccacccgccgaagaacccttgctcgccgcgaacggtacagtgccaagctggccaactgcccctgttccaagcgccggggaaccaggcgaagaggccccttacctggtgaaggtgcaccaggtctgggcggtgaaagccggcgggttgaagaaagattctcttctgacagtgcggctgggcacttggggccacccagcctttccctcctgcgggaggttgaaggaggacagcagatatatcttcttcatggaacctgacgcgaatagcacctccagagctccggctgcatttcgcgcctcttttccccccctggagactggtcgaaatctcaagaaggaagtgagccgcgtgctgtgtaagcgctgtgctttgcctccccggctgaaggagatgaaatctcaagagtcagctgctgggtctaagcttgtcctgcggtgcgagaccagctctgagtacagcagtcttagattcaaatggttcaaaaacggtaacgaactcaatagaaagaacaagcctcaaaatatcaaaatccaaaagaagccaggcaagagtgaactcaggattaacaaagcatcactggctgatagcggcgaatacatgtgtaaggtcatatctaaacttggaaatgacagtgcaagcgccaacataactatcgttgaatcaaatgccactagtactagcactacgggaacctcccatctggtgaagtgcgccgagaaagagaaaaccttttgcgtgaatgggggcgagtgtttcatggtaaaggatctcagcaacccttctagatacctgtgcaaatgccctaacgagtttacgggcgacagatgtcagaattacgtcatggcatccttttattccaccagcaccccgttcttgtccctgccagaa

SEQ ID NO: 17472 - DNA, 1266 bp, Artificial Sequence
  Description of Artificial Sequence: Synthetic coding sequence
atgcgttggcggagagctccccgccgcagcgggcgcccaggtcctcgggcacagcgacctggaagtgccgcgcgctcaagcccgcctttgccactgctgccactgctgctgctactgggcaccgctgcgctggctccaggtgcggcggctggtaacgaggcagccccagcgggagccagcgtttgctactcatctccacctagcgtgggttctgtgcaggaactggcacagcgcgccgcggtggtgatcgaaggcaaagttcatcctcaacgacgtcagcaaggcgctctggaccgtaaggcagctgctgcagccggcgaggccggggcttggggcggtgatcgcgagccaccggctgccggtcctcgggcactgggcccacctgcagaagagccactgctggcggcgaacggtaccgtgcctagctggccaaccgcgccggtcccgtccgccggtgagcctggtgaggaagccccttacctcgtgaaagtccatcaagtctgggcggtcaaagcaggtggcttgaaaaaggatagcctgctcaccgttcgcctgggtacttggggccacccggcgttcccttcctgcggccgactgaaagaagattcacgctacatcttcttcatggagcctgatgcaaactctacgtcccgagcgccggctgcatttcgagcctctttccctccattggaaacggggcgaaacctgaaaaaggaggtgagcagggtcctgtgcaagcgttgcgccctgccgcccagactgaaagagatgaagagccaggaatccgcagcgggcagcaagctggttctgcggtgcgaaactagctcggagtacagctctctgcgatttaagtggttcaagaacggaaatgaactaaaccgcaagaacaagccccaaaatattaaaattcaaaagaaaccgggtaagtcagaactgcgcatcaacaaggcgtcacttgcagatagcggggagtacatgtgtaaagtgattagcaagcttggtaatgattctgcgtccgccaatatcacgatcgttgagtctaatgctacctcgacgtccacgaccggtacctcccacctggtcaaatgtgctgagaaggaaaaaacgttttgtgtaaacggtggtgaatgcttcatggtgaaagatttgagcaacccaagccgctacctgtgcaaatgccctaacgaattcacaggtgatcgttgccagaattatgtgatggcaagtttctacagcacctcgactcctttcctgagcttgccggag

SEQ ID NO: 17473 - DNA, 1266 bp, Artificial Sequence
  Description of Artificial Sequence: Synthetic coding sequence
atgcgctggcgtcgtgcccctcgtcgctctggtaggcccggtccccgcgctcagcgtcccggcagtgccgctcgcagctcacctcccctccccctcctccctctgcttctgctgctgggcactgcagctttggcccccggtgccgctgccggtaacgaagccgcacctgctggcgcttccgtctgctattcttccccacccagtgtcggtagtgtgcaggagcttgcccaaagagctgccgtcgtaattgagggtaaagtacaccctcagcgcagacagcagggagctctggatcgcaaggcagccgccgctgccggtgaggccggtgcctggggcggcgacagagagcccccagccgcaggtcccagagcactcggccccccagcagaagagcccctgttggccgccaacggaaccgtgcccagctggcctaccgcccccgtaccaagcgccggcgagcccggagaggaagccccatatttggtcaaggttcatcaggtgtgggccgtgaaggcaggaggtttgaagaaagattctctcctgactgtaagactgggtacctggggccatccagctttccccagttgcggccgtctcaaggaagacagccgctacatttttttcatggagcctgatgccaatagcactagccgcgcccccgctgcatttcgcgctagcttcccaccccttgagaccggaagaaacctcaagaaagaagtgtctagggtgctgtgcaagaggtgtgcactgcccccacgcctcaaggaaatgaagtctcaggagtccgccgcaggtagcaagctggtacttcgctgcgagacctccagtgagtactcatccctgaggttcaaatggttcaagaatggaaacgagctgaaccgtaagaacaaacctcagaacattaaaatacagaagaaacctggaaaatccgaactgcgcatcaataaggcctcccttgccgatagcggcgaatacatgtgtaaggtcatctccaagttgggtaacgattccgcttccgccaatattaccattgtggagtccaatgccacatctacatcaaccaccggaacctctcatctcgttaagtgcgccgaaaaggaaaagaccttttgcgttaatggtggtgaatgtttcatggtcaaggacctgagcaacccctcacgctatctctgcaaatgccccaacgagtttaccggcgaccgttgtcagaattatgtcatggcatcattctactctacctcaacccctttcctcagtctgcccgaa

SEQ ID NO: 17474 - DNA, 1266 bp, Artificial Sequence
  Description of Artificial Sequence: Synthetic coding sequence
atgcgttggcggagagcgccaagacgatcagggcgacctggtcccagagcgcagcggcccgggtcagcagcccggagctcccctccccttccacttctccctctgcttcttctgctggggaccgcagcgctggctccaggtgcagccgcaggaaacgaggctgctcctgctggagcctcagtgtgttactcgtcccctccaagcgtgggatcggtgcaagaactggcacagagggccgcagtggtcatagagggcaaagtccatcctcaacgtcgtcagcaaggagcactggataggaaagcggcagccgctgcgggggaagcgggtgcatggggcggtgaccgggaaccacctgccgctgggcctcgagccctgggaccgcccgcagaagagccccttcttgcagccaacggcaccgtcccttcctggcccacggcacctgtcccatcagcaggggaaccgggagaagaagcaccttacctggttaaggttcatcaagtctgggcggtgaaggcaggtggtctgaaaaaggactccctgctcaccgtgaggctcggtacctggggtcacccagccttcccatcgtgtggtagactcaaggaggattcccgctacatcttctttatggagccagacgcgaattcaacttcgagggccccagctgcgtttcgtgcctcatttccaccattggaaactgggcgtaacctcaagaaggaagtctccagagtcttgtgcaaacggtgtgcactcccacctaggcttaaggagatgaagtcacaagagtccgccgcaggatcgaaactggtgcttaggtgcgagacttcatcggaatactctagcctgagatttaagtggtttaagaacgggaacgaacttaatcgcaagaacaagcctcaaaacattaagatccagaaaaagccaggaaagtcagaactcaggattaacaaggcatcgctcgcagatagcggcgagtacatgtgtaaggtcatttccaagctcggaaacgattcagcctcggcaaatatcaccatcgtggaatcaaacgcaacgtcgacctcgactaccggaacctcgcaccttgtcaaatgtgcagaaaaagagaaaactttttgcgtcaatggtggcgaatgtttcatggtgaaggatctctcgaatcccagccgatacttgtgcaaatgtccgaatgagttcactggtgaccgctgccagaactatgttatggcctccttttactctacctcgacgcccttcctgtcgcttcctgag

SEQ ID NO: 17475 - DNA, 1266 bp, Artificial Sequence
  Description of Artificial Sequence: Synthetic coding sequence
atgagatggcgccgggctccgcgccggtcgggacggccgggccctcgtgcacagagaccgggttcggcagcgcgaagctctcccccgttgcctcttttgccgctgctccttttgcttggcacggctgcacttgccccgggggcggcggccggaaacgaagcagcaccggccggggcgtccgtttgttattcgtcacctccgtccgtcggatccgtgcaggaactcgcgcaacgcgcggcagtagttattgaaggaaaggtccatccgcagagacgtcagcaaggcgcgttagatcgcaaagcggccgcggcagccggagaagctggtgcatggggaggagatcgtgagccgccggcagcaggccctcgagccctggggccaccggcggaagagccgcttcttgctgccaacggaaccgtacctagctggcctacagctccggtcccgagcgccggcgaaccaggcgaagaagctccgtatcttgtcaaagtgcaccaagtgtgggctgtaaaagcgggcggacttaaaaaagactcgcttcttacggtaagacttggcacgtggggccatccggcttttccaagctgtggacgactaaaggaagatagccgctatatatttttcatggagccggatgcaaattccacgagtcgcgcaccggcggcgtttagggcttcctttccgccactggaaacaggccgcaacttgaaaaaggaagtaagccgggtgctttgtaagcgttgcgcactgcctcctcggctgaaggaaatgaaaagtcaagaaagcgcggcaggctcaaaattagttctgcgatgcgaaacgagctctgagtattcatcgcttagatttaaatggtttaaaaacggcaacgaattgaatcgcaagaataaacctcagaacatcaaaatccaaaaaaagcctggaaaaagtgagttgagaattaacaaagccagcctggcggactcgggagaatatatgtgtaaagttatttctaagctgggcaatgattccgcatccgcgaatattacaatagttgaaagcaatgccaccagtacctctacgaccggtacgtcacacctagtcaaatgcgcggagaaagaaaaaacgttttgcgtcaatggcggagaatgttttatggtgaaggatctttcaaatccgtccaggtacttatgcaaatgccctaacgagtttactggagatagatgtcaaaattatgttatggctagtttttatagtacatctactccgtttctcagcctgcctgag

SEQ ID NO: 17476 - DNA, 1266 bp, Artificial Sequence
  Description of Artificial Sequence: Synthetic coding sequence
atgaggtggcgccgggcacctcggcgaagcggtcggccgggaccccgggcacaacggcctggatcggcagctcggagctccccgcctctgccgcttttgcccctgctgctgttgctgggaacggctgcacttgcaccaggtgccgccgcgggaaatgaggctgcaccggctggtgcatcggtgtgctactcctctccgccgtccgtgggaagcgtgcaggagctggcacaaagagccgcggtggtgatcgaaggaaaggtgcacccgcaacgcagacaacaaggggccctggaccggaaggctgcggcggcggccggcgaagctggggcttggggtggcgaccgtgaaccaccggccgccggcccgcgcgcgcttggacctccggcggaggaacctcttcttgccgcaaatggaactgtgccttcctggccgactgccccggtcccatccgcgggtgaacccggagaggaagctccctacctggttaaggtgcatcaggtgtgggccgtgaaagcaggcgggctgaagaaggacagtctgctgactgtgaggctgggcacctggggccacccagccttcccgtcctgcggaaggctgaaggaggactcgagatacatcttctttatggaacccgacgcaaactccacctcaagggcccctgccgctttccgcgcctcgttcccgcctctggaaaccggacgcaatctcaagaaggaagtgtcccgggtgctgtgcaagagatgtgcattgccacctcggttgaaagaaatgaagtctcaagaatcagccgcaggatcaaaactcgtgctccgttgcgagacttcatcggaatactcgtcgctcagattcaagtggttcaaaaacggaaatgagctcaatcggaagaataaaccgcagaatatcaagattcaaaagaagccgggtaagtcagaactgaggatcaacaaggcctccctcgccgactcgggtgagtacatgtgcaaggtcatctcgaagctgggaaatgacagcgcctcagctaacattacgattgttgagtccaacgccaccagcacttcgactacgggcacctcccacctcgtcaagtgcgcagagaaggaaaagaccttctgcgtgaatggaggagagtgcttcatggtcaaagatctgagcaatccatcgcgatacctctgtaaatgtccaaacgaattcactggcgacaggtgccagaattacgtgatggcctcgttttactcaactagcactccgtttctgtcgctgccagaa

SEQ ID NO: 17477 - DNA, 1266 bp, Artificial Sequence
  Description of Artificial Sequence: Synthetic coding sequence
atgaggtggagaagagctccaaggaggtccgggcgacccgggcctcgggcccagcgtccgggctccgctgcccgatcatcacctcctctgcccttgcttcctctactcctattactaggcaccgcagccctggcccctggagccgccgccggaaacgaggcggcccccgccggagcttcggtttgttactcgtcacctccatccgtaggctctgtgcaggaactcgctcagcgcgctgctgtggtcatcgagggtaaagtccatccacaaagaaggcagcaaggggctctggatcgcaaggctgcagctgcagcaggtgaggccggcgcctggggaggcgaccgagagccaccagccgccggtcctagagctctaggacctcctgccgaggagcctctgctggccgcaaatggcacagtcccgtcgtggccgactgcccctgtcccaagcgctggggagcccggggaggaagcaccctacctggtgaaggtacaccaggtctgggctgtgaaggctggcggcttgaagaaagattcccttctgaccgttcgtctcggcacttggggacaccccgccttcccttcttgcggaaggttaaaagaggatagtcgctacatctttttcatggagccagatgctaattcaacgtcacgcgcacctgctgctttccgggcctcgttcccccctttggagaccggtcggaacctcaagaaggaagtgtctagagtgctctgcaagcgctgtgcactgccaccgaggctgaaggaaatgaagtcccaggagtcagccgccgggtctaagctggtgctgaggtgcgagacgtcaagcgagtattcatctcttaggtttaaatggtttaagaacggaaatgagctgaaccggaagaacaagccacaaaatattaagatacagaagaaaccagggaagtccgagcttagaatcaataaagctagcctcgccgacagcggcgagtatatgtgcaaagtgatatctaagctgggaaatgatagcgccagcgcgaacataaccatcgtggagagcaacgctacctccaccagcacgacaggaacgtcacatctggtgaaatgcgccgagaaggagaagactttctgtgtaaacgggggtgagtgcttcatggtgaaggacctgagtaaccctagtaggtatttgtgtaaatgcccaaatgagtttactggtgatcggtgtcagaattatgtcatggctagtttctactccacttctacgccttttctatccctacctgaa

SEQ ID NO: 17478 - DNA, 1266 bp, Artificial Sequence
  Description of Artificial Sequence: Synthetic coding sequence
atgagatggaggcgcgcccctcgtagatcggggcgtcctggtcctagagcgcaaagacctggatccgcagctagatcgtcccctccacttccgctcctgcctcttctgctgcttctgggaaccgccgcattggcacctggagcggcagcaggcaatgaagccgcgccagcaggcgcctcagtgtgttactcctcccctccatcagtcggatcggtgcaggaattggcacagagagcagcagtggtcattgagggaaaggtgcatccacaacgcagacaacagggggcgctggatcgtaaggctgcagcggccgccggtgaggcaggtgcttggggcggggaccgcgaaccaccggcagcaggacctcgggcacttggcccacccgctgaggaaccccttctggccgcaaacggaaccgtgccttcctggccaactgcgccagtgcctagcgcgggtgaaccaggagaagaggcaccttaccttgtcaaagtgcatcaagtgtgggctgtgaaagccggtggcctcaaaaaggacagcctgctgaccgtgcgccttggaacttggggacatcctgcctttccaagctgcggtagactgaaggaggattcacgttacattttctttatggaacctgacgccaattcgacctcgcgcgctcctgctgcattcagagcatccttccctccccttgaaaccggtcgcaaccttaagaaggaggtttctcgggtgctttgtaaaagatgtgcactcccgccaagactcaaggagatgaagtcccaagagtccgcagccggcagcaagctggtgctccgttgtgaaacgagcagcgaatactccagcctgaggtttaagtggtttaagaacggaaatgaacttaatcgcaaaaacaaaccgcagaacattaagatccagaagaagccgggtaagtcagaactgcgcattaacaaggcgtcgctcgcagatagcggcgaatacatgtgtaaggtgatttcgaagctcggaaacgattccgcctcggccaatatcaccattgtcgaaagcaacgctaccagcacttcgactaccggaacttcccaccttgttaaatgcgcggaaaaggaaaagaccttttgcgtgaatggaggtgagtgctttatggtgaaggacctctcgaatccttcgcgatacctttgtaaatgtcctaatgagtttaccggtgacagatgtcaaaactacgtcatggcctccttttactccacttccaccccgttcctttcgctccctgaa

SEQ ID NO: 17479 - DNA, 1266 bp, Artificial Sequence
  Description of Artificial Sequence: Synthetic coding sequence
atgcggtggagaagggctcctcgccgtagtggtcgtcccggtcctagggcccaaaggcctggatcagctgcgcgatctagtcctcctctccctctgctgccattactgctccttcttggcacggccgcgcttgcccctggtgcagctgcagggaacgaggcggctccagccggagcgtcggtgtgttactccagccccccttccgtagggtcagtgcaagagttagcccaacgagctgccgttgtgattgagggaaaggtccatccccagcgacgccagcaaggcgctcttgatcgcaaagctgcggcggcagctggggaggcaggagcctgggggggagatagagagccaccagctgcaggtccccgggctcttggtcccccagccgaggaacccttgttggccgctaacggcactgttccaagctggcccaccgcccccgttccgtctgccggggagcccggggaggaggctccatacctggtaaaagttcaccaagtatgggcagtaaaggctgggggcctcaagaaggacagcctcttgaccgtgcgccttggaacctggggtcatcccgctttcccatcatgcggccgacttaaggaagactctcggtacattttttttatggagcctgacgccaactcaacgagccgcgcccctgcggcattccgcgcttccttccctccccttgagaccggccgcaacttaaagaaggaggtaagtcgggttctctgtaagagatgtgcactaccgcctcgcctgaaagaaatgaagagccaggagtcggcggctgggtccaagctagtattgcggtgcgagacgtcatctgagtactccagtctacgtttcaagtggtttaaaaacgggaacgagctgaaccgcaagaacaaaccacaaaacataaagattcagaaaaagccaggtaagtctgaacttcgcattaataaagcatcgcttgcagacagcggtgagtatatgtgtaaggtgatctcaaagctgggtaacgatagcgcatcagcgaacatcactatcgtggaatccaatgccacatcgacctcgacgaccggtacttcgcaccttgttaaatgcgccgaaaaggagaagacattttgtgtgaacggaggtgagtgcttcatggtcaaggacctgtccaacccctcacgctacctgtgcaagtgtcccaacgagtttacaggcgataggtgtcagaactatgtcatggcttcattttacagcacgtcgactccgttcttgtcactccctgag

SEQ ID NO: 17480 - DNA, 1266 bp, Artificial Sequence
  Description of Artificial Sequence: Synthetic coding sequence
atgcggtggagaagagctccgcgaaggtcgggacggcctgggccgcgggcccagcgtcccggtagcgcggcgaggagctcgccgccgcttcctcttctgcccctccttctcctgctgggcacggccgccctggcacccggagcggcggcaggaaatgaggcagcccccgccggcgcgagcgtgtgctactcgtctccaccgtccgtgggcagcgtgcaagagctcgctcaacgggccgccgtggtgatcgagggaaaggttcatccacaaaggcgccagcagggcgccctcgataggaaagctgcagcagcggcgggcgaagccggggcatggggaggagatcgagaaccgcccgccgcaggaccgcgggcgctgggtcctccagccgaggaacccttgctcgcagcgaacggaaccgtcccgtcctggcctactgcaccggtcccgagcgcaggtgagccaggcgaagaggcaccgtacctggtgaaggtccatcaggtctgggctgtcaaggctggaggcctcaagaaggattcgcttctgaccgtgagacttggaacctggggccacccagcattccccagctgcggacgcttgaaagaggactcgcgctacatctttttcatggaaccagacgccaattcaacctcgcgcgcaccggcggcattccgggcttccttcccgcccctggagactggacgaaacctgaaaaaggaggttagccgcgtgctgtgcaaaagatgcgcgctcccaccaagacttaaggaaatgaagtcgcaggagagcgcagccggcagcaaactcgtgctcaggtgtgaaaccagttccgagtacagctcgctgagattcaagtggttcaaaaacggtaacgagctgaacagaaagaacaagcctcagaatatcaagatccaaaagaaaccaggaaagtcggaactccgcatcaacaaagcatccctggctgactccggggaatacatgtgcaaggtcatcagcaagctcggtaatgattcggcctcagcgaacattactattgtcgagtcaaacgcaactagcacctcgaccactggaacctcgcacctcgtgaaatgcgccgagaaggaaaagaccttttgcgtgaatggaggggaatgctttatggtaaaggacctgtcgaatccgtcaaggtatctctgcaagtgtccgaacgaattcaccggagacagatgtcaaaactacgtgatggcatccttctactccacttcaactccgtttctcagtctcccggaa

SEQ ID NO: 17481 - DNA, 1266 bp, Artificial Sequence
  Description of Artificial Sequence: Synthetic coding sequence
atgaggtggaggagggcccctcggcgatccgggcgccccggacctcgggcacagaggcccggatccgcagcacgctcttctcccccactgccccttctacctcttctgcttctgttgggcacagcagccctggcccccggcgccgctgctggtaacgaggccgccccagcaggcgcctccgtatgttattcttctccacccagcgttggttctgtccaggagctggcacagcgcgcagcagtcgtgattgagggaaaggtgcacccacaacgtagacaacagggggcacttgatcggaaagccgcagcggcggctggggaagccggcgcgtggggcggagacagagaacctcctgcagccgggccaagagccttaggcccacctgctgaggagccattactggcagcaaatggaacagtcccatcttggcctacggcaccggtgccaagtgcgggggaacctggcgaggaggctccctatctagtcaaagtccaccaggtgtgggcggtgaaggctggagggctaaagaaggattcactacttactgtgcggcttgggacctgggggcatcctgcttttcctagttgcggccgattgaaagaggattctaggtacatattcttcatggagccagacgctaattctactagcagagcacctgcggcctttcgcgcctcttttcctccactagaaacgggccgaaatttaaaaaaagaggtctcccgggtgttgtgcaaaagatgcgctcttcctcctcggcttaaggagatgaagtcccaggagtcagccgcaggaagtaaacttgttcttcgctgcgagacatccagcgagtacagctctctgcggtttaagtggttcaagaacggaaatgaactcaaccggaaaaacaagccccagaacatcaagattcagaaaaaaccaggtaagagcgagcttcgcattaacaaagccagccttgctgattctggggagtacatgtgtaaagtgataagcaaactcgggaacgactctgcatccgctaacattactatagtcgagagcaacgcaacatctacatcaacaacaggtacctcccacctggttaagtgcgctgaaaaagagaagactttttgcgttaacggcggagaatgttttatggtcaaggacctgagtaacccctcaaggtacctctgtaagtgccccaacgaatttactggcgaccggtgtcagaactatgttatggcatccttctattcaacttctactcctttcctgagcctgcctgaa

SEQ ID NO: 17482 - DNA, 1266 bp, Artificial Sequence
  Description of Artificial Sequence: Synthetic coding sequence
atgcggtggagacgcgccccgcggaggagcggcaggcccggaccgcgcgcccaaagacctggaagcgcagctagatcgagcccgcctctccctctgctcccactcttgctgttgctgggtactgcggcacttgcaccgggcgcggccgctgggaatgaagccgccccagccggtgcctccgtgtgctattcgtcaccaccgtccgtcggatcagtgcaagagttggcgcaacgcgcggcagtggtgatcgagggaaaggtgcacccgcaacggcgccagcagggagctctcgaccgcaaagcagccgctgcggccggagaagcaggcgcctggggaggcgaccgcgaaccgccagctgccggtccacgggccttgggtcccccagcagaggaaccattgctggctgccaatggcaccgtcccaagctggccaactgcgccggtgccctccgcgggagagccgggagaagaggcaccgtaccttgtgaaggtgcatcaagtgtgggcagtgaaggccggtggactgaaaaaggactcactgctcaccgtgaggctgggtacttggggacacccggccttcccatcatgtggcaggttgaaagaggactcccggtacatcttcttcatggaaccggatgcaaactcaacttcaagagccccagccgctttccgcgcatcgttcccgccgcttgagacgggaagaaatctgaagaaggaagtgtctcgcgtgttgtgcaagagatgtgccttgccccccagacttaaggaaatgaagtcgcaggaaagcgcagcgggaagcaagctggtcctccgatgcgaaacctcctccgagtactcatcgctcagattcaagtggttcaaaaacggaaacgagttgaaccgcaaaaacaagcctcagaatatcaagatccagaagaaaccagggaagtccgaactccgcatcaacaaagcctcactggccgattccggagagtacatgtgcaaggtgatcagcaaattgggcaacgattctgcttcggcaaatatcaccatcgtggagagcaacgccacttccacctcgactactggaacttcgcatctcgtgaagtgcgcggaaaaagaaaagactttctgcgtgaacgggggagaatgcttcatggttaaggacctcagcaacccgtcccggtacctgtgcaaatgcccgaatgagttcaccggggacaggtgtcagaactacgtgatggcgtcattctacagcacgagcactccgtttctttctctgccggaa

SEQ ID NO: 17483 - DNA, 1266 bp, Artificial Sequence
  Description of Artificial Sequence: Synthetic coding sequence
atgcgctggaggcgcgctccaagaagatctgggaggcctggacccagagctcaacgtcccggcagcgccgctaggagctcaccccccctgccactcctgccactactgctactcctgggaacagccgccctcgctcctggagctgcggccgggaatgaggcggccccagcgggcgcctctgtttgttactcatccccaccctcagtgggtagcgttcaggaattggcacagagagccgcggtcgtaattgaaggcaaggttcatccgcagcgcagacagcagggcgccctggacaggaaagccgccgccgcggccggcgaggccggagcttggggcggtgaccgagagccaccggctgccgggcctcgggccttggggcctccagccgaggaacccctgctagctgccaacggcacagtgccttcctggccaaccgcccctgtccccagcgctggagagcccggggaagaagctccctatctcgtcaaggtccatcaggtgtgggccgtgaaagccggaggtctgaaaaaggactccttgttaacggttcgcctgggaacatgggggcatccggcttttccctcctgtggccgattaaaagaagactcaaggtacattttctttatggagcccgatgctaattctacgagtcgggctcccgcggcgttccgagcgagtttcccacctctggagaccggccgtaacctgaagaaagaggtctctcgggttctgtgtaagcgctgcgccctgccacccaggctgaaagagatgaagtcccaagagtccgctgctggctcaaaactggtgctgcgctgcgaaacatcctccgaatacagctcgctgcgtttcaagtggtttaaaaatgggaatgagctcaatcggaagaacaagcctcaaaacatcaagatccagaagaaacccggcaagagcgaactccgcatcaataaagcatctctggctgacagcggggagtacatgtgcaaagtcatttcaaagctgggcaacgactccgcgtcagccaacatcactatagtggagtctaatgcaacctccactagtactactggcacaagccacctggtgaagtgcgccgaaaaggaaaaaactttctgtgttaacggaggggagtgcttcatggtcaaggatctgagcaacccatctcggtacttgtgcaagtgccctaacgagttcactggcgatcgatgccagaattacgtgatggcaagcttttactctacttccaccccctttctgtctttgccagag

SEQ ID NO: 17484 - DNA, 1266 bp, Artificial Sequence
  Description of Artificial Sequence: Synthetic coding sequence
atgaggtggcgccgggcaccaagaaggagcggccgccccggccctcgcgcccagaggccgggatcggcagcccggtcaagtcccccactgcccctactgcctcttctattgttgctcgggacggctgctttggccccaggcgccgctgccgggaatgaagccgccccagcgggcgcgtcggtctgctacagcagccctcccagtgtagggtccgtccaggaactggcgcagcgcgccgccgtcgtaatcgagggaaaggttcacccacaacggcgacagcaaggtgctctggatcgcaaggcagctgctgccgctggagaagctggggcgtggggtggagatagggaaccacccgcagcaggccctcgggctctggggcctcctgctgaagaacccctccttgccgcgaatggcaccgtcccgtcttggcctactgctccagtcccctccgccggtgagccaggagaggaagccccatatctggtgaaggtgcaccaggtctgggcagttaaggctggcggtctgaagaaagattcacttctgacggtgcggctgggtacctggggccacccggccttcccttcctgtggccgcctcaaggaggactcacggtatattttttttatggaacctgatgccaattcgacctcccgtgcaccggccgcgtttagggcctcctttccacctctggagactggcagaaatctcaagaaagaggtgagtcgcgtgctatgcaaacgctgtgcactgccgccgagactgaaggagatgaaaagtcaagaatccgcggccggctctaaacttgtcctgcgctgcgagacttcttctgaatattcgagtttgcgattcaagtggttcaagaacggaaatgagctcaaccgcaaaaacaaaccccagaatataaaaattcagaaaaaacccggaaaatcagagctgagaatcaataaggcaagcctggccgatagcggcgagtatatgtgcaaagttatatctaagttaggaaatgatagcgctagtgctaacattacgattgtggagtccaatgccacatccacttcaacgacaggaacttcccatctcgtgaaatgtgcagagaaggaaaaaacgttttgtgtcaatgggggggaatgtttcatggtgaaggatctctccaatccatctagatatctgtgcaagtgccctaacgagttcaccggcgatcggtgccaaaattatgtgatggcaagcttctattccacttccacgccttttctttccctgcctgag

SEQ ID NO: 17485 - DNA, 1266 bp, Artificial Sequence
  Description of Artificial Sequence: Synthetic coding sequence
atgcggtggagacgggcgcccaggcgctcgggtcggccggggccgcgggcacaacgcccgggctcggctgctcgatccagcccgccattgcctctgcttccactgctgctgcttttggggactgcggcgctcgccccgggcgcagctgctggaaatgaagcggccccagccggtgcgtccgtgtgctactcctcgccgccgtccgtgggttccgtgcaagagctcgcccaaagggcggctgtggtgatcgagggaaaggtgcacccgcagcgcaggcagcagggagccctcgataggaaagcggccgcagccgcgggagaggctggagcctggggcggagacagagaaccgcctgcggccggaccgagagcactgggcccaccagccgaggaaccgctgctggccgccaacggaacggtcccatcgtggccaactgcccccgttccgtcggcgggagaaccaggagaagaagccccgtacctggttaaggtgcaccaagtgtgggctgtgaaagcaggaggtctgaagaaagattcactccttaccgtgcgcctgggaacctggggacatccagcgttcccgtcgtgcggcaggctgaaggaggacagcaggtacattttctttatggaaccggatgccaacagcacctcacgggcccctgctgctttccgcgcctcctttccgcccctcgagactggtagaaacctcaagaaggaagtgtcaagagtgctttgcaagcgctgcgctctccctccacgcttgaaggagatgaagagccaagagtcagctgcaggctcaaagctggtgctccggtgcgaaacctcgagcgagtacagttccctccgctttaagtggttcaagaatggaaatgagctgaaccgcaagaataaaccgcagaatatcaagattcagaaaaaaccgggcaaatccgaactgcggatcaacaaggccagcctggccgactcgggcgaatacatgtgcaaagtgatttcgaagctggggaacgactccgcgagcgccaatatcactatcgtcgaatctaacgccacctccacctctaccactggcacctcccacctcgtcaagtgtgcggagaaggaaaagacgttctgtgtcaacggaggcgagtgtttcatggtgaaggacctctcgaatccaagcaggtacctgtgcaagtgtcctaacgaattcaccggagacagatgtcaaaactacgtcatggcctccttctactcaacttcaactcctttcctgagtctgcccgag

SEQ ID NO: 17486 - DNA, 1266 bp, Artificial Sequence
  Description of Artificial Sequence: Synthetic coding sequence
atgcgatggcgccgagccccgagaaggtctgggaggcccggtccacgggctcagaggcccggttccgcggcccgatccagtcccccgttacctcttttgcccctcttgcttctgctcggaactgcggccctggctcctggcgccgctgccggaaacgaggcagctcctgccggggctagtgtgtgctatagcagtccaccttcggtaggctccgtacaagaactcgcccagcgcgctgctgtcgtcattgaggggaaggtacacccacagcgccggcagcaaggcgctttagataggaaggccgccgcagccgcgggagaagcaggcgcatggggcggggatagggaaccacccgcggccggccctcgtgcactgggccccccagcggaggagccacttctggcagccaacgggaccgtgcctagttggcctactgcacccgtccctagcgccggagagcctggagaggaggcaccttatttagttaaagtgcaccaggtgtgggcagtgaaggctgggggcctgaaaaaagacagcctcctgacagtacggctaggcacctggggacaccccgcatttccatcttgtggcaggctgaaagaggactcccgctacatattctttatggaaccggatgccaattctacctcacgggctcctgccgcctttagagcaagctttcctcctcttgagactgggcggaacctgaagaaagaagtttctcgggtactgtgcaaacgttgcgccctgccccctcggctcaaggaaatgaaaagccaggaatcagctgctggaagtaagcttgtgctccgatgcgaaaccagcagtgagtactcttcactgcggtttaaatggttcaaaaatggcaacgagctgaacagaaagaataagcctcagaacatcaagattcaaaaaaaacccggaaaatcagaattgcgcatcaacaaggcaagcctggccgactcgggtgaatatatgtgcaaagtcataagcaagctcggaaacgactccgcctccgccaacatcactattgttgagtctaacgcgacctccacctcaacaacaggaacgagccatctggtgaagtgcgccgagaaagaaaaaactttctgcgtgaacgggggggaatgttttatggttaaggatctgtctaatcccagtcgctatctgtgtaagtgccctaacgaatttacaggggaccgctgtcagaactatgtgatggctagcttctactcgacatccacacctttcctaagcctgccagaa

SEQ ID NO: 17487 - DNA, 1266 bp, Artificial Sequence
  Description of Artificial Sequence: Synthetic coding sequence
atgagatggcgaagggcgccgcgccggtccggaaggcctggtccaagagcacagaggcccggtagcgccgcaagatcgtcaccccctctgcctcttttgccccttcttcttttgctgggaaccgcagctctggcgcctggtgccgcggccggtaacgaagctgcacctgcgggagcatcagtctgttactcgtccccacccagcgtgggatccgtgcaggaactcgcacagagggccgcggtggttatcgaaggaaaggtccatcctcaaagacgccaacaaggagcacttgatagaaaagccgcggcagcagccggggaggctggagcatggggaggagatcgtgaaccgccggcagcaggacctagagcacttggtcctcccgccgaggagcctctcctcgctgcaaacgggaccgtgcctagctggcccaccgctcccgtgccaagcgcaggagaacctggggaagaggcaccctaccttgtgaaagtacaccaggtttgggcggtcaaggctggggggctgaagaaggactccctcctgactgtgcgccttggaacctgggggcacccagcattcccatcgtgtgggaggctcaaggaagattcgcggtacattttcttcatggaacctgatgcaaactccacttcgcgtgcacccgcagcatttagggcatccttccctcctctggaaaccggaagaaacctgaagaaggaggtcagcagagtgctctgtaaaagatgtgcgcttccaccaagacttaaagagatgaagtcccaagaatccgcggccggatccaagctggtcctgagatgtgaaacttcttcagagtactcatcactgcggttcaaatggtttaagaacggcaacgaactgaacagaaaaaacaaaccacaaaacattaagattcagaagaagccaggaaagtccgaacttaggataaacaaggcatcacttgcagatagcggagagtacatgtgcaaggtgatatccaaactgggaaacgactccgcatcggcaaatatcaccatcgtggaaagcaacgcgacttcaacgtccactaccggcacgtcacatctcgtgaagtgcgcagaaaaggaaaagactttttgcgtcaatggtggagagtgttttatggtgaaggacctgtccaacccttctcgctacctgtgcaagtgtcctaacgaattcacgggggaccgatgtcaaaactacgtgatggcaagtttctatagcacttcaacccctttcctctcgttgcccgaa

SEQ ID NO: 17488 - DNA, 1266 bp, Artificial Sequence
  Description of Artificial Sequence: Synthetic coding sequence
atgcgctggcggcgcgcacctcggaggtcgggcagacccggccccagagcacagcggccgggatcggccgcgcgctcttccccgccgctgccgctgcttccgctgctcctgcttttggggaccgccgcgctggcccctggtgccgctgcaggaaacgaagccgcaccggctggcgcgtcagtgtgctactccagcccgccgtcagtcggttcagtacaagaacttgctcaacgggcagccgttgtgatcgaaggcaaggtgcacccgcagagacgtcagcagggagccctggatcggaaggccgcggccgccgcgggtgaggcgggggcctggggaggcgacagagagccaccggcggccgggcctcgcgctttgggtcccccagcagaggaaccgctcctggcggcgaacggaacggtcccgtcttggccaaccgctccggtgccctcggctggggagcctggagaggaagccccctacctggtgaaagtgcaccaagtctgggctgtgaaggctggaggcctcaaaaaggactcactcctgaccgtgaggttgggcacttggggacatccggcgtttccttcctgtggccggctgaaagaggactcaaggtacatattctttatggagccggacgctaacagcacttcgagggccccagccgccttccgtgcatccttcccgccgcttgaaaccggacggaacctgaaaaaggaagtgagtcgggtgctgtgtaagcgctgtgcacttccacctcgcctcaaggagatgaagtcgcaggaaagcgcagctgggagcaaactggtgttgcgatgcgaaacctccagcgaatactcatccctgaggttcaagtggttcaaaaacggaaatgagctcaacagaaaaaacaaacctcagaatatcaagatccaaaagaagccaggaaagtcggagctgcgaattaacaaggcgtcgctggcagactcaggcgagtacatgtgtaaggtgatctccaagctcggaaatgactccgcgtcggcaaatatcaccatcgtggaatcgaatgcaacctccacttcgaccactggcactagccatctggtgaagtgcgcggagaaagaaaagacgttctgcgtgaacggaggagaatgcttcatggttaaagacctttcgaacccgtcgcgctacctctgcaaatgcccaaacgaatttacgggggaccgctgccagaattatgtgatggcgtccttctactccacgtccacccctttcctgtcactgcctgaa

SEQ ID NO: 17489 - DNA, 1266 bp, Artificial Sequence
  Description of Artificial Sequence: Synthetic coding sequence
atgagatggagaagagcaccaagaagatcaggaagaccaggtcctagagcacaaagaccaggaagtgctgctaggtcttcaccaccacttccattacttcctttacttcttttacttggaacagcagcattagcaccaggtgctgctgctggtaacgaagccgcaccagccggagcaagtgtttgttattcatctcctccttctgttggatcagttcaagaattagctcaaagggcagctgttgttatagaaggaaaagttcatccacaaagaagacaacaaggtgctcttgatcgaaaggcagcagcagccgctggagaagcaggtgcttggggaggagatagagaacctccagctgcagggccaagagcattaggaccacctgctgaagagcctttattagcagctaatggaactgttccatcatggccaacagctccagttccttcagctggtgagccaggagaagaagcaccatatcttgtaaaagttcatcaagtttgggccgttaaagcaggaggtcttaaaaaagattctttacttacagtaagattaggaacttggggacacccagcattcccatcatgtggtagactcaaagaagatagtaggtatattttttttatggaacctgatgctaattctacatctagggcaccagctgcatttagagcttcatttccaccattagaaactggaagaaacttaaaaaaagaagtttcaagagtgttatgtaagcgatgtgcacttccaccaagacttaaggaaatgaaaagtcaagaatcagctgctggatcaaaattagtattgagatgtgaaacttcgtctgaatactcctcattaagatttaaatggtttaaaaatggaaatgaattgaacagaaagaacaaaccacaaaacattaaaattcaaaaaaaaccaggaaaaagtgaactaagaattaataaagcttctttagcagattccggagagtatatgtgtaaagtaatttctaaacttggaaatgattcagcatcagctaatattacaattgtagaaagtaatgcaacttctacatctacaacagggacttcacatctagttaaatgtgcagaaaaagaaaaaacattttgtgtaaatggtggagaatgttttatggtaaaagatttatctaatccttcacgttatctttgcaaatgtccaaatgaatttactggagatagatgtcaaaattatgttatggcttcattttattcaactagtacaccatttttatcacttccagaa

SEQ ID NO: 17490 - DNA, 1266 bp, Artificial Sequence
  Description of Artificial Sequence: Synthetic coding sequence
atgcggtggcgccgggccccacggcggtcgggtcgcccgggaccgagagcacagaggccgggctccgccgctcgctcctcgccgcctcttccactccttcctctcctgctgctgctgggcactgcggccctggcacccggcgcggcggccgggaatgaggcggcccctgcgggagcctcagtgtgctactcgtcaccgccatccgtggggagcgtgcaggaactggcccagagagcggccgtggtgattgaggggaaggtgcacccacaacgcagacagcagggagcattggatcgaaaggccgcagccgctgctggagaagccggagcatggggtggagacagagaaccccccgcagctgggccccgggccctcggaccaccggccgaagagccgttgctggccgcgaacggaactgtgccgtcatggccgacggcgcccgtcccgtccgccggagaaccaggtgaagaggccccgtacctcgtcaaagtgcatcaggtgtgggccgtgaaggcgggagggctgaagaaggattcgctcctgaccgttaggttgggcacctggggacatccagctttcccgtcctgcggacggttgaaagaggattcgcggtatatcttttttatggagccggacgctaactcgaccagcagagcccctgccgcgttccgcgctagcttcccacctctggagactggacgcaatcttaagaaggaggtcagccgcgtgctgtgcaagaggtgtgcactgcctccgcggcttaaggagatgaagtctcaagaatcagccgcaggaagcaaactggtcctgagatgcgaaacctcgtccgaatactcgtcgctgcgtttcaaatggttcaaaaacggcaacgagctgaaccgcaagaacaagccgcaaaacattaaaatccaaaagaaacctggaaagagcgagctccgcatcaataaggcctcactggctgacagcggtgaatacatgtgtaaagtgatctccaaactcggcaacgactcggcatccgcaaacatcaccatcgtggagagcaatgcgacttccactagcactaccggcacgtcacacctggttaagtgcgcggaaaaggaaaagaccttctgcgtcaacggaggcgaatgcttcatggtcaaggatctgagtaatccatccaggtacctctgtaagtgcccgaacgaattcaccggcgaccgctgccagaattacgtgatggcttcattctactctacctcgactccgtttctctccctcccagaa

SEQ ID NO: 17491 - DNA, 1266 bp, Artificial Sequence
  Description of Artificial Sequence: Synthetic coding sequence
atgcgctggcgtcgagctccaaggcgatcaggccgaccaggtccaagagcccagcgcccgggatctgcagcccgatctagcccccccctgcctttattaccactcctgctcctgctcgggacagctgctctggctcctggagccgcagctggcaatgaagctgccccagctggcgccagtgtctgttatagctccccaccctccgtcggatctgtgcaggagctggcccagagagccgctgtggttatcgagggtaaggtccatcctcagcgtcggcagcagggcgctctggatagaaaggcagcagctgccgctggagaggcaggcgcttggggcggggatcgcgaaccacctgctgccggccccagagcccttgggccacctgccgaggagccactgctggccgcaaacggcacagtccctagttggcccactgcccctgtcccatccgctggagagccaggcgaggaggccccatacctggtgaaggttcaccaggtatgggcagtgaaggctggaggactaaagaaggatagtctgcttaccgtgcgcctcgggacctggggacaccctgcctttccgtcatgcgggcgtctgaaggaagacagtcgctacatcttcttcatggaaccagatgccaactcaacatccagggccccagctgctttcagggctagttttccaccgctggagactggtcggaaccttaaaaaagaagttagtcgtgtgctgtgtaaaaggtgcgccctgcctccccgactgaaggagatgaaatcccaggagtccgccgccggtagcaagctggtgttacggtgcgagacatcatccgagtattctagtctgcgcttcaagtggttcaagaacggcaacgagctgaatcggaagaataagccacaaaacattaagatacagaagaagccaggcaagtcagaactccgtattaataaagcatccctggccgattctggcgaatacatgtgtaaggtcataagcaagctgggtaatgattcagcttccgcaaacataaccatcgtagagtctaatgcaaccagcacttctacaaccggcacctctcatctggtgaagtgtgcagagaaagaaaaaacattctgtgtgaatggcggcgagtgcttcatggtgaaagatctgagcaatcctagccggtacctgtgtaagtgccccaacgaattcactggcgaccggtgtcagaattatgtgatggccagtttctactctacctcaaccccatttctgagcctgcctgag

SEQ ID NO: 17492 - DNA, 1266 bp, Artificial Sequence
  Description of Artificial Sequence: Synthetic coding sequence
atgagatggcgccgcgctcctagaaggtccgggaggcctggtccacgggcgcagcggccaggtagcgccgcccggtcctcacccccattacccctactgccgttgctgcttctgttgggaacagcagccctggcaccgggcgccgcggcaggaaacgaggcagcccctgccggagcttctgtctgttacagctctcccccttcagtcgggtcagtgcaggaactggcccagcgcgcagctgtcgtaattgaagggaaggttcatccccagcgacgacagcaaggcgctctggatcggaaggccgcagcagctgcgggggaagctggagcctgggggggcgatcgcgagccaccagccgcgggacctcgtgctctcggacctcccgccgaagaaccactgctcgcggccaacggaacagtaccttcctggccaacagcccccgtgccgtcggctggcgagcccggagaggaggccccataccttgttaaggttcaccaagtttgggctgttaaagctggtggcctcaagaaggattccctgctgacagtccgcttagggacttggggacatcctgctttcccttcttgtggccgacttaaagaggactcgcggtatattttctttatggagcctgacgctaactccacaagtcgtgcccctgccgcatttcgggcctcatttcccccgctcgaaacaggaagaaatcttaaaaaagaggtgtctcgcgtcctttgtaagcgctgcgcccttcctccccgtcttaaagagatgaaatctcaggagtctgccgcggggtcgaaactggtgctccgatgtgagacatcttccgagtattcatcactgaggtttaagtggttcaagaacgggaatgagcttaacagaaagaataagccacagaacattaaaatacagaagaagcctggtaaaagcgaattgcggataaacaaagcaagcctcgccgattcaggagagtatatgtgcaaggtgatttccaagctgggaaatgatagtgcttctgcgaatatcaccatcgttgagtccaacgctacctccaccagtacaaccgggacgtcgcatttggttaagtgtgccgagaaagagaagaccttttgtgtcaatggaggggaatgtttcatggttaaggatttaagcaaccccagcaggtacctgtgcaagtgtccgaatgagtttacaggtgatcggtgccagaactacgtgatggcttctttctactcaacgagtacaccttttctgtctctccctgag

SEQ ID NO: 17493 - DNA, 1266 bp, Artificial Sequence
  Description of Artificial Sequence: Synthetic coding sequence
atgcgatggagacgcgcacctcgtagatcagggcgacctggtcctcgggcccagcgtcccggtagcgccgcaagaagctccccaccccttccactcctgcctctgctcctgctcctgggtactgctgcactggcgcccggagcagcggcaggtaacgaggcagcacccgcgggggcctctgtgtgttactcctcacccccctctgtgggatcggtgcaagaacttgcgcagcgcgcggcggtggtgattgaggggaaggtgcatccacaaagaaggcagcagggtgctcttgatagaaaggcggcagccgcggcgggagaggccggtgcatggggcggcgacagggagcctccggcagcgggaccacgcgctctcggccctccagctgaagaacctctcctggcagcaaacggaaccgtgccgtcatggccaactgcacctgtccctagcgcaggcgaaccaggcgaagaggctccttaccttgtgaaagtccaccaggtttgggcagtcaaggcgggaggtcttaagaaagactctcttctgaccgtgcgcctgggaacctggggtcatccagcgtttccgagttgtggacggttgaaggaagattcaaggtacattttctttatggagcctgatgccaactctacctccagggcccctgcagcgttcagagcgtcgtttccacccctggagacgggtcggaatctcaagaaggaagtatcccgtgtactctgtaaacgttgtgcactgccgcctagactgaaagaaatgaagtcccaagagtccgcagccggatcgaaacttgtgctgcggtgtgaaacgtcctcagaatactcatccctgagattcaagtggttcaaaaatggaaatgagttgaaccgtaagaacaagccacaaaacataaagattcaaaagaagcctggcaagtcggaacttagaataaacaaggcctcccttgcggattcgggagaatacatgtgtaaagtcatttccaagctcgggaatgactcggcaagcgcaaacattactatcgtcgaatccaatgcaacgtccacctcgactaccggtacttcacacttggtcaagtgcgccgaaaaggaaaaaactttttgcgtgaatggaggcgaatgctttatggtcaaggatctgtcaaaccctagccgctacctgtgtaaatgtcctaatgagtttaccggtgaccgctgccaaaactatgtgatggcatcattctactcgacgtccaccccctttctctcccttccggaa

SEQ ID NO: 17494 - DNA, 1266 bp, Artificial Sequence
  Description of Artificial Sequence: Synthetic coding sequence
atgcgctggcggcgagctcctaggagaagcggccggccaggacctagggcacaacggcctggaagcgcagcaagatcgtcgccacctctgcctcttctcccactcctgcttctgctcgggactgcagccctggcacctggcgccgcagcaggcaatgaagcagctccagcaggagcatcggtgtgctactcgtcgcccccatcggtggggtccgtgcaggagctggcccaacgggcagcagtcgtgatagaaggcaaggtgcatcctcagagacgacagcagggagcacttgatagaaaggccgccgcagccgcgggtgaagccggggcatggggaggcgatcgtgaaccaccggccgcagggccgagagcactgggaccgcctgcagaggaaccgctcctggcagcgaatggaaccgtgccgtcctggccaaccgcccccgtgccatcagcgggggaaccaggagaagaggccccttacttggtgaaagtccatcaggtgtgggcagtgaaggcaggtggcctcaagaaggactcgctgcttactgtgagactgggtacttggggtcatccagcatttcctagctgcgggagacttaaggaagattccaggtacatctttttcatggaaccagatgcaaactcaactagcagggcccccgcagcatttagggcgtcctttcccccacttgaaaccggacgaaatctgaagaaggaggtgtcgcgtgtgctgtgcaagagatgtgcccttcctccgcgcctgaaggaaatgaaatcacaagaatcggcagctggttccaagttggtcctgcgctgcgagacttcatcggaatactcgtccctgcgtttcaaatggtttaagaacggcaacgaactgaatcggaagaacaaacctcaaaacatcaaaatacagaaaaaacccggcaagtcggagctgcgcatcaacaaggcatcgctggcggattcgggtgagtacatgtgtaaagtcatctcgaagctcggaaatgactcagcatcggcaaacatcaccattgttgaatccaacgcaacttccacctcgaccaccggcactagccacctcgtgaagtgtgcagaaaaggaaaagaccttttgtgtcaatggaggtgaatgttttatggtgaaggatctcagcaatccgtcgagatacctgtgtaaatgtccaaacgaatttactggagatcgttgtcaaaactacgtgatggcgtccttttactctacctcgacgccttttctttcgctgccagaa

SEQ ID NO: 17495 - DNA, 1266 bp, Artificial Sequence
  Description of Artificial Sequence: Synthetic coding sequence
atgaggtggcgcagagcaccacgacgttccggtcgacccggaccacgggcacaacgccccggatcagccgcgagatccagtcctccactgcccctcttgcccctcctccttcttctgggaactgcagcgcttgcacctggtgcagcagcaggaaacgaggcagccccggctggtgcgagcgtctgttactcaagccccccatccgtcggatcagtccaagaactcgcacagagagcggccgtcgtgattgaaggaaaggtccatccacaacgcagacaacaaggagcccttgatagaaaagccgcggccgcagctggagaagcaggcgcttggggaggtgaccgagaacccccggcagcgggacctcgcgcacttggacctcctgctgaggagccactgctggcagcaaacgggaccgtgccatcatggcctactgctcccgtgcctagcgcaggcgaaccaggagaggaggcaccttacttggtgaaagtgcatcaggtctgggctgttaaggcaggtggcctgaaaaaggactcgctgctgactgtgcgcctcggcacttggggtcatcccgcatttccctcatgtgggcgtctcaaggaggattcgaggtacatattctttatggaacctgatgctaactccacctcccgtgcaccggcagcatttagggcatcctttccaccactcgaaactggaagaaacctcaagaaagaggtgtccagggtgctttgcaagcgatgtgctctcccaccacggctgaaggaaatgaaatcgcaagagtcggcagcaggaagcaaactggtgctccgctgtgaaacttcgtcagaatactcctcgctgagattcaagtggtttaagaatggtaacgagctgaataggaaaaacaaacctcagaatatcaagattcagaaaaaaccaggaaagtcagagttgaggatcaacaaggcatcgctcgcagatagcggggagtacatgtgcaaagtcatttccaaacttgggaatgactctgcgtccgcgaacattactattgtggaatcaaatgcaacctccacctcgaccaccggtacctcgcatcttgtgaagtgtgcagaaaaagaaaagacgttttgcgtcaacggaggtgaatgttttatggtcaaagatttgtcgaacccatctcgctatttgtgcaaatgtccaaacgagttcaccggagatcgatgtcagaattacgtgatggcgtccttctactcgacttcgaccccatttctttccctccctgaa

SEQ ID NO: 17496 - DNA, 1266 bp, Artificial Sequence
  Description of Artificial Sequence: Synthetic coding sequence
atgaggtggcgtagagcccctcgacgatctggccgacccggccctagagcgcagcgccctggatccgctgcccggagctcacctccactgccgttgctgcccctcctgctgctacttggcaccgctgccctcgctccaggggccgctgcaggcaacgaggccgcacccgctggggcatctgtgtgctatagctctcctccgagtgttggtagcgtgcaggagttggctcagcgtgccgccgtcgtcatagaagggaaagtgcatccccagcgtcgacagcagggcgcgctagacaggaaagccgcggccgcggcaggggaggccggtgcatggggcggagaccgcgagcctccagcagcaggaccacgggctctcggtcctcctgcagaagaaccgctgctcgcggccaacggaaccgtgccaagttggcccactgcacccgtccccagtgcaggcgagccgggagaagaagctccctatctcgtgaaagtgcaccaggtgtgggctgttaaggcagggggactaaagaaggatagtttgctgactgtccgcctagggacctgggggcacccggcattcccttcgtgcgggagactaaaggaggacagccggtatatttttttcatggagcccgacgctaactctacaagccgcgcccctgcagctttcagggctagcttccctccacttgaaaccgggagaaacctgaaaaaagaggtgtcgagagtgctctgcaagagatgtgcactgccaccccgcctgaaagagatgaagtcccaggagtcagccgccggctccaaactggtccttagatgtgaaaccagctcagaatatagttctctgcggtttaaatggtttaaaaatggcaatgagctgaaccgcaaaaataaacctcagaacattaagatccagaaaaaacccggaaagagtgagctgcgaatcaacaaagcatccctggccgatagtggggagtacatgtgtaaagtgatatctaagctggggaacgatagcgcatctgccaacatcacaatcgttgaatccaacgccacgtccacttccaccaccggcacaagtcacctcgtgaaatgtgcggagaaagaaaaaaccttttgtgtaaatgggggcgagtgctttatggtgaaagacctgtcgaaccctagccggtatttgtgcaagtgccctaacgagtttacaggagatagatgccagaactatgtgatggcctccttttacagcacttcaacgccattcctatcacttcccgag

SEQ ID NO: 17497 - DNA, 1266 bp, Artificial Sequence
  Description of Artificial Sequence: Synthetic coding sequence
atgcgatggcgacgagcgccgcgacgttcgggtcgaccgggtccgcgtgcgcaacgtccgggttcggcggcgcgttcgtcgccgccgttaccgttattaccgttattattattattaggtacggcggcgttagcgccgggtgcggcggcgggtaatgaagcggcgccggcgggtgcgtcggtatgttattcgtcgccgccgtcggttggttcggttcaagaattagcgcaacgtgcggcggtagttatagaaggtaaagtacatccgcaacgacgacaacaaggtgcgttagatcgtaaagcggcggcggcggcgggtgaagcgggtgcgtggggtggtgatcgtgaaccgccggcggcgggtccgcgtgcgttaggtccgccggcggaagaaccgctactagcggcgaatggtacggtaccgtcgtggccgacggcgccggtaccgtcggcgggtgaaccgggtgaagaagcgccgtatctagtaaaagttcatcaagtatgggcggtaaaagcgggtggtttaaaaaaagattcgttattaacggtacgattaggtacgtggggtcatccggcgtttccgtcgtgtggtcgtttaaaagaagattcgcgttatatattttttatggaaccggatgcgaattcgacgtcgcgtgcgccggcggcgtttcgtgcgtcgtttccgccgttagaaacgggtcgaaatctaaaaaaagaagtatcgcgtgtactatgtaaacgttgtgcgttaccgccgcgtttaaaagaaatgaaatcgcaagaatcggcggcgggttcgaaactagttctacgttgtgaaacgtcgtcggaatattcgtcgttacgatttaaatggtttaaaaatggtaatgaactaaatcgaaaaaataaaccgcaaaatataaaaatacaaaaaaaaccgggtaaatcggaattacgaataaataaagcgtcgctagcggattcgggtgaatatatgtgtaaagttatatcgaaactaggtaatgattcggcgtcggcgaatataacgatagtagaatcgaatgcgacgtcgacgtcgacgacgggtacgtcgcatttagtaaaatgtgcggaaaaagaaaaaacgttttgtgtaaatggtggtgaatgttttatggttaaagatttatcgaatccgtcgcgatatctatgtaaatgtccgaatgaatttacgggtgatcgttgtcaaaattatgtaatggcgtcgttttattcgacgtcgacgccgtttttatcgctaccggaa

SEQ ID NO: 17498 - DNA, 1266 bp, Artificial Sequence
  Description of Artificial Sequence: Synthetic coding sequence
atgagatggcgtcgtgcgccaaggcgctcaggacgacctggacctagagcgcaacggcccggctcggccgccagatcaagcccgcctcttcctctgctgcccctgctccttctcctgggcaccgctgccctggcacctggagctgcagcaggcaacgaagcagcccctgcgggtgcaagcgtgtgttactcttccccaccttcggtcggtagcgtgcaggagcttgcacaacgtgcagcagtcgtgattgaaggcaaagtccatccacagcgtagacaacaaggggctcttgaccgcaaagcagcagccgcagctggcgaagcaggggcatggggaggtgaccgagagccgccagcggcaggaccgcgcgcgctcggaccacctgcagaagagcctctgctcgccgcgaatggaactgtgccttcatggcctactgcacccgtccctagcgcgggggaacccggagaagaggcaccctacctggtcaaagttcatcaagtgtgggctgtgaaagcagggggactgaaaaaggattcgttgctgactgtgcgcttgggcacgtggggacacccagcttttcccagctgtggacggctgaaggaagattcgcgctacatattctttatggaacccgatgccaactccacttccagggcaccagcagcttttcgtgcatcgtttccgcccctggagacgggcaggaacctgaagaaagaagtctccagagtcctgtgcaagaggtgtgcactgccgccaaggctgaaggaaatgaagtctcaggaatccgcagctgggtccaaactggtgcttcgatgtgagactagcagcgaatactcgtcacttagattcaaatggttcaaaaatggtaacgagcttaataggaaaaacaaaccccaaaacattaagatccagaagaaaccgggtaagtcggaactccgcataaacaaggcatccttggcagactccggtgaatacatgtgtaaggtcattagcaagctggggaatgattcagcgtccgcaaacatcaccatcgtggagtccaatgcaacctcgacttccactaccggtacgtcgcaccttgtgaagtgcgcagaaaaggaaaaaaccttttgcgtgaacggtggggaatgttttatggtgaaggacctgagcaatccctcccgatacctctgtaagtgccctaatgaattcactggggatcggtgtcaaaactacgtgatggccagcttctactctacgtcgactccctttctctccctccctgag

SEQ ID NO: 17499 - DNA, 1266 bp, Artificial Sequence
  Description of Artificial Sequence: Synthetic coding sequence
atgcgctggcgcagagctcctagaaggtcaggcagaccaggtcctagggcacagcgacccggaagcgcagcccgctcatcacccccgctgccactcctgccccttctgcttctgctgggaacggccgccctcgcccctggtgcagcagccggaaatgaagccgcaccggcaggcgcctccgtgtgctactccagcccaccttcggtcggaagcgtgcaggagttggcgcagcgcgcagcagtcgtgatcgagggtaaggtgcaccctcagagacgccagcaaggcgcactggataggaaagcggcagcagcggcaggagaagccggagcatggggcggagatcgcgaacctccagcagcaggcccaagagcacttggtccccccgcagaagagcctctccttgcagcgaatggcaccgtgccctcgtggcccaccgcacctgtgccttcagcaggcgaacctggagaggaagcaccctacttggtcaaggtccatcaggtctgggcagtgaaggcgggtgggctgaagaaggactccctgcttactgtgcgtttgggtacgtgggggcaccctgcctttccctcatgcgggcgactgaaagaggactcccggtacatcttctttatggagccagacgcaaattcgacctcccgggcaccagccgcattcagagcgtcctttccccctcttgaaactggtagaaaccttaagaaggaggtgtcacgggttctgtgcaagcgctgtgcccttcctcctaggctcaaggaaatgaagagccaagaaagcgcggcaggatcaaagctggtgcttagatgcgaaacgtcgtcggagtacagctcgctcagattcaaatggttcaagaacgggaacgagctcaacaggaagaacaaaccacagaacataaagatacagaagaaacccggtaaatcggaacttagaatcaataaggcatccctggccgattccggtgaatacatgtgtaaagtgatctccaagctgggaaacgattcagcatcagcgaacatcaccatcgtcgagtcaaacgcaacctcgacttccaccaccggtacttcgcatctggtgaagtgtgctgaaaaagaaaagactttctgtgtcaatggaggtgaatgcttcatggtgaaagacctttccaacccatcgagatacctgtgtaaatgtcctaatgaatttaccggcgatcgctgtcagaactacgtcatggcatcattttacagcaccagcaccccgtttctttcgcttcccgag

SEQ ID NO: 17500 - DNA, 1266 bp, Artificial Sequence
  Description of Artificial Sequence: Synthetic coding sequence
atgaggtggagacgagccccgcgtagaagcggacgcccaggaccacgcgctcagcggccgggttcggcggcccggagctctccacccctgccgcttcttccactgctcctcctgcttggaaccgcagccctcgctccgggcgcggcagctggcaacgaagccgcgccggccggagcttcggtgtgctactccagcccaccgtctgtcggatcagtccaggagttggcacaacgcgcagcggtcgtcatcgaagggaaggtgcatccacaacggcggcagcaaggcgccctggaccgtaaagccgctgccgccgccggagaggccggggcgtggggtggagatagagaaccgccggcggcaggacctcgggcactcggaccaccggcagaagaaccactgctcgccgccaacggaaccgttccgtcctggcccactgcccctgtgccgtcagcaggtgaaccgggtgaagaggccccttacttggtgaaagtgcaccaggtgtgggccgtgaaggcaggaggactgaagaaggactcactcctgaccgttcgactggggacctggggtcatccggccttcccaagctgcggaaggctgaaggaggactccagatatatcttcttcatggaaccggatgccaactctacttccagagcgcctgctgctttcagagctagcttcccaccgctggaaactggccggaatctcaagaaggaagtcagcagagtgttgtgcaaaagatgtgccctgccgcctaggctcaaggagatgaaatcacaggagtcagcggcgggcagcaagctggtgctgcggtgtgagacgtcgtccgagtactccagcctgcggttcaaatggtttaagaatggcaacgagctcaatcgtaaaaacaagccgcaaaacattaagatccaaaagaagccagggaagagcgagctgcggattaacaaagcatccctcgcggatagcggagagtacatgtgcaaggtgatctcaaagctgggaaatgactcggcctcggccaacatcaccatcgtggaatccaatgcaacgtcgacctcgaccactggtacttcccacttggtcaagtgcgccgaaaaagagaaaactttctgtgtcaatgggggagaatgcttcatggtcaaggacctgagcaacccgtcgagatacctgtgtaagtgtcctaacgaattcaccggagacaggtgtcaaaactacgtgatggcgtccttttactcaacttcgaccccgtttctgtcgctgccggag

SEQ ID NO: 17501 - DNA, 1266 bp, Artificial Sequence
  Description of Artificial Sequence: Synthetic coding sequence
atgagatggcgaagggccccacggagaagcggcagacccggacctcgtgcccaacgccccggatcagcagccagatcgtcacctcctcttcccctgctcccactgttgctgcttttgggaaccgcagcactggccccaggtgcagcagccggaaacgaggcagcaccggctggagcgagcgtgtgctattcatcgccgccaagcgtaggatctgtccaggagctggcacaacgggcagcggtcgtgatcgaagggaaggttcatcctcagaggcgccaacagggagcattggatcggaaggcagctgccgctgcaggagaggcaggcgcatggggaggagatcgggaacctccagccgccgggcctcgcgcattgggcccgcctgcagaagaaccactgctcgctgcaaatggtacggtgccttcgtggcctaccgcgcctgtgccatccgcaggagagccgggtgaagaggccccctacctcgtgaaggtgcatcaagtgtgggcagtgaaggccggaggactgaaaaaagactcccttttgactgtcaggcttggtacttggggacatcctgcatttccttcgtgcgggcggctgaaggaagattcaagatacatcttctttatggagccagacgcaaattcgacttcgcgggcacctgcagcattccgggcgtcatttccaccacttgaaactgggagaaatctcaaaaaggaggtgtcgcgtgtcctttgcaaacgctgtgcactgccacctcgcctcaaggaaatgaagtcccaagagtcggcagcaggatccaagctcgtcctgagatgcgaaacctcctccgaatactcgtcgctgagatttaagtggtttaagaacggtaacgagctcaacaggaagaacaagccacagaacattaagattcagaagaagccaggaaaaagcgagctgaggattaacaaggcatctctggcagattcaggcgagtacatgtgtaaagtgatttccaaacttggaaatgattcggcgagcgcaaacataaccatcgttgagtcaaatgccacgtccacgtcgactaccggaacctcacatctcgtgaagtgtgcagaaaaagaaaaaactttctgtgtgaatgggggagagtgttttatggtgaaggatctgagcaatccatcccgttacctttgcaagtgtcccaacgaattcaccggtgatcgttgccagaactacgtgatggcgagcttctactccacgagcactccattccttagcctcccagaa

SEQ ID NO: 17502 - DNA, 1266 bp, Artificial Sequence
  Description of Artificial Sequence: Synthetic coding sequence
atgcgctggagacgggccccgaggcgatcgggtcggccgggcccacgcgcccaaagacctggatcggccgcccgatcctcaccacctctgccgctcctgcctttgcttctccttctgggcactgccgcgctcgccccgggagctgcggcgggaaacgaggctgcaccggccggcgcgtcggtgtgctactcatcacctccgtcggtggggtcggtccaagaactggctcagagagccgccgtcgtgatcgagggaaaggtccacccgcagagacgccagcagggtgctctggaccggaaggcagcggcagctgcaggcgaggcgggcgcctggggtggtgatcgcgaaccccctgcagctggacctcgggctctcggaccgccggccgaagaaccacttctggcggctaacggtactgtcccatcgtggccgacggccccggttccttcggcaggagaaccgggtgaagaggccccttacttggtgaaggttcaccaagtgtgggcggtcaaagcaggcggtctgaagaaggatagcctgctcaccgtgcgcctcggtacctggggtcatcccgcctttccaagctgcgggcggctgaaagaggactccagatacatcttcttcatggaaccggatgcgaattccacttcaagggccccggccgcttttagggcctccttcccgccgctggagactggaaggaacctgaagaaggaagtatctcgcgtgctgtgcaagagatgtgcgctccctccccgcctgaaggagatgaagtcgcaagaaagcgctgcgggttcgaagttggtgctgcggtgcgaaacttcgtccgaatacagctcgctgcggttcaagtggtttaagaatgggaacgagttgaatcggaagaataagccgcagaacatcaagatccagaagaagccaggtaagagcgagctcagaatcaataaggcgtcgctggccgactcaggcgagtacatgtgcaaagtgatttccaagctgggaaacgactccgcctcagctaacatcaccatcgtggaatccaatgcgacctcaacctcgaccaccggaaccagtcacctcgtcaaatgtgcagagaaggaaaagactttttgtgtcaacggaggagagtgcttcatggtcaaagacctcagcaacccgtcacgctacctctgtaagtgtccgaatgagtttaccggcgaccggtgccagaattacgtcatggcttccttttacagcacttcgacgccgttcctctctctgccagag

SEQ ID NO: 17503 - DNA, 1266 bp, Artificial Sequence
  Description of Artificial Sequence: Synthetic coding sequence
atgaggtggcggcgcgcgcctcggcgctccgggcgtcccggaccacgcgcgcagcgccccggatctgctgctagaagctccccaccgctgccgcttctccccctcctgctcctgttgggtaccgcggcactggcccccggagcggccgccggcaacgaagccgcccccgcgggagcaagcgtctgttactcgagcccgccctcagtgggttccgtgcaggaactggcgcagagggccgcggtggtcatcgagggaaaggtgcaccctcaaaggcggcagcaaggcgcactggacagaaaagccgctgccgcagcaggggaagcaggagcatggggtggcgaccgcgaacccccagccgccgggccgcgggccctgggccctccagcagaggagccactgttggcggctaacggaaccgtgccaagctggcccactgccccggtgccgtcagccggcgagccgggagaggaagctccctacttggtgaaggtgcatcaagtgtgggcggtgaaagcgggaggactgaagaaggactcgttgctgactgtccggctgggaacctgggggcatccggccttcccgtcatgcgggcgcctgaaagaggattcaaggtacatcttctttatggaaccagacgccaactcgacttcacgggctccggcggcttttcgggcgtcgttcccgcccctcgaaaccggaaggaatcttaagaaagaggtgtcgcgcgtgctctgcaagaggtgcgcgctgcctccacggctcaaggaaatgaagtcacaagaatcggctgccggatcgaagctggtccttcggtgtgaaacttcgtccgagtatagctcgctccgcttcaagtggttcaagaacggaaatgaactgaaccggaagaataagccgcagaatatcaagatccagaagaagcctggaaaatccgaacttcgcatcaacaaggcaagcctcgccgactcgggagaatacatgtgtaaggtgatctccaaactggggaacgattcggcttcagctaacattaccatcgtcgaatccaacgcgacttccacctcgaccactggaactagccacctggtgaagtgtgccgagaaggaaaagaccttctgcgtgaatgggggcgagtgcttcatggtgaaggacctgagcaatcccagcagatacctgtgcaagtgcccgaacgagtttaccggagatagatgccaaaactatgtcatggcctcattctactcaacttcgactccttttctctcattgcctgag

SEQ ID NO: 17504 - DNA, 1266 bp, Artificial Sequence
  Description of Artificial Sequence: Synthetic coding sequence
atgcgctggaggagagcacctcggcggagtggaagacctggcccgagggctcaaaggccagggagcgccgctaggtcttctcctccccttccacttctgccactcctgctgttgctcgggaccgcagcactggcgcctggcgccgctgcaggcaatgaggccgccccagctggggcttctgtgtgttattcttcacccccgtctgttggatcagtacaggaactggcccagcgtgctgccgtggtgattgagggtaaggtgcatccccagcgcaggcagcaaggtgccttggatcgtaaagcagctgctgctgcgggagaggcgggcgcgtggggcggggatagggaacctccggcagccggacccagagctctcggaccgcccgctgaggaacccctgctcgccgccaatggaaccgtgccatcatggccaacagcgcccgtaccatccgcaggcgaaccgggcgaggaagcaccctacttagtgaaagttcaccaagtctgggcagtcaaagctggcgggcttaagaaagatagtttgctcacagtccgcctcggaacgtggggccaccctgcctttccctcctgtgggagactgaaggaagactctcgatatatattcttcatggagcctgatgctaacagcacttctcgggctcctgccgcctttcgcgcaagtttcccaccactcgaaacggggcggaacttgaagaaagaagtctcgcgggtcctttgcaaacgctgtgccctgccacctagactgaaagagatgaaatctcaggaatcagctgcgggatcaaagctggttctgcggtgcgaaacaagtagcgaatatagctctctaaggttcaaatggtttaaaaatggcaacgaactgaaccgtaagaataaaccacagaatatcaagatccagaagaaaccggggaaaagcgagctgaggatcaacaaggcgtccctggccgatagtggcgagtatatgtgcaaggtcatctcgaagttgggaaatgacagcgcctcagcaaacatcacaatagtagagtctaatgcaacatccaccagtacaacaggaacttctcaccttgtgaagtgtgctgagaaagaaaaaacgttttgcgtgaacggaggtgagtgtttcatggtcaaggacctgtcgaatcctagtcgctatctctgcaagtgtccaaatgaatttacaggtgacaggtgccagaactacgtgatggccagcttctattctacatccacaccgtttttgtctctccctgaa

SEQ ID NO: 17505 - DNA, 1266 bp, Artificial Sequence
  Description of Artificial Sequence: Synthetic coding sequence
atgcgctggagaagggcccctcgcaggagcggacgcccgggacctagggcccaacggccgggatcggccgccaggagctccccgccgctcccgctgctgcccttgctgttgctgctcggaaccgcggccctcgctccgggagccgccgctggaaatgaagcggccccagcgggtgcaagcgtctgctacagctcaccaccgtcggtgggcagcgtgcaggagcttgcccagcgggcagctgtggtcattgagggaaaggtccacccacagcggcgccagcaaggggccctggataggaaggccgccgctgccgcaggggaggctggtgcttggggcggagatcgggaaccgccggccgcggggccaagagcgctcggcccgcccgcggaagaaccactgctggccgccaacggcaccgtgccgtcatggccgactgcacctgtgccgtccgctggagagcctggggaggaagcgccgtacctggtgaaggtgcatcaagtgtgggcagtgaaagccgggggactcaagaaagactcgctgctgactgtgcgccttggaacctggggtcatccggcctttccgtcatgcgggcggctgaaggaggactcacgttacatcttcttcatggagccggacgccaattcgacctcacgggcgccagcggcattccgggctagctttccgccactggagacgggccgcaaccttaagaaagaagtgagccgtgtgctctgcaagaggtgcgccctgccaccacgcctgaaggagatgaagtcccaggagtcagccgccggcagcaagctggtgctgaggtgtgaaaccagctccgaatactcgtcgcttcgcttcaagtggttcaagaacggaaacgagctgaatagaaaaaacaagccacagaacatcaaaatccaaaagaagccgggaaaatccgagctgagaatcaacaaggcttccttggctgactctggggagtatatgtgcaaagtgatctctaagctcggaaacgattcagcatcggccaacattacgatcgtcgagtcgaacgcaaccagcacctccactactggcacctcgcacctggtgaagtgcgccgagaaagaaaagaccttctgcgttaatggaggagagtgtttcatggtcaaagacctgagcaacccatcccgctatctgtgcaagtgtcctaacgaattcaccggcgaccggtgccaaaactacgtgatggcttccttctactccacctcaactccattcctgtcactgcctgaa

SEQ ID NO: 17506 - DNA, 1266 bp, Artificial Sequence
  Description of Artificial Sequence: Synthetic coding sequence
atgaggtggcgtagagcaccgcgacgtagcggccggcccggcccccgcgctcagaggcccggcagcgctgccagatcctcacctcccttgccactgcttccattgctgctgctgctaggcactgcagcgttggcccctggggccgctgcaggcaatgaagccgcgcccgccggagcttctgtgtgttatagcagccccccctccgttgggtcagttcaggagttagctcaaagagccgccgtcgttatcgaggggaaggtgcatccccaacgaaggcagcagggggcgctggatcgcaaggcagctgcggctgccggggaagcaggggcctgggggggggaccgcgagcctccagccgctggcccccgggccctgggtccccccgccgaagagccacttcttgccgccaatggaacagtcccttcatggccaacagcccccgtgccatcagctggggagcctggagaagaagccccatacctcgtaaaagttcatcaggtgtgggccgtaaaagcaggtggccttaagaaggattctctgctgaccgtccggctgggcacctgggggcaccctgcgttcccatcttgcggacggctgaaggaggactcgcggtatatattctttatggaaccggacgcgaactccacgtcccgtgctcctgcggcttttagagcttcatttcccccgctcgaaacaggaaggaacttaaagaaagaagtatcaagggtgctgtgtaaacgctgtgccctgcctcctagactcaaggagatgaaatctcaggaaagcgccgccggatctaaattggttctgcgctgcgaaacctcatcagagtactcctccttaaggttcaagtggtttaaaaatgggaacgagctgaacaggaagaacaagcctcagaacatcaaaattcagaagaagcccggcaagtctgagctgcgaatcaacaaagctagtttggcagactccggcgagtacatgtgtaaagtcatctctaagcttgggaatgattctgcctccgctaatataacaatcgttgaatctaacgcgaccagcaccagtacgacaggcacatctcatctggtcaagtgcgccgagaaggaaaaaaccttttgcgtcaacgggggcgaatgttttatggtcaaggacttatccaatccctccaggtacttgtgtaagtgccctaatgagtttaccggggatagatgccagaattacgttatggcttccttttactcaacctctacgccattcctgagcttgcccgag

SEQ ID NO: 17507 - DNA, 1266 bp, Artificial Sequence
  Description of Artificial Sequence: Synthetic coding sequence
atgcgatggcgacgcgctcccaggcggtccgggcgtcccggtcctagagcccagagacccggaagcgccgccaggtctagcccccctcttcctctgctgccgctgttgcttctgttgggcaccgctgcactcgcccctggggcagccgcaggaaatgaagctgctcctgccggcgcctctgtgtgctattctagtccaccatcggtcggttctgttcaggaacttgctcaacgagctgctgtggtgattgaaggcaaagttcatccccagcggcgacaacaaggtgctttggaccggaaagcagctgcagcagcaggcgaggcaggggcctggggcggcgatagggagcctccagcagccggaccaagagcactcggtccgccagcggaagagcccttactagcggcaaacggcaccgtgcccagctggcctaccgcacctgtgccaagcgcaggtgaaccaggagaggaagctccttacttggttaaggtacatcaggtttgggctgttaaagctggtggacttaagaaagactctttattgacagtgaggctgggaacttggggtcaccccgcattcccttcgtgtggtcgactgaaggaggacagcaggtacatcttcttcatggagcctgatgctaactccacctccagggctccagccgctttcagggccagtttcccaccgctggaaaccgggaggaaccttaagaaggaagtgtcacgagtcctttgcaagcggtgcgccctaccacctagactgaaagagatgaaaagtcaggagagcgctgctgggtcaaagctcgtgctgcgttgcgagacatcctctgaatatagttccttgcgattcaagtggtttaagaacgggaacgaactgaatcgaaagaacaagccccagaacattaaaatccaaaagaaacccggaaaatcagaactccgaatcaacaaagcttcactggcagactccggcgagtacatgtgtaaggtaatcagcaagctcgggaatgacagcgcctccgccaacatcactattgttgaaagcaacgccaccagtaccagtactactggcacatcacatctggtgaaatgtgcagagaaggagaagactttctgcgttaacggaggggagtgcttcatggtgaaagacctgtcaaacccaagcagatatctgtgtaaatgtcctaatgagtttacgggagacagatgtcagaactacgtgatggcgtcattctacagcacctccactcctttcctgtctctgccagag

SEQ ID NO: 17508 - DNA, 1266 bp, Artificial Sequence
  Description of Artificial Sequence: Synthetic coding sequence
atgaggtggaggagagctccccggcgttccggccgacccggtcctagggcccagagaccaggttccgcggctaggagctctccgcctctgcccctcctgccattgttgctgctcctgggtacagcagccctcgcccccggcgccgcagcaggtaacgaagccgcccctgccggggcttcagtttgctattcttcaccccccagcgtgggaagcgtccaggagctggcgcagagagccgccgtggtgatagagggcaaagtccacccacaacgccgccagcagggggccctggaccggaaggcagcagcggccgccggggaggctggagcttggggcggggatcgggagccacccgctgcagggccgcgggcattgggaccacccgccgaagagcccttgctagcagcgaatggcactgttccctcttggccaactgcaccagtgccttccgctggcgagccaggcgaagaagcaccctacctagtcaaagtgcaccaggtctgggctgttaaggctggcggattgaagaaggactccttgctaactgtacgcttgggcacatgggggcaccccgcttttccttcatgtgggaggcttaaagaagacagcaggtacattttcttcatggagccagacgcaaacagcacgtcccgcgctcctgcagccttccgcgctagcttcccaccactggaaactggacgaaaccttaagaaagaggtgtcgagggtactttgtaagaggtgtgccctgcccccacgtctgaaagagatgaagagccaggagtccgcggccggttctaagttagttctgcgctgtgagaccagcagcgaatactcatcgctccggtttaaatggttcaaaaatgggaacgaattgaatcggaagaataaacctcagaatatcaaaattcaaaaaaaacctggaaagtcagagctgcgaatcaacaaggcctcgttagccgattccggcgaatatatgtgtaaggtaatcagcaagctgggcaacgactccgcctccgcaaatatcaccatagtagaaagcaatgcaacatcgacatccaccacgggcacaagccacctagtaaaatgcgccgagaaagagaaaaccttttgtgtaaatggcggcgaatgcttcatggttaaagatctcagcaatccctcgcgttatctgtgtaaatgtcccaatgaatttacgggcgataggtgccagaactacgttatggcatccttctactccacgtcgaccccgtttctaagcctccctgaa

SEQ ID NO: 17509 - DNA, 1266 bp, Artificial Sequence
  Description of Artificial Sequence: Synthetic coding sequence
atgagatggcgccgagcccctagacggtctggaagacctggaccgagagcccagcgccctggctcagccgctcgttcaagcccacctctacctctgctccctttgttacttttacttggaacagccgcactggcccctggagctgcagcgggcaacgaagccgccccagctggcgcctctgtgtgttatagttcgcccccgtccgtcggctccgtccaggagctagctcagcgggccgccgtcgtcattgaagggaaggtgcatccccaacgaagacagcagggtgctttagacaggaaagcggccgctgcagctggcgaagccggtgcgtggggcggagatagggagccacccgctgcaggccccagagccctcggtcccccagcagaggagcctctccttgccgccaatgggaccgtgcctagttggcctaccgccccagtcccttccgcaggagaacctggggaagaggccccctatctggttaaggtccaccaagtgtgggctgttaaagctggcgggttgaaaaaagactccttgctaactgtccgactaggaacgtggggacaccccgcctttcctagctgtggcagactcaaagaggattctcgttatattttcttcatggagcccgatgccaactccacgtccagggcacccgccgcatttcgagcgagctttccaccactcgagacaggtaggaacttgaagaaggaggtaagccgcgtcctatgcaagaggtgtgccttgccaccacgactgaaagagatgaaatctcaggaatctgcagccgggtccaaactcgtgttacggtgtgagacgagctccgagtattcgtcccttaggtttaaatggtttaagaacggtaatgagcttaacaggaagaacaagccgcaaaatattaaaatccagaaaaagcccggcaaaagcgaactgcgaatcaataaggcctcgcttgcagacagcggggagtacatgtgtaaagtgatctctaagctgggcaacgactccgccagcgccaacatcactatagttgagtctaacgcaacatccacgtcaacaacaggtacttcccacctagtcaagtgtgcagaaaaagaaaagaccttttgcgtcaacgggggggagtgttttatggtgaaggacctcagcaatcccagcagatatctgtgcaagtgccccaacgagtttaccggggatcgatgtcaaaattacgtgatggcctccttctacagcaccagcacccccttcctgagcttacccgag

SEQ ID NO: 17510 - DNA, 1266 bp, Artificial Sequence
  Description of Artificial Sequence: Synthetic coding sequence
atgcggtggagacgggcgcctcgccgctccgggcggccagggccacgcgcgcagcggccaggatccgcagcccgctcgagcccgccgctcccgctgctcccactgctcttgctgttgggaactgcggccctggccccgggggcggcggcaggcaatgaagccgccccggctggagcttccgtgtgttactcatccccgccatccgtcggaagcgtgcaggaactggcccagcgggccgccgtggtgatcgagggcaaagtccaccctcagcgacgccaacagggagcccttgatcgcaaagctgccgccgcagctggagaggctggagcgtggggaggggaccgggaaccgccggccgcgggaccgagagcgctcggccccccggccgaagagcctctgctggcggcaaatggtaccgtgccatcgtggccgactgcgcctgtcccaagtgctggagagccgggtgaggaggccccatacctcgtgaaagtgcaccaggtgtgggcagtgaaggccggaggattgaagaaggactcgctgttgactgtgcggctgggcacctggggccatccggcgtttccaagctgcggtagactcaaggaggactccagatacatcttctttatggaaccggatgcgaattcaacttcaagagccccggccgccttccgggcgtcgttccctcctctggaaactgggcggaatctgaaaaaggaagtatcccgcgtgctctgtaagcgttgcgccctgccgccgcgcctgaaggaaatgaagtcacaggaatctgccgcgggatcgaaactggtgcttcgctgcgagacttcttccgagtactcgtcccttcgcttcaagtggttcaaaaatggcaacgagcttaacagaaagaataagccacagaatatcaagatccagaaaaagcctggcaagtcagagctcagaatcaacaaagcctcactggccgattcaggcgagtacatgtgcaaggttatcagcaagctggggaacgacagcgcttcagctaatatcaccatcgtggagtctaacgcaacttcgactagcaccaccggaacctcacacctggtcaagtgcgctgagaaagaaaaaactttctgcgtgaacggaggagaatgctttatggtgaaggatctttcaaacccttcgaggtacttgtgcaagtgtccaaatgagtttactggcgatagatgtcaaaactacgtgatggcctcgttctactccacttcgactccgtttctgtcactgcctgaa

SEQ ID NO: 17511 - DNA, 1266 bp, Artificial Sequence
  Description of Artificial Sequence: Synthetic coding sequence
atgcggtggcgcagggcccccagaagaagcggccggcctggcccaagggctcagagacccggcagcgccgcccggtcttcacctcctctgccccttctgccactgctcctgctgctgggcacagccgcgctggctcctggggccgctgctgggaatgaggccgctcctgctggtgcatcagtttgctactcatctcccccgagcgtaggctccgttcaggagcttgcgcagagagccgcggtggtgatcgaaggtaaggtccaccctcaaaggcgccagcagggggctttggacagaaaagccgctgcggcagccggtgaggccggtgcttggggaggggacagagaaccccctgctgccggacctagggctctgggccctccagcagaggagccactgctggcagctaatggtaccgtgccttcttggcctaccgctcctgtgccctctgccggtgagcccggtgaagaggccccctatctggtgaaggttcatcaggtttgggctgttaaggcaggcggattgaagaaggatagtctgctgacagttaggctcggaacttggggacaccccgcatttccatcttgcgggcgccttaaggaagatagccgctatatctttttcatggaaccggatgcaaacagtacatcacgcgcccctgctgcctttcgcgcgagttttcccccactggaaacaggcaggaatttgaagaaagaagtttctcgggtactgtgcaaacgatgtgcccttcccccgaggctgaaggaaatgaagtcacaggagtccgcggcagggtccaaacttgtacttaggtgtgagacatctagtgagtatagcagcttgcgctttaaatggtttaagaatgggaatgagttgaaccggaagaataaaccacagaatattaagattcagaagaagcccggtaagagcgaactgcggataaacaaagcctctctcgctgacagcggtgagtatatgtgcaaggtgatctccaaactggggaacgactccgcttccgctaacattactatagtggagtctaacgcaacctccacttctactaccggaactagccacctcgtcaagtgcgccgagaaagagaagacgttttgcgtgaacggcggggagtgcttcatggtgaaagatctgagcaacccttcaagatacctgtgtaagtgccccaacgaattcaccggcgacagatgccagaattacgttatggcctctttctacagcacctccacacccttcttgtcccttccagag

SEQ ID NO: 17512 - DNA, 1266 bp, Artificial Sequence
  Description of Artificial Sequence: Synthetic coding sequence
atgcgctggcggagggcgcctcggcgatctggtcgcccgggtccacgggctcagcgacctggaagtgccgccaggagctcccctccactgccgctgcttcccttgctgcttcttctgggaaccgcagccctggctcctggcgcagcggcaggtaacgaggccgcaccggcaggcgcttctgtttgctactcttctcctccttcagttgggagcgttcaggaacttgctcaaagggcggcagtcgtaatcgaaggtaaggtgcaccctcagaggcgacaacaaggggctctggataggaaggctgcggctgcggcgggcgaggctggggcttggggcggggaccgcgaacctcccgcggctggtccccgagccttgggacccccggcggaggaaccacttctcgccgccaacgggaccgtcccctcttggcctacagccccagtcccgtctgccggagagcccggggaggaagctccatatttggtgaaagtgcatcaggtctgggctgttaaagccgggggcctcaagaaagacagtctgcttacagtacgactcgggacctgggggcatcccgcatttccttcctgtggtagacttaaggaggacagtcggtatatcttcttcatggagccggacgccaactccacctcaagagcgccggccgccttccgggcgagtttccctcccctcgaaacaggacggaacctgaagaaggaagtcagcagggtgctctgtaaacgctgcgctttgcctcccaggctgaaagagatgaagtctcaggagtctgctgctgggtccaagttggtgttgcggtgtgagacaagctctgagtactcatccctgaggttcaagtggtttaaaaacggtaacgagctgaataggaagaataagcctcagaatattaagatccagaagaaaccagggaagtctgagctgcgaatcaataaggcttccctggcagattccggcgaatatatgtgtaaggttatctctaaacttggaaacgattctgccagtgctaatattaccatcgtcgagtccaacgcgacatctacgtctacaactggaacaagtcacctggtcaaatgtgccgagaaggaaaagactttctgtgttaatggcggcgaatgctttatggtcaaagacctgagtaatccttcacgctacctctgtaagtgccctaacgagtttaccggagatcgatgtcagaattacgtaatggcgagcttttacagcacgtctacacctttcttgtccctccccgaa

SEQ ID NO: 17513 - DNA, 1266 bp, Artificial Sequence
  Description of Artificial Sequence: Synthetic coding sequence
atgaggtggcggcgggcaccgcggcgatccggacgcccgggaccacgcgctcaaagaccgggctcggctgcccgatcatccccgccgctcccgctgctgccgctcttgttgctgctgggaaccgccgccctggccccgggagctgcagctgggaacgaggcagcgcccgcgggagctagcgtgtgctattcgagcccgccgagcgtcggatccgtgcaggaactcgcacagcgcgctgccgtcgtgatcgagggcaaagtgcacccccaaaggagacagcagggagcactcgatcgcaaggctgcggcggcagccggggaagccggtgcctggggaggcgatcgggaaccaccggctgcggggccgcgcgccctcggcccgcctgcggaggagccgttgttggccgccaatggtactgtgccatcatggcctaccgctccggtgccctcggcaggggagccgggagaagaggctccctacctggtcaaggttcatcaggtgtgggctgtgaaggctggcggcctcaaaaaggactcgctgctgactgtgaggctgggaacctggggacacccggccttcccgtcgtgcggacggctgaaggaggactcccggtatatcttcttcatggagcctgacgcgaacagcacgtccagggctccagctgcatttagggcctcattcccgccactggagactgggaggaacctgaagaaggaggtgtcgcgcgtgctctgcaagagatgcgcactgccaccgcgcctgaaggaaatgaagtcccaagaatcagcagctggatccaagctggttctgcgctgcgaaacttcatccgaatactcctcgctcagattcaagtggtttaagaacgggaatgaactgaatagaaaaaacaagcctcagaatatcaagatccaaaagaagccaggaaaatcagagctgagaatcaataaagcaagccttgctgactcaggagaatacatgtgcaaggtgatctcaaaactgggaaatgactcagcgtccgccaatatcaccatcgtcgaatcaaacgcaacttccacttcgaccaccggaacctcccatctggtgaagtgtgctgaaaaggagaaaactttctgtgtcaacggaggggagtgcttcatggtcaaggacctgtcgaacccatcacggtacttgtgcaagtgcccaaacgaattcaccggcgaccgctgccaaaactacgtgatggcctcattctacagcacgtcaaccccgtttctgagccttcctgag

SEQ ID NO: 17514 - DNA, 1266 bp, Artificial Sequence
  Description of Artificial Sequence: Synthetic coding sequence
atgaggtggcgcagggcacctcgcagatctggtcgccccggtccgagggctcagcgccccggaagtgccgctaggtcttcaccacccctgcccctcctccccctgttgttgctcctcggtacggcagcattggcaccaggcgcagctgcaggcaacgaggccgctcccgccggagcgtcagtctgttattcatctccacctagcgtgggatccgtccaagaactggctcagagggctgctgttgttatagagggcaaagtccatccccagaggaggcagcaaggcgctttggacaggaaagctgctgccgctgctggcgaggccggcgcatggggcggcgacagagagcctccggctgcgggcccgagagccttgggacctccagctgaagaacctctgctggccgccaatggaactgtcccatcttggcctactgccccggttcctagcgcaggtgaaccgggcgaagaggctccatacttggtcaaggtgcaccaagtctgggccgttaaggctggtggactgaagaaagattcactcctgaccgtgaggctcggcacttggggacaccctgcattcccaagctgtggcagactgaaggaagattccaggtacatcttttttatggaaccagacgccaatagtacgagtagagctccggccgccttccgcgcgagttttcctccacttgagactggtaggaatctcaagaaagaggtgagtagggtcctctgtaagaggtgcgccctgccccctaggctgaaggagatgaaatcacaagagtcagccgccggtagcaagctggttctgcgctgtgaaaccagttcagagtactcctctcttaggttcaagtggttcaagaacggcaatgaactgaatagaaagaacaagccccagaatatcaagatccaaaagaagcccggaaagtccgagttgaggataaataaggctagcctggctgattccggtgagtatatgtgcaaggtcatttctaaactcggcaacgacagtgctagtgctaacatcactatcgttgaaagtaatgccacttccaccagtaccaccggaaccagccatctggtcaagtgcgccgagaaggagaagactttttgcgtgaacggtggcgagtgcttcatggttaaagatttgtctaacccgtccaggtacctttgcaagtgtcctaacgaattcactggagaccgctgtcaaaactacgttatggcttccttttactctactagcaccccatttctctcattgcctgaa

SEQ ID NO: 17515 - DNA, 1266 bp, Artificial Sequence
  Description of Artificial Sequence: Synthetic coding sequence
atgcggtggcggcgggccccgcggcggtcaggacgtcccggcccacgggctcagaggcctggatctgcggccagatcatccccgccgctgcctctgcttccgctcctgctgctgctcggcaccgccgccctcgccccgggcgccgcggcgggcaatgaagccgcgccagcaggcgcaagcgtgtgctactcgtccccaccgtccgtcggctcggtgcaggaactggcccaacgcgctgcggtggtgattgagggaaaagtgcacccacagcggaggcagcagggagcgctcgacaggaaggctgccgccgccgccggagaggctggggcatggggaggcgatagggaaccaccggccgcgggaccgagggccctgggaccgccggccgaggagcctctcctggctgctaacgggactgtgccgtcctggccaaccgcgccagtgccgtcggcaggagagcctggagaagaagccccctacctggtgaaagtccaccaggtctgggcagtgaaggccggcggtctgaagaaggattcgctgcttacggtgcgcctgggcacctggggtcacccagcgtttccttcgtgcggacgcctgaaagaggattcgcggtacattttctttatggagcccgacgcaaacagcacttcacgcgctcctgccgcatttcgcgcctctttcccacccctcgaaaccggacgcaatctcaagaaagaagtgtcgagagtcttgtgtaagagatgcgcactcccgccgagactgaaagaaatgaaatcgcaagaatctgcggctggctcaaagctggtcctccgctgcgagacgagctcggaatactcgagccttagattcaagtggttcaagaacggaaacgagcttaaccgcaagaacaaaccgcagaatatcaagatccagaagaagccgggaaagtccgaactccgcatcaacaaggctagcctcgctgattcaggagagtatatgtgtaaggtgatcagcaagctcggaaatgactcagcgtcggcgaatatcaccatcgtggaatccaatgcgacttccacgtcgactactggcacctcccacctggtgaagtgtgccgaaaaagaaaaaactttttgcgtgaacggcggggaatgtttcatggtgaaagatcttagcaacccctctcgttatctgtgcaagtgcccgaacgagttcactggagatcgctgtcagaactacgtgatggcgagcttctactcgacctccactccgttcctgtcgctgcctgag

SEQ ID NO: 17516 - DNA, 1266 bp, Artificial Sequence
  Description of Artificial Sequence: Synthetic coding sequence
atgagatggagacgcgcaccgcgccggtccggccgcccgggtccaagggcccaacggcccggatcggcggcacggagctcgccgccgcttccgctgctgccactgctgctgcttctgggaactgccgccctggcccctggagctgctgcggggaacgaagccgcgcccgcgggggctagcgtctgctacagctccccaccctcagtcggatcggtgcaggagctggcccagcgggctgcagtggtgatcgagggtaaagtgcatccacaaagacgccaacagggggccctggatcgcaaagctgccgcggctgcgggagaagcgggcgcgtggggtggagatcgggagccaccggccgccggacctcgcgcgctgggacctccggccgaggaaccgctgctcgccgctaatggaacggtgccgtcctggccaacggcgcctgtgccgtcggcgggagagcccggagaggaagccccgtacctcgtgaaggtgcaccaggtgtgggccgttaaggcgggaggcctcaaaaaagattccctcctgactgtgcgcttgggcacttggggccatccggcgttccctagctgtggcagactgaaggaggactcgcgctacatcttctttatggaacctgatgcaaacagcacctcccgcgcaccagcggctttccgggcgagctttccgccactcgaaactggacgcaacctcaaaaaggaggtatcccgagtgctgtgcaaacgctgcgctctgccgcctagactcaaggaaatgaagtcgcaagaatcagctgcgggatccaagctggtgctcagatgtgaaaccagctcagaatacagctccctgcgattcaaatggttcaaaaacggaaacgaattgaatagaaagaacaagccgcagaacatcaagatccaaaagaaaccgggcaagagcgaactgcgcatcaataaagcatcgctggcagactccggagagtacatgtgcaaggtgattagtaagctgggaaacgactccgcttcagcgaacatcaccatcgtggaatcgaatgcgacctcaacctccactaccggaacttcgcatctggtcaagtgtgccgagaaggaaaaaactttctgcgtgaacggaggagaatgcttcatggtgaaggacttgtcgaatccgagccggtacctgtgcaagtgcccgaacgaatttactggagacagatgccaaaactacgtcatggcatcattctactcgacgagcactccttttctgagcctccccgag

SEQ ID NO: 17517 - DNA, 1266 bp, Artificial Sequence
  Description of Artificial Sequence: Synthetic coding sequence
atgcggtggcgccgtgcaccacggagatctgggagaccaggacccagagctcagcggcccgggtcggctgctcgaagttctcctcctttgccactactgccgcttctgctacttcttggaacagcggctcttgcccctggagctgccgcggggaacgaagctgcacctgccggagcatcggtctgttattcatcccctccatcggtggggtctgtgcaggaactcgcccagagagcagctgttgtcatagaaggaaaagttcacccccagaggcggcagcagggagccttggatcgaaaagcagccgcagcggcaggagaagcaggagcgtggggaggagaccgcgaaccccctgccgctggaccccgagcactagggccacccgctgaggaaccattgctggctgccaatgggacagtaccctcttggcccactgcacccgttccctctgctggagaacctggggaagaagctccatatctcgtgaaagtacatcaggtgtgggctgttaaagccgggggactaaaaaaagactcgttgctcacagtgaggctcggaacatggggacatccagcgttcccctcttgtggacgcttaaaagaggactcacgctacatcttcttcatggaacccgatgcaaattcaacttcacgggctcccgccgcctttagagctagttttcctccactcgaaactgggcggaaccttaaaaaagaagtatcaagggtgctgtgcaaacggtgcgcactgcctccaagattgaaggagatgaaatcccaggaatccgccgcagggtctaaattagtgcttcggtgtgaaacttcttcagaatattcatctttacgcttcaaatggttcaaaaatggaaacgaactgaacaggaaaaacaaacctcagaacatcaagatccagaagaagccaggaaaatctgagctcagaataaataaagcatctctcgctgatagtggggaatatatgtgcaaagtcattagtaaacttggaaatgatagtgcttctgctaatatcacaattgtcgagtcgaatgcaacatcaacttcaacaacaggaacaagtcatctggtaaaatgcgcagaaaaagaaaaaacattctgtgtgaacgggggggagtgctttatggtaaaagatctgtcaaacccctcaaggtatctctgcaaatgcccaaatgagtttactggagatcgctgtcaaaactatgttatggcttcgttttactctacatcgacaccttttctgtctctcccagag

SEQ ID NO: 17518 - DNA, 1266 bp, Artificial Sequence
  Description of Artificial Sequence: Synthetic coding sequence
atgaggtggcggagggcaccaagaaggtccggccggccaggacctcgtgcccagcgacctggaagcgctgctagaagctcccctcctctgcccctgctccccctgcttcttttattgggaactgctgcactggctcccggagccgctgctgggaacgaggcagcgcccgcaggcgcttcggtttgttatagcagtcctccctctgtgggtagcgttcaggagctggctcaaagggccgcagtcgttatcgagggaaaagtccacccccagagaagacagcaaggggcgttagataggaaggctgcagcagctgctggggaagctggagcatggggaggggatcgcgagccacccgccgccggccctcgcgcacttgggcctccagctgaagaaccgcttttggccgccaacggcacggtgccctcatggcctaccgccccagtgccgtcagcaggagaacctggcgaggaagccccctacctcgttaaggttcaccaagtctgggctgtcaaagctggcgggctcaagaaggactccctcctgacagtgcgtcttggcacatggggacatccagccttcccctcttgtggccgcctcaaggaagattccaggtatatcttcttcatggagcctgatgcaaattctaccagccgcgcacctgctgcctttcgggcttcctttcccccgcttgaaacaggtaggaatctgaagaaagaggtgtcacgcgtgctctgcaaaagatgtgcactgcccccgcgactaaaggaaatgaagtctcaagaatccgcagcaggatctaagcttgtgctgaggtgcgaaacatcgtctgagtattcttctcttaggtttaagtggttcaaaaacgggaatgaattgaacaggaaaaacaagccacagaacatcaagatccaaaaaaaacctggaaagagcgagctgaggattaacaaggcttctcttgccgattctggcgagtacatgtgcaaagtcatttccaaactgggcaacgacagtgcttcagctaacattactatcgtcgagagtaacgcaaccagcacgtctactaccggcacaagtcacctcgttaagtgtgccgaaaaggagaagaccttctgtgtcaacggcggggagtgttttatggtcaaagatctctcgaacccaagcagatacctgtgtaagtgcccaaacgagtttacaggcgaccgctgccagaactacgtgatggcaagcttttactcaaccagtactcctttcttgagcctgcccgaa

SEQ ID NO: 17519 - DNA, 1266 bp, Artificial Sequence
  Description of Artificial Sequence: Synthetic coding sequence
atgcggtggcggcgtgctcctagaagatcagggagacccggtcctcgtgctcaacgcccgggatccgcagctcgttcgagtcccccactgccattactgccgcttcttttactgcttgggacagccgcgcttgctccgggagcggcagcaggtaatgaggctgcccctgccggagccagtgtgtgttactccagtccgccttctgtaggctctgtgcaagaactcgcacagcgagccgcggttgtgattgagggaaaagttcacccacagcggagacagcagggagcacttgacagaaaagctgctgccgcagctggagaagctggcgcttggggaggagatcgcgaaccaccagcagccggacctcgagcgttgggcccgccagctgaggaaccacttttagctgctaacggcactgtgccaagttggccaacggccccagttccatccgctggtgagccgggggaggaggcaccttatctcgtcaaggttcatcaagtttgggcagtgaaagcaggaggactaaaaaaggactcactattgacagtgcgcttaggtacgtggggccacccagcatttccgtcatgtggtcgacttaaagaagattcccgatatattttctttatggagccagacgcaaactccacttcccgagcaccggcggcgtttagggcgtcgtttccacctttagaaaccgggagaaatcttaagaaagaagttagccgggttctttgtaagcgatgtgcgttaccaccgagattgaaagaaatgaaatcgcaagagtcggctgcaggatccaaactggtattgcgttgcgagacttcatctgagtactcatcacttcgttttaaatggtttaaaaatggaaacgagcttaaccgaaaaaacaaaccacagaatattaaaatacagaagaaaccggggaaatcagagttgaggatcaacaaggcatctcttgcggattccggagagtacatgtgcaaggttatatcaaaattgggaaatgactctgcctcagctaacattactattgtggagagtaatgctacaagtacatcaaccacaggaacatcccacctcgtaaaatgcgcggaaaaggaaaaaaccttctgtgtcaacggaggtgaatgtttcatggtgaaagatttgtctaacccaagccgttatttgtgtaaatgtcccaatgagttcacaggagaccgttgccaaaattatgtgatggcttctttctattcaacttcaacaccattcttgtcattgccagag

SEQ ID NO: 17520 - DNA, 1266 bp, Artificial Sequence
  Description of Artificial Sequence: Synthetic coding sequence
atgagatggagacgtgcccccagacgctccggtaggccaggacctcgcgctcagcgacccggcagtgccgccaggagttctcctcccctccccttactcccccttttgttgttgcttggtacagctgccctggctcccggcgccgcagctggaaacgaagctgcgcccgctggggcgtctgtgtgttacagctccccacctagcgtgggcagtgtacaagaactggcacagagagctgcagtggtcatcgaaggcaaagtgcaccctcaaaggaggcaacaaggagccctggacaggaaggcagccgcggccgctggcgaagcaggcgcttggggaggagatcgggaacctcccgctgccgggccgagggctttgggacccccagcggaggaacctctcctcgctgctaacggaactgttccaagctggccaacagcccccgtgccatcggctggcgagccaggggaggaggcaccgtacctggtgaaagtgcatcaggtttgggcggtaaaagccggggggctgaaaaaagatagtctcctcaccgtgagactggggacttgggggcaccccgcttttccctcatgtggaagactaaaggaggatagccgttatatcttctttatggagcccgatgcaaattccacctccagagccccagcagcctttagggcttcgttccctcctctcgaaaccggccgcaacctaaaaaaggaagtgtccagggtcctttgtaagagatgcgctctgccccccaggttgaaagaaatgaaaagccaggagagtgccgcagggtctaaactcgtcctcaggtgcgagaccagctcggagtatagcagtctgagattcaaatggtttaaaaatggaaacgaacttaaccgaaaaaataagcctcagaacataaaaatccaaaaaaagccaggcaaatcggagctccggatcaacaaggcatctctggctgactcaggagagtacatgtgtaaagtgataagcaagctcgggaacgattctgcatcagcaaatatcaccatcgtagaatctaacgctactagtactagcaccacagggacctcacatttggtgaaatgtgcagaaaaggagaagaccttctgtgtcaacggaggggagtgcttcatggttaaagatctttctaatccaagtagatacctctgtaaatgccctaatgaattcacaggcgatcgatgccagaactacgtgatggccagtttttactccacttccacaccatttctgagcctgcctgaa

SEQ ID NO: 17521 - DNA, 1266 bp, Artificial Sequence
  Description of Artificial Sequence: Synthetic coding sequence
atgagatggcgaagagcaccaagacggtcaggacggcccggtccccgggctcaacggccaggatctgcagcaaggtcgagccctccattgccacttctgccattgttgctcctcctgggcaccgcagcacttgcaccaggagccgcagcagggaatgaagcggcacccgcaggcgcaagcgtgtgctactcgtcacctccttcagtgggatccgtgcaggagcttgcacagcgagcggccgtggtgattgaaggaaaagtacacccgcaacgtaggcagcagggtgccctggaccgcaaggcagccgccgccgcaggcgaggcgggtgcctggggtggagatcgagaaccacctgcagcaggaccaagagcgctggggcctcccgctgaagagccactgcttgccgcaaacggaactgtgcctagctggccgaccgcgccggttcctagcgcaggcgagcctggggaagaggcaccttaccttgtcaaagtgcaccaggtttgggctgtcaaggcgggcggactgaaaaaagattcactgcttaccgtcaggctgggcacttggggtcatcctgccttcccatcgtgtggcaggcttaaggaggactctcggtacattttctttatggaacctgacgcgaactcaacctccagggccccggccgcgttcagagcatcctttcctcctttggaaaccggccgtaatctgaagaaggaggtgtcccgagtgttgtgcaaacgctgcgcattgccgccaagactgaaggaaatgaagtcgcaagaatcagccgcaggatcgaaacttgtcctccgttgtgaaacttcgagcgaatattcctcacttcgcttcaaatggtttaagaatggaaacgaactcaatagaaagaacaagcctcaaaacatcaagattcaaaagaaaccgggtaaaagcgagctccgcatcaacaaagcatcgcttgccgatagcggtgaatacatgtgcaaagtgatttcaaagctgggaaacgattctgcgtccgctaatatcactatagtggagtcgaacgcaacgtccacgagtaccactggtactagccatcttgtgaagtgtgcggaaaaggaaaagactttttgcgtgaatggtggggaatgttttatggtcaaggatctctccaaccctagtcgttacctttgtaagtgtccgaacgagttcactggagatcgttgtcaaaactacgtgatggccagcttttacagcacctccaccccgtttctgtctctccccgaa

SEQ ID NO: 17522 - DNA, 1266 bp, Artificial Sequence
  Description of Artificial Sequence: Synthetic coding sequence
atgcgatggcgaagggccccaagacgaagcggccgacccggcccgcgcgcccagaggcccgggtctgctgctcgatcttcccccccccttccactgctcccccttttattgttgttgggcactgccgctctggcccctggggcggcggcgggcaacgaagccgcccccgccggcgcctccgtgtgctatagcagccctccaagcgtggggagcgttcaggagctcgctcaacgtgctgccgtggtcatcgaaggaaaagtccacccccagcgccgccaacagggcgccctggaccggaaagccgccgctgccgcgggcgaagccggggcttggggaggagatcgcgaaccccctgcagcaggtcccagggccctcgggccccccgctgaagaaccacttctggcagctaatggaacagttccatcttggcctactgcgccggtgccatccgctggggaacccggcgaagaagccccgtacttggtgaaggttcaccaggtttgggccgtgaaagctggcgggcttaaaaaggattcattgttgactgtcaggcttgggacctgggggcatcccgctttcccttcctgtgggcgtctcaaagaagactctagatatatctttttcatggagccagatgcgaattccacctctcgagcccctgccgcctttcgggcctcattcccaccgctcgagaccggccgaaacctgaagaaagaggtaagtcgagtcctgtgtaaaaggtgtgcccttcctccccgccttaaggagatgaaatcacaggagtccgctgctggatccaagttagtcctgaggtgcgagacatcaagcgagtattccagcctgcgctttaaatggtttaagaatgggaacgaactaaatagaaagaacaagccccagaacatcaagattcagaagaaacctggaaaatccgagctgcgaatcaacaaagcttctctggccgactctggagagtatatgtgtaaagttatttcaaagcttggtaacgactccgccagcgccaacattaccatcgtggaatcaaacgccacttcgaccagcaccaccggcacttctcatttggtgaagtgtgcagaaaaagagaaaacattctgcgtgaacggtggtgaatgtttcatggtgaaggacttgagtaacccatcccggtatctgtgcaagtgccccaacgagttcactggcgatcgctgccagaattatgtgatggcttctttttactctacttccacccctttcctgagtcttccagag

SEQ ID NO: 17523 - DNA, 1266 bp, Artificial Sequence
  Description of Artificial Sequence: Synthetic coding sequence
atgaggtggcgacgggcgcctcgtcgctctggccgacccggtccaagagctcagcgccctggaagcgcagcacgcagttcgcctcccctacctctgctccctcttctgctgcttctcggcacagcggcactggcgccaggggccgcagcgggaaatgaagccgccccagcaggtgcatccgtgtgttactctagccccccatccgtggggagtgtgcaggaactcgcacagagggcagccgtggtaatcgaaggcaaagtccaccctcaacgcaggcaacagggagcactggacaggaaagccgccgcagctgccggagaggcgggcgcatggggcggagatagggaaccccctgcagccggacctagggctctcggacctcctgccgaagagcccctcctagccgccaacggaacggtcccctcatggcccaccgcgccagttccctctgccggggagcccggtgaggaggctccctacctggtgaaggtccatcaggtatgggcggttaaggctggaggtctgaagaaagacagtctgctaaccgtaagactcggcacatggggtcatcccgctttccctagctgtggacgcctgaaagaagattctaggtacatttttttcatggaaccagacgccaactcaacttccagggccccagcagccttcagagcttcctttcccccactggagacaggacggaatcttaagaaagaggtgagccgggttctgtgcaaacgatgcgcgctgcccccacgcctcaaggagatgaagtcacaggaaagcgcagcaggatctaagctcgttcttcgctgcgaaacgagctccgagtactcttctcttagatttaaatggtttaagaacgggaatgagttaaataggaagaacaaaccccagaatattaagattcagaagaaaccaggaaagtcagaactccgtattaataaagccagcctggccgattccggtgagtacatgtgtaaagtcataagcaaactgggcaacgactccgccagcgccaatatcacaatcgtggagagtaatgccacaagtactagcaccacaggtacctctcaccttgtcaaatgcgccgagaaagagaagacattctgcgtgaacggtggcgagtgctttatggtgaaggatctttcaaacccgtcacgttatttatgtaaatgccctaacgaatttacaggggaccgctgccagaattatgtgatggctagcttctactcaacaagcacaccttttctgtcactgccagaa

SEQ ID NO: 17524 - DNA, 1266 bp, Artificial Sequence
  Description of Artificial Sequence: Synthetic coding sequence
atgaggtggcgacgggctcccagacgcagtgggcgccccggccctagggcccagcgccctggcagtgctgcacggtcttcgcccccactcccactcttgcccctgctgctgttgctagggaccgcagccctagccccaggcgccgcagctggaaacgaagcggcgccagctggtgcatcagtatgttactcatcacccccttccgtaggctccgttcaagagctggctcagcgggccgccgtggtaatagaggggaaagtgcatcctcagaggaggcagcagggagctctcgaccgcaaggccgccgctgcggccggcgaggccggggcctggggaggtgatagagagcctccagcggctgggccgcgcgctctcgggccgcccgccgaggaacctctcctggctgcaaatggtactgtgccgagttggcccactgcccctgttcccagcgcaggtgagcccggtgaggaagccccctatctagtgaaagtccatcaggtctgggcagtgaaggctgggggccttaaaaaggactctctgctgacagttcggctaggaacctggggacatcccgccttcccgtcctgcggacgcctgaaagaagattctcgctatattttttttatggagccggatgcaaacagtacgagccgggcgccagccgccttccgggcttcctttccgcctctcgaaactggtcggaatctcaagaaggaagtatcacgcgtgctctgcaagcgatgcgccctcccaccgcgtcttaaggaaatgaagagccaggaaagtgcagcgggatccaaactggtgttgcggtgcgaaactagcagtgagtactcctccttgcgctttaagtggtttaaaaatggaaatgagctgaataggaaaaacaaacctcagaacattaagatacagaagaagcctggaaagtccgagttgagaatcaataaggctagtctcgctgactccggggaatacatgtgtaaggtaatttccaagctgggcaacgactcggccagcgccaacatcacgattgtggagagcaatgcaacctctaccagtactacgggcacaagccacctggtcaaatgcgctgaaaaagagaaaacattctgcgttaacggaggcgagtgtttcatggtgaaggacctgagcaaccccagcagatatttgtgcaagtgccctaatgaattcacgggcgaccggtgccagaattacgtcatggcaagcttttactcaacgagtaccccgtttctgtccttgcctgag

SEQ ID NO: 17525 - DNA, 1266 bp, Artificial Sequence
  Description of Artificial Sequence: Synthetic coding sequence
atgaggtggcgacgcgcacccagaaggtccggcagaccagggcctagggcacaaaggccaggaagcgctgcccgatcttcgcccccactgccgcttcttccactcttgctgttgctggggaccgccgctctcgcaccaggagcagccgccggcaacgaagcagcaccggcaggggcatccgtgtgttactccagcccaccctcagtgggttcggtccaggagctggcacaacgcgcggcagttgtgatcgagggaaaagtgcatccacaacgtcgccagcagggagctttggatcgaaaagcagccgcggcggcgggtgaagcgggagcatggggaggagatcgagaacctccagcggcagggcctagagcactgggacccccagcagaagaaccgcttcttgcagcaaacgggactgtcccttcgtggccaaccgcgcccgtcccgtcagctggtgagcctggcgaagaggcaccatacctcgttaaggtgcaccaagtttgggccgtgaaagcggggggccttaagaaagattcgctgcttaccgtgagacttgggacttggggccatccagcattccctagctgtggcagactcaaggaggactccaggtacattttcttcatggaaccagatgccaactccacctcgcgagcccctgcggcatttcgcgcatcttttccacctctggaaactggacgaaatctgaaaaaggaagtctcccgagtgctgtgcaagcggtgtgcactgcctcctagactgaaggagatgaagtcccaagaatcggcagcaggctccaagctcgtccttcggtgtgaaacgtccagcgaatactcgtcactccggtttaagtggtttaagaacgggaacgaacttaaccgtaaaaacaagcctcagaacattaagattcagaagaagcctggcaagtcggaactcagaatcaataaggcatcgctggctgattcgggggagtacatgtgtaaggtcatttcaaaacttggcaacgactcagcaagcgcaaacattacgattgtggagtcaaatgcaacctcgacttccaccaccggtaccagccatctggtgaaatgcgccgagaaggagaaaactttttgcgtgaacggtggagagtgttttatggtcaaggatctgtccaatcctagccgttatctgtgcaagtgtcctaacgaatttaccggtgaccgttgtcaaaactacgtgatggccagcttctactcgacctccactcctttcctgtccctgccggaa

SEQ ID NO: 17526 - DNA, 1266 bp, Artificial Sequence
  Description of Artificial Sequence: Synthetic coding sequence
atgaggtggcgccgcgcaccgcggcgctccggtcgcccgggaccacgggcccagcgaccaggctccgcggcccgcagctcgccgcctctgcccctcctcccgcttctcctgttgctgggaaccgctgccctcgccccaggagctgcggcagggaatgaggctgccccggcgggagcttccgtctgctactcgagccccccgtcagtgggttcggtgcaggaactggcccaacgcgctgccgtcgtcatcgagggaaaggtgcatcctcagagacgacagcaaggcgccctcgaccggaaagctgcggctgcagcgggggaagcgggagcatggggtggcgacagggaaccgccggcggcaggcccgagagcgctgggacctccggcagaggagccgcttctggccgccaatggcactgtgcctagctggcctaccgcgccggtgccatccgcgggggaaccgggagaggaggcgccctatctggtcaaagtgcatcaagtgtgggcagtgaaagcgggaggactgaagaaggacagcttgcttactgtacggctggggacctggggacacccagccttcccgtcatgcgggcgcttgaaggaggactcccgatacatcttcttcatggaaccggacgctaactccacctcacgggcgccggcggcgttccgcgcttcgttcccgccgctcgagactggaagaaacctcaagaaggaagtgagcagagtgctgtgtaagcggtgtgccctgccgcctcgcttgaaagaaatgaagtcgcaagagtccgccgccggatcgaagctcgtgctgcggtgcgaaacctcgtccgagtactcgtcgctgcgcttcaaatggtttaagaatggtaacgaactgaaccggaaaaacaagccacagaatatcaaaatccagaaaaagcctggaaagtccgaactgagaatcaataaggctagtctggccgacagcggagaatacatgtgcaaggtgatctccaagctgggaaatgattccgcaagcgctaacatcacgatcgtggagtccaacgccaccagcacctcgaccaccggcacctcacatctcgtgaaatgcgccgagaaagaaaaaaccttttgtgtcaatggaggagaatgtttcatggtgaaggatttgtccaaccctagcaggtacctttgcaaatgtccaaacgagttcacgggagatagatgtcaaaactacgtgatggcctccttttacagcacttctactccgttcctcagcctgcccgaa

SEQ ID NO: 17527 - DNA, 1266 bp, Artificial Sequence
  Description of Artificial Sequence: Synthetic coding sequence
atgcgctggagacgagctcctcgacgctctggtagaccaggtcctagagctcagcgacctggaagcgcagcccggtcatcacctccactgccgctgttgccactccttttgctgcttggaaccgctgcactcgcaccaggggcggccgcaggtaacgaggcagcccctgcaggcgcaagcgtgtgctacagttcacctcctagcgtgggatcggtgcaagaactggctcagagagctgcagtcgtgatagagggaaaggtgcatccgcagcgtcgccaacaaggagcccttgacagaaaggccgcagccgcagcgggcgaggcaggtgcatggggtggtgacagagagccacctgccgcaggcccgcgcgcgctcggtcctccagcagaagaacctctgcttgccgccaacggaaccgtgccatcgtggccaaccgcaccagtgccttcggccggagagcccggggaagaagcaccctacttggtgaaggtccatcaggtgtgggccgtcaaggcaggaggactcaagaaggactcgttgctcactgttagactcgggacttggggtcacccggcatttcctagctgcggtaggctcaaggaagatagcaggtacattttctttatggaaccagatgcaaattcaacttccagagcgccagccgctttcagagcatcgtttccaccactggaaaccggaagaaacctgaaaaaggaggtgtcaagggtgctgtgcaagcgctgtgcactgcctccaagactgaaggagatgaagtcccaagagtcagccgccggttcaaagctggtcctcaggtgtgagactagcagcgaatactcctcccttcgcttcaaatggttcaagaatggaaacgaactcaaccgaaaaaacaagccacagaatatcaaaatccagaaaaagcctggaaagtcagagttgcgcataaacaaggcctcgcttgcagattctggtgaatacatgtgtaaagtgatttccaagctcggcaacgattccgcatccgcgaacattactatagtggagtcgaatgcaactagcacctcaaccaccggaacctcccatctggtgaaatgcgccgaaaaagaaaaaacgttttgtgttaacggaggagaatgttttatggtgaaggatctcagcaacccatccagatacctgtgcaagtgccctaacgaatttacgggagatcgctgtcagaactatgtcatggcatcgttttacagcaccagcacgccctttctttccctgccagag

SEQ ID NO: 17528 - DNA, 1266 bp, Artificial Sequence
  Description of Artificial Sequence: Synthetic coding sequence
atgaggtggcgcagagctccccggcggtctggaagacccggcccccgcgcccagcggcccgggtcagccgcccgaagtagtccacctttaccattgttgcccctgctgctgctgctgggaaccgcggccctggcgcccggtgctgccgccggtaacgaggccgccccggccggtgcttccgtatgctacagttctccacctagcgttggtagcgttcaggagcttgcacagcgagccgctgtcgtcattgagggcaaagtgcaccctcagaggcgccagcagggtgcccttgacagaaaggctgccgctgctgcaggcgaggcaggcgcatgggggggcgaccgagagccacctgcggccggccctcgtgcactggggcccccagctgaagagcctcttttagctgccaatggcaccgtgccgagttggcccacagcacctgtaccttccgccggcgagcccggggaagaagccccctaccttgtgaaagtgcaccaggtgtgggctgtgaaggccggcggcttgaagaaagatagtctgttgaccgtgaggttgggcacctggggccatcctgcttttccatcttgcgggcgactgaaagaagacagccggtacatcttctttatggagcctgacgcaaattctactagccgcgcccccgcggcgtttcgcgcatcatttccacctctggaaaccggccggaatctgaaaaaagaggttagccgtgtactttgtaaaaggtgcgccctgccgccgcggttgaaggagatgaagtcccaggagtctgcagccggttccaaattagttctgagatgcgaaacatctagcgagtatagttcactgcgctttaagtggtttaaaaacggaaatgaactcaacagaaagaacaagccacagaatattaagatacaaaagaaacccggaaagagcgagctgagaatcaacaaggcttcactcgcagacagtggagagtatatgtgcaaagtgatatcaaaacttggcaacgactccgcatctgcaaacattacaatcgtggaatccaacgctacctcaacttctactaccggtactagccatttggtgaaatgtgctgagaaggagaagacgttctgcgtgaacggaggcgaatgcttcatggtgaaggacctgagtaacccatctagatatctgtgcaagtgtcccaacgagtttaccggcgatcggtgccagaactatgtgatggcaagtttttactctacttcgaccccatttctgtcattgcctgaa

SEQ ID NO: 17529 - DNA, 1266 bp, Artificial Sequence
  Description of Artificial Sequence: Synthetic coding sequence
atgcggtggaggagagctcccagacgctccgggagacctgggccgagagcccaaagacccgggagcgctgccaggagcagcccacccttaccacttttgccccttctgcttcttctggggaccgcagccctggctccgggcgccgcggccggaaatgaggccgctcctgccggcgcgagcgtgtgttactcctccccccccagcgttggcagcgtccaagagctggcccagagagctgcggttgtcatagagggcaaggtgcatccacagagaaggcagcagggtgctctcgaccggaaggccgccgcagccgccggtgaggccggcgcctggggcggagacagggagcctccggccgccggtccgcgagcactgggtccacctgccgaggagcctctgctggcggcaaacggaactgtcccctcatggccaacagcccccgtgccgagtgctggagagcccggcgaagaagctccataccttgtgaaggttcaccaggtgtgggctgtgaaagccggaggacttaagaaagactctctcttgacagtcaggctgggtacctggggtcatcccgccttccccagctgcggtcggctcaaagaagacagtcggtacatcttctttatggaacccgatgcaaacagcacctcccgagcacccgccgctttccgggccagcttcccccccctcgaaacgggaaggaacctgaagaaggaagtgtcacgcgtgctctgtaagcggtgcgccctgccgccccggttgaaagaaatgaagtcccaggaaagcgccgccggatccaagctggtgctgcgatgcgagaccagctcagaatattcgagtttgcgctttaaatggtttaagaacggtaatgagctaaacaggaaaaacaaaccccagaacatcaagattcaaaagaagccaggcaagtcggaactccgcataaataaagcctccctggcagattcgggtgaatatatgtgtaaagtgatatcgaaactcggcaatgactccgcttctgcgaacatcacaatcgttgaaagtaatgcaacgtcaacctccaccacaggaaccagtcacctcgtcaagtgtgccgagaaagaaaagacattctgtgtgaacggtggagaatgcttcatggtgaaggatctgtctaatcctagtcgttatttgtgcaaatgcccgaatgaattcacaggagaccgctgccaaaactacgtcatggcatctttttatagcacctctaccccctttctcagccttccagag

SEQ ID NO: 17530 - DNA, 1266 bp, Artificial Sequence
  Description of Artificial Sequence: Synthetic coding sequence
atgcgctggaggagggctcctcggcgttcggggcgtccggggccccgggcccagcgccctgggagcgccgcaagatcctctccgccgctccccctcctgccgctcctactgctgcttggtacggccgcactagcaccaggggcagcagcagggaacgaagcagctcccgcaggggcgagtgtgtgttacagctcccctccctcagtgggatctgtccaggaattggctcagcgtgctgccgttgtaatcgaagggaaggtccacccccaaaggagacaacagggtgccctggaccggaaggctgctgccgctgccggagaggccggtgcctgggggggcgaccgcgaaccgcccgcagccgggccacgcgctctcggccctccggcagaagagccactgttggctgccaacggcaccgtgcctagctggccaacggcccctgtgccttctgctggtgagcctggcgaagaggccccttatctggtgaaagtgcatcaggtatgggctgtgaaagccgggggcctcaagaaggattccttactgactgtgcggttgggaacatgggggcacccagcctttccttcgtgtggccggctaaaggaagactcacggtatattttctttatggaacctgacgctaactctacctcaagagctccggcggcttttcgggcctcctttccccctctcgagacagggagaaatctgaaaaaggaagttagtcgcgtcctctgcaaacggtgtgcattgccccctcgattaaaagagatgaagagtcaggagtcagcggcggggagcaagctggtgttgcggtgcgaaaccagtagtgagtacagctcccttagatttaaatggttcaagaatggaaatgaactgaaccggaaaaataagcctcagaatatcaaaatacagaaaaaaccaggaaagtccgagcttaggatcaacaaggcctcccttgccgatagcggggaatacatgtgtaaagtgatctctaagttagggaatgactcagcctcagccaacattactattgtggagagcaacgcaacatcaactagtaccaccggaacatcacatcttgtgaaatgcgctgagaaagaaaagacgttctgcgtgaacggaggagagtgcttcatggtgaaagacctgtctaatccctcacgctatttgtgcaaatgcccaaacgaattcactggggataggtgtcaaaactatgtgatggcttcattttatagcacatccacgcctttcctgagcctgcctgag

SEQ ID NO: 17531 - DNA, 1266 bp, Artificial Sequence
  Description of Artificial Sequence: Synthetic coding sequence
atgcggtggagacgggcacctagacggtctggaagacccggacctagggctcaaagacccggctccgctgccaggtcctcacccccgctgcccctccttcctctccttctgctattggggactgccgcactggcacctggcgccgccgccggcaatgaggcagcgcctgcaggagcctcagtttgttactcaagccctccatctgtgggcagtgtgcaggaacttgctcagagggcggccgtcgtgatcgagggtaaggtccacccacagcgccggcagcagggggctctcgatcgtaaagcggccgcagcggcaggtgaggccggagcctggggcggggaccgggagcccccggccgctggcccccgagccctggggccaccagccgaagaacccctgctggcggcaaacgggacagtcccttcctggcctactgcgcctgtcccgtctgcaggggagccaggagaggaagcgccatatctagttaaggtgcaccaggtgtgggcagtaaaagcggggggtctgaaaaaggatagtctgctgactgtgcgactagggacttggggtcacccagctttcccaagctgtggacgcctaaaagaagactctcggtacatctttttcatggagcctgatgcgaattctactagccgtgctccagcagcttttcgagccagtttccctcccctggagacagggaggaatctgaagaaagaggtttctcgggtgctgtgtaagaggtgcgcactgcccccacgccttaaagagatgaaaagccaggagtccgcggcaggcagcaagctggtgctcagatgcgaaacgtcatcggaatattcaagcttgcgattcaagtggttcaagaacgggaacgagctaaatcggaagaacaagccccaaaacataaagatccagaagaaacccggaaagtccgagctgcggattaacaaggcttccttggctgactcgggcgaatatatgtgcaaagtgattagcaaactcggaaatgatagcgcatccgccaatatcactattgtggagagcaacgctacttccacttccaccactggaaccagccacttggtgaagtgtgccgaaaaggaaaagacattctgtgtgaatggaggggagtgctttatggtgaaggatctctctaatccatcccgctacctctgtaagtgccccaacgagttcacaggcgacagatgccagaactatgtcatggccagtttttactcgacgtctactccctttttaagccttcccgaa

SEQ ID NO: 17532 - DNA, 1266 bp, Artificial Sequence
  Description of Artificial Sequence: Synthetic coding sequence
atgcgatggcgccgagccccccgacgaagtggtcggccgggaccccgtgcgcagaggcctggcagcgctgcccggagctctccgccgttgcctctcctccccttgcttcttctgctgggtactgcagcactcgcgcctggtgccgccgccggtaacgaggccgccccggcaggtgcttcggtgtgttactcgtcgcccccatccgttggttccgttcaggaactcgcccagagggccgcagtcgtcattgagggcaaggtgcacccacagcgtcgtcaacaaggggcgcttgaccgcaaagcagcggccgccgctggtgaggctggtgcttggggcggtgatcgggagccccctgctgccggcccgcgcgccctgggtcccccggctgaggagccccttctcgcggccaatggcaccgtccccagctggcccacggcccctgttccgtctgctggagaacccggtgaggaagcgccttatctggttaaggtgcaccaggtttgggctgtcaaggcgggcggtctgaagaaggactccctgctgaccgtgcgcctgggcacgtggggtcatccggctttcccatcgtgcggcagactcaaggaggattcccgctacattttcttcatggagcccgatgctaacagcacatctagggcgccggccgccttccgagcaagcttcccgcctctcgagactggacgcaatctgaaaaaggaggtgtcccgtgtactttgtaagcgttgtgcactcccgccccgcctgaaggaaatgaaatcccaagagtcggctgccggatccaagctcgttctgcgttgcgagaccagtagcgaatactcgtctctgcgcttcaaatggttcaagaacggtaatgagctcaatcgcaaaaacaagccccagaatattaagattcagaagaagcctggtaagtccgagctcaggatcaacaaggcatccttagccgattcgggagaatacatgtgcaaggttatttctaagctcggaaacgactccgcgtccgccaacatcacaatcgtagagagtaacgcgacctctaccagcacgacaggcacttcgcacttggtaaaatgcgcagaaaaggagaagacattctgcgttaacggcggggaatgttttatggtcaaggatttgtcaaatccaagccgttatctctgcaagtgcccgaatgagttcactggagaccgctgccagaattatgtcatggcaagcttctacagtacctcgacaccgttcctctcactgcctgag

SEQ ID NO: 17533 - DNA, 1266 bp, Artificial Sequence
  Description of Artificial Sequence: Synthetic coding sequence
atgcggtggcgccgcgcccctcgccgctctggacggcccggccctagggcacaaagacccggctccgccgctagatcaagtcctcccttgcctctgctcccactcctattattgctcggcaccgcagctctggcgccaggcgccgctgctgggaacgaggccgctcctgccggagcatctgtgtgttattccagtcctccctccgtggggagcgtccaggagcttgcccagcgcgccgccgttgtcattgagggcaaggtgcatccccaaaggaggcagcaaggtgctctcgaccggaaggctgcggccgctgccggtgaagcaggcgcctggggcggagacagggaaccgccagccgcagggcccagggcgcttggcccgcctgccgaggaacccctactcgccgcaaacgggaccgttccgagctggcctacggcccctgtcccgagcgccggcgagcctggggaggaagccccgtatctagtgaaggtccaccaggtctgggccgtgaaggccggcgggcttaaaaaggatagcttactaaccgtgcgtctggggacctggggtcaccctgcatttccatcctgtgggcggctgaaagaggatagccggtatatttttttcatggagcctgacgccaactctacaagtagagcacccgcggcctttcgagcctcattcccaccgctagaaaccggaagaaatctcaagaaagaggtctcacgggtgttgtgtaagcgatgtgcgctgcccccaaggctaaaggagatgaaatctcaggagagcgcggccggcagtaagctggtattgcgctgcgagacaagctcagagtatagttccttgcggtttaaatggttcaagaatggaaacgagctcaaccgcaagaataagccacaaaacattaaaatacaaaagaaacccggtaaatctgagctcaggattaataaggcctctttagcagacagtggtgaatacatgtgcaaagtgatttcgaaacttggaaatgactcagcctccgcaaatatcaccatagtggagtctaacgcaacatctacctcgaccaccgggacatctcacctcgtcaagtgcgcagagaaagagaagacgttttgcgtgaacggtggtgaatgtttcatggtcaaggatctcagtaatccatctaggtacctctgcaagtgccctaatgagtttacaggggatcgctgccaaaactacgtaatggcttccttctacagcacctccaccccgtttttgtccctccctgaa

SEQ ID NO: 17534 - DNA, 1266 bp, Artificial Sequence
  Description of Artificial Sequence: Synthetic coding sequence
atgcgctggagaagggcccccaggcggagcgggcgaccggggcctagagcacaacgccctggatcagcggcaagaagctcgcctcctctccctctccttcctttgctgcttcttctggggactgcagcactcgcccctggagcggcagcggggaacgaggcagccccggctggtgcatcggtgtgttactccagcccaccaagcgtggggagcgtgcaagaactcgcccaaagagccgccgtggtgatcgaaggcaaagtgcatcctcagagaaggcaacagggtgcactggataggaaggcagccgcagcagcaggtgaggcgggtgcctggggaggtgaccgcgagccaccagccgccggcccaagagcacttggcccccctgccgaagagccactcctcgcagcaaatggaactgtcccatcatggcctaccgcccctgtcccttcggcaggtgaacctggggaggaggctccctacttggtcaaggtgcatcaagtgtgggcagtcaaagcggggggactgaaaaaggattcccttcttactgtgcggttgggtacttggggccatcctgcctttccatcctgcggacgtctcaaggaagatagcagatacatcttcttcatggaacctgacgcgaatagcacctctcgcgcacctgcagcatttagagcatcgtttccacccctggagactggacgtaatctcaagaaggaggtcagcagagtcctctgcaaacggtgtgcacttccacctagactgaaggagatgaagagccaagaaagcgcagctggttcaaaacttgtcctgcgatgtgaaacctcctcagagtactcgtccctgagatttaagtggttcaaaaatggaaacgagctcaatcgaaagaacaaaccacaaaacatcaagatccagaaaaaaccagggaagagcgaactgaggataaacaaggcatcactcgccgattccggagaatacatgtgcaaggtcatttccaagttgggcaatgattccgcatctgccaacattaccattgtcgaaagcaacgcaacctctacttcaaccactggaacctcgcaccttgtgaaatgcgcagaaaaagagaaaactttctgtgtgaacggaggagaatgttttatggtgaaggacctgagcaacccctcgagatacctttgtaaatgccccaacgaatttactggggatcgatgccaaaactacgtgatggcatcgttttactcaacgtcgactccttttttgtcactccctgaa

SEQ ID NO: 17535 - DNA, 1266 bp, Artificial Sequence
  Description of Artificial Sequence: Synthetic coding sequence
atgcgctggagaagggcacctcggcgctcaggaagaccaggtccgcgagcccagcggccgggttcagccgcgagatctagcccaccgctgcctctgctgccgctgcttctcctgttgggcaccgccgcgctggcgccgggagccgcagccggaaacgaggccgcgccagcgggcgcatcagtgtgctactcatcgccgccgtccgtgggatccgtgcaggagctcgctcaaagagctgccgtggtgatcgagggaaaagtgcatccgcagcgccggcagcaaggtgccttggaccggaaagccgcggcggccgcgggagaggctggggcatggggaggtgatagagaacctccagcagcaggaccacgcgcgctcggaccgccagccgaagagccgctcctggctgcaaatgggactgtgccctcatggccgacggccccggtgccatccgcaggagaaccaggcgaagaggcgccatacctggtcaaggtgcaccaggtgtgggctgtgaaagcaggaggtctgaagaaggactctctgctcactgtgcgactcggaacctggggtcaccccgcattccctagctgcggacgcctgaaagaggactcgagatacattttcttcatggaaccggacgcgaactcgaccagccgcgcacctgcggcgttcagagcgagctttccgcctctcgagactgggagaaacctgaaaaaagaagtctcgcgcgtgctgtgcaagcggtgcgcgctgcccccgcgcctgaaagaaatgaaatcgcaggagtcggcggcggggagcaaactggtgctgaggtgcgaaacttcttccgaatactcgtcgctgcggttcaaatggttcaagaatgggaatgaactgaaccgcaaaaacaaaccgcaaaatatcaagatccagaaaaaacctggaaagtcggagctcagaatcaacaaagcctccctggcagatagcggagagtacatgtgcaaagtcatctccaagctcggaaatgactcggcgagcgctaacattaccatcgtcgaaagcaacgcgacctcgaccagcacgaccgggactagccacctggtgaagtgcgcggaaaaggaaaagactttctgcgtcaacggcggggaatgctttatggtcaaggacttgtccaacccgtcgcgctacctgtgtaagtgcccgaatgagttcaccggcgatcgctgtcagaactacgtgatggctagcttctacagcacctcgaccccattcctttcactgccggag

SEQ ID NO: 17536 - DNA, 1266 bp, Artificial Sequence
  Description of Artificial Sequence: Synthetic coding sequence
atgcgatggaggcgggcccctcggaggagtggccgcccgggtcccagagctcagcggcctggcagcgcggcgaggtctagtcctcccctgcccttgcttccattactgctcctgctgggaaccgcagcactggcgcccggcgcggccgctggaaatgaggctgcacccgccggcgctagcgtgtgctattcttcccctccctcggtcggatcagtacaggagctggcacagcgggctgcagtggtcatcgaagggaaagtgcatcctcagcggcgccaacagggagccttagaccgcaaggcggctgctgctgctggcgaggctggagcctggggaggtgaccgagagcctcccgccgctgggccgcgggccctcggacccccagcggaggagccactgctagccgccaacgggacagtgccctcttggcccacagctcccgtcccttctgcaggtgaacctggcgaagaggcaccatacctcgtgaaggtgcaccaagtctgggccgtcaaagctggcggtctcaagaaggatagtctgttaaccgttcgcctgggtacgtggggacacccagcctttcctagctgcggccggctgaaggaggattctaggtacatcttcttcatggagccggatgcaaacagcacctcaagagcaccagcagcatttagggcgagtttcccaccactggagaccggtaggaaccttaagaaggaggtgtctcgagtcttgtgtaaaaggtgtgcactacctccgaggctcaaggagatgaagtcccaggaatctgccgccggtagcaagttggtactgaggtgtgagacttcatcagagtatagttcactcaggttcaaatggtttaaaaacggaaacgaactgaaccggaagaataagccgcagaacattaaaattcagaaaaagcctggtaaatccgaattgcggatcaacaaagctagtctcgccgatagtggggaatacatgtgtaaggttatttcaaagttaggcaacgacagtgcttcggccaacattactatcgtggagtcaaacgccacatctaccagcactaccggaaccagccacctcgtcaaatgtgctgaaaaggaaaagaccttttgcgtcaatggcggtgagtgttttatggtgaaggacctcagcaatccatcacggtacttatgcaaatgtcccaatgagtttaccggagatagatgccaaaactacgtgatggcttctttctactcgacctcaactccctttctctccttacccgag

SEQ ID NO: 17537 - DNA, 1266 bp, Artificial Sequence
  Description of Artificial Sequence: Synthetic coding sequence
atgcggtggcgcagggcgccgcgacggtccgggaggcctgggccgagggctcaacgcccgggcagtgccgcgagaagctccccaccacttccgctgcttccacttctcttgctgcttggaactgccgcactggctccaggagccgcggcaggtaacgaagcggccccggcgggagctagcgtgtgttacagctcaccaccgtccgtgggctccgtccaggagctggcgcagcgggcggccgtggtgatcgagggcaaggtccatccacagagacggcaacaaggagcgctcgacaggaaagctgcggcagcggcgggagaggccggagcttggggaggagatcgggaacccccagcggctggccccagagcactggggccccctgccgaagaaccgctgctggccgcaaatgggactgtcccaagttggccaaccgccccggtgccttccgccggagagcccggtgaggaagccccgtacttggtaaaggtgcatcaggtatgggcagtgaaggcaggcggcctcaagaaggattccctcctgaccgtgcgcctggggacctggggacacccagccttcccgtcgtgcggacggcttaaggaagatagcagatacatcttcttcatggagcctgacgctaacagcactagcagggccccggccgctttccgtgcgtcgtttcctcctctcgaaaccggccggaatctgaaaaaggaggtgagccgtgttctgtgcaagcgctgcgccctgccgccgcggcttaaggagatgaaatcgcaagagtcggcggctggaagcaaattggttctcagatgtgagacttcctccgaatactcgtcactgaggttcaagtggttcaaaaatggtaacgaactgaatcgaaagaacaaaccacaaaacatcaaaatccagaagaaaccgggaaagtcagagctccgcatcaacaaggcgtcgctggccgattcaggcgagtatatgtgcaaggtgatttccaaacttggaaacgacagcgcctcagcgaacattacgatcgtcgaatccaatgccaccagcactagcaccaccggaacttcgcacctggtcaagtgcgctgaaaaagaaaagaccttctgcgtgaatggtggggaatgtttcatggtgaaagacctgtccaacccgtcgcgctacctgtgtaagtgccctaacgaatttactggcgaccggtgccagaactacgtgatggcatcgttttactctacctccacgccgtttttgtcactccccgaa

SEQ ID NO: 17538 - DNA, 1266 bp, Artificial Sequence
  Description of Artificial Sequence: Synthetic coding sequence
atgcgctggagaagggccccaagacggtccggtcggccggggccacgggcgcagcggccaggatcagcagcccgcagctcgccgccgctcccacttctcccgctgctcttgctcctgggaaccgcggctctggccccgggagcggcagccggcaacgaagctgccccggcaggtgctagcgtgtgctactcgtctccgccaagcgttggctcagtgcaggagctcgcgcagcgcgccgccgtggtcatagaaggaaaggtccacccgcagcgacggcagcaaggagcccttgacaggaaggccgcggctgccgctggggaggccggcgcatggggcggagacagagagccgccagccgcggggcccagggcccttgggccgccagcggaggaaccactgctcgcggcgaacggtaccgtcccgtcatggccaactgcgccggtcccatcggccggcgaacccggagaagaagcaccttacttggtcaaagtgcaccaagtctgggcagtcaaggcggggggactgaaaaaggactctctgctgaccgtgcgactcggtacttggggtcaccctgcctttccgtcctgcggccgcctcaaggaggacagccgctacatcttcttcatggagcccgatgccaatagcaccagcagagcgcctgctgccttccgcgcctcctttccaccgcttgagactggacggaatctcaaaaaggaagtgtcgcgggtcctgtgcaaaagatgtgccctcccgccgcgcctgaaagagatgaagtcccaagagagcgcagccggatccaagctcgtgctcaggtgtgaaactagctccgaatatagctcgctgcgtttcaagtggttcaaaaacggaaatgagctgaatcgaaagaacaagcctcagaatatcaaaattcaaaagaaaccaggcaagtcagaactccggatcaataaggcgtcactggcggactcaggagagtatatgtgcaaggtcatttcgaaattgggtaatgacagcgcgtccgccaatatcaccatcgtggaatccaacgcaactagcacttccactaccggtactagccatctggtcaaatgtgctgaaaaagagaaaactttttgcgtgaacggtggagagtgcttcatggtgaaagatctgtcgaacccatcgcgctacttgtgcaagtgcccaaatgagttcaccggggaccgctgtcagaattacgtgatggcaagtttttactcgacgtccacgccattcttgtcactgccggag

SEQ ID NO: 17539 - DNA, 1266 bp, Artificial Sequence
  Description of Artificial Sequence: Synthetic coding sequence
atgcgatggagacgcgcacctcgccggagcggacgtcctgggccacgggcgcaaagacccgggtccgcggcaagaagctcccctccacttccactccttcctctcctgctgctgctcggaacggccgcgcttgctcctggagcagcggctggtaacgaagcagctcctgcgggggcaagcgtctgctacagctcgcccccgtctgtgggcagcgtgcaggaactggcccaaagggcagcggtcgtgatcgaagggaaggtgcatccccagcgacggcaacaaggggccctcgatcggaaggccgccgcggcagccggagaggccggggcatggggcggagatagggagcccccagcagcaggtcctagagccctgggaccaccggcagaggaaccattgctggcagcaaacggtaccgtcccttcctggcctaccgctcctgtgccttcagctggggaacctggggaagaggccccatatctggtgaaggtccatcaggtgtgggcagtcaaggcaggtggactcaaaaaggattcgctcctgacggtccgactcggtacttggggacatccagcgttcccaagctgcggcagacttaaggaagatagcagatacattttctttatggaacccgacgcaaacagcaccagcagggccccagcagccttccgtgcatcctttcccccgctggaaaccggccggaaccttaagaaagaggtgagtagagtgctgtgtaagaggtgtgcacttccaccacggctgaaagagatgaaatcgcaagaatccgcagcaggttcgaagctggtccttagatgtgaaacttcctcagagtactcctcactgcgctttaagtggttcaagaacggtaatgagctgaaccgcaagaacaagccccagaacataaagatccaaaagaagcctggaaaatccgaactgcggattaacaaagcctcgctggcagattcgggagaatacatgtgtaaggtcattagcaagctgggtaacgacagcgcctccgcgaacataaccattgtggaatcaaatgccacctcgacttccaccactggcactagccatctcgtgaaatgtgccgaaaaggaaaagaccttttgtgtgaatgggggagaatgctttatggtgaaggatcttagcaatccttcacggtatctttgtaaatgccctaacgagtttaccggtgaccggtgtcaaaactacgtgatggcgagcttctactcgacttctactccatttctgtcgcttccagag

SEQ ID NO: 17540 - DNA, 1266 bp, Artificial Sequence
  Description of Artificial Sequence: Synthetic coding sequence
atgagatggcggcgagccccccgccgatcaggaaggcctgggccccgcgcccagcggccagggagcgccgcacggagctccccccctctgcctctcctgcccttattactcctgttggggactgccgcactcgccccaggcgccgcagctggaaatgaggccgcccctgcaggagcttctgtgtgctactcttcccccccttcggtggggtccgtacaggaactagcccagagagccgccgtcgtcatcgaggggaaggtgcaccctcagcggcgccagcaaggagccctcgatcggaaagcagctgctgccgccggagaagcaggcgcttgggggggggacagagagcctcctgcagccggcccgcgggccctcggcccacccgctgaagaaccgctcctggctgcaaacggaaccgtgccatcgtggccaaccgctccagtgccgtctgctggagagcccggcgaggaggccccttatctcgtaaaggtgcatcaggtgtgggctgttaaggctggaggcctcaaaaaagactcgctgctcacggttaggctggggacgtggggccacccggccttccccagctgtggccgattgaaagaagatagtcgatatatcttttttatggagccagacgccaacagtacctccagggcgccggcagcctttcgggccagctttcctccacttgaaacgggacggaaccttaaaaaagaggtcagcagagtgctgtgcaaaagatgtgcgctgcctccacgacttaaggagatgaaaagccaggagtcagccgctggatccaaacttgtactgaggtgtgagacgtcttccgagtattctagccttaggtttaagtggtttaaaaacggcaacgagctaaacaggaaaaataaaccccagaacattaagattcagaagaagcctggcaaatccgaactccgtatcaataaggcgtccctcgctgattccggggaatatatgtgcaaggtgatctcaaagctggggaatgacagcgccagcgccaacatcaccattgtggagtcaaatgccacatccacttcgacgaccggaactagtcacttggttaagtgtgcagaaaaagagaagactttttgtgtgaatggcggagagtgctttatggtgaaagatctgtccaatccttcccggtacctctgtaagtgtcctaacgaatttacgggagatcgttgccagaattatgtcatggccagcttttacagcacgagtacccccttcttaagcttacccgag

SEQ ID NO: 17541 - DNA, 1266 bp, Artificial Sequence
  Description of Artificial Sequence: Synthetic coding sequence
atgcgctggagaagggcccctagacgatctggccggccgggtccacgagcacagcgcccaggttccgcggccagaagtagccctcctcttccattactgcctctgctgctgttactgggcaccgccgccctggctccaggcgcagcagcaggtaacgaagccgcacccgccggagctagtgtgtgttattcttcccccccttctgtcggatctgtgcaggagctcgcccagcgggcagctgttgttatagagggaaaggttcacccccagcggcggcaacagggggctctggataggaaggccgcagcagctgctggagaggcaggcgcctggggaggcgaccgggaacccccagctgccggcccgagggcactgggccccccagccgaagagccactgcttgcagcaaatgggaccgtgccctcttggcctactgctccagtaccctcagccggcgaacccggagaggaggcaccctatctggtgaaggtccaccaggtctgggccgtgaaggccggcggcttgaaaaaggacagcttgctgaccgtccggttgggaacttggggccacccagcatttccttcatgcgggagacttaaagaagacagcagatatatcttttttatggaacccgatgcgaacagcacttccagagcccctgcggccttcagagcttcatttcccccgctggagacaggaagaaaccttaaaaaggaagtaagccgggtcttgtgtaaacgctgcgctttgcctccaaggctcaaggagatgaagtcacaggaatcagcggcaggatccaaactggttctgcgatgtgaaacatctagtgaatattcttctctgagattcaagtggttcaaaaatggaaatgaactgaaccgtaaaaacaagcctcaaaacatcaaaattcagaagaagcctgggaagtccgagctgcgaataaacaaagcttcccttgccgacagcggcgaatacatgtgtaaagtgatcagcaagttaggcaacgatagcgcctcagcaaatattacaattgtggagtcaaacgccacctccacctctacgaccggtacctctcatctcgtaaagtgtgccgaaaaggaaaaaacgttctgcgtaaacggcggagaatgttttatggtgaaggacctttctaaccccagccgttacttgtgtaaatgtccaaacgaattcaccggtgataggtgtcagaattatgtcatggctagtttctacagcacatctacccccttcctcagtctcccagaa

SEQ ID NO: 17542 - DNA, 1266 bp, Artificial Sequence; identical to SEQ ID NO: 17496
  Description of Artificial Sequence: Synthetic coding sequence

SEQ ID NO: 17543 - DNA, 1266 bp, Artificial Sequence
  Description of Artificial Sequence: Synthetic coding sequence
atgaggtggaggcgagcaccaaggagaagtggtagacccgggcctcgagctcagcgccctggctctgccgcacgctctagccctcccctgcccctcctgcctctgctcctcctactgggaacggcagcattggccccaggagcagcagccggcaatgaagctgcacctgcaggggcctccgtgtgctattctagtcccccaagtgtgggtagcgtgcaagaactggcccagcgagcggcggtggtgattgagggcaaagtgcacccacagagaaggcagcagggggcactggatcgaaaagccgccgccgccgctggcgaggcaggcgcctggggcggtgaccgagagcctcctgcagcgggacctcgggctctgggcccgccagcggaggagcctctgttagccgctaacggcacagtgccttcgtggcctactgcccctgtacctagcgccggggagccaggtgaggaggctccctaccttgtcaaagttcatcaagtgtgggccgtgaaggccggtggactcaagaaagattcgctcctcacagtgaggcttggaacatggggccaccccgcttttccttcctgtggccgactgaaggaggactctaggtatattttctttatggagcccgatgccaatagcacatcaagagctcctgcagctttcagagccagcttccctccacttgaaacgggccgaaatttgaagaaagaagtgtccagagtgctctgcaaaagatgcgcgctcccacctaggctaaaagaaatgaagtctcaagaatctgccgctgggagtaagcttgtgctcaggtgcgaaacctccagcgagtattcctctctgagatttaaatggtttaaaaatggaaacgagctcaacaggaagaataagccccagaatataaaaattcagaaaaagcctgggaagagcgagctccgaatcaacaaagctagcctggctgattccggggaatacatgtgtaaagttatctcgaagcttggcaacgattctgcttcagccaacattacaattgtcgaatccaatgcaactagtacctccaccaccggcaccagccacctggtgaagtgcgctgagaaagaaaagaccttctgcgtcaacggcggcgaatgctttatggtgaaagacctaagcaacccatctcgttacctctgtaagtgccccaatgaattcaccggcgaccgttgtcaaaattatgtcatggcttccttttacagcacctcaactccctttctgtccctcccagaa

SEQ ID NO: 17544 - DNA, 1266 bp, Artificial Sequence
  Description of Artificial Sequence: Synthetic coding sequence
atgaggtggcgtcgcgccccacggcgttccgggcggcctggccccagggcccagcggccgggatcggccgcgaggtcctcacccccattgccgctgcttccccttttgttgctccttgggacggcagctttggccccaggggcagccgcagggaacgaagcggcccccgcaggagcttcagtgtgctactccagtccccccagcgttgggtccgtgcaggagctggcacagcgggccgctgtagtcatcgaaggtaaggtccatccccagaggagacagcagggagcactcgatcgaaaagcagcagctgcagccggggaagcaggagcatggggtggggacagagaacctcccgccgccggaccccgggcacttggcccccccgccgaagagcccctgctggctgctaacggaaccgtaccctcttggcccacggctccagtgcccagcgctggggaacccggagaggaggccccatacctcgtcaaagtccaccaagtatgggccgtcaaggctgggggactaaaaaaagattcactgcttacagtgcggctgggtacatgggggcaccccgctttccctagctgtggccgcctgaaggaagattcccgatatatttttttcatggagccagatgccaattctacgagccgtgccccagctgcatttcgagcaagctttcctcctctggaaacaggtcggaatctgaagaaagaggtttcaagggttttatgtaagagatgtgccttgccccctaggctgaaagagatgaaaagtcaggagagcgccgcaggatctaagctggtcctcagatgcgagacttcgtccgaatacagcagcctcaggtttaaatggttcaaaaatggaaacgaactgaaccgcaagaataagccccagaacataaaaattcaaaagaagccaggcaagtccgaactgcggattaataaagctagtctggccgatagcggagaatatatgtgcaaagtgatttctaagctcggaaacgactcggcttctgccaacatcacgatagtcgaatcaaacgccacttccacgtctaccaccggaacctcacatttggtgaagtgcgctgagaaagagaagacgttctgcgttaacggcggagaatgttttatggtaaaagatttgagtaacccttcccggtacctctgcaagtgtcctaatgagtttacaggggataggtgccagaactatgtcatggccagcttttactccacctccactccctttctttctttgcctgag

SEQ ID NO: 17545 - DNA, 1266 bp, Artificial Sequence
  Description of Artificial Sequence: Synthetic coding sequence
atgcgctggaggcgggctccacgccggtctggacgccccggaccgagagcacagcgaccaggctccgcagcaaggtcatcgccaccacttcccctccttcccctcctcctgctgcttggtaccgccgcgcttgcacctggggccgcagccggtaatgaagcggcgcctgccggagcctcggtttgttactcatcacctcctagcgtcggtagcgtccaagagctcgctcaacgcgcggcggtcgtcatcgaaggaaaggtccatccgcagagacgccaacaaggggcactggatcggaaagccgcagccgcagctggcgaggcaggagcctggggaggtgatagagaacctccagcggcaggcccgcgtgctctgggccctcctgctgaggagcctcttcttgccgccaatggcactgtcccatcgtggccaaccgcaccggtgccgtccgccggagagcctggggaagaagccccttacctggtgaaggtgcaccaagtgtgggcagtgaaggcaggcgggctgaaaaaggattccctcctcactgtgagactggggacttggggacacccggctttcccttcctgcggcagactcaaagaggactcccgatacatattcttcatggaaccagacgcgaactcaacctcgagagcacctgccgcatttcgggcgagcttcccacctctggaaaccgggagaaaccttaagaaggaggtgtccagagtgctgtgtaagcggtgcgcacttccgccccgacttaaggaaatgaagtcccaagaatcggcagcaggttccaaacttgtgctgaggtgcgaaacctcgtccgagtattcctcactcaggttcaagtggttcaagaatgggaatgaactcaacagaaaaaacaaacctcaaaacatcaagattcaaaagaaaccaggcaaatcagagctccgcatcaacaaagcgtctctggcagattcgggagagtacatgtgtaaggtgatttccaagctgggaaacgattcggcgtcagcaaatatcaccatagtcgaaagcaatgccacgtcgactagcactaccggaactagccacctggtgaagtgtgccgaaaaggaaaagacgttctgtgtgaacggaggagagtgctttatggtcaaagatctgagcaacccaagcagatacctctgcaagtgtcctaacgagtttactggggaccggtgtcagaattatgtcatggcatcgttttactccaccagcacgccttttctttcactgccagag

SEQ ID NO: 17546 - DNA, 1266 bp, Artificial Sequence
  Description of Artificial Sequence: Synthetic coding sequence
atgaggtggagacgggctccaagacgatctggacgccccggaccgcgtgcacaaaggcctggctcggcggcgagaagcagccctccgctcccgctcctcccacttcttctgcttcttggaactgcagccctggcccctggtgccgcagccggtaatgaagcagcacccgccggcgcatccgtgtgttactcctcacctcccagcgtcggttctgtccaagaactggcacagagagcagccgtggtcatcgagggtaaggtgcacccacaacgtaggcaacagggcgcgctggatcggaaggcagccgcagcagctggagaagcaggagcatggggaggtgatcgagaacctccggcagctggtcctcgtgccctcggtccgccagcagaagaacctcttctggcagctaatggtactgttccgtcatggccaactgccccggtgccgtcggcaggcgagcccggcgaagaggctccttacctcgtgaaggtgcatcaagtgtgggcagtgaaggccggaggtcttaagaaggacagcctgctgacggtgaggttgggaacctgggggcatcctgctttcccatcctgtgggagactgaaggaagattcgcgttacatattcttcatggaaccagacgccaattcgacttcgagagccccagcagcattccgcgcttcatttcctcccctcgaaaccgggagaaaccttaagaaagaggtgtcccgggtgctctgcaagagatgtgcacttccaccccgacttaaagagatgaagagccaggaaagcgcagcgggaagcaaattggtcctgcgatgcgaaacctcttctgaatactcctcccttagatttaagtggttcaagaacggcaatgagctgaaccggaagaacaaaccacaaaacatcaagattcagaaaaaaccagggaaatccgaactccgcatcaacaaggccagcctggccgattccggggaatacatgtgcaaggtgattagcaagctcggaaacgatagcgcatcggcgaacattactattgtcgaatccaacgcaacttcaacctcaactacgggcacttcccatctggttaagtgtgcagaaaaggaaaaaactttttgcgtcaacggcggcgagtgctttatggtcaaggatctgtcgaacccctcgcgttatctctgcaaatgtccgaatgagtttacgggggatcgatgtcagaattacgtcatggcttccttctattcaacctctacgccttttcttagcctgcctgag

SEQ ID NO: 17547 - DNA, 1266 bp, Artificial Sequence
  Description of Artificial Sequence: Synthetic coding sequence
atgcgttggcgccgcgcgcccagacggagtggccgccctggtccacgggctcagcgcccaggaagcgccgccaggtccagtccacccttgcccttactgcctctacttttgttgctcgggaccgcggccttggctcccggggctgccgctgggaacgaagccgcgcctgccggcgcgtccgtgtgctacagttctcctcctagcgttggctcagtgcaagaactcgcgcaacgcgccgcggtcgtcatcgagggtaaagtccaccctcagcggcgacagcagggcgcactagatcgcaaggccgcagccgccgccggcgaagctggagcctgggggggcgatagagagccaccagcagccgggccacgtgccttaggaccaccagctgaggagcccctactcgcggctaacgggacagttccctcgtggcccacagctccagtgccaagtgccggagagcccggagaggaggccccttatctggtgaaggtccaccaggtttgggcagtgaaagctggtggcctgaaaaaggactcgctactgacggtcaggctgggcacatggggccaccccgcctttccgtcctgtggtcgtctaaaggaagacagccgatacattttctttatggaacccgacgcaaacagcacctccagagcaccggcggcgtttcgtgcctctttccccccactagagaccggcagaaacttgaagaaagaggtcagtcgcgtactgtgcaagcgttgtgcgctaccccccaggctgaaggaaatgaagtcccaggagtcagcggccggctctaagcttgttttgaggtgtgagacaagctcagagtatagctctcttaggtttaaatggtttaagaatgggaatgaactgaaccggaagaataagccgcagaacatcaagatacagaagaagccgggtaagagcgagctgcgaattaacaaggcatccctggcagattctggtgaatatatgtgcaaggtcatcagcaaactgggtaatgactctgcctcagctaatataactatcgtggagtccaacgctacctccactagcaccactggcacttcacaccttgtgaagtgtgcagagaaggaaaaaactttttgtgtgaacggaggtgaatgcttcatggtgaaggacctgtcaaatccttccagatatctgtgcaagtgccccaacgagttcacgggagaccggtgccagaactatgtgatggcttctttttattccacaagtacgccctttctgagtcttcctgag

SEQ ID NO: 17548 - DNA, 1266 bp, Artificial Sequence
  Description of Artificial Sequence: Synthetic coding sequence
atgagatggaggcgggcaccaagacgatccggcagacccggcccccgagctcagaggcctggaagtgccgcacggtccagtcctcctctgcccctgctgcctcttttgctcctgctgggaacggctgctctggccccaggtgctgcggcaggaaacgaagcagcacccgcaggggcatccgtgtgctactccagtcccccctccgtggggtctgtgcaggaattggctcaacgagcagcagtggtgattgagggtaaagttcacccccagcgcaggcagcagggagcactcgatagaaaggcagcggccgcggccggcgaggctggagcctggggcggcgatagagagccacccgctgcaggtcctcgtgcattaggaccccccgcagaagagcccctgttggctgctaacggaaccgtaccctcttggccgaccgcccctgttcccagcgctggtgagcctggtgaagaggcgccgtaccttgtgaaagtccatcaagtttgggcagttaaggctgggggcctgaagaaagacagtctgctcactgtgaggttgggaacctggggccacccagcattccccagttgtggacgacttaaagaggacagtaggtacatcttttttatggaacctgacgctaacagcacgagtcgggctcccgctgcctttagagcctcttttcctccactagaaacgggtaggaatcttaagaaggaagtctcgcgggtcctgtgtaagcggtgcgcgctgccaccacgccttaaagagatgaagagtcaagaaagcgcagcgggttctaaactcgttttgcgctgcgagacaagtagtgagtattcttcccttcgctttaaatggttcaagaacggcaatgaactaaaccggaagaacaagccgcaaaatattaagatacagaagaagccagggaagtcagagctgcgcattaacaaagcatctctggccgactctggcgagtatatgtgtaaggtcatctctaagctgggcaatgattcagcgagcgcgaatatcacgattgttgagtctaacgctacgtcgacctcaaccacaggcacgagccatcttgtgaagtgtgctgagaaggaaaagactttctgcgttaatggcggagaatgcttcatggtgaaggacctaagtaatccaagtaggtatctgtgtaagtgcccgaacgagttcacaggagatagatgtcaaaactacgttatggcgtctttctacagcacatctacacctttcctgagcctccctgaa

SEQ ID NO: 17549 - DNA, 1266 bp, Artificial Sequence
  Description of Artificial Sequence: Synthetic coding sequence
atgcgttggagaagagcaccccgacgctcaggtaggcctggtccacgtgctcaaagaccgggcagtgctgcgaggtcaagccctcctttgcccttgttacccttgttgttgttgctcggaactgctgcgcttgccccaggtgccgctgccggtaacgaggctgcgcccgctggtgcatcggtttgttattccagtccacccagcgtgggaagcgtgcaggaattggcacagcgagctgccgttgtaattgagggtaaggttcaccctcagagacgtcaacagggcgccctggatcgaaaagctgcagcagctgctggagaagctggtgcgtggggtggggatagagagcctccagctgctggtcctcgggcgctgggaccacctgccgaagagccgttattggctgccaacggcaccgtaccatcatggcccaccgctcccgtgccctcagctggagagcctggagaagaagctccatatttggtgaaggttcatcaagtgtgggctgtgaaggctggcggactcaagaaagattctcttcttacagtgcgactaggtacctggggccatcctgcctttcctagctgcggtcgtctgaaggaggatagccgatatattttttttatggagcctgatgctaactcaacttccagggcgcctgccgcttttagagcctcatttccccctttggagactggaagaaacctgaaaaaagaggttagcagagttctgtgcaagaggtgtgctcttccccctaggctcaaagagatgaagtcccaagagagcgcggcgggatcaaaacttgtcctcaggtgtgagacttcgtcggaatattcgtcattgcggttcaaatggttcaaaaatggcaacgagttgaaccgtaaaaataaacctcaaaatataaagattcaaaaaaagcctggtaagtctgagttaagaataaataaggcctctctcgctgacagtggtgagtacatgtgcaaggtcatatccaaattgggaaatgattccgcttctgcgaatattacaatcgtggagagtaatgcaacctccactagcacaacaggtacctcacatctcgtgaaatgtgccgagaaggaaaaaactttttgtgttaacggcggtgagtgctttatggtcaaagatcttagcaatccttctcgatacttatgtaagtgcccgaatgagttcaccggtgataggtgccagaattacgttatggccagtttttattctacttctacaccttttctttctcttcctgaa

SEQ ID NO: 17550 - DNA, 1266 bp, Artificial Sequence
  Description of Artificial Sequence: Synthetic coding sequence
atgaggtggaggcgggctcctcgcagatcaggccgcccgggtccgagggctcagcgcccgggatccgccgcccgctcctccccaccgctcccgctgctgccgctgcttctcctgctcggcaccgctgctctggcgccaggcgcggcggcgggaaatgaggccgcccctgctggggccagcgtgtgctactcgagcccaccgagcgtgggatccgtgcaggagctcgcacagcgggccgcagtggtcatcgaaggaaaggtccatccgcagcgccggcaacagggagcgcttgacagaaaggctgccgcagccgctggcgaggccggggcatggggaggagacagagaaccacctgccgccgggcctcgcgcgcttggaccgccggctgaagaacccctgctcgcggcgaatggaacggtgccatcctggccgactgccccggtgccttcggctggggagcccggagaagaggcaccttatctcgtcaaggtgcaccaagtctgggcggtcaaagctggaggtctgaagaaagactcgcttctcactgttcgcctcggaacttgggggcacccggcatttccgtcctgtggccgtctgaaggaggacagccgatacatcttcttcatggaaccagacgccaactcgactagccgtgcacctgccgcttttcgcgcatcgtttccaccactggaaaccggacgcaacttgaagaaggaggtgtcacgggtgctgtgtaaacgctgtgcgcttcccccgaggttgaaggagatgaagtcacaggagtccgccgccggttcgaagctcgtgcttagatgcgaaacctccagcgaatactcttcgttgagatttaagtggttcaagaacggcaacgaactcaatcgcaaaaacaagcctcagaacattaagatccagaaaaaaccgggaaagtccgaattgcggattaacaaggcctcgttggctgattccggagagtacatgtgcaaagtgatttctaaactgggtaatgacagcgcctcagcgaacatcacgatcgtggaatccaacgcaacttcaacgtcgaccaccggtacctcacacctcgtcaagtgcgctgaaaaggagaaaaccttctgtgtgaacggaggagaatgcttcatggtgaaggacctttcgaatccttcacggtacctctgcaagtgtccgaatgagttcaccggagatcggtgccagaactacgtcatggcgtcgttctacagcacttcgaccccattcctttcgttgccagag

SEQ ID NO: 17551 - DNA, 1266 bp, Artificial Sequence
  Description of Artificial Sequence: Synthetic coding sequence
atgagatggagacgggccccacggcggtcaggccgtcccggccctagagcccagaggccgggaagcgctgcacgttcctccccacctctgccgcttctccctctactgcttctgctcggtactgcagccctggcccccggggcagctgccggcaacgaggcagctcctgccggcgcgtctgtgtgttactcttcccccccatcagtcggatccgtacaggagcttgctcagagggccgccgtcgtgattgagggtaaagtgcacccccaacggaggcagcagggagcccttgacagaaaggcagccgccgccgcaggcgaagccggggcatggggaggggatagggagccgcctgccgccgggcctcgggctctggggcctcctgccgaagaaccactcttggctgccaacggaacagtcccgtcatggcccaccgctcctgtgccttcagcgggcgaacccggggaggaagccccatacctggtcaaggtccatcaggtttgggcggtaaaagcaggcgggctaaaaaaagacagtctgctgaccgtacgcctgggaacttgggggcaccctgccttcccatcctgtgggcgactgaaggaagacagtaggtacattttctttatggagcctgacgccaacagcactagtcgtgctcccgccgcctttagagcgagctttccccctttagagactggtcggaacctcaagaaggaggtaagtcgggtgttgtgtaaacgatgcgccctaccccctcgcctgaaggaaatgaagagtcaagagtcagcagcaggaagcaagctggttctgaggtgtgagacaagttccgaatattcttcactacggttcaagtggttcaaaaacggtaacgagctgaacaggaagaacaagccccagaacattaagatacagaagaaacccgggaagtctgagctccgtatcaataaagcctcactagctgactctggcgagtatatgtgcaaggtgatttcaaaactcggcaatgacagtgcgtctgctaacatcacaattgtcgaaagtaacgccaccagtacaagtactaccggcacgagccacctggtgaagtgcgccgaaaaggaaaagactttttgcgtgaacggcggggaatgtttcatggtcaaggatctttcgaaccctagcagatacctctgcaagtgcccgaacgagtttacaggcgacaggtgccagaattacgtaatggcctccttctacagtaccagtactccttttttaagcctgcctgag

SEQ ID NO: 17552 - DNA, 1266 bp, Artificial Sequence
  Description of Artificial Sequence: Synthetic coding sequence
atgcggtggcggcgcgctcctaggcgatctggaaggcctgggccgcgggcccagaggcctggatcagcagccagatcttctccaccattgccactgctcccacttctgctgctcttggggacggcagcactagcacccggggcagcagccgggaatgaagccgccccagcaggagcttccgtatgctacagttcacccccatccgtcggatccgtgcaggaactggcccagagagctgctgtggtaatcgaagggaaagtacatcctcaacggcggcaacagggagctctagatcgaaaggccgctgcagcagcaggagaagctggggcctggggaggggacagggaacccccagctgctgggccccgcgcattagggccacctgctgaagaaccattactcgccgctaacggaactgtgccctcctggcctactgctccagtcccttctgctggggaaccaggggaggaagcaccctatttagtcaaagtacatcaggtatgggctgtcaaggctggagggctcaaaaaagattcccttttaacagtgcgcctgggaacatggggacatcccgcatttccctcctgcgggaggttaaaagaagatagtagatacatcttcttcatggaacccgatgcgaactctacttctcgggctcccgctgcttttagagcatcgtttccccctcttgaaactggaaggaaccttaaaaaagaagtcagtcgggtgctctgcaaacggtgtgccctacccccacgacttaaagaaatgaaatcccaggaatcagctgctggaagtaaacttgttctcaggtgcgaaacatcctctgaatactcatctcttagattcaaatggttcaaaaacgggaatgaactgaacagaaaaaacaagccacagaatataaaaattcagaaaaaacccgggaaatctgagctccggataaataaagcctcactagcagatagtggagaatatatgtgtaaggttatttctaaactagggaacgattctgctagtgctaatattactatagttgaatccaatgcgacatctacatcaacaacaggaacttcccacctcgtgaagtgtgccgaaaaagaaaaaacattctgtgtcaatggaggggaatgtttcatggtgaaagatctctctaaccccagtcgctatttatgtaaatgtcctaacgaatttactggggacaggtgccagaattacgttatggcctcattttattccacatctactcccttcttgagtcttcctgag

SEQ ID NO: 17553 - DNA, 1266 bp, Artificial Sequence
  Description of Artificial Sequence: Synthetic coding sequence
atgcgatggcgccgggcaccacggcgctcaggaaggccaggcccacgggcccaacgcccaggctccgcggcccgaagctccccccctttgcctctccttcccctcctgctgttattagggaccgcagcactggcaccaggcgcagcagctggcaacgaggccgcaccagccggggctagtgtgtgctacagcagcccaccaagcgtcggctctgtacaggaactagcacaacgtgccgccgtcgtgattgagggaaaggttcatccgcaacggagacaacaaggcgcgctggataggaaggccgcagccgctgcaggagaggctggcgcctgggggggtgatcgcgagccacccgcagccggtcccagggcattggggccccctgccgaggagccattactggccgcgaacggcacagtcccatcctggccgacagccccagtaccttcagctggagagcccggtgaagaggccccctatctggtcaaggttcatcaagtctgggcagtgaaagctggagggctaaagaaggactcgctcctgaccgtgcgcctgggcacttggggccaccctgcttttccatcttgcggcaggctgaaagaggacagcaggtatatcttttttatggagcccgacgctaatagtacctctcgcgccccggccgcctttcgcgcctcatttcctcctttggagaccggaagaaacctgaagaaagaagtttcaagggtgctgtgtaaaaggtgtgccttgcctcctagactgaaggagatgaaatcgcaggagagtgctgccggctcaaaattggtgttgcgatgtgagactagctccgagtattcgagcctgaggttcaaatggtttaaaaacggaaacgaacttaataggaagaacaagccccaaaatattaaaattcagaaaaaacctgggaaatctgagctaaggattaacaaggccagtttagcagatagcggtgaatatatgtgtaaggttatcagtaaattgggaaacgactctgccagtgccaatatcacgatagtagagtcaaacgcaacttccacgtcaacaacgggaacatcccaccttgtgaagtgcgccgaaaaggagaagaccttctgcgtgaatggcggcgagtgtttcatggttaaggatctgagcaatccttctagatacttatgtaagtgcccaaatgagtttaccggggacagatgccagaactatgtgatggcatccttttattcgacatcaactcctttcttaagtctgcctgag

SEQ ID NO: 17554 - DNA, 1266 bp, Artificial Sequence
  Description of Artificial Sequence: Synthetic coding sequence
atgcggtggcggcgtgctcccaggcgctccgggcgtccaggtcccagggcccaacgacctgggtctgctgcgcgctcatctccgcctttaccattgctgcccctgctactcctactcggtaccgcagcccttgcgccgggcgccgcagcagggaatgaggcggcaccagctggcgcaagcgtgtgctactcgtcaccgccatccgtggggagtgtgcaggaattggctcagcgggccgctgttgtcatcgagggaaaagtgcacccacagcgccggcagcagggggcactcgatagaaaggccgccgcagccgcaggggaggcgggcgcatggggcggcgatagagagccccctgcagcaggtcctagggctctggggcctcctgccgaagaacctttattggctgctaatgggaccgttccgtcgtggcccaccgcaccagtgccatctgcaggagaaccaggagaagaggctccttacctggtgaaagtgcaccaagtgtgggcagtgaaggcgggcggcctaaagaaggactcactgctgacagtccgcctcggcacgtggggacatccagccttccccagttgcggtagattgaaagaagacagtcgctacatcttctttatggaacccgacgctaactctacaagtcgggcacccgccgcattccgggctagcttcccgcctcttgagactggccggaatctaaagaaggaagtgtcccgagttctttgtaagcgatgtgccctgccgcctaggctgaaggagatgaagtcccaggaatcagccgcagggtcgaaattggttcttcgctgcgaaacatcctccgagtattcaagtctgcgctttaagtggtttaaaaacggcaatgaactgaatagaaagaataagcctcagaacattaaaatacaaaagaagcccgggaagagcgagctgaggatcaacaaagcgtcactggccgattctggagagtatatgtgcaaagtgatttccaagctgggaaatgactccgccagcgctaatatcaccatagttgagtccaatgccaccagcaccagtactaccggtactagccatctcgtaaaatgcgccgaaaaggaaaaaactttttgtgttaatggcggcgaatgtttcatggtgaaagatctaagtaacccctcacgatacctgtgtaaatgcccgaatgaatttactggggacagatgccagaattacgtaatggctagcttctattccactagcactccgtttctgtctctgccagaa

SEQ ID NO: 17555 - DNA, 1266 bp, Artificial Sequence
  Description of Artificial Sequence: Synthetic coding sequence
atgcgatggcgacgagccccgcgaaggtctggcaggccaggtccccgcgcccaaaggccaggttcggcagcacgatcgtcaccacccctgcctctgttgcccctgttgttgctcctcggaacggctgccttggccccgggtgctgcggccggtaacgaggccgccccagccggtgcttctgtgtgttattcgtccccgccctccgtcggtagtgttcaggagctggcccagagagctgccgtggtgatcgaaggcaaggttcacccgcagagacgccagcaaggtgcgctggatcgcaaagccgcagccgctgccggcgaggctggtgcttggggaggggaccgtgagcctccggccgccggcccgcgcgcgctgggccctcccgcagaagaacccctgctcgccgcgaatggcactgtgccgagctggccgactgcaccagtgccctcagcaggagaaccgggcgaagaggccccatacctggtgaaggtgcaccaggtctgggcggtgaaggctggcggcctgaagaaagattcactgctgacggttaggctcggcacctggggccaccccgccttcccaagctgcgggcggctgaaggaggattctaggtatatcttttttatggaaccagacgcaaacagtaccagccgcgccccggccgcctttcgggctagcttccccccattggaaactgggcgtaatcttaaaaaggaggtatcgcgggtcctgtgcaagcgttgcgctttgccaccccgtctgaaggaaatgaaatcccaggagagtgccgcgggctcgaagctagtgctacggtgcgaaacgagttccgagtactccagccttcgttttaagtggtttaagaacggcaacgaactgaatcgaaagaacaaacctcagaatatcaaaatccagaagaagcccggaaagagcgaactacgcatcaataaggcgagcttggccgacagtggcgagtacatgtgcaaggtgatctcgaaattggggaacgattccgcttccgcgaatatcaccatagtggagagcaatgcgacgagcacctcgactactggtacgagtcatttggtaaagtgcgctgagaaggagaagaccttctgtgtgaacggcggagaatgctttatggtgaaggatctgtccaatcccagccggtacttgtgcaagtgccccaatgagtttaccggcgaccgctgtcaaaattacgtgatggcctccttctacagcacgagtaccccattcttgagtctgccggaa

SEQ ID NO: 17556 - DNA, 1266 bp, Artificial Sequence
  Description of Artificial Sequence: Synthetic coding sequence
atgcgctggaggcgggcaccaagacgctcaggtcgcccgggaccccgcgcccagagacccggcagtgcagctcgcagcagtccccccctccccctgcttccactgctgttgctgctcggcaccgctgccctcgcacctggcgccgccgccggcaacgaagccgcacccgccggtgctagtgtgtgctattcttcacctccgtctgttggttctgttcaggagctcgcacagcgtgccgctgtggttatcgaaggtaaggtgcacccacagaggcgccagcagggggctcttgacaggaaggccgcagcagctgcgggcgaagccggtgcttggggaggggaccgcgaacctccagccgctgggcctagggcgctgggaccacccgccgaagaaccactgcttgcagccaacggtacagtgccttcatggcctactgccccggttccaagtgccggcgaacctggcgaggaggccccctatttggtgaaggtgcatcaggtatgggcggtgaaggctgggggattgaagaaggattccctgttgacggtgaggctgggtacctggggacatcctgctttccctagctgtggcagactgaaggaagatagcagatatatcttcttcatggagcccgacgctaatagcactagcagagctccggcggccttccgagcaagctttccaccactggagactggacggaacttaaagaaggaggttagccgagtgctgtgcaagcgatgtgctttgccaccccgcctgaaggagatgaaaagtcaggaaagcgcagctggatcaaaactggtcttacgatgtgaaacctcgtcagaatactcctccctccggtttaagtggtttaagaacgggaacgaacttaatagaaaaaacaaaccgcagaatatcaagatccagaagaagccagggaaatctgagctgcggatcaacaaagcttctctggcagattccggcgaatatatgtgcaaagtgatatctaaactcggcaatgatagtgccagcgccaacatcactatcgttgaatcaaacgccacctcaaccagcacaaccggaacctctcacctggtcaagtgcgctgaaaaagagaagacgttctgcgtcaacgggggcgaatgttttatggtgaaggacttgtcaaatccatctaggtatctgtgcaagtgtcccaatgagttcactggggacagatgccagaattacgtgatggcctcattttacagcacttcgacgccgttcttgtccctccccgaa

SEQ ID NO: 17557 - DNA, 1317 bp, Artificial Sequence
  Description of Artificial Sequence: Synthetic coding sequence
atgccgctgaacgtgtctttcaccaacaggaactacgaccttgactacgacagcgtgcagccctacttctactgcgacgaggaagagaacttttatcaacagcagcagcaatcggaactccagccgccggcgccgtctgaggacatatggaagaagttcgaactcctcccgacccctccgctgtcgccgtctcgccgctccgggctgtgctccccgtcctatgtggccgtgactcctttcagcctgcgcggagataatgacggaggtgggggatcgttctcaaccgccgatcagctggaaatggtcaccgagctgttgggtggagacatggtaaaccaatcgtttatctgtgacccagatgatgaaaccttcatcaagaatatcatcatacaggactgtatgtggtccggcttcagtgccgcagcaaaactcgtgagcgaaaaacttgcctcctaccaggcagctcggaaggattccggatcgcccaatcctgcccggggccattctgtgtgctcaacttcctcgctgtaccttcaagacctgagcgctgcggcatcagaatgcatcgacccatctgtggtctttccatacccgctgaacgactcgagctcacctaagtcttgcgctagccaggattccagcgcgttctccccgtcatcagatagccttttgtcctcgaccgagagctcgccccagggatcgccggaaccgttggtactgcacgaggaaacgcctcccactacctcgagcgactccgaagaagagcaggaagatgaggaagaaatcgatgtggtttccgtggaaaagagacaagcgcctggcaaaaggtccgagtcgggctcgccgtcagcgggaggacattcgaagcccccacactcgccactggttctgaaaagatgccacgtcagtacgcatcagcacaattacgccgcacctccctcaactcggaaagattaccccgccgcgaagcgggtgaagctcgattcagtcagggtgctgcgccagatcagcaacaacagaaagtgtacttcgccacggtcctccgacactgaggaaaacgtcaagcgacgtacccataatgtgctcgagaggcaacggcggaacgaactgaaacgctcgttctttgctctccgcgaccaaattccggaactggagaacaatgagaaggccccaaaggtggtcatcctgaagaaagccacggcctacatcttgtcagtgcaagcggagactcagaagctcatttccgaaatcgacctgctccggaagcagaacgaacagctcaagcacaaattggagcaactccgcaattcctgcgca

SEQ ID NO: 17558 - DNA, 1317 bp, Artificial Sequence
  Description of Artificial Sequence: Synthetic coding sequence
atgccgctgaacgtctcgttcacgaatcgcaattatgatctcgattacgattcggtgcagccttacttttactgcgatgaggaggagaatttctatcagcaacaacaacagagcgagttgcagccgcctgcgccaagtgaggacatatggaagaagttcgaattgcttccaacgccccccctctcgccctcccgaagaagcggtctgtgctcgccgagttacgtggccgtcactccattttcgctccgcggtgataacgatggcggaggaggctcgttctccactgcggaccaactcgagatggttaccgaactattgggcggagatatggtcaaccaaagctttatctgcgatccggacgatgagaccttcattaagaacataatcatacaggactgcatgtggtccggcttttcggccgccgctaagctcgtgagtgagaagttggcatcttaccaggctgctcgtaaggactcgggctcccctaaccccgctcgaggccacagtgtttgtagtacctcctcactgtatctacaggacttatctgccgcagcctccgagtgtatcgatccctcggtcgtcttcccgtatcccttgaatgatagcagttctccaaaaagctgcgcgtcccaggactcgtcggcgttcagcccctcctcagactccctcctgtcctcaacagagagtagcccgcagggatcccccgagcccttggtcctccacgaggagacaccccccacaactagcagcgattccgaagaggaacaagaagacgaagaagagattgatgttgtctccgtggagaagcgtcaagcaccgggtaagcgtagcgagtctgggagccccagcgcaggaggccatagcaaaccgcctcacagtcccttggtattgaaaagatgccacgtctcgacgcatcagcacaattacgccgccccaccctccacacgcaaagattatccggccgcgaagcgcgttaaattggattcggtgagggttttgcgtcagatttcgaataacagaaagtgcacgtccccccgtagcagcgataccgaggagaacgtcaaaaggcgcacacataacgtcttggagcggcagcgaagaaacgaacttaagaggtccttttttgcgctacgtgatcagataccggagctggagaataacgaaaaggcacccaaggtggtcatactgaagaaggcgaccgcctacattctttcggtccaagccgaaacccagaagctgatctcagagattgacttgctgcgtaagcagaatgagcagctgaagcacaaattggagcagctgcgaaatagctgtgct

SEQ ID NO: 17559 - DNA, 1317 bp, Artificial Sequence
  Description of Artificial Sequence: Synthetic coding sequence
atgcctctgaatgtttcctttactaatagaaattacgacctggactacgattctgtgcagccatatttttattgcgacgaggaagagaacttctatcagcagcagcagcagtcggagctgcagccccctgcaccttcagaagatatctggaagaagttcgagctgctgccaacacccccattatcaccaagtaggcgatcaggcctgtgttcaccctcctatgtggccgtgacccccttttcgctacgcggtgacaatgacggcggaggcggctccttttcaaccgccgaccaactagagatggtgactgaactgctgggaggtgatatggttaatcagtccttcatctgtgacccagacgacgagacatttattaagaatattatcattcaagactgcatgtggagcggcttctccgcagcagcgaagctggtgtccgagaaactggcctcctaccaggccgcccgaaaggactctggaagccccaaccccgcaagaggccattcagtatgttccacaagctcactttacctgcaggatttgagtgctgccgcctcagaatgcatcgatccaagcgtcgtcttcccttatcccctaaacgattcatcttcccccaaaagctgcgcctcccaggatagctcagcttttagcccgagctcggactctttgctgagcagcaccgaatctagcccccaaggctccccggagcccctggtactgcatgaagaaactccacccacgacgtcttccgattctgaagaggaacaggaagatgaagaagagatagatgtggtatccgtggagaagcgacaagcacctggtaaaagaagtgaatccggcagtcctagcgcaggcgggcacagcaagccaccacacagcccgctggtcttgaagcgatgtcacgtgtctactcaccagcacaactacgcagcaccccccagtactagaaaagactatccagcagctaaaagagtgaagctcgattcagtaagggtgcttcgacagatcagtaacaatcggaagtgtaccagccctcgttctagtgatactgaggagaatgtgaagcgacgaacccataacgttctggaacgtcaaaggaggaatgaactgaagcggtcattttttgccttaagagaccagatacctgaactggaaaacaatgaaaaggcgcccaaggtagttatcctgaagaaggctaccgcatacatactttctgtgcaggcagagacgcaaaagctcatttcggaaatcgatctgttgaggaagcagaatgaacaactcaaacacaaactggagcaactgcgtaatagctgcgca

SEQ ID NO: 17560 - DNA, 1317 bp, Artificial Sequence
  Description of Artificial Sequence: Synthetic coding sequence
atgccacttaatgtgtcctttaccaatagaaactacgatctggactacgattcagtgcaaccatatttctactgcgacgaggaggaaaacttttaccagcagcagcaacagtcggagttgcaacctccggccccaagcgaagatatctggaagaagtttgagctgctgccaaccccgcccctttccccaagcaggcgctcgggactgtgttccccgtcgtacgtggccgtgactccattctccctcaggggagacaacgacgggggaggaggatcattcagcactgcggatcagctcgagatggttactgagctgctggggggagatatggtaaaccagtccttcatttgcgacccggacgacgaaaccttcatcaagaatatcatcatacaagactgcatgtggtccggttttagcgccgccgccaagctggtttcggaaaaacttgcttcgtaccaagcagcaagaaaggacagcgggtcgccaaacccggcgcggggacattcggtgtgttcaactagctccttgtacctgcaggacctttcggccgcggcctcggaatgtattgatcctagcgtagtgttcccgtacccactcaacgactcatccagccccaagtcgtgcgcgtcgcaggactcctcagcattctcgccctcatccgattccctgctgagcagcacggagagctcgccgcaaggatcacctgagccgctcgtcctgcacgaggaaaccccgcctactacttcatcggacagcgaggaagaacaggaagatgaggaagagatcgacgtggtgtccgtggaaaagcgccaggcgccgggcaaaagatccgaaagcggctctccttcagcgggcggccattcaaagcctccacatagccctctcgtgcttaaacgctgccacgtgagtacccaccaacataactatgcggctccaccgtccaccagaaaggactacccggcagcgaagcgggtcaaacttgatagcgtccgggtgctcagacagatctcgaacaatcgcaagtgtacttccccccgcagttctgatactgaagaaaacgtgaagcgcaggacccacaatgtcctcgaaaggcagcgacgcaacgaactgaagcgctcattctttgctcttcgcgatcagatcccggaactcgaaaacaacgaaaaggcaccgaaggtggtcatcctgaagaaagccacggcgtacatcctgtcggtgcaagctgaaacccagaagctcatttcagaaatcgacctgctgcgcaaacagaatgagcagcttaagcacaaacttgagcaactgcgcaattcgtgcgca

SEQ ID NO: 17561 - DNA, 1317 bp, Artificial Sequence
  Description of Artificial Sequence: Synthetic coding sequence
atgccgctcaacgtgtcctttactaatcgtaactacgatctcgactacgacagcgtccagccatacttctactgtgacgaggaagagaacttctaccaacagcagcagcagagtgagctccagcccccggccccttcggaagatatttggaagaagttcgaactccttcctactccgccgctgtccccgtcccgaagatccgggctctgctcgccgtcgtacgtggccgtgacccccttctcgttgcgcggcgataacgacggcggaggaggatcgttctcaaccgccgatcagctcgagatggtgaccgaactcctcgggggtgacatggtcaaccaatcgtttatctgtgaccctgacgacgaaaccttcatcaagaacatcattatccaggactgcatgtggtcaggattttcagcggccgccaagctggtgagcgagaagttggcgagctaccaagccgcgcggaaggactctggctcccccaatccagcccggggacattccgtgtgttccactagctcactgtacctgcaggacctttcagctgctgcatccgaatgcatcgacccatcggtggtgttcccatacccactgaacgacagttcgtctcctaaatcctgcgcatcacaggacagcagcgccttttctccgtcatctgatagccttctgtcctcaactgagtctagtcctcaaggatccccagaaccgctggtcctgcatgaggaaaccccgccgactacttcatcagactccgaagaagaacaggaagatgaggaggaaatcgatgtggtgagcgtagagaagcgccaggctccgggcaagcgctccgaatcgggtagtccatcagctggtggacactcgaagcctcctcactccccactggtgctgaaacgttgccatgtctcgacccatcaacacaattacgcggctccgccttcaacccggaaggattaccccgcagcgaagagggtcaaactcgatagcgtgagagtcctgcgccagatcagcaacaatagaaagtgcactagcccgagatctagtgatacggaagaaaatgtgaagagaaggacccacaatgtgcttgaacgccaacggcggaatgagctgaagcggtcgttcttcgccctgagggatcagattccagagctcgaaaacaacgagaaggccccgaaggtggtcatcctgaaaaaagcgaccgcatatatcctttctgttcaggcagaaacgcagaaactcatctcagagatagacttgctgcgcaaacaaaacgagcaactgaagcacaaattggagcaactgcgcaactcgtgcgct

SEQ ID NO: 17562 - DNA, 1317 bp, Artificial Sequence
  Description of Artificial Sequence: Synthetic coding sequence
atgccattgaatgtatcctttactaatcgtaattacgatcttgattatgatagtgtccaaccatacttctattgtgatgaagaagaaaatttttatcaacagcagcagcagtccgaacttcaacctccggcgccatccgaagatatatggaaaaaatttgaattattgccgacgccgccactgagcccgtcgagacgatcagggctgtgttcacccagctatgtggctgttacaccgtttagtttacgcggggataatgacggcggcggaggttctttttctactgcagatcagcttgaaatggtgacagaacttttaggaggcgatatggttaaccaaagtttcatttgcgacccggatgacgaaacatttatcaaaaacattatcattcaggattgcatgtggagtggtttttcagcggcggcaaaattggtgtcagaaaagctggcctcgtatcaggcagcccggaaagattccgggtctccgaacccagcacgtggacactccgtgtgctcaacgagtagtctatatcttcaggatcttagtgctgcagcgagcgaatgtatagatccttctgttgtgtttccatatccactgaatgattcctcaagccctaaatcctgcgcatcgcaggattctagtgcattcagtccttcatctgatagcttgttgtcaagtacagaatcatcgccgcaggggtcgccggagccgctggtgttgcacgaggaaacgccgccgacgacatcatctgattctgaagaagagcaagaagatgaggaagaaatcgacgtggtatcagtcgaaaaacgtcaagcgccaggaaaacgttctgagtctggctcaccatccgcggggggccattcaaaaccgcctcactctcctcttgtactcaaacggtgccacgtgagcacccatcagcataattacgctgccccgccgagtacccgcaaggactatccagcagcaaaacgagtgaagctggatagcgttcgcgtcttgcgtcaaattagcaataatagaaaatgtacttcaccgagatcgtcagacacagaagaaaatgtgaaaagacggacgcacaatgtcttagagagacaacgccgcaatgaattgaaacgttccttctttgcgcttcgggaccaaataccggaactggaaaataacgaaaaagcccccaaggtggtaatcctgaaaaaagccacagcttacattttgagtgtccaagctgaaacacaaaaacttattagcgaaattgaccttcttcgcaagcaaaatgaacaattaaaacataaattggagcaattacgcaattcttgtgcg

SEQ ID NO: 17563 - DNA, 1317 bp, Artificial Sequence
  Description of Artificial Sequence: Synthetic coding sequence
atgcctttgaatgtgagttttacaaaccgaaattacgaccttgattacgactcagtgcagccctatttttactgtgatgaagaggagaacttttaccagcagcagcagcagagcgagttgcagcctccggcaccaagcgaggatatctggaagaaattcgagctccttcctactccccctctgagcccatcccggagatctggactgtgcagtccatcttatgtggcggtgacacctttttccttgcgtggggacaatgacgggggtggaggctccttttccaccgcagaccagttagaaatggtaactgaactcctcggcggagatatggtgaatcagtctttcatttgcgacccagacgacgagacctttattaagaatatcatcattcaggactgtatgtggagcggcttctcagccgctgcaaaactggtgtctgaaaaactggcctcctaccaggccgcgcggaaagactcaggaagtcccaaccccgctaggggccattctgtgtgctcgacaagttccctctatttacaggacctgtcagctgctgccagcgaatgtatcgacccttcagtggtctttccctacccactaaacgactcatcatctccaaagtcctgcgctagtcaggattcctctgcctttagtccatcatcagattctctactgtccagtacagagtcaagtcctcagggcagtcccgaaccattggttctgcacgaggagacccccccaaccacatcctccgatagcgaggaagaacaggaggacgaagaggagatcgatgttgtcagtgttgagaaacgccaggcgcccggaaaacggagcgaaagtgggtccccctccgccggtggccacagcaaaccgccccactctcctctggtgctgaaacgctgccacgtgagcacacaccagcacaactatgcggcccccccgtcaacccgaaaggattatcccgccgcaaagcgagtaaagcttgactctgtgcgagtcctgcgccagatttcaaacaatagaaagtgcaccagcccgagaagttccgacacagaagaaaacgttaagaggaggactcataacgtcctggaacggcagcggcggaatgagcttaagcgcagctttttcgccctgcgtgaccaaataccggaattagaaaacaacgagaaggcccctaaagtcgtcatactgaagaaggccacagcttacattctgtcagttcaagcggaaacccagaagttaatctccgagatcgatttgctgaggaagcagaacgagcagcttaagcacaagttagagcaactgcggaattcttgcgct

SEQ ID NO: 17564 - DNA, 1317 bp, Artificial Sequence
  Description of Artificial Sequence: Synthetic coding sequence
atgccattaaatgttagctttaccaatcgaaattacgatctggactacgatagcgtacagccatacttttactgcgacgaagaagagaatttttatcaacaacaacaacaaagtgagctgcaaccaccggcgccttccgaagatatctggaagaaattcgaactgctaccgactcctccgttgtcaccatcacgacggtcgggactctgctcgccgagttacgtcgctgtgaccccgtttagtttaaggggagataatgatggagggggggggagcttctcgacagctgatcaactagaaatggtgacagagctgctcggtggagatatggttaatcaatccttcatttgtgatccagatgatgagacattcataaaaaacattataattcaagattgcatgtggtcaggattttccgcagcggctaagttggtttcggaaaagttagcatcatatcaggctgccagaaaagattccggatcaccgaatccggctagaggtcactccgtctgtagtacgtcaagcctctaccttcaagatctttctgctgctgcctcagaatgcatcgatccatctgttgtatttccatatccactaaatgacagttcttcgcctaagagttgcgcgtcccaagattcatcagctttttcgccgtcatcagattccttactttcctcaacagaatcgtcgcctcaaggaagccccgaaccccttgttttgcatgaggaaacgccgcccacaacctcgtcggattcagaagaagagcaagaagatgaggaagaaatcgacgttgtgtctgttgaaaagcgacaagcaccggggaaaagatccgaatccggttcaccgtctgcgggagggcacagcaaacctccacactcaccactggtcctaaaaagatgccatgtgtctactcaccagcataactatgctgcccccccttcaacgcgtaaagattatcccgccgcgaaacgagtgaaactggattcggtgagggttctaagacaaatttcgaataatagaaagtgtacttcaccacgatcttccgatactgaagagaatgtaaagcgaagaacgcacaatgtcctggaacgccagaggcggaacgagcttaaacggagtttttttgcactgcgtgatcaaattcccgaactggagaacaacgagaaggctccaaaggtcgttattttgaaaaaagccacggcttatatcttatcagttcaagccgaaactcagaagctaattagtgaaatcgaccttcttcgaaaacaaaacgaacaactcaaacataagcttgaacaattgagaaattcctgcgca

SEQ ID NO: 17565 - DNA, 1317 bp, Artificial Sequence
  Description of Artificial Sequence: Synthetic coding sequence
atgcctctcaacgtttccttcacaaacagaaattatgacctagattacgattccgtgcagccttacttctactgcgatgaagaagagaatttctaccaacaacagcagcaatcagaacttcaaccccccgcaccgagtgaggatatttggaagaaatttgagttgttgcctacccccccgctctccccgtctcggcggtcaggtttgtgttcgccatcctacgttgcagtcacccctttctcgctccggggagacaacgatgggggagggggatctttttccaccgcagaccagcttgaaatggtgaccgaactcctgggcggggatatggtcaatcagtcttttatctgcgatcccgacgacgagacttttattaaaaatattataattcaagactgtatgtggagcggattctcggccgcagcaaagttggtgtctgagaaactagcttcctatcaagctgcgcgcaaggattcaggtagcccgaacccggcgcgcgggcattccgtatgtagcacatcgtcattgtatctgcaagaccttagtgccgctgcgtcggagtgcattgatccctccgttgtctttccttatccgctcaacgattcctcgagcccaaaatcatgtgcaagtcaggattcctcggcattcagcccgtcgtcagacagtctattaagctcgaccgaatccagtccacagggaagcccagaacctctggttctccatgaggaaacacctcccacgacgtcttctgacagcgaggaagagcaagaggatgaggaggagatcgacgtagtttctgttgaaaagcgtcaagctccgggtaagaggtcggagtctggttctccatccgccggtggccactcgaagccgcctcattctccacttgtgttgaaacgttgtcacgtctcgacacaccaacataattacgcagctccccctagcacccgtaaggactatcccgctgcgaagcgtgtgaagctcgactcggtgcgcgtgctccgtcaaataagcaataaccgcaagtgcacatccccccgctcatctgatacagaagaaaacgtcaagagaagaacccataacgtcttggaacgccaacgcaggaacgagcttaaacgttcattcttcgcgctgcgcgaccagatcccggagttggaaaacaatgagaaagcgccaaaagtcgtcattttgaaaaaggccacagcttatatcctgtccgttcaagcagagacccaaaagctcatctcagaaattgatctgctacgaaagcaaaatgagcaacttaagcataaactggaacagttgagaaactcatgcgcg

SEQ ID NO: 17566 - DNA, 1317 bp, Artificial Sequence
  Description of Artificial Sequence: Synthetic coding sequence
atgccccttaatgtcagcttcacaaatagaaattatgaccttgattatgacagcgttcagccttacttttactgtgacgaggaggagaacttttatcagcagcaacagcagtctgagctacagcctccagctcccagcgaagatatttggaaaaagttcgaactactgccaactcctcctttgtctccgtctcggcggtccggtctgtgctctccaagctacgttgcagtgactcctttctcactgcgcggggataacgatggcggcggtgggagcttttcgactgccgatcagctggagatggtgacggaattactgggcggggatatggtgaaccagagcttcatctgcgatcctgacgacgagacatttatcaaaaacattatcattcaagattgtatgtggtccggcttttctgcagccgccaaactcgtctccgaaaagctggcctcctaccaagccgcccgtaaagattccggctcccccaatccagctcgcgggcattccgtctgctctacatcgtcactctatctgcaggacctttccgctgctgcgtcagagtgcattgacccatccgttgttttcccatacccactgaatgattcctctagtcccaaatcttgcgccagtcaggattcatcagctttttccccttctagcgatagccttctctcatcaaccgagagctccccacaagggagtcctgaaccccttgtcttgcatgaggagactccaccaaccacctccagtgactccgaggaggaacaagaggatgaagaagaaatcgatgtggtgagcgttgagaaacgccaggctccagggaagaggtctgaatctggaagcccatctgcaggcgggcattcaaagccaccacactcacctctggtacttaagaggtgccatgtgtccacacaccaacataattacgcggcaccaccctccacaaggaaggactaccctgctgcaaagagggtgaaattggatagtgtgcgcgtgctgaggcaaatctcgaataaccgtaagtgcaccagtccgaggtcaagtgatacagaagagaacgtgaagaggcgaacacataacgtcttggagcgtcaacgacggaatgagctgaagcgtagcttctttgcacttagggatcagatacccgaactcgagaataacgaaaaagctcctaaagttgtgattctgaagaaggctacagcctacatactgtcagtgcaggcggagacacagaaactgatctctgagatcgatctgctgcggaagcagaacgagcagctcaaacacaaacttgaacagttgaggaattcgtgcgct

SEQ ID NO: 17567 - DNA, 1317 bp, Artificial Sequence
  Description of Artificial Sequence: Synthetic coding sequence
atgcccctcaacgtgagctttaccaaccgcaattatgatttggactacgactccgtgcagccatatttttactgtgacgaggaggaaaacttttaccagcagcagcaacagtccgagttgcagccacctgctccttctgaagacatttggaaaaaattcgaactgctccccactccgccactgtcgccttcaagaagatccggtttgtgctctccaagttatgtggccgtgacccctttctctctgaggggggataacgatggcggtggtggctctttttcaactgcagatcaactcgagatggtgacagagctgctgggaggcgacatggtgaaccagagctttatctgcgaccccgatgacgaaacctttatcaaaaatattattatacaggattgcatgtggtcgggcttcagtgcagcagccaaattggttagtgagaaactagcctcttatcaggctgctcggaaagattccggatcacccaatccggcacgaggacacagtgtctgctcaaccagctctctttacctgcaggacttgtccgcagcagcgagcgagtgtatcgacccgtccgtcgtgttcccctaccccctgaatgactctagctctccaaaaagttgcgcttctcaagacagctctgccttttctcccagtagcgatagcctgttatcttcaaccgagtcttccccacaggggtcgccagagccactggttctgcacgaggagactccacccacgacctcatcagactctgaggaggagcaggaagatgaggaggagatcgacgtggtttcagtcgaaaagcggcaggctcccggcaagcggtctgagtcaggcagtccctcagccgggggtcactcaaagcccccgcactctcccctcgtgctcaagcgctgtcacgtgtcgacccatcagcataactacgcggccccaccctctacccgtaaggattacccagcagccaagagagtgaagcttgactctgttagggtgcttcggcagatcagtaacaataggaagtgcacttcccccagaagctccgacacagaggagaatgtcaaacgcaggactcataatgtgttggaaaggcagagacgtaatgaacttaagagatctttttttgcactccgagatcagatccctgagctcgaaaataatgagaaggctcctaaagtggttattctcaaaaaggccacggcttatatcctatccgtgcaggccgaaactcagaagctaatctcagagatagatcttcttagaaagcagaatgagcagctcaagcacaaactggaacagctcagaaattcctgtgct

SEQ ID NO: 17568 - DNA, 1317 bp, Artificial Sequence
  Description of Artificial Sequence: Synthetic coding sequence
atgccactcaacgtttcgttcaccaatcgcaactatgacctggactatgattccgttcagccgtacttctactgcgacgaagaagaaaacttctaccagcagcaacaacagtctgaactgcaacctccagcaccgtcggaggacatctggaagaagttcgagcttctcccaactccgccgctttcaccgtcccgcagatctggactgtgctccccgtcctacgtggcggtgaccccctttagcctgcggggagacaatgacggtggcggaggatcattctccactgctgatcaattggaaatggtcaccgaactgctcggcggggatatggtcaaccagagctttatctgcgacccggacgacgagactttcattaagaatatcatcatccaggactgtatgtggagcggattctcagcggccgcaaaactggtgtcagagaagctcgccagttaccaagccgccaggaaggattctggatcacctaaccctgctcgtggtcactctgtgtgcagcacttcctccctgtaccttcaagatttgtccgcagcggcctctgaatgtattgatccttcagtggtctttccgtaccccttgaacgatagttcatctccgaagtcgtgcgcgtcccaggattcatccgcgttttcgccatcgagcgactccttgctctcgtcaactgaaagctcacctcagggttccccggagcccctggtgcttcacgaagaaactccgccgacgacctccagtgactcggaggaagagcaagaagatgaagaagagatcgacgtggtttccgtagagaagcgccaggcaccaggaaagagatcggagtcgggctccccctcagccggaggccattcgaaaccgccgcactccccgctggtcctgaaacggtgccacgtctcgacccaccagcacaactacgcagccccaccttcgacccgaaaggactaccctgctgctaagcgcgtgaaacttgactccgtccgggtgctgcggcagatctcaaacaataggaaatgcacctcgcctcgcagctcggatacggaagaaaatgtgaagcgtcggacccacaacgtgctggagcgtcagcggcgcaacgagctcaaacggtcctttttcgcgttgagagatcagatccccgagctggaaaacaatgagaaggccccgaaggtggtgatcctgaagaaagctaccgcctacattctctcagtgcaggccgaaactcaaaagctgatcagcgaaatcgatctgctgcggaaacaaaatgagcagctcaaacataaactggagcagctgagaaacagctgtgcc

SEQ ID NO: 17569 - DNA, 1317 bp, Artificial Sequence
  Description of Artificial Sequence: Synthetic coding sequence
atgcctctgaacgtctccttcactaatcggaattacgatctggactacgattccgtgcagccatatttctactgtgatgaagaggaaaatttctaccaacaacagcagcagtctgagctgcagcctcccgcaccgagcgaggatatttggaaaaaatttgaattgctgccgaccccacctcttagcccatccagaaggtcaggcttgtgcagcccgagctacgtggcggtgacccccttttcgctgcgcggtgataacgatggtggaggtggcagcttcagcacggcggaccaactcgagatggttacagaacttctgggcggcgacatggtgaatcagagctttatatgcgatccggatgacgaaacgttcattaagaacattattatccaagattgcatgtggtccgggttcagcgccgccgcgaagctggtgagcgaaaaactggcgtcctatcaggcagcccgaaaggattccggtagccctaacccggcgcgtggacactcagtgtgttccaccagctctctatacctgcaggatctgtctgccgccgcgtctgagtgcattgatccttctgtcgtgtttccctacccgcttaacgactcctcgtcgcccaagagctgtgccagccaggactctagcgccttctcaccgtcgtccgacagccttctctctagcactgaatcaagcccacagggctcccctgagcctctggtgcttcacgaagagacacctcctacaacctcaagcgattcggaagaggagcaagaggacgaggaagagatcgacgtagttagtgtcgaaaagcgccaggcacccggtaagcgctcagaaagcgggagcccttccgctggtggccacagcaagccacctcattctccactggttcttaagcgttgccacgtcagcacccaccagcacaattatgcagcccctcctagcactagaaaggattacccggccgccaaacgcgtcaagctggatagcgttagagttctacgccagatctcaaacaataggaaatgcaccagccctcgcagctctgacacggaggaaaatgtaaagcgccgcacccacaatgtcctagaaagacaacgcaggaacgaactgaagagatcctttttcgcgcttagagaccagatccctgagctggagaataatgagaaagcgccgaaagttgtgattctgaaaaaggcgactgcctatattctgtcagttcaggcagaaacccaaaagctcatttctgagattgatctgctgcgcaaacagaacgagcagctgaaacacaagctggagcaactgcgcaattcatgtgcc

SEQ ID NO: 17570 - DNA, 1317 bp, Artificial Sequence; identical to SEQ ID NO: 17563
  Description of Artificial Sequence: Synthetic coding sequence

SEQ ID NO: 17571 - DNA, 1317 bp, Artificial Sequence
  Description of Artificial Sequence: Synthetic coding sequence
atgcctctaaatgtctcttttacaaatcggaactatgatttagactacgattccgtgcagccttacttttattgtgacgaagaagaaaatttctatcagcagcagcagcagtcagagctccaaccccctgctccctctgaagacatatggaaaaaatttgaactccttccaacacctccgctaagtccttcaaggaggagtgggctctgttccccatcctatgtggcagtcacacccttttccttgcgcggggataacgacggaggggggggatccttttctacagccgaccagctcgagatggtgactgaactcctcgggggggatatggtgaaccagtctttcatatgcgatcctgatgatgaaactttcatcaaaaatattataatacaggattgcatgtggagtggattctccgcagccgcaaagctcgtgtctgaaaaacttgcaagttaccaagctgcaaggaaagattccggaagtccaaatcctgcccgggggcattctgtgtgttcaacaagtagtctatatctccaagatctctctgcggcagcctccgaatgtatcgatccaagtgtggtctttccatatccccttaatgactcatcttctccaaagagttgtgcctcccaggattcctccgctttctctccctcctcggatagtttgctgagttccacggaatcatcaccccagggatccccagaacccctcgtcctacatgaagaaacaccacctacaactagttctgattccgaagaggaacaggaagatgaagaggaaatagatgtagtctctgtcgaaaaaaggcaggcacccgggaagaggtccgaaagtgggtctccctccgctgggggacattctaaacctcctcactctcctctggtattaaagagatgtcacgtgtcaactcaccagcataattatgctgctcccccctctacgcgaaaagattaccctgctgctaaacgagtgaaactcgattctgtcagggtccttcggcagatttctaataataggaaatgtacaagtccgaggtcctcagatacagaagaaaatgtgaaacggaggactcataatgtgctagaacggcagcgcagaaatgagctgaaacgcagtttttttgctcttcgcgatcagattcctgaactggaaaacaacgaaaaggctccaaaagtggtgatactcaaaaaagctacagcatatatcctttctgtccaggctgagactcaaaaactgatttccgaaatcgatctgctaagaaaacagaatgaacagttgaaacataaactggagcagctcaggaacagttgtgca

SEQ ID NO: 17572 - DNA, 1317 bp, Artificial Sequence
  Description of Artificial Sequence: Synthetic coding sequence
atgccattaaacgtttcatttactaatagaaattacgatttagattatgattctgttcaaccttatttttattgtgacgaagaagaaaatttttatcaacaacaacagcaatcggaattacaacctcctgcaccatcagaagatatttggaaaaaatttgaacttcttccaacaccaccattatcaccttcaagaagatcagggctttgtagtccatcatatgttgcagttactccattttcacttagaggagataatgatggaggaggaggaagtttcagtactgcagatcaacttgaaatggttacagaacttttaggtggagatatggttaatcaatcttttatttgtgatccagatgatgaaacatttataaaaaatattattattcaggattgtatgtggtcaggttttagtgcagctgcaaaattagtttctgaaaaattagcttcataccaagctgcacgaaaagattctggtagtccaaatccagctaggggacattcagtttgttctacctcaagtttatatcttcaagatttatcagctgcagcaagtgaatgcattgacccatctgttgtttttccatatccacttaacgactcatcttcacctaaatcatgtgcatcacaagatagttcagcattcagtccatcatctgattctcttctttcttctactgaatcttcaccacaaggttccccagaaccattagttttacatgaagaaactcctccaactacttcatcagattcagaagaagaacaagaagatgaagaagaaattgatgttgtatctgtagaaaaaagacaagctccaggtaaaagatccgaatctggatcaccatcagcaggagggcattctaaaccaccacattcaccacttgttttaaagagatgtcatgtttcaactcatcaacataattatgcagcaccacctagtactagaaaagattatccagcagcaaagagagttaaacttgattctgtacgtgttttaagacaaatttcaaataatagaaaatgtacttctccaagaagttcagatacagaagaaaatgtaaaaagacgaacacataatgtcttagaacgtcaaagacgaaatgagttaaaaagaagtttttttgcattaagagatcaaattccagaattagaaaataatgaaaaagccccaaaagttgttatcttaaaaaaggctacagcttatattttatcagttcaagcagaaactcaaaaacttatatctgaaattgatttacttagaaaacaaaatgaacaactcaaacataaacttgaacaattaagaaattcatgtgct

SEQ ID NO: 17573 - DNA, 1317 bp, Artificial Sequence
  Description of Artificial Sequence: Synthetic coding sequence
atgccactgaacgtgagcttcaccaatcgtaactatgacctggactacgactccgtgcagccatacttttactgtgatgaagaggagaatttctaccaacaacagcagcaatctgaactgcagccgcctgctccctccgaagatatttggaagaagtttgagctgctgcccactccgcctctgtcccctagccgccggtccgggctctgttctccaagctacgtggcagtgaccccattttcgctcagaggagataatgatggtgggggtggctctttttcaaccgcggatcagctcgaaatggtgactgagctgctcgggggcgacatggttaaccagagcttcatttgtgatccagacgatgaaaccttcattaagaacatcataatccaagactgcatgtggtccggttttagcgctgcagcaaagctcgtgtcggaaaaacttgcctcctatcaggcagcgcgaaaagattccggttcgcccaatcccgcacgcggacattcagtgtgctcaaccagcagcctgtaccttcaagatctgtcggccgcggcgtcggaatgtatagaccctagcgtggtgtttccatacccactgaacgatagctcatcccctaagtcctgcgcctcgcaggattcttccgcattcagccctagctccgatagcttgctgtcctcaaccgagtcgtcaccacaaggttcccctgagcctttggtgcttcatgaggaaaccccacctaccacctcatcggatagcgaagaagaacaggaggacgaagaagaaatcgatgttgtgtcagtggaaaagagacaagcacccggaaaaagatctgaatccggttcccctagcgcaggaggacattcaaagccacctcattcccctctcgtcttgaaaagatgccacgtgtcaacccatcaacataactacgcagcaccaccttcaactaggaaggactaccctgcggcaaagcgcgtcaaacttgactcagtgcgggttcttcgccaaatcagtaacaaccgaaagtgtacgtcccctagatccagcgataccgaagaaaacgtgaagagacgaactcataacgtgctggaacgccagcgtagaaacgagctcaagaggtcattctttgctctgagagatcagatcccagaactggaaaacaatgaaaaggctcctaaggtggtcatcctgaaaaaggctactgcatacattctctcagtgcaggctgaaacgcagaagctcatttctgagatcgaccttcttcgcaagcaaaacgagcaacttaagcacaagctggaacaattgagaaactcgtgtgca

SEQ ID NO: 17574 - DNA, 1317 bp, Artificial Sequence
  Description of Artificial Sequence: Synthetic coding sequence
atgcctctgaacgtgagctttacgaaccgcaattacgacctggactacgattccgtgcagccttacttctactgcgacgaagaagagaatttttaccagcagcagcaacagtccgagctgcaaccccccgcccctagtgaggacatttggaagaaattcgagttgctgcccacgccacctctgtctcctagcagacggtcaggactgtgttccccgtcctacgtcgccgtcacaccctttagtctcagaggtgataacgacggtggtggcggcagctttagtactgctgatcagttggagatggtgacggagcttctgggcggtgacatggttaatcagagcttcatttgtgatccagatgacgagacattcatcaagaatattatcatccaggactgcatgtggtccgggttttctgcagccgccaagctggtgagcgagaaactcgccagttaccaggccgcccggaaggactctggctccccaaacccggcaaggggacactcagtgtgttccacaagctccctgtacctgcaggacctctctgccgctgcgtccgagtgcattgacccttcagttgttttcccataccccctgaacgattcctctagtccgaagagctgcgcatcccaggactcctctgctttctctcccagtagtgactctctgctgagcagtaccgaaagtagccctcaggggtcccctgagcctctggttttgcacgaggagactccccccaccacttccagcgattccgaggaggagcaggaagatgaggaggaaatcgacgtggtgtcagttgagaagaggcaggcacccggcaagcgcagcgaatcagggagccccagtgccggggggcattctaagcctccgcactccccactcgtgctcaaaaggtgtcatgtgtctactcatcagcacaactacgctgccccaccatctactcgcaaagattaccccgcggctaagcgggttaagttggacagtgttcgggtcttgcgacagatctcaaataatcgaaaatgcacttccccccggagctcagataccgaggaaaacgtgaagcggcggacacataatgttcttgagaggcagcgccgaaacgaacttaagaggagcttcttcgcccttcgggatcagatacccgagcttgagaataacgaaaaggcccccaaagtcgtaatactgaaaaaggcaaccgcctatattctgagcgtgcaggcggaaactcagaagctgatctccgaaatcgatttgctccggaaacagaatgagcagcttaagcacaagcttgaacagctgagaaacagttgcgcc

SEQ ID NO: 17575 - DNA, 1317 bp, Artificial Sequence
  Description of Artificial Sequence: Synthetic coding sequence
atgccattaaacgtctctttcaccaatagaaactatgatcttgactacgactccgtacaaccttacttttactgcgatgaagaggaaaacttctatcaacagcagcagcaaagcgaactccagcccccagctccttcggaggacatttggaagaaattcgaactcttgccaactcccccactgtctccctctaggagatccgggctatgttccccttcttacgtggctgtaacaccgtttagcctgcggggtgataacgacggaggaggcgggtcattctcgactgctgaccagctggagatggtcacagagctgctggggggagacatggttaaccagagcttcatctgtgacccggatgatgaaacatttattaagaacatcattattcaagattgcatgtggtccgggttttctgccgccgccaagctggtgtccgagaaacttgcaagctaccaggccgcaagaaaggattctggctcccccaaccccgcccgcggacactccgtgtgttctacatcgtctctgtacctccaagatctttctgccgctgctagcgaatgcatcgacccctcggtggttttcccataccctcttaatgatagcagtagccctaagagctgcgcctcacaagacagttctgctttctctccttctagtgattctttgctcagctctaccgagtcatctcctcagggatcccccgagcctctcgtgcttcacgaagagacgccacctacgaccagcagcgactctgaagaggagcaggaagatgaagaggagattgatgtggtaagcgtggaaaaacggcaagcgccagggaaaaggtctgagtcgggctccccgagcgctggtggccactcaaagcccccacacagtccgcttgtgttgaaacgctgtcacgtttccacgcaccagcataactacgccgcccctccctccactagaaaagattacccggccgctaagagagtgaaactggactcagtacgtgtgctgcgtcaaatatctaataacaggaaatgcacgtcgcctagatcttctgatacagaggaaaacgttaagagaaggacgcacaacgtcctggaaagacagcgccgcaatgaactcaagcgatccttcttcgcgctcagagaccagattccggagctggaaaacaacgagaaggcacccaaggtagtgatccttaaaaaggccacagcctatattctgtcagtgcaggcagaaacacagaaattaattagcgagatcgatttgctgaggaagcagaacgagcagctgaagcacaagcttgagcagctccgcaattcttgtgcc

SEQ ID NO: 17576 - DNA, 1317 bp, Artificial Sequence
  Description of Artificial Sequence: Synthetic coding sequence
atgcccctgaacgtgagctttacgaacaggaactatgacctggactatgattccgttcagccatacttctactgtgatgaggaagaaaatttctatcaacagcaacagcagtccgaactccagcctccagctccttctgaggacatttggaagaagtttgaactgttgcccaccccacctctgagcccctcacggcgcagtggtttgtgctcaccgtcctacgtcgctgtgacccccttcagcctccgcggagataacgatggcggaggaggatccttctccaccgccgaccagctggaaatggtcaccgaactcctcgggggagacatggttaaccagtccttcatatgcgaccccgatgatgaaacctttattaagaatattattattcaggactgtatgtggagcgggttctctgccgctgcaaagcttgtctccgagaagctggccagctatcaggcggctcggaaagatagcggaagccctaatcccgcccggggccattctgtttgttctacttccagtctgtatcttcaggacctgtcagcggcagcttccgagtgtatcgacccttcagtagtgttcccttaccctctcaatgactcttcatcaccaaagtcatgtgcaagccaggatagctccgcgttctctccttcctcagactctctcttgtcttccactgaaagcagtccgcaaggaagccccgagcctttggtacttcacgaggagaccccaccgactacatcatcagacagcgaggaggaacaggaggacgaggaggagattgatgtggtctcagtcgaaaaacggcaggctccgggtaagagatccgaatccggctctccttccgctggggggcactccaagccaccgcactcccctcttgtgctgaagcgatgccacgtctcaacccaccaacacaactatgctgcaccaccgagcacacgaaaagactacccggcggccaagagagtcaaacttgatagtgtgcgcgtgctgaggcagatttccaacaatagaaagtgcacttctccaagaagctctgacaccgaagagaacgtgaaaagaagaacacacaacgttctggaaagacagcgaagaaacgagttgaagcgctcattttttgctcttcgagatcagatccccgaacttgaaaacaatgagaaggcccccaaggtagtcatcctgaaaaaagcgacagcttacatcctgtccgttcaggccgaaacccagaaactgatatctgaaattgacctgctgagaaagcagaacgagcagctgaagcataagcttgagcagttgaggaactcctgcgca

SEQ ID NO: 17577 - DNA, 1317 bp, Artificial Sequence
  Description of Artificial Sequence: Synthetic coding sequence
atgccacttaatgtgtccttcaccaaccgcaactacgaccttgactacgattcggtgcagccctacttctattgtgacgaagaagagaatttctaccagcaacaacaacaaagcgaacttcagcccccggccccatccgaagatatttggaagaagtttgagcttcttcctactcccccactctcgcctagccggaggtccggattgtgttcgccctcgtacgttgcagttacccctttttccctgagaggagacaacgacggtggcggcggttcgttctccaccgcagatcagcttgaaatggtgaccgaactgctcggtggtgatatggtgaatcaatcgttcatttgcgatccagatgacgaaacctttatcaaaaacataatcattcaggactgtatgtggtccggatttagcgcggcggctaaattggtgagcgaaaagctggcctcgtaccaagcagcaagaaaagactcaggaagcccaaacccagctcgtgggcatagcgtgtgtagcactagctccctttaccttcaggacctgtcggccgctgcaagcgaatgtatcgatccctcggtggtgttcccatatccattgaacgattcttctagccctaaatcgtgtgcatcgcaggactcctccgcgttttcaccgtcatctgacagcctgttgtcctcaactgagtcgagcccccagggatcgcctgaaccccttgtgctccatgaagaaactccacctactacctcctcggatagcgaggaggaacaggaggatgaagaagaaattgacgtggtgtcggtagaaaaacggcaggcaccaggtaaaaggtcagaatcgggttcgccaagcgcaggcggtcattcaaagcctcctcactctcctctcgtgttgaagaggtgccatgtctcgacccatcaacataactatgcagcaccaccttccacgcgcaaagattacccagccgcaaagcgcgtcaaactggattcagtgagagtcctgcgccaaatttcaaacaatcgaaagtgcacttcaccccgttccagcgatactgaggaaaacgtgaagcgtcgaacccacaatgtgctcgaacggcaacggcggaacgagctgaagagatcatttttcgctcttagggatcagatcccggaactcgagaataacgaaaaggcgccgaaagtggtcatcctgaagaaggccacggcgtacattctgtcagtccaagcggagactcaaaagctcatctctgaaatcgatcttctccgcaagcaaaatgaacagcttaaacataaacttgaacaattgaggaacagctgcgca

SEQ ID NO: 17578 - DNA, 1317 bp, Artificial Sequence
  Description of Artificial Sequence: Synthetic coding sequence
atgcctttgaacgtgagcttcacaaacaggaattacgatcttgattacgatagtgtgcaaccatatttctattgcgatgaggaggagaatttctaccaacagcaacagcaatccgaattacagccacccgctccaagcgaggatatttggaaaaaatttgagctcctcccaaccccgcccctctccccgtctagacgctccggcctttgctctcccagctatgtcgcggtaactccgttttctctgaggggagataatgatggaggtgggggcagctttagcacagccgaccaactggagatggttaccgagctgcttgggggcgacatggtgaaccagtctttcatatgcgatcctgatgatgaaacatttattaaaaacattattatccaggattgcatgtggtctggattttccgcagcagctaagctggtgagcgaaaagctggcctcttaccaggctgcgcgaaaagacagcggttcacccaacccggcccgggggcacagcgtctgcagcactagcagcctatacctgcaggacctttctgcagccgcctccgagtgtatcgacccatctgtggttttcccttaccccctgaatgattcaagctccccaaagtcatgcgcaagccaggacagctcagccttttcaccttcaagcgattcccttttatccagtactgaatcttccccccaggggagccctgaacctctggttctgcatgaggagacccctccaaccacttcttccgattcagaggaggaacaggaagatgaggaggagattgatgtcgttagcgttgagaagcgacaagcgccgggcaaaaggagtgaaagcggcagcccaagcgctggaggacattctaaacctccacactctcctttggtattgaaacgttgtcacgtctccactcatcaacacaattacgctgccccgcctagcactcgaaaggactatccagccgcaaagcgggtgaaactcgatagcgtgcgcgtgctcaggcaaataagtaataacaggaaatgcacctcaccaagatcgagcgatactgaggaaaacgtcaaacgacgcacccacaacgtgctggaacgtcagcgtagaaacgagcttaagagaagcttcttcgctctgagagatcagataccagagctggaaaacaatgaaaaagcaccaaaggtggtgatcctgaagaaagctactgcgtacatcctttcagtgcaggctgagactcagaaattgatcagtgagattgatctcctgcgcaaacagaatgagcagttgaagcacaaactggaacaactgaggaactcttgtgcc

SEQ ID NO: 17579 - DNA, 1317 bp, Artificial Sequence
  Description of Artificial Sequence: Synthetic coding sequence
atgccactgaacgtgagcttcactaacagaaactacgatttggattacgactcggtgcaaccttacttttactgtgacgaggaggagaacttctaccaacaacagcagcaatcggagctgcagccacctgcgccgagcgaggatatttggaagaagtttgaacttctcccaactccgcccctctccccatcgagacgcagcgggctctgtagcccgtcatacgtcgccgtgactcccttttcgcttcggggcgataatgatggcgggggcggctccttctcgaccgcagatcaactcgaaatggtgactgagttgctgggaggcgatatggtcaaccagtcatttatctgtgaccctgacgatgagacttttatcaagaacatcattatacaggattgtatgtggtcaggattctccgctgcggccaagctcgtctccgagaaactggcttcttaccaggcagcccggaaagatagcggatctcctaaccctgcacgtggtcatagcgtgtgttcgactagctccctttacctgcaagacctctcggcagccgcaagcgaatgtattgatccttccgtggtctttccttaccctcttaatgattcatcgtcgccaaaatcatgtgcgtcacaggattcaagcgccttttcgcctagcagcgattcccttctgagctcaactgaatcgtcgcctcagggttcgcctgagccactcgttctgcacgaagaaaccccgcctaccactagctccgactcagaggaagaacaggaggatgaagaagagatcgacgtggtgtcggtcgaaaagcgccaagcgccaggaaagcgctcggagtcaggctcgccttcagccggtggacattcgaagcctccccattcgcctctcgtccttaagcgttgccacgtgagcacccatcagcataactacgcagcgcctccttctacccgcaaagattaccctgccgcgaagagggtcaagctggattccgtgagggtgcttagacaaatcagcaacaaccgtaagtgtacttccccacggtccagcgacaccgaggaaaatgtgaaacgacggactcataatgtgctggaacgacaacgccgcaacgagcttaaacgttctttcttcgcacttcgagatcaaataccggagcttgagaataacgagaaggcccccaaggtcgtgattttgaaaaaggcaaccgcctacattctgtccgtgcaggcagaaacccaaaaacttatttccgaaatcgaccttctgagaaagcagaacgagcagcttaagcataaacttgaacaacttagaaattcctgtgca

SEQ ID NO: 17580 - DNA, 1317 bp, Artificial Sequence
  Description of Artificial Sequence: Synthetic coding sequence
atgcccctgaatgtgagcttcaccaataggaactacgacctcgattatgatagcgtacagccctatttttattgtgatgaggaggagaatttctaccagcagcagcaacagagtgagctccagccaccggcaccttctgaggatatttggaagaagtttgagttactgccaacgccaccacttagcccaagccggcgatccgggctgtgctccccctcttatgtggcggtcaccccttttagcctgaggggagataatgacggcggtggcgggtcatttagcaccgcagaccaactggaaatggtgaccgagctgcttggaggtgatatggttaatcagagcttcatctgcgatcccgatgacgagacatttatcaaaaacattattatccaagattgcatgtggtccggtttctctgccgcagccaagctggtgtctgagaagcttgcttcctaccaggcggcccgaaaggatagcggatcccccaaccccgcaagaggacactcagtgtgcagcacctcctccctatatctccaggacttgagcgccgctgcaagcgaatgcattgacccgagtgtggtctttccataccctttgaacgattcgagttcgccaaaatcctgcgccagtcaggacagttctgcttttagtccatctagcgatagcctgcttagcagcactgagtctagccctcagggatcaccagagccactagtgctacatgaagagactcctcctaccaccagtagcgatagcgaggaggagcaggaagacgaagaggaaatcgatgtggtgtccgtggaaaagaggcaggcccccggaaaaaggtctgaaagtgggtctccgtcagccgggggacatagcaaacctccgcattctcctttagtgcttaagaggtgtcacgtgagcactcaccaacataactacgctgctcctccctcaacacgcaaggactacccggccgctaaacgtgtgaaactagattccgtaagggtacttaggcagattagtaataacaggaaatgtacgtcgccaaggtctagcgataccgaggagaacgtcaaacgtcggacccacaacgtcctcgaacgacagagacgcaacgaactgaaacggagtttctttgccctccgagatcagatacccgagctggaaaacaacgagaaggcccccaaggtcgttatcttaaagaaagctaccgcttacatcctctccgtccaggcggagacacagaaactgatttcggagatcgacctgctgcgcaagcaaaacgagcagctcaaacataagttagaacagctgaggaactcttgcgcc

SEQ ID NO: 17581 - DNA, 1317 bp, Artificial Sequence
  Description of Artificial Sequence: Synthetic coding sequence
atgccgcttaatgtttctttcaccaacagaaactacgatttggactacgactccgtccagccatacttttactgcgatgaggaggaaaacttctaccagcaacagcagcaatctgagctgcaaccgcccgcgccgtccgaggatatctggaagaagtttgaactcctgcctactccgcccctgtccccgagcaggcgttccggactctgctcgccctcgtacgtggctgtcacccccttcagcttgcgcggcgacaatgatggcggcggtggttctttctccactgcggaccaactggaaatggtgactgagctgctgggcggagatatggtgaaccagagcttcatttgcgatcctgatgatgaaaccttcatcaagaacataatcatccaggattgcatgtggtcgggcttttcggcagctgctaaactggtcagcgaaaaactcgcctcataccaagccgcacgcaaggacagcggaagccctaatccagcgcgcggacattcagtctgcagcacctcctcgctttacctgcaggacctctcggcggccgcgtcagagtgtatcgacccgtcggtggtgttcccataccctctgaacgactcctcctcaccaaagtcttgcgctagccaggattccagtgccttctcaccgtcctcagacagcctgctgtcctccacggagtcgagcccacaagggtccccggaaccgttggtgctgcacgaagagacgccacccactacttcatcagactcggaggaggaacaagaggacgaggaagaaatcgacgtggtatccgtcgagaaacgacaagcgccagggaagagatccgagtcgggatcgccatcagcgggaggccacagcaagccaccacactccccgcttgtgctgaagcgctgccatgtgtccacgcatcaacataactatgccgcaccgccttcaactcgcaaggactatccggcagccaagcgggtcaagctggactccgtgagggtgctgagacaaatctctaacaatcgcaagtgtacctccccacgctcctccgataccgaagaaaatgtaaagcggcgcactcacaacgtgcttgaacggcaacggagaaatgagctgaagcgatcattctttgccctgcgggatcaaatcccggaactggaaaacaacgaaaaagccccgaaagttgtgatcctgaagaaagctactgcatacatcctgagcgtgcaggctgagactcagaaactcatctccgaaattgacttgctgcggaaacaaaatgaacagctcaagcacaaactcgaacagctgcgcaactcgtgtgcg

SEQ ID NO: 17582 - DNA, 1317 bp, Artificial Sequence
  Description of Artificial Sequence: Synthetic coding sequence
atgccgctgaatgtgtccttcaccaacagaaattacgatctcgactacgactcggtgcagccgtacttctactgcgatgaggaagagaatttctaccagcagcaacagcagtctgagcttcagccgcccgcgcctagcgaggacatctggaagaagtttgaactcctgcccactccgccactctcaccctcgcggaggtcgggcctttgctcaccgtcatacgtcgccgttacgcctttctcgctgcggggagacaacgatggcggaggtgggtcattctccacggccgaccagttggagatggttaccgaattgctgggaggcgatatggtgaaccagtcgttcatctgcgatccggatgacgagactttcatcaagaatatcatcatccaggactgcatgtggagcggattctccgcggctgcaaagttggtgtcggagaagctggcttcctaccaagcggcgcgtaaggacagcggaagcccgaacccggcccgcggtcactcagtctgctccacttcgtctctgtatctgcaagacctgtccgccgcggcctcagaatgcattgatccgagcgtggttttcccatacccacttaacgactcctcctcacctaaatcgtgtgcatcccaagactcgtccgccttttcaccatcgtcggactcgcttctctcctcaacggaatcgtcgccgcaagggtcccccgagccgcttgtgcttcacgaggaaaccccacctaccacctcctcggactccgaagaggaacaggaagatgaggaggaaatcgacgtcgtctcggtcgaaaagcgccaggcacccgggaaaagatcagaatccggctcgccgtcggctggaggacacagcaagccccctcattcaccacttgtgctcaagcggtgtcacgtgtccactcatcaacacaactatgccgccccaccgtccacccgcaaggattacccagccgcaaaaagagtgaagctcgattcggtgcgcgtgttgcgccaaatctccaataaccgcaaatgcacttctccacggtcatccgacactgaagaaaatgtgaagagaagaacccataatgtgctcgaacgacaacgcagaaacgagctgaagcggtcgtttttcgctctccgggaccaaatccctgaattggagaacaacgaaaaagcccctaaggtggtcattctcaaaaaggcgaccgcttacatactgagcgtgcaggcagagactcagaaactgatttcggaaatcgatctcttgcgcaaacaaaacgagcagcttaagcacaagctcgagcagcttaggaactcgtgtgcg

SEQ ID NO: 17583 - DNA, 1317 bp, Artificial Sequence
  Description of Artificial Sequence: Synthetic coding sequence
atgcccctcaacgtttccttcacaaaccggaactacgaccttgactacgattctgttcagccgtacttttattgtgacgaggaggagaatttctaccagcaacagcaacagtccgagctgcagccccctgccccttcggaagacatttggaagaaatttgaactgcttcctacgccccctctctctccctccaggcggagtgggttatgctcacccagttacgttgcagtgactccctttagtctgcgcggcgacaacgacggaggtgggggctctttctctacagccgaccagcttgaaatggtcacagagctgcttggcggggacatggtaaatcagtccttcatctgtgatccagatgatgaaacatttatcaagaatatcattattcaggattgcatgtggtcagggttctctgcagccgccaagttggtctccgaaaagctcgctagctaccaagctgcccgcaaggattcgggatcccccaatccagcaagaggacactctgtgtgtagcacaagctctttatatctacaagatctgtcggcggcagcatccgaatgcattgatccgagcgtcgtgtttccttacccgctgaacgactcaagtagtccgaagtcttgcgcttcccaggattcctccgcattcagtcctagtagtgacagtcttctatcttctaccgaaagtagtccgcaaggatctccagagccactcgttctgcacgaagagaccccccctacaacttccagcgacagcgaggaggagcaggaggatgaagaggagatcgacgtggtctccgttgagaagcggcaagccccgggcaagcgcagcgagagcggaagcccctcagcgggaggacattcaaagcctcctcacagtcccctggtgctgaagcggtgccatgtgagcacccaccagcataactatgcagcccctccaagcactcggaaggactatcccgcggcgaagagagtcaaactggacagtgttagggtgcttcgacaaatttcaaacaatcggaaatgtactagcccgcggtcgagcgacaccgaggaaaatgtgaagcgaagaacacacaacgtgcttgaacgacagagacgcaacgagctcaagagatctttttttgctcttcgggaccaaatacccgagctggaaaacaacgaaaaggcccccaaagtcgtgatattaaaaaaagccacggcctacatattaagtgtgcaagctgaaacccagaaactgatcagcgaaatcgatctgttacgtaaacagaacgagcagctcaaacataagctggagcagctcaggaactcatgcgcg

SEQ ID NO: 17584 - DNA, 1317 bp, Artificial Sequence
  Description of Artificial Sequence: Synthetic coding sequence
atgccccttaacgtgtcttttactaatagaaactacgacttggactacgatagcgtccagccttacttctattgtgatgaagaagaaaacttttaccaacaacagcagcaatccgaacttcaacccccagcaccaagcgaagatatctggaagaagttcgagcttcttccaacccctcctctctcgccctcgcgtcgtagcggcctttgttcgcctagctacgtggcagtcactcctttctcgctgcggggagataatgacggtggaggagggagcttcagcaccgccgatcaacttgagatggtgaccgagctcttgggtggagatatggtgaaccaatcgtttatctgtgaccctgatgatgaaactttcataaagaacatcataatacaggattgtatgtggagcggtttttccgcagcagccaagctcgtctcagagaagttggcatcgtaccaggcggcccggaaagattcgggctcgccgaatccagcgcgcggacactcggtctgctccacttcgagcctgtatctccaagatctctcagccgcagcctcagagtgcatcgatccttcggttgtgtttccttaccctctcaacgacagctcatccccaaagtcctgtgcatcccaagattcctcggccttctccccgtcgagcgactcgctcctttcgtccacggaatcctctcctcaagggtcgcctgagcccttggtcctccacgaagaaaccccaccgacgaccagctccgatagcgaagaagaacaagaggatgaagaggaaattgatgtcgtgagcgtcgagaaaagacaagcgccgggaaaaagaagcgaatccgggtcaccttcagcaggcggacattcgaagccaccccattccccactggtgctgaagagatgccacgtgtcgacccatcagcacaattacgcggcacctccatccaccaggaaagactacccagcagcaaagcgcgtcaagctggactccgtgcgagtcttgcgccagatcagcaataaccggaagtgtacgtccccgcggtcgtcagacactgaagagaacgttaaaagacggacccataatgtgctggaacgccagagacgaaacgagctgaagagatccttctttgcactccgtgaccagatcccagagctggaaaacaacgaaaaagcacccaaggtggtgatactcaagaaagctactgcttacatcctttccgtccaggcagaaacccaaaaactcatttccgaaatcgacttgcttcgaaaacagaatgagcagctgaagcataagctggagcaacttagaaattcatgcgca

SEQ ID NO: 17585 - DNA, 1317 bp, Artificial Sequence
  Description of Artificial Sequence: Synthetic coding sequence
atgccccttaatgtgtcgtttacaaaccgcaactatgatttggactacgattctgtgcaaccatacttctactgcgatgaggaagagaacttctaccagcagcagcagcagtccgagctccagccacccgccccatcggaggatatttggaagaagtttgaattactacccacaccgccgctttcaccttctagacgctccggtctctgtagcccaagttacgtcgccgtgaccccgtttagcttgaggggtgataacgacgggggaggaggtagcttttcaaccgcagatcagctggagatggtgactgaactgcttggtggcgacatggtcaatcagtcattcatttgcgatccggacgatgaaaccttcatcaaaaacataatcattcaggattgtatgtggtctggcttcagcgccgctgctaagctggtgtccgagaaactcgccagttaccaagcagcgaggaaagactccggctcgccaaacccggcgagggggcactccgtgtgtagcacaagtagtctgtatctgcaggacctgtctgcagctgcctcggaatgtatcgacccgtctgtggtcttcccttaccccttgaacgattcgagtagcccaaagagctgcgcaagccaggactcttcagctttctctccgtcgtctgactcactgctgtcctcaacggagtccagtcctcagggctctcccgaacccctagtgctgcacgaggagacacctccgaccacttctagtgacagtgaggaagagcaagaagatgaggaagagatagacgttgtgagcgtcgagaaaagacaggcacccggcaagcgctcagagtcagggagtcccagtgctggaggccactccaaacccccgcactccccgcttgtcctcaagcgttgccacgtctcaacccatcagcataattacgccgctcccccttccacccggaaggactaccccgccgctaaaagagtgaagttggacagtgtcagggtccttcgacagatctcaaataatcggaagtgtacctcccctaggagcagcgataccgaggaaaatgtgaaaagacggacccacaatgttctagaacgtcagcgccggaatgagttgaagcgcagcttcttcgctctgagggaccagattcctgagctagaaaataatgaaaaggcgccaaaggtcgtcatcctgaaaaaagccactgcctatatactatctgtgcaggcagaaactcagaaactgatcagtgaaattgatcttttgcgcaagcagaatgaacagcttaagcataagctggagcagctgaggaatagttgcgct

SEQ ID NO: 17586 - DNA, 1317 bp, Artificial Sequence
  Description of Artificial Sequence: Synthetic coding sequence
atgccactgaacgtcagctttaccaacaggaactatgacttagattacgattctgttcagccctatttctactgcgatgaggaagaaaatttctatcagcaacagcaacagtcggagttacagccccccgctccgtctgaggacatttggaaaaaattcgagctgctgcctacacccccattaagcccatctcgtcgcagtggtttatgttcccctagctatgttgcggttacaccttttagtctaaggggggacaatgacggcggcggaggtagttttagtaccgctgaccagctagaaatggtgactgagctgctgggaggggatatggtgaatcagtcattcatatgtgaccccgacgatgaaacgtttattaaaaacatcattatccaggactgtatgtggtcaggtttttccgccgcagccaaattagtgagcgaaaagctggccagctaccaggcagctaggaaagattccgggtcgccaaaccctgcccgggggcacagcgtttgcagcactagctccctgtacttgcaagatctctctgcagctgcaagcgagtgtatagatccctcagttgtcttcccttatcccctgaacgactcatcttccccaaagtcctgtgccagtcaggactcctccgcattttctccttcgtcggattcacttttgagcagcacagagagctctccgcaagggagccccgaaccactggtcttgcacgaagagacccccccaaccaccagcagcgactcagaagaggaacaagaggacgaagaggagattgatgttgtatccgtggagaaacgacaggctccaggcaagagatcagagtcgggctcaccctctgccggaggccactccaagccgcctcatagcccccttgtgcttaagcgttgccacgtctcaactcaccagcacaactatgccgcccccccatcaacccgcaaggattatcctgccgctaaaagggtgaaactggatagcgtgcgcgtgctaagacagattagcaataacagaaagtgcacttctcctagatccagcgatacggaagaaaatgtgaagcgccgtacccacaacgttctggagcggcagcgaagaaacgagctgaaaagatcctttttcgcgctgcgggatcagataccagaactagagaataatgagaaggctcctaaagtggtgattctgaagaaggctaccgcatatatattgtcagttcaagccgagactcagaagcttatctccgagattgacttgctccgaaaacagaatgaacagctgaaacacaaactggagcagcttagaaatagttgtgct

SEQ ID NO: 17587 - DNA, 1317 bp, Artificial Sequence
  Description of Artificial Sequence: Synthetic coding sequence
atgcctcttaatgtcagcttcaccaacaggaattacgatctcgattacgactcggtgcagccatacttttactgcgatgaagaagaaaacttctaccagcaacagcaacagtcggaattgcaacctcctgcgccttccgaggacatctggaagaaattcgaacttcttcctactcctcccctctcgccctcgagacgctcgggtttgtgtagcccatcctacgtggctgttaccccattctcacttcggggagataacgatggagggggaggcagcttttccactgctgatcaattggagatggtcactgagttgttgggtggagatatggtgaaccagtcattcatttgcgatccggatgacgaaaccttcattaagaatatcattatccaggactgcatgtggtcgggtttttcggcagcagccaagctcgtgtcggagaagttggcatcctaccaggcagcacgtaaagattccggttccccaaatccagcgcgtggccactcggtgtgttcgacgtcgtcgctgtacctgcaagacttgtccgcggcagcgtcagagtgtatcgacccatccgtcgtttttccataccccttgaacgactcatcatcacccaagtcctgtgccagccaggatagctcagcgttcagcccctcctcggattcgcttctgtcatccaccgagtcatcaccacagggatcaccagaacctctggtcctgcatgaagaaactccaccgactacttcatcagactcagaggaagaacaagaggatgaggaagaaattgatgtcgtgtccgtcgaaaagcgacaagcacctggaaaacgatcagaatccggatcgccttctgcaggcggccactcgaagcccccacactcgccgctggtgcttaaacggtgccatgtgagcacccatcaacataactatgcggcccctccttcgacccgcaaggactatcccgctgcaaagcgcgtgaagctcgactccgtgcgtgtgctgcggcaaattagcaataacagaaagtgtacctcacctagatcgtcagatacggaggagaacgtcaagcgccgcactcataacgtgttggaacgccagcgtaggaacgagctcaagagatccttttttgcactgcgggatcaaattccggagctggaaaacaatgaaaaagcccctaaggtggtgatactgaagaaagcaacggcatacatcctgtccgtgcaggcagaaacccaaaaacttatcagcgaaatagacctgctgcgtaagcaaaatgagcagctgaaacacaaacttgagcagctgcggaactcgtgtgct

SEQ ID NO: 17588 - DNA, 1317 bp, Artificial Sequence
  Description of Artificial Sequence: Synthetic coding sequence
atgccgcttaatgtgagctttaccaaccggaactacgatttggattacgactctgtacagccttacttttattgcgacgaggaggagaatttctatcagcagcagcagcagtctgagctgcagcctcccgcacctagcgaggacatctggaagaagttcgaactgctgccgaccccaccgctctcaccctcccggagatctggactgtgttccccgtcttacgtagcagtaactcccttcagccttagaggggacaatgacggcggcggtggaagctttagcaccgctgaccagctggaaatggtaacggaattactgggcggggatatggtgaaccagtctttcatctgcgaccctgatgacgaaacctttatcaagaatattataatacaggactgtatgtggagcgggttctccgcggccgccaagcttgtatccgaaaaactcgcctcgtaccaggctgctcggaaagacagtggtagccctaatccagcacgaggccatagtgtgtgttccaccagcagtctctacctacaggacctgtccgcggcagcctctgagtgcattgacccttccgtagtctttccttacccccttaatgacagtagctcgccaaagagttgcgcaagtcaagatagttctgccttctcccccagtagcgactctttgttatccagcaccgaaagttcccctcagggctcccctgagccgcttgtgctgcatgaagagactccgcccaccacctccagcgatagtgaggaagaacaggaggacgaggaggaaattgacgttgtatcggtcgaaaaacgccaggctcctggtaagcgatctgagagcggctctcccagtgctgggggccactctaaacccccacatagccctctggttttaaaaaggtgccacgtgtcgacacatcagcacaactacgccgcacccccaagcacccgtaaagactatcccgccgccaaacgagtgaagcttgattcagtccgcgtgcttcggcaaatctccaataaccgcaagtgtacctctccacggagctcagataccgaggagaatgttaaacgaaggactcacaatgtgctggaacgccagaggcgtaatgagctcaagcgcagtttcttcgccctaagagatcagataccagagctcgaaaacaatgagaaggccccaaaagtagtcatcttgaaaaaagctacagcctatattctgtccgtccaggccgaaacccagaagctgatttcagaaatagacctactgagaaagcaaaatgagcagctgaaacataaactggaacagctgcgcaattcctgcgcg

SEQ ID NO: 17589 - DNA, 1317 bp, Artificial Sequence
  Description of Artificial Sequence: Synthetic coding sequence
atgcccctgaatgtgtcctttacgaatcgcaattacgaccttgactacgattcggtgcaaccttacttttactgcgatgaggaagagaacttctaccagcagcaacagcagtccgagctgcaacctcctgccccaagcgaggacatttggaagaagttcgagctgttgccaacgccccctctctcgccatcaagaagaagcggactttgttctcccagctacgtggccgtgactcctttcagtctgagaggtgacaacgatggaggaggaggatcgttctcgactgcggatcagctggaaatggtcaccgagctgcttgggggcgacatggtgaaccaatcgttcatctgtgatccagatgatgaaactttcattaagaatatcattatacaggactgcatgtggagcggattttcagcagcagcaaagctggtcagcgaaaagctcgcatcataccaagccgctagaaaagacagcggctcacctaaccctgcacggggtcattccgtgtgttcgaccagctcgctttacttgcaagatctctcggctgcagcctcggaatgcattgacccatcagtggtgttcccttaccctctgaatgattcctcatcccctaagagctgcgcctcgcaagattcaagcgcattttcaccatcatcggacagcctcctgtcatccaccgagtcgagccctcaaggctcacctgaaccccttgtcctccatgaggaaacgcccccaacgacttcctcggattcggaagaagaacaggaggacgaagaagaaatcgacgtcgtgtcagtggaaaaaaggcaggcgcccggaaagagaagcgagagcggttcaccctcagccggaggccatagcaaaccccctcactcgcctctggtccttaagagatgtcatgtgagcacccaccaacataactacgccgccccaccttccactaggaaggactaccctgcagctaagcgagtgaagctggactccgttagagtgctcaggcaaatatcgaacaaccgcaagtgtacgtcgcccagatccagcgataccgaagagaacgtcaagaggagaactcacaacgtgcttgaaaggcaacggaggaacgagctgaaacggtccttttttgcactgcgggaccagattccggaactggaaaacaatgaaaaggcacctaaggtcgtgattctcaagaaagcaactgcctatattctgtccgtgcaagcagaaacgcagaagctgatttccgagattgaccttttgagaaagcaaaacgagcaactgaaacataagctcgaacaacttcgcaactcttgtgcg

SEQ ID NO: 17590 - DNA, 1317 bp, Artificial Sequence
  Description of Artificial Sequence: Synthetic coding sequence
atgccgctgaacgtgtcgttcaccaatagaaattacgatcttgattacgattccgtccagccttacttttactgtgatgaggaagaaaacttctaccagcagcaacagcaaagcgaattgcaaccacccgcgccatccgaggatatttggaagaagtttgaactgcttcccactccgcctctgtcgccaagcagaaggtctggtctgtgttccccatcttatgttgccgtgaccccatttagcctccgaggcgataatgacggcggcggaggcagcttcagcactgctgaccaacttgaaatggtcactgagcttctcggaggagatatggtgaaccaatcgtttatctgcgacccagatgatgaaacgtttatcaagaacatcattatccaggattgtatgtggtcgggatttagcgcagctgcaaagctcgtctcagagaagctggcaagctaccaagcagcaagaaaagattctggtagccctaatccagcacgagggcatagcgtttgctcgacctcctccctctatctgcaagacctttcagcagcagcatccgaatgtattgatccaagcgtggtgttcccttaccctcttaacgattccagctcacctaagtcatgtgcatcccaggattcatcggcattctcgcctagctcggattcgcttctgtcatcgaccgaaagctcacctcagggtagccccgagccactggtgctgcatgaagaaactccccctactacttcctcagactccgaggaagaacaagaagatgaagaagaaatcgatgtcgtctcagtcgagaaacggcaggcccctggtaagaggtcggaatcgggatcaccttcggctgggggtcattcgaaacccccacattcccctctcgttcttaagcggtgtcatgtgtcgacccatcaacataactacgccgctcctcctagcacccgcaaagattatccggcagcaaagcgggtgaagctggactctgtgcgtgtgcttcgacaaattagcaacaatagaaagtgtacctccccccgtagctccgatactgaagagaatgtgaaacggcgtactcacaatgtgctggaaagacaaagaagaaacgagctgaagagatcgtttttcgctcttcgcgatcaaatccctgagctggaaaacaacgaaaaggcaccaaaggtggtgatactgaaaaaggcaaccgcgtatattctgtcagtgcaggcagaaactcagaaactcatctcggaaattgatctgctgagaaagcaaaacgaacaactgaaacacaagctcgagcaacttagaaactcctgcgcc

SEQ ID NO: 17591 - DNA, 1317 bp, Artificial Sequence
  Description of Artificial Sequence: Synthetic coding sequence
atgccgttaaatgtttcgtttacgaatcgtaattatgatctagattatgattcggtacaaccgtatttttattgtgatgaagaagaaaatttttatcaacaacaacaacaatcggaactacaaccgccggcgccgtcggaagatatatggaaaaaatttgaactattaccgacgccgccgttatcgccgtcgcgtcgttcgggtctatgttcgccgtcgtatgtagcggttacgccgttttcgctacgaggtgataatgatggtggtggtggttcgttttcgacggcggatcaattagaaatggtaacggaactactaggtggtgatatggtaaatcaatcgtttatatgtgatccggatgatgaaacgtttataaaaaatataataatacaagattgtatgtggtcgggtttttcggcggcggcgaaattagtttcggaaaaattagcgtcgtatcaagcggcgcgaaaagattcgggttcgccgaatccggcgcgtggtcattcggtatgttcgacgtcgtcgttatatctacaagatttatcggcggcggcgtcggaatgtatagatccgtcggtagtttttccgtatccgctaaatgattcgtcgtcgccgaaatcgtgtgcgtcgcaagattcgtcggcgttttcgccgtcgtcggattcgttactatcgtcgacggaatcgtcgccgcaaggttcgccggaaccgttagtattacatgaagaaacgccgccgacgacgtcgtcggattcggaagaagaacaagaagatgaagaagaaatagatgtagtatcggtagaaaaacgacaagcgccgggtaaacgatcggaatcgggttcgccgtcggcgggtggtcattcgaaaccgccgcattcgccgctagttttaaaacgatgtcatgtatcgacgcatcaacataattatgcggcgccgccgtcgacgcgtaaagattatccggcggcgaaacgtgtaaaattagattcggtacgtgttttacgtcaaatatcgaataatcgtaaatgtacgtcgccgcgatcgtcggatacggaagaaaatgtaaaacgacgaacgcataatgtactagaacgacaacgacgtaatgaattaaaacgttcgttttttgcgttacgagatcaaataccggaattagaaaataatgaaaaagcgccgaaagttgttatattaaaaaaagcgacggcgtatatattatcggttcaagcggaaacgcaaaaactaatatcggaaatagatttattacgtaaacaaaatgaacaactaaaacataaactagaacaattacgtaattcgtgtgcg

SEQ ID NO: 17592 - DNA, 1317 bp, Artificial Sequence
  Description of Artificial Sequence: Synthetic coding sequence
atgccgctgaacgtgagcttcaccaaccgcaattacgacctggactacgatagcgtccaaccgtacttctactgcgacgaggaggagaacttctaccaacagcagcagcagtccgaactgcaaccgccagccccctcagaggacatctggaagaaattcgagttgttgccgactccgccactgagcccctcgcgccggagcgggctgtgctcaccaagctacgtcgcggtgaccccgttcagcttgcgcggcgacaacgatggcggagggggatcgttctctactgccgaccaactcgaaatggtcactgaactcctgggcggagacatggtgaaccaatcatttatttgcgaccctgacgacgaaactttcatcaagaacatcattatccaggattgtatgtggtcgggtttctccgccgccgcaaaactggtgtcggaaaagctggcctcctatcaggcggcacggaaggacagcggatcgccgaacccggcccgcggtcattcagtgtgctcgacttcgtcactctacctccaagatctgtcggccgctgcttccgaatgcatcgacccctcagtggtgttcccataccctcttaacgacagcagttcgcctaagagctgtgcctcgcaggactcctcggcgttttctccatcctcagattcccttctgagctcgaccgagtcctctcctcagggatcgccagaacctttggtgctccacgaggaaaccccaccgaccacctcgtcggatagcgaggaagagcaagaggatgaagaggaaatcgatgtggttagcgtggaaaagcgccaggcgccaggcaagagatccgaatcagggtccccaagcgcgggaggacactccaaaccgccccattcccctctggtcctcaaaagatgccacgtctcaactcaccaacataactacgctgccccgccgtcaacgaggaaggattacccggctgctaagcgcgtcaaactggacagcgtgcgggtgctgcggcagatttcaaacaatcgaaagtgcacctcgccccggtcctcagataccgaagaaaatgttaagaggagaacgcataatgtgctggaacggcaacgcagaaatgagctcaagaggtccttttttgcactgcgcgaccagatccctgaacttgagaacaacgagaaggccccgaaagtggtcatcctgaagaaagcgaccgcatacatcctctccgtgcaggcagaaactcagaagctgatctccgaaatcgatctgctgagaaagcagaatgagcagctcaaacacaagctcgagcagttgcgtaattcgtgtgcc

SEQ ID NO: 17593 - DNA, 1317 bp, Artificial Sequence
  Description of Artificial Sequence: Synthetic coding sequence
atgccactgaatgtttcatttacaaataggaactatgacctggattacgatagcgttcagccctacttctattgtgatgaggaggagaacttctatcagcagcaacagcagagtgaacttcagcctcctgcccctagtgaagacatctggaagaagttcgagctgcttcccacaccacctctctccccctctcgtcgtagcgggctgtgcagcccatcatatgttgcagtaactcccttttccttgcgcggcgacaatgacggaggcggtgggtctttttcaacggctgatcagctcgagatggtgacggaattattgggcggcgacatggtgaatcagtctttcatctgcgacccagacgacgaaacatttatcaagaacataatcatccaggattgtatgtggtccgggttcagcgccgccgccaagctggttagcgaaaagctcgcctcctaccaagcagccagaaaagatagcggttccccaaaccctgcgcgaggtcattcagtttgcagcacttcatctctgtacctgcaggatctgtccgcagccgcgtcagagtgcatcgacccatccgtggtgtttccatatcccttaaacgactcgtctagccccaagtcgtgtgcgagccaggacagttctgcgttctcccccagcagtgactctctgttatcatctacagagtcctccccccaaggatcccccgagccactagtactccatgaggaaaccccccccaccaccagcagcgattccgaggaagaacaggaggacgaagaggagatagatgtcgtctctgtggagaaaaggcaagccccaggcaagcgctccgaatctgggtctccctccgccggaggacacagcaagcccccgcactccccgttggtgttaaagaggtgccacgtgtcgacacatcagcacaactacgcagcccccccctccacccggaaagattacccagccgccaagagagtgaagcttgacagtgtccgggtactcaggcagatcagcaacaatcgaaagtgcacaagtcctaggagttcagatacagaggagaatgtcaaacgccgcactcacaacgtgttagagagacagcgccgaaacgagctcaagcgttctttctttgcccttcgggaccaaatacccgagctagaaaataatgagaaggcccccaaggtcgtgatcctgaagaaggcaaccgcttatatcctctccgtacaggccgagactcagaagttaatcagcgaaattgacctactaagaaagcaaaacgagcagctgaagcacaaactcgagcagctgcggaatagctgtgcg

SEQ ID NO: 17594 - DNA, 1317 bp, Artificial Sequence
  Description of Artificial Sequence: Synthetic coding sequence
atgccccttaacgtgagcttcaccaataggaactacgatctggattacgattcagtgcagccatacttttactgtgatgaagaagaaaacttttaccaacagcaacaacagagcgaacttcagcccccggcaccatcagaggatatttggaaaaagtttgaactgctgccgactccgccactctccccatcgagacgatcgggactttgctcgccttcatacgtagccgtgacgcctttttcattgaggggggataacgatggtgggggtggatcattcagcactgccgatcaacttgaaatggtcactgaattgctgggaggagatatggtgaaccagtcgttcatttgcgaccctgacgacgaaaccttcataaagaacattatcatacaagattgtatgtggtccggtttttcggcagctgcaaaacttgtctccgagaagctggcctcatatcaggcagctcggaaggattcgggctcccccaacccggcgagaggtcattccgtgtgttccacttcgtcactctatttgcaagatctgagcgcagcagcatccgagtgcatcgatccgtcggtcgtgtttccttaccctcttaacgactcctcatccccaaaatcctgcgcttcacaagactccagcgccttttccccatcatcagactcactcctttcaagcactgaatcgagccctcagggatcgcctgaacctctggtgctccacgaggaaacccctcccaccacttcatcggattcggaagaagaacaggaggatgaagaggagattgatgtggtgtcggttgaaaagagacaagcaccaggaaagcggtcggaatcaggatcgccatcagcaggaggacacagcaaaccaccacattcgccacttgtgcttaaacgctgtcatgtgtcgactcatcagcataactacgccgcccctccttcaaccagaaaggactacccggccgcgaagagagtcaaactggacagcgtgagagtgctgcggcagatcagcaacaatagaaaatgtacgtctcccagatcgtcagacactgaagagaacgtgaagagaagaactcacaacgtccttgagagacaacgccgcaacgaactgaaaagatcattcttcgcgctgcgggaccagattccagaactcgaaaacaacgaaaaggcaccaaaggtggttattctcaagaaggccactgcatacatcctttcggtccaggcggagacgcaaaagctgattagcgaaatcgacctgctccgcaaacaaaatgagcaactcaagcacaagctcgaacagcttcgcaactcctgtgcc

SEQ ID NO: 17595 - DNA, 1317 bp, Artificial Sequence
  Description of Artificial Sequence: Synthetic coding sequence
atgcctttaaatgtttctttcaccaatagaaactacgacctcgattatgactcagttcagccatatttctattgtgacgaagaagaaaatttctatcagcagcaacaacagagtgagctgcagcccccagccccgtcagaggacatctggaagaagttcgaattactcccgacacctcccctctctccatccagaagatctggcttgtgttccccgagttacgtcgctgtgacacctttcagcttgcgcggggacaacgatggcggaggaggatccttcagtacagcagaccagcttgagatggtcacagaactcctcggaggtgatatggtgaaccaaagttttatctgcgaccccgatgacgaaacctttatcaaaaacatcatcatccaggattgcatgtggagcggatttagcgctgctgccaaactggtgagcgaaaaacttgctagctaccaagccgcccgcaaggattccgggtctcctaaccccgcgcggggtcattctgtgtgctcaacatctagcttgtacctacaagacttaagcgccgcagctagcgagtgcattgaccccagcgtcgtcttcccttacccacttaacgatagctcttctcctaaatcctgcgcctcccaggacagtagcgctttctcccccagttctgacagcctcctgtctagcacagagagtagtccccagggatctccagaaccactggtcctccatgaggagacgcccccaacaacttctagtgatagcgaggaggagcaggaagatgaagaggagatcgacgtggtgagcgtggaaaagaggcaagctcctgggaaaaggtctgaatctggtagcccttctgcaggaggacatagtaagccccctcacagccccctggtcctgaagaggtgccacgtgagcacacatcaacacaactacgcagcgcccccatccacacgcaaagactaccctgccgcaaaaagagtcaaattggacagcgttcgtgtgctgcggcagatcagcaataatcggaaatgcacaagccccaggtccagtgacacagaggagaacgtaaagagaagaacccataacgtcctcgaacggcagcgtcgcaatgagctcaaaaggtcttttttcgctctaagagatcaaatccccgaattggagaacaacgagaaggctcctaaggtggtcattctgaaaaaagcaactgcctatatattatcagtccaggccgagacccagaagctgatctccgagatcgacctgttgaggaaacaaaatgagcaactcaagcataagttggagcagcttagaaattcttgtgca

SEQ ID NO: 17596 - DNA, 1317 bp, Artificial Sequence
  Description of Artificial Sequence: Synthetic coding sequence
atgcccctgaacgtttcgtttactaacaggaattacgacctggattacgactcagtgcagccctacttctattgtgacgaggaagaaaatttctatcagcaacagcagcagtctgaactacagcctcctgctccgtccgaggacatttggaagaaattcgagctgctgccgactccgcctttaagtccttccaggcgaagcggattgtgcagccctagctacgtggcggtcacccctttcagtctgcggggcgataatgatgggggcggcggaagtttcagcaccgctgatcagctggaaatggtcacagagctcttagggggcgacatggtaaatcagagttttatttgtgaccccgatgacgagaccttcatcaaaaacattatcattcaggattgcatgtggtcaggattttccgccgccgcaaagctggtgtctgagaagctagcgtcctaccaggctgccagaaaagactcaggctcccctaaccctgcgcggggtcactccgtctgtagcacatcgagcctctatctgcaagacctgagtgcagcagcctcagaatgtatcgacccctcggtagttttcccatatcctcttaacgattctagcagtcccaaatcctgcgcttcccaggactcaagcgccttcagcccttctagcgactccctgttatcctccaccgagtcatctccgcaagggagccctgagcccctcgttctacacgaggagactcctcccacaactagctctgactccgaagaagaacaagaggacgaggaggaaattgacgtcgtgtctgtggaaaagcggcaagctcctggaaagcgatccgagagcggctcgccgtccgcaggcgggcactctaaacctccgcattctccattggtgctgaaaagatgtcatgtgtcaacgcatcagcacaattatgcagcacctccttctactaggaaggactacccagccgcaaagcgagtgaaactggactcggtgcgagtgctcaggcaaatcagtaacaaccggaaatgcacgtctcctagaagttctgacaccgaagagaatgttaaacgacgcacacataacgtgctggaacgacagcgacgtaatgagcttaagcggtctttcttcgctctgcgcgatcagatccccgagcttgaaaataatgagaaggcacccaaagtggttattctgaaaaaagctaccgcgtatattctgtcagtacaggccgagacacagaagttgatcagcgagattgatctgttgcggaaacagaacgagcagcttaagcacaaattggaacagctgcgaaacagctgtgcc

SEQ ID NO: 17597 - DNA, 1317 bp, Artificial Sequence
  Description of Artificial Sequence: Synthetic coding sequence
atgccgcttaatgtctcgtttaccaaccgtaactacgatttggactacgactcagtgcagccttacttctactgcgatgaagaagagaatttctaccaacaacaacaacagtcggaactccagcctcccgccccttcggaagatatctggaagaagtttgaactgctcccaaccccgccactttccccatcccgaaggtcgggactctgttccccctcgtacgtcgccgtgactccattctcacttcggggagataacgatggaggaggcggatcattttcaaccgctgatcaacttgaaatggtgactgagctgcttggtggtgatatggtgaatcagtcctttatctgcgatccagacgatgagacttttatcaagaacatcatcatccaggactgcatgtggtcgggtttttcggcagcggcaaagctggtgtccgagaagctcgcatcataccaggcagcacgcaaggattcgggttcccccaatccggcacgtggacattccgtgtgtagcacttcatcgttgtacctgcaagatcttagcgccgcggcttcagaatgcatagacccatccgtggtgttcccttacccactgaacgactcctcctcgcccaagtcctgtgcatcgcaggatagcagcgcattttcgccctcctcagactccctcctttcgtcaactgaaagctcgcctcaaggaagccccgagcctctcgtgctgcatgaggaaacgcccccgactacttcttcagatagcgaagaggagcaagaggatgaagaagaaattgatgtcgtgtccgtcgaaaaaagacaagctcccggcaagaggtcagaatcggggagcccgagcgccggaggccacagcaaaccacctcattcaccacttgtgctgaagagatgccatgtgtccacccatcagcataactacgccgcacccccttcaacccggaaagactacccggcagcaaagagggtgaagctcgactccgtgcgcgttctgcgccagatatccaataaccgcaagtgcaccagccccagatcatccgacactgaggaaaacgttaaaagacgtacccataacgtgcttgagcggcaacggagaaatgaactgaaacgttcgttttttgccctccgcgaccagattcctgaacttgaaaacaacgaaaaggcaccgaaggtcgtcatcctcaaaaaagcaaccgcctacattctttccgtccaggccgaaactcagaagctgatctcggaaattgatctcctgcgaaagcaaaacgagcagctcaagcataagctcgaacaactccgcaattcgtgtgca

SEQ ID NO: 17598 - DNA, 1317 bp, Artificial Sequence
  Description of Artificial Sequence: Synthetic coding sequence
atgcctctgaacgtgagcttcaccaaccgcaattacgatttagattacgattccgtgcagccttacttttattgcgacgaggaggagaacttctatcaacagcaacaacaatccgagctccagcctccagccccttcagaggatatttggaaaaaattcgagctgctcccaacacctccactgtctccatcccgccgctccggtctctgttccccgtcctacgtggcggtgactccattctcactgcgcggtgataacgatgggggaggaggctcgttctcaacagccgaccaactcgagatggtcaccgagctactaggaggcgacatggtgaaccagtctttcatctgcgatcccgatgacgagacattcattaagaatatcattatccaggattgcatgtggtccggatttagtgcggcagccaagctggttagcgagaagcttgccagctatcaagcagcaagaaaggactcaggaagtcccaatccagctcgcggccattccgtgtgctctacctcctccctgtatcttcaagacctcagtgccgctgccagcgagtgcatcgacccctccgtggtctttccctatcccctcaatgatagctccagccctaagtcttgcgcgtctcaggactcctcagcatttagtcctagctctgatagcctgctttcgtctactgaaagctctccgcagggtagcccggaaccactagttctccatgaggagactccccccaccacatcttccgatagcgaagaagagcaggaggacgaagaggagatcgacgtggtgagtgttgagaaacgtcaggcacccgggaagagatcggagagcggtagcccctcagccgggggacattctaaacctccacattctccactggtgctcaaaagatgccacgtgtcaacccaccagcacaattacgcagctccaccaagcaccagaaaggattaccccgccgccaagcgtgttaaactggatagcgtgcgcgtactgaggcaaatttctaataataggaagtgtactagtcctaggagtagtgacaccgaggaaaacgtaaaacgcaggacacacaacgtgctggagcggcagaggcgtaacgagctgaaaagaagctttttcgccttaagggaccagatccccgaattagagaataacgagaaggctcccaaagtggttattcttaagaaggctacggcctacatactgagcgtccaggcagaaacccagaaattgatttctgagattgatttgctgagaaagcagaacgaacagctgaagcataaactagagcagctcagaaattcctgcgcc

SEQ ID NO: 17599 - DNA, 1317 bp, Artificial Sequence
  Description of Artificial Sequence: Synthetic coding sequence
atgcctctcaacgtgtcgtttactaatagaaactacgacctcgactacgactcagtccagccgtacttttactgcgatgaggaggaaaacttctaccagcagcaacagcaatcggaattgcaacccccggccccctcagaggacatatggaaaaagttcgaattgctgccgactccgccactgtcaccgtcacgccgcagcggactctgctcgcctagctacgtggcagtgacccctttttcactgcgcggagacaatgacggtggagggggatccttctccacggcagaccagctcgaaatggtgaccgagcttctgggcggagacatggtcaatcaatcgttcatctgtgatccggatgatgaaacctttatcaagaacatcattatccaggactgcatgtggagcggattcagtgcagcggcaaagctcgtctcagagaagctggcgagctatcaggcggctaggaaggatagcggatcgccgaacccggcacgcggtcactcggtgtgcagcacgtccagcctgtacctgcaggatctctcagccgcagcctcggagtgcatcgacccgtcggtggttttcccgtacccgctgaacgattcctcgtcgccgaagtcctgcgccagccaagattcgagcgctttctcgccaagcagcgactcattgctctcctccaccgaaagctcaccgcagggtagccccgaaccgctggtgctgcacgaggaaactccaccgacgacctcatccgactccgaagaggagcaagaggatgaggaagaaattgatgtggtcagtgtggaaaaaaggcaggctcctggtaaacggtctgagtctggatcgccctccgcgggcggacatagcaagccgccacactcacctctggtgcttaagcgctgtcacgtgagcactcatcaacacaattacgccgctccgccgtcgacgcgtaaggactaccccgccgctaaacgcgtcaagctcgactcagtgcgggtgttgcgccaaatctccaacaacagaaagtgtacgagccctcggagttcagataccgaagagaacgtgaagagaaggactcacaatgttctcgaaaggcagcgcaggaacgagctcaaacgctctttcttcgcgctgcgggaccagatcccggaactggagaataacgagaaagcacctaaagtcgtcattctgaaaaaggccactgcctacatcttgagcgtgcaagccgaaactcagaagctgatctcggagatcgacctgctccgcaagcaaaatgaacaactgaagcataagctcgaacaacttcgcaatagctgtgcc

SEQ ID NO: 17600 - DNA, 1317 bp, Artificial Sequence
  Description of Artificial Sequence: Synthetic coding sequence
atgccattgaacgtgtcctttacgaatcgtaactacgacctggactacgattccgtgcagccctacttttactgcgacgaggaagaaaacttttaccaacagcagcaacagtcagagcttcagcctcctgccccatcggaagatatttggaagaaatttgaacttctgccgaccccgcccctgtccccttccagaagaagcggattgtgtagcccgtcgtacgtggcggttaccccgttttcactcagaggagataatgacggcggagggggttcattctccaccgcagatcaactggaaatggtcactgaattgttgggtggcgatatggtgaaccagagcttcatctgcgatcccgacgacgaaacttttatcaagaatatcattattcaggattgtatgtggagtgggttcagcgccgccgctaagctggtgtccgaaaaacttgcctcctaccaagccgcaagaaaggactcaggatcgcctaacccggcacggggacactcggtgtgttcaacttcgtcgctttacctgcaagatctcagcgctgctgcgtcagagtgtattgatccgtcggtggtctttccgtaccctctgaatgactcctcgtctccaaaatcctgcgcatcacaagattcttcggccttttcaccttcctctgacagcttgctgagttccaccgagtcatctccccaagggagccctgagccactggtgctgcatgaggagactccacctactaccagtagcgactcggaagaggagcaggaagatgaggaagagatagacgtggtgagcgtcgaaaaacgccaagcacctggaaagaggagcgaatcaggtagccccagcgcaggaggacactcaaaaccaccacactcacccttggtgctcaagcgctgtcatgtctcgacccatcagcacaactacgcagcaccaccttccaccagaaaggactatcccgcggccaagcgtgtgaaattggattccgttcgcgtgcttcgccagatatcgaacaacaggaagtgcaccagcccccggtcgtcagacactgaagaaaacgtgaagaggagaacccataacgtgcttgaaagacaacgaaggaacgaactcaaacgctccttcttcgcactgagagatcaaatccccgaactggagaacaatgagaaggcacctaaggtcgtgattctgaagaaggcgactgcatacatccttagcgtgcaggcggaaacccaaaagctcatctcggaaattgatttgcttcgcaagcaaaacgaacagttgaagcataagctggagcaactccgcaactcatgtgca

SEQ ID NO: 17601 - DNA, 1317 bp, Artificial Sequence
  Description of Artificial Sequence: Synthetic coding sequence
atgcctctgaacgtttcgtttaccaaccggaactacgacttagattacgacagcgttcaaccctatttttattgcgatgaagaagagaatttttatcagcagcagcaacagtcagaactgcaacctcctgccccctctgaagacatctggaaaaaattcgagctgctccctactcctcctttgtcccctagtagacgttccggtctttgcagcccctcctacgtcgccgtgacaccctttagcctgcggggggacaacgacggaggtgggggatctttctccacggccgaccagctggaaatggtgacagagctgctcggaggtgatatggtgaaccaaagtttcatttgtgatccggacgacgaaaccttcattaagaatatcatcatccaggattgtatgtggagcggcttcagtgctgccgccaagctagtgtcggagaagctggcttcctaccaggctgctagaaaagacagcggatccccaaatcctgctcgaggccactccgtatgttcgacatcgtctctgtacctccaggacctctctgctgcggctagcgagtgtattgaccccagcgtggtgttcccttatccactgaatgactcatcatccccaaaaagttgcgcttcgcaggatagtagcgccttctcgccatcgtctgattctctcttaagctctaccgaaagttctcctcaaggatctccagagcccctagtgctccatgaggagacaccccccacaacctcatccgattcagaggaggagcaggaagacgaggaggagatcgatgtggtgtccgtcgaaaagcgacaggccccgggcaagaggtccgagtcaggcagcccaagcgccggtgggcatagcaagcccccacactctccactggtgttaaagagatgtcacgtttccacccaccaacacaactacgctgccccaccctccacccggaaggattaccccgccgctaagcgcgtgaaacttgattccgtccgcgtcctgcgccagatctccaacaacagaaagtgcacgtccccacgatcttccgatactgaggaaaacgtgaaaagacgcactcacaatgtgcttgagcggcagaggcggaatgagctgaagcggtccttcttcgctctgagggaccagattcctgaactcgaaaacaatgagaaagccccaaaagtggtgatcctcaaaaaggcgacggcgtacatcttgtccgtccaggctgagacccagaagctcataagtgagatagatctgttgcgaaaacaaaacgaacagcttaaacataagcttgagcagcttcggaattcctgtgcc

SEQ ID NO: 17602 - DNA, 1317 bp, Artificial Sequence
  Description of Artificial Sequence: Synthetic coding sequence
atgcccctcaatgtctccttcaccaaccgcaactatgacctggactacgattccgtccagccgtatttctactgcgatgaggaagagaacttctaccaacagcaacagcagtcagagcttcaaccacccgccccgtccgaagatatatggaagaaattcgaattgctgcccacgccaccgctttcgccgtccaggcggtccggactgtgctctccatcctacgtggccgtcactcccttttcccttcggggtgataacgacggtggaggcggctcgttttcgactgctgaccagctggagatggtcacggagctgctcggaggagacatggtcaaccagtcatttatctgcgacccagatgatgaaaccttcatcaagaacatcattatccaggactgcatgtggagcgggttctccgcagccgcgaaacttgtgtcagaaaagttggcatcataccaggcggcgcgcaaggactcaggttccccgaacccggcccgcgggcactcggtgtgtagcacctcgtcactgtaccttcaagacctttcagccgcggcttcggaatgtatcgaccctagtgtggtctttccctacccgctcaatgacagctcgtcaccaaaatcttgcgcctcccaggacagctcagccttctccccatcctcggatagtttgctgtcctccaccgaaagcagcccgcagggatcgccagaacctctggtcctccatgaagaaaccccgccaactacttcgagcgatagcgaagaggaacaggaggacgaagaggagatcgatgtcgtgtccgtggagaagcggcaagcgccgggaaagcgatcggagtccggatcgccctcagcaggcggtcactccaagccgccacatagcccgctcgtgctcaaacggtgccatgtctcaacgcaccagcataactacgcggctccacctagcaccagaaaggattacccagcagcaaaacgcgtgaaactcgactcagtgcgcgtgctgcgccaaatctcaaacaatcgtaagtgcacctccccgcggtccagcgacactgaggagaatgttaaaagaagaacccacaacgtgttggaaaggcagcgcagaaacgagcttaaacgcagcttctttgctctgcgggatcagatcccggagctggaaaacaatgagaaggccccgaaggttgttatactgaagaaagccaccgcatacattttgagcgtgcaagctgagactcaaaagctgatttcggaaatagacctcttgcgaaagcagaatgaacaactcaagcacaagttggaacagctcaggaattcatgtgcc

SEQ ID NO: 17603 - DNA, 1317 bp, Artificial Sequence
  Description of Artificial Sequence: Synthetic coding sequence
atgcctctgaatgtttccttcacaaatcgaaattatgaccttgattatgactccgtgcagccatatttctactgtgatgaagaagaaaatttctaccagcagcagcaacagtctgagctacagcccccagctccctcagaagacatctggaagaaatttgaattgctgcccaccccacctctctcccccagccgcagaagtgggctgtgtagcccctcttacgtcgcagttactccgttttcactgaggggagacaatgacggcggcggcgggtcattcagcacggccgaccaattggagatggtaaccgagctgcttggcggtgatatggtgaatcaatccttcatttgcgaccccgacgatgagacctttattaagaatattattattcaggactgcatgtggtccgggttttcagcagccgcgaagctcgtgtcagaaaaactagcttcttatcaggcagcaagaaaagattctggatctcctaatcccgcccgtgggcactcagtgtgtagtactagctcactgtaccttcaggacttgtctgctgcagcctctgagtgcatcgacccctctgtcgtgttcccttatcctcttaatgacagttcctcacctaaatcctgtgcatcccaggattcaagcgccttctctcccagtagtgactctcttctgtcctcaactgaatccagccctcagggcagcccagagcccctggtgctgcacgaggaaactccccctactaccagcagcgacagtgaggaagaacaggaggacgaagaggagattgacgtggtatccgtggagaaaaggcaagccccgggcaagcgctccgagagcggctccccatccgcgggtggacatagtaaaccaccacactcgccactggtgcttaagagatgtcatgtttcaacccaccagcacaattacgccgcaccaccgtccactaggaaggactacccagccgctaaaagggtgaaactggactcagtgagggtacttaggcagatctccaacaaccgaaagtgcacctctccacggtcaagtgacactgaagaaaatgtgaagcggcgaacacataatgtactcgagcggcaaagacgcaatgagctcaaaaggtccttctttgctctgcgtgatcagatcccggaactcgagaacaacgagaaagcacccaaagtcgtgatccttaagaaggccaccgcttacatattgagcgtccaggccgaaacacaaaagctgattagcgaaatagacctgctgcgcaagcagaatgagcaactgaaacacaaactcgaacagctcagaaacagttgcgct

SEQ ID NO: 17604 - DNA, 1317 bp, Artificial Sequence
  Description of Artificial Sequence: Synthetic coding sequence
atgcctcttaacgtgtcgttcaccaaccggaattacgacttagattacgactcagtgcagccatatttctactgcgatgaagaggagaatttctatcagcagcagcaacagagcgagctccagcctccggccccctctgaagacatctggaagaaatttgagctgttaccaactcctcctttgagtccttcccggaggtctggcctatgcagccctagttacgtcgctgttaccccattcagcctgagaggcgacaatgacggaggtggaggctcgtttagtaccgccgatcagctggagatggttacagagctgctcgggggtgatatggtgaatcagtcattcatctgtgacccagacgacgaaacattcattaagaatattatcattcaggattgtatgtggtcaggcttctccgctgccgccaagctagtgtccgaaaagctggcctcgtaccaggccgctcgcaaagattctggaagccccaatccagcacggggccactctgtgtgctcgacatcctccctatacctacaggacctctcagctgccgcatccgaatgtatcgaccccagtgttgtgttcccctaccccctaaatgattcatcgtcccccaagagctgtgccagtcaggactccagcgccttttccccttcctctgacagtctgttgtcgagtaccgagtccagccctcaggggtcccccgaacccctagtgctgcacgaggaaacacccccaactacttcttcagattctgaagaggagcaggaggatgaagaagaaattgatgttgtgagcgtggaaaagcgacaggccccggggaagagaagcgagtcaggcagcccctccgccggtgggcacagcaaaccaccacactccccgcttgtcctaaaacggtgccacgtgtcaactcatcagcacaattatgctgccccgccaagcacaagaaaggactatcctgcagcgaagcgggtcaagcttgactccgtgagggtgctccgacagatctccaataaccgtaaatgtactagcccgcggtcatctgataccgaggaaaacgtgaaaaggcggacacacaacgttttggagcgacagcggagaaatgaacttaagcgcagcttctttgctctccgcgatcagatcccggaattggagaataacgaaaaggcccccaaagtggtgattctgaagaaagctacggcttacatcctatctgtgcaggctgaaacgcaaaaattgatcagcgagatcgatctcctgcgcaaacagaacgagcagctaaaacataagctcgagcaactccggaactcctgtgcc

SEQ ID NO: 17605 - DNA, 1317 bp, Artificial Sequence
  Description of Artificial Sequence: Synthetic coding sequence
atgcctctgaacgtctcgtttaccaacaggaactacgatctcgactacgattccgtccagccctacttttactgcgatgaagaagaaaacttttaccagcagcaacaacaatcggagctgcagcctcctgcaccttcagaagatatctggaagaagtttgaactgctcccgacccctccactctccccatccagaaggtccgggctctgctcgccttcatacgtggcagtcaccccattttccctgcggggtgataatgacggtggcggtggtagcttttcgaccgccgatcagttggaaatggtcaccgagcttctgggaggcgatatggttaaccagtcgttcatttgtgatccagatgatgagactttcattaagaacataatcatccaagattgtatgtggagcggattctcggcagcagccaaacttgtgtcagaaaaacttgcgtcgtaccaggccgccagaaaggattccggatcgcccaacccggcccgagggcattcggtgtgtagtactagctccctttaccttcaggacctctccgccgccgcctccgagtgcatagatcccagcgtggtattcccctacccattgaacgactcctcctcacctaagtcatgcgcaagccaagattcgagcgcattctcaccaagctccgacagtctcttgtcgagcaccgagtcctcacctcagggctcgccagagcctctggtcctgcatgaggaaactcctccgacgacttcatcggactcagaggaggaacaggaggatgaagaggaaattgatgttgtctcggtggaaaagcggcaagccccaggaaaacggtcggaatccgggtccccatcggcgggaggtcactcgaagcctccacactctccattggtgctcaagagatgccatgtgagcactcaccaacacaattacgcagctccaccatcaactaggaaggattaccctgccgcaaagagggttaagttggattcggtgcgagtgctgcggcagatcagcaacaatcgaaagtgtacttcgcccagatcctcggataccgaagaaaacgtgaagcgcagaactcataacgtgcttgaaaggcagagaaggaacgagctcaagcggtccttttttgcacttcgggaccaaatccccgaacttgagaacaatgaaaaggctcctaaagtggtcattctgaagaaggcaaccgcatatatcctttccgtccaagctgagacgcagaagctgatttcagaaatcgatcttcttcggaagcaaaatgagcagcttaagcacaagctggagcaacttcggaattcatgcgca

SEQ ID NO: 17606 - DNA, 1317 bp, Artificial Sequence
  Description of Artificial Sequence: Synthetic coding sequence
atgcctctgaacgtgtccttcactaacaggaactacgatttggactatgactccgtccagccctatttctattgcgacgaggaggagaatttctatcaacaacaacagcaaagcgaacttcaaccccctgcaccttcagaggatatctggaagaaatttgaattgctgcccaccccaccactgtccccctcccgtcgcagcggcctgtgttcacctagttacgtggccgtgacccctttctctctccgtggtgacaacgacggaggtggtggctccttttccactgccgaccagttggagatggtaaccgaactcctcggcggtgacatggtgaaccaatcattcatttgtgatcctgacgacgagacattcattaagaacattatcattcaagactgtatgtggagcggcttcagtgccgctgctaagttggtgtccgagaagctggcttcttaccaagctgctagaaaagattccggatcacccaaccccgccaggggtcattccgtctgcagcacatcttcactgtacctccaggatctgtcagctgctgcctccgaatgcatcgacccatcagtggtgttcccataccctttgaatgattcaagctcccccaagtcctgcgcttctcaggacagctcagctttcagtccttcttctgattccttgctcagctccactgagtcatcacctcagggcagccctgagccattggttctgcacgaggagaccccccccaccacctccagtgattccgaggaagaacaggaagatgaagaggaaattgatgtcgtatctgtggagaagagacaagcaccaggtaagaggagtgaatctggtagcccctccgctggaggtcattctaagcccccccactcaccccttgttctgaaacgttgtcatgtgtccacccaccagcacaactatgctgcaccaccatccacaagaaaggattatccagcagcaaagagggtgaagttggattctgtaagagttttgagacagatctcaaacaatagaaaatgcacatcaccacgttcaagcgacaccgaggaaaatgtcaagagaagaactcacaacgttttggagcgccagcgtcgcaatgagctgaagaggagtttcttcgcactcagggatcaaatcccagagttggaaaacaacgaaaaggctcctaaagtagtgatcctgaagaaagcaaccgcatacatcctctccgttcaggccgagacccaaaaattgatctctgaaatcgatttgctgagaaagcagaacgaacaactcaagcacaaattggagcagttgcgtaacagctgcgct

SEQ ID NO: 17607 - DNA, 1317 bp, Artificial Sequence
  Description of Artificial Sequence: Synthetic coding sequence
atgccactaaacgtgtcattcacaaacagaaattacgatctggactacgactctgttcagccatacttttactgcgatgaggaagagaacttctaccagcagcagcagcagtcagaactgcagccccccgcaccttccgaggacatctggaaaaagttcgaactgctgccaacgcctcccctgtctccttcacgacggtccggactgtgtagcccgtcctatgtggccgttactcccttctctcttaggggcgacaatgatggcgggggaggctcattttccacagctgatcaattagagatggtgacggagctgcttggcggggacatggtcaatcagtcctttatttgtgatccggacgacgagactttcattaaaaacatcattattcaggattgcatgtggtccggatttagtgccgcggcaaaacttgtgtccgagaagttagcctcttaccaggctgcccggaaagactctgggtccccaaaccctgcccgcgggcatagcgtttgctcaacttcatccttgtatctccaggacctcagcgccgcagcctctgaatgtattgatcctagtgtagtgttcccctaccccctcaacgactccagcagcccaaaatcatgcgcctctcaagacagttcagcgttctccccctcatctgacagcctgctcagctcaactgaatcaagtccccagggcagccctgagcctctggtcttacatgaagagacacctccaaccacatcttctgactctgaagaagagcaagaagacgaggaggaaatcgacgtcgtttcagtggagaaaagacaggcccctggcaaacggtcagagagcggaagcccctcagccggaggtcactcgaagccaccccacagccccctggtgctcaagcgatgtcatgtcagcactcaccagcacaattacgccgctcctccatctactcgcaaagattaccctgctgctaaacgcgttaagctggatagcgtgcgagtgcttagacaaatctcaaacaaccgtaaatgcacatctccgcgcagcagtgacaccgaggaaaacgtgaaacgacgaacacataacgtactagagcgccagagaaggaacgagctcaagcggagctttttcgctctcagagaccagatccctgaactcgaaaataatgagaaggctcccaaagtcgtgatcctgaagaaggctactgcttacatcctcagtgtgcaggcagagacgcagaaattgatctccgagatcgacctgctgagaaagcaaaatgaacagcttaaacataagctggagcaactgcggaactcatgcgcg

SEQ ID NO: 17608 - DNA, 1317 bp, Artificial Sequence
  Description of Artificial Sequence: Synthetic coding sequence
atgccacttaacgtgtcgttcactaatagaaattacgaccttgattacgactccgtgcagccttacttttactgtgatgaggaagagaacttctaccaacaacaacagcaatcagagcttcagcccccggcccctagcgaggacatctggaagaagttcgagctgctgcctacgccgccactgtctccatctaggcgctccggcttgtgctcgccatcctacgtggccgtcactcctttctccctgagaggagataatgatggcggaggtgggagtttttcgaccgcagaccagctggaaatggtgaccgagttgctcggaggcgatatggtgaatcagtcatttatctgcgacccggatgacgagactttcattaagaacatcataattcaggactgtatgtggtccggtttttcagccgcagcaaaacttgtctcggagaagctggcctcctaccaagcagcacgtaaggattccggaagcccgaaccctgcaagaggccactcggtgtgcagcacttcaagcctctaccttcaggacctgtccgctgcagcatccgagtgcatagacccctctgtcgtctttccttatcccttgaatgacagcagctcgcctaaatcgtgtgcaagccaagatagcagcgctttctcaccttcgagcgattcacttctgagctccactgagtcctcgcctcagggatcgccagagccgttggtgctgcacgaagaaacccctcctaccacttcatccgactcggaagaggagcaggaggacgaggaagaaattgacgtggtgtccgtggagaagagacaagcacccggaaagagaagcgaatccggatcaccatcggcgggcgggcattccaaacctcctcattcaccgctggtgctcaagcggtgtcatgtgtccacccatcagcacaactacgcagctccgccctccactagaaaggattacccagcagcgaagagagtgaagctcgactcggtgcgagtcctgcggcagatcagcaacaaccggaagtgtacctcccctagatcgagcgacacggaagaaaatgtcaagcgtcgcacccataacgtgctggaaagacaaaggcggaacgaacttaagagatccttctttgcccttcgcgatcagatccccgaactggaaaacaacgaaaaggcacctaaggtggttattctcaagaaagcgaccgcctacatactttcggtgcaagccgaaacccaaaagttgattagcgaaattgacctgttgaggaagcaaaacgaacagttgaagcataaacttgaacagttgagaaattcgtgtgca

SEQ ID NO: 17609 - DNA, 1317 bp, Artificial Sequence
  Description of Artificial Sequence: Synthetic coding sequence
atgccattgaacgttagtttcactaatagaaactatgaccttgactacgactcagttcagccatatttctactgcgacgaagaggagaatttctatcagcaacaacagcagtcagaactgcagccgccagctccgagcgaagacatctggaagaaatttgaactcctgcccactcccccgctgagccctagccgcaggtcgggtctctgtagcccttcctacgtggcagttacacctttctctttaaggggagacaatgatgggggtggcgggagcttctccaccgctgaccagctcgagatggttacagaacttttagggggtgacatggtgaatcagtccttcatctgtgatcccgacgacgaaacctttattaagaatatcatcattcaggattgcatgtggagcggattcagcgctgcggccaaactagtcagcgaaaagctggcttcgtatcaagcagcccgaaaggacagtgggtcccctaaccccgctagagggcactccgtctgttccacatccagcctctatttgcaagatttgtctgccgcggcgagcgaatgtatcgatcccagcgtagtgttcccatacccgttgaacgattcctcctcgccaaaaagttgtgcctctcaggacagctcagctttttctccatcaagcgattcactgctaagttctactgaaagctccccccaaggctcgcctgaacccctggtattgcacgaggagacccctcctaccacaagctccgattctgaagaagaacaggaggacgaagaggagatcgatgtcgtgtctgtggaaaagaggcaggccccgggaaaacgatctgaaagcggtagtcctagtgccggagggcactcaaaaccgccacattcacctctcgtgctgaagagatgccacgtgtcaacgcatcagcataactacgcagcgcctcccagcacacggaaggattatcccgctgccaagagagttaaactggactccgtgagagttcttagacagatctccaataaccggaaatgcacctcccctagatcatctgacacagaagagaatgtgaaacgccgcacacacaacgtgctggagcggcagcgccggaacgagctcaagcggtcattctttgcactgcgggaccagatcccggagctcgaaaataacgagaaggctccaaaggttgtgatactaaaaaaggccactgcttacatcctgagcgtacaggccgaaacacaaaagctgatctctgaaattgacctccttagaaagcaaaacgaacagctcaaacacaagcttgaacagcttcgcaactcttgcgca

SEQ ID NO: 17610 - DNA, 1317 bp, Artificial Sequence
  Description of Artificial Sequence: Synthetic coding sequence
atgccactgaacgtgtccttcactaaccgtaactacgatctggattacgacagcgtgcagccatacttttactgtgatgaagaggagaacttttaccaacagcagcagcaatcggagctgcaaccgcctgcgccgtcggaagatatttggaaaaagtttgaactcctgcccactcctcctctgtcgccctccaggagatcgggactttgcagcccttcatacgtcgcagtcacgcctttctcactgagaggcgacaacgatgggggcggaggatcgttctcgactgcagaccaactggaaatggtgactgaactgctcggaggtgatatggtgaatcagagctttatctgtgacccagacgatgaaaccttcattaagaatatcatcattcaggattgtatgtggtcgggattcagcgccgccgcaaaactcgtgtccgaaaaactggcatcctaccaagcagcacgaaaggattccgggagcccaaatcctgcaagaggccacagcgtctgttcgactagctccctgtacctccaagacctgtcggcagctgccagcgagtgtatcgatccatcggtcgtgtttccatacccccttaacgactcctcatcccctaaatcatgcgcatcacaagattcgagcgcattttcgccatcgtcagattcacttctgtcatcaacggaatcgtcgccgcaggggagcccagaaccactcgtactccacgaagagactccgcctacgacctcgtccgattcagaagaagagcaagaggacgaggaagaaattgacgtcgtctcagttgagaagagacaggcaccaggaaagagatcagagagcggatcgccctccgccggaggtcatagcaagcccccacattcgccattggttttgaagaggtgtcatgtcagcactcatcagcataactacgccgctcccccaagcacccgtaaggattaccctgctgccaagcgtgtgaagctcgactcggtgcgggtgctgagacagatttctaacaataggaagtgtacctcgcctaggtctagcgacactgaggaaaacgtgaaacggcgcacccataacgtccttgagaggcagcggagaaacgaactgaagcgctccttcttcgcacttcgcgaccaaattcctgaactggagaataacgagaaggccccaaaggtagtgatactcaagaaagcaactgcatacattcttagtgtgcaagctgaaacccagaagctcatttccgaaatagacctcctgcggaaacaaaatgagcaactcaagcacaagctggagcagcttcgcaactcgtgtgcc

SEQ ID NO: 17611 - DNA, 1317 bp, Artificial Sequence
  Description of Artificial Sequence: Synthetic coding sequence
atgcccttgaacgtatcctttactaaccgaaactatgatctagactatgatagcgtgcagccctacttctactgcgatgaggaggaaaacttctaccagcaacagcagcagtccgaactgcagccccctgccccaagcgaagatatctggaagaagttcgaactgctgcctactcctcccctgagtcctagtcggcggtctggcctttgtagcccctcatacgtcgctgtgaccccgttttccctgcgtggagataatgacgggggcggagggtcattctccacagcagatcagttagagatggtgacagaactcctgggtggggatatggtcaatcagtcattcatttgtgaccccgacgacgagacctttatcaagaacattattattcaggattgcatgtggtccgggttcagcgccgccgccaagctggtcagcgaaaagcttgcgtcttaccaggccgccagaaaagatagcggctcacctaatccagctaggggccattctgtgtgttccacctcatcattatacctccaggacctgagtgccgcagcatccgagtgcatcgacccatcggtagtgttcccttatccactgaacgatagctcatctcctaaaagctgcgcttcacaagacagttcagctttctctccttctagcgattcacttctgagctctaccgaatcctcaccacaggggtcccccgagccactggtcctgcacgaggagacgcctccaacgacttcctcagactctgaggaagagcaggaggacgaggaggaaatcgatgtcgtcagtgttgagaaacgccaagcgcccggcaagaggagcgaaagcggcagcccctccgccggaggtcactcaaaaccaccgcacagcccactagtgctaaagaggtgccatgtgagcacacaccagcacaattacgcagcccctccaagtacccgtaaggactatcccgccgcgaagcgagtgaaactcgattccgtgagagtgcttaggcaaatttcaaataaccggaagtgcacgtcgccaaggagtagcgatactgaggaaaatgtgaagagacgtactcacaacgttcttgagcggcagcggaggaacgaactcaagaggagtttctttgctctaagggatcagatccctgaactggagaataatgaaaaagctcccaaggttgtcatattgaaaaaagctacagcttatattctgtccgtgcaggccgagactcagaaactgatctccgagatcgatctcctgcgcaagcaaaatgaacaattaaagcataaactagagcagctacgaaattcttgtgca

SEQ ID NO: 17612 - DNA, 1317 bp, Artificial Sequence
  Description of Artificial Sequence: Synthetic coding sequence
atgccactcaacgtctctttcaccaaccgcaattatgatcttgactacgacagtgtgcagccgtatttctactgtgatgaagaggaaaatttctatcagcagcaacagcagagcgagctgcagccccccgccccctccgaggacatctggaagaaatttgagttactgcccaccccacctctttccccaagcaggaggtccggcctgtgttccccatcatatgtcgcggtgacacctttctcgctgagaggagataacgatggaggcgggggctcgttttccaccgctgaccaactagagatggtcaccgaactactgggcggtgatatggtcaaccaaagctttatttgcgaccccgatgatgaaacctttattaaaaacattattatccaggactgcatgtggtctggattctcggcggccgcgaagctcgtctcagagaagctcgcatcataccaggcagcccgaaaggacagcggctcacccaacccagcgagaggtcactcagtgtgctctaccagtagcctctatctccaggacctttccgccgcggccagcgagtgcatcgacccctcagtggtgtttccataccccctcaatgatagctccagtccaaaatcctgcgccagccaagactcatcagcttttagtccgagcagtgattctttgctaagcagtactgagtcttccccacaaggctctcctgagccactcgttcttcatgaggagactcctcccaccacttcatctgatagcgaggaggagcaggaggacgaggaagagatcgatgtcgtgtccgtggagaaaagacaagctcccggcaagaggagcgaatcaggttccccctctgccggaggacatagcaagcctccacacagtcccctcgttctgaagcgatgtcatgtctcaacccaccagcacaactatgcggcgcccccatcaacccgaaaggattatcctgctgctaagcgggtaaagttagacagcgtgcgtgtgttgagacagatttctaataataggaaatgcacaagcccaaggagtagcgacaccgaagaaaatgtcaagcggcggacacacaatgtgcttgagcgtcagcgccgcaacgaactgaagcgatccttcttcgccctccgagaccagatccctgaactggagaataacgagaaggcccccaaggtcgtgatcctgaagaaggctaccgcttatatcctgtcagttcaggcagagacacaaaagctcatcagtgaaattgatctcctgaggaaacagaacgagcagctgaagcataaactggagcaactgcggaacagctgcgct

SEQ ID NO: 17613 - DNA, 1317 bp, Artificial Sequence
  Description of Artificial Sequence: Synthetic coding sequence
atgccactgaatgtcagcttcaccaatcggaactacgacttggattacgactccgtccagccctatttctactgtgacgaggaggagaacttctaccagcagcagcagcaaagcgaattgcagcccccggccccgagcgaggacatctggaagaaatttgaactgcttccaactccgcctctgtcgcctagcagaagaagcggtctgtgctccccatcgtacgtcgccgtcaccccgttttcactgaggggagacaacgacggaggaggcggatccttttcaaccgctgaccaactggaaatggtgactgaactgttggggggagacatggtgaaccaatccttcatctgcgatccggacgatgaaaccttcatcaaaaacatcattattcaagattgcatgtggtcgggtttttctgctgccgccaagctcgtgtcagaaaaactggcctcataccaagccgcccgcaaggacagcggatccccaaacccggcccggggacattcggtgtgtagcacctcctccctctacctccaagacttgtctgctgctgcgagcgaatgcatcgacccgtccgtggtgttcccgtacccgctgaacgactcgagcagccctaagtcctgcgcgtcccaagattcatcagcctttagcccatcctcggactcgcttctttcctccactgaaagctccccgcaggggtcgcctgagcccttggtgctgcacgaagaaactccaccgaccacctcaagcgatagcgaggaagagcaggaggacgaggaagagatcgacgtcgtttccgtggaaaaacgccaagcaccaggtaagaggtccgaatcgggatcaccctcggccggaggacactcaaagccgcctcattcgcctctcgtgctcaagaggtgccacgtgtccactcaccagcacaactacgcagcgccgccttcaacgagaaaggattacccagccgcaaagcgggtgaaactcgatagcgtgcgcgttttgcggcagatctcgaataaccggaagtgcacgagcccgagatcgagcgacaccgaagaaaacgtgaaaaggagaacccacaacgtcctcgagagacaacgcaggaacgaacttaagagatccttctttgccctccgcgatcaaatcccggagttggaaaacaatgaaaaggcaccaaaggtggtgatcctcaagaaggcaactgcttacattctctcggtccaggctgagacgcagaagctgatcagcgagatcgacttgctgcgcaagcagaacgaacaattgaagcacaaactcgagcagcttcgcaactcgtgcgcc

SEQ ID NO: 17614 - DNA, 1317 bp, Artificial Sequence
  Description of Artificial Sequence: Synthetic coding sequence
atgccactcaacgtctcatttaccaaccgcaactatgacctagactacgacagtgtgcaaccatatttctactgcgatgaggaagagaacttttaccagcagcagcagcagtctgagcttcaaccccctgctccctccgaggatatctggaagaaattcgagctcctacccacacctccactgtctcctagccgcaggtcagggttgtgcagtccgagctatgtggccgtcacccccttttcactgcgtggggacaacgatggcggtggaggaagtttttcaacagctgaccaactggaaatggtgaccgagctccttggcggggacatggtgaatcagagctttatatgtgaccctgatgacgaaaccttcatcaagaacataatcatacaggactgtatgtggtcgggtttcagcgccgccgccaagctggtttcagagaagctcgccagctaccaagctgcccgaaaggattcggggtccccaaatcccgcgagaggacattcagtctgctcgactagcagcctgtacctgcaggacctgagcgccgctgccagcgaatgtatcgatccgtcagtggtattcccctatcctctgaatgatagctcgtcgcccaagagctgtgctagccaggactctagcgccttcagtccgtcctctgatagcctactgagctctactgagtcaagtccacaaggctctcctgaaccgctggtgctgcatgaggagactccacccaccacctctagcgatagtgaggaagagcaagaagacgaagaggagatagacgtagtgtctgtcgaaaaacggcaagctccaggaaagcgatcagaaagtggtagtcctagtgccggtgggcacagtaagcctccgcacagtcctctagtcctgaaacggtgtcacgtctctacacatcagcataactacgctgctccaccgtccactcggaaagactaccccgcagcaaagagggtgaagctggattctgtacgtgtcctccggcagatttctaataatcgaaaatgcaccagccctcgctccagtgatactgaggaaaatgtgaaaaggcggacccataacgtgcttgagcggcagcgtaggaatgaactgaaaaggtcattcttcgcactgcgggatcaaattcccgagctcgagaataacgaaaaggccccaaaagtggtgattttgaaaaaggcaactgcctacattctgtcagttcaggcggaaactcagaaactgattagtgagatcgacctgctccgcaagcaaaatgagcagctgaagcataagctggagcagttgcgcaatagctgtgcc

SEQ ID NO: 17615 - DNA, 1317 bp, Artificial Sequence
  Description of Artificial Sequence: Synthetic coding sequence
atgccgcttaacgtgagctttaccaatagaaactacgatctggactacgactcagttcagccttacttttactgtgatgaagaggagaacttctaccaacaacagcaacaatcggaactgcagcctccagcaccctcggaggatatttggaaaaagttcgagctgttgccaacgccacctctttcgccttccagacggtcgggcttgtgctccccttcgtacgtggcagtcaccccgttttcactccgcggtgacaacgacggaggaggtggttcctttagcaccgcggatcagctggaaatggtgactgagcttcttggtggggatatggttaaccagtccttcatctgcgaccctgatgatgaaacctttatcaaaaacatcattattcaagattgtatgtggagtggcttttctgcagcggcaaagctcgtcagcgagaagctggccagttaccaagcggctaggaaagatagcggatcgcccaatcctgcgcgcggtcatagtgtctgttcgacctcaagcctttaccttcaggatctgtcggcagcagcatccgaatgtattgatccctcggtggtgttcccctatcctctcaacgacagctcgtcgcctaagtcatgtgcaagccaagatagcagcgcattcagcccatcctccgattcattgcttagctccactgaatcctctccccaaggctcaccagagcctctggtcctgcacgaagaaactccaccaaccacgtcatccgactcagaggaggaacaggaagatgaagaagaaatagacgtcgtgagcgtggaaaagcggcaagcaccgggaaagcgatcagaatccggcagtccctcggcaggagggcattctaaacccccgcacagcccacttgtgctgaagcggtgccatgtctccactcatcagcataactacgcagctcctccatccacccggaaagattaccctgcagctaagcgcgtgaaactcgattcagtaagggtgctccgccaaattagtaataacagaaagtgtacctctccgagaagctctgataccgaggaaaatgtaaagcgtagaactcataatgttcttgaaagacaacgtagaaacgaactgaagcgatccttttttgcccttagggaccagatcccagagctggaaaacaatgagaaggccccaaaagtggtgattctcaagaaggccactgcctacatactgtctgtgcaagccgaaactcaaaagctcatttcggagatcgacctcttgcgaaaacaaaatgaacagctgaagcacaagctcgaacagctccggaactcctgcgca

SEQ ID NO: 17616 - DNA, 1317 bp, Artificial Sequence
  Description of Artificial Sequence: Synthetic coding sequence
atgccattaaacgtaagtttcaccaatcggaactacgaccttgattatgacagtgttcagccctacttttactgtgacgaagaagagaacttctatcagcaacagcagcagtccgagctgcagcctccagctccatcggaggacatttggaagaaattcgaacttctgccaaccccgccactgagcccctcccgacgcagcggcttatgttctcccagctacgtggccgtgacccctttctctttgcggggcgacaatgatggcgggggaggcagctttagcacagcagaccagttagagatggtcacagagcttttgggaggtgatatggtaaaccagagctttatatgcgaccccgacgacgaaacctttatcaaaaacatcattatccaggattgcatgtggtctggcttctccgcggcagccaagctggtgtcggagaaactagcctcttatcaggctgcgcgcaaagattccgggagccccaaccccgcgagaggacactccgtttgcagcacctcctccttgtacttacaggatttgagtgccgcggcctcagagtgcatcgatccctccgtggttttcccctatcctctcaacgactccagctcccccaagtcttgtgctagccaggatagtagtgctttctccccttccagcgactcactgctgagctctactgaatccagcccgcaaggcagccccgagccattggttctacacgaggagaccccaccaactacaagcagtgactccgaggaggagcaggaagatgaagaagaaattgacgtcgtgagtgtcgagaaacgacaagcacccggcaagcggagcgaatccggtagtccctccgcaggcggacactccaaaccaccgcacagtccattggtcctgaagagatgtcatgttagcacacaccaacataactatgctgcgcctcccagcacaagaaaagactatccggcggccaagagggttaagctggactctgtcagagtattacgccaaattagcaacaataggaagtgtacctctccccgcagttccgacaccgaggaaaatgtgaagcggagaacacataacgtcctggaacggcagaggcgaaacgaactgaagcgctccttctttgctttaagggaccagatacccgaattagagaacaacgagaaggcacccaaagtggtgatactgaaaaaagccacagcttacatcctaagcgtccaggctgaaacacagaagctgatcagtgagatcgatctgctgagaaagcagaacgagcagctcaaacataagctggagcagctccgtaatagttgcgct

SEQ ID NO: 17617 - DNA, 1317 bp, Artificial Sequence
  Description of Artificial Sequence: Synthetic coding sequence
atgccgctgaatgtgtccttcactaatcgtaactacgatctggactacgactccgtacaaccctacttctactgtgatgaggaggagaacttctaccaacagcagcagcaatcggagctgcagccaccagctccgagcgaagatatctggaaaaagtttgagcttctgccaactccgcctctctcaccgagtaggagatccggactgtgctccccgagctacgtcgcggtgacgcctttttctctgcggggcgataatgatggaggaggaggtagcttctccaccgcggaccagctcgaaatggtgaccgagctcctgggaggagacatggtcaaccagtcgttcatttgcgacccggatgacgagactttcattaagaacatcatcatccaggattgtatgtggagtggtttttccgcggccgccaaattggtgagcgaaaaactggcgtcatatcaagccgcgcgaaaagattccggatccccgaaccctgcccgcggccatagcgtgtgctccacttcttctctgtatctgcaggaccttagcgcggcagcctcggagtgcatagacccgtcagtggtatttccatacccgctcaacgactcttcgtctccgaagtcttgcgcatcgcaggattcaagcgcattcagcccgagctcggattcacttctctcctcgaccgagagctcaccacagggatccccggaacctttggtgctccatgaggaaacccctccaactacctcctcggactccgaagaagagcaggaggacgaggaagagatcgacgtggtcagcgtggagaaacggcaagcacccggcaagaggagcgaatcggggtcgccaagcgccggcgggcattccaagccgccccacagtcccctggtcctgaagcgctgtcacgtcagcacccatcagcacaattacgccgctcccccttcaacccggaaggactacccagcagcaaagagagtcaagctcgatagcgtgagggtgctgaggcaaatctcgaacaatagaaagtgcacttcgccccggagctctgacacggaagaaaatgtgaagcgtcggacccacaatgtgctggagcgccaaagacgcaacgaactgaagcgctcattcttcgccctgagggaccaaatcccagaattggaaaacaacgaaaaggctcccaaagtcgtgatcctgaagaaagccaccgcttacattctgtcggttcaggcggagacgcagaagctgatctccgaaatcgatcttttgagaaaacaaaacgagcagttgaaacacaagctggagcagcttcggaactcctgcgca

SEQ ID NO: 17618 - DNA, 1317 bp, Artificial Sequence
  Description of Artificial Sequence: Synthetic coding sequence
atgccgcttaatgtatcctttaccaacaggaattacgatctcgactatgattcggttcagccctacttttactgcgatgaggaagaaaatttttatcagcagcagcagcagagcgagttacagccgcctgctccatccgaggacatctggaaaaaatttgagcttcttccaacaccaccgctctccccttcgaggcggagtgggctctgctctccatcctacgttgcagtcacaccatttagtctccgtggtgataatgatggcgggggaggcagttttagcaccgctgaccagctggaaatggttactgagttgttgggaggagatatggtgaaccagtcctttatctgtgatcccgatgacgagaccttcattaagaatattatcatccaggattgtatgtggagcggatttagcgccgcagccaagctggtgagcgaaaaactggcgagctaccaagcggcaaggaaagattcgggcagcccaaaccccgcgcgcgggcatagtgtgtgctccacatcgtctctttacttacaggacctgtctgccgctgctagcgaatgtatagatccgtcagtggtgttcccttacccactcaatgattcctcctccccgaaaagctgtgcgagccaggactccagcgccttctctccaagttccgactcccttctgtcaagtacggaatccagcccacagggctcccccgagccattggtgctgcacgaggaaacacctcccactaccagcagtgactctgaggaggaacaggaggacgaggaggagatcgatgtggtttccgtcgagaaaaggcaggctccagggaagcgttccgagtccggcagcccttcggctggtggacattccaagccccctcactcaccattggtccttaaacgatgtcacgtttcgacccaccagcataattacgccgcccctcctagtaccaggaaagactaccctgccgccaagcgggtgaaactggacagtgtgcgagtacttagacagatctcaaataacaggaagtgcacgtctcccagaagctctgatacagaagaaaacgtgaaacggcgcacccacaatgtgttagagcgccagcgacgaaacgagcttaagcgcagtttttttgcactgagagatcaaatccccgagttagaaaacaacgagaaggccccaaaggtggttattcttaaaaaggcaacggcatacatcctgtcagtccaggcagaaactcagaagttaattagtgaaatagaccttctccggaaacagaacgagcagctgaagcacaaactggaacagctgaggaacagttgtgct

SEQ ID NO: 17619 - DNA, 1317 bp, Artificial Sequence
  Description of Artificial Sequence: Synthetic coding sequence
atgcccctcaacgtcagttttaccaacagaaactatgacctcgattatgactcggtgcaaccgtacttctactgtgatgaggaagaaaacttttaccagcaacagcaacaatccgagttgcagccccccgcccctagcgaggatatctggaaaaagttcgagctcctgcccacacccccactcagcccttcccggaggtcaggcctctgttccccaagttatgtggccgtgacgcccttcagcctccgtggggacaacgatggaggcggaggatctttcagtaccgctgaccagcttgagatggtcaccgagctgctcggaggagacatggtgaatcagtcctttatctgtgacccagatgatgaaacattcataaaaaacatcatcatacaggactgcatgtggagtgggttctccgctgcggccaagcttgtgagcgagaaactggcttcctaccaagccgcgcggaaagactccgggtctccaaaccctgcgcggggccacagcgtctgttccacttcttcgctttatctgcaggatctctccgccgccgcttcagaatgtattgacccaagtgttgtgtttccgtaccctctcaatgactcttcctcccctaagtcatgcgcttctcaggacagttctgcgttcagcccttctagtgactccttacttagtagtacagagagtagccctcagggctccccagaaccactcgtcctccacgaggagaccccccctacaacaagctctgactcagaagaggagcaggaagatgaggaggagatcgatgtggttagcgttgagaagcgccaggccccaggcaaaagatcggagtctggctcaccaagtgctggagggcactcgaagccgccacattcccccctggtactgaagagatgtcacgtgtctacacatcagcacaactatgccgcccctccttctacaaggaaggactaccctgctgccaaaagggttaaacttgactctgtcagggtgctcaggcaaataagcaataataggaagtgtacttctcccaggtcttctgacactgaggagaacgtgaagaggcgcactcacaacgttctggagcggcagcgtagaaacgagctgaagaggtctttctttgccttgcgcgaccagattccagaactggaaaacaacgagaaagccccaaaagtggtcattctgaaaaaggccactgcttatatcctgtctgtgcaggcggagacacagaaattgatctctgaaatagaccttctccgaaagcaaaacgaacagttaaaacacaaattagagcagctgcgtaactcatgtgcg

SEQ ID NO: 17620 - DNA, 1317 bp, Artificial Sequence
  Description of Artificial Sequence: Synthetic coding sequence
atgccgttgaatgtgagtttcacaaaccgaaattatgacctggactatgatagtgtccagccatatttctactgcgatgaggaggagaatttctatcagcagcagcagcagtctgaactgcagccacccgcaccatccgaagatatatggaagaagttcgaactcctgcccaccccaccgctgtctcccagccgcagatctggactctgttctccttcttacgtggcagttacgcccttttcgctgcggggggacaacgatggtggtgggggcagtttctcaaccgccgatcagctggaaatggttacagagctgttgggaggcgatatggtgaaccaatcatttatctgcgacccagatgacgaaacttttatcaagaatatcatcatccaggactgcatgtggtccggcttctcagctgccgcaaagctggtgagcgaaaagttagcttcatatcaggccgcccgcaaggacagcgggtcccctaatcccgctcggggccactccgtgtgtagtacaagctcactgtacctgcaggatttgagcgcagctgcctctgaatgcattgatccaagcgtggtgttcccttacccactgaatgacagctcatcacctaaatcatgtgcttcccaggactccagcgcgttcagcccctcctctgacagcttgctgtcttccactgagagtagtccacagggatctcccgagccgctggtgctgcacgaggagacgccccccacaacctccagtgacagcgaggaggaacaagaggatgaggaggagatcgacgttgtgtctgtggagaagagacaggcccctggcaaaagatctgaaagtggctccccctcagcaggggggcactcaaagcctccacactctccattagtgctgaagaggtgtcacgtgtctacccaccagcataactatgcagcaccaccctcgactagaaaagattatccagccgctaaacgggttaagcttgacagtgtcagagttttaaggcaaatctctaataataggaagtgcactagcccgcgtagctctgacacagaagagaacgtgaagcgccggacccataacgtcctcgagcggcagcggaggaatgagctgaaaaggtcctttttcgcgctgagagatcagatcccagagcttgagaataacgaaaaagcccctaaagtggtaattctgaagaaagcgaccgcttacatactaagtgtgcaggcagagacccagaagttaatttccgaaatcgatctcttacgcaagcaaaacgaacagttaaaacacaaactggagcagctccgcaatagctgtgca

SEQ ID NO: 17621 - DNA, 1317 bp, Artificial Sequence
  Description of Artificial Sequence: Synthetic coding sequence
atgccacttaacgtgagcttcaccaacagaaattacgacctggattacgacagcgtgcagccttacttctactgtgacgaagaagaaaacttttaccagcaacagcaacagtccgagcttcagcctccagctccctcagaggacatatggaagaagtttgagcttcttccaaccccgcctctctcgccatcgagaaggtcgggactgtgctccccatcgtatgttgcagtaacgccttttagcctgcggggagacaatgacggtggaggtggatccttttcaaccgcagaccaacttgagatggtcactgagctgcttggcggcgatatggtaaatcaatcattcatctgcgatccagatgatgaaaccttcataaagaacattatcattcaggattgtatgtggtccggttttagcgcagcagcaaagctggtgtccgaaaaacttgccagctaccaggcggcaagaaaggattccggtagcccgaatccagcgcggggacattcagtgtgctcaacctcatccctgtacttgcaggacctctcggcggcagcctcggaatgcattgatccatcagtggtttttccatatcctcttaatgattcatcgtctcctaagtcatgtgcctcacaagattcgtccgctttttccccctcctcagactccctgctgtcgagtaccgagagttcacctcaagggtcgcccgaacccctcgtcctccacgaggaaactcccccgaccacttcatcggacagcgaggaagagcaagaggatgaagaagagattgatgtggtgtcagtcgaaaaaaggcaggcacctggcaagcgtagcgaatcgggctcgccctcggcagggggacactcgaagcctcctcactcgccgcttgtgcttaaaaggtgtcatgtgagcactcatcaacataactacgccgcccctccgagcaccagaaaagattaccccgcagccaagcgtgtgaagttggattcagtccgggtgttgagacaaatttccaacaaccgcaaatgtaccagcccccgatcaagcgatactgaagaaaacgtgaagaggcgcactcataatgtactggaacgacaacgccggaacgaactcaagagaagtttctttgcactgcgcgatcagatcccagaactggaaaacaacgaaaaggcacctaaggttgtgattctgaagaaagcaactgcatacattctgtcagtccaagccgaaacgcagaagctcatctccgagatcgatctgctgcggaaacaaaacgaacaactcaagcataagctcgagcaacttagaaattcctgtgca

SEQ ID NO: 17622 - DNA, 1317 bp, Artificial Sequence
  Description of Artificial Sequence: Synthetic coding sequence
atgcctctgaacgtatcttttaccaaccggaattacgaccttgactatgattccgtgcaaccctacttctattgcgatgaggaggagaatttttaccagcaacagcagcaaagcgaactccagccaccggcgccatccgaagacatttggaagaagttcgagcttctgcccactcccccactgtcgccttccaggcgttccggcctttgttcccctagttacgtagctgtcactcccttttcccttagaggcgacaacgatggtggaggaggcagtttctcgacagcggaccagctcgaaatggtcactgaactgttggggggtgacatggtcaatcagagcttcatatgcgaccctgatgacgagaccttcataaagaacataattatccaggactgtatgtggagcgggttctctgccgccgctaaacttgtttccgagaaactcgcaagttatcaggctgccagaaaagattccgggtcccccaatccagcaagaggacatagcgtttgctcgacgagcagcctctacctccaggacttaagcgcagcagcctcagagtgcatcgatccttcggtcgtattcccttatccgttaaacgacagcagttcccctaagagttgcgcatctcaagactccagtgccttctctccctcttcagacagtctgctttcctcgacagagtctagcccgcaggggtctccagagccgttggtcttgcatgaagaaacgcctcccactactagttcagactccgaggaagagcaggaagacgaggaagagatcgacgtggtcagcgttgaaaagcggcaagcccctggaaaacgctctgagtctgggtccccctccgccggtggccactccaagccgccacactcccctcttgtcctgaagcgctgtcacgtgagcacccaccagcataattacgcagcaccacctagcacaagaaaggactatcccgccgccaaaagggttaaattagactcggtcagggtgcttcgtcagatttctaacaatcgaaagtgtacctccccaaggtcttccgacactgaggagaatgtgaaacggcgtacccacaacgtattggagagacagagacggaacgagctgaagagatcttttttcgccctccgcgatcaaatccctgagctggagaataatgagaaggcgcctaaggtagtcatcttaaagaaggccactgcctatatcttgagtgtgcaggctgaaacccagaaacttataagtgaaatcgatctgctgagaaaacagaatgagcagcttaaacataaactggagcagctgaggaatagctgtgct

SEQ ID NO: 17623 - DNA, 1317 bp, Artificial Sequence
  Description of Artificial Sequence: Synthetic coding sequence
atgccattgaatgtgtcattcactaaccgcaattacgacctggattacgatagtgtgcagccttacttttactgcgacgaagaggaaaacttctaccagcaacagcagcaatccgagttgcagccgccggcaccatcagaagatatctggaagaaattcgagttgttgcccactccacccctgtccccatcccggaggtcgggcctgtgctccccgtcctacgtggccgtgactccattctcgctgaggggtgataacgacgggggcggaggttcgttctccaccgctgaccagcttgaaatggttaccgagctcctgggtggcgatatggtgaaccaatcgtttatctgcgaccctgatgacgaaaccttcatcaagaacattatcatccaggactgtatgtggagtggattctcggcggccgccaaactggtgagcgagaaactggcctcgtaccaggccgccagaaaggactccggcagccctaaccctgcaagggggcactcagtatgctcgactagctcactgtacctccaggacctgtcggccgctgcctccgaatgcatcgacccgagcgtggtctttccgtacccgctgaatgattcgtcctcaccgaagagctgtgctagccaagacagctcagctttttcgcctagcagcgacagccttctctcatcgaccgaatcgtcaccacagggtagccctgaaccgctcgtgctccatgaagaaaccccgccgacgaccagcagtgactcagaggaagaacaggaagatgaagaagagatcgatgtcgtgtcggtcgaaaagagacaggcgccgggcaagcgctcggagagcgggtcgccgtccgcaggcggacattccaaaccaccgcacagcccgctggtgctcaagaggtgccatgtctcaacccatcaacacaattatgcggcgccgcccagcactcgcaaagactacccggcagccaaaagagtgaaacttgattcagtgcgggtgctgcgccagatcagcaacaatcgcaagtgcacttcccctagatccagcgacactgaagaaaatgtgaagcgccgaacccacaatgtgttggagcggcagcgccggaacgagctgaagcgctcgttcttcgcacttagagatcaaatccctgaattggagaacaatgaaaaagccccgaaggtggtgatcctgaaaaaggctactgcttacattctgagcgtgcaggctgagacgcaaaaattgatttctgagattgacctcctgcggaaacagaacgaacaactgaagcacaagctggaacaattgcggaatagctgtgcc

SEQ ID NO: 17624 - DNA, 1317 bp, Artificial Sequence
  Description of Artificial Sequence: Synthetic coding sequence
atgcctctgaatgtgtcatttacaaacaggaattacgacctggattacgactctgtacagccatacttttattgtgatgaggaggaaaatttttatcagcagcagcagcagtcagagctgcaacctccagcaccttctgaggatatttggaagaagtttgaactgttgccaactcccccactgtccccctctaggcgttcaggactctgttctccttcgtacgtggcagttacccctttttcactgcgaggggataatgatggtggcggcggtagtttcagtacagctgaccagttggagatggtgaccgagctgttgggcggcgatatggtgaaccagagctttatttgcgatcccgacgatgaaaccttcattaagaatatcatcatacaagattgcatgtggagcgggttttctgccgccgccaagctagtgtccgaaaagcttgcgagctatcaggctgcaaggaaggatagtggcagtcctaatcccgcccgaggccatagtgtttgttctacatcatcgctgtacttacaagatctcagcgccgcagccagcgagtgcatagatccctccgtggtgtttccctatccacttaacgacagctcatcgccgaagtcttgcgcttcccaggactcaagcgcattcagtcctagctcagacagccttctcagtagtaccgagtcaagtccacaggggtcgccagagcctttggtgttgcacgaggagaccccccctaccacatccagcgattccgaagaagaacaggaagatgaagaggagatcgacgtcgtgtcagtagagaagaggcaggctcctggcaaacggtccgagtccggatccccatccgcaggcgggcattctaagcctcctcactcgcccctggtcctgaaaaggtgccatgttagtactcatcagcataactatgccgctcctcctagcacccgtaaggactaccctgccgccaagagagtaaaattagactctgtgcgtgttttgagacagattagtaacaacagaaagtgtacgagcccacgctcatctgacaccgaggaaaacgtgaaacggaggacccacaacgtgctggagagacaaagacgaaatgagctcaagcggtcattcttcgccctgagagatcaaatccccgaactggaaaataacgaaaaagcccccaaggtggtcatccttaaaaaggccaccgcatatatcctatcggtgcaggctgagactcagaagctcatcagtgagatcgacctcctgcggaagcaaaacgaacagctgaagcataaactcgaacagctgcgcaactcgtgtgcc

SEQ ID NO: 17625 - DNA, 1317 bp, Artificial Sequence
  Description of Artificial Sequence: Synthetic coding sequence
atgccgctgaatgtgagcttcactaaccgcaactacgatctggactacgattcagttcaaccgtacttttactgtgatgaggaagagaacttctaccaacaacagcaacagtcagaattgcagccaccagctccctcggaggatatttggaagaaattcgagctcctgccgactccgccacttagcccttcgcgccgctcaggactgtgttccccgagctacgtcgccgtgactcccttctctctgcgcggggacaacgacggtggcgggggctccttttctaccgccgaccaactggagatggtgaccgagttgctcggaggggacatggttaatcagtccttcatctgcgaccctgatgacgaaacgttcatcaagaacatcatcattcaggactgcatgtggtcgggattcagcgcagccgccaagctcgtaagtgaaaagctggcctcctaccaggcggctcgtaaagactcgggatctcctaacccagcgcgcggacatagcgtctgcagcacttcatccctctatttgcaggacttgtccgcagccgcttcggagtgcatcgacccatccgtcgtgtttccatacccgcttaacgatagctcttcgccaaaatcgtgcgcgagccaggattctagcgccttttccccgagctccgattcgctgctctccagcaccgagtcatccccgcaggggagcccggaaccgcttgttctgcacgaagaaaccccgcctaccacctctagcgactccgaagaagagcaggaggacgaagaggaaatcgatgtggtgtcggtggaaaaacggcaggcgccaggaaagcgcagcgaaagtggcagcccctcagccggaggccacagcaagcccccgcattccccgctggtgttgaagcggtgccatgtgtccactcaccaacacaattacgctgccccaccaagcaccagaaaggactaccccgcagccaagcgcgtcaaactcgattcggtgagagtgctgcggcagatctctaacaatcgaaaatgcacttcacctcgttcttccgatactgaagaaaacgtgaagcggagaacccacaacgtccttgaaagacaaagacggaacgaactcaaacgatccttcttcgctctgcgcgatcagatccctgaactggagaataatgagaaggcgccgaaagtggtgattttgaagaaagccaccgcctatatcctgtcagtccaggcagaaacgcaaaagctgatctccgagatcgacctgctcagaaagcagaacgagcagttgaagcacaagctggagcaactgagaaactcctgtgcc

SEQ ID NO: 17626 - DNA, 1317 bp, Artificial Sequence
  Description of Artificial Sequence: Synthetic coding sequence
atgcccttaaacgtgagctttaccaatcgaaactacgatctcgactacgacagcgtgcaaccctatttttactgtgatgaggaagagaacttctaccagcagcagcaacagtccgaattacagccaccagcccctagtgaggatatctggaagaaatttgagctgctgccaacccctcctctaagcccatctcgccggagcggcctgtgctcaccatcttatgttgcagttacccccttctcactgcgcggagacaatgatggagggggtgggtctttttccacagctgaccagctcgagatggtcactgagctgctagggggagatatggtgaatcagtcatttatctgcgaccctgatgacgaaacttttatcaagaacatcattattcaagactgtatgtggtctggcttttctgctgccgctaagctcgtgagtgaaaagctagcttcttatcaggctgcccggaaagattctggatccccaaatcccgcccgcggccatagcgtttgctctacaagcagtttgtatctccaggacctgagtgcagcagccagcgaatgtattgatcccagcgtggtgtttccttaccctctgaacgatagttcctctcctaagtcctgtgcttcccaggactccagcgcattcagcccatctagtgatagtctgctcagtagtactgaatcttctcctcagggcagcccagaaccactagtgctgcacgaggaaactcctcccacaacctccagcgatagcgaggaagaacaggaggatgaagaagaaattgatgtggtgtcagtggagaagcggcaggctccaggcaaaagaagcgagtctggctctccatctgccggcggccacagcaagccaccccactccccacttgtgctgaagagatgtcatgtctctacccaccaacacaactacgctgctccaccatctactcgcaaagattaccctgctgcaaaaagggtgaaactagattctgtgcgggtgctgaggcagatcagcaataatcggaaatgtaccagcccaagaagttctgacactgaggaaaacgttaaacggcgcacacacaacgtgttggagcgacaacggcgcaacgaactgaagcgcagctttttcgccctgagagaccagatcccagagctggaaaataacgagaaagcccccaaggtggttatactgaagaaggcaaccgcttatattctgagcgtgcaagctgagacccagaagcttattagcgaaatcgatctgctccgtaagcagaatgaacagctgaaacacaaattagagcagctgaggaattcctgcgcc

SEQ ID NO: 17627 - DNA, 1317 bp, Artificial Sequence
  Description of Artificial Sequence: Synthetic coding sequence
atgccgctgaatgtctccttcaccaaccgcaactacgatttggactacgattcggtgcaaccgtacttttactgcgacgaggaagaaaacttctaccagcagcaacagcagtcggagctgcaacccccagcgccatccgaggatatatggaagaaattcgaactgttgccaaccccgccgctgtccccttcacgaagaagcggactttgctcgccgtcctacgtggccgtgactccgttctccttgcggggagacaatgacggaggagggggatccttctccacggcagatcagttggaaatggtgaccgagctgctgggcggagacatggtcaatcagtcatttatctgcgaccctgacgatgagacgttcatcaaaaacatcatcatccaggattgcatgtggtcgggattctccgcagccgccaaattggtgtcggagaagctcgctagctaccaggcagcgcgcaaggactctggaagcccaaacccggctcgcggacactccgtctgctcgacttcatcgctgtacctccaggacctgtccgctgccgcgtcagaatgcatcgatcctagcgtcgtgttcccgtacccgctgaatgattcctcatcccctaagtcgtgtgccagccaggactcctcggcgttctccccatcgagcgactcgcttttgagctccactgaatcgtccccgcagggatcgcccgaacccctggttcttcacgaggagacgcccccaaccacctcgagcgattcagaagaggaacaggaggatgaagaagaaatcgacgtcgtgtccgtcgaaaagcggcaggcacccggcaaacggagcgaatcaggttccccgtcggccggagggcattccaaaccacctcattcccccctggtgttgaaacgctgtcacgtgtccactcaccagcacaactacgctgcaccacctagcacccgcaaagactacccagctgcgaaaagggtgaaactggacagcgtgagggtactgcggcaaatctctaacaaccgcaagtgcacctcgccgcggtcctccgacactgaggaaaatgtgaaacggcgcactcacaacgtcctcgagcgccagaggagaaacgagctgaaacggtccttttttgctctgcgtgaccaaattccagaactggagaataatgagaaggcccccaaggtcgtgattctgaagaaagccactgcctacatcctgtcagtgcaagccgaaacccagaagctcattagcgaaattgacctcctgagaaagcaaaacgagcagctgaagcacaaactggaacagctgcggaattcctgtgct

SEQ ID NO: 17628 - DNA, 1317 bp, Artificial Sequence
  Description of Artificial Sequence: Synthetic coding sequence
atgccgctgaacgtcagctttaccaatcggaattacgacctcgactatgattcagtgcaaccctacttctactgcgacgaagaagaaaacttttaccagcaacagcagcagtcagagctgcaaccgccagcaccgtccgaggacatctggaagaagttcgaactcctccccacccctccactgagcccatcaagacgaagcggactctgttcgccttcctacgtcgccgtgactcctttctcgcttcggggcgataatgacgggggaggaggatcattctcaaccgctgaccagctcgaaatggtgaccgagctcctgggcggagacatggtgaatcagtcatttatctgcgacccagacgatgagacttttatcaagaacatcatcatccaagattgtatgtggtcgggcttctcggcggcagcgaaattggtgtcggaaaaacttgcaagctaccaagctgcacggaaggacagcggctcaccgaacccggcccgcgggcattccgtctgctcaacgtccagcctctaccttcaagatctctcagcagccgcgagcgagtgtatcgacccttcagttgtgttcccgtaccctctgaatgacagctcgtcgccaaagtcatgcgcctcacaagatagctcggctttcagcccctcctccgattctctcctctcgagcaccgaatcctcgcctcagggatcgccggaacccctcgttctgcatgaggaaactccgccgacgacttcttcagactccgaagaggaacaagaagatgaggaggagattgatgtggtgtccgtggagaagcggcaggcgccgggcaaacgctccgaatccggatcgccgtcggccggtggccattcgaaaccaccgcattccccgctggtgcttaaacggtgtcacgtgtcaacccaccaacacaattacgctgccccaccgtcgactcgcaaggattaccctgccgcaaagcgcgtgaagctggactcggtgcgggtcctccggcagatttcgaacaacagaaagtgcaccagcccgagatcatcagataccgaagagaacgtgaagcggagaacccacaatgtcttggagcgccaaaggcgcaacgagctgaagcgctccttcttcgctcttcgcgaccaaatcccggaactggaaaacaatgagaaagcccccaaagtggtcatactgaagaaggcgactgcgtacatcctgtccgtgcaggcagaaactcaaaagctcatctcggagattgacttgctccggaagcagaacgaacaactgaagcataaactcgagcagcttcggaactcgtgtgct

SEQ ID NO: 17629 - DNA, 1317 bp, Artificial Sequence
  Description of Artificial Sequence: Synthetic coding sequence
atgcccttgaatgtaagctttacaaacagaaattacgaccttgattacgactctgtccagccgtacttttattgtgacgaggaggaaaatttctatcagcagcagcagcaaagtgagcttcagcctccagctccttcagaggacatttggaagaaattcgagctgttgcccactcctccattgtctccttccagaaggtccggactttgttctcccagttatgtggcagttaccccttttagcttgagaggcgataatgatgggggaggcggcagtttctccaccgcggatcagctggagatggtgaccgagcttctcggaggagacatggtcaatcagagtttcatatgtgaccccgatgatgagacattcatcaagaatattatcatacaagattgcatgtggagtggattctctgcagccgccaagctcgtttccgaaaagctggcatcttaccaagctgcacggaaggactcaggatctcccaacccagccagaggccatagcgtctgcagcaccagcagcttgtatctgcaggacctctctgcagcagcctctgaatgtattgatccctctgtggtctttccttaccccctgaatgactcttccagccctaagtcctgtgcttctcaggacagcagtgccttcagcccttcctccgactctcttctctcctccactgagagctcacctcagggctccccagaacctcttgtgctccatgaggagacccctcccacaacttctagtgatagcgaggaagagcaggaagacgaggaggagatcgacgttgtcagtgtggagaagcgacaggcgcccggaaagagatccgagtccgggagtccgtctgctggaggccacagtaaaccaccgcatagccctctcgttctgaaacgctgccatgtgtctacccaccagcataactacgccgcacccccttccaccagaaaggactatcctgcggccaaaagagtgaaactggatagtgtccgggtccttaggcagataagcaacaatcgcaagtgcacctctccacgctcctccgataccgaagagaacgttaagcgccggacccacaacgtgctggagcggcaacggcgcaacgagttgaagcggagttttttcgccctgcgggatcagatccccgagctggagaacaatgagaaggcacccaaggtcgtgatcctcaaaaaggctacggcctacatccttagtgtgcaagccgaaacacaaaaactcatcagcgagattgacctccttagaaagcagaatgagcagcttaaacataagctggagcaacttagaaacagttgcgcc

SEQ ID NO: 17630 - DNA, 1317 bp, Artificial Sequence
  Description of Artificial Sequence: Synthetic coding sequence
atgccccttaacgtgtccttcactaatcgcaactacgatctggactacgacagcgtacagccatacttctactgcgacgaagaggaaaacttttaccagcagcagcaacagagcgaactccagccacctgctccgagcgaagatatctggaagaaattcgaactgctgccgaccccgccgctcagcccgtcgaggagaagcggactttgttccccatcgtacgtggccgttacgccgttttccttgcgtggagataatgacggaggaggtggttccttctctaccgccgatcagctggagatggtgaccgaacttctcggaggcgacatggtgaaccagtccttcatttgcgaccccgacgatgaaaccttcatcaagaacatcatcatccaagattgcatgtggagtgggttctccgccgcagccaagctggtgtcagaaaagctggcctcataccaagcggcgcgcaaagatagcgggtcccctaacccggcgcggggccactccgtgtgctccacttcatccctttacttgcaagatctcagcgcggcggcatctgagtgcatcgacccttctgtggtgttcccttatccactcaacgactcaagctctccgaagtcatgtgcttcgcaagactcctccgcattctcgccaagctccgatagcctgctcagcagcactgagtcgtcccctcaaggatccccggagcctctggtgctccacgaagaaactccgccaaccactagctccgactcggaagaagagcaggaggacgaggaggaaatcgatgtggtcagcgtggaaaaacgccaagcaccggggaaacggagcgaatccggatcgccgtcagcggggggccattccaagccgccgcactcgccacttgttctcaagcgctgtcatgtgtctacccaccagcataactatgccgcgccgcccagcacccggaaggactacccggctgctaagagggtgaagctcgattccgtccgcgtcttgcgccaaatttcgaataacaggaaatgcacgtctccgcgcagctccgataccgaagagaatgtgaagcggaggactcacaatgtgttggaacgccaacggcgaaacgaattgaaaagatccttctttgccctgagggaccagatcccagagctggagaacaatgagaaggcgccaaaggtcgtcatcctgaaaaaggcaaccgcgtacatcctgagtgtccaagcggagactcaaaaactgatctccgaaatcgacttgctgcggaagcagaatgagcaactgaagcataagttggagcagctccgcaatagctgcgct

SEQ ID NO: 17631 - DNA, 1317 bp, Artificial Sequence
  Description of Artificial Sequence: Synthetic coding sequence
atgccacttaatgtgtcctttactaaccggaactatgacctggattacgacagcgtgcagccatatttctactgtgacgaggaggagaacttctaccagcaacaacagcagtcggaactgcagccgccagccccaagcgaagatatctggaagaaattcgagctgctgccaaccccgccgcttagcccgtccaggcgcagcgggctgtgttcaccgtcgtacgtcgcagtcaccccgttctccttgcgcggagacaacgacggcggaggcgggtccttcagcaccgcggaccaattggaaatggtgactgaactgctcggcggagacatggtgaaccaatcgtttatctgtgatccagatgacgagacttttatcaagaacatcatcattcaagattgcatgtggtcaggattctccgcagcagccaaactggtatcggagaagctcgcgtcttaccaggctgctagaaaggattccggttccccaaacccggcccgcggccacagcgtgtgcagcacttcaagcctgtacctccaagacctgtcggcggctgcttccgagtgcatcgatccatcggtggtgttcccttacccgctgaacgattcgtcctcacctaagtcgtgcgccagccaggactcgtcagcgttctcgccatcgagcgacagcctgctgtcatcaaccgagtcatctccgcagggaagcccggagccgctggtgttgcacgaagagactccaccgaccacttcgtcagactcagaagaagagcaggaagatgaagaggaaatcgacgtggtgtccgtcgagaagaggcaggcgccaggaaagcggtccgagagcggatcaccgagcgctggtggacacagcaagccacctcattccccactcgtgctcaagcggtgccatgtctcgacccaccagcacaattacgctgctccgccatcgactcgtaaggactaccccgccgcgaagcgggtcaagctcgactccgtgcgcgtccttagacaaatctcaaacaaccggaagtgcacgtctccccggtcatccgacactgaagaaaatgtgaaacgccggacccacaacgtgttggaaagacaacgccgcaacgagttgaagagatcatttttcgcgctgagggaccaaatcccagaactggaaaacaacgaaaaggctcccaaggtggtgatcctcaagaaggccaccgcgtacatcctttctgtgcaggccgagactcagaaacttatttcggaaatcgatctgctgcgcaagcagaacgaacagctgaaacacaagttggagcaactgcgtaattcgtgcgcc

SEQ ID NO: 17632 - DNA, 1317 bp, Artificial Sequence
  Description of Artificial Sequence: Synthetic coding sequence
atgcctctgaacgtgtcctttacgaatagaaattacgacctcgactacgactccgtgcaaccatacttctattgtgatgaagaagagaatttctaccagcaacagcaacaatcggaacttcagccccccgcgccctccgaggatatctggaaaaagtttgaattgttgcctacccctccgctctctccaagcagacgctcaggtctgtgttccccttcatacgtcgctgtgaccccattttcacttcggggcgataatgatggcggcggaggatcgttctcgactgcagatcagctggaaatggtcaccgagctccttggaggagatatggtcaaccaatctttcatttgtgaccctgacgacgaaaccttcattaagaacatcattattcaggactgcatgtggtcaggtttctcggcagcagcaaagctggtcagcgaaaaacttgcgtcataccaggccgcaaggaaggattcaggttcccctaaccctgcacgaggccattccgtgtgttccaccagctcactgtaccttcaagatctttcggcagccgcaagcgaatgtattgatccatccgttgtgtttccctacccgctcaacgactcctcctcgccaaagtcatgcgcctcgcaagactcctccgcatttagcccaagcagcgattctcttcttagctccaccgaaagttcgccccaagggtcgccagagccactggtgctgcatgaagaaacccctcctactacttcctccgattctgaagaggaacaggaagatgaagaggaaatagatgtggtgagcgtggagaagcgacaagcacctggcaagcggtccgagtcgggatcaccttcagcaggtggacattccaagccccctcactcgccactcgtcctcaagaggtgtcatgtgtctacgcatcaacacaactatgcagcgcccccaagcacccgaaaggactacccagcagcaaagagggtgaagctggattctgtcagggtgcttaggcagatttctaacaatagaaaatgcacgtccccgcgctcatccgataccgaggagaacgtgaaacgccgtacccataacgtgctggaaaggcagagacgaaacgaactcaagcgatcgttctttgctcttcgggaccagattcctgagcttgagaacaatgaaaaggcccctaaagtggtgatccttaagaaggcaaccgcatacattctgtccgtgcaagcggaaacccagaaacttatctcggaaatcgaccttcttaggaagcaaaatgagcagctgaagcataaactcgaacagcttcgtaacagctgcgca

SEQ ID NO: 17633 - DNA, 1317 bp, Artificial Sequence
  Description of Artificial Sequence: Synthetic coding sequence
atgccgctgaatgtttcttttaccaaccgcaattacgacctggattacgattcggtccaaccgtacttttactgcgacgaggaagaaaacttctaccaacagcagcaacagtcggagctgcagccgccggccccatcggaagatatctggaagaagttcgagctgctgccgactccgccattgtcaccttcccgccggtcaggattgtgctcaccgtcctatgttgcagtcacgcctttctccctccgcggagataatgatggcggaggcgggtcgtttagtactgcagaccaattggaaatggtgactgagctgctcggcggtgatatggtgaaccagagcttcatctgtgatccggatgacgaaaccttcatcaaaaacattatcatccaggattgcatgtggtcgggattctcagcagctgctaagctcgtctctgaaaaactcgcgagctaccaagctgcccgcaaggattcgggctcgccgaatccggcccgcgggcattccgtctgttcaacgtcctccctttacctccaggacctctcggcggctgcttcggagtgtattgatccatcggtggtgtttccgtacccactgaacgactcctccagcccaaaatcgtgcgcatcgcaagactcctccgcgttttcgccttccagcgacagcctcttgtcctccaccgagagctcgcctcaaggtagccctgaaccgttggttttgcacgaggagactccgccgaccaccagctcggattcggaagaagaacaggaagatgaggaagaaatagatgtggtgtctgtggagaagagacaggccccgggaaaacggagcgagtccggatcaccttccgcggggggacattccaagccacctcacagcccacttgtgctgaaacgctgtcacgtctctactcaccaacacaactacgcggccccgccaagcaccagaaaggactacccagccgccaagagggtgaagctggatagcgtgcgggtgctgcgccagatctcgaataaccgcaagtgtacttcgccgcgatcgtcagacactgaggaaaatgtgaaacgtcgcacccataacgtcctcgagcgccaacggcgcaacgaactgaagcggtcgttctttgcgctgagggaccagatcccggaactggagaataatgaaaaagcgccaaaagtggtgattctgaagaaagccactgcgtacatcttgtccgtgcaagcggaaacccagaaattgatcagtgaaattgacctcctgaggaagcagaatgagcagctgaagcacaagctggaacagctgaggaacagctgcgct

SEQ ID NO: 17634 - DNA, 1317 bp, Artificial Sequence
  Description of Artificial Sequence: Synthetic coding sequence
atgccactgaacgtgagcttcacaaaccggaactatgatcttgactacgattctgtgcagccatacttttactgcgacgaggaagagaacttctaccagcaacagcaacagtccgaacttcagcctcccgccccatcggaggacatctggaagaagttcgaactgttgcccactcctcctttgtctccaagccgcagatcaggtctctgctcaccaagttacgttgcagtgactccctttagcctacgaggtgataatgacgggggtggcgggagctttagcaccgcagaccagctcgagatggtcacagagttgctgggcggggacatggtgaatcagagcttcatttgcgaccctgacgatgaaaccttcatcaagaacattataatccaggactgtatgtggtccggtttttccgctgcagccaaacttgtgtcagagaagctggcgtcctaccaggcggctcggaaagacagcggttctcctaatcctgctagaggacactccgtttgctccaccagcagtctgtatctccaggatttatccgctgccgcctccgaatgcatagaccccagtgtggtgtttccatacccactgaatgactcttcatcaccgaaatcctgtgcctcacaagatagttctgctttctctccctcctcagacagcttgctgtcctcaaccgagagtagccctcagggatcccctgaaccacttgtcttacacgaagagacaccaccaacgacctcttctgactcggaggaggaacaggaagatgaggaagagatcgatgttgtttctgtagaaaagcggcaggcaccgggaaaacggtctgagagcggctcaccttccgctggcggtcactctaagccaccccatagcccactggttcttaagcgctgtcacgtgtccacccatcagcataactacgcagcacccccctctacgcggaaggactaccccgccgctaagcgcgtgaaactcgatagtgttcgcgtacttcgtcaaatctctaacaacaggaaatgcacaagtccccgtagctcagacaccgaggagaatgttaaacggaggacccacaacgtgctggaacggcaacgccgaaacgaactaaagcggtcttttttcgccttacgagatcaaattcccgagcttgagaataacgagaaggcccctaaggtcgtgatcctgaaaaaggcaactgcctacatcctgagtgtgcaggccgaaacacagaagctcattagtgaaatcgatctgctccggaagcaaaacgagcagcttaagcataagctggagcagctacggaacagctgcgcc

SEQ ID NO: 17635 - DNA, 1317 bp, Artificial Sequence
  Description of Artificial Sequence: Synthetic coding sequence
atgccactgaacgtgtcgttcactaacagaaactacgacctcgattacgattctgtgcaaccgtacttctactgcgacgaagaagagaacttctaccaacagcagcagcaaagcgagctccagcctccggccccatcagaagatatttggaaaaagttcgaactcctcccgaccccaccgttgtcgccgtcacggcgcagcggactgtgctcaccctcctacgtggcagtcaccccattctccctgcggggagataacgatggcggtggaggttccttcagcacggccgaccaactggaaatggtcaccgagctgcttggcggagatatggtcaaccaaagttttatctgcgacccggacgatgaaacgtttatcaagaatatcatcatccaggattgcatgtggtccggcttctcggctgccgccaagctcgtgtcagaaaagctcgcctcctaccaggcagcccgcaaggactcgggaagcccaaatccggcacggggacattccgtgtgctcaacctcgtcactctacctccaggatctctccgccgcagcttcagagtgtattgacccatcggtggtgttcccctacccgctcaacgattcgagctcaccgaaatcttgtgcctcgcaggattcatctgcgttttcgccaagctccgactcccttctgtccagcaccgaatcatcgccacagggctccccagaaccgctggtcctccacgaggagactccaccaaccacttcatccgactcagaggaagaacaggaggatgaggaagaaatcgatgtggtgtcagtcgagaagcgacaggctcccggtaaacgctcggagtccgggtcgccctcggcgggaggtcactccaagccaccgcactcaccgcttgtgctgaagagatgccatgtgtcgactcaccaacataactacgccgccccaccttccacccgcaaggattacccagcggctaagcgggtgaaactcgactcggtccgcgtcctgcgacagatctccaacaatagaaaatgcaccagccctcgatcatcggacactgaagagaatgtgaaacgcagaacccacaacgtcctggaacggcaacggcgcaatgagttgaagcggtcattctttgcgctgcgggaccagatcccagagcttgagaataatgagaaggcaccaaaagttgtgatcttgaagaaggctactgcatacatcctgtcggtgcaagccgaaactcaaaagctgatctccgagatcgacctccttcgcaaacagaacgaacaactcaaacacaaactggagcagctgagaaactcatgcgcg

SEQ ID NO: 17636 - DNA, 1317 bp, Artificial Sequence
  Description of Artificial Sequence: Synthetic coding sequence
atgcccttaaatgtttcttttaccaatagaaactatgatttggactacgattctgtgcagccctacttttactgtgatgaagaggagaatttctaccaacagcagcagcagtcagagctgcagccacccgccccttctgaagatatctggaaaaagtttgagctcttaccaacgccgcccctgagtccttctcgaaggagcgggctttgtagcccatcgtatgtggcggttacccccttcagcctgagaggagataacgatggcggcgggggcagtttttccactgcagaccagctagaaatggtaactgaacttctcggcggcgacatggtcaaccagtcttttatttgcgacccagatgatgaaacattcatcaagaacatcataatacaggattgtatgtggtcaggttttagcgcagccgccaaactcgtgagcgaaaaacttgctagctatcaggccgcaagaaaggatagtggaagcccgaacccagcaagaggacactcagtttgttccactagctcactttatttgcaggacctctctgctgcagccagtgaatgcattgaccctagcgtggtttttccctaccctttaaatgactcctctagccccaagtcatgtgcttctcaggattcttcagcgttcagcccaagttctgattcccttctgtctagcaccgaaagttcaccccagggatcccccgaacctctcgtcctccacgaagaaacacctcccactacctccagcgactcggaggaggagcaggaggacgaggaggagatagatgtagtgtcggttgagaagaggcaggctccgggcaagagatccgaatcgggcagcccttccgccggcggacattccaagccgcctcacagccctcttgtgctgaaacggtgccacgtgagcacacatcagcacaattacgccgccccacctagcacgcgtaaggactaccccgcggccaaacgtgtgaagttggatagcgtgcgtgtcctaagacaaatctctaataatagaaaatgtacctccccaagatcaagtgataccgaagagaacgtaaaacggagaactcacaatgtgctggagagacaaaggcgaaatgagctcaagagatccttttttgccctccgtgatcagattcctgagctcgagaataacgagaaggcaccaaaggttgtgattctcaaaaaagctaccgcttacatcctctctgtacaggctgagactcagaaactcatcagtgaaattgatttgctccgaaaacagaacgagcagctaaagcacaagctcgaacagctgcgaaattcgtgtgcc

SEQ ID NO: 17637 - DNA, 1317 bp, Artificial Sequence
  Description of Artificial Sequence: Synthetic coding sequence
atgccactcaacgtgagctttacgaaccgtaattatgacctggactacgactctgtccagccatacttctattgtgatgaggaggagaacttttaccagcagcagcagcaatcagaactccagccacctgccccttccgaagacatttggaaaaagtttgaactactgccgacccctccattgtcacctagtaggaggtctggcctctgcagcccgagctatgtggcggttacaccgttcagtctgcggggtgacaacgacggggggggcggcagctttagcacagcagatcaactggaaatggtcactgaactgttgggcggcgatatggtaaaccagtcctttatttgcgaccctgacgacgagaccttcattaagaacataataatccaggactgtatgtggagtgggttctctgccgctgccaagctggtatcggagaaacttgcttcttaccaggcagctaggaaagatagtggatcaccgaacccagccagagggcattctgtgtgtagcaccagttccctctatttgcaggatttaagcgccgctgcctccgagtgcatcgacccgagcgtggtcttcccttacccactgaatgactcaagctcccccaaaagttgtgcttctcaggactcctccgccttcagcccgtccagcgactccctgctttcttccaccgagtctagcccacaaggaagccctgagcccctggtgctacatgaggaaactcccccaactacctcgagtgacagcgaagaggagcaagaggatgaggaagaaatcgacgtggtgtctgtggagaagcgacaagctcccggcaaacggtccgagtccggatcacctagtgccgggggacacagtaagcctccgcacagtccacttgtgctcaagaggtgtcatgtcagcacccaccaacacaactacgccgctcccccctccactagaaaggattatcccgctgcaaagcgggtgaaactggactcagttagggtattgcggcagatcagcaataatagaaagtgcacatcccctcgatcatctgacaccgaggaaaatgtgaagcgaaggactcataatgttttggaaaggcagaggaggaatgagctgaaacgctccttcttcgctcttagggaccagatcccagaactggaaaataatgagaaagctccgaaagtggtgatcctgaagaaagcaacagcctacatactatcagtgcaggccgagacccaaaagctcattagcgaaattgatctgctgcgcaagcagaacgaacagctgaagcacaaattggagcagctccggaactcctgcgct

SEQ ID NO: 17638 - DNA, 1317 bp, Artificial Sequence
  Description of Artificial Sequence: Synthetic coding sequence
atgccattgaatgtatcattcacgaatagaaattatgacctggactacgatagtgttcagccttacttctattgcgatgaagaagagaatttttatcagcagcaacagcagagcgaattacagcctcctgcgcccagtgaagatatttggaaaaagttcgaactgctccctactccaccactcagtccttcaaggcgatccgggctttgctcaccatcctatgtcgctgttacaccttttagtctcaggggtgacaatgatggtgggggtgggtcttttagcaccgcggatcagcttgaaatggttactgagcttttaggtggggatatggttaatcagtcattcatatgcgatcccgacgacgagacgttcatcaaaaacattattatccaggattgcatgtggtcaggcttttctgctgctgctaagctcgtgagcgaaaagctagcctcatatcaagctgctcgcaaggattcaggtagtcctaatccagcacgtgggcattctgtatgttcaacatcgtctttatatctacaagaccttagtgctgctgcgtccgagtgtattgatccatcagttgtgttcccatatcctttgaatgattcttcctctccgaagtcctgcgcaagtcaggactcttccgctttttcgccttcttccgacagccttcttagcagcactgagagttcaccccaaggctcgcctgaaccgctagtgcttcacgaagagactcctccaaccaccagctctgacagcgaggaagaacaggaggatgaggaagagattgatgtggtgtcagttgagaagagacaagcgcctggcaagcgctctgagagtgggtctccttctgcgggcggtcacagtaaaccccctcattcaccgctggtgcttaagcgttgtcatgtttctacacatcagcacaactacgccgccccacctagtacacggaaagattatccggccgcaaagcgagttaagctcgacagtgtgagggtcctcaggcaaattagcaacaacaggaaatgcacctctcccagatcatcagacaccgaagagaatgttaaaaggcggacccataatgttctagaacgtcaaaggaggaatgagcttaaacgaagcttttttgctctgcgtgatcagattcctgagcttgaaaacaacgaaaaggctcctaaggttgttattcttaagaaagctacggcatatattctttcggtgcaggcagaaacgcagaagcttatatctgaaatcgaccttcttcggaagcaaaatgaacagcttaagcataaattagaacagttacgtaattcctgtgct

SEQ ID NO: 17639 - DNA, 1317 bp, Artificial Sequence
  Description of Artificial Sequence: Synthetic coding sequence
atgcctctgaacgtatcatttactaaccggaattacgaccttgattacgacagcgtgcagccgtacttctattgtgatgaagaagaaaacttctatcaacagcagcagcaatcagagctgcaacctccggccccttcagaagatatttggaagaagtttgagctcctccctacccctcctctgagcccgtcaaggagatcgggactgtgctcgccatcatacgtggctgtgacgcctttcagcctgcggggtgataacgatggagggggagggagcttttcaaccgcagaccaactcgaaatggtcaccgagctcctcggcggagatatggtgaaccagtcctttatctgcgacccagatgatgagacttttatcaagaatatcataatccaagattgtatgtggtccggattttccgcagctgcaaagctggtgagtgagaaattggcatcttaccaagcagcacgtaaagactctgggtcccctaatccggcacgtggacacagcgtttgttctacgtcgtccctttaccttcaagacctttccgccgctgcgtcggaatgtattgacccatccgtcgtgtttccgtacccactgaatgattcatcatctccaaagagctgtgcctcccaagattcgagtgcattcagcccgtcgtcggatagtctgctgtcctcaacggaatcaagcccccagggatccccagaaccactcgtgctgcatgaagaaactcccccaaccacctcttctgactcggaagaggagcaggaggatgaggaagaaattgacgtcgtatccgtcgaaaagaggcaagcacctggcaagagatcagaatccggttccccatcagccggtggtcacagcaagccaccacattctcccctggtgctcaagcgctgtcacgtcagcactcatcaacacaattacgccgcacctcccagcaccagaaaggattacccagcagccaaacgggtcaagctggattcagtgcgggtcctccgacagatttcgaataaccgcaagtgcacctcccccagatcgtcagatacggaggaaaacgtgaaaaggagaacccataatgtgcttgaacgccagcgtagaaacgaattgaagagatctttcttcgcactgcgggatcaaattccagagcttgaaaacaacgagaaagcgcctaaagtggtgattttgaagaaagcgactgcatacattctctcggtgcaagctgaaactcagaaactcatatccgaaatcgaccttcttcgcaagcagaacgagcaactgaagcataaactcgaacagctgaggaactcgtgcgca

SEQ ID NO: 17640 - DNA, 1317 bp, Artificial Sequence
  Description of Artificial Sequence: Synthetic coding sequence
atgccccttaatgtgagctttaccaatcgcaattacgatctggactatgacagcgtccagccgtacttctactgcgatgaagaggagaacttctaccagcagcaacagcagtcagagttacaaccccctgccccttcagaggacatctggaagaagttcgagctgctgcctacccctcccttgtcacctagccgccgcagtggactttgctccccttcatacgtggcagtcacccccttttctttgagaggcgacaatgatggcggtggaggcagcttctctaccgcggatcaactggagatggtaactgagctgttgggcggtgacatggttaaccagagctttatctgcgacccggacgacgagaccttcattaagaacatcattatccaggactgtatgtggtccgggttctccgcggccgcaaagttggtctccgagaagctggcttcttaccaagccgctcggaaggactcgggttctcctaaccctgctcgtggccacagtgtctgctccacgtcctcactttatttgcaggaccttagcgccgcagctagcgagtgcattgatcccagcgtggtctttccatacccactgaacgactcgagctcacctaagtcgtgtgctagtcaagattcgtcggcattctcgccctcgtccgattctttactgagcagcactgaatcttcgccgcaaggatcaccagagccacttgtgctccatgaagagactccgcctaccaccagtagcgacagcgaggaagaacaggaggacgaggaagagatagatgtggtatcggttgagaaaagacaagcaccgggtaaacggtccgaatccggctcgccctcagccgggggtcactccaaacctccgcattcgccgctcgtcttgaagcgttgtcacgtctccactcatcagcataactatgcagctcctccctccacccgcaaagactatccagctgccaagcgtgttaagctagactctgtaagggtgctacgccagatctcgaacaaccgcaaatgcacctccccccgcagcagtgacaccgaagagaacgtcaagcgtcgcacgcataacgtcctcgagcgccagcgtcgcaacgagcttaagcgttcgttcttcgcgctccgcgaccaaattcccgagttggagaataacgagaaggccccaaaggtcgtcattctgaagaaggccaccgcatacatcctgtcagttcaggcggagacccagaagctgataagcgagatcgacctgctcagaaagcagaacgaacaacttaagcataagcttgaacaactccgtaatagctgcgca

SEQ ID NO: 17641 - DNA, 1317 bp, Artificial Sequence
  Description of Artificial Sequence: Synthetic coding sequence
atgccgctcaacgttagctttaccaatcgaaactacgatttagattacgatagcgtccagccttatttttactgcgacgaagaagagaacttttatcagcagcagcagcagtctgagctgcaacccccagccccctctgaagatatatggaaaaagttcgaactgttaccaacacctcccctaagccccagccgccggtccgggctgtgttccccttcatacgtcgccgtaacaccattctcattgaggggcgacaatgatgggggtggtgggtcttttagtacagcggatcagctggaaatggtcacggagctgctagggggcgacatggttaatcaatctttcatttgtgacccagacgacgaaacgttcattaagaacatcatcattcaagattgcatgtggagcggattcagtgcggccgcaaaactagttagtgagaagcttgcttcttaccaggccgcaagaaaagattccggctccccaaatcccgcccggggccatagtgtctgctccacctctagtctgtatcttcaggaccttagcgccgcagcatctgagtgcattgatccatccgtggtgttcccttatcccctgaacgacagtagctcacccaaatcgtgcgcatcccaggattccagtgccttctcccctagctctgactccttgcttagttcaacagaatctagcccccaaggcagtcccgaacctctagtacttcacgaggaaaccccgccaaccacatcatcggattcggaggaagagcaggaagacgaggaggagatagacgtggtgtctgtagagaaaagacaggctccaggaaagcgtagtgagagcgggtctccttccgcaggcggacacagcaagcccccccacagtccactggtgttaaaacgctgccacgtgtccacccatcagcacaactatgccgcacctccctccacccggaaagactaccctgccgccaagcgtgtcaagctggacagcgtgagagtgctgaggcagattagcaataatagaaagtgtaccagccccaggtcttccgatacggaggagaacgtcaagcgccggactcataatgtgttggagcgccagagacgcaatgaactaaaaaggtccttttttgccctcagggatcagatcccagagctggaaaataacgaaaaagcacctaaagtggtgatattgaagaaagcgacagcttacattctttctgttcaggctgagacgcagaaattaatttctgaaattgacctgctgcggaaacagaatgagcagttgaagcacaagctcgaacagctgagaaattcgtgcgcg

SEQ ID NO: 17642 - DNA, 1317 bp, Artificial Sequence
  Description of Artificial Sequence: Synthetic coding sequence
atgcctctcaatgttagcttcaccaaccgcaattacgaccttgactatgacagcgtgcagccctacttctattgtgatgaagaggagaatttttatcagcagcagcagcagtctgagcttcagccaccggccccatccgaggacatctggaaaaagtttgaactgctgcccacccccccactgtccccgagtaggcgctcaggactctgcagcccctcctacgtcgctgtgacacccttcagcctgagaggtgataatgatggaggaggcggatctttcagtaccgctgaccagcttgagatggtcacggaactgctgggaggtgacatggtcaatcagagcttcatctgtgaccctgatgacgaaacttttatcaagaacatcatcatccaggattgcatgtggtctggattctccgcagccgccaagttggtctcagagaagctggctagctaccaagcagcacgcaaggactccggcagtcctaacccagctaggggacattcagtatgctccacttcctccctgtacctgcaggacctgtcagctgctgcaagtgagtgcatcgatccatctgtagtatttccatatcccttgaacgactcttcctcacccaagagttgtgcatcacaagacagcagtgccttctctccctctagcgactccttgttgtcctccactgaaagctctccgcagggctcaccggaacctctcgtactccacgaagagaccccaccgactacatctagcgactccgaggaagagcaagaagacgaagaagaaatcgacgtggtgtctgtagagaaaagacaagcgccaggaaagaggtccgagtccggatcccctagtgcgggaggacactcaaagcctccacatagtccgctcgttctgaaaagatgccacgttagcactcaccagcacaactacgcagcccccccttctacaagaaaggactacccggcggcgaagcgcgtaaagctggactccgtgcgcgtcttgcgccagatttccaacaacaggaagtgcacgagtccaaggagctcagacaccgaagagaatgtcaagagaagaactcataacgttctcgagagacagcgccgcaatgagctcaagaggagtttttttgcgctgagggaccagatcccggagttggagaacaacgaaaaagcgcccaaagtggttattctgaagaaggccaccgcttatatcctgtctgtccaggcggaaacccagaagttgatctccgaaatcgacctgcttaggaagcaaaacgaacagctgaagcacaagcttgagcagctgcgcaactcctgcgct

SEQ ID NO: 17643 - DNA, 1317 bp, Artificial Sequence
  Description of Artificial Sequence: Synthetic coding sequence
atgcctcttaacgtatcctttacgaacaggaattatgatctcgattacgattcagtccaaccatatttttactgcgatgaagaagaaaatttctatcagcagcagcagcaatcagaactccagcccccagctccctccgaagatatctggaaaaaattcgaactgctccccactccaccactttccccatcaaggagatctgggctctgttccccatcttacgtagctgtaactccattctctctcaggggagataacgacggagggggaggatctttttctactgccgatcagctagagatggtcacagaactgctgggaggagacatggttaatcagagtttcatttgcgatccggatgatgaaacattcattaaaaacataatcatccaggattgtatgtggagtgggttctccgcagctgccaagcttgtcagtgaaaaactggcatcttatcaggcggcccggaaagactccgggtcgcctaacccagccagagggcatagtgtatgttcaacatcttctctgtatctccaagatctgtccgccgctgcctccgagtgtattgatccctcagtggtgttcccctatccgctaaacgactcctcctccccgaaatcttgtgcatctcaggattcttcggcgttctccccgtccagtgattccttgctctcttccacagagagttccccccagggatcccctgaacctttggttctgcacgaagaaacgccaccaacaacatcttccgattccgaagaggagcaggaagatgaagaagaaattgatgttgtgagtgtggaaaaaaggcaggcccccggaaaacggtccgaatctgggtccccttccgcaggggggcattctaagcccccccattcgccccttgtgctgaaaagatgccacgtttccactcaccaacacaattatgcagctcctccaagtacgaggaaagattatccagctgctaagcgagtcaaactggattctgttagggtactgcgacagatcagtaataatcgcaaatgtactagtccacgttcctctgatacagaagagaacgtcaagcgccggacacacaatgtcctcgaacgacagcggcgcaacgagctcaaacgaagtttcttcgctctcagggatcagatccctgaacttgaaaacaacgagaaagcgcccaaagtcgtcatactcaaaaaagcaacagcttatatactgtcagttcaagccgagactcagaaattaattagtgaaatagacctcttgaggaagcagaacgaacagctaaagcacaaactagaacagctgcggaatagttgtgcc

SEQ ID NO: 17644 - DNA, 273 bp, Artificial Sequence
  Description of Artificial Sequence: Synthetic coding sequence
atgactgaggaaaacgtgaagaggcggacccacaacgtcctcgaacgccaaagaagaaacgaactgaagcgctcattctttgctctccgcgaccaaatcccggaactggagaataacgaaaaagccccaaaagtcgtgatccttaagaaagcgaccgcatacattttgtccgtgcaagcggaaactcagaagctcatcagcgagatcgatctgctgcggaagcagaatgagcagctgaagcataagctcgagcagctgcggaattcgtgcgcc

SEQ ID NO: 17645 - DNA, 273 bp, Artificial Sequence
  Description of Artificial Sequence: Synthetic coding sequence
atgaccgaggaaaacgtcaagcggaggactcacaatgtgctggaaagacaacgtcgaaacgaactcaaacgctcctttttcgctcttagagatcaaatccctgaacttgaaaacaatgagaaagcaccaaaggtcgtgatacttaagaaggcgaccgcatacattctgtcggtgcaagccgaaactcagaagctgattagcgaaatcgacctgcttcgcaaacaaaacgagcagttgaagcataagctggagcagctccggaattcatgtgca

SEQ ID NO: 17646 - DNA, 273 bp, Artificial Sequence
  Description of Artificial Sequence: Synthetic coding sequence
atgaccgaagaaaatgtcaagagacgcacccacaacgtgctcgaacggcaaaggagaaacgagctgaaacggagcttctttgctctgcgcgaccagatcccggaacttgagaataacgaaaaggcgccaaaggtggtcattctcaagaaagccactgcatacatcctgtccgtgcaggccgagactcagaagttgatctcagagatcgatctgctccgcaagcagaacgaacaactgaaacataagctggagcaactccggaattcgtgcgcg

SEQ ID NO: 17647 - DNA, 273 bp, Artificial Sequence
  Description of Artificial Sequence: Synthetic coding sequence
atgaccgaagagaatgtgaagaggagaacccacaatgtgctggagcgacaaagacgtaatgagctgaagcgctcattctttgcattgcgcgaccagatcccagaactggaaaacaacgaaaaagctcctaaggtggtcattcttaagaaggcaactgcatacatactgagcgtccaggcggagactcaaaagctgatctcggaaattgatcttcttcggaaacaaaacgaacagctcaaacataagctcgaacaacttcggaactcctgtgcc

SEQ ID NO: 17648 - DNA, 270 bp, Artificial Sequence
  Description of Artificial Sequence: Synthetic coding sequence
atgaccgaggaaaatgtgaagcggaggacgcacaatgtgcttgaaagacagaggaggaatgagctcaaaaggagtttttttgctctcagagaccagattccggagctggagaacaacgagaaggcgccgaaggtggtgattctgaagaaggctaccgcatacatcttatctgtgcaagcagaaacgcagaagttgatttccgaaatcgacctgttaagaaagcaaaacgaacagctgaagcacaagttagaacagctacggaactcatgc

SEQ ID NO: 17649 - DNA, 270 bp, Artificial Sequence
  Description of Artificial Sequence: Synthetic coding sequence
atgacagaggaaaacgtgaaaaggcgcacacataacgttctggaacggcagcgacgcaatgagcttaaacgtagcttcttcgcactccgcgaccaaattccagagctagaaaacaacgaaaaggccccaaaggtggtaattttgaaaaaggctaccgcatatattttaagcgtacaagccgagacgcagaagttgatctctgaaatagatctgctgcgcaaacagaatgagcagctgaaacacaagctggagcagcttcgaaactcgtgc

SEQ ID NO: 17650 - DNA, 270 bp, Artificial Sequence
  Description of Artificial Sequence: Synthetic coding sequence
atgaccgaagaaaacgtgaagagaagaacccataatgtgctggagaggcaacgacggaacgaattgaaaagatccttttttgcgctcagggatcagattcctgagcttgagaataatgagaaggcccctaaggtggtgattcttaagaaagccactgcctacatcctgtccgtgcaagcagagactcaaaagctcatttcggaaatcgatcttctgcggaaacaaaacgaacaacttaagcacaaactcgagcagctgcgaaattcctgt

SEQ ID NO: 17651 - DNA, 270 bp, Artificial Sequence
  Description of Artificial Sequence: Synthetic coding sequence
atgactgaggaaaatgtcaagcggagaactcacaacgtcctcgagcgccagcgccggaacgagctcaagagatcctttttcgccctgcgcgatcaaatcccagaactggagaacaatgaaaaagcgccaaaagtggtgatcctgaagaaggccactgcctacatcctgtcggtgcaggccgaaacccagaaactgatcagcgaaatcgatctgcttcgcaagcagaacgaacaactgaagcataagttggaacaattgcggaactcgtgc

SEQ ID NO: 17652 - DNA, 270 bp, Artificial Sequence
  Description of Artificial Sequence: Synthetic coding sequence
atgactgaggagaatgtcaagaggcgcactcacaatgttttggaacgccagagaaggaacgagctcaagagaagttttttcgctctgagggaccagattcctgaattggagaataacgaaaaggctcctaaggtggtgattctgaagaaggctactgcatatattcttagcgtacaggctgaaactcaaaagcttattagcgagattgacctcctgcgcaagcaaaatgaacagcttaagcacaagttggagcagttgcgcaattcatgt

SEQ ID NO: 17653 - DNA, 270 bp, Artificial Sequence
  Description of Artificial Sequence: Synthetic coding sequence
atgacggaggaaaacgtcaaacgcaggactcacaacgtgctcgaaagacagaggcgcaatgagttgaagaggtcattcttcgcgttgagggaccaaattccggaactggagaacaacgagaaggctccaaaggtcgtgatccttaagaaggccactgcctacatcctctccgtacaagcagagacgcagaagcttatctcagaaatcgacctcctgagaaaacaaaatgaacaactgaagcataaattggagcagctgaggaacagttgc

SEQ ID NO: 17654 - DNA, 270 bp, Artificial Sequence
  Description of Artificial Sequence: Synthetic coding sequence
atgactgaagagaacgttaaaagacgtactcacaatgtgctggagcggcaaaggcgcaacgaactgaagcggtctttctttgctcttcgcgaccaaattcccgaactggagaataacgaaaaggccccgaaagtggtgatccttaagaaggccaccgcatacatcttgtcggtccaggcggaaacccagaagctgatctccgaaatcgatttgcttagaaaacagaatgagcagctcaaacataagctcgagcaactccgcaacagctgt

SEQ ID NO: 17655 - DNA, 270 bp, Artificial Sequence
  Description of Artificial Sequence: Synthetic coding sequence
atgactgaggaaaatgtgaaacgccggacgcacaacgtcctggagcgtcagagaagaaacgagctgaaaaggtcttttttcgcactgcgagaccagatccctgagctggagaacaacgagaaggcacctaaggtcgtcatactgaaaaaggccacagcttacattctgtcggtacaagcagagacccagaagctaattagcgaaatcgacctcctgaggaaacagaacgaacagctaaagcataagttagagcagttacggaattcatgc

SEQ ID NO: 17656 - DNA, 270 bp, Artificial Sequence
  Description of Artificial Sequence: Synthetic coding sequence
atgaccgaagagaacgtcaaaaggaggacacacaacgtgctggaacggcagcgcagaaacgagttgaagcgcagtttctttgcccttagagaccagatacccgagctggagaataatgaaaaggcccctaaagtcgtcattctcaagaaagcaaccgcctacatcttgagtgtacaggcggaaacccagaaactcatcagtgagattgatctgctgaggaagcaaaatgaacagcttaagcacaagttggagcagctgagaaactcatgc

SEQ ID NO: 17657 - DNA, 270 bp, Artificial Sequence
  Description of Artificial Sequence: Synthetic coding sequence
atgacagaagaaaacgttaagagaaggacacataatgtgctcgagcgccagaggcgcaatgagctgaagcggagcttcttcgccctgagagaccagatccccgagttggagaacaatgaaaaggcgccaaaggttgttatactgaagaaagcaacggcatatattctcagcgtgcaagccgagacacagaagctgatctccgagatcgatctgctcagaaagcagaacgaacagcttaaacacaaactcgaacaattgagaaattcttgc

SEQ ID NO: 17658 - DNA, 270 bp, Artificial Sequence
  Description of Artificial Sequence: Synthetic coding sequence
atgaccgaggagaacgttaaacgccggacgcataacgtgctcgagcgtcagcgtagaaacgagctaaagcgcagcttcttcgcactgcgcgatcaaatccccgaactagagaacaacgagaaggcccctaaggtggtaatattaaaaaaggcaactgcctatatactttccgttcaggccgagacgcagaagcttatcagcgaaatagatctccttcgcaagcagaacgagcagctcaaacacaagctagaacaattacggaatagttgt

SEQ ID NO: 17659 - DNA, 270 bp, Artificial Sequence
  Description of Artificial Sequence: Synthetic coding sequence
atgacggaagagaatgtgaaacgaagaactcacaacgtcctcgaaagacaaaggcgcaacgagctgaaaagatccttctttgcacttagagatcaaatccccgagttggagaacaatgagaaggcacctaaggtcgtcattctgaaaaaggcgactgcatacattctctcggtgcaggcggaaacccaaaagctcattagcgaaattgatcttctcagaaaacaaaacgaacagctgaagcataagctcgaacaacttcgtaactcgtgt

SEQ ID NO: 17660 - DNA, 270 bp, Artificial Sequence
  Description of Artificial Sequence: Synthetic coding sequence
atgaccgaagaaaacgtgaaaaggcggacgcataacgtgctggagcgacaacgcagaaatgagcttaagcggagcttttttgcgctcagagatcagatcccggaactggagaataacgaaaaggcgccaaaggtggtgatccttaagaaagccacggcttacattcttagcgtgcaagccgagactcaaaagctgatctccgaaatcgacctgcttcgtaagcagaatgaacagcttaaacataagctggaacaactgcgaaactcatgt

SEQ ID NO: 17661 - DNA, 270 bp, Artificial Sequence
  Description of Artificial Sequence: Synthetic coding sequence
atgacggaggaaaacgtcaagagacgaacccataacgtgctcgagcgacagaggcgaaatgaactcaagcgatcatttttcgccttgagggaccagatccccgagctggaaaacaacgagaaggccccgaaggtggtcatcctcaagaaggcaactgcttatatcctgagtgtccaggcggaaactcagaagctgattagcgagatagatctcctgcgcaaacaaaacgaacagctgaaacacaaactggagcagctgagaaattcttgc

SEQ ID NO: 17662 - DNA, 270 bp, Artificial Sequence
  Description of Artificial Sequence: Synthetic coding sequence
atgactgaagaaaacgtaaagagacgcacccataatgtcctggagcggcaacgccgaaacgagctgaagagatctttctttgccctccgcgatcagatcccggagcttgaaaacaacgaaaaggcacccaaggttgtgatccttaagaaagcgaccgcttacattttgagcgtgcaggccgagactcaaaaactcatctccgaaatcgaccttctgaggaagcagaacgaacagctgaaacacaaactggaacaactgcggaattcctgc

SEQ ID NO: 17663 - DNA, 270 bp, Artificial Sequence
  Description of Artificial Sequence: Synthetic coding sequence
atgacggaggaaaatgtgaaacgccgaacccacaatgtgctggagcggcagaggcgtaacgaactgaagcgatcctttttcgccttgagagatcaaattccggagctcgagaacaacgaaaaggccccaaaggtcgtcatcctgaagaaggctaccgcatacatcttgtcggttcaggcggaaacgcagaaacttatcagtgagatcgacctgcttcgcaaacaaaacgaacaactcaagcataagctcgaacagctgagaaatagctgc

SEQ ID NO: 17664 - DNA, 270 bp, Artificial Sequence
  Description of Artificial Sequence: Synthetic coding sequence
atgacagaagagaatgttaaaaggaggacacataacgtgctggaaagacagagacgaaacgagctaaaaagatctttctttgctctgcgcgatcagatccctgaactggagaataacgagaaggccccgaaggttgtcattctcaagaaggccacggcttacattctctccgtacaggccgaaactcagaagctgatctccgagatcgacctgctccgtaaacagaacgagcagctcaaacacaaattagagcagctccgcaactcctgt

SEQ ID NO: 17665 - DNA, 270 bp, Artificial Sequence
  Description of Artificial Sequence: Synthetic coding sequence
atgaccgaggagaacgtaaagcgaaggacacacaatgttctggagcgacagcgcagaaacgaacttaagagatcctttttcgctctacgagatcagatccctgagcttgagaataacgagaaggcaccaaaagtcgttatcctgaaaaaggctaccgcgtacattcttagtgtacaagcagagacccagaaactcattagcgaaatagatctgcttcgaaaacagaacgaacaactgaagcataagctggaacagctcagaaatagctgt

SEQ ID NO: 17666 - DNA, 270 bp, Artificial Sequence
  Description of Artificial Sequence: Synthetic coding sequence
atgactgaagagaacgtgaagagacggactcataatgtcctcgagcggcagcgcagaaacgaacttaagcgtagcttctttgcacttagagatcaaattccggagctcgaaaacaatgaaaaggcaccaaaggtggtcatacttaagaaggctactgcatacatactcagcgtccaagcggagacgcagaagctgatttccgagatcgatttgcttaggaaacagaacgaacaactgaaacacaaactggaacagctgcgcaattcttgt

SEQ ID NO: 17667 - DNA, 270 bp, Artificial Sequence
  Description of Artificial Sequence: Synthetic coding sequence
atgaccgaagagaatgttaagaggcggacccataacgtcctggagagacagagaaggaatgagctcaaacgatcttttttcgctttgcgagatcagatcccggagctggaaaacaatgagaaggctcccaaggtggtcatcttgaagaaggccaccgcctatatcctgagtgtgcaggcggaaacccagaagttaatcagtgaaattgacctgctgcggaagcagaatgaacaactgaaacacaaactggaacagttgaggaacagctgc

SEQ ID NO: 17668 - DNA, 270 bp, Artificial Sequence
  Description of Artificial Sequence: Synthetic coding sequence
atgacagaagagaatgtgaagaggcgcacccacaacgttctagaaaggcaacggcgcaacgagctgaagcggtcttttttcgccctacgggatcagatcccggagctcgagaacaatgagaaggctccgaaggtggttattctgaaaaaggccacagcgtatattctctctgtgcaggcggagacacagaaactgatatcagagattgacctgcttcggaaacagaacgagcaactgaagcacaaactcgagcaactgagaaattcatgt

SEQ ID NO: 17669 - DNA, 270 bp, Artificial Sequence
  Description of Artificial Sequence: Synthetic coding sequence
atgaccgaggagaacgtgaagagaagaacgcacaacgtgctggagcggcaacggaggaacgagctgaagagatctttcttcgccctccgcgatcaaatccctgagctggaaaataacgagaaagcccctaaagttgtgattctgaagaaagcgaccgcctatattctgtctgtccaggcagaaactcaaaagctcatttccgagatcgacttgctgcggaagcagaacgaacaactgaagcacaagctggagcagctgcgcaacagctgc

SEQ ID NO: 17670 - DNA, 270 bp, Artificial Sequence
  Description of Artificial Sequence: Synthetic coding sequence
atgaccgaggagaatgtgaaacgccgtacccataacgtgcttgaacgacagcgcagaaacgaactgaagcgctcatttttcgcactcagggatcaaatacccgagctcgagaataatgaaaaggcgccgaaagtcgtgattctcaagaaggcaaccgcctatatcctctccgtgcaagcagaaacgcagaagttgatttccgaaattgatctccttagaaagcagaacgaacagcttaagcataagctggagcaactgcgtaattcgtgt

SEQ ID NO: 17671 - DNA, 270 bp, Artificial Sequence
  Description of Artificial Sequence: Synthetic coding sequence
atgacggaagagaatgtcaagaggcggacccataacgttctcgaaagacagcgccggaatgagctgaaacgctcattctttgccctccgagatcagatccctgagctggagaacaacgagaaagccccgaaggtggtgatcctcaaaaaggccactgcttacatcctgtcggttcaagcagaaacccagaagctcatttccgagatcgatctgttgcgcaagcaaaacgaacagttgaagcacaaactggaacagctgagaaactcatgt

SEQ ID NO: 17672 - DNA, 270 bp, Artificial Sequence
  Description of Artificial Sequence: Synthetic coding sequence
atgactgaagaaaacgtgaaacgccgaactcataacgtgctggaaaggcaaaggaggaacgaactcaagcgctcatttttcgcactcagagatcaaataccggaacttgagaataacgagaaggcaccaaaggtggtgatccttaagaaggcaaccgcgtacattctgagcgtccaggcagagacgcagaagctgatctcggagatagatttgttgcgaaaacagaacgaacaacttaaacacaaactcgaacagcttagaaactcatgc

SEQ ID NO: 17673 - DNA, 270 bp, Artificial Sequence
  Description of Artificial Sequence: Synthetic coding sequence
atgactgaagagaatgtaaagcgcaggacacacaacgtgcttgagcggcagcgtcgtaatgaacttaagagaagcttctttgcccttcgggatcaaattccagagctggagaacaacgaaaaagcaccaaaggtagtgatcctcaagaaggctacggcttacattctttcagttcaggccgaaacgcagaagctgataagcgaaattgacttactcagaaagcagaatgagcagcttaaacataagctggagcagctgaggaatagctgc

SEQ ID NO: 17674 - DNA, 270 bp, Artificial Sequence
  Description of Artificial Sequence: Synthetic coding sequence
atgacggaagagaacgtgaaacggcgaacccacaatgtcctggaaaggcaaaggcgaaatgagctgaaacgctccttcttcgcacttcgggatcaaataccagagctggaaaacaacgagaaagctccgaaggtggtgattctgaaaaaggccacggcgtacatcctctcggtgcaggcggagactcagaaactcatctcagagatcgacctccttcgcaagcagaatgagcagttgaagcataagctggaacagttgcggaattcatgt

SEQ ID NO: 17675 - DNA, 270 bp, Artificial Sequence
  Description of Artificial Sequence: Synthetic coding sequence
atgacggaggagaacgtaaagcggcgcactcataacgtactcgagcgccagcggaggaacgagctcaagcgaagcttcttcgcactgcgcgaccaaattcccgagcttgagaacaatgagaaggcaccaaaggtagtgatactaaagaaggccactgcctatatcctgagtgttcaagccgagacgcaaaaactgatatcggagattgacttactgcgaaagcagaacgaacaactaaagcataaactggagcaattgcggaactcgtgc

SEQ ID NO: 17676 - DNA, 270 bp, Artificial Sequence
  Description of Artificial Sequence: Synthetic coding sequence
atgactgaagaaaacgtgaagcgtcgcacccacaatgttctggaacgacagagaaggaacgaactgaaaagatccttttttgctctgagagatcaaattccggaactggagaataacgagaaggcgcctaaggtggtgatccttaagaaggccactgcatacatcctttcggtccaggctgaaacccagaagctgattagcgaaatcgacctcctgcggaagcagaatgagcaactgaagcataaactggagcaattgaggaatagctgt

SEQ ID NO: 17677 - DNA, 270 bp, Artificial Sequence
  Description of Artificial Sequence: Synthetic coding sequence
atgaccgaagaaaacgtgaagcgaaggacgcacaacgtcctggagagacaaagacgcaatgagctcaagcgttctttcttcgctcttcgtgaccagatcccggagctggagaacaatgaaaaagcaccgaaggtggtcatccttaaaaaggccaccgcctacatcctgagcgtgcaggcagagacacagaagctcatatctgaaatcgacctactgagaaaacagaacgagcagctgaagcataaacttgagcagctgaggaactcttgt

SEQ ID NO: 17678 - DNA, 270 bp, Artificial Sequence
  Description of Artificial Sequence: Synthetic coding sequence
atgacagaagaaaatgtcaaaagaagaacacataatgttcttgaaagacaaagaaggaatgaattaaaaagaagtttttttgctcttagagaccagattccagaattagaaaataatgaaaaagctccaaaggttgttattttaaagaaagccactgcttatattttgtcagttcaagctgaaacacaaaaacttatctcagaaatagatttacttagaaaacaaaatgaacaattaaaacataagttagaacaattaagaaattcttgt

SEQ ID NO: 17679 - DNA, 270 bp, Artificial Sequence
  Description of Artificial Sequence: Synthetic coding sequence
atgactgaggagaatgtcaagcgccgcactcataatgtgttggaacgccaaagacggaacgaactcaagcggtcgtttttcgccctgagggatcagatcccagagctcgagaacaacgaaaaggcaccgaaggtggtgattctgaagaaagcgaccgcttacatcctgtcagtccaagccgaaacccaaaaacttatctccgaaatcgacctgctgcggaagcagaacgagcagctgaagcacaaactcgaacagctcagaaatagctgt

SEQ ID NO: 17680 - DNA, 270 bp, Artificial Sequence
  Description of Artificial Sequence: Synthetic coding sequence
atgacagaagaaaacgtcaaaaggaggacacacaatgtgctggaacggcagaggcgcaatgaactcaaaagaagtttctttgccttacgggatcagatacctgaactcgaaaacaatgaaaaggctcccaaagtagtaatcctcaagaaagccactgcttatatactatcagttcaggccgaaacacagaaactcatttcagaaatagatctgcttcgcaaacagaatgagcagttaaaacataaactcgaacagcttcgcaacagttgc

SEQ ID NO: 17681 - DNA, 270 bp, Artificial Sequence; identical to SEQ ID NO: 17657
  Description of Artificial Sequence: Synthetic coding sequence

SEQ ID NO: 17682 - DNA, 270 bp, Artificial Sequence
  Description of Artificial Sequence: Synthetic coding sequence
atgaccgaggaaaatgtgaaacgtcgtacgcataacgtcctggagcgccaacggcgtaacgaacttaagaggtcatttttcgcgctccgggaccagatccccgagctcgagaacaacgaaaaggctccgaaggtagtcatcctgaagaaagcaaccgcctatatcttgtccgttcaggctgagactcagaagcttatcagcgagatcgacctgctccgcaagcaaaatgagcagctcaagcacaagctcgagcagctccgcaactcttgc

SEQ ID NO: 17683 - DNA, 270 bp, Artificial Sequence
  Description of Artificial Sequence: Synthetic coding sequence
atgaccgaagaaaacgtgaaaaggagaacacataacgtgctcgagagacagagacggaatgaactgaaacgaagctttttcgctttgcgggaccaaattcccgagctggaaaacaatgagaaagcccccaaggtggtgatcctcaagaaggctactgcctatatcctctcagttcaggctgagacgcagaagctgatctccgagatcgacctactcaggaagcagaacgaacaattgaagcataagcttgagcagctccgtaattcatgt

SEQ ID NO: 17684 - DNA, 270 bp, Artificial Sequence
  Description of Artificial Sequence: Synthetic coding sequence
atgaccgaagagaatgtcaaacgccggacccataatgtgttagagcgacaaagaagaaatgaattgaaaaggtcttttttcgctctgagagatcagattcctgagttggagaacaatgaaaaagcccccaaggttgtgattctcaagaaagctactgcgtatattctgtccgtgcaagccgaaacccaaaagctgatttccgagatcgatctgctgcgaaaacaaaacgaacagctgaaacacaaactcgaacaactccggaacagctgt

SEQ ID NO: 17685 - DNA, 270 bp, Artificial Sequence
  Description of Artificial Sequence: Synthetic coding sequence
atgacagaggagaacgtgaaaagaaggacccacaatgtccttgaacgacagcgaaggaacgaactaaaacgcagtttctttgcactaagagaccaaatccctgaactagaaaacaatgagaaggcccccaaagtagtaattcttaagaaggcaactgcctatatcctgagtgtgcaggctgaaactcagaaacttatctctgagatcgacctacttaggaaacagaacgaacaactgaaacataaattagagcagctcagaaatagttgt

SEQ ID NO: 17686 - DNA, 270 bp, Artificial Sequence
  Description of Artificial Sequence: Synthetic coding sequence
atgaccgaggaaaacgtgaaaaggcgcactcataacgtcctggagagacagcgccggaatgagcttaagagatccttctttgccctgcgcgaccagatccctgaactggagaataacgaaaaagcacctaaggtggtgattctgaagaaggccactgcctacatcctctctgtgcaggctgagactcaaaagctgatttcggaaatcgacctgttgcggaagcagaacgagcaacttaagcacaaactcgagcaattgaggaatagctgc

SEQ ID NO: 17687 - DNA, 270 bp, Artificial Sequence
  Description of Artificial Sequence: Synthetic coding sequence
atgacggaagaaaatgtgaagagacgtactcataatgtgcttgagagacaacgtagaaatgaacttaaacgcagtttcttcgccttgagagaccagattccagagcttgaaaataatgaaaaggcccctaaggttgtgatcttgaaaaaggctactgcatatattttgtcagttcaggccgaaactcagaaactgatttcagagattgatctcctgcgaaagcagaacgagcagctcaaacataaacttgagcaattacgtaacagctgt

SEQ ID NO: 17688 - DNA, 270 bp, Artificial Sequence
  Description of Artificial Sequence: Synthetic coding sequence
atgactgaggagaatgtcaaaagaagaactcataatgtcctcgagagacagcgccgaaatgagctgaagcgctcgttcttcgcgctcagagatcaaatcccggagttggagaataatgaaaaagcaccgaaggtggtgatcctcaagaaggccaccgcctacattctgtccgttcaggctgaaacccaaaaactgatcagcgaaattgacctcttgcgcaagcagaacgaacaattgaaacataagctggagcaactgcggaactcctgt

SEQ ID NO: 17689 - DNA, 270 bp, Artificial Sequence
  Description of Artificial Sequence: Synthetic coding sequence
atgactgaggaaaatgtgaagcggaggactcacaatgtgctggaaaggcaaagacggaacgagcttaagcgaagcttctttgccctgagagaccaaattccggaactggagaataatgagaaagctcctaaagtggtgattttaaagaaggctactgcctatatcctgtcagtacaggcagagactcagaaattgatatctgagatcgacctgttgaggaagcagaatgagcagctcaagcacaaactggaacaattgcgaaattcatgt

SEQ ID NO: 17690 - DNA, 270 bp, Artificial Sequence
  Description of Artificial Sequence: Synthetic coding sequence
atgactgaagaaaatgtgaaacggcggacccataacgtgctcgaacgccagaggcggaacgaactgaagaggagcttcttcgccctgcgcgaccagataccggaactggagaacaacgagaaagctccaaaagtggtcatcctgaagaaggctaccgcttacatcctgtcagtccaagcagaaactcagaagttgatctcagaaattgatctgttgcgaaaacaaaacgaacaactcaaacacaagctggaacagctcaggaactcctgc

SEQ ID NO: 17691 - DNA, 270 bp, Artificial Sequence
  Description of Artificial Sequence: Synthetic coding sequence
atgaccgaggagaatgtgaagcgccggactcataacgtcttggaacggcaacgccgcaacgagctgaagaggtcgtttttcgcgctcagggaccaaatccccgaactggaaaacaatgaaaaagccccgaaggtggtgattcttaagaaagccactgcgtacatcctttcagtgcaggccgagactcagaagctcatcagcgagatagatctcctgagaaagcaaaacgagcagcttaaacacaaattggaacaactccgcaattcctgc

SEQ ID NO: 17692 - DNA, 270 bp, Artificial Sequence
  Description of Artificial Sequence: Synthetic coding sequence
atgacggaagagaacgtgaaaagacgcactcataatgtcctggaaagacagagacgaaacgagctcaagaggtcattctttgcgcttagagatcagatacctgagctcgaaaacaacgagaaggcgccgaaagtggtgatacttaagaaggccaccgcttacattctttcggtccaggctgagactcaaaagctgatttcagaaatcgatctgctccgaaagcagaatgaacagctcaagcacaaactcgaacaacttcggaactcctgc

SEQ ID NO: 17693 - DNA, 270 bp, Artificial Sequence
  Description of Artificial Sequence: Synthetic coding sequence
atgaccgaagaaaacgtgaaacgccgtacgcacaacgtgctggagaggcagcggaggaatgaactcaagaggagcttcttcgctctgagggaccagatccctgagctggaaaacaacgagaaagcacccaaggtagttatcttgaaaaaggcgacagcgtatattttgtcggtgcaggctgagacacagaaactgatctcagagatcgatctgttgcgcaaacagaatgagcaactgaaacataagcttgaacagctacggaattcctgt

SEQ ID NO: 17694 - DNA, 270 bp, Artificial Sequence
  Description of Artificial Sequence: Synthetic coding sequence
atgacggaggagaacgttaagagacgtacccataacgtgctggaaagacaacggcgcaacgagctcaaacgcagcttttttgcgctgcgcgaccagatccctgagctcgagaataatgaaaaagccccaaaggtcgttatcttgaagaaggcgactgcctatatcctgagcgtccaggccgaaacccagaagctgatttccgagatcgacctgttgcgcaaacagaacgagcagttgaagcacaagctggagcagctgcgaaactcatgt

SEQ ID NO: 17695 - DNA, 270 bp, Artificial Sequence
  Description of Artificial Sequence: Synthetic coding sequence
atgactgaggaaaacgtcaagcgccgtacccacaacgtgctggaacgacagcgtcgcaatgaactgaaacgttcgttcttcgcacttagagatcaaatccctgaactggaaaacaacgagaaggccccgaaggtggtgatccttaagaaggcgactgcctacatcctttcggtgcaagccgaaactcagaaacttattagcgaaatcgatctcctccggaaacaaaatgaacagctgaagcataagttggaacagctgaggaactcatgt

SEQ ID NO: 17696 - DNA, 270 bp, Artificial Sequence
  Description of Artificial Sequence: Synthetic coding sequence
atgaccgaagagaatgtcaagcgccggactcataacgtgctcgagaggcaacgtcggaatgagttgaaacggtccttcttcgcactgagggaccaaattcccgagctggagaataacgagaaagcaccgaaggtcgtcatcctcaagaaggcaaccgcgtacatcctcagcgttcaggccgaaacgcagaaattgatttcggaaatcgacctgctgcgcaaacaaaacgagcaacttaaacacaagctggaacagcttagaaactcatgt

SEQ ID NO: 17697 - DNA, 270 bp, Artificial Sequence
  Description of Artificial Sequence: Synthetic coding sequence
atgactgaggagaatgttaagcggaggacccacaacgtgcttgaaagacagcgtcgaaacgaactgaagagatcattctttgccttgcgtgatcaaatccctgaactggaaaacaatgaaaaagcaccgaaggtggtcatactcaagaaagcgactgcttacattctgtcggttcaggcagaaacccagaagctcatcagtgagattgacctgctgagaaaacagaacgaacagcttaaacataaacttgagcaactgcgcaactcctgc

SEQ ID NO: 17698 - DNA, 270 bp, Artificial Sequence
  Description of Artificial Sequence: Synthetic coding sequence
atgaccgaggagaacgtgaaaagaagaacgcataacgtcctggaacggcaaaggcgaaacgagctcaagagatcgttcttcgcacttcgcgaccagatccccgagctggagaataacgaaaaagcgccaaaggtggtcattttgaagaaggctactgcctacattttgagcgtccaagccgaaactcagaagttgatctcagaaattgatctgctccggaaacagaacgaacaattgaaacacaaacttgagcagctgaggaattcatgc

SEQ ID NO: 17699 - DNA, 270 bp, Artificial Sequence
  Description of Artificial Sequence: Synthetic coding sequence
atgactgaggaaaacgtcaaacggcgaactcataacgtgctcgaacgccaacggcgcaatgagcttaagcgctccttcttcgcgctgcgtgatcagattccggaactggaaaacaatgagaaggcaccaaaggtggtcattctcaagaaggcaacggcttacatcctcagcgtccaagccgaaacccagaaactgatttcagaaatcgaccttctgagaaagcaaaacgagcagctcaagcacaaattggaacaactgcgtaattcgtgt

SEQ ID NO: 17700 - DNA, 270 bp, Artificial Sequence
  Description of Artificial Sequence: Synthetic coding sequence
atgaccgaggaaaacgtgaaaaggagaacccataatgtcttggaacggcaaagaagaaacgaattgaagcgctccttttttgctctgagagatcaaattcctgagcttgaaaacaacgaaaaggcacccaaggtggttattctgaagaaggcgaccgcatacattctgtccgttcaggcagaaactcagaaactgatttcggaaatcgatctgctgaggaagcaaaatgaacaacttaagcacaaactggagcagcttcgaaacagctgc

SEQ ID NO: 17701 - DNA, 270 bp, Artificial Sequence
  Description of Artificial Sequence: Synthetic coding sequence
atgaccgaggaaaatgtgaaaaggcgcacgcataatgtgctagaacggcaaaggcggaacgagctgaagcgcagtttttttgccctcagagaccagatccccgagcttgagaacaacgagaaagctcctaaagtggtcatccttaaaaaggccactgcatatatcctctccgtgcaggccgagactcagaaactcatctccgaaatcgacctgctacggaaacaaaacgaacagttgaagcataaactggagcagttgaggaatagttgc

SEQ ID NO: 17702 - DNA, 270 bp, Artificial Sequence
  Description of Artificial Sequence: Synthetic coding sequence
atgaccgaagaaaatgttaaacgcaggacgcacaatgtgctggagaggcagagacgcaacgagctgaaacgcagtttcttcgcgctccgtgatcagatccctgagctggagaacaacgaaaaggccccaaaggtggtgatcctcaaaaaggcaacagcctatatactctccgtgcaggccgaaacacagaagcttatttccgaaatcgatctgctaaggaagcagaatgagcagcttaagcacaagctggaacagctgcgtaacagttgc

SEQ ID NO: 17703 - DNA, 270 bp, Artificial Sequence
  Description of Artificial Sequence: Synthetic coding sequence
atgacggaggaaaatgtgaaaagacgaacacacaacgtgcttgagcgccagcgaaggaacgagctgaagcgttcttttttcgcacttcgcgatcagatccccgagttagaaaataacgaaaaggctccaaaagtagtgatacttaagaaggccacagcttacatcctgagtgtgcaggctgagactcagaaactgatcagtgagattgatcttttgaggaaacaaaatgagcagctgaaacataagctggagcagctcagaaattcctgc

SEQ ID NO: 17704 - DNA, 270 bp, Artificial Sequence
  Description of Artificial Sequence: Synthetic coding sequence
atgactgaagagaatgtcaagagacgaacccataacgtgttggaaagacagagacgcaacgagcttaagaggtccttctttgcactcagagatcaaataccagagcttgagaataatgaaaaggcgccaaaggtggtgatcctgaagaaagccaccgcctacattctgtcagtgcaagcagagactcagaaactgatatccgagatcgacctcctccggaaacagaatgaacaactgaagcataagctggaacaactgcggaattcatgt

SEQ ID NO: 17705 - DNA, 270 bp, Artificial Sequence
  Description of Artificial Sequence: Synthetic coding sequence
atgactgaggagaacgttaagagaagaactcacaatgtcctggaaaggcagcgccgtaacgaactgaagaggtccttttttgcactgagggaccagatccccgagctggaaaacaacgaaaaggccccgaaggtggtgatcctgaaaaaagctacagcatacatcctatctgtgcaggccgagacccagaagttaatatcggagatcgacttgctgcggaagcagaacgagcagctcaagcacaagctggagcagctcaggaactcctgt

SEQ ID NO: 17706 - DNA, 270 bp, Artificial Sequence
  Description of Artificial Sequence: Synthetic coding sequence
atgaccgaggagaacgtcaaaaggaggactcataatgttttggagcgacagcggagaaacgagttgaagcgcagtttcttcgccctgagagatcagatccctgagctggagaataacgagaaggccccgaaggttgtgatcttgaaaaaagcaaccgcatacattctttcagtacaggcagaaactcagaagctgatctcagagatcgatctgttgcgcaagcagaacgaacagctcaaacataaactcgagcaactgaggaattcctgt

SEQ ID NO: 17707 - DNA, 270 bp, Artificial Sequence
  Description of Artificial Sequence: Synthetic coding sequence
atgacagaagaaaatgtcaaaagaagaacgcataatgttctggagcgccaaagacggaacgagctcaagcggtcgttcttcgccctgagagaccagattcccgagctggagaataatgaaaaggcgccaaaggtggtcattctgaaaaaggcgaccgcgtatattctgtctgtgcaagcggagacccagaagctcatcagcgagatcgatctcttacgaaagcagaacgaacagttgaagcataagctggagcagctcagaaatagttgc

SEQ ID NO: 17708 - DNA, 270 bp, Artificial Sequence
  Description of Artificial Sequence: Synthetic coding sequence
atgacagaggagaacgttaaacgtcgaacccataacgtactggagagacagcgccgaaatgaattaaaacgttcattcttcgctctgagagatcagattccagaactagaaaataacgaaaaagcgccgaaagttgtcatcttaaaaaaagcgacggcgtatatccttagtgtccaagccgaaacacaaaaattgatatctgagatcgatctgttgagaaaacaaaatgaacaattaaaacacaagcttgaacagctccgcaattcgtgt

SEQ ID NO: 17709 - DNA, 270 bp, Artificial Sequence
  Description of Artificial Sequence: Synthetic coding sequence
atgaccgaagagaacgtcaaacgtaggactcacaatgtgttagaacggcagcgacgcaatgagctgaagcggagttttttcgctcttcgagatcaaatccccgagctggagaataacgaaaaggcccctaaggtagtgattttgaagaaagcaaccgcttacatcctgagtgtgcaagctgagacccagaagctcatcagcgagattgatttgctccggaaacagaacgagcagctgaagcataagctggagcagttacgcaattcatgc

SEQ ID NO: 17710 - DNA, 270 bp, Artificial Sequence
  Description of Artificial Sequence: Synthetic coding sequence
atgactgaagagaacgtcaaacgcaggacccataatgtgttggagcggcagcggagaaatgaactgaagagatcgtttttcgccctgagagatcagattcctgaactggaaaacaacgagaaggcacctaaggtcgttatacttaagaaggccacggcgtacatactctccgtgcaagcagagactcagaagttgatctccgaaattgaccttctccgaaagcaaaacgagcaactgaagcacaaactggaacagctgaggaattcgtgc

SEQ ID NO: 17711 - DNA, 270 bp, Artificial Sequence
  Description of Artificial Sequence: Synthetic coding sequence
atgacagaggaaaacgtgaaaagacggacacataatgtgcttgagcgacagcggaggaatgagctgaagcgaagtttctttgcattgcgagatcagatccctgaactcgagaacaatgaaaaggccccgaaggtggtcatcttaaagaaagcaaccgcttacatcctctctgtgcaagcggaaacccagaaactcattagtgaaattgacctgctgcgtaagcagaatgaacagctcaagcataagctcgagcagcttaggaatagctgc

SEQ ID NO: 17712 - DNA, 270 bp, Artificial Sequence
  Description of Artificial Sequence: Synthetic coding sequence
atgacggaagagaacgtcaaacgccgcactcacaatgtcctcgagcggcagcgccgcaatgagctcaagaggtccttttttgccctgcgagatcaaattccagaacttgagaataatgagaaggcacctaaggtggtgatcctgaaaaaagcgaccgcctacatcctttccgtgcaggccgaaacccagaagttgatcagcgaaattgaccttctgcggaaacagaacgagcagctgaaacacaagctggagcaactgcggaactcctgt

SEQ ID NO: 17713 - DNA, 270 bp, Artificial Sequence
  Description of Artificial Sequence: Synthetic coding sequence
atgactgaagagaatgtgaaacggagaacccataatgtcctggagagacaaagaaggaatgagttgaaacggagcttcttcgccctgcgagaccagattcccgagttagagaacaatgaaaaagccccaaaagtggtgatcctgaagaaggccaccgcctatatcctcagcgtgcaggccgaaacgcagaagttgatctcagagatcgacctgcttcgcaaacagaacgagcagctcaagcacaaattggaacagctccggaatagttgt

SEQ ID NO: 17714 - DNA, 270 bp, Artificial Sequence
  Description of Artificial Sequence: Synthetic coding sequence
atgactgaggagaatgtgaagcgcagaactcacaatgtcctcgaaaggcagcggcgcaatgaactcaagcggtcattcttcgcgctgcgcgaccaaatcccagaattggagaacaatgagaaagccccgaaagtcgtcatcctcaagaaagcgactgcctacattctttcggtgcaggccgaaacccagaagctcatctcggaaatcgacctgctcagaaaacagaatgagcagctgaagcacaagctggagcaattgcggaattcctgc

SEQ ID NO: 17715 - DNA, 270 bp, Artificial Sequence
  Description of Artificial Sequence: Synthetic coding sequence
atgacagaagaaaacgtgaaacgccggacacacaacgtactggaaaggcagcgccggaacgaactgaaaaggtcttttttcgctttgagggatcagatccccgagcttgaaaacaatgaaaaagcccctaaagttgtgatactgaaaaaagctacggcttatatccttagtgtgcaggcagagactcagaagcttataagtgagatcgatcttctacgaaaacagaacgaacagcttaaacacaagctagagcagttaaggaatagttgc

SEQ ID NO: 17716 - DNA, 270 bp, Artificial Sequence
  Description of Artificial Sequence: Synthetic coding sequence
atgactgaggaaaatgtgaagcgccgcacgcataatgttctggagcggcaacggcgcaacgaactgaaacggagttttttcgcccttagagatcagatcccggaactggagaataatgaaaaggctccaaaggtggtcatactgaaaaaggccaccgcgtacatcctgtccgtgcaggcagagactcagaagttgatctcagaaattgatcttttgcgaaaacagaacgaacaactgaagcacaaactcgagcagctgagaaacagctgt

SEQ ID NO: 17717 - DNA, 270 bp, Artificial Sequence
  Description of Artificial Sequence: Synthetic coding sequence
atgacagaagaaaatgtgaagaggcgaacacataacgtcctcgaacggcagaggcgcaacgagctcaaacggtctttcttcgcgctgcgcgaccagatccccgagctcgaaaataatgagaaggcccccaaagtggtgatcctaaagaaagctacggcttatatcttgtccgtccaagcagagacacagaagctgataagtgagatcgatctccttcgtaaacagaacgagcagctgaaacacaagttggaacaactgagaaactcttgc

SEQ ID NO: 17718 - DNA, 270 bp, Artificial Sequence
  Description of Artificial Sequence: Synthetic coding sequence
atgaccgaggagaatgtgaagcgtcggacccataatgtcctggaacggcaacgtagaaatgaacttaagcggagcttttttgctctcagagatcagatcccagaactggaaaacaatgagaaggcacccaaagtcgtgattctgaaaaaggccactgcatacattctttccgtgcaggccgagactcagaagctcatatcagaaatcgatctgcttcgaaagcagaacgagcaattgaaacacaaactcgaacaacttcgaaattcatgc

SEQ ID NO: 17719 - DNA, 270 bp, Artificial Sequence
  Description of Artificial Sequence: Synthetic coding sequence
atgactgaggagaacgtgaaacgcagaacccacaatgtgctggaaaggcagcggcgcaacgaattgaaaagatccttcttcgccctgcgtgaccagataccggaactggagaacaacgagaaggcccctaaagttgtcatactcaagaaagctactgcatatatactgagtgtgcaggctgagacccaaaaacttatcagcgaaatcgatttgttgcgaaagcagaatgaacagcttaaacacaagcttgagcagttgcgcaacagctgc

SEQ ID NO: 17720 - DNA, 270 bp, Artificial Sequence
  Description of Artificial Sequence: Synthetic coding sequence
atgacggaagagaacgtgaaaagaagaacccataacgtgcttgaacggcaacgtaggaatgaactgaagcggagcttcttcgccctccgcgaccaaatccctgagctggagaacaatgaaaaagccccaaaggttgtgatcctgaaaaaagctaccgcgtacatcctcagcgtgcaagctgaaacccagaaactgatcagcgaaatcgatctgcttcgcaagcagaacgagcaactgaagcacaagctggaacagctcagaaactcgtgc

SEQ ID NO: 17721 - DNA, 270 bp, Artificial Sequence
  Description of Artificial Sequence: Synthetic coding sequence
atgacggaagaaaatgtgaagcgccgaacccacaacgtgttagagcggcagcggcgcaacgagctcaaacggagcttcttcgctctccgggaccagatccctgaactcgaaaacaacgagaaggcacccaaagtggtcatcctgaagaaagcaaccgcctatatcttgagcgtccaggcagagacccagaagttgatatctgagatcgatctgcttaggaagcagaatgagcaacttaagcacaagctagagcaactgagaaactcctgc

SEQ ID NO: 17722 - DNA, 270 bp, Artificial Sequence
  Description of Artificial Sequence: Synthetic coding sequence
atgacggaagaaaatgtaaaacgtcgtacgcataatgttttagaacgacaacgacgtaatgaattaaaacgttcgttttttgcgttacgagatcaaataccggaattagaaaataatgaaaaagcgccgaaagttgttatactaaaaaaagcgacggcgtatatactatcggtacaagcggaaacgcaaaaactaatatcggaaatagatctattacgtaaacaaaatgaacaactaaaacataaattagaacaattacgtaattcgtgt

SEQ ID NO: 17723 - DNA, 270 bp, Artificial Sequence
  Description of Artificial Sequence: Synthetic coding sequence
atgactgaggagaacgtgaagcggcggacccacaatgtgcttgagcggcagcgcaggaacgagctgaagcggagctttttcgcgcttagagatcaaattcccgagcttgagaataacgaaaaggcacccaaggtggtgattctcaaaaaggccaccgcatacatcttgagcgtgcaggcagaaacccaaaaacttatttcggaaatagatctcttgcgtaagcagaacgaacaactgaaacataagctggaacaactccgcaacagctgt

SEQ ID NO: 17724 - DNA, 270 bp, Artificial Sequence
  Description of Artificial Sequence: Synthetic coding sequence
atgaccgaggagaatgtcaaaagaagaactcataacgtgctagagagacagcggagaaatgaacttaagcggagcttcttcgccctgcgggaccagattccggagcttgagaacaacgaaaaagctccaaaagtggtcattctaaaaaaggcgactgcttacatcctgtctgtccaggctgagacccagaaactcattagcgagattgacctcctaagaaagcaaaatgagcagcttaaacataagctagagcagttgcggaatagctgt

SEQ ID NO: 17725 - DNA, 270 bp, Artificial Sequence
  Description of Artificial Sequence: Synthetic coding sequence
atgaccgaagaaaatgtcaagaggcggacccataacgtgctggaacgccaaaggagaaacgagctcaaacgttcctttttcgcactgagggatcagatccctgaattggagaacaacgagaaggcaccaaaggtcgtgattcttaagaaggccactgcgtacattttgagcgttcaagctgagacgcaaaagctgatcagcgaaatcgacctgctgcgtaaacagaacgagcaacttaagcacaaacttgagcagcttcgcaactcatgt

SEQ ID NO: 17726 - DNA, 270 bp, Artificial Sequence
  Description of Artificial Sequence: Synthetic coding sequence
atgacggaagaaaacgtgaagcgcagaactcacaacgtactcgaaagacagcgtcgtaacgagcttaaaagatcttttttcgcgttgcgggaccaaattccagagcttgaaaataatgagaaagcaccgaaagttgtgattctgaagaaagccacagcttatatcctgagcgttcaagccgaaacacaaaagcttatttcagaaatcgacttactaaggaaacaaaacgagcaattaaaacataaacttgaacagttacggaattcttgt

SEQ ID NO: 17727 - DNA, 270 bp, Artificial Sequence
  Description of Artificial Sequence: Synthetic coding sequence
atgacggaggagaacgtgaaaaggaggacacataatgtgcttgagagacagcggcgaaatgaattaaagaggtctttctttgctctgcgcgaccagatccctgagctggaaaataacgaaaaggctccaaaggtggtcatactcaagaaggcaaccgcatatatattgagcgttcaagcagagacacagaagttgattagtgaaattgacttacttcgcaaacaaaatgagcaactgaagcacaaactcgaacagctgcggaactcatgt

SEQ ID NO: 17728 - DNA, 270 bp, Artificial Sequence
  Description of Artificial Sequence: Synthetic coding sequence
atgaccgaagaaaatgtgaagaggcgcactcataacgtcctcgagcgccagcggagaaacgagctcaagaggagcttcttcgccctgagggaccagattccagagcttgagaataacgaaaaggctcccaaagttgtgatcctgaaaaaagccactgcatacattcttagcgtccaggctgaaacccagaagctgatctcggaaatcgacttgctgaggaagcaaaatgagcagctcaagcataagctggagcagctccgcaactcctgc

SEQ ID NO: 17729 - DNA, 270 bp, Artificial Sequence
  Description of Artificial Sequence: Synthetic coding sequence
atgaccgaggagaatgtcaagcggcgcactcataacgtcctagagaggcagaggcggaatgaactgaagcggtccttcttcgcgctgcgggaccaaatccctgagctggaaaacaatgagaaggcccccaaagtagtgatattgaaaaaagcaacagcctacattctgtctgttcaggccgaaacccagaagctgattagcgagattgacttgctgcgcaagcaaaatgagcagttgaagcacaaactggagcaactgagaaacagctgt

SEQ ID NO: 17730 - DNA, 270 bp, Artificial Sequence
  Description of Artificial Sequence: Synthetic coding sequence
atgacagaagaaaatgtcaaacggcggacacataatgtgctggagagacaacggagaaacgagctcaaacggtcattttttgcactaagagaccagattccggagctggagaacaacgagaaggcccctaaagtcgtcattctcaaaaaggccacagcctacattttgagtgttcaggccgagacccagaaactgatcagcgagatagatttgcttagaaagcaaaacgagcagctaaaacacaagctggaacagctgcgaaattcctgc

SEQ ID NO: 17731 - DNA, 270 bp, Artificial Sequence
  Description of Artificial Sequence: Synthetic coding sequence
atgaccgaggaaaacgtcaagcgaaggacacataacgtgctggaaagacagcgtaggaatgaactgaaaaggtctttttttgccttaagggaccagataccggagcttgagaacaacgaaaaggctcctaaagtcgtcatcctaaagaaagctactgcttacatcctgagcgtccaggccgagacccaaaaacttatctctgaaatagatttgcttcgcaagcagaacgagcagttgaaacacaaactcgagcagttaaggaacagctgc

SEQ ID NO: 17732 - DNA, 270 bp, Artificial Sequence
  Description of Artificial Sequence: Synthetic coding sequence
atgaccgaggaaaatgtcaaacgtcggactcataacgtgctcgaaaggcagcggagaaacgaactaaagagaagtttctttgccctgcgcgaccagatcccagagttggagaacaacgaaaaggcccccaaggttgttattctcaagaaagctaccgcttacatactctcagtgcaggccgagacacagaagctcatttctgaaatagatctgctgcgtaaacagaatgaacagttgaagcacaaactggaacaattacgcaacagctgt

SEQ ID NO: 17733 - DNA, 270 bp, Artificial Sequence
  Description of Artificial Sequence: Synthetic coding sequence
atgaccgaggagaacgttaaacgaaggacgcataacgtgctggagcgacagaggaggaacgagctgaagcgcagcttctttgctcttcgggatcagatacctgaattggaaaataatgagaaggcacccaaagtcgttatactgaagaaagcgacagcatacatactgtcagtccaggctgagacacagaaattgatctctgaaatcgacctgctgagaaagcagaacgagcagcttaagcacaagctggaacagcttcgtaattcctgt

SEQ ID NO: 17734 - DNA, 270 bp, Artificial Sequence
  Description of Artificial Sequence: Synthetic coding sequence
atgaccgaggaaaatgtcaaaagacgcacccacaacgtgctcgagcggcagcgcaggaacgaactgaagcgctccttctttgcgcttcgggaccaaataccagaattggaaaacaatgaaaaggcaccgaaggtggtgatcctgaagaaggctacggcatacatcctgtcagtgcaggccgagactcagaagctgatctcagaaatcgacttgctccggaaacaaaacgagcagcttaagcataaactcgaacaattgagaaactcgtgt

SEQ ID NO: 17735 - DNA, 273 bp, Artificial Sequence
  Description of Artificial Sequence: Synthetic coding sequence
atgactgaagagaacgttaagcgccgcacccacaacgtgttggaacgccagcgtcgcaatgaattgaaacgaagcttctttgcgctgagggaccagatcccagaactggaaaacaatgaaaaggctccaaaggttgtgatcctcaaaaaggcaaccgcctatatcctgtccgtgcaagcggagacccagaagttgataagcgagatcgatttattgagaaaacaaaatgaacagctgaaacacaaactggagcagctgcgaaattcctgcgcc

SEQ ID NO: 17736 - DNA, 273 bp, Artificial Sequence
  Description of Artificial Sequence: Synthetic coding sequence
atgacagaagaaaatgtaaaacggcgtacacataatgtgcttgaacgacaaagacgcaatgagttgaaacgatcattcttcgctctaagggatcagatacccgaactcgaaaataacgaaaaagcacccaaagtagtcattcttaagaaagccacagcctatatactctctgtgcaagccgaaacacaaaaattaatatctgagatagatcttctgcgaaaacagaatgagcagcttaaacataagctggaacagctccggaattcctgtgcg

SEQ ID NO: 17737 - DNA, 273 bp, Artificial Sequence
  Description of Artificial Sequence: Synthetic coding sequence
atgacagaggaaaacgtgaaacgacgcacacataacgtgctggaaaggcagcggaggaatgaactcaaacggtctttttttgctctcagagaccagatacccgaattggagaacaacgagaaagcacccaaagtagtcatactcaaaaaggccactgcttatatcctgtctgttcaggctgaaactcagaaactcataagtgaaatagatctcctcaggaagcagaacgaacagctgaagcataaacttgaacagctgcgaaattcttgcgca

SEQ ID NO: 17738 - DNA, 273 bp, Artificial Sequence
  Description of Artificial Sequence: Synthetic coding sequence
atgactgaagagaacgtcaagcggaggactcacaacgtgctcgagaggcagcggcgcaatgaactgaaaaggtccttctttgcactacgcgatcagatccctgaattggaaaacaacgaaaaagccccaaaagtcgtcatacttaaaaaagccacagcttacattctaagtgttcaggctgagacacagaaactgatcagtgaaatagatttattgcggaaacagaatgaacagctcaaacacaaacttgaacagttaaggaattcttgcgca

SEQ ID NO: 17739 - DNA, 273 bp, Artificial Sequence
  Description of Artificial Sequence: Synthetic coding sequence
atgaccgaagaaaacgtcaagcgacggactcataatgttctggagcgccaacgacgtaatgagcttaagagatcgttcttcgcacttagggatcagattcccgaactcgaaaataacgaaaaggctcctaaagtggtcatcctgaagaaggcgaccgcttacatcctgtcagttcaggcagaaacacagaagctgatatcggaaatcgatcttttgagaaaacaaaatgaacagcttaaacataaactcgaacagctcagaaacagttgtgca

SEQ ID NO: 17740 - DNA, 273 bp, Artificial Sequence
  Description of Artificial Sequence: Synthetic coding sequence
atgaccgaggagaatgtgaaaaggaggacacacaacgtgttggagagacaacgacgaaatgaacttaagcgctctttctttgccctcagggatcagattcctgagttggagaataatgagaaagccccaaaagtggtgattttgaagaaggctacggcttacatccttagcgtacaggcagagacccagaagctcataagtgaaatagacctgttgagaaaacagaatgagcagttgaaacataagcttgagcagctgaggaatagctgtgcc

SEQ ID NO: 17741 - DNA, 273 bp, Artificial Sequence
  Description of Artificial Sequence: Synthetic coding sequence
atgacagaggagaatgtgaaacgccgtacccataacgtgctggagagacagagaagaaacgaattgaagaggtccttcttcgctcttcgcgatcagatcccagagctggagaataatgagaaagcccccaaggtggtgatactgaagaaggcaactgcttacatactgagtgtccaggctgaaactcagaaactgatttccgaaatagatcttctgcggaagcaaaatgagcagctgaaacacaagctggagcagctacgcaactcttgcgct

SEQ ID NO: 17742 - DNA, 273 bp, Artificial Sequence
  Description of Artificial Sequence: Synthetic coding sequence
atgaccgaggagaacgtgaagcgccgtacacacaatgttttggaaagacaaagacggaatgagcttaagcgcagcttcttcgcgcttcgcgatcagatcccagaactggaaaacaatgagaaggcaccaaaggtcgtgatcttgaaaaaggccaccgcatacatcctgagcgtccaggctgaaactcagaaattgattagcgagattgacctccttaggaagcaaaacgaacaactgaagcacaagttagagcagctgcgcaactcatgcgca

SEQ ID NO: 17743 - DNA, 273 bp, Artificial Sequence
  Description of Artificial Sequence: Synthetic coding sequence
atgaccgaggagaacgttaagcgacgcacgcacaacgtgttggaaagacaaaggcgcaacgaactcaaaagatcgttcttcgcactgagagaccaaatccctgaacttgaaaataacgaaaaggcccctaaggttgtgatcttgaaaaaggcaaccgcctatattctttcggtgcaggccgaaacacagaagcttatcagcgagattgacctcttgcggaaacagaatgagcagcttaagcataaacttgaacaattgcggaacagctgtgca

SEQ ID NO: 17744 - DNA, 273 bp, Artificial Sequence
  Description of Artificial Sequence: Synthetic coding sequence
atgaccgaggagaacgtcaaacgacgaacacataatgtcctggagcggcagcgccggaatgagctgaaacgcagcttctttgccctgcgggaccagatccctgagttggagaataacgagaaggctcctaaggtggtgatcctcaaaaaggctaccgcatatattctgtctgtacaggctgaaacccagaagctgataagcgagatcgatctcctgcgaaaacagaacgagcagctgaagcacaagctcgagcagctcaggaacagttgcgcc

SEQ ID NO: 17745 - DNA, 273 bp, Artificial Sequence
  Description of Artificial Sequence: Synthetic coding sequence
atgaccgaagagaacgtcaagcgccggacccacaacgtcctggagaggcaacggaggaatgaattgaagaggagcttcttcgccctgagggatcaaatcccagagttagagaataacgagaaagcccccaaggtcgtgatcttgaagaaagctaccgcgtatatactgtccgtgcaagctgaaactcagaaactcatatctgagatcgatttgctcaggaaacagaacgaacaactgaagcacaagcttgagcaacttagaaactcctgtgcg

SEQ ID NO: 17746 - DNA, 273 bp, Artificial Sequence
  Description of Artificial Sequence: Synthetic coding sequence
atgacagaggaaaacgtcaagcggcggactcacaatgtgttggagcggcagagaaggaacgaacttaagcgaagcttcttcgcactgcgggatcagatccccgaactggagaataatgaaaaggcacccaaggtcgtaattctcaaaaaagctactgcatacattctcagcgtccaggcagaaacacagaagctgattagtgaaatcgatttgctgcgaaagcaaaatgaacagttgaagcataagctcgagcagctcagaaacagctgcgca

SEQ ID NO: 17747 - DNA, 273 bp, Artificial Sequence
  Description of Artificial Sequence: Synthetic coding sequence
atgactgaagaaaacgttaagagaagaactcacaacgtgctggagcgacagaggagaaatgaactgaaacggagtttcttcgcccttagggaccagatacctgaacttgaaaacaatgaaaaagctcctaaagttgtgattcttaaaaaagccacagcctatatcctctctgtgcaggctgagacacagaaattaatctcagaaatagatttgctccggaagcaaaatgaacagctcaaacacaagttggaacaactcaggaatagttgcgct

SEQ ID NO: 17748 - DNA, 273 bp, Artificial Sequence
  Description of Artificial Sequence: Synthetic coding sequence
atgaccgaagagaacgtcaagcgccgaacacataacgtcctcgaaaggcagcggcggaatgaactcaagaggtctttttttgccttgagggatcagatacctgaactggaaaacaacgagaaagccccaaaggtcgtcatcctgaagaaagctacagcgtacatcctgagcgtgcaggcagaaacacagaaactcatctctgagatcgacctgctcagaaaacaaaatgagcaactgaagcataaactcgaacagctcaggaattcatgcgct

SEQ ID NO: 17749 - DNA, 273 bp, Artificial Sequence
  Description of Artificial Sequence: Synthetic coding sequence
atgaccgaagaaaatgtcaagagaaggacacataatgtgttggagcgacagcgtcggaacgaattaaagagatccttctttgccctcagagatcaaataccggagctcgagaacaacgagaaggcccccaaggttgtgattttgaaaaaggctactgcctacatccttagcgtccaggccgaaacccagaaattgataagcgaaattgacctgctgagaaagcagaacgagcaattgaagcataaacttgaacagctccgaaattcatgcgca

SEQ ID NO: 17750 - DNA, 273 bp, Artificial Sequence
  Description of Artificial Sequence: Synthetic coding sequence
atgacagaagagaatgttaaacggcgcacacataacgtgttggagcggcagcggcgaaatgagctgaagcggagcttttttgcgcttcgcgaccaaataccagagctggagaacaacgagaaggcccccaaagtggttatcctcaaaaaggcgacagcctacatacttagcgtgcaagcagaaacacagaaactgatctcagagattgatctgctccgcaagcaaaatgaacagctgaagcataaactggagcagttgagaaattcttgtgcc

SEQ ID NO: 17751 - DNA, 273 bp, Artificial Sequence
  Description of Artificial Sequence: Synthetic coding sequence
atgactgaggagaatgtgaaaagacgaacccacaacgtgttagagagacaacgccgaaacgaattgaaaaggagtttcttcgcacttcgagatcagattccggaactcgagaacaatgaaaaagcccccaaagtggtaatcctgaaaaaagcaaccgcctacatattatctgtccaggcagagacacagaagttaattagcgaaatagatctgctgcgcaagcagaatgaacagcttaaacataagctggagcagctgagaaactcttgcgct

SEQ ID NO: 17752 - DNA, 273 bp, Artificial Sequence
  Description of Artificial Sequence: Synthetic coding sequence
atgaccgaggagaacgtgaagcgccgtacacacaatgtattggagaggcagcgtcgcaatgagcttaagagaagcttcttcgcgctgagagaccagatacccgagctggagaacaacgagaaagcacccaaagttgtaattttgaaaaaggccactgcgtatattctgtcagtgcaggcagaaacccagaaactcatatctgagatcgacctactccgcaaacagaacgagcagctcaagcacaagctcgagcagctgaggaactcctgcgca

SEQ ID NO: 17753 - DNA, 273 bp, Artificial Sequence
  Description of Artificial Sequence: Synthetic coding sequence
atgactgaagagaacgtgaaacgaaggacccacaacgtgcttgaaagacagagaagaaatgaattaaaacggagcttcttcgcactgcgggaccagataccagaattggagaataacgagaaggcccctaaggtggtgatcctgaaaaaagctacagcatatatcctctccgtgcaggctgagacacagaagcttatttctgaaattgacctactcagaaagcagaatgagcagctcaagcacaaacttgagcagcttaggaacagttgtgct

SEQ ID NO: 17754 - DNA, 273 bp, Artificial Sequence
  Description of Artificial Sequence: Synthetic coding sequence
atgactgaggaaaacgtaaagaggcgcactcataacgtgctggagagacagaggagaaatgagctgaagcgctctttcttcgccctgcgagatcaaatcccagaactggaaaataacgagaaagctccaaaggtggttattctcaagaaggcgacggcctatattctctctgtgcaagccgaaactcagaaactcatttccgagatcgatctgctgagaaagcagaacgagcaactgaaacacaagctggagcaactgagaaactcctgcgct

SEQ ID NO: 17755 - DNA, 273 bp, Artificial Sequence
  Description of Artificial Sequence: Synthetic coding sequence
atgaccgaggagaacgtaaaaagacggacccacaacgtactggagaggcaacgcaggaacgagctgaagcgtagctttttcgcattgcgagaccaaatccccgagctggagaacaatgagaaggccccaaaggtagtcatcctgaagaaagctaccgcatatattctgagtgtgcaagcagaaacccagaagttgatttcggaaattgatcttttgcgcaagcagaacgagcagcttaagcataaattagaacagctcagaaactcttgcgcg

SEQ ID NO: 17756 - DNA, 273 bp, Artificial Sequence
  Description of Artificial Sequence: Synthetic coding sequence
atgactgaggaaaatgtcaaaagaagaacacacaacgtgttggagaggcagcgccgaaatgagctcaagcggagcttttttgcactgcgcgaccagatccccgagctggagaataacgaaaaggcacctaaagtggtaatcctgaaaaaggccacggcttatatcctctctgtgcaggccgaaactcagaagttgatctctgaaatagatctcctcaggaagcaaaacgaacagcttaaacataagctggaacagctgaggaacagctgcgcc

SEQ ID NO: 17757 - DNA, 273 bp, Artificial Sequence
  Description of Artificial Sequence: Synthetic coding sequence
atgacagaagagaatgtcaagaggagaactcacaatgttctggagcgacagaggagaaacgagttgaagcggtcctttttcgcacttagagatcagatacccgaactggagaacaacgagaaggcccccaaggtggtcattttgaagaaagccactgcctacatcctgagcgtccaggccgagacccagaagctcatttcagagattgacttgctccggaagcagaacgagcaactcaaacacaaacttgaacagttgagaaactcatgtgcc

SEQ ID NO: 17758 - DNA, 273 bp, Artificial Sequence
  Description of Artificial Sequence: Synthetic coding sequence
atgacagaagaaaatgtcaaacggagaactcacaatgttctcgaaaggcagcggcggaacgaactgaaacggtcgttctttgctctacgcgatcagataccagaattggagaacaatgagaaagcccccaaagtcgtgatcctcaaaaaagcaacagcctacattctgtctgtgcaggccgagacacagaaactgatctccgaaatcgatctcctaaggaagcagaacgaacagcttaaacataagctggaacagcttaggaattcctgcgct

SEQ ID NO: 17759 - DNA, 273 bp, Artificial Sequence
  Description of Artificial Sequence: Synthetic coding sequence
atgacagaggagaacgtcaagcgtagaacccacaacgtcctagagaggcaaaggagaaatgagctgaagaggagctttttcgcccttcgggatcagatccctgaacttgaaaataatgagaaggctcctaaggtggtgatactgaaaaaagctacggcatacatcctgtctgtgcaagccgagacccagaagttgatttcagaaatcgacctgctacggaagcagaatgaacagctcaagcataaactggagcagttacgaaattcctgcgcc

SEQ ID NO: 17760 - DNA, 273 bp, Artificial Sequence
  Description of Artificial Sequence: Synthetic coding sequence
atgaccgaggagaacgtcaagcggcggactcataacgtactggagagacaaagacgaaatgaactaaagcggagcttttttgcgctgcgcgaccagatacctgagttggagaataacgaaaaggcccctaaagtggtaatcctgaaaaaagctactgcctatattctctcagtccaggccgaaacacaaaaactgatatccgagatcgacttgttgagaaaacaaaacgagcagctaaaacataagctggagcagttgcggaatagctgtgcg

SEQ ID NO: 17761 - DNA, 273 bp, Artificial Sequence
  Description of Artificial Sequence: Synthetic coding sequence
atgaccgaagagaacgttaagagacgcacccataacgtgcttgagagacagaggagaaacgaactgaagaggagcttctttgccttgagagatcaaatcccagaacttgaaaacaatgagaaagcgcccaaggtcgtgatcttaaaaaaagcgactgcatacatcctgtcagttcaggccgaaactcaaaaactgatcagtgaaatcgacctgcttcgaaaacaaaacgagcagcttaagcacaaactggagcaacttagaaactcatgcgca

SEQ ID NO: 17762 - DNA, 273 bp, Artificial Sequence
  Description of Artificial Sequence: Synthetic coding sequence
atgacagaagaaaatgtcaaaaggcggacacataacgtgctggaacggcagcgaaggaacgaactcaagcggagttttttcgcactacgggatcagataccagaactggaaaacaacgaaaaggcaccaaaagtagttatcctcaaaaaagctacagcttacattctctcagtgcaggcagaaactcagaaattaatctctgaaatagatttgttgagaaaacagaatgaacagctgaaacataaactggaacagctcaggaattcttgcgca

SEQ ID NO: 17763 - DNA, 273 bp, Artificial Sequence
  Description of Artificial Sequence: Synthetic coding sequence
atgacagaagagaatgtaaaacgtcgaacccacaatgtgctggagcgccaaaggagaaacgaactgaaaaggtccttctttgccttgcgagatcagatccccgagctggaaaacaacgagaaagcacctaaagttgtgatcctgaagaaggctaccgcctacattctgtctgtccaagccgaaacccagaagcttatctccgagatcgatctcctccgcaaacagaacgagcagctgaaacacaagttagaacagcttcggaattcatgtgca

SEQ ID NO: 17764 - DNA, 273 bp, Artificial Sequence
  Description of Artificial Sequence: Synthetic coding sequence
atgacagaggagaacgtgaaacggcggacccacaacgttttggagcggcagcgaagaaacgagctgaaaagaagtttcttcgccctcagagaccagattcccgaactggaaaataacgaaaaggctcccaaagtcgtgatcttaaaaaaagccaccgcatatatcctttctgttcaggctgagacgcagaagttgatcagtgagatcgaccttctaaggaagcagaacgagcaactaaaacacaagctggagcagctgagaaactcctgtgcc

SEQ ID NO: 17765 - DNA, 273 bp, Artificial Sequence
  Description of Artificial Sequence: Synthetic coding sequence
atgacagaagaaaatgtgaaacgcagaacacataacgtgctggagcgtcagcgtagaaatgagctcaaaaggtcgttttttgcgcttagggatcagatcccagaactcgaaaataacgagaaggcgcctaaagtggtcatcctgaagaaggccacagcatacatcctttcagtgcaagcagagacacagaaactgatcagtgagattgacctattgaggaagcagaacgagcagttgaaacataagttggaacagctgagaaatagctgtgca

SEQ ID NO: 17766 - DNA, 273 bp, Artificial Sequence
  Description of Artificial Sequence: Synthetic coding sequence
atgacagaggaaaacgttaaaaggcggactcacaatgtgctcgagcggcagcgccgcaacgaactgaagaggagctttttcgcccttcgcgatcaaattccggagctcgagaataatgagaaagcccctaaggtggttatcctcaagaaggccacagcttatatactctctgtccaagcggagacccagaagctcataagtgagatcgatctcctccggaagcagaatgagcagctgaaacacaagctagagcaactacggaatagctgcgcc

SEQ ID NO: 17767 - DNA, 273 bp, Artificial Sequence
  Description of Artificial Sequence: Synthetic coding sequence
atgacagaagagaacgtgaaacgccgaacccacaacgttctggagcgacagcgccggaacgaactcaagcgctcattttttgccctgagggaccaaatacctgagctggagaacaatgagaaagcaccaaaagtcgtaatcctgaaaaaagcgactgcttacattctgtcagtccaggctgagacccagaaactcatatccgaaattgacctgctgcggaaacagaacgagcagctgaaacacaaattggaacagctgaggaattcttgtgcc

SEQ ID NO: 17768 - DNA, 273 bp, Artificial Sequence
  Description of Artificial Sequence: Synthetic coding sequence
atgacagaagaaaatgtgaagcggcgcacacacaacgttttggagcgccaaaggagaaacgaactgaaacgaagtttttttgctctccgggatcagatccctgaactggaaaacaatgaaaaagcacccaaagtggttatactcaaaaaagccactgcctatatactcagtgtacaagccgaaacacagaaactcatcagtgagatcgacctgctacggaaacagaacgaacagcttaaacacaaactcgaacagttgcgtaatagttgtgcc

SEQ ID NO: 17769 - DNA, 273 bp, Artificial Sequence
  Description of Artificial Sequence: Synthetic coding sequence
atgacggaagagaacgttaagaggcggacacacaacgtgctggaaaggcagaggagaaacgaactgaagcgcagcttttttgcgctgagggaccagattcctgaactcgagaacaacgagaaagcccctaaagtggtgatcctcaaaaaggccactgcctacatactgtccgtgcaggcagagacacaaaaactgataagcgaaatcgatctcctgcggaagcagaacgaacaactgaaacacaagttggagcaactcagaaactcttgcgcc

SEQ ID NO: 17770 - DNA, 273 bp, Artificial Sequence
  Description of Artificial Sequence: Synthetic coding sequence
atgactgaagagaacgttaagcgcagaacccacaacgtgcttgagcggcagcggcggaacgagctaaagcgaagttttttcgccctgcgagatcagatccccgaactggagaataacgaaaaagctcccaaagtcgtcatcttgaagaaagctactgcatatatcctgtccgtgcaagcagagacacagaagctgatcagtgagatagatcttctgcgcaagcagaatgaacagctgaaacacaaactggagcagttgcgcaacagctgcgca

SEQ ID NO: 17771 - DNA, 273 bp, Artificial Sequence
  Description of Artificial Sequence: Synthetic coding sequence
atgaccgaagaaaacgtgaaaaggagaacacacaacgtgttggaaagacagaggcgtaacgagctgaaacgctctttctttgccctgcgagatcagatccctgagttggagaacaatgagaaggctcccaaggtggtgatcctgaaaaaggctaccgcttatatactatccgtgcaggcagagacacagaagttgatttcggaaatagacctgttgaggaaacaaaatgagcagctgaaacacaagctggagcagcttagaaactcttgcgca

SEQ ID NO: 17772 - DNA, 273 bp, Artificial Sequence
  Description of Artificial Sequence: Synthetic coding sequence
atgacggaggagaatgtgaagcgtcgcacacataatgtactcgaacggcagcgccggaatgagctaaaaagatctttctttgccctccgggatcagatacccgaactggagaataacgaaaaagcacccaaagtggtaattctgaagaaggctacagcatatattctctctgtgcaagcagagacccagaaactcatcagtgagatcgatcttctcagaaaacagaacgagcagcttaagcataagttagagcagctcaggaactcctgcgca

SEQ ID NO: 17773 - DNA, 273 bp, Artificial Sequence
  Description of Artificial Sequence: Synthetic coding sequence
atgactgaagaaaacgtcaaaagaagaacacataatgtgttggagcggcagagacgaaacgaactgaaacgctcctttttcgccctacgggatcagatcccagaactcgagaacaacgaaaaggcccccaaagtcgtgatattaaaaaaggccactgcctatattctctccgtgcaggcagagactcagaaacttatctccgaaattgatctgctgcggaaacagaatgaacagcttaaacataaactcgaacagctccggaattcttgcgca

SEQ ID NO: 17774 - DNA, 273 bp, Artificial Sequence
  Description of Artificial Sequence: Synthetic coding sequence
atgaccgaggaaaacgtaaagagaagaacccacaacgtgttagaaagacagaggagaaacgaacttaagagatcattttttgctctgcgggatcaaatccccgagttagagaacaacgagaaggcacctaaggtggttatactaaagaaggctacagcctacatattgtccgtacaggcggagactcagaagctcatctccgaaatcgatctgctgcgcaaacaaaacgaacagctgaagcacaagttggagcaactgcggaactcctgcgca

SEQ ID NO: 17775 - DNA, 273 bp, Artificial Sequence
  Description of Artificial Sequence: Synthetic coding sequence
atgacagaggagaatgtaaagaggaggacccataatgtgctggagcggcaaaggagaaatgagctcaagagatcatttttcgctctgcgggaccaaatccctgagctggagaacaacgagaaagcaccaaaagtggtgatcctcaagaaagccaccgcctacattttgtcagtacaagctgaaactcagaaactcatcagcgagatcgatctcctgagaaaacagaacgaacagctgaagcacaagctcgaacaacttaggaatagctgcgct

SEQ ID NO: 17776 - DNA, 273 bp, Artificial Sequence
  Description of Artificial Sequence: Synthetic coding sequence
atgaccgaagagaatgtgaaaagacgaacacataacgtgctggagcggcagcgccggaacgagttaaagaggtccttcttcgccctgagggatcagattccagagctggagaataatgaaaaggcaccaaaggtggtgatactgaagaaggccacagcttacatcttgtctgtgcaggccgagacacagaaactgatatcggagatcgacctcctccggaagcagaatgagcagcttaaacacaagctcgagcagctgcgcaatagctgtgcc

SEQ ID NO: 17777 - DNA, 273 bp, Artificial Sequence
  Description of Artificial Sequence: Synthetic coding sequence
atgaccgaggagaacgtgaaacgtagaactcacaacgttctcgagaggcagaggcgcaacgagctgaaacggagcttctttgcccttagagaccagatcccagagctggagaacaacgaaaaagcccccaaagtggtaatactgaagaaggcaacggcttacatcctgagtgtgcaggcagaaactcagaagctgattagtgagatcgatctgctacgaaaacagaacgagcagttaaaacacaaactggagcagctaagaaattcgtgtgcc

SEQ ID NO: 17778 - DNA, 273 bp, Artificial Sequence
  Description of Artificial Sequence: Synthetic coding sequence
atgactgaagaaaacgtgaaacggcgcacccataatgtgctcgagcggcagagacggaacgagctcaagcggagtttcttcgcactgcgggaccagatcccagagttggagaacaatgagaaggcgccaaaagtagttattcttaagaaggcaaccgcatacattctctctgtccaggctgagacacagaagctgatttccgagattgacctgctccgaaagcagaatgagcaactgaagcacaaactggaacagcttagaaattcctgcgct

SEQ ID NO: 17779 - DNA, 273 bp, Artificial Sequence
  Description of Artificial Sequence: Synthetic coding sequence
atgacagaggaaaacgtcaaaagaagaactcacaacgtactagaaaggcagagacggaacgaactcaagagatcctttttcgcattgcgggatcagatacccgagctcgaaaacaatgagaaagcacctaaagtcgtgatccttaaaaaagcaacagcttacatcttgagtgtgcaggcagaaacacagaaattaatctccgaaatcgatttgctcagaaaacagaatgaacaactgaaacacaaactagaacagctgaggaactcgtgtgcg

SEQ ID NO: 17780 - DNA, 273 bp, Artificial Sequence
  Description of Artificial Sequence: Synthetic coding sequence
atgacagaagagaacgtgaagcgcaggacgcacaatgttctcgagcgccagcggcgcaacgaactcaagcggagtttcttcgcactcagggaccagatccccgagctggagaacaatgaaaaggcacctaaggtcgtcatcctgaagaaggccacagcctatatactgtcagtgcaggcagagacccagaaacttatcagtgagattgatctgctaaggaaacagaatgaacagctgaagcacaagctggagcagctgaggaactcgtgcgcc

SEQ ID NO: 17781 - DNA, 273 bp, Artificial Sequence
  Description of Artificial Sequence: Synthetic coding sequence
atgaccgaagagaacgtgaagagaagaacacacaacgtcctggagcgccaaaggagaaatgagctgaagcgctctttcttcgctctccgagatcagattccagaattagagaacaacgagaaagccccgaaggtggtcatccttaagaaggctacggcatacatactttcagtgcaggctgaaactcaaaaactgatatcagaaatcgaccttcttcgcaaacagaacgaacagttgaaacacaaattggagcagcttaggaacagttgtgct

SEQ ID NO: 17782 - DNA, 273 bp, Artificial Sequence
  Description of Artificial Sequence: Synthetic coding sequence
atgacagaggaaaatgtaaaacgcagaacccacaatgttctagaaaggcagaggaggaacgagttaaagcgatccttcttcgccctgagagatcagatcccagagctggaaaacaacgaaaaggctccgaaagtagtgatcctcaagaaggccaccgcgtacatcctgtcagtgcaggcagagactcagaaactgatcagcgagatagacctgctccgtaagcagaacgagcaactgaaacacaagctcgaacagctacgaaactcctgcgct

SEQ ID NO: 17783 - DNA, 273 bp, Artificial Sequence
  Description of Artificial Sequence: Synthetic coding sequence
atgacagaagaaaatgtgaaacggcggacacataatgtgttagaaagacagaggaggaatgagcttaaacggtctttctttgctctaagggatcagatccctgagctcgaaaacaatgaaaaagcccccaaagtagtaatacttaaaaaggctacagcttatatcctctctgtgcaagcagaaactcagaaactgattagtgagatagatttgctgaggaaacagaatgaacagctcaaacataaattagagcagctacgcaattcatgcgct

SEQ ID NO: 17784 - DNA, 273 bp, Artificial Sequence
  Description of Artificial Sequence: Synthetic coding sequence
atgacagaagagaatgtgaaaaggcgcacccacaacgtcctggagcgccagagacgcaacgaattgaaacgctctttcttcgcgctccgcgatcaaatccctgagctggagaacaatgaaaaagccccaaaagtggtgatcctcaagaaggccaccgcctacatactgtctgttcaggctgagacgcagaagttgatctctgagattgaccttctgaggaagcagaatgagcagctcaaacataagctggagcagttgcgcaactcctgcgcg

SEQ ID NO: 17785 - DNA, 1062 bp, Artificial Sequence
  Description of Artificial Sequence: Synthetic coding sequence
atgctgttcaatctccgcatcctacttaacaacgcagcgtttaggaatgggcataacttcatggtgaggaactttcggtgcggacagcctctccagaacaaggtccagctcaagggccgcgatctgttaactctgaagaattttacaggggaagagattaagtacatgctctggctcagcgctgacctcaagtttcggattaaacagaagggcgagtatttacccctgctgcaaggaaagagtctgggtatgatttttgagaagagatctacacggacaaggctgtcgacagaaactggcttcgctctgctgggtggccacccttgcttcctgaccactcaagacatccatctcggagttaacgagtcgcttacggacactgctagagttctcagctctatggctgacgcagtcctggcacgagtctataaacagtcagatcttgatacgctcgctaaggaagcttctatacccataatcaacggtctgtctgatctgtatcaccctattcaaatcctggctgattatcttaccttgcaggaacactactctagccttaaaggacttacgctttcctggattggtgatggcaataacatactccactcaataatgatgagcgcagcaaaattcggcatgcaccttcaggcggcgacgccaaaggggtacgagccggacgcttctgttaccaaactcgccgaacagtatgccaaagaaaacgggactaagctactacttacaaacgaccccctggaggccgcacatggtggcaacgtactgatcaccgatacatggatcagtatggggcaggaagaggagaaaaagaagcgcttgcaagctttccaggggtatcaggtgaccatgaaaaccgccaaggtggcagctagtgattggacgttccttcactgccttccgaggaagccagaggaagtcgacgatgaagtcttttactctcctcgctccttggtcttcccggaagccgaaaatagaaagtggactatcatggccgtgatggtgagtttgctcaccgactactccccacaattgcaaaaacctaagttc

SEQ ID NO: 17786 - DNA, 1062 bp, Artificial Sequence
  Description of Artificial Sequence: Synthetic coding sequence
atgcttttcaacttacggatactcctgaacaacgctgcatttcggaacgggcacaattttatggttcggaacttccgctgtggccaacctctgcagaataaggttcaacttaagggccgtgatctattgaccctgaagaatttcaccggggaagagatcaaatacatgctgtggttgtctgccgacctgaaattccgtatcaaacagaaaggtgagtacctgcccctgctgcagggtaaatcactcgggatgattttcgagaagaggtccactaggacaaggctgagtacagaaactgggttcgcactgctaggcggtcatccttgtttcctcacaacacaggacattcatctgggcgttaacgagtcactgactgacaccgccagagttttgtcaagcatggcggatgcagtgctggcccgggtgtacaaacagagtgacctcgatactcttgccaaggaggcatcaatccctattatcaacggcctatccgatctttatcatcccatccaaatcctggctgattatctcacgctgcaggagcactacagttcactcaaaggccttacactgagctggattggcgacggtaacaatattctgcactccatcatgatgtcagcagctaaatttgggatgcacttacaagcagccacacctaagggctacgaaccagacgccagtgtgactaaactggccgagcagtacgccaaggagaacggcaccaagctgctcctcaccaatgatcctttagaagccgcacatgggggaaacgttctgattactgacacatggatttccatgggacaggaagaagagaagaaaaagaggctacaggcattccagggctatcaagtgacaatgaagactgcaaaagtggccgcctccgactggacatttttgcactgcctgcctaggaaacccgaggaagtcgatgatgaggtattctatagtcccaggagtctggttttccccgaagccgaaaaccgtaagtggacaatcatggcagtgatggtgagtctgttgacagactactcccctcagcttcaaaaaccaaaattc

SEQ ID NO: 17787 - DNA, 1062 bp, Artificial Sequence
  Description of Artificial Sequence: Synthetic coding sequence
atgctattcaacctgcgcattctacttaacaatgctgcgtttcgaaacggccacaatttcatggtcagaaattttcggtgcggacagccattgcagaacaaggtccaattgaaaggacgcgacttgctgacgcttaaaaacttcacaggagaggaaatcaaatacatgctctggctgagcgcagacttgaaatttcgcatcaagcaaaaaggggaatacctccctctgctgcagggaaaatcactcggtatgattttcgaaaagcgaagtacacggacaaggctgtccacagagacggggtttgctctcctgggcggacacccctgcttcctcaccacacaggatatccatctgggcgtgaacgaatccttgaccgacaccgcccgcgtgttgtcctcaatggcagacgctgttctggctcgcgtgtacaaacagagcgacctggacacactggcaaaggaagcgtccatccccatcattaatggtctgtccgatttgtaccacccaattcagatccttgcagactatctgactctgcaagaacattactcatccctgaaggggcttaccttgtcctggatcggggacggcaacaacattctgcatagtatcatgatgtcagctgcaaagtttggcatgcatttgcaggccgccactccgaagggctacgagccggatgccagtgtgacaaaactcgccgagcagtacgcaaaagagaacgggacaaagctgttgttaacaaacgatcctctcgaggctgctcacgggggtaatgtactcatcacagatacctggatcagcatgggtcaggaagaggaaaaaaaaaagcggctccaggcttttcagggctaccaggttaccatgaagactgccaaggtggccgcttccgactggacatttttgcactgtctaccccgcaaacctgaggaggtggacgacgaggtcttttacagtcccagatctcttgtgttccccgaggccgagaacagaaaatggaccatcatggcggtcatggtctccctgcttaccgattattcaccccagctccagaaacctaagttt

SEQ ID NO: 17788 - DNA, 1062 bp, Artificial Sequence
  Description of Artificial Sequence: Synthetic coding sequence
atgctctttaacctgagaattcttttgaataatgcagcctttcggaatgggcacaacttcatggtcaggaatttccgctgcggacagccgctgcagaacaaggtgcaactgaagggccgggatttgctgactctgaagaacttcactggtgaagaaatcaagtacatgctgtggctgtccgctgatctgaagttccggatcaagcagaagggagaatacctgcccctgctgcaaggaaagagcttgggaatgatcttcgaaaagcggtccacccggacccggctctccactgaaactggtttcgcgctgttggggggtcacccgtgttttctcaccactcaggatatccacctcggagtcaacgagagcctgaccgataccgcccgcgtgctgtcgtcaatggccgacgctgtgctggcaagagtgtacaaacaaagcgacctcgacaccctcgcgaaggaggcttcgatcccgatcatcaacggactctccgatctgtaccatccgattcaaatcctggctgattacttgactctgcaggaacactacagctcgcttaaggggcttactctgtcgtggatcggcgacgggaacaatatactgcactctatcatgatgtccgcggctaagtttggaatgcacctgcaggcggcaaccccgaaggggtacgaacctgacgcttctgtgaccaagctcgccgagcagtacgccaaggaaaatggaaccaaactgctgctgacgaatgacccactcgaggccgcccacggaggcaacgtcctgatcaccgatacttggatctccatgggccaagaggaagaaaagaagaagaggctccaggcattccagggctaccaggtcactatgaaaactgccaaggtcgctgcctcagactggaccttcctgcactgcctcccccggaagcccgaggaagtggacgatgaggtgttctactcccctcgctcgctcgtgtttccggaagcggagaatcgcaagtggactatcatggcggtcatggtgtcacttctgaccgactactccccgcaactgcaaaagccgaagttc

SEQ ID NO: 17789 - DNA, 1062 bp, Artificial Sequence
  Description of Artificial Sequence: Synthetic coding sequence
atgctctttaatcttcgtatactgttgaacaatgctgcgttcagaaacggtcacaactttatggtgcggaacttcagatgcggtcagccgctccaaaacaaagtgcaacttaagggcagggatctgctcactctcaagaatttcaccggagaagagatcaagtacatgttgtggctttcagcagacctcaagttcagaatcaaacaaaagggagaataccttcctcttctgcagggaaagtcccttggcatgatttttgaaaaacgctcgaccaggacgagactgtcaaccgaaaccggattcgctttgctcgggggacatccgtgttttcttactactcaagacatccacttgggtgtcaatgaaagcctgactgatactgccagagtgctctcatccatggctgatgccgtgctggcacgcgtgtataagcagtcggatttggacacccttgcaaaggaagcaagcattccaatcattaacggactttcagacctttatcaccctattcagattctggcggattaccttacccttcaagagcattacagcagccttaaaggccttactctcagctggattggagatgggaacaatatacttcatagcattatgatgagcgcagcaaagtttggaatgcatttgcaagctgcaaccccaaaaggatacgagcccgatgcgtcggttaccaaacttgcagagcaatacgctaaagaaaacgggactaaacttcttctgaccaacgatcccctggaagccgctcatggcggaaacgtcttgattaccgacacctggattagcatgggtcaagaggaagaaaagaagaagcgtttgcaggcctttcagggctaccaagtcaccatgaaaaccgcaaaagtggccgcctcggattggacgtttctgcattgtctgccgcgcaagccagaggaagttgatgacgaagtgttttactctcctcgctcacttgtgtttcctgaggcagagaatcggaagtggaccataatggcagttatggtgtcgctgctgactgactacagtcctcagcttcaaaagcccaagttt

SEQ ID NO: 17790 - DNA, 1062 bp, Artificial Sequence
  Description of Artificial Sequence: Synthetic coding sequence
atgctgttcaacctccggattctgctgaataatgccgctttcaggaatgggcacaacttcatggttagaaactttagatgcgggcagcctctacagaataaggtgcagctcaaaggcagggatctcctgactctcaagaacttcactggtgaggagatcaagtatatgctgtggctgtccgcagatttgaaatttcgcatcaagcagaagggagagtatctacccttgttgcagggcaagagcctcggcatgattttcgagaagaggtcaacccgcactcggctatcgaccgaaactggcttcgcattgttgggcggacatccatgttttcttacgacgcaagacatccatctcggagtaaacgaatctctgactgacaccgcgcgagtactgtctagcatggccgatgcagtcctggcccgggtttataagcagagtgatcttgacaccctggctaaagaagcatctattcccatcattaatggcctgtctgatctgtaccaccctattcagattttggcagattatctgaccctccaggaacactattcttctctgaaaggactgaccctgtcctggatcggagacgggaacaatatactgcattctatcatgatgagcgccgccaagttcggaatgcacctccaggccgctacccctaaggggtacgagccggatgccagcgtgaccaaactcgccgagcaatacgccaaggagaatgggaccaaactgctgttgacaaatgaccctttggaggccgctcatgggggcaacgtactgattaccgacacctggataagcatgggacaggaggaggaaaaaaagaaacggctgcaagcgtttcaggggtaccaggtgactatgaagactgcgaaagtggccgcttccgattggacctttctgcactgtctcccacgaaaacccgaggaggtggatgacgaagtgttctactctcctcgtagcctagttttcccggaagctgagaaccgaaaatggaccatcatggctgttatggtgtcgctgctgaccgattattcaccccagctacaaaagccaaagttc

SEQ ID NO: 17791 - DNA, 1062 bp, Artificial Sequence
  Description of Artificial Sequence: Synthetic coding sequence
atgcttttcaacctcaggatactgttgaacaatgccgcctttaggaacggacacaactttatggtccggaacttcagatgtggtcagccactgcagaacaaggtccagcttaaaggtcgcgatctgctcacccttaagaatttcactggggaagagattaagtacatgctgtggctcagcgccgatcttaagtttaggatcaagcaaaaaggagagtatcttcctctgctccagggaaagtcacttgggatgatttttgaaaaacggtccaccaggacccgactgtctaccgaaacgggctttgcccttttgggaggacacccctgctttttgactacccaggatattcatctgggagtgaatgagtcgcttacggatacggcacgtgtgctttcaagcatggccgacgcggtgttggcacgtgtgtacaagcaatccgatcttgacaccttggcgaaagaagcgtctattcctattatcaacggcctgtccgatttgtaccatcctatccaaatactcgcagactacctcactctgcaagagcactacagctctctgaagggtctgaccctgtcgtggattggagatggaaacaacatactgcattcgattatgatgagcgcagcaaagtttggaatgcatctgcaagcggctacccctaaggggtacgagccagatgccagcgtcacgaaacttgccgagcaatacgcgaaggagaacggaactaagctccttctcaccaatgatccactcgaagcggcacatgggggaaatgtgcttattaccgatacgtggatctcaatgggccaagaggaagaaaagaagaaacggcttcaggcatttcaaggctaccaagtgaccatgaaaacggctaaggtcgcagcatccgactggacctttctgcattgtctgcctcgaaaaccagaagaagttgacgacgaggttttctacagcccgagatccttggtgttcccagaagcagaaaaccgcaaatggactattatggcagtgatggtgtcgcttctgactgactattcaccacagctccaaaagcccaaattc

SEQ ID NO: 17792 - DNA, 1062 bp, Artificial Sequence
  Description of Artificial Sequence: Synthetic coding sequence
atgttgtttaacctccggattttactgaacaatgccgcatttcggaatggacataattttatggttcggaactttagatgtggccaacccctacagaataaagtgcagctgaaaggacgcgatctgctgaccttaaagaactttacaggtgaggaaataaaatatatgttatggctgtccgcagatcttaagtttagaattaagcaaaaaggtgaatacctgcctctgctccaggggaaaagcttaggaatgattttcgagaagaggagtaccaggacaagactgagcacagagactgggttcgcacttctgggaggtcacccatgttttctcacaacccaagatatacacctgggcgtcaacgagtccctcaccgacacagcccgagtgctcagtagtatggcagatgctgtgctggctagggtctataagcagtccgacttagatactctggcaaaagaggcctccatacctatcatcaacgggctgtcagacctgtaccatcctatccagattctagcagattacctgacactgcaggagcactactcttcactcaagggactcactctgagctggattggagatggaaacaacattttacactcaattatgatgagcgcagccaagtttggaatgcacctgcaggctgctaccccaaagggctatgagccagacgccagtgtaaccaaattagccgagcaatacgcaaaagaaaatggcacaaagcttctgctgaccaatgatccactggaggccgcccacggggggaacgttctgatcaccgacacttggatttctatgggccaggaagaggagaagaagaagcgattgcaggcatttcagggttaccaggttactatgaagacagctaaagtggcagctagtgactggacctttctgcattgcttgccacgtaagcctgaggaggtggatgatgaggtgttctatagccctaggagcctagttttcccagaggctgaaaatagaaaatggactataatggcagttatggtttccctgctgaccgattatagcccccagctgcagaagccaaaattc

SEQ ID NO: 17793 - DNA, 1062 bp, Artificial Sequence
  Description of Artificial Sequence: Synthetic coding sequence
atgctctttaacctgcgtatcctcctcaataatgccgctttccgaaatggacacaactttatggtgcgaaatttccgttgtggccaacccctgcagaataaggtgcagctgaagggccgcgacctactcaccctgaagaacttcacgggcgaagagattaagtatatgctttggctttcggctgatctaaagttcagaattaaacagaagggtgagtatctccccttgctccagggcaaatccctcggaatgatctttgagaagcggagcacgcggacaagactgtcaacggagaccggattcgctctccttgggggccatccttgcttcttgacaactcaggatatccaccttggggtgaacgagtccctgactgatactgcacgcgtcttatcttcaatggccgacgcagtattggcccgggtctacaagcagtctgacctcgatactttggcaaaagaagcgagcatccctattataaatggcttgtcggacctatatcatcccatccagatcctcgccgattaccttactctccaagaacactattcttccctgaagggcttgactctgtcctggatcggcgatggtaataacattctccatagtataatgatgtctgctgctaagtttggtatgcatcttcaagctgccactccaaaaggatacgagcctgacgccagcgtcactaagctggcagaacagtatgcaaaagaaaacgggaccaaactccttttgactaacgacccgttggaggctgcccatggaggaaatgttcttatcaccgacacctggatctcgatgggacaagaagaagagaagaagaagcggctgcaggcgttccagggttaccaggttactatgaaaacagcaaaggtggctgcgtcagactggacattcctccattgcctcccacgaaaacccgaagaagtggacgacgaagtcttctactccccacgttctcttgtctttccagaggctgaaaatcggaagtggacgatcatggccgtgatggtcagcctgcttactgattactccccacagcttcagaagccaaagttc

SEQ ID NO: 17794 - DNA, 1062 bp, Artificial Sequence
  Description of Artificial Sequence: Synthetic coding sequence
atgcttttcaatttaagaatacttcttaataatgcagcattccgtaatggtcataattttatggttagaaatttcagatgtggacaaccattacaaaataaagttcaattaaaaggtagagatttattaacattaaaaaatttcacaggagaagaaattaagtatatgttatggttatcagctgatttaaaatttagaatcaaacaaaaaggagaatatcttccacttcttcagggtaaatcattaggaatgattttcgaaaaacgttcaacaagaactcgactttctactgaaactggatttgcattattaggtggacatccatgctttttaacaacacaagatatacatttaggagttaatgaatcattaactgatacagctagagttttatcttcaatggctgatgctgttcttgcaagagtatataaacaatcagatttagatacgttagctaaagaggcatcaataccaattattaacggtttatctgatttatatcatccaattcaaattcttgcagactaccttacacttcaagaacattatagttctttgaaaggacttacactttcatggataggagatggaaataatattcttcattcaattatgatgtcagctgcaaagttcggaatgcatcttcaagcagctactccaaagggatacgaaccagatgcatcagttactaaattagcagaacaatatgctaaagaaaatggaactaagcttcttcttacgaatgaccctctagaagctgctcatggaggtaatgtacttattacagatacatggatttcaatgggacaagaagaagaaaaaaagaaaagattacaagcatttcaagggtatcaagttacaatgaagacagctaaagttgcagcatctgattggacattcttacattgtttacctagaaaaccagaagaagttgatgatgaagttttttattcaccacgatcattagttttcccagaagcagaaaatagaaaatggacaattatggcagttatggtatcattactaacagattattcaccacaattacaaaaaccaaaattt

SEQ ID NO: 17795 - DNA, 1062 bp, Artificial Sequence
  Description of Artificial Sequence: Synthetic coding sequence
atgctgttcaacctgcgcattcttctgaataacgcagccttcaggaacggccataacttcatggtgcgaaactttaggtgcggacagcccttgcaaaacaaggtgcagctcaaaggccgggatcttcttacgctgaagaacttcaccggagaagaaatcaaatacatgctctggctgagcgcagacctgaaattccgcatcaagcagaagggagaatacctgccgctgctgcagggaaagagtctcggaatgatcttcgagaaacggagcacccgcacccggctgtcaaccgaaactggcttcgccttgctgggaggtcatccgtgctttcttacgacccaagacattcacttgggcgtcaacgagtcgctgaccgacactgccagagtgctgtcctccatggccgacgctgtcctcgcgagagtgtacaaacagtcagatctggatactctggcaaaggaagcctccattcccatcatcaatggactgtcggacctgtaccaccccattcaaatcctggcagattacctgaccctgcaggagcactactcctccctgaaaggactgacgctttcatggatcggagacggcaataacatccttcactcgatcatgatgtctgctgcgaaattcgggatgcacttgcaagctgccactccaaaggggtacgaacctgacgcctccgtcactaagctcgccgaacaatacgccaaagagaacggtaccaagctgcttctgaccaacgatccgctggaggcagcccatggaggaaacgtcctcatcaccgacacctggatcagcatgggtcaagaagaagagaagaagaagaggctgcaggccttccagggatatcaagtgaccatgaaaaccgcgaaggtggccgctagcgactggaccttcctccattgcctgccaagaaagcccgaagaagtggatgacgaggtcttttactcgcctcgatcgctggtattccctgaagctgagaatcgcaagtggaccatcatggccgtgatggtgtcgcttctgaccgactactcgcctcagctgcagaaacctaagttt

SEQ ID NO: 17796 - DNA, 1062 bp, Artificial Sequence
  Description of Artificial Sequence: Synthetic coding sequence
atgctgtttaacctgcgcattctacttaataacgccgccttcaggaatggccataacttcatggtgcgaaactttcggtgtggccagcctcttcaaaacaaagtgcaactgaaggggcgagacctgctgaccctgaagaattttaccggtgaagagattaagtatatgctgtggttgtcagcagatttgaagttcaggattaagcagaagggagaatacctccccctgctgcaggggaagagcctcggtatgatttttgaaaagcgctcaaccaggacgagattgtcgaccgagacagggttcgcactgctgggcgggcatccctgtttcctgaccactcaggatattcacctgggcgtgaacgaaagcttaacagatacggcacgcgttctgagctccatggccgacgcggtcttggctagagtatataagcagagtgatttggacaccctggcaaaggaagctagcatccccatcattaatgggctgtctgatctgtatcaccctatccagattctggccgattacctaacactgcaagagcactactcatctctgaaaggtctgaccctgtcctggataggcgacggcaacaacattctccattccatcatgatgtctgcggccaagttcggtatgcatctccaggccgccacccctaaaggatacgagcctgatgcaagcgtaactaagctggctgagcagtacgcaaaggagaacgggacgaagctgctccttacaaatgacccgcttgaggctgcacacggcggcaacgtgctgattacagatacatggatctctatgggccaagaggaggagaagaaaaagcggctgcaggcctttcaaggctatcaggtgacaatgaagactgctaaggtagccgcctccgattggacttttctccattgtttgccaagaaagcctgaagaggtggatgatgaggtgttttactcccctcgatccctagtgtttccagaagcggaaaataggaaatggaccatcatggccgtgatggtgtccttgctgaccgactactcaccacagctccaaaaaccaaagttt

SEQ ID NO: 17797 - DNA, 1062 bp, Artificial Sequence
  Description of Artificial Sequence: Synthetic coding sequence
atgctgtttaacttgcgcatcctgctgaataacgccgccttcagaaacgggcacaattttatggtaagaaacttccggtgcggtcagcctctccaaaacaaggtgcaactgaagggacgtgacctcctgacgctcaagaactttactggagaggagattaagtacatgctctggctgtccgcagatctcaagttccgcatcaaacagaagggagagtatttgccgctgctgcaggggaagtcgctcggcatgatcttcgagaagagatcaacccgcactcgactcagcacggaaacgggattcgctctgctgggcggccatccctgcttcctgactactcaagatatccatctgggcgtgaatgaatcgctgaccgacaccgctcgggtcttgagctctatggccgacgctgtgctggcccgcgtgtacaaacaatcagaccttgacactctggccaaggaagcgtccatcccgattatcaatggactctccgatctttaccatccaatccagattcttgctgattacctgactctccaggagcactacagctcattgaagggactgaccctctcctggatcggagatggcaacaacatcctccactcaatcatgatgtcggccgcaaaattcggtatgcacctccaggcagcgacccccaaaggatacgagccggacgcttcggtgactaagctcgcggaacagtacgcgaaagaaaacggaaccaagctgctgctgaccaacgaccctctggaagcagcgcacggtggaaatgtcctgatcaccgacacttggatcagcatggggcaggaggaagaaaagaagaaaaggcttcaggccttccaaggctaccaggtgactatgaaaaccgcaaaggtggcggcctccgattggaccttccttcattgtttgcctcggaaaccagaggaagttgacgatgaggtcttttactccccgcggagcctggtgttcccggaagccgaaaatcgcaagtggactatcatggccgtcatggtgtcgctgctcaccgactactcgccacaactgcagaagccgaagttc

SEQ ID NO: 17798 - DNA, 1062 bp, Artificial Sequence
  Description of Artificial Sequence: Synthetic coding sequence
atgctgttcaacctcaggatacttctgaacaacgcagccttcagaaacgggcataacttcatggtcagaaacttcagatgcggacagccactgcagaacaaggtgcagctcaaggggagagatcttctaacacttaagaacttcacaggggaagaaattaaatatatgctgtggttatcggctgatcttaaattccgaatcaaacagaaaggagaatatcttcctttgcttcaggggaaatcccttgggatgatcttcgaaaaaaggtctacacgcacaagactgagtacagagactggatttgctctcctaggagggcatccctgttttctcacaactcaggatatccatttgggagtgaatgaatccttaactgatacagcaagggttctgtcctctatggccgatgcagtccttgctagggtgtacaaacagtccgatctggacactcttgccaaagaagctagtataccaatcattaacggactctctgatctttatcatcctatacagatattagccgattatctaacactgcaggaacactattcatcactaaaagggcttactttgtcttggattggggatgggaacaatatattgcactcaatcatgatgtctgccgcgaaattcgggatgcatttgcaagcggccactcccaaaggatacgaacccgatgcttctgtgacaaaactcgctgagcagtatgctaaagagaacggaacaaaactcctactgactaacgatccactggaagccgctcacggaggaaatgtgctgattactgatacgtggatctctatgggacaggaagaagaaaaaaaaaaaaggctccaggcattccagggataccaagtaacaatgaaaacagcaaaagtagccgcaagtgattggacttttttacattgcttaccacggaaaccagaagaagtggacgacgaagtattttatagtccaaggtccctggtcttccccgaagccgagaaccggaaatggactatcatggctgtgatggtgtccctcctgacagattactctccccaacttcagaaacccaaattt

SEQ ID NO: 17799 - DNA, 1062 bp, Artificial Sequence
  Description of Artificial Sequence: Synthetic coding sequence
atgctgttcaatcttcgtatcttgcttaacaacgccgctttccgcaacggtcataatttcatggttcgcaatttccggtgcggacagcccctgcagaataaggtgcagctgaagggccgcgacctgctgaccctaaagaacttcacaggcgaggaaattaagtatatgttgtggctgtcagctgacctgaaattccgaatcaagcagaaaggtgagtatctacctcttctccagggaaaatctctgggtatgatcttcgaaaagcggtccacacgtacgcgcttgtccactgagacgggctttgcccttctcgggggtcacccatgcttcctgaccacacaggatatacacctgggggtcaacgagagtctgactgatacagctcgggtcctgagtagcatggctgatgctgttttagcccgagtgtacaagcaatctgacctggatactttggcgaaggaggccagtataccaataatcaatgggttgtcggatttgtaccacccgatccagatactcgccgactatttaactttgcaagagcactacagttcactcaagggactcaccctgtcctggattggtgatggtaataatatcctgcactcaattatgatgtctgccgccaaattcggcatgcacctccaggctgccacacccaaggggtatgaaccagatgccagcgtaaccaagttggccgaacagtacgcgaaagaaaatggcaccaagttgttgctgacaaacgacccattagaggccgcccatggggggaacgtattaattacagatacttggatctccatgggccaagaggaggagaagaagaagcgactgcaagccttccaagggtaccaggtgacaatgaaaactgcgaaagtggctgcttccgactggacctttttgcactgcctgccgcgcaagcccgaagaggtggatgatgaggtgttttactcacctcgctccctggtgttccccgaagccgagaaccggaagtggaccatcatggctgtcatggtctccttgttgaccgactatagccctcagctgcagaagcctaagttc

SEQ ID NO: 17800 - DNA, 1062 bp, Artificial Sequence
  Description of Artificial Sequence: Synthetic coding sequence
atgctgttcaatctgcgaatcctccttaacaatgctgcctttagaaacgggcacaatttcatggtcaggaattttcgttgcgggcaaccactgcagaacaaggttcagctgaaaggacgggacctcctcacattaaaaaactttacgggcgaagagatcaagtatatgctgtggttgtccgccgatctaaagtttcgaattaagcaaaaaggcgagtatctgcccttgcttcaggggaagtctctggggatgatctttgaaaaacgttcaacccgaacgaggctctcaaccgaaaccgggtttgcccttttgggaggccatccctgcttcctcactacccaggacatccatctgggggttaatgagtcactgactgacacggccagggtcctgtccagcatggcagatgcagtgctggcacgcgtctacaagcagtcagatttggacactctcgcaaaagaggcatcaattcccatcatcaatggcctcagtgatctgtaccaccctatacagatcctcgctgactatttaactttgcaagagcactactcaagcctaaaaggtctgactttgtcctggattggcgatgggaacaacattctccacagcattatgatgtcagcggcgaagtttggcatgcacttgcaagccgcaacacctaagggctacgaacccgatgcaagtgtcaccaaactggccgaacagtatgccaaagaaaacggaacaaaattgttgctcaccaacgatcctctggaagcagcgcatggaggcaatgtgctcatcacagacacctggattagcatgggtcaggaggaagagaagaagaaacgactccaggcctttcaaggctatcaagttacaatgaaaactgccaaggtagccgcaagtgactggacttttctccactgcctaccacggaaaccggaagaggtagatgatgaggtgttttattcgccaagatccctggtttttcccgaggcggagaacaggaagtggacaattatggctgtaatggtgtcactgttgaccgactactcccctcagctgcagaaacccaaattc

SEQ ID NO: 17801 - DNA, 1062 bp, Artificial Sequence
  Description of Artificial Sequence: Synthetic coding sequence
atgttgttcaacctccgcattctgctgaataatgccgccttccgaaatggacacaatttcatggttagaaatttcaggtgcggccagccactacagaacaaagtgcagctcaagggacgggacctgttaacactgaagaattttaccggggaagagattaaatacatgctgtggctgtctgcagacttaaagtttaggatcaagcaaaagggagaatacctcccgctcttgcagggaaagtcattgggaatgatctttgaaaagcgtagcacacgcactcgcctcagtacggaaacagggttcgcacttctgggtggacatccatgttttctgacgacccaggacatccacttaggggtcaacgagagccttacagataccgccagggttctcagttctatggccgacgccgtgctggcaagagtgtataagcagtcggacttagatactcttgccaaggaggcctcaattcctattatcaacgggctaagtgatctctatcatcccattcaaattttggccgattatcttaccttacaagaacattattcgtctctgaagggactgactctctcctggattggcgacggaaacaacattctccattctatcatgatgtcagccgcaaagttcggcatgcatctgcaggccgccacccctaaaggctacgaacccgatgcctcagtgacaaaattggccgaacagtacgcaaaagagaatggaacgaaactgctgctgacgaacgaccccctggaggcagcccatggaggcaacgttttgatcaccgacacatggatatccatggggcaagaagaggaaaagaagaagcgccttcaagccttccagggataccaagtcacgatgaagacggctaaagtcgccgcgagtgattggacattcctgcactgcctgcctcgcaaacccgaggaggtggatgatgaggtcttctacagccctaggtccctggtttttcctgaagcggaaaataggaaatggactattatggcagttatggtcagccttcttacagactattccccacagttacagaaaccgaaattt

SEQ ID NO: 17802 - DNA, 1062 bp, Artificial Sequence
  Description of Artificial Sequence: Synthetic coding sequence
atgctgtttaatttaagaatactgctgaataatgccgcctttaggaatggccataactttatggtgagaaattttagatgtggtcagcccctgcaaaacaaggtgcagctcaagggaagggatctgctaactctcaagaacttcacaggcgaagagattaaatacatgctttggctgagtgcagacctgaaatttagaatcaagcagaaaggggaatacttgcccctgctgcaaggcaaaagtctgggcatgatttttgaaaagcgatccactaggactcggctgtccactgaaactggtttcgccctgctaggcggccacccatgcttcctgacaactcaagatatccatctcggagtgaacgagtctctgaccgataccgcacgtgtcctttccagcatggctgacgccgtcctcgccagggtctacaagcagagtgatctggacacgttagctaaagaagcttccatacccataatcaacgggctcagtgacttgtaccaccccatacaaatactggcagattacttgactttgcaggaacactactcgtccctgaaggggctcactctctcttggattggggatggaaataatatcttacattctattatgatgtctgctgcaaagttcgggatgcacctacaggccgcaacccccaaggggtacgaacccgacgcctccgtgactaagctggccgagcagtatgccaaggaaaacggtaccaagctccttctgactaatgaccctctggaggcggcccacggaggcaacgttcttataacagacacatggatcagtatgggccaggaggaagaaaaaaaaaagagactgcaggctttccagggctaccaggtcacaatgaaaacggcgaaggtcgctgcctccgactggacctttctgcactgtctgcctagaaaaccggaggaagtggatgacgaggtgttttattcccccagatccctcgtgttccccgaagccgaaaatcgaaaatggacaattatggccgttatggtcagtctcctgaccgactatagccctcagcttcagaagcctaaattc

SEQ ID NO: 17803 - DNA, 1062 bp, Artificial Sequence
  Description of Artificial Sequence: Synthetic coding sequence
atgctgtttaacctgcgcattctgctaaacaatgccgcgttccgcaacgggcacaattttatggtgcgcaattttcgatgtggccagccattgcagaacaaggtgcagcttaaaggccgggatctgttgactcttaagaacttcacaggagaggagatcaagtacatgctgtggctgtctgccgatcttaaatttagaatcaagcagaaaggcgaatacctccctctgctgcagggcaagtcattgggtatgattttcgagaagcggagtacaagaaccagattaagcactgagactgggttcgcccttcttggcggccatccctgtttcttgacaacgcaggatatacatctcggcgtaaacgaaagcttgaccgatacagcgagggtgctgtcttccatggcagatgcggttctagcccgggtgtataagcagagtgatcttgataccctggcaaaagaagcctcaattcccattattaatggtttgtcggacctctatcaccccattcagatattagccgactacttgactcttcaggagcattattctagccttaaaggtctgaccctgtcttggatcggcgatggaaataacattctccattctattatgatgtctgccgccaagtttggcatgcacttgcaagccgcaaccccgaagggatacgagccagatgcttcagtcacaaagctagcagagcagtacgcgaaggagaatggaaccaaacttttgttaacaaatgacccactggaagctgctcatggaggtaacgtgctcatcactgatacctggatctccatgggacaggaggaggagaagaagaaaaggctccaggcctttcaggggtatcaggtcaccatgaaaacggcgaaggtggcggcttcagattggacgttccttcactgcctgcctcgtaagcccgaagaggttgacgacgaggtcttctactcccctcgcagcctggtgtttcctgaggccgaaaatcgcaaatggaccatcatggccgtgatggtctcattgctcacagactactccccgcagctacaaaagccaaagttc

SEQ ID NO: 17804 - DNA, 1062 bp, Artificial Sequence
  Description of Artificial Sequence: Synthetic coding sequence
atgttattcaatctgagaatactcctgaacaacgccgcattccgaaatggccataacttcatggttcgcaacttccgatgcgggcagccactgcagaacaaggtgcagctcaaaggaagagatttgttgacactgaagaactttacaggggaggagataaagtacatgttatggctgtccgcagacctgaaattcagaataaaacaaaagggtgagtacctacctctgctgcaaggaaagtccctcggtatgattttcgagaagaggtcgacccgaacacgcctgtcgaccgagaccgggttcgccttattgggggggcacccctgctttctcacaactcaggatatccatctgggagtgaatgagtctctaaccgacaccgctagagtgctcagcagcatggccgatgctgtcctggcgagggtctataagcaatctgacctggataccctcgccaaggaagcttctatccctatcataaacggcctgagtgatctataccatccgattcagatcctggcggattacctaaccctccaggaacactacagttccctaaaaggtttgactttgtcttggattggcgatggtaataatattctccactcgataatgatgtcagcggcaaagttcggcatgcaccttcaggctgcaacccccaaaggctatgaacctgatgcctctgttacaaaactggctgaacagtacgctaaagaaaatgggacaaaactgcttctgacaaacgatccacttgaggcggcccatggaggaaatgtcttaataaccgatacttggatatcgatggggcaggaagaagagaaaaagaagaggctacaggccttccaaggatatcaggttacaatgaaaaccgctaaggttgcggcatctgactggacgttcctccactgcctgcctcgcaaacccgaagaggtggacgatgaggtgttttactcgccacgaagcttagtgttccctgaagccgaaaaccgtaagtggactattatggctgtgatggtttctctgctgaccgattacagcccccagctgcagaaaccgaagttt

SEQ ID NO: 17805 - DNA, 1062 bp, Artificial Sequence
  Description of Artificial Sequence: Synthetic coding sequence
atgctcttcaacctccgaattctgttaaacaatgcggctttcagaaacgggcacaactttatggtgcgaaatttcagatgcggtcagcccctccaaaataaggtgcaactcaaaggcagagaccttttgaccctgaagaacttcacaggcgaggaaatcaagtatatgctgtggctctcagccgacctcaagttccggattaagcagaagggagaatatctgcctctgctccaagggaagagcctggggatgatctttgagaaacggtcaactcgcaccaggctgtcaaccgagactgggtttgcgctactcggaggccatccttgtttccttacaacacaggacattcatcttggggtgaacgagtccttgaccgacacagcccgggtgctgagctcaatggccgatgcagttctcgcccgggtctataagcagtctgatctggacaccctggcaaaagaggcttcaataccaattattaacggcctgagcgatctctaccatcctatccagattctcgcggattacctgactctccaggaacactattcatctctcaagggtcttacactctcttggatcggcgacggcaataacattctgcatagcatcatgatgagcgcagccaagttcggcatgcatctccaggccgcaacaccgaagggctacgagccagatgcatccgtgactaagttggccgagcaatatgcaaaggagaatgggacaaagctacttcttaccaatgatccccttgaggccgcccatggcggaaacgtcttaataacagacacatggataagcatgggtcaggaggaggagaagaaaaaaaggctccaagctttccagggctaccaggttaccatgaagactgccaaagtagctgctagcgactggactttcctgcattgtctgccacgtaagccagaagaggtcgatgacgaggtcttctactcgccccgatctctcgtgttccccgaagcggagaacagaaaatggaccataatggcagtgatggtgagtctgctgacagattattcaccacagttgcagaagcccaagttc

SEQ ID NO: 17806 - DNA, 1062 bp, Artificial Sequence
  Description of Artificial Sequence: Synthetic coding sequence
atgttgttcaaccttagaatactgctgaacaacgcagccttcaggaatggccataatttcatggtgcggaattttaggtgcgggcaaccacttcagaacaaggtgcagctgaaaggtcgggatctgcttaccctgaaaaacttcacgggagaagaaatcaagtacatgctgtggctgtctgcagatttgaagtttcgaatcaaacagaagggtgagtatctgccactcctacagggcaaatccttgggaatgatatttgagaaacggagcactcgtacacggctgagcaccgagacagggtttgccctgctgggagggcatccatgtttcctcaccacacaggatatccacctgggggtgaacgaatctctgactgataccgctcgggtcctttcatccatggcggacgccgtgctggcccgcgtgtataaacaatcagatctagatacactcgccaaggaggcgtctatccccatcattaacggtctgtctgatctatatcaccccattcagatcttggctgactacctgacattgcaggagcactacagtagcctgaagggattgaccctgagctggataggggatggaaacaatatcctgcactccatcatgatgtccgctgctaagtttggaatgcacttacaggcagctacgccgaagggatatgagcctgatgctagtgtgacaaaactggcagaacagtatgctaaagagaacggaaccaaactgctgctgacgaacgatccattggaagctgcacatggcggtaacgtgctcatcacggacacttggatctcaatgggccaggaagaagaaaaaaaaaaaagactgcaggccttccagggctatcaggtcactatgaagactgccaaagtggcggccagcgactggactttcctgcactgcctgccacgaaagcctgaagaagttgacgacgaggttttttattcgcctcgttccttggtgttccctgaggccgaaaaccgcaagtggacaatcatggcagtaatggtgtcccttcttaccgactactctccacaacttcagaaaccaaagttc

SEQ ID NO: 17807 - DNA, 1062 bp, Artificial Sequence
  Description of Artificial Sequence: Synthetic coding sequence
atgttgttcaaccttcggatcctgctcaacaacgcagctttccggaatggacataactttatggtgcggaatttccgctgcggacagcctcttcaaaacaaggttcaactcaagggaagagatctgctcacccttaagaatttcactggggaagaaatcaaatacatgctgtggcttagcgccgacctgaagtttcggattaaacaaaagggggaatacctgccactgctccagggaaagtctttgggaatgatcttcgagaaacgatcaacgcggactcgccttagcaccgaaaccggatttgcgctgctcggtggacacccatgtttcctcactactcaggacatccacctgggcgtgaatgagtccctcaccgacaccgcccgcgtcttgagctcgatggcggatgccgtgctcgctcgcgtgtacaaacagtcggatctggacaccctggccaaggaggcgtcgattccgattatcaatggtctttccgacctgtaccacccgatccaaatcctggccgattacttgactctgcaggagcactacagcagcctgaaggggttgactctctcgtggatcggagacggtaacaatattcttcactcaattatgatgtcggccgctaagttcggaatgcatctgcaggctgctaccccgaagggctacgaaccagatgcatcagtgaccaagctcgcggagcagtacgccaaggagaatgggaccaagctcctgcttactaacgatccactcgaggccgcccacggaggaaacgtcctcattactgacacgtggatctcgatgggccaggaagaggagaaaaagaagcggctgcaagcgttccagggataccaggtgacgatgaaaactgccaaggtggctgccagcgattggactttcctccactgcctgcctcggaagccagaagaagttgacgacgaagtcttttactcgccgagatcactggtgttcccggaagcggaaaaccgcaaatggactatcatggcggtgatggtcagcctgctgactgactactcccctcaactgcaaaagccaaagttc

SEQ ID NO: 17808 - DNA, 1062 bp, Artificial Sequence
  Description of Artificial Sequence: Synthetic coding sequence
atgctgtttaatctcagaattcttttgaacaatgccgcatttagaaacggccataactttatggttcgcaacttcaggtgcggtcagccactgcagaacaaggtgcaacttaagggcagggaccttcttacgctgaagaactttaccggtgaagaaatcaaatacatgctgtggctgtccgctgacctgaaatttcgcataaaacagaagggggaatatctgcctctgctgcaaggtaaatccctcggtatgatctttgaaaagcgatcaacccgtactcgactctcgactgagactggctttgcgcttttggggggacacccgtgtttcttgaccactcaagatattcatctgggcgtgaatgagtcactgacggacactgcacgggtccttagcagcatggcagatgcagtgctggcacgggtctacaagcaatcagatctcgacactctggcgaaggaagcctccattcccatcatcaacggtttgtcagacctgtaccatcctattcagattctcgctgattacctgacgcttcaggagcactactcatcgcttaaaggactgacgctgtcatggatcggagacggtaataacattcttcactcgataatgatgtccgcagcaaaattcggaatgcatcttcaagccgccaccccaaagggatacgaaccggacgcctcggtcaccaagctcgccgaacagtacgcaaaggaaaacgggactaagctcctcctgactaacgatccactggaggctgcacatggcggtaacgttcttataaccgatacctggatttcgatgggccaagaagaggagaaaaagaagcggctccaagcatttcagggctatcaggtgaccatgaaaacggcgaaggtggccgctagcgattggaccttccttcactgtctgcctcgcaagccagaagaggtcgatgatgaagtcttttactcccctcgctcactggtgttcccggaagcagaaaataggaaatggaccatcatggcagtgatggtgtcattgctgaccgattattctcctcaactgcaaaagccaaagttt

SEQ ID NO: 17809 - DNA, 1062 bp, Artificial Sequence
  Description of Artificial Sequence: Synthetic coding sequence
atgttgttcaatctccggattctactgaacaatgccgcttttagaaatggccataactttatggtgaggaactttcggtgcgggcagcctcttcagaataaggtacagttgaaagggcgcgatctattaacactgaagaatttcactggggaggaaatcaagtacatgctgtggctgtccgccgacctcaagtttcgcattaaacagaagggcgagtatttgcctctccttcaagggaagtccttggggatgatcttcgagaagcgttcaacgagaacacgactgagcacagagacaggtttcgcccttttagggggccacccctgtttcctgaccacacaggatattcatctgggggttaatgagagcctgaccgacacagcgcgggtgctgagtagcatggctgacgccgtcttggcacgcgtgtataaacagtcagatcttgatacactcgccaaagaggcgagtatccccattatcaatggactgtcagacttgtatcaccccattcagattctggccgattacctgaccctgcaggaacattacagttccctcaaaggactgacattaagctggattggcgatgggaacaacatactacacagcatcatgatgagtgctgccaagtttgggatgcacctgcaggccgctactcccaagggatatgagccagacgcatccgtgacaaagctggccgaacagtacgctaaggagaatgggactaagctgctcctgacaaacgatcctttggaggccgctcatgggggaaatgttctgattactgatacgtggattagtatgggccaggaggaagagaagaagaagagattgcaagcctttcagggttaccaggtgactatgaagaccgctaaggtcgcagcgagcgattggacctttctgcattgcctgcctaggaaacccgaagaggtcgacgatgaagttttctattcaccccgatcactggttttcccggaggcagagaatcgcaagtggaccatcatggctgtgatggtctctttgctgaccgattactctccacagttgcagaagcctaagttc

SEQ ID NO: 17810 - DNA, 1062 bp, Artificial Sequence
  Description of Artificial Sequence: Synthetic coding sequence
atgctgttcaatctgcgtattctgctgaacaacgctgcatttcgcaacggacataacttcatggtgaggaattttcgctgtggccagccgttgcagaataaggtacaactgaaaggccgagatctgctgacgctgaagaatttcaccggtgaggagattaagtatatgctctggcttagcgcggacctgaagtttcgtatcaaacaaaaaggcgaatacctgcctttgctgcagggtaagagcctcggtatgatcttcgagaaacgtagcaccagaacccgcctgagcacggagaccggtttcgcgctcctgggtgggcacccttgcttccttaccacccaggatatacacctgggcgttaacgaatccctgactgatacggcccgcgtactgtcgtcaatggcagacgcagtactggctcgcgtgtacaaacagagcgacctggacacactggcaaaagaagcttctattcctataattaatggcctgtctgacctttaccaccctattcagattctggctgactacttgacgctgcaggaacactactcgagcctgaaggggctgacgcttagctggattggagacggtaacaatattctccactcaatcatgatgagcgcagccaagtttggcatgcacctgcaggcggccacgccgaaaggttatgagccggatgcttctgtcacgaaactggcagagcaatatgcaaaggaaaacggaacaaaactgttgctgacaaacgatccactcgaggcggcccacggcggtaatgtgttgataacggatacctggattagcatgggccaagaagaagaaaaaaagaagagattgcaggcctttcagggataccaggtgacgatgaaaactgctaaggttgcagcatcggactggacattccttcactgcctgcctcgcaagcctgaggaagtggatgatgaggtgttttattccccgaggtctctggtttttccggaggcagagaatcgtaaatggacgattatggccgttatggtaagtcttctgaccgactattcccctcagctgcagaaacctaagttt

SEQ ID NO: 17811 - DNA, 1062 bp, Artificial Sequence
  Description of Artificial Sequence: Synthetic coding sequence
atgctattcaacttgagaatacttctcaataacgctgcgtttaggaatggacataatttcatggttaggaacttcaggtgtgggcagccacttcagaataaagtgcaactaaaaggaagagatctcctcacactaaaaaactttacaggggaggaaataaaatacatgctgtggctaagtgccgatctcaaattcagaatcaaacagaaaggggagtacttgcccctgctgcagggaaaatccctggggatgatatttgaaaagcgctccacacgaactcggctgtcaactgagactggattcgctttactcggggggcacccatgcttcttgacaacgcaggatattcaccttggagtgaacgaatctctgactgatactgcaagggtgttgagttcgatggctgacgccgttttagctcgagtgtacaaacagagtgatctcgacacattagctaaagaagcgtcaataccaatcatcaacggactttctgacctgtatcatcctattcagatcttggccgactaccttacactgcaggaacattactcctctttaaaagggctaactctgtcctggatcggagacggaaataatattctccatagtattatgatgtctgcagccaaattcggaatgcatctacaggcagcaacacccaaaggatatgaacccgatgcgtcagtcactaaacttgccgaacagtacgctaaggaaaacggaactaaacttctcttaacaaatgaccctctggaagctgctcacggggggaatgtcctgatcactgatacttggatcagtatggggcaagaggaagaaaagaaaaaaaggcttcaggcgtttcagggatatcaggttacaatgaaaactgccaaagtcgcagcctctgattggacatttctgcattgcctccctagaaaacctgaagaagttgacgatgaagtgttctattctccccgctccctcgtgttcccagaagccgaaaatcggaaatggacaattatggccgtgatggtctctctcctcactgattatagtccccagctgcagaaacccaaattt

SEQ ID NO: 17812 - DNA, 1062 bp, Artificial Sequence
  Description of Artificial Sequence: Synthetic coding sequence
atgctcttcaacctgcggatcctgttgaataacgccgcattccgaaacggtcacaatttcatggtccgcaactttcggtgcggacagcccctgcagaacaaggtgcagctcaagggtcgggatctgcttacgctgaaaaacttcaccggcgaggagatcaagtacatgctgtggctgtcggccgaccttaagtttagaattaagcagaaaggcgagtacctgccgctcctgcaagggaaatcgttgggcatgatttttgaaaagaggtccaccagaacgcggctttctactgaaacgggatttgctcttctgggaggacacccttgtttcctgaccactcaggacattcaccttggtgtgaatgagtcgttgaccgacactgctcgggttctgtcgagcatggccgacgcagtcttggctcgggtgtacaaacaaagcgacctggataccctggcaaaggaggctagcatcccaattatcaacggtttgtcagacttgtaccatcctatccaaatcctggccgactacctgaccctgcaagagcactactccagccttaagggactcacgctctcctggattggagacggaaacaacattctgcattccatcatgatgtccgcggcaaagttcggaatgcaccttcaggccgctacccctaagggctacgaacctgacgcatcggtcaccaaactggccgagcagtatgcgaaagaaaacggaactaagctgctcctgacgaacgatccgctggaagcggcacatggaggcaacgtgctgatcactgatacctggatctccatgggacaggaagaagaaaagaagaagcggctccaggctttccagggatatcaggtgaccatgaaaactgcgaaggtcgctgcgtcagattggactttcctgcactgccttccacggaaacccgaggaagtggatgatgaagtgttttactccccacggagcctggttttcccagaagccgagaatcggaaatggaccatcatggcagtgatggtgtcgctcttgaccgactacagcccgcaactgcaaaagccgaagttc

SEQ ID NO: 17813 - DNA, 1062 bp, Artificial Sequence
  Description of Artificial Sequence: Synthetic coding sequence
atgttgttcaacttgcggatcctcctgaacaacgcagcatttcggaatggacataactttatggtcagaaactttcggtgcgggcaaccattgcagaataaggttcaactgaagggaagggacttgctgacgttgaagaactttaccggagaggaaatcaaatacatgctttggctttcggcggacctgaagtttaggatcaagcaaaagggtgaatacctgccgcttcttcagggaaagagcctcggcatgatctttgaaaagcgctccactagaacgagacttagcactgagactggattcgcgctgcttggcggacatccgtgcttccttactactcaagacatccatcttggggtgaacgaatccctcactgataccgcgagagtcctgtcgtccatggcggatgcggtccttgcccgtgtgtacaagcagtctgatctggacaccctggcaaaagaagcatcaatacccataatcaatggactttccgacctgtaccatcctatccagattctggcagactaccttaccctgcaagaacattacagcagcctgaaagggctcactctttcgtggattggtgatggtaataacattcttcatagcatcatgatgagcgcagcaaagtttggaatgcacctgcaagcagcaactccaaaaggatacgaacctgacgccagcgtcaccaagttggcagaacagtacgcaaaggaaaacggcaccaagctcctgctgaccaatgatccactggaagcggcacacggtggaaacgtgctcatcaccgatacctggatatccatgggtcaggaggaagagaagaagaaaaggctccaggcatttcagggctaccaggtcaccatgaaaactgccaaagtcgccgcatcagattggacttttttgcattgtctccccaggaagcctgaggaagtggatgatgaggtgttttactccccaagatcgctcgtgttccctgaagcagagaaccggaagtggactatcatggccgtcatggtcagtctgcttacggattacagccctcaacttcaaaagcctaagttt

SEQ ID NO: 17814 - DNA, 1062 bp, Artificial Sequence
  Description of Artificial Sequence: Synthetic coding sequence
atgcttttcaacttgagaatattgctcaataacgctgcctttaggaatggacataactttatggtaagaaactttcggtgtggtcagcctctccagaacaaggttcagttaaagggcagggatctcctcactcttaaaaacttcacgggcgaggaaatcaagtacatgttatggttgtcagcagatctcaagtttagaatcaagcaaaaaggtgagtatctgcctctgctgcagggaaagtctttgggaatgatcttcgagaaaaggtccacgcgcacccggttgtcaactgagactggatttgcgctgctcggcggacatccgtgcttcctgaccacacaagatatacatcttggggtcaacgagtcgctgacagatacagcccgggtcttgtccagcatggcagacgccgttttggcaagagtttataaacaatcagatctcgatactctggccaaggaagcatctatacctattatcaacggtctcagtgacctttatcacccgatccagatactcgctgattatttgaccttgcaggagcactactcttctctcaaaggcctgacactgagctggataggagatggtaataatattctccactcaattatgatgtccgcagccaagttcggcatgcatcttcaggccgccacacccaaaggttacgagccggacgccagtgtgaccaaactggctgaacagtatgctaaagaaaacgggacaaagcttctactgactaatgatccgctggaagctgcccacggagggaacgtgctcattaccgatacatggatctccatggggcaagaggaagagaaaaagaaaaggctccaggcctttcagggttatcaagttactatgaaaaccgcaaaggtagccgcaagcgattggacctttctgcactgcttaccccggaagcccgaggaagttgatgacgaagtgttctactccccccggtctctcgtgtttcccgaggccgagaaccggaagtggaccatcatggccgtgatggtgtccctgctaactgattattccccccagttacagaaacccaagttt

SEQ ID NO: 17815 - DNA, 1062 bp, Artificial Sequence
  Description of Artificial Sequence: Synthetic coding sequence
atgcttttcaatcttagaatcctgttgaacaacgctgcatttcgaaacggacataactttatggtccggaacttccgctgtggccagccactgcagaacaaagtgcagctcaaggggcgcgaccttctgaccctgaagaatttcactggggaagaaatcaagtatatgctgtggctgtctgctgatctgaagttccgcatcaagcagaagggagaatacctgccgctcctccaaggtaagagccttggaatgatcttcgagaagcggtcgaccagaacgcgcctgagcaccgaaaccggattcgcactgttgggcggacacccttgtttcctcactacccaagatatccacctcggagtgaacgagtcgctgacggacaccgcccgcgtcctgtcctcaatggcggacgcagtcttggcccgcgtgtacaagcagagcgatctggacacgctggccaaggaggcttccatcccgatcatcaacggcctgtcagatttgtaccacccgatccaaatcctcgctgattacctcaccctgcaagaacactactcgtctctcaagggcctgactctctcgtggatcggcgacggcaataacatactccacagcatcatgatgtcagcagcgaagtttggcatgcacctgcaggctgcgactccgaaaggatacgaacccgacgcgtcagtcaccaaacttgccgagcagtacgccaaggaaaatggaactaaactccttctgaccaacgacccgttggaggcagcgcacggcgggaacgtgctgattaccgacacttggatctccatgggtcaagaggaggaaaagaagaaaaggctgcaagcctttcaaggataccaggtgactatgaaaaccgccaaagtggcggcctctgattggaccttcctgcactgccttccaagaaagcccgaagaggtggacgatgaggtgttctactcgccccggtcgctggtctttccggaggcggagaaccggaaatggacgatcatggccgtgatggtgtcgctcttgactgattactcgcctcagctccagaagccgaagttc

SEQ ID NO: 17816 - DNA, 1062 bp, Artificial Sequence
  Description of Artificial Sequence: Synthetic coding sequence
atgctgtttaatctgcgcatacttcttaacaacgccgcgtttaggaacggtcacaacttcatggtgcgcaatttcagatgtggacagcccctccagaacaaggtccagcttaaaggtcgtgatcttcttacccttaagaatttcacgggtgaagaaatcaagtacatgctttggctttcggcggatctcaagtttaggattaagcagaagggagagtatctgcccctgctgcaaggaaaaagccttggcatgatttttgagaagcgctcgactcggacccgtctttccactgaaactgggtttgcactcctggggggacatccttgttttcttactacccaagatatccacctcggggtcaacgaatcgttgactgataccgcacgcgtgctgtcctcgatggccgatgccgttttggctagagtatacaagcaatccgatctcgacactctggcaaaggaagcaagcattcccattatcaatggactgtcagatctgtaccatcctatacaaatcctggctgattaccttactcttcaagaacattacagctccttgaaggggcttacgttgtcctggataggcgatggaaataacattcttcatagcattatgatgtccgccgcaaagtttggcatgcatcttcaagctgcgaccccaaagggttacgaaccagatgcatcagtgaccaaactggcagaacagtacgctaaggagaacggcacgaaactccttttgactaatgacccgttggaagcggcacatggagggaacgtgctgatcactgacacttggatttcgatggggcaggaagaggagaaaaagaagagactgcaagcatttcaaggttaccaagtgacgatgaaaaccgccaaagtcgcagcatcggattggaccttcctgcactgccttcctcggaaacctgaggaggtggacgacgaagtgttctattcgccacggagtctggtgtttccggaagcagaaaacagaaagtggaccatcatggcggtcatggtgtcgctgctcaccgactacagccctcaactccagaagcccaagttt

SEQ ID NO: 17817 - DNA, 1062 bp, Artificial Sequence
  Description of Artificial Sequence: Synthetic coding sequence
atgctgttcaatctgaggatcctgctcaacaatgccgccttcagaaatggacataacttcatggtccgcaattttcggtgcgggcagccattgcagaacaaggtccaactcaaggggcgggacctgctgacccttaagaatttcaccggcgaggaaatcaaatacatgctctggctgtcagcagatctgaagttcaggattaagcagaagggagaatacctgccgctgctgcagggaaagtcgctggggatgatctttgagaagcggtcaacccgcacccgactcagcaccgaaactggctttgctctgctcggaggccacccgtgcttcctgaccacccaggatatccacctgggagtgaacgagtcacttacggacactgcccgcgttctcagctccatggcagatgccgtgctggcgcgagtgtacaagcaaagcgacctggacactctcgctaaggaggcttcaatccctatcattaacggactgagtgacctgtaccatcctatccagatcctggcggattacttgactctgcaggaacattactcgtcactcaagggattgaccttgtcctggatcggagacggaaataacattctccactcgatcatgatgtcggccgcgaagttcggaatgcacctgcaggccgctactccaaagggatacgaaccggacgcgtcggtgactaaactggccgagcagtacgccaaagaaaatgggaccaagctgctcctgactaatgacccgctggaggccgcccatggaggaaatgtgctgatcactgatacctggatctccatgggtcaggaggaggagaagaaaaagcggctccaggccttccaagggtaccaggtgacgatgaaaaccgcaaaggtggcggcatcagactggacgtttctccattgtctcccgcgtaagccggaggaagtggatgacgaggtcttttactcgccgaggtcgctggtgttcccggaagccgagaatcgcaagtggaccatcatggccgtcatggtgtctctgctcactgactactcgccacaactgcagaagccaaaattc

SEQ ID NO: 17818 - DNA, 1062 bp, Artificial Sequence
  Description of Artificial Sequence: Synthetic coding sequence
atgttgttcaacctgcggatcctgttgaataacgccgcattccgcaacggacacaacttcatggtgagaaactttaggtgcggacagccgttgcaaaacaaggtgcagctcaagggaagggacctgttgaccctgaaaaacttcacgggcgaagaaatcaagtatatgttgtggctctctgctgatctcaagttccgcatcaagcaaaagggtgaatacctgccgttgctgcagggcaaatcgctgggcatgatcttcgaaaagcgctccactagaactcgcctttccactgaaaccggctttgcgctcctcggtggacacccgtgcttcctgaccacgcaggacattcatctgggagtgaacgaatcactgactgacaccgcccgggtgctgtcgtccatggcggacgctgtgctcgccagagtctacaagcagtcggacttggatactctggccaaagaggcatcaatccctatcattaacgggctctcggacctctaccatccaatccaaatcttggcggattacctgaccctgcaagaacactactccagccttaagggactgactctgagctggatcggagacggcaacaatatcctccactccattatgatgagcgcagctaaattcgggatgcacctgcaggccgctaccccgaaagggtacgagccagatgcctcggtgactaagctggcggagcaatacgccaaggagaacggaaccaagctcctgctcaccaacgacccgctggaagcagcacacggcggaaacgtcttgatcaccgatacgtggatcagcatgggacaggaagaagagaaaaagaagcgcctgcaagcgtttcaagggtaccaggtgacgatgaaaactgctaaagtcgcagcctcagattggactttcctgcattgcctcccgagaaagccggaggaagtggacgacgaggtgttctactcgccccggtccctcgttttccctgaggcggagaatagaaagtggaccatcatggcagtgatggtgagcctgttgactgactacagcccgcagttgcagaagccaaaattc

SEQ ID NO: 17819 - DNA, 1062 bp, Artificial Sequence
  Description of Artificial Sequence: Synthetic coding sequence
atgctgtttaatctgcggatcctgctcaacaatgccgccttcagaaatggacataacttcatggtgcgaaatttccgttgcggccagccgctgcagaacaaggtccagctcaagggccgtgatctgctaacattgaaaaattttaccggcgaggaaatcaagtatatgctctggctctcggccgaccttaagttccgtataaagcagaagggagagtacctaccattgttgcagggtaaaagtctcggaatgatctttgaaaagcgtagcaccaggacacgcctgtccacagaaaccggctttgctctcttgggcgggcacccctgttttcttacgacccaggatattcacctgggagtcaatgagtccttgactgacactgcccgggtcctgtcatctatggcagacgccgtgctggccagggtctacaaacagtcagacctggatactctcgccaaagaggccagtattccgattattaacgggctgtccgatctctaccacccgatccagatcctggccgactatctgacccttcaggagcactactcttcattaaagggacttacgttgagttggatcggggatggcaataatatcctccattctattatgatgtctgcagccaagttcggtatgcacctgcaagccgcgacgccaaagggctacgagcccgacgcctcagtgaccaagctggctgagcagtatgccaaggagaacgggaccaagctgttgctcaccaacgatccactggaagcggcgcatgggggaaacgtgctgattactgacacatggatatccatggggcaggaggaagaaaaaaagaaaaggctacaggctttccagggctatcaagtcaccatgaagaccgctaaggtcgcagcttccgactggactttcttgcactgtctcccccgtaagccagaggaagtggatgatgaagtgttttacagtcctcgttcactggtcttccctgaagcggagaaccgaaagtggacgatcatggcagtcatggtctcgctcctgactgattatagtcctcaactgcagaagcctaaattc

SEQ ID NO: 17820 - DNA, 1062 bp, Artificial Sequence
  Description of Artificial Sequence: Synthetic coding sequence
atgcttttcaacctgcggatacttctgaataacgccgcttttcgtaacgggcacaacttcatggtacgaaacttcaggtgtggacaaccactgcaaaataaggtgcagctcaaggggcgtgacctgttgacgctgaaaaactttaccggcgaggagattaaatacatgctttggctcagcgccgacctgaagttcaggatcaagcagaagggggagtacctgcccttgttacaagggaagtccctaggtatgatattcgagaagagatccactagaacacgtcttagtacagagacgggatttgcactattgggcggccacccctgttttctcaccacacaggacattcatcttggcgtgaacgaaagcctgaccgatacagcaagggttcttagtagtatggccgatgccgttttagctcgtgtatacaaacagtctgatctagacactctggccaaggaggcttccatcccaatcattaacgggttgagtgacctgtaccaccccatccagatccttgctgattacctgacccttcaggagcattattccagcctgaaagggttaacgctgtcctggattggcgatggtaacaacatcttgcactccattatgatgtctgctgccaaatttgggatgcatctgcaggccgccacacctaagggctacgaacctgatgccagcgttaccaagttggccgaacagtacgcaaaggaaaatggcacgaaactcctgctgaccaatgaccctctggaggctgcgcatgggggaaacgtcttgatcaccgatacttggatcagcatgggacaggaggaggagaaaaaaaagcgactccaggcgtttcagggataccaggttaccatgaagacagctaaggtggccgcctcggactggacatttctgcactgcctgccgagaaaaccagaggaagtcgatgacgaggtgttctattccccaagatcactcgtcttccccgaggctgagaataggaagtggacaattatggctgtgatggtgtcactgctgaccgattattccccccagctgcagaagcctaagttc

SEQ ID NO: 17821 - DNA, 1062 bp, Artificial Sequence
  Description of Artificial Sequence: Synthetic coding sequence
atgctcttcaacctgcgaattctgctaaacaatgccgcttttaggaatggccacaatttcatggttcgcaactttagatgtggccaaccgctgcagaacaaagtgcagctgaaaggccgcgatttgttgacactgaaaaatttcacgggcgaggaaatcaaatatatgctgtggttgagtgcagatttgaagtttagaatcaaacagaaaggagaataccttcctctccttcagggtaagagtttggggatgatctttgagaaacgaagtaccagaacaaggctgagcacagaaaccggattcgctttactcggcggacacccctgcttcctgacaacccaagacatacatctgggcgtcaatgaaagcctaaccgacactgctcgtgtgctatctagcatggcagatgcagtgctagccagagtttataaacagtccgacctcgacaccctggcaaaggaggcatctatccccatcatcaatggactgtctgatctctaccatcccatccagatcctcgccgactatctcactttgcaggaacattacagtagtcttaaggggttaactctttcctggatcggggacggcaataacatcctccacagtatcatgatgagcgctgcaaaattcggcatgcacctgcaagcagcgacacctaagggctacgagccagatgcatccgtgacgaaacttgccgagcagtacgccaaagagaatggaaccaagctgctcctgacaaatgatcctttagaagccgctcatggagggaacgtcctgattacagacacatggatttcaatgggacaagaagaagagaagaagaagaggttacaagcattccaaggatatcaggtcacaatgaaaaccgctaaggtcgctgcctctgactggacttttttgcactgtctgcctcgaaaaccggaagaagttgacgatgaggtgttttacagcccacgttccctggtttttcctgaagcagagaatagaaagtggaccattatggccgtgatggtaagcctcctgaccgattactccccgcaactgcagaagcctaagttt

SEQ ID NO: 17822 - DNA, 1062 bp, Artificial Sequence
  Description of Artificial Sequence: Synthetic coding sequence
atgctgttcaacttaaggatcctgttaaataatgcggccttcaggaacggccataacttcatggttaggaatttcagatgtggccagcctctgcagaacaaagtccagcttaagggacgcgacttgcttacattaaagaattttacaggcgaggaaattaagtacatgctttggctgagcgccgacttgaagtttcgcatcaagcagaagggcgagtacttgccattgcttcagggaaagtctctgggcatgatctttgagaaaaggtccacgagaaccagactctctactgaaaccggatttgccctgctgggcggccacccgtgcttcctgactacacaggatatacacttgggtgtgaacgagtccctgactgacaccgcgcgtgtgctgagttcaatggccgacgcagttctggctcgggtgtacaagcaatctgacttagataccctggcaaaggaggcatcaattcccattatcaacggcttgtccgatctgtatcaccctatccagatattagccgattaccttacgctgcaagaacattattcttcgctgaagggtctgacgctctcctggattggcgatggcaataatattttgcattcaattatgatgagtgctgccaagttcggaatgcacctgcaagctgcgaccccaaaggggtatgagcccgacgcttctgttactaagctagctgaacagtatgctaaggaaaacgggacaaagctccttcttacaaacgaccccctcgaggctgcccacggcgggaatgtgctcattacagatacatggatttccatgggccaggaagaggaaaagaagaaaagacttcaggcctttcagggataccaggtcacaatgaagaccgccaaggtggctgcatccgattggacattccttcactgtctacctagaaaacctgaggaggtggatgatgaggtattttatagccccaggtccctggtttttcccgaggctgagaatagaaagtggacaataatggccgttatggtgagtctcttgaccgactattccccccaactgcaaaagcctaagttt

SEQ ID NO: 17823 - DNA, 1062 bp, Artificial Sequence
  Description of Artificial Sequence: Synthetic coding sequence
atgctgttcaacttgcgtattctattgaataatgcagctttccgcaatggacataatttcatggtaagaaatttccgttgcggtcaacccctacagaataaggtgcaactaaaaggacgggacttacttacccttaagaatttcacaggagaagagataaaatacatgttgtggctatccgcggacttgaagtttaggattaaacaaaagggtgaatacctaccattgcttcaaggaaaatccctagggatgatctttgaaaaacgttcaactcggacacgcctgtccactgagactgggtttgcacttctaggaggacacccgtgttttcttacaacacaagatattcacctcggagtgaatgagtcgttgactgacacagcgagagttctctctagtatggcggatgcagtactcgcacgagtttataaacaatctgatttggatactttggctaaggaagcttccattccaatcattaatggtctctcggatttgtaccatccaatacaaattcttgctgattatctcactttgcaagagcactatagctctctaaagggcctgactctttcatggatcggagacggaaataacattctgcactcaataatgatgtcagcggctaagtttggaatgcatctacaagcagctacaccaaagggttacgaaccagacgcatcagttacgaaactcgctgagcagtacgcgaaggaaaatggaactaaacttctcctgacgaatgatccgttggaagcagcacacggtggaaatgttctgattacagatacttggatatcaatgggacaggaggaagagaagaaaaaacggcttcaagcttttcaaggatatcaggtaacaatgaagactgctaaagttgcggctagcgactggacatttctccattgccttccgcgtaaacctgaagaggttgatgatgaagttttttactcgccacggagtctcgtgtttccagaagcagaaaatagaaaatggacaatcatggccgttatggtttcattgctgacagactactcgccacagttgcagaagcctaaattt

SEQ ID NO: 17824 - DNA, 1062 bp, Artificial Sequence
  Description of Artificial Sequence: Synthetic coding sequence
atgctgttcaacctgcggatcctgttgaataacgcggcattcaggaacgggcacaactttatggtgcgcaatttcagatgtggtcaaccgttgcagaacaaggtgcagctgaaggggcgcgatctcctcaccctgaagaatttcactggggaagagatcaagtacatgctgtggctgagcgcagaccttaagtttcgaattaagcagaagggtgagtacctccctctgctgcagggaaaatctctcggaatgatctttgagaaacgctccaccagaacccggctgtcgactgaaactggattcgcactgctcggcggtcacccgtgttttctgacgacccaggatatccatctgggcgtcaacgagtcgctgactgatactgcccgcgtgctgtcaagcatggcagatgccgtccttgctcgcgtgtacaagcaatcagatctcgacactctggcgaaggaagcctccattccgatcatcaacggattgtccgacctgtaccaccccattcagatcctggccgattacctcacgctgcaagaacactactcctcgctgaagggactgaccctgagctggattggcgacggaaacaatatcctgcactcaatcatgatgtcggccgcaaagttcggaatgcaccttcaggccgccactcctaaaggatatgagccagacgcctccgtgactaaacttgcggagcaatacgccaaggaaaatggtaccaagttgcttctgactaacgatccactcgaggccgcccatggcggaaacgtgttgatcaccgatacttggatctccatgggacaggaagaagaaaagaaaaagcggctgcaggcattccaggggtaccaggtcacgatgaaaactgcgaaggtggcggcctccgactggacgttcctccattgcctccctcggaaaccggaagaagtggatgacgaggtgttttacagccctcgctcactcgtgttcccagaagcggagaaccggaaatggaccatcatggcagtcatggtttcgctgcttactgactattccccgcagctccaaaagcctaagttc

SEQ ID NO: 17825 - DNA, 1062 bp, Artificial Sequence
  Description of Artificial Sequence: Synthetic coding sequence
atgctctttaatctgcggattctgctcaacaacgcagcatttcgtaacggacacaacttcatggtcagaaactttagatgtgggcaacctcttcaaaacaaagtgcaattgaaaggtcgtgatctccttactcttaagaactttaccggtgaagagattaagtacatgctttggctgtccgcagacttgaagtttaggattaagcaaaaaggggaataccttccacttcttcaaggaaagtcgcttggaatgatctttgaaaagcgatctactagaaccaggctgtctaccgaaaccggctttgcactgctgggcgggcatccgtgctttcttactacccaagatatccatcttggtgtgaacgagtccttgaccgacaccgcacgggtgcttagctcaatggcagacgccgttttggcgagagtctacaaacagagcgatctcgataccttggcaaaagaagcatcaataccaataatcaacggacttagcgacctttaccaccccatccagatcttggccgattacctgacgctgcaagaacactactcctcgctgaagggccttaccctgtcctggatcggagatgggaataacatcctgcattcaatcatgatgtcagctgctaagtttggcatgcatctgcaggcagcaacccctaagggttacgaaccagatgcctcagtgaccaagctcgcagaacaatacgcaaaagaaaatggcaccaaactcctgctgactaacgaccctctcgaggcagcccacggtggaaacgtgctgatcactgacacgtggattagcatggggcaagaagaagagaagaagaaaagactccaagcatttcagggctatcaagtgaccatgaaaacggctaaggtggccgcgagcgattggacttttcttcattgtttgccaagaaagccagaggaagtggacgacgaagtcttttactccccacgctcccttgtctttcctgaggcagaaaatagaaagtggaccatcatggcagtcatggtttcgctgctgaccgattattcaccgcagctgcaaaagccgaagttc

SEQ ID NO: 17826 - DNA, 1062 bp, Artificial Sequence
  Description of Artificial Sequence: Synthetic coding sequence
atgctgttcaatctccgaattcttcttaacaatgctgcctttaggaacggtcacaactttatggtgagaaactttagatgtggacaaccactccaaaacaaagtgcaactcaaggggcgcgacctgctgactctcaaaaactttactggggaggaaatcaaatacatgctgtggctctcggcagatctgaagtttcggattaaacaaaaaggagaataccttcctctgctgcaaggtaaatcgcttggtatgattttcgaaaagcgtagcaccagaacgcgcctttccaccgaaactgggtttgcgcttttgggagggcatccatgttttctgactacccaggatattcatctcggagttaacgaaagccttaccgatactgcaagagtgctgtccagcatggccgacgctgtgctggctagagtgtacaagcaatcggaccttgatactctggcaaaagaggcatccatccctattatcaacggtctttccgacttgtaccatccgattcaaatcttggcagactacctgactctgcaggaacattacagctctcttaagggcctgaccttgtcctggattggtgacgggaacaatattctccattccatcatgatgtcagctgcaaaattcggcatgcatcttcaagccgcaactccaaagggctacgaacctgatgcgtcggttaccaagctggccgagcagtacgcgaaggagaacggaactaaacttctgctcactaatgacccacttgaagcagctcatggcggaaacgtcctcataaccgatacctggatttccatgggacaggaggaggagaagaagaagagacttcaggcattccaggggtatcaggtgactatgaaaactgcaaaggtggcagctagcgactggacttttctgcattgccttccacggaagcctgaagaagtggatgacgaagtgttctacagtccacgtagcctggtctttccagaagcagagaacagaaaatggacgattatggcggtgatggtgagcctgctgaccgattactcaccccaactgcaaaagccaaaattc

SEQ ID NO: 17827 - DNA, 1062 bp, Artificial Sequence
  Description of Artificial Sequence: Synthetic coding sequence
atgttgttcaacttaaggatactgctgaacaatgccgcatttcgaaacggacacaattttatggtcagaaacttccgatgcgggcaaccgcttcagaataaggtacagctgaaggggagggatctgctgacattgaaaaatttcaccggggaagaaatcaaatacatgctctggctcagcgccgatctgaagttcaggataaagcaaaagggtgagtacctccctctgctacaggggaaaagtttaggcatgatctttgaaaaaagaagtacgagaactagacttagcacagaaaccggatttgcactcctgggtggccacccttgtttcctgacgactcaggatatacatctgggagtaaatgagtctctcaccgatacagcccgggtcctgtctagtatggccgatgctgtcctggcacgcgtgtacaagcagtcggacttagataccctggctaaggaagcctctatccccattataaacggactctccgacttgtatcaccctattcagattcttgccgattacctgaccctgcaggagcactattcttccttaaaagggttaaccctgagttggatcggagatggcaataatattctgcactccatcatgatgtctgcagctaagttcgggatgcaccttcaggctgctacaccgaaggggtatgagcccgatgcgtctgtgacgaaactggcggagcagtacgcaaaggagaacggcaccaaattgctgctcaccaacgatccattggaagcggcacatggcggtaatgtgctgatcaccgatacgtggatatctatgggacaggaagaggagaagaagaaacgcctgcaggcgttccagggctaccaagtgaccatgaaaaccgccaaggtggcagcgagcgactggactttcctgcattgcctgcctagaaaaccagaggaggtggacgatgaagtgttttacagtccgcgttctctggtctttccagaggcagagaaccggaaatggacaatcatggctgtgatggtgtcgctgctgaccgactactcccctcagcttcagaagccgaagttc

SEQ ID NO: 17828 - DNA, 1062 bp, Artificial Sequence
  Description of Artificial Sequence: Synthetic coding sequence
atgctatttaatctacgtatattactaaataatgcggcgtttcgtaatggtcataattttatggtacgaaattttcgatgtggtcaaccgttacaaaataaagtacaactaaaaggtcgagatttactaacgctaaaaaattttacgggtgaagaaataaaatatatgttatggctatcggcggatttaaaatttcgaataaaacaaaaaggtgaatatttaccgctactacaaggtaaatcgttaggtatgatatttgaaaaacgttcgacgcgaacgcgtctatcgacggaaacgggttttgcgttattaggtggtcatccgtgttttctaacgacgcaagatatacatttaggtgttaatgaatcgctaacggatacggcgcgtgtactatcgtcgatggcggatgcggttctagcgcgtgtatataaacaatcggatctagatacgctagcgaaagaagcgtcgataccgataataaatggtctatcggatctatatcatccgatacaaatattagcggattatctaacgttacaagaacattattcgtcgttaaaaggtttaacgctatcgtggataggtgatggtaataatatattacattcgataatgatgtcggcggcgaaatttggtatgcatctacaagcggcgacgccgaaaggttatgaaccggatgcgtcggttacgaaattagcggaacaatatgcgaaagaaaatggtacgaaactattactaacgaatgatccgttagaagcggcgcatggtggtaatgtactaataacggatacgtggatatcgatgggtcaagaagaagaaaaaaaaaaacgtttacaagcgtttcaaggttatcaagtaacgatgaaaacggcgaaagtagcggcgtcggattggacgtttttacattgtttaccgcgtaaaccggaagaagttgatgatgaagtattttattcgccgcgatcgttagtatttccggaagcggaaaatcgaaaatggacgataatggcggtaatggtttcgttattaacggattattcgccgcaattacaaaaaccgaaattt

SEQ ID NO: 17829 - DNA, 1062 bp, Artificial Sequence
  Description of Artificial Sequence: Synthetic coding sequence
atgttgtttaatctgcgcattctcctgaacaacgcggccttccgcaacggccataacttcatggttcggaacttccgctgcggccagccgctgcagaacaaggtgcagctcaaagggcgggacctccttactctcaagaacttcaccggtgaggagatcaaatacatgctttggttgagcgcagacctgaagttccgaattaagcaaaagggcgagtacctgcctctgctgcagggaaagtcactgggaatgattttcgagaagagatcgaccaggacccgtctctccaccgagactggtttcgcgctgctcgggggtcatccatgcttcttgacgactcaggacatccacctgggagtcaacgagagcttgaccgacaccgcgcgtgtcttgtcatccatggccgacgctgtattggcgcgggtttacaagcagagcgaccttgataccttggccaaggaagcctcaatccccataattaatggtctctctgacttgtaccatcctatccagatcctggctgattatttgacactgcaggagcactactcctcgctgaaggggttgaccctctcgtggattggcgatgggaataacatacttcacagcatcatgatgagcgctgctaagtttggcatgcacctccaggctgctacccccaagggctatgagcccgacgcgtctgtaactaagttggctgagcagtacgccaaggagaacggcaccaagctgttgcttacgaacgaccccctggaggctgcccatgggggtaacgtacttatcacagatacctggatctctatggggcaggaggaggagaagaagaagcggctccaagctttccaaggttatcaggtcacaatgaagaccgcaaaggtggccgcgagcgactggaccttccttcactgcctccctcgtaagccggaggaggtcgacgacgaggtgttttactccccccgttctctagtcttccccgaagccgagaatcgcaagtggaccattatggccgtgatggtttcgctcctgacggattatagcccccagctgcagaagccaaagttc

SEQ ID NO: 17830 - DNA, 1062 bp, Artificial Sequence
  Description of Artificial Sequence: Synthetic coding sequence
atgttgttcaatctgagaatcctgctcaacaatgcggcattccggaacggacacaatttcatggtgagaaacttcaggtgcggccagccgttgcaaaacaaagtgcagctgaagggccgggatctgcttactctgaagaactttactggagaggaaatcaaatacatgctgtggctgtcagcggatctcaagttccggatcaagcagaagggagagtacctccccctcctgcaaggcaaatccctggggatgatcttcgaaaagcggagcactaggacccgcctgagtactgagactggatttgcactcctggggggacacccgtgctttctgaccactcaggacattcatttgggcgtcaatgaaagcctgactgataccgcccgggtcttgtccagcatggccgatgccgtgctggcacgggtgtacaaacagtcagatttggataccctggcgaaggaggcctccattccaatcattaatggcctgtccgatctgtatcatccgatccagattctggcggactacctcactctgcaagagcattactcctccctgaagggactgacccttagctggatcggagacggcaacaacatcctgcatagcatcatgatgtcagctgcgaagttcgggatgcacctgcaggcggcgacccctaagggatatgaaccagacgcatccgtcaccaaactggcggagcaatacgccaaagaaaacgggacgaaactgttgcttaccaatgaccctttggaggccgcgcacggaggaaacgttctcatcacggacacctggatctcgatgggccaggaagaggaaaagaagaagcggctgcaagccttccagggataccaggtcactatgaaaacggcaaaggtggccgcctcggattggactttcctgcactgcctgcccaggaagccagaggaggtggacgacgaagtgttctactcgcccaggagccttgtgttcccggaagccgaaaatagaaagtggactataatggccgtgatggtgtccctgctcaccgattacagccctcagctgcagaagccaaagttc

SEQ ID NO: 17831 - DNA, 1062 bp, Artificial Sequence
  Description of Artificial Sequence: Synthetic coding sequence
atgctttttaacctgcgaatcctgctgaacaatgctgcattccgaaacgggcacaattttatggtacgaaattttaggtgcggccagcccctgcagaataaggtccagctcaagggaagggacctgctcacgctcaagaattttactggtgaggaaatcaagtacatgctctggctgtcagcagacctcaagttcagaatcaagcagaagggcgaatacctgccactgctgcaagggaaaagtctcggcatgatattcgagaaacgatcaacacgcacacgactgtccacagaaactggattcgctctgctgggaggtcatccatgcttcctgaccacacaggatattcaccttggggtcaacgaatctctcacagacaccgctagagttctgagtagcatggcggatgccgtgctcgccagagtgtacaagcaaagcgatctggacacactcgcaaaggaggccagcatccctattatcaacgggctgagcgatctttatcacccaattcaaatcctcgctgattacctgaccctgcaagagcattatagctctctgaaaggcctgaccctttcttggatcggggacggtaataatatattgcactctatcatgatgagcgctgccaaattcggcatgcacctgcaggctgcaactcccaagggctatgagccagatgcatcagtaactaagttggcagaacaatatgccaaagagaacggcaccaaactgctgttgacaaatgatccccttgaagccgcacacggtggaaacgtgttgatcacagatacctggatttctatgggccaggaggaagagaagaagaagcgactccaggcctttcaagggtaccaggtgacaatgaaaaccgccaaagttgccgcttccgactggacttttcttcactgtctgccacggaagccggaagaggtggacgacgaggtgttttactctccccggtccctcgtgtttccagaggctgagaacagaaagtggaccattatggccgtaatggtaagcctgctgaccgactacagcccccagttgcagaaaccaaagttc

SEQ ID NO: 17832 - DNA, 1062 bp, Artificial Sequence
  Description of Artificial Sequence: Synthetic coding sequence
atgttattcaatctaaggatcttgctgaataacgccgctttccggaacgggcataatttcatggttcggaatttcaggtgcgggcaaccactgcagaataaagttcagctgaagggccgcgatcttctaactctaaaaaacttcactggagaagaaataaagtatatgctctggctgagtgcagacctgaagtttagaatcaaacagaagggcgagtatctgcctctgctgcagggcaaatctctggggatgattttcgagaagaggagcaccaggacgaggctttccaccgagacaggtttcgcactacttggaggccacccctgcttcctcacaacccaggacatccatctgggcgtgaatgagtccctgacagatacagcgcgcgtgttgagctctatggccgacgccgtgctggctcgagtgtataagcagtccgacctggacactttggcgaaggaagcctccatccccataatcaacggcctgagcgacctgtaccatcccatccagatcttggccgattatctcaccctgcaggagcactattcttctttaaaagggcttacactctcctggatcggagacggtaataatatccttcactcgataatgatgagcgctgctaaattcggcatgcacctgcaagctgccacccctaaaggatacgagcccgacgcctccgtgacaaaactggcagaacagtacgccaaagagaatggcaccaaactgctgctgaccaacgatcctctggaagccgcacatggggggaacgtgctgataaccgacacttggatctcgatgggccaggaggaagaaaagaagaagcgactgcaggccttccagggctatcaggtgacgatgaaaactgcaaaggtagccgcatccgattggacattcctgcactgcctaccacgcaagcccgaagaggtggatgacgaggtgttttacagtccccgcagcctcgtgttccccgaagcagagaatagaaaatggacaatcatggctgtcatggtttcactgttgaccgactatagccctcagctgcagaagcccaaattt

SEQ ID NO: 17833 - DNA, 1062 bp, Artificial Sequence
  Description of Artificial Sequence: Synthetic coding sequence
atgctgttcaatctgcggattctcctcaacaacgccgcttttcgcaatggacacaactttatggtgagaaatttccggtgtggacagcccctccaaaacaaggttcagctcaagggaagggacctgctcaccttgaagaacttcacgggggaggaaatcaagtacatgctgtggctctcggccgatttgaagttccgaatcaagcaaaagggcgaatacctgccgctgcttcagggtaagagccttggaatgatattcgagaaaagatcgactagaacgaggctgagcactgaaactggtttcgccctgcttggaggacatccatgcttcctgactactcaagatatccatctgggcgtgaatgagtccctgaccgatactgcccgggtcctctcatcgatggcggacgccgtgctggcccgggtctacaaacaatcggacctggacactctcgcgaaggaagcatcgatcccaatcatcaatggcctttcggacctgtaccacccgatccagatcctggcagactaccttacgctgcaggagcactactcctctttgaagggtttgacgttgtcatggatcggtgacggaaacaacatcttgcactctatcatgatgtccgccgccaaattcggaatgcatctgcaagccgccaccccgaagggctacgaaccagacgcgtcagtgaccaaattggcagaacagtacgctaaggaaaatggtaccaagctgctgctgactaatgatcctctggaggctgcgcatgggggaaacgtcttgatcactgatacttggattagcatgggacaggaggaagagaagaagaaacgcctccaagcgttccagggataccaggtgactatgaaaaccgctaaggtcgctgcgtccgattggaccttcctccactgtctcccgcgcaaaccggaggaggtcgatgatgaagtgttctattcgcccaggagcttggtgtttcctgaagccgagaaccgaaagtggaccatcatggcggtcatggtgagcctcctcactgactacagcccgcagttgcaaaagccgaagttt

SEQ ID NO: 17834 - DNA, 1062 bp, Artificial Sequence
  Description of Artificial Sequence: Synthetic coding sequence
atgctcttcaatctccgcatcctcctgaataacgcggccttcaggaacgggcataactttatggtgaggaactttaggtgcggccagccgcttcagaacaaagtgcagttgaagggccgtgaccttctcaccctgaagaatttcaccggggaggagattaagtacatgctttggctgtccgccgacctcaagttccggatcaagcaaaagggagagtacctgccgctgctgcaaggcaagtccctcggaatgatctttgagaagcgcagcaccaggactcggctgtcgactgagactgggttcgccctcttgggcgggcacccatgcttcttgactacccaggacatccacctgggcgtcaacgagtccctgaccgatactgcccgggtcctgtcatccatggcggatgccgttctcgctcgggtgtacaaacaatcggacctcgataccctggccaaagaagcgagcatcccgatcatcaacggactctcagacctgtaccaccccatccaaatcttggccgactaccttacgctccaggaacattactcgagcctcaagggcctgacgttgtcatggatcggggacggtaacaacatcctgcactcgattatgatgtcggccgctaagttcggaatgcatctgcaagccgccaccccaaaaggctatgagcctgatgcgtcggtgaccaagctggccgaacagtacgcgaaggagaatgggaccaagctcctgctgactaacgacccactggaagcagctcacgggggcaacgtgctcatcacggacacctggatttccatgggacaggaagaagaaaagaaaaagcgcctccaggccttccaaggataccaagtgactatgaaaaccgcgaaggtcgctgcatcggactggactttcctccattgtttgcctcgcaagccggaagaggtcgacgatgaagtcttttactcgccaaggtccctggtgttcccggaggcagaaaaccggaagtggacgatcatggccgtgatggtgtcactcctgacggactactccccgcagctgcagaagccgaagttc

SEQ ID NO: 17835 - DNA, 1062 bp, Artificial Sequence
  Description of Artificial Sequence: Synthetic coding sequence
atgctcttcaacctgagaatcctgctcaataacgccgccttccggaacggacataattttatggtccggaacttcagatgtgggcagccactgcaaaacaaagtgcagttaaaaggtagggatttgcttacactgaaaaatttcacaggggaggaaattaagtatatgctatggttatccgcagacctgaagtttaggattaagcagaaaggagagtatttacctctgctgcagggcaagtccttggggatgatctttgagaaacgatccactaggacccgactgtctactgagacaggctttgccctgcttggcgggcacccttgctttctgaccacccaagacattcacttgggggtcaacgaatcacttacagataccgcccgagtattgagcagtatggccgatgctgttctggcccgagtttacaaacagagcgacctggacacgctggcgaaggaagcaagtattcccatcatcaacgggttatccgatctgtatcatcctatccagattcttgccgactatctgacgttgcaggagcactattcctccctgaaaggattgaccctgtcctggattggcgacgggaataatatccttcactccataatgatgtctgccgctaagttcggcatgcatcttcaggcagcaacgcctaagggctatgagcccgatgcgtcggttacaaagcttgcagaacagtatgctaaagagaacggaactaagctgctgctgacaaatgaccccctggaggccgcacacggggggaacgtgctcattactgacacctggatatcgatgggacaagaggaggagaagaaaaagaggcttcaggcatttcaggggtatcaggtgacaatgaagactgcgaaggtggcagccagcgattggacatttctgcactgtctgccccgtaagccagaggaagttgatgatgaagtcttctactcaccacgctccctcgtctttccagaggcggagaaccggaagtggacaatcatggctgtgatggtttccctcctgacagactactcacctcagttgcagaagcctaagttc

SEQ ID NO: 17836 - DNA, 1062 bp, Artificial Sequence
  Description of Artificial Sequence: Synthetic coding sequence
atgttgttcaaccttagaattttattaaacaatgcagctttcagaaacggacataatttcatggtccgtaatttcaggtgtggtcaaccgttacaaaacaaggtgcaattgaaagggcgtgacttacttacattaaagaactttacaggtgaggagatcaaatatatgctttggcttagtgcggatttaaagtttaggatcaaacaaaaaggggaatatttaccgctccttcaaggcaaaagtctaggaatgatttttgagaaaagatcaacaaggacgcgtttatcaactgaaaccggattcgctcttttaggcggacatccttgttttttaacaacacaagatattcatttgggcgttaatgaatcacttacagacacagcacgcgtgttatcttccatggccgatgcagtgcttgctcgcgtgtataagcaaagtgatttagacacattggcgaaagaagctagcattccgataattaacggcctttctgatctgtaccaccctattcaaattttggcggattatctaacactgcaagaacattatagttccctcaagggccttacgctgtcttggattggggatggcaataacattttacactcgattatgatgtcagctgctaaatttggtatgcaccttcaagctgcaacgccgaaaggctacgagccggatgcttcggtaacaaaacttgcagaacagtatgcaaaagagaatggcactaaattgttgcttacaaacgacccgcttgaggccgcgcatgggggtaatgttctcattactgatacgtggatttcgatggggcaggaagaagagaagaagaaaaggctgcaggcctttcagggatatcaggtgacaatgaagacagctaaagttgccgccagcgattggacgtttttgcattgcttaccgcgtaaaccggaggaggttgatgacgaagtgttttattcaccacgctctctcgtctttccggaggcggaaaaccgcaaatggacgatcatggctgtaatggtctctcttcttacagactattcgccgcagctgcaaaagccgaaattt

SEQ ID NO: 17837 - DNA, 1062 bp, Artificial Sequence
  Description of Artificial Sequence: Synthetic coding sequence
atgcttttcaatctcaggatcctgcttaacaacgcagcctttagaaacggtcataactttatggtccggaattttcgttgcggtcagccactccagaataaggtgcaactgaagggtcgcgatcttctgacccttaagaactttactggagaagagattaagtatatgctttggctttccgctgatcttaagttcagaataaagcaaaagggcgaatatctgcccctgctgcagggcaagtcgctgggtatgatctttgaaaaacgatcgactagaaccagactgtcaactgaaaccggttttgcgcttctgggaggacatccgtgttttctgacgactcaagatattcacttgggtgtcaatgagtccctgaccgacactgcaagggtgctgtcgagcatggcagatgcggtgctggccagggtgtacaaacaaagtgatctggatacccttgccaaggaagcctccattccaattatcaacgggttgtccgacctgtaccatccgattcaaattctggcagattacctcacccttcaggaacactactcatcacttaagggccttaccctgtcctggatcggcgatggtaataacattctccatagcataatgatgtcggcagccaaatttggaatgcatctgcaagcggcaacccctaaaggctacgaacctgatgcgtcggtgactaagttggcagaacaatacgcaaaagagaacggaaccaaactgctgctgactaatgatccgcttgaggccgctcatggtggtaacgtgctgatcacggatacttggatttcgatgggtcaagaagaggaaaagaaaaagaggcttcaggcttttcaaggttaccaggtgactatgaaaaccgccaaggttgcagcatcggactggacctttcttcattgtctgcctagaaagccagaggaagtggatgacgaggtgttctactcccccaggtcgttggtgttcccagaggcagaaaatagaaagtggaccataatggcggttatggtcagcctcctgactgactactcgccccaactgcagaagccaaagttt

SEQ ID NO: 17838 - DNA, 1062 bp, Artificial Sequence
  Description of Artificial Sequence: Synthetic coding sequence
atgctgttcaacctccgcatccttctgaacaatgccgctttccggaacggacataactttatggtgagaaatttccggtgtgggcaaccactgcagaacaaggtccagttgaaaggcagggatctgctgactcttaagaacttcactggcgaagaaatcaaatacatgctgtggttgagcgccgacctgaagttccggatcaagcagaaaggcgaatacctgccactgctgcaagggaagtccctcggaatgatctttgagaagagatccactcgcactcggctttccaccgaaactgggttcgctctcctcggtggtcacccgtgttttcttacgactcaggacattcatctgggagtgaatgaatcgcttactgatactgctcgggtcctgtcctcgatggcggacgcggtgctcgcgagagtgtacaagcaatccgaccttgacactcttgccaaagaggcatccatccccatcatcaacggactctctgacctttaccaccctatccagatcctcgccgattacttgaccttgcaggaacactactcgtctctgaaaggattgactctctcctggatcggtgatggaaacaacattctccactccattatgatgagcgcagcaaagttcggcatgcacctgcaggccgcaacccccaaagggtacgagccggatgcaagcgtgaccaagctggcagaacagtatgcgaaggagaatggaactaagctgctgcttaccaacgacccgctggaggccgcgcatggcggcaatgtgctgataactgacacctggatctcgatgggacaagaggaagagaagaagaaacgcttgcaggctttccaaggataccaggtgaccatgaaaaccgctaaggtggcggcgtccgactggacctttctgcactgcctgcctcggaagcctgaggaagttgacgacgaggtgttctactcgcctagaagtctcgtgtttccggaggccgaaaacagaaaatggactatcatggctgtcatggtatccctgctgaccgattacagcccgcagctccagaagccgaagttc

SEQ ID NO: 17839 - DNA, 1062 bp, Artificial Sequence
  Description of Artificial Sequence: Synthetic coding sequence
atgctttttaacctcagaatcttgctcaacaacgcggcttttcgcaacggccacaacttcatggtgaggaatttcagatgcggacagccactacagaacaaagtgcaactgaagggccgagacttgctgacattgaagaactttaccggggaggaaatcaaatatatgctgtggctgtcagcagatctcaagttcaggatcaagcagaagggcgaatatctgcctctgctgcaaggaaaaagcttaggaatgatcttcgaaaagagatctactaggactaggctgtcaactgagaccggctttgctctgcttggaggccatccttgttttttaacaacccaagatatccacctgggcgtgaatgaaagcctcaccgatactgctcgcgtgctttcctctatggcagacgctgtgctggccagagtatacaaacagagcgatcttgacaccctcgctaaagaggcaagtattcctattatcaacggactcagcgatctttatcatccaatccagatactagcagattacctgacattgcaagagcattactcgagtctgaaaggcctgaccctgtcctggatcggtgacgggaacaatatccttcacagcattatgatgagcgccgctaagttcggcatgcacctgcaagctgcgacaccaaagggctacgagcccgatgcgtccgtcacaaaactagccgaacagtacgccaaggaaaacggaaccaagctgctcttgacaaacgacccactggaggcagcccacggcggaaacgtactaattaccgacacttggattagtatgggacaggaggaggaaaagaagaagaggcttcaggcatttcaaggctaccaggtgactatgaagacagccaaagtggcggctagcgattggacctttctgcactgtcttccacgaaagcccgaagaggtcgatgatgaggttttctactccccacgctcactggtgttcccggaagccgagaataggaagtggactataatggcagtcatggtttctctgctgaccgattatagtccacagctgcaaaaacctaaattt

SEQ ID NO: 17840 - DNA, 1062 bp, Artificial Sequence
  Description of Artificial Sequence: Synthetic coding sequence
atgcttttcaatctgagaatcttgctgaacaatgccgcgttccgcaacggccacaatttcatggtccgcaattttcgctgtggccaaccactgcaaaacaaggtgcagctgaagggaagggacctgctcaccctcaagaatttcacgggggaggagattaagtacatgctctggctctccgccgatctcaagttccgaatcaagcagaagggggagtacctgccgctgctgcagggaaagagcctgggaatgatcttcgagaagcgctcaactaggacgcggctctcgactgaaaccggctttgctctgcttgggggtcacccgtgcttcctgaccacccaggacatccacctgggagtgaacgaatccttgaccgacaccgcccgcgtgctctcatctatggcggacgctgtcctggccagagtgtacaagcagtcggacctggacacccttgccaaggaggcctcaatcccgatcatcaacggattgtccgatctctaccatccaatccagatcctggccgactacctgactctccaggaacactacagctcgctcaaaggcctcaccctgagctggataggggacggcaacaatattcttcactcaatcatgatgtcagctgcgaagtttggaatgcatctgcaggccgccaccccgaaaggatacgaaccggacgcgtcggtcaccaaacttgccgagcagtacgcaaaggagaacggcaccaagctcctgctcaccaatgaccctctcgaggccgcacatggcggaaacgtgctgatcaccgatacttggattagcatgggccaagaggaggaaaagaaaaagcgattgcaggcgttccagggctaccaagtgacgatgaaaactgccaaggtcgcggctagcgattggactttcctgcattgcctcccacgcaagccagaagaggtcgatgatgaagtgttttactcaccgagatcgctggtgttccctgaagccgaaaatcgcaagtggactattatggcagtgatggtgagcttgttgaccgattactcgccgcaactgcagaagccgaagttc

SEQ ID NO: 17841 - DNA, 1062 bp, Artificial Sequence
  Description of Artificial Sequence: Synthetic coding sequence
atgctctttaacctcagaattctgctgaacaacgcagcattccgtaacggtcacaatttcatggtccggaactttcggtgtggacaaccacttcaaaacaaagtgcaacttaaaggacgtgatcttctcaccctcaagaatttcaccggagaagagatcaagtacatgctctggctgtcagcagatctgaagtttcgtatcaagcaaaagggagagtacctgcctcttctccagggcaaatcgttgggtatgatcttcgaaaagcgatcaaccaggacccgtcttagcactgaaactggctttgcactccttgggggtcatccttgttttctgaccacgcaggatatccacctcggagtgaatgaatcattgaccgatactgccagagttctgtcgtcgatggctgatgcagtcctcgcccgcgtgtacaagcaatcggatctcgatactcttgcgaaggaagcctctatacctatcatcaacggtcttagcgacctgtaccatccaattcaaattcttgccgattacctgactctgcaggagcattattcgagccttaagggtctgactctgtcgtggatcggagatggaaacaatatactgcacagcatcatgatgtcagcagcgaagtttggtatgcatttgcaggccgcaaccccgaaaggatacgaacctgatgcgtcagtcaccaagctggccgagcagtacgcaaaggagaatggcactaagctccttctgaccaatgaccctctcgaagcggcacatggtggcaacgtgctgataacggacacttggatttccatgggccaggaagaggaaaagaaaaagcgcctgcaagcatttcagggataccaggttaccatgaaaaccgcaaaggtggccgcgtcggactggacttttttgcactgtctgcccaggaagccggaagaagtggatgatgaagtgttctactcacccaggtcgcttgtgttccctgaagcagaaaaccggaagtggactattatggctgtgatggtttcacttctgactgattattcaccacagcttcaaaagcccaaattt

SEQ ID NO: 17842 - DNA, 1062 bp, Artificial Sequence
  Description of Artificial Sequence: Synthetic coding sequence
atgcttttcaacctccggatcctactgaataacgccgcttttcgaaacgggcacaactttatggttaggaacttcaggtgtggccagcccctgcagaataaggtgcagctgaaggggcgggatctgctgacactgaagaattttactggggaagagataaaatacatgctctggctgtccgcggatctcaagttccgcattaagcagaaaggggagtacctgccactgcttcaggggaaaagcctaggaatgatttttgaaaaaaggtccacacggacccgcctgagcaccgaaacgggcttcgccctgcttggcggccacccctgcttcctgaccacgcaggacatccatctcggcgtgaatgagtcactgaccgacacagccagggtactgagcagcatggcagatgcagtgttagcccgcgtatacaagcaatcagatctagacactctagctaaggaagccagtatcccaatcattaatggtctttccgatctttatcaccccatccagatcttagctgactacctcacgctccaggagcattactcgtccttgaaggggctcacgctgtcctggataggagatggcaacaatatcttgcattccatcatgatgtctgctgccaaattcggcatgcacttacaggcagccactccaaagggttatgaacctgatgcaagcgttacgaaactagcggagcagtatgcgaaggaaaacggtaccaagctcctgctgaccaacgatccacttgaggctgcccatgggggaaacgtcttgattaccgacacctggatatctatgggacaggaagaagaaaagaagaagagactgcaggcctttcaaggataccaagtgacaatgaagacggctaaggttgcagcatctgactggactttcctccactgcctcccccggaagcctgaagaagtcgacgatgaggtgttctactcccctagatccttggtgttcccagaggctgagaatcgtaagtggaccattatggctgtcatggtatcgttactgacagattactctccccaactccaaaagcccaaattc

SEQ ID NO: 17843 - DNA, 1062 bp, Artificial Sequence
  Description of Artificial Sequence: Synthetic coding sequence
atgctgttcaacctgcggattcttttgaataatgccgcttttagaaatggtcacaatttcatggtgcgcaacttccgctgtggccaaccactgcagaacaaagtgcagttgaaaggacgcgacctgctcactctcaagaacttcactggggaggagatcaagtacatgctgtggctctcggcagatcttaagtttcgaattaagcaaaaaggagaatacctgcctcttcttcaggggaagtcgctcgggatgatttttgaaaagagaagcacccgtactcgcctgtcaactgaaactggatttgcacttttggggggacatccgtgcttccttaccacccaggatattcatctcggcgtcaacgaaagcctcactgatactgcgagagtcctctcatcgatggcagatgcagtcctggccagagtctacaaacaaagcgatcttgataccctggcaaaagaggcttccatacctataatcaatggtctgtccgatctttaccatccaattcagattctcgcagattaccttacgctccaagaacactactcctcgctcaagggactgaccctttcctggatcggggatggcaataacattcttcactccattatgatgtctgcggcaaagtttggtatgcatctgcaggcagccacccctaagggctacgaaccagacgcatcagtgactaaacttgcggaacagtacgcgaaagaaaatggtaccaagctgcttctgacgaatgaccctcttgaggctgcacatggtgggaacgtcctgataaccgatacgtggatctccatgggacaggaagaggagaagaagaagagattgcaagcattccaagggtaccaggtgaccatgaaaacggctaaggtcgcagcatcggattggaccttcctgcattgtttgccaaggaagcctgaagaagtggacgatgaggtgttttacagccctagatcattggtgtttccagaagcagaaaacagaaaatggaccataatggccgtcatggttagccttcttacggactactccccccaacttcaaaagcccaagttt

SEQ ID NO: 17844 - DNA, 1062 bp, Artificial Sequence
  Description of Artificial Sequence: Synthetic coding sequence
atgctgtttaatctcaggattcttcttaacaatgcagcattccgcaacggacacaactttatggtgcgaaactttagatgcggacagccattgcagaacaaagtgcagttgaagggaagagatcttctgaccctgaaaaactttaccggggaggagatcaagtacatgctgtggctttccgcagatctgaagtttaggattaagcagaagggcgagtacctcccacttctccagggcaaatcgctgggtatgattttcgaaaagagaagcaccagaactcgcctgtccactgagactggctttgcactccttggaggacatccatgtttccttactactcaggatattcaccttggagtcaacgaatccctgaccgacaccgcgagagtgctttcgtcaatggcagatgccgtgctggctagagtgtacaagcagagcgatcttgacacccttgccaaggaagcctcgattcctattatcaacgggctgtccgatctctaccatcctatccaaatactggcggattaccttactttgcaggaacattacagctccctgaaggggttgaccctttcatggattggagatggcaacaatatcctgcattccatcatgatgagcgcagcgaagtttggaatgcacctgcaggccgcaacccctaagggttatgaaccggatgcgtccgtcaccaagctggctgagcagtacgcaaaggaaaacggaactaagctgctgctgaccaatgatccacttgaggccgcccacggtggcaatgtcctcattactgatacttggatttcaatgggacaagaggaagagaagaagaagcgcttgcaggcctttcagggttaccaggtgaccatgaaaactgctaaggtggccgcatctgattggacttttctgcattgccttccacgcaaacctgaagaagtggacgacgaggtgttctactcccctaggtcccttgtgtttcctgaagccgaaaatagaaaatggactataatggcagtgatggtgtcgctgttgaccgactacagcccacaactgcaaaagccgaagttc

SEQ ID NO: 17845 - DNA, 1062 bp, Artificial Sequence
  Description of Artificial Sequence: Synthetic coding sequence
atgctgtttaatctcagaattctactgaataacgccgccttcagaaacggccacaatttcatggttcgcaattttaggtgcggacagccattgcagaacaaggtgcagttgaagggacgcgatctcctgacattgaagaacttcacgggtgaggagatcaagtacatgctctggctctccgctgacctgaagttcagaataaagcagaagggagagtacctgccgctgcttcaaggaaaatccttgggtatgatattcgaaaagcgcagtactcgcacaagattgagtaccgaaaccggctttgcattgttgggcggccacccctgcttcctgaccacacaagacatccacctcggagtgaacgagagcctgacggacacggcacgtgttctgtctagcatggcggatgctgtgctcgctcgggtgtataagcagtccgacttagatactctggcgaaagaggcatctatcccgatcatcaacggccttagcgatctgtaccatcccattcagatattggccgattaccttacactgcaggagcattattcgtcgctgaagggccttaccttaagctggattggcgatggtaataacatcttgcactcaataatgatgtccgcagctaagtttggtatgcacctgcaagccgctacaccaaagggctacgagccggatgcttcggtgaccaagttggctgagcagtatgcgaaagagaatggtaccaagctcctgttgaccaatgatccgctggaggctgctcacggaggaaatgtgctgataacggacacttggatttcgatgggacaagaggaagaaaaaaagaagagactacaggccttccagggctaccaagtgacgatgaagacagccaaagtggctgcatctgattggacatttctgcactgcctacccaggaaaccggaggaggtcgacgacgaggtgttttacagtccccgcagcctggtcttcccggaggccgagaatcgcaagtggaccattatggccgtgatggtctccctactgaccgattacagtcctcagctgcagaaaccaaaattc

SEQ ID NO: 17846 - DNA, 1062 bp, Artificial Sequence
  Description of Artificial Sequence: Synthetic coding sequence
atgctcttcaatctgcgtatcctgctgaacaatgccgcctttcgaaacggccacaacttcatggtgagaaacttccggtgcggacagccgctccaaaacaaggtgcagcttaagggaagagatctgctgactcttaagaacttcaccggagaagagatcaagtatatgctgtggttgtctgctgacctgaagtttcgcatcaagcagaagggagaatacctgccgctgctgcagggcaagtccctgggcatgatcttcgagaaacgctccactcgcacccgcttgtcgaccgagactggattcgcgctgctgggaggacacccttgtttcctgaccactcaagacatccatctgggggtgaacgagtccctcacggataccgcgcgggtcctgtcctcgatggcagacgcagttttggcccgagtctataagcaatcggaccttgatacccttgcaaaggaagctagcatccccatcatcaacggattgagcgacctctaccacccgatccaaatcctggcagattacttgactctgcaagagcactactcatcactgaaggggctgactctctcctggatcggcgacggcaataacatcctgcattcaattatgatgtcggccgcgaagtttggaatgcatctgcaagccgcgactccgaaaggatacgaaccagatgcatccgttaccaaacttgcggaacagtacgccaaggaaaacggaactaagctgttgctgaccaacgatccactggaggcagcccacgggggaaatgtgttgattactgacacctggatttcaatgggtcaagaagaggaaaagaagaaacggctccaggcgtttcaggggtaccaggtgacgatgaaaaccgctaaagtcgcagcctctgactggacttttttgcattgccttccccggaagccggaagaagtggacgacgaagtgttctacagccctcggtcccttgtgttcccggaggctgaaaatcgcaaatggaccattatggccgtgatggtgagcctgctcacggactattcaccgcagctgcagaagcctaagttt

SEQ ID NO: 17847 - DNA, 1062 bp, Artificial Sequence
  Description of Artificial Sequence: Synthetic coding sequence
atgctgtttaacctccggatcttgctgaataatgccgcgtttcggaacggacacaatttcatggttcggaactttaggtgtggtcaaccactgcaaaacaaggtgcagctcaaaggaagagacttgctgaccctgaaaaactttaccggagaagagattaagtacatgctgtggctcagcgcagatctgaagtttagaatcaagcaaaagggtgagtacctgcctcttctgcaggggaaatctctcggaatgattttcgaaaaacggtcgacccgaacccgcttgtcgactgaaactggatttgcactcctggggggacatccttgcttcctgactacccaagacattcatcttggagtcaacgagtcgctgaccgatactgcccgtgtgctctcatcaatggctgatgcagtgcttgcgcgagtgtacaaacaaagcgacctggatacgttggccaaggaggcatcaatccccattatcaacggactcagcgacctctaccatccaatacaaattctggccgattacctcaccctgcaagagcactactcgtcgctcaaggggcttactctctcgtggataggcgatgggaacaacatccttcattccataatgatgtcggcggctaagtttggtatgcacctccaagcagccactcctaagggatacgagcctgatgcgtccgtcaccaaacttgcagaacagtacgcgaaggaaaacggcaccaagctgcttcttaccaacgacccactggaagcagcacatgggggaaatgttctgataacggatacctggatctcgatgggacaggaagaggaaaagaagaagcggctccaggcatttcaaggttaccaagtgactatgaaaacggcaaaggtcgcagcatccgattggacttttctgcattgtctccctcggaaaccagaagaagtcgatgacgaagtgttctactccccacgttcgcttgtgtttcctgaggcagagaaccgtaaatggactattatggcagtcatggtgtcgctgctgactgattactcgccacaacttcagaagccaaagttt

SEQ ID NO: 17848 - DNA, 1062 bp, Artificial Sequence
  Description of Artificial Sequence: Synthetic coding sequence
atgctcttcaacctgagaatccttctgaataacgcagcgtttcggaacggacacaacttcatggtccgcaatttcaggtgcggacaaccactccagaacaaggtccaactgaagggaagagatcttctgacgctcaagaactttaccggtgaagaaataaagtacatgctgtggctgtccgccgacctgaagttccggatcaagcaaaagggtgaatacctccccttgctccaaggcaaatcactcgggatgatcttcgagaagcgctcgactcgaacgaggctctcgaccgagactggatttgccttgctcggagggcatccgtgcttcctcacgacccaggatattcacctcggggtgaacgaatcactcactgacaccgcgagagtgctctctagcatggccgacgccgtcctcgccagagtgtacaaacagtcggacctcgacaccctggcaaaagaggcctccatcccgatcatcaacggtctgtccgatctgtaccacccaatccagattctggccgactacctgactctgcaagaacattactcctccttgaagggcctgaccctgagctggatcggagacggcaataacattctgcactcaattatgatgtcagcagcgaagttcggaatgcatttgcaagcggccactcctaaggggtacgagccggatgcaagcgttactaaactggccgagcaatacgcaaaggaaaacggaacgaagctgcttttgactaacgaccctctggaagccgcgcacggaggaaacgtgctcattaccgatacctggatctcaatgggacaggaggaagaaaagaagaagcggttgcaagcgtttcagggataccaggtgactatgaaaaccgcgaaggtggcggcatcagactggaccttcctgcattgcctccctcgtaaaccagaagaagtggacgacgaggtgttctattcgccgcgctccctcgtgtttccagaagcggaaaataggaagtggaccatcatggcagtgatggtgtcgctcctgactgactactccccccaactgcagaagcctaaattt

SEQ ID NO: 17849 - DNA, 1062 bp, Artificial Sequence
  Description of Artificial Sequence: Synthetic coding sequence
atgctgttcaaccttaggattcttttgaataacgccgcctttcggaacggtcataactttatggtgcggaactttagatgtggccaaccacttcaaaacaaggtccagctgaaaggcagggatcttctcactcttaagaacttcactggagaagagattaagtacatgctgtggctttccgcagaccttaagtttcgtatcaagcaaaagggggaatacctgccactgctgcaaggaaagagccttggtatgattttcgaaaagcggtcgacgcgcaccagactcagcaccgaaactggttttgcgctgcttggtggtcatccgtgttttctcaccacccaagacatccatctgggagtgaacgaatccttgactgatactgcccgggtcctttcctcgatggcagatgcagtgctggcaagggtctacaagcagtcagaccttgatactctcgcaaaggaggcatccatcccgatcattaacggtctttctgatctctaccatccaatacagattcttgcagattaccttactctgcaagaacactacagctcgcttaagggacttacgctctcctggattggtgacggaaataacattctgcattcgattatgatgtcggcggcaaaattcggtatgcatctgcaagcagcaacgccaaaaggttacgaacccgacgcatcggtcaccaagctcgcagaacagtacgctaaggagaacggaacgaagttgctgctgaccaatgatccactcgaggcagctcacggcggcaatgtgttgattaccgatacttggatatcgatgggccaagaggaagaaaagaaaaagcgcctgcaagcattccagggataccaggtgaccatgaaaaccgccaaagtggctgcaagcgattggacctttctccattgcctcccacgaaaacccgaagaagtggacgatgaagtgttctacagccccagatcgcttgtctttccagaagcagagaatcgaaagtggactataatggcagtgatggtgtcgctgctgactgactactccccccaacttcaaaaacctaagttc

SEQ ID NO: 17850 - DNA, 1062 bp, Artificial Sequence; identical to SEQ ID NO: 17804
  Description of Artificial Sequence: Synthetic coding sequence

SEQ ID NO: 17851 - DNA, 1062 bp, Artificial Sequence
  Description of Artificial Sequence: Synthetic coding sequence
atgctgtttaatctgcgcatattgctcaacaacgccgcctttcggaacgggcacaactttatggtcagaaacttccgctgcggccaacctttacagaataaagtgcagctgaagggcagagacctgctgacgctcaagaattttaccggggaggagatcaaatatatgctgtggctctcagcggatctaaaatttagaattaagcagaaaggggagtatttgcccttgctccaaggtaaaagccttggaatgatcttcgaaaagaggtcaacacggactcgcctctccactgaaacagggttcgctttattaggcggccacccctgtttccttaccacccaggacatccacttaggcgtaaacgagtccttaactgatacagcccgggtcctatccagcatggctgacgccgttcttgcacgagtatacaagcaatccgatttggatacactggccaaggaagcctccatcccaattatcaatggactgtcggacttgtaccaccccattcagatcctggccgactacctgacactgcaggaacattactcctctctcaaaggccttacactctcatggattggagacggtaacaacattcttcactccattatgatgtctgccgccaagttcgggatgcacctgcaggccgctactcctaaggggtacgaaccagacgctagcgtgacgaagttggctgagcaatatgcaaaggagaatggaacaaagctcctgctcacaaacgacccactggaggccgcgcatggcggtaatgtccttattactgacacttggatttccatgggccaggaggaggagaagaagaaacggctgcaggcattccaggggtatcaggtgaccatgaagactgcaaaggtggctgcctccgattggacctttctacattgcctcccaagaaaacctgaagaggtcgatgatgaagtgttttattctcccagaagcttggtgttccctgaggccgagaaccggaagtggactatcatggccgtgatggtgagcctcctaaccgattactcaccacagctccagaaacccaagttt

SEQ ID NO: 17852 - DNA, 1062 bp, Artificial Sequence
  Description of Artificial Sequence: Synthetic coding sequence
atgctctttaatctgaggatcctgctcaataatgctgccttccggaacggccacaatttcatggtgagaaatttccgatgcggccagcccctccagaacaaggtccaattgaagggacgggacctcttgactctcaagaacttcaccggagaagagatcaaatacatgctgtggttgtccgcagacctcaagttccgtatcaagcaaaagggagaatacctcccgcttctccagggcaagtccctcggaatgattttcgaaaagagaagcactcgcacgcgcctgtcgactgaaactggatttgcactgctcgggggacatccgtgtttcctgactactcaggacattcatctcggcgtcaacgaatcactcaccgacaccgcccgcgtcctgtccagcatggccgatgcggtcctggccagagtttacaagcagtcggacctcgacactctggcaaaagaggcatcgatcccgattatcaatggactctccgatctctaccatcctattcagatcctggcagactacctgaccctgcaggagcattactcatctctgaagggtcttaccctgtcgtggatcggcgatggcaacaatatcctgcatagcattatgatgtcagcagcaaagtttgggatgcacctccaggccgcaaccccgaagggctacgagccggacgctagcgtgactaaacttgcggaacagtacgcgaaagagaacggaacgaaactgctccttacgaatgatcccttggaagctgcgcacggaggtaatgttctgatcaccgatacttggatctccatgggacaggaagaagagaaaaagaagcggctccaggcctttcaagggtaccaggtgaccatgaaaaccgccaaggtggccgcgtcagattggacttttctccattgcctcccccgcaagcccgaagaggtggacgacgaggtgttctactcaccaagatcactggttttcccggaggcagagaatcggaagtggaccatcatggccgtcatggtgtccttgctgaccgattactccccgcagctgcaaaagccgaagttc

SEQ ID NO: 17853 - DNA, 1062 bp, Artificial Sequence
  Description of Artificial Sequence: Synthetic coding sequence
atgttatttaatctccggattttacttaacaacgccgccttccgaaatggccataatttcatggtccgtaattttcgatgtggccagcctttgcagaataaggttcaactgaaaggccgggacttactgaccctgaaaaactttactggtgaggaaattaagtatatgctatggttatctgccgacctgaagtttagaataaagcagaagggtgagtacttaccgctgctgcaaggtaagtcgttaggcatgatcttcgagaagcgctccactcggactcgcctgagtactgagacaggcttcgccctcctgggtggccacccttgtttcctgaccacccaggacatccacctgggagtgaatgagtctttgaccgacaccgcaagggtcctttcaagcatggctgacgcagtgctggcccgggtctacaagcagagcgacctggataccctggccaaagaggcgagcattcctataataaatggactctcggacctttatcaccctatccaaatactcgcggactacctgacactacaagagcactactcctccttaaaggggttgacattgagttggataggagacgggaataatatcttgcactccattatgatgtctgctgctaagttcggcatgcatcttcaggctgctacacccaaggggtacgaacccgatgcatcagtgacgaaattggcagagcagtacgccaaggaaaatggaaccaagttgctgttgactaacgaccctctggaggccgcacacggtggcaatgttctgatcacagacacatggatctcgatgggccaggaggaggagaagaagaaacgactgcaggccttccagggctaccaagtaactatgaagacagccaaggttgcagccagcgattggacattcttgcactgtctgccacgcaagccagaagaggtcgacgacgaggtattctactctccgcggagtctggtctttcctgaggcggagaatcgtaaatggaccattatggccgtgatggttagtctgttgactgattattctccacaactgcaaaaacccaagttc

SEQ ID NO: 17854 - DNA, 1062 bp, Artificial Sequence
  Description of Artificial Sequence: Synthetic coding sequence
atgttgtttaaccttcgcatcctgttaaataacgccgcttttaggaacggccataattttatggtacgtaactttagatgtggccagcctcttcagaacaaggttcaactgaagggcagagacctgttaacactgaagaacttcaccggagaagagatcaagtatatgctgtggctatcggccgacctgaaattccgtatcaaacagaaaggggaatatttgcctctgctgcagggtaagagcttaggaatgattttcgaaaagagaagcacaagaacaagactctcgactgaaaccggttttgcattactgggggggcatccctgctttctcactactcaagatatccacttgggcgtgaacgagtcacttaccgacaccgcaagagtgctgtccagtatggccgatgctgtgctcgcccgggtctacaagcagagcgatctggataccctcgctaaggaagcttccataccgatcataaacgggttgtctgatttgtaccatcccattcagatccttgcagattacctgactctacaggaacactactctagcctcaagggtctgaccctctcgtggatcggcgacgggaataatatattacactcaatcatgatgtccgctgctaaatttggcatgcatttgcaggccgccactcccaaggggtatgaacccgatgcaagtgtgaccaagctggcggaacagtacgccaaagagaacggaaccaaactgctgctcacgaacgaccccttggaggccgcccatggcgggaatgtcctgatcactgatacatggatctctatgggtcaggaggaggaaaaaaagaaacggctccaggcctttcaggggtaccaggtgaccatgaagacggccaaagtagccgctagtgactggacttttctgcactgcctgccccgtaagcccgaagaggttgacgacgaagttttttactctcctcgttcactcgtgttccccgaggccgaaaacaggaagtggaccatcatggctgtcatggtatctctactgacggactactccccccagttacagaagcctaaattt

SEQ ID NO: 17855 - DNA, 1062 bp, Artificial Sequence
  Description of Artificial Sequence: Synthetic coding sequence
atgctttttaatctgcgtatcctccttaataatgctgctttccgaaacggtcacaactttatggttagaaattttcgatgcggacaacctttgcaaaataaagttcaattgaaaggtcgtgaccttctgaccctaaaaaacttcactggtgaggagatcaagtatatgctgtggcttagtgctgaccttaaattcaggatcaagcaaaaaggggaataccttccattactgcaaggtaaaagcttaggtatgatttttgaaaagcggagtacccgaacgcgtctttcgacggagaccggatttgctcttctcggtggtcatccttgcttcctgactacccaggacatacatcttggagtgaacgaatccttgacggacactgcaagggtattgtcgagcatggctgacgcagtacttgctagagtttacaagcagtctgacttggacacacttgctaaggaagcatccattcctattatcaacggattgtctgatttgtatcatccaatccaaatcctggccgattaccttacattgcaagagcactattcttccctcaaggggttaactttgtcctggattggtgatggtaacaacatactccattcgataatgatgagtgccgccaagtttggcatgcatcttcaagctgcaacacctaaaggttacgagccagatgcttcagtgaccaagctggcagagcaatacgccaaggagaatggaactaaactcttgctaactaacgatccattagaggcagcgcatggcggtaatgtgctgatcacggatacgtggatttccatgggccaagaagaagaaaaaaagaagaggcttcaagcattccaagggtatcaggttactatgaaaacagctaaagttgcggcatcggattggacttttctccactgcttgccgaggaagccggaggaggtggatgacgaggtcttttactctcctcgatctttggttttcccagaggctgaaaacaggaagtggactatcatggcagtcatggtctctcttttgaccgattactcacctcagcttcagaagcccaaattc

SEQ ID NO: 17856 - DNA, 1062 bp, Artificial Sequence
  Description of Artificial Sequence: Synthetic coding sequence
atgctattcaacctgagaattttgctcaataacgcagcttttcgtaacgggcacaattttatggtccgcaacttccgatgcggacagcccttacaaaacaaggtgcagctgaagggccgtgatctgctcacattgaaaaacttcaccggcgaagagatcaaatacatgctgtggctgtctgctgacttaaaatttcggatcaagcaaaaaggcgagtaccttcccttgctgcagggcaaaagcctgggaatgatatttgagaagcggtcaacccgcacccggttgtcgacggagacagggtttgcactattaggcgggcacccctgtttcctcactacccaggacatccacctgggagtgaatgagtcactcaccgatactgctagagtgctgtcatccatggcagacgctgtgctcgcaagggtatataagcagagtgatctggacacattggcgaaggaagcgtcgatcccgatcatcaacgggctcagtgatctgtaccacccaatccagattctggcagattacttgaccctgcaggaacattattcatccttgaaaggtctgactctttcctggattggtgatgggaataacatcctgcacagcatcatgatgagtgcagccaagttcgggatgcatcttcaggccgccacgccgaagggatatgagcccgacgccagtgtgaccaagttagctgagcagtatgccaaggaaaatggtaccaaactcctgctgaccaacgaccctttggaggcggcacacggcgggaacgtcctgatcaccgatacatggatcagtatggggcaggaggaagagaagaaaaagcggctgcaggcattccaaggttaccaggtgaccatgaaaaccgctaaagtggcagctagcgactggacctttctacactgtttgcctaggaagcccgaggaggttgacgatgaggtgttctattcaccgagatctctggtgtttcctgaggcggagaatcgcaagtggacaatcatggccgtgatggtgagtctgctaacggattattcccctcagttacagaagccgaaattt

SEQ ID NO: 17857 - DNA, 1062 bp, Artificial Sequence
  Description of Artificial Sequence: Synthetic coding sequence
atgctgttcaacctgcgcatcctgcttaacaacgcagcttttcggaatggccataactttatggtcaggaactttagatgtggacaaccactgcagaacaaggtgcaactcaaaggacgcgatctcctcactctcaaaaactttaccggcgaagaaatcaagtacatgctgtggctgagtgccgatcttaagttccgcatcaagcagaagggagaatacctgccgctgctccagggaaagagcctgggaatgatttttgaaaaacggtccacccggaccagactgtcgacggaaaccgggttcgcactgcttggcggacatccttgctttctcaccactcaggatatccacctgggtgtgaacgaatccctgacggatacggcacgagtcctgtccagcatggccgatgccgtgttggcgcgcgtgtacaaacagtcagacctggacactctcgccaaggaggcttcgataccgatcatcaacggcctctccgacttgtaccaccccatccagattcttgccgactacctgactctgcaagaacactactcgtcgttgaaagggcttaccctgtcgtggatcggagatgggaacaatatcctccactccatcatgatgtctgctgctaagttcggcatgcatctccaagccgctacgccgaagggctacgagcctgacgcatcagtcaccaagctggccgagcagtacgcaaaagagaacggaactaagctcctcctcaccaacgaccccctcgaagcggcccacggcggaaacgtgttgatcacggacacttggatctcgatgggacaggaggaggagaaaaagaaacgcctgcaagcctttcaaggataccaagtgaccatgaaaacggccaaggtggctgcttccgactggaccttccttcactgcctgccccggaaacccgaagaggtggacgacgaggtgttctactcaccgcgcagcctcgtgttcccagaagcagaaaacaggaagtggacgattatggcggtcatggtgtcactcctgaccgactactccccacagctgcagaagccgaagttt

SEQ ID NO: 17858 - DNA, 1062 bp, Artificial Sequence
  Description of Artificial Sequence: Synthetic coding sequence
atgctctttaatctgaggattctgctgaacaacgcagcctttaggaacgggcataattttatggtgagaaactttagatgcggccagcctctccagaataaggtgcagcttaaggggagagatctgctgactctgaagaactttactggggaagaaatcaagtatatgctgtggctctctgcagatctcaagtttcgcataaaacagaaaggggagtaccttcccctgctgcaggggaagtccctcgggatgatttttgaaaaacgcagcacccgcacaaggttgagcaccgagacgggcttcgccctcttgggaggccacccctgcttcctgactacacaggacatccacctcggcgtcaatgagtccctcaccgacaccgccagggtgcttagcagtatggctgatgcagtgctggctcgggtctacaagcagagcgacctggacaccctcgccaaggaagcttctataccaatcattaacggtctgagcgacctgtatcaccctatccagattcttgcggattacctgacactgcaggagcattacagctctctcaaagggttgacacttagctggataggagatgggaataacattctgcactccatcatgatgagtgccgccaaattcggcatgcacctgcaggcggcgacccccaaaggctatgagcctgatgcctctgttaccaagttggcagaacagtacgccaaggagaatggaactaagttgctgctgacaaacgatcccctggaggccgcccacggtggaaacgttcttatcaccgacacatggatctctatgggacaggaagaggagaagaaaaagcggctccaggctttccagggctaccaggttaccatgaagacagccaaagtagctgcctctgattggacctttctgcattgcctgccccgcaagcccgaagaggttgacgatgaagtgttctatagcccccgctcactggtttttccagaagccgagaataggaaatggacaattatggccgtgatggtatctttgctgacagactactcaccccagctgcagaaaccgaagttc

SEQ ID NO: 17859 - DNA, 1062 bp, Artificial Sequence
  Description of Artificial Sequence: Synthetic coding sequence
atgttattcaatcttagaatccttcttaataatgccgctttccgaaatgggcacaatttcatggtgaggaattttcgttgcggacagcctctgcaaaataaagttcagctgaaaggaagggaccttttaacactgaagaacttcacaggagaggagatcaaatatatgctgtggctctctgcagacttgaagttcagaataaaacagaaaggggagtatctgcccctgcttcagggaaaatcacttggaatgatctttgagaaaaggagcactcggacccgcttgagcacagaaactggattcgccctgctgggggggcacccttgtttcttgacaacgcaggacatccaccttggtgtcaatgaatccctcaccgatactgcgagagttctgagtagtatggcagatgcagtcctggcaagggtgtacaaacagagcgatcttgacacactagcaaaagaggcgtccattcctatcatcaacggcctgtccgacctgtaccaccccatccagatcctggctgactatctaactctgcaggaacattacagttcactaaaaggtctcactctatcttggattggagatggaaacaatatcctccattctattatgatgtccgccgctaagtttggcatgcacttgcaggccgctacccctaagggatatgaaccggacgcaagtgtgacgaagttggctgagcagtacgccaaagagaatggtacgaagttgctcctgactaatgatcccctcgaggctgctcacggaggaaatgtgctaattacagatacctggattagcatgggccaggaggaagagaagaagaagcgcctccaggcttttcagggttaccaggtgaccatgaagaccgcaaaagtggccgcatctgattggacatttttacattgtcttcctcggaagcccgaagaggtcgatgatgaagtgttttactctccccgctcactggtatttccagaagctgagaataggaaatggacaatcatggcagttatggtctctctgctgacggattacagcccccagttgcagaagcccaaattc

SEQ ID NO: 17860 - DNA, 1062 bp, Artificial Sequence
  Description of Artificial Sequence: Synthetic coding sequence
atgttgtttaaccttaggatcctgctgaacaatgcagcatttcggaacgggcataactttatggtacggaactttaggtgcggtcagccgcttcagaacaaggttcagcttaagggtcgtgatcttttgaccctgaagaactttacgggggaggaaatcaaatacatgctgtggctttccgcagacctcaaattcagaataaagcagaaaggcgaatacttgccactcctgcaagggaagagccttggtatgattttcgagaagcgatcaaccaggacgcgcctttcgaccgaaaccgggtttgccctgctcggaggacatccgtgtttcttgaccacccaggatatacatctgggcgtcaacgaatcacttactgacactgcacgcgtcctctcgtcgatggcggacgctgtgctcgcccgtgtgtacaagcaatcggatcttgataccttggcaaaagaagcatcaatccccatcattaatggactttcggacctgtaccacccaattcaaatactcgcggactacttgacgcttcaggaacattacagctcgcttaagggcctgactctctcctggattggagacggcaacaatatccttcactcgattatgatgtccgcggccaagtttggtatgcaccttcaagctgcaacccctaagggctacgagccggatgcatcggtaactaaactggcagaacaatatgcaaaggaaaatggtaccaagctgctcctgaccaatgatcctcttgaagcagcacacgggggtaacgtgctgattactgatacttggatctccatgggccaggaggaagaaaagaagaaacgcctccaagcattccaggggtaccaagtcactatgaaaactgcaaaggtcgcagcaagtgattggacctttcttcattgccttccccgaaagcctgaggaagtggatgatgaggtcttttactccccacgatcgcttgtgttccctgaagctgagaatcgtaagtggaccatcatggcggtcatggtgtcactcctgactgattattcccctcagctccaaaagcccaaattt

SEQ ID NO: 17861 - DNA, 1062 bp, Artificial Sequence
  Description of Artificial Sequence: Synthetic coding sequence
atgctttttaatttgcgtattctcctgaacaacgccgcctttaggaacggacacaatttcatggtccgtaacttcaggtgtggccagccccttcaaaataaggtgcagttgaagggtagggacctgctgactcttaaaaattttactggcgaggagatcaaatacatgctgtggctgagtgccgacttgaagttccgcatcaagcagaaaggcgagtacctccctctcttgcaaggcaagtcactgggtatgatcttcgaaaagagatcaacacgtactagattgagcactgaaaccggctttgccctgctgggtggtcatccctgcttccttaccacacaagacatccatctcggcgtcaacgagagtctcacagacacagcccgtgtattgagcagtatggctgatgccgtgctggctagagtgtataagcaaagcgacctggataccctcgccaaggaagcctcaatcccaataataaatggactttctgatctttaccaccctattcaaattctggccgattacctgactctccaggagcactattccagcctgaagggtctgaccctctcatggatcggagatggaaacaatatcctgcactctataatgatgtccgctgctaaattcggtatgcacctccaggccgccacacccaagggatatgagcctgacgcaagcgtcacaaagcttgccgagcagtacgcaaaggagaacggcacaaagctgcttctgactaatgacccactggaggccgctcatggaggcaatgtgctgatcactgatacctggatctccatgggacaagaagaggagaagaagaaaagactccaggctttccagggctatcaagttacaatgaagaccgcaaaggtggcagctagcgactggacattcctgcattgtcttcccaggaaaccagaagaggtggacgatgaggttttttattctccccgctcacttgtgttccctgaagccgagaacaggaagtggactataatggctgtcatggtttctctcctgacagactactccccacaactccagaagcccaagttc

SEQ ID NO: 17862 - DNA, 1062 bp, Artificial Sequence
  Description of Artificial Sequence: Synthetic coding sequence
atgctgtttaatctgcgcattctcttgaacaacgcggcattccgcaacggacacaacttcatggtgcgcaactttagatgtggacaacctctgcagaataaagtgcagctcaaggggcgagatcttctgaccctgaagaatttcactggtgaggagattaagtacatgctgtggttgagcgccgaccttaagtttcggattaagcaaaagggagaatacctccctctgctccaaggcaagtcgcttggcatgattttcgagaagcggagcaccaggactcgcctgagcaccgaaaccggttttgcactgcttggaggtcatccttgctttctgactactcaggacatccacctgggcgtcaatgaaagccttaccgataccgcacgagttttgagctcaatggcagatgccgtgctcgcccgggtctataaacaatcggatctcgatactctggcgaaggaagccagcattccgatcattaatggcctttccgacttgtaccatcctatccagattcttgccgactacctgacgctgcaggagcattactcttctcttaagggactcactctctcatggatcggggatggtaacaacatcctgcattcaatcatgatgtcggctgccaagtttggtatgcatctccaggcggccacccctaagggatacgagcctgacgcgagtgtcacgaagttggcggagcaatacgcaaaggaaaacggaaccaagctgttgctcactaacgatccccttgaagctgcacacggcgggaacgtgctcattactgatacctggatttcgatgggacaggaagaagaaaagaaaaaacggctgcaagcgttccaaggctaccaagtgaccatgaaaaccgctaaggtggcagcatcggattggacttttttgcattgccttcctcgcaagccagaagaagttgatgacgaagtgttttactcgcccagatcactcgtgtttcccgaggctgaaaatcgtaaatggaccatcatggccgttatggtcagcctgttgactgattactccccacagcttcaaaaacccaagttc

SEQ ID NO: 17863 - DNA, 1062 bp, Artificial Sequence
  Description of Artificial Sequence: Synthetic coding sequence
atgctgttcaatctccgcattctgctgaacaacgcagcttttcgcaatggccacaactttatggtgcgaaatttcagatgcgggcagccactacagaacaaagtacagcttaagggacgggacctcctgacattaaaaaattttactggggaagaaatcaagtacatgttgtggctcagcgctgacctgaagtttaggatcaaacagaagggggagtatctaccgctcctccagggtaaaagcctggggatgattttcgagaaaaggagtacacgaacaagactctccacagaaaccggatttgccttactcggcggccatccttgctttttgacaacccaggatattcatctgggagtgaacgagagtcttactgacaccgcccgtgtcttaagttctatggctgacgcagtactggcacgcgtgtataaacagtctgaccttgacactctggcaaaggaagcatcaattcctattattaacgggctctcggatctctatcatcctattcagatcctggcagattatctgacattgcaggaacactattccagcttgaaagggctgacccttagttggataggcgatgggaacaacatactgcactcaatcatgatgtctgcagccaagttcggcatgcacctccaggctgctaccccaaagggatatgagcccgacgcatctgtcaccaagctggcggagcagtacgcaaaggaaaatgggaccaagctgcttcttactaacgatcctctggaagcagcacatggtgggaatgttctcattacagacacatggatctccatggggcaggaggaggagaagaagaagagactgcaagcgtttcagggctaccaggtgacaatgaagacagcaaaagtggctgcctcggattggactttccttcactgtctgcctcggaaacccgaggaggtagacgacgaggtattctatagtcctcggagtcttgtattccctgaagcagagaatagaaaatggactataatggctgttatggtttccttgttgacagattattcgccacagctgcagaagcctaaattc

SEQ ID NO: 17864 - DNA, 1062 bp, Artificial Sequence
  Description of Artificial Sequence: Synthetic coding sequence
atgttgttcaacttgcgtatcctgctgaataacgccgccttccgcaatggacacaactttatggttagaaacttccggtgcggacagccactgcagaataaggtgcaactcaagggtcgcgacctcctcaccctcaagaacttcactggcgaggagattaagtacatgctctggctgtcggcggatctgaagttcaggatcaaacagaagggagagtatctcccactgctgcaagggaaatcgctgggaatgatttttgaaaaacggagcaccagaactaggctgtcgaccgaaactggattcgcactcctgggaggtcacccgtgctttctcactacgcaggatatacatcttggcgtcaatgagtccctgactgacactgccagagtgctctcctctatggccgacgcagtcctggcacgcgtgtacaaacagtcagacttggatactcttgccaaggaagcctcaatcccgatcatcaacggactttcggatctgtaccaccctatccaaatcttggctgactaccttactctgcaggaacactactcctctctgaagggactgactctctcctggatcggagatggcaacaacatcctgcattcgatcatgatgtctgccgctaagttcggaatgcacttgcaggcagcgacccccaaaggatacgagccggacgcatccgtcaccaagctcgccgagcagtacgccaaggaaaacggaactaaacttctcctcactaacgacccattggaagcagcacatggaggaaacgtcctcatcaccgacacctggatttcgatggggcaagaggaggaaaagaagaagagactgcaggccttccagggataccaggtcactatgaaaacggctaaagttgccgcctcggattggactttcctgcactgtctgcctcggaagcccgaggaagtggatgatgaggtgttctactcaccgcggtcgctggtgtttccggaggcggaaaatcggaagtggaccatcatggcagtgatggtatcgctgttgacggactactcaccgcagctccagaagccgaaattt

SEQ ID NO: 17865 - DNA, 1062 bp, Artificial Sequence
  Description of Artificial Sequence: Synthetic coding sequence
atgctgtttaaccttagaattcttctgaataacgcagcatttcggaacggacataactttatggtgcgtaatttcagatgtggacaaccactgcaaaacaaagtccagcttaagggtcgggacctccttaccctcaagaatttcacgggggaagagattaagtacatgttgtggctctcagcagaccttaagttccgaataaagcagaagggagagtacctccctctgctccagggaaaatcacttggtatgatctttgaaaagcgcagcactcggactcggctttcgactgaaacgggttttgcccttcttgggggacacccttgttttctgaccactcaagacattcatctcggagtgaatgagtcactcactgataccgcaagagtgctttcgtctatggcagacgcggtgctggctagagtctataagcaatccgatttggatacgttggccaaggaagcatccattcctatcatcaacggacttagcgacctgtaccaccccattcagatcttggcagattacctgactctgcaagagcactactcgtccctcaaagggctcacccttagctggataggagatggtaacaacattctgcattcaatcatgatgagcgcagccaagtttggcatgcatcttcaagcagcaaccccaaaggggtacgaaccagacgcatcagtgaccaaactcgcggagcaatacgcgaaagaaaatgggactaaacttcttctcaccaacgacccactggaagcagcccatggagggaatgtgctgattactgatacctggatctccatgggacaggaagaagaaaagaagaagagacttcaagccttccagggttaccaggttactatgaaaacggccaaggtcgcagcaagcgactggacctttctgcattgccttccaaggaagcctgaggaagttgatgatgaagtcttttactcaccgcgctcacttgtgtttccagaagccgaaaataggaagtggactatcatggcagtgatggtgtcacttctgaccgactactcgccacagcttcaaaagccaaagttt

SEQ ID NO: 17866 - DNA, 1062 bp, Artificial Sequence
  Description of Artificial Sequence: Synthetic coding sequence
atgttgtttaacctgaggatacttctcaataatgctgctttcaggaacggtcataacttcatggttcggaactttcgctgtgggcagcctttgcagaacaaggtgcagctgaaaggtagggacctgttgacgcttaagaacttcacaggagaagagataaagtatatgctgtggctgagcgccgacctcaagttccgaatcaagcagaaaggagaatacctgcctctcttgcaaggcaaaagcctgggaatgatcttcgagaaaagaagtactagaacaagactgagcacagaaactggtttcgcactgttgggcgggcacccctgcttcctgaccacacaggacatacatcttggtgtaaacgaaagtcttactgacactgctcgcgtgctttcctcaatggcagacgccgtgcttgcccgcgtctacaagcagtctgacttggatacgctcgctaaagaggcctcaattccgatcatcaacgggctgagtgatctgtatcaccccatacagatcctggccgactatctgactcttcaggaacactatagtagtttgaaggggctgacactgtcatggatcggagatggaaacaacatcctgcacagtatcatgatgtcagctgcgaaatttggcatgcatctgcaggctgcaactcctaaaggctatgagccagacgcaagcgtaactaagttggccgagcagtacgctaaagaaaatggtactaagctgctcttgacaaatgatccactcgaagccgcccacggaggtaacgtgctgattacagatacatggatcagtatggggcaagaggaggaaaagaagaagcggctgcaggcattccagggatatcaggtaacaatgaagacagcaaaggtggccgcgtctgattggacctttctccattgcctgccacggaagccggaggaagttgacgatgaggtcttttatagccccagaagtcttgtgttccccgaggcagagaacaggaaatggaccatcatggctgtcatggttagcttgctcacagactacagccctcagttgcagaagccaaagttt

SEQ ID NO: 17867 - DNA, 1062 bp, Artificial Sequence
  Description of Artificial Sequence: Synthetic coding sequence
atgctgttcaacctgagaattctgttgaataatgccgccttcaggaatgggcataacttcatggtcagaaatttccggtgcgggcagccactacaaaataaggtgcagcttaaaggccgtgacctacttactctgaagaatttcaccggggaggaaattaaatatatgttgtggctgagtgccgaccttaaatttcggatcaaacagaagggtgagtatttgcctcttcttcaaggaaagagtctcggtatgatttttgagaagcgcagcacgcgtacacgattatcaactgagacaggtttcgccttgctgggaggccatccttgcttcctcacgacgcaggatattcacctgggcgtgaacgagtctctgaccgataccgctcgggtcctcagttctatggctgatgccgtactggcacgggtctataagcaaagcgatcttgacacattagccaaggaagcctcaattccaatcataaacgggctgtcagatttataccaccctatacagatccttgcggattatctaacgcttcaagagcattattcctccctgaagggcctcacacttagctggataggagatggtaacaacattctgcattcgattatgatgtctgctgctaagttcggtatgcatttacaggcagccactccaaaaggctacgagcctgacgcatctgtcacaaaactggcagagcagtatgccaaagagaatggcactaagctcctgctgacaaatgaccctctggaagccgcccacggaggtaacgtcctgattacggatacatggatcagcatgggacaggaggaggagaaaaaaaagaggctgcaggccttccagggataccaggtgactatgaaaacggctaaagtggctgcatctgactggaccttccttcactgtcttccgagaaagcctgaggaggttgacgacgaggtcttttactctccgaggtctctggtgtttccggaggccgagaatcggaagtggacgatcatggcggttatggtttcactgttaacagattatagcccccagctgcagaagccgaagttt

SEQ ID NO: 17868 - DNA, 1062 bp, Artificial Sequence
  Description of Artificial Sequence: Synthetic coding sequence
atgctctttaacctgagaattctactgaataacgccgcattccgaaacgggcataattttatggtgcgaaattttcgttgcggccagccactgcagaacaaggtacagctaaagggaagagatctgctgacgcttaagaatttcactggagaagaaatcaagtacatgctgtggctgagtgccgacttaaagtttaggatcaagcagaaaggcgagtatttgcctttgttgcagggaaaatcactcgggatgatcttcgagaaacgaagcacccgcacacgactttctacagagacagggtttgcgttgcttggcgggcacccttgctttctgactacacaggatatccatttgggagtcaacgagagcctgaccgacactgccagagtgctgtcctctatggcggatgccgtgctcgctagggtgtacaaacaatccgacctagataccctggccaaagaagcttccattccaattattaatggtctgagcgatctctaccatccaattcagatacttgccgactacttgaccttacaggagcattattcgtccctaaagggtctgacgctgtcttggataggggatggaaataatattcttcattccatcatgatgagcgctgctaaattcgggatgcacctgcaagccgccactccgaagggctatgagcctgacgcctctgtgactaagctggccgagcagtatgcaaaggagaacggaaccaagctactcttaaccaacgacccactcgaagccgcccacggaggaaatgtcctgataacagatacctggatctcgatgggacaggaagaggagaaaaagaaaaggctgcaggccttccaaggttatcaagtaacaatgaagacagcgaaggtggccgcttctgattggaccttccttcattgcctgccccggaagcccgaggaagtagacgacgaagtattctattctccacggtccctcgtttttcctgaggcggagaacagaaaatggacaatcatggcggtaatggtttcgcttctgacagactactcccctcagctgcaaaagccgaaattt

SEQ ID NO: 17869 - DNA, 1062 bp, Artificial Sequence
  Description of Artificial Sequence: Synthetic coding sequence
atgttgtttaatcttcggatcttgttgaataacgcagcgtttaggaatggtcacaactttatggtgcggaacttcaggtgcggccagccgcttcagaataaagtccagctgaagggaagagatcttctgaccctgaagaatttcactggagaagaaatcaaatacatgctttggctgtccgctgatcttaagttccgcattaaacagaagggggaataccttccgctccttcagggaaaatccctggggatgattttcgagaagagaagcactcgcaccagacttagcaccgaaaccggttttgcactgcttggcggacatccttgctttctcaccacccaagatatacatctcggtgtcaatgagtcgctgaccgacaccgcacgcgtcctcagcagcatggccgacgcagtgcttgcacgggtgtacaaacagagcgaccttgataccctggcaaaggaagcatcgatcccaattatcaacggactgtcggacctgtaccaccctattcagatccttgcagattatctgaccctgcaagagcattactcgtcattgaaaggacttactttgtcctggataggagatggtaacaacatccttcatagtattatgatgtcggcagcaaagttcggaatgcatcttcaggcagcaacccctaagggttacgaaccagacgcatcagtgaccaagttggcagaacagtacgcgaaggagaatgggactaagctcctccttaccaacgatccacttgaagcggcccacggagggaacgtgttgatcactgatacctggatctcgatgggacaagaagaggagaaaaagaagcgactccaagcatttcaaggttaccaagtcactatgaaaacggcgaaggttgcagcatcggactggacctttctgcactgtctgcctcgaaagcctgaggaagtcgatgacgaggtgttttactcgccgcggtcgctggtctttccagaagccgaaaatcgaaaatggactattatggccgtgatggtgagcctcctgactgattactcgcctcaactgcagaagcctaaattc

SEQ ID NO: 17870 - DNA, 1062 bp, Artificial Sequence
  Description of Artificial Sequence: Synthetic coding sequence
atgctatttaatctgcgcattctactgaacaatgccgcgttccgtaacggacacaatttcatggttaggaatttcagatgtggccagccgctgcagaataaggtgcaacttaagggcagagacctgctgacgctgaagaactttacaggggaggaaattaagtacatgctgtggttgtctgccgacctgaagtttcgcattaaacagaagggcgaatacctgcctctgttgcagggaaagagcctggggatgatcttcgagaaaaggtccacaaggaccagactgtccaccgagaccggatttgcgctgctagggggacacccgtgttttctgacaacccaggatatccatctgggcgtgaacgagtcattgacggataccgcccgtgtgctgtctagtatggccgacgcggtgctggcgagggtgtataaacagtccgatctggacactttagccaaggaagcatccataccaatcatcaatggccttagtgacttataccatccgatccagatactcgcagattacctgaccctacaagaacactattcttccctgaagggtctgactttgtcctggattggcgacggtaacaatatacttcactcaataatgatgtctgctgctaaattcgggatgcacctccaggctgcgaccccgaagggctacgaacctgatgccagtgtgacaaaactggccgagcagtatgccaaagagaacggtaccaaactgttactgacaaacgacccccttgaggctgctcatggcgggaatgtgctcataaccgatacatggattagcatgggacaggaggaggagaagaaaaaacgcctgcaggccttccaggggtaccaagtaacgatgaaaactgccaaggtggcggcaagtgattggacctttctgcactgtctgccccgaaagcccgaagaggtggatgatgaggtgttctattccccgcgcagtcttgtctttcctgaagctgaaaaccggaagtggaccataatggctgtgatggtcagtctgctcactgactactccccgcagctccagaagccaaaattc

SEQ ID NO: 17871 - DNA, 1062 bp, Artificial Sequence
  Description of Artificial Sequence: Synthetic coding sequence
atgctgttcaacctcagaatcctgctgaataatgcggccttcagaaatggccataattttatggtgagaaatttcaggtgtggacaaccactgcaaaacaaggtccaactcaaaggccgcgatttgctcacactgaaaaacttcactggtgaggagatcaaatatatgctgtggctgagcgcggatctgaaattcagaatcaagcagaagggagagtaccttcctctgttgcagggaaagagtttgggtatgatcttcgagaaaaggtctactaggaccaggctttcaaccgaaaccggcttcgccctgctcggaggacacccttgtttcctcaccacgcaggacattcatcttggcgtcaacgagtccctgactgacactgcgagagtgcttagcagcatggctgatgccgtccttgcccgcgtgtacaagcagtctgacctggacaccctggctaaggaagcttcaatacctattatcaatggactctctgatctgtaccacccgatacagatactggccgactacctgactctgcaagaacactattccagtctgaagggcttgaccctgagctggatcggtgacggtaataatatcttgcatagcatcatgatgtctgccgctaagtttggtatgcacctgcaggcggccacccccaagggctatgagcccgacgcttctgtgactaaactcgcggagcaatacgctaaggagaacggcacgaagcttctgcttactaacgatcctttggaagccgcgcacggcggcaacgtactgatcactgacacatggatctccatgggtcaagaggaagagaagaaaaagaggctccaggccttccaaggttaccaggtgacaatgaaaaccgcaaaggtagcggcctccgactggacctttctccactgcctcccccgcaagccggaagaagtggatgatgaagtgttctacagcccaagatctctggtcttccccgaagcagagaaccgcaaatggaccattatggccgtgatggtcagtctgctcaccgattattccccccagttgcagaagcccaagttc

SEQ ID NO: 17872 - DNA, 1356 bp, Artificial Sequence
  Description of Artificial Sequence: Synthetic coding sequence
atgtctaccgctgtgttggagaaccctggactcggcaggaaactgtccgactttggccaagagacaagttatattgaggacaactgcaaccagaacggtgcaatttcccttattttctcccttaaagaggaggtaggcgcactggccaaggtcctgcgcctcttcgaagagaacgatgttaacctgacacacatcgaaagtaggcccagtcgtctcaagaaggacgaatacgagttctttacccacctggataagagatccctacccgctctgaccaacatcataaagattctgaggcatgatattggagctacagtgcacgaattgagccgcgacaaaaagaaggacacagtcccatggttcccgagaactattcaggagcttgatagatttgccaatcaaattctgtcatacggcgcggagctagacgctgatcaccccggatttaaagaccccgtgtatagagcgcggaggaagcagtttgccgatatcgcctataactaccggcacggccagccaattccaagagttgaatatatggaggaagaaaagaaaacctggggaaccgtgtttaagaccctcaaatcactttacaaaactcacgcctgctacgagtataatcacatctttcctctgctggagaaatattgtgggttccatgaagataatattcctcaactggaagacgtcagccagtttctgcagacctgtaccggattcaggcttcgacctgtggccggcttgttgtcgagcagagatttccttggaggattagctttccgggtgttccattgcacacagtacatccgtcacgggagcaagcctatgtacacaccagaaccggatatctgccacgaattacttggtcacgttcccctcttttcagacagaagtttcgcccagttttcacaggagattgggcttgcttccctgggagctcctgatgaatacatcgagaaactggctaccatttactggttcaccgtcgagtttggcctttgtaagcagggcgatagcatcaaggcctacggggctgggttactgagtagtttcggagagctgcaatattgcctttctgaaaagccaaaactgctgccactggaattggagaagaccgccatccagaactatactgttacggagttccagcccctctactacgtggcagagtcctttaacgatgccaaagagaaggttaggaacttcgccgcaacaataccccggccattttccgtaagatacgacccctacacccagcggatcgaagtgctggataacacccaacaacttaagatccttgcagactctatcaactctgaaatcggcattctgtgtagcgctctgcaaaaaatcaag

SEQ ID NO: 17873 - DNA, 1356 bp, Artificial Sequence
  Description of Artificial Sequence: Synthetic coding sequence
atgagcaccgcggtgctggagaatccgggtctggggagaaaactgtcagattttggtcaggaaacctcctatatcgaggacaactgcaaccaaaatggcgctataagcctgatcttcagcctgaaggaagaagtaggggctcttgcaaaagtgctgcggctgtttgaggagaatgacgtgaatctcacccacatagaaagccgccctagccgtctgaaaaaagacgaatacgagtttttcacccacttggataaacggtccctgcccgcactgacgaatatcattaagattcttcgccatgatattggtgccacggtgcacgagctgagccgggacaaaaaaaaggataccgtgccttggttcccacgcactattcaggagctggatcgcttcgctaatcagatcctgagctatggcgcagagctggatgccgaccatcctggcttcaaggatcctgtttatcgcgcccgtcgtaaacagttcgctgatatcgcctacaattatcgccatggacagccgatcccgcgcgtggagtacatggaagaggagaaaaagacatggggtactgttttcaagactctcaagagcctgtataagacccacgcgtgttatgagtacaatcacattttcccactgcttgaaaaatattgcggcttccacgaagacaacatcccgcagctggaggatgtctcccagtttcttcagacgtgcaccggatttaggctgcgcccagtcgcggggctgcttagcagcagggactttctaggtggtctggcttttcgcgtgttccattgtactcaatacatcaggcacggttccaaaccgatgtataccccagaaccagacatctgtcacgagctactgggccacgttccgttgtttagcgaccgcagcttcgcccaattctctcaagaaattggattggcttctctaggagcgcctgacgagtacatagaaaagctggcgacgatttattggttcacggtggaatttggtctgtgtaagcagggcgatagcatcaaggcatatggcgccggcctcctaagctcattcggggagctgcagtactgtctgagtgaaaaaccaaagctgctgccactggaactggagaagaccgcgatacaaaactacaccgttactgagttccagcccctgtattacgtggccgagagtttcaatgacgctaaagaaaaagtccgtaattttgctgccactattcctcgcccattctctgtgcgttacgatccatatacgcagcgaatcgaggtgctggataacacgcagcagctaaagatcctggctgacagcattaactctgaaattggaattctgtgctcggctctccagaaaataaag

SEQ ID NO: 17874 - DNA, 1356 bp, Artificial Sequence
  Description of Artificial Sequence: Synthetic coding sequence
atgtctacggctgtcctggagaatcctggtctgggacgcaagctgagcgatttcgggcaggagaccagctacattgaggacaactgtaaccagaatggtgccatatctttaattttttcattgaaggaggaggttggtgcattggctaaggttttgaggctgttcgaggaaaacgacgtcaatcttactcacattgagtctcgcccatcccgcctaaaaaaagacgaatatgagttcttcacccacctggataaacgcagcctcccagccctgacaaatataattaaaattttaagacatgacatcggcgcgacggtgcatgagctgtcaagagataaaaaaaaagatacagtgccatggttcccccgcaccatacaggagctcgatcgcttcgcaaaccaaatcctgagttatggcgcagaactggacgctgaccatcccggattcaaggaccccgtctaccgcgcccgaagaaagcaatttgccgacatcgcttataactacagacatggccaaccgattccccgagtagaatacatggaggaggaaaagaagacttggggaactgtcttcaagactttaaagtcgctttataaaacccacgcctgttacgagtacaatcacatttttccactgttagagaagtattgcggatttcatgaggataatattcctcagctggaggatgttagccagttcttgcagacctgcacgggctttcggctgcggcctgtggctggactcctttcaagcagagactttcttggcggcctggccttccgcgtgttccattgtactcagtatatccgacacgggtcaaagccaatgtacacacccgaaccagatatttgtcacgaattgctgggccatgtgccactgttctcagataggagctttgctcaattctctcaagaaatcggcctggccagcctaggagcaccagacgaatacattgagaaactggctacaatctactggttcacggtcgagtttgggttgtgtaagcagggcgattccatcaaagcttacggggcagggctgctttcgtctttcggtgaattgcaatattgcctttctgagaaaccaaagctgctacctctggaacttgaaaagaccgctatccaaaactacacggtaacggaatttcaacccctctactacgtggcggagtccttcaatgacgctaaggagaaggtccgcaatttcgcagcaactattccacggcctttctcggtgcggtatgacccgtatacgcagcgcatcgaggtcctagacaatactcaacagctgaaaatactggccgattccattaatagcgagattgggattctgtgctctgcactgcagaagatcaag

SEQ ID NO: 17875 - DNA, 1356 bp, Artificial Sequence
  Description of Artificial Sequence: Synthetic coding sequence
atgagtactgccgtcctggaaaatcccggtctgggccgtaagttgtcagattttggccaggaaacctcctacattgaagacaactgtaaccagaacggtgctattagcctgatatttagcctgaaagaggaagtgggcgcactcgccaaagtattgcgattattcgaagaaaatgacgtaaatctgacccatatcgagagtcgcccatcacgactcaagaaggacgagtacgaattttttactcacctggataagagaagtcttccggctctcacaaacatcatcaagattctgcggcacgacattggggccacggtgcacgagctgtccagagataagaagaaggacacagtcccatggtttcctaggacaatccaggaattagacagattcgccaaccaaatcctaagctatggcgctgagctggacgcggatcaccccggatttaaggatccagtgtatcgggcgcggagaaagcaattcgctgacatagcttacaactatcgccacggccagccaatcccaagagttgaatacatggaggaggagaagaaaacctgggggacggtgttcaagactctcaaatccttgtataaaacacacgcatgttatgagtataatcatatatttcctctgctggagaagtactgtgggttccacgaagataatattccgcagctggaagatgtctctcagtttctacaaacgtgtacgggctttaggctccgaccagttgccgggttgctgagtagccgtgactttctggggggactggcattcagggtattccactgcactcagtacattcgacacggtagtaaacccatgtacacaccagagcccgatatctgccacgagcttcttggccatgtgccacttttctccgatcgtagcttcgctcagtttagtcaggagatcggactcgcttccctgggtgcccctgacgagtatattgaaaagttggcaacaatctactggttcacagttgaatttggcctgtgcaaacaaggggattccatcaaggcatacggcgctggactgctcagcagtttcggggagctgcagtattgtctgagcgaaaagccaaagttattaccacttgagcttgagaagaccgctatccagaactataccgtgaccgagtttcagccactttattatgtggccgaatctttcaatgatgccaaggagaaggttcgcaactttgccgcgaccattcctcgtcccttctcggtcagatatgacccctatactcagcgcatcgaagttctcgacaacacccaacagctaaaaatcttagccgactcaatcaattcagagatcggcattttgtgttcagccttacagaaaatcaag

SEQ ID NO: 17876 - DNA, 1356 bp, Artificial Sequence
  Description of Artificial Sequence: Synthetic coding sequence
atgtcgaccgcggtgctggaaaatccagggcttggaagaaaacttagcgacttcggacaagagacttcatacatcgaggacaactgcaaccagaacggtgcgatctccctcatctttagcctgaaggaggaggtgggagccctggctaaagtcctgcggctgttcgaagagaatgacgtgaatctgactcacatcgagtcgcgcccgtcccggttgaagaaagatgaatacgagttctttacgcatctggacaaaaggtccctgccggcacttaccaatatcatcaagatcctgaggcatgatattggggctaccgtgcatgaattgtccagagacaagaagaaggatactgtcccgtggtttccgagaaccattcaggaactcgaccggttcgctaaccagatcttgtcctacggagccgaactcgacgccgaccacccgggattcaaggacccggtgtaccgcgcacgccggaagcagttcgcggatatagcctacaactatagacacggacaaccaatcccgcgcgtggaatacatggaagaagaaaagaaaacttggggcaccgtattcaagaccctcaaatcgttgtacaagacccacgcctgttatgaatacaatcacatttttccattgttggagaagtactgcggcttccacgaggataacatcccgcaactggaagatgtctcgcagttcctccaaacctgcaccggcttccgactgaggccggtggcaggactgctgtcatcacgcgacttcctcggcggcctggccttccgcgtctttcattgcacgcagtacataagacatggtagcaagccaatgtacactccagagcccgacatctgtcacgagctgctggggcacgtaccactgttctcggatcggtccttcgcgcagttctcacaggaaattggacttgcttctctgggagcccctgacgagtatatcgagaaactcgccacgatctactggttcacggttgagtttggtttgtgcaaacagggtgattcgataaaggcatacggggcgggacttcttagcagctttggggaattgcaatactgcctctcagaaaagcctaagctgctgcctctcgagctggagaaaactgcaatccaaaactacaccgtcaccgaattccaaccattgtattacgtggctgagtcattcaacgacgccaaggaaaaggtgcgcaatttcgccgcaactatccctcgaccgttcagcgtgcggtatgatccctacacccagcgcatcgaggtcttggataacactcagcaactgaagatcctcgcggatagtatcaactcggagatcgggatcctgtgttcggcgctccagaagatcaaa

SEQ ID NO: 17877 - DNA, 1356 bp, Artificial Sequence
  Description of Artificial Sequence: Synthetic coding sequence
atgtcaaccgcggtgcttgagaacccgggactgggtcgcaaactgtcggatttcggacaggaaactagctacatcgaggacaactgcaaccaaaatggtgccatctccctgatcttctccctcaaagaggaggtcggagcgctggcgaaggtgctgagactttttgaggagaatgacgtgaatttgacgcacatcgaatcacggccgagcagactgaagaaggatgaatacgagttcttcacccatttggataagcggagccttcccgccctcaccaacataatcaaaatcctcagacacgacatcggagcaactgtgcatgagctgagccgagacaagaaaaaagataccgtgccgtggttcccgcgtaccattcaggaactggaccggttcgcgaatcagattctgtcgtacggcgcggagctggatgctgatcatccaggcttcaaagacccggtctaccgggcccggcgcaaacaattcgcggacatcgcctacaattaccgccatggacaaccgatcccacgggtggagtacatggaggaggaaaagaaaacctggggaactgtctttaagacgctcaagtcactgtacaagacccacgcctgttacgaatacaaccacatcttccctttgttggagaagtattgcggatttcacgaggacaatattccacaattggaggacgtctcacagtttctgcagacttgtactggctttaggcttcgtccggtcgctggactgctctccagcagagactttcttggaggactcgccttccgagtgttccattgtacccagtacatccggcacggctcgaagccgatgtacactccagaaccggatatctgccacgagctcctgggacatgtgccgctcttctccgaccgctcgttcgcgcagttctcgcaagaaattggacttgcctccttgggcgctccagacgagtacatcgaaaagctggcgactatctactggtttactgttgagtttggactgtgcaagcagggagactccatcaaggcctatggcgctgggctgttgtccagctttggcgagctccaatattgtctgtcggaaaagccgaagctcttgcctctggagctggaaaagaccgccattcagaactacaccgtgaccgaattccagcccctctactacgtcgccgaaagttttaacgacgcgaaggagaaagttagaaatttcgcagcaaccattccgcgcccgttctcggtcagatacgacccttacacgcagcggattgaggtactggataacacccaacagctcaagatccttgccgactccatcaattccgagatcggaatcctgtgctcggccctgcaaaagatcaag

SEQ ID NO: 17878 - DNA, 1356 bp, Artificial Sequence
  Description of Artificial Sequence: Synthetic coding sequence
atgtcaaccgccgtgctggagaacccagggctcgggaggaagctgtctgatttcggtcaggagaccagctatattgaagacaactgcaatcagaatggcgcaatttctcttatattcagtttgaaggaggaggtgggggccctggccaaggtgctgaggttgtttgaggaaaacgatgtcaacctgacccatattgagtcccggccgagccggcttaaaaaggacgagtatgaattttttacccacttagacaaaaggagcctgcctgcactgactaacataattaagatcttaagacacgatatcggagcgacggtgcacgaattgagtcgcgacaagaagaaggatacagtgccttggttccctcgtactatccaggagctagatcggtttgctaatcagatcctgtcctatggggcagagttggacgcagatcaccctggcttcaaagaccccgtgtacagggcccgacggaagcagttcgcagatattgcttataattatcgccatggccagcctattccccgggtcgagtacatggaagaagagaagaagacctggggcacggtttttaaaactctgaaatccttgtacaagacgcacgcttgttatgaatataatcacatatttcctctgcttgagaagtattgtggttttcacgaggataacatcccgcagcttgaggatgttagtcagtttcttcagacctgtactggcttcagattgaggccagtggccggattgctttcaagccgcgacttcctcggtgggttggcttttcgggtgtttcactgtacacaatatattagacacggcagtaagcccatgtacactcctgagcccgacatctgtcacgagctgctggggcatgtgcccctgtttagtgaccggtctttcgcccagtttagccaagagattgggctggcctcacttggcgctccggatgaatacattgagaagctggctactatttattggttcaccgtagaatttggcctttgcaaacaaggagacagcattaaagcctatggggctggcttgcttagttcttttggagaattacagtactgtcttagcgagaagcccaagctcctaccactcgaactggagaagacggctatccagaactataccgtcaccgaattccaaccactctattacgtcgcagagagctttaatgacgccaaggaaaaggtccgcaatttcgccgcaacaattcctcggccgttcagtgtccgttatgatccctatacccagcgaatcgaggtactggacaacacacagcagctgaaaatcttggcagactccatcaactcagagatcgggatactctgttctgctttacagaaaatcaaa

SEQ ID NO: 17879 - DNA, 1356 bp, Artificial Sequence
  Description of Artificial Sequence: Synthetic coding sequence
atgtcaactgctgtactcgaaaatccagggctcgggcgcaaactgtctgacttcggacaggaaacaagttatatcgaagataactgtaatcagaatggagcaatttccctgatattctccctaaaagaggaggtgggggctctcgctaaagtactgcgcttatttgaagaaaacgacgtcaatttaacacacatcgaatcaagaccttcacggctcaaaaaagacgagtacgaattttttacacacctagataaacggtcgctgcctgcactcacaaatataataaaaatactcagacacgatattggagccactgttcacgaactgtcccgcgataaaaaaaaagacacagttccctggtttcctcgcactattcaggaacttgatagattcgccaatcagattctatcctacggagctgagctcgacgctgatcatcccggatttaaagatcctgtctatagggcacggcggaagcagttcgctgatatcgcttacaattaccggcacgggcagcccattccaagggtggaatacatggaagaagagaaaaaaacatgggggacagtttttaaaacactgaaaagtttgtataagacacacgcctgctacgaatacaatcacatttttccactgctggaaaaatattgcggatttcatgaagataacatccctcagctcgaagatgtttcccagtttctccagacttgtactgggtttagacttagacccgttgcagggcttctttcatcaagagatttcttgggaggactcgcatttcgggtgttccattgtacacagtatattcgacacggatcaaaacctatgtatacacctgagccagatatctgtcatgaattgcttggacatgtgcccctgttctcagatagatcctttgctcagttctctcaggagattggactggcctcccttggggctccagatgaatacatagaaaaacttgctactatatactggttcacagtcgagttcggactgtgtaagcagggagattccataaaagcatatggggcaggactgttaagttcctttggggaactgcagtactgtctatccgaaaaacccaaactcttaccactggaactggaaaagactgctatccagaattatacagtcacagaattccagcccctgtattatgttgcggaaagtttcaacgatgctaaagaaaaagtgcggaactttgctgccactattccgcggccctttagtgtgcgatatgatccctatactcagcgcatcgaagtgcttgataacacacagcagctaaagatacttgcagactctattaactctgaaatcggaatcctgtgctctgcactccagaaaataaaa

SEQ ID NO: 17880 - DNA, 1356 bp, Artificial Sequence
  Description of Artificial Sequence: Synthetic coding sequence
atgtcaactgcggtgctcgaaaatccgggtctgggccggaaattgtcggacttcgggcaggaaacctcatacatcgaggataactgcaatcagaatggcgccatcagcctgatcttctccctgaaggaggaggtgggagcattggcaaaagtgctccggttgttcgaagaaaatgacgtcaacctgactcacattgagtcaagaccgagccggctgaaaaaggatgaatacgagtttttcacccacttggacaagcggtcgcttccggctctgactaacatcatcaaaatcctgcgccacgacatcggagccactgtgcatgaactgagccgcgacaagaaaaaggacaccgttccatggttcccacgaacgatccaggaactcgatcggttcgctaaccaaattctctcctacggagccgagctcgacgcagaccatccgggattcaaagatcctgtgtatagagcgcgccgcaagcagttcgcagacatcgcctacaactaccggcatggccagccgatcccgcgcgtggaatacatggaagaggagaaaaagacgtggggtaccgttttcaaaactctgaagtcactgtacaagactcacgcttgttacgagtacaatcatatcttcccactgctcgaaaagtactgcggatttcacgaggacaatatcccccaactcgaagatgtgtcgcaatttctccagacctgtaccggattcagactgaggcctgtggccggactgctcagctccagggacttccttgggggattggcattccgcgtctttcactgcactcaatacatccggcatggatccaagccaatgtacaccccagagcccgatatctgtcatgaactgctcggtcacgtcccgctgttcagtgataggtccttcgcccagttcagccaggaaatcggactcgcgagcctgggagcgccggatgagtacatcgagaagctggcgacgatttactggttcactgtggaattcggcctctgcaagcagggcgacagcatcaaggcatacggagctggattgctgtctagctttggagagctccagtactgtttgagcgagaagcctaagctcctgccgcttgagctcgagaaaaccgcaatccagaactacactgtgactgagtttcaaccattgtactatgtggccgaatccttcaacgatgccaaggaaaaagtgagaaatttcgccgccactatcccgaggccgttttccgtgcgctacgacccgtacacccagaggatcgaggtgctggacaatacgcagcagctgaaaattctggccgactcgatcaatagcgaaatcggaatcctctgctcggctctgcagaagatcaaa

SEQ ID NO: 17881 - DNA, 1356 bp, Artificial Sequence
  Description of Artificial Sequence: Synthetic coding sequence
atgtcaactgcggtcctggaaaatccaggactgggtcgcaaattgagcgattttggccaagagacatcatatatagaggacaactgcaatcaaaacggggcaatttcacttattttcagcttgaaggaggaagtgggtgccctcgcgaaagtcttgcgactattcgaggaaaatgatgtaaatctgacacacatagagtcccgccctagtagattaaagaaagacgagtatgaattcttcacccatctggataaacggagtctaccagccctcacaaatattataaagattctgcgtcatgacatcggtgctaccgttcacgaattgagccgggacaaaaagaaggacaccgtgccctggtttccccgcaccatacaagagttggatcgcttcgcgaatcaaatcctaagttacggcgcggagctagacgcggaccatccaggctttaaggacccggtctatcgtgcgaggcgaaagcagttcgccgatattgcgtataactatcgtcacggtcagccgataccgagggtggaatatatggaagaggagaagaagacctggggcaccgtgtttaaaactttgaagtccctctataagacccacgcgtgctacgaatataatcacatcttcccgttactggagaagtactgcggctttcacgaagacaacatcccgcagctagaggacgtgtcacaattcctccaaacctgcacgggttttcgtctgcgaccagtagccggcctgctgagcagtcgtgatttcttgggtggactggccttccgagtgtttcactgcactcaatatatccgccacggtagcaaacccatgtacacgcctgaacccgacatctgccacgagctactcggccacgtcccactgttttcggatcgcagctttgcgcagttctcacaggagattgggttggcaagtctgggtgcaccggacgagtacatcgagaagctggccacgatctattggttcaccgtggaatttggtctatgcaaacagggcgacagcattaaagcgtacggtgccggactgttgagctcgtttggcgagttgcaatactgcctcagcgagaagccaaaactgttgcctctggagttggagaagaccgccatccagaactacaccgtaaccgaattccagccgttgtattacgtcgcagaaagcttcaacgatgcaaaggagaaagtacggaactttgcggccacaattccacgcccattctctgtacgctatgacccgtacacccagcgcatcgaggttctggataacacccagcaactaaagatactagccgatagtatcaactccgagataggcatcctgtgctccgcattgcagaagattaag

SEQ ID NO: 17882 - DNA, 1356 bp, Artificial Sequence
  Description of Artificial Sequence: Synthetic coding sequence
atgtccacggccgtccttgaaaaccccggcctgggccgcaagttaagcgacttcggtcaagaaacgtcgtatatcgaggataattgtaaccagaacggagctatcagcctgatcttctccttgaaggaggaggtcggtgccttggccaaggtactgcgtctcttcgaagaaaatgacgttaacctcacacacatcgagtcccgcccctcccgtttgaagaaggacgagtacgagtttttcacacacctcgacaagaggagcctgcctgccttgacgaatataatcaaaatcctgcgtcatgacattggagcaaccgtacacgagctcagtcgtgacaagaagaaggacacagttccttggttccctcgaaccattcaagagttggatcgcttcgccaatcagattttgtcttatggcgcagaactcgatgctgaccaccccggcttcaaggatcccgtctaccgtgctcgtcgcaagcaattcgcggatatcgcgtacaactaccgacacggtcagcccatcccccgcgtagagtacatggaggaggagaagaagacctggggaaccgtgttcaagacgctgaagtccctctacaagacgcatgcttgttacgagtataatcacatcttcccgctgctggaaaagtattgcggcttccatgaagataatatccctcagctcgaggatgtctctcagtttcttcaaacgtgtactggctttcgcctccggcccgttgccgggttgctcagctcccgtgacttcctcggcggtctcgccttccgggttttccactgcacccagtacatccgccacggcagcaagcccatgtacacaccggaaccagacatctgccacgaactactgggccatgttcccctgttctccgataggtcattcgcgcagttctcacaggaaatcggcctggcatcgctgggagcacccgacgagtacatcgagaagttggcgaccatttactggttcaccgttgaattcggcctttgcaagcagggggatagcatcaaggcctacggtgctggcctcttgagctcctttggcgaactgcagtactgcctatccgaaaagccgaagctgctgcctctggaactcgagaagaccgctatccaaaactatacagttacggagtttcagcccttgtactacgtggccgagtccttcaacgacgcaaaggagaaagtgcgtaactttgcggctaccattcctcgtccgttttctgtccgttacgacccctacacccagcgtatcgaggttcttgataacactcagcagctgaagattctggccgactctattaattccgagattggcatcctttgtagtgcccttcagaagatcaag

SEQ ID NO: 17883 - DNA, 1356 bp, Artificial Sequence
  Description of Artificial Sequence: Synthetic coding sequence
atgagcaccgcagttcttgaaaaccctggtttgggcaggaagctgtcggattttgggcaggaaacctcatatatcgaggacaactgcaaccaaaacggggcaatatcccttatcttttcattgaaggaggaagtgggcgccctcgctaaagttctgagactgttcgaagagaatgatgtcaatctgacacacatcgagtcacggcccagtcgtctcaaaaaggacgagtatgagtttttcacccacctggacaaaaggagtctgccagcattgacgaacataatcaagatcttacgacacgatataggcgccacagttcacgagctgtctcgggataaaaaaaaggatacagttccttggtttcctagaacaatccaagagcttgaccggttcgctaaccagatcctctcatacggcgctgagctggacgccgaccatcccggtttcaaagacccagtgtatagagcccggcgcaaacagttcgcggatatcgcttacaactatagacatggacagccaatccccagagtggagtacatggaagaagaaaagaagacctgggggacagtttttaaaacattgaagagcctgtacaagacacacgcttgctacgaatataaccatatattccctctactcgaaaaatactgtgggttccatgaagataatatacctcaactggaggatgtcagccagttcctccagacttgtactgggtttaggctgaggcccgtggcgggcctgctctcctcaagagactttcttggaggactcgcctttcgtgtgttccattgcacccaatatattagacacggcagtaagcccatgtatactcctgagccagacatttgtcatgagctgctggggcatgtgcccctgttctccgatagatctttcgcccaattcagtcaggagatcggattggcctctctgggggctcccgatgaatacattgagaagctggccaccatatattggtttacagtggagttcgggctatgcaagcagggcgactctatcaaagcctatggcgccgggctgttgtcatcctttggcgaacttcagtactgcctctccgagaagccaaagttgctgccgctggaactggaaaaaactgctatccagaattataccgtgaccgaattccagcccctttactacgtagccgaaagcttcaatgacgcgaaggaaaaggtgaggaatttcgcagcaacaattccacgacctttctccgtcaggtatgacccttacacgcaaaggatcgaagtgctggataatacacagcagttgaagatcttagctgattcgatcaattccgagatcgggattctgtgctctgcactgcagaaaatcaag

SEQ ID NO: 17884 - DNA, 1356 bp, Artificial Sequence
  Description of Artificial Sequence: Synthetic coding sequence
atgtccaccgccgtgttagagaacccgggtctggggcgaaagctgtctgatttcgggcaggaaacatcatacattgaggacaattgtaaccagaatggcgccatctcactaattttctccctcaaggaagaggtcggggcgcttgccaaagtgctgcgcctgttcgaggaaaatgatgtcaacctgacccacattgagtctagaccaagtcgattgaaaaaggatgagtatgagttttttacacaccttgacaagaggtcactaccggctcttaccaatattattaaaatcctgcggcatgatattggcgctaccgtgcacgagctgtcgagagacaaaaaaaaggacacagtgccgtggtttccccggaccatacaggagttggaccgctttgctaatcaaatattgtcttacggcgctgagctcgatgccgaccacccagggtttaaagatcctgtttacagagctaggagaaagcaattcgctgacatagcctataattatagacatggccaacccatcccacgtgtggagtatatggaggaagagaagaagacttggggcaccgtgttcaagaccctgaaatctttatacaaaacacacgcctgctacgaatataatcacattttccctttgctagaaaaatattgcggctttcatgaagataacatccctcaattagaggatgttagtcagttcttgcaaacttgtaccggattccgcctgagacctgtggctgggctactctcaagccgggacttcctcggtggactggcgtttcgtgtctttcattgcacccaatatattcggcacggctccaagcccatgtatacccctgaacccgacatctgtcacgagctgctgggccatgtgcctctcttcagcgatagaagttttgctcaattctcccaggagataggcctggcgtcactgggggcccctgacgagtatatcgagaagctcgcgactatttattggtttaccgtggaattcggcttgtgcaaacagggcgatagtatcaaagcctatggagctgggctcttatcttccttcggcgagttgcaatactgcctctccgagaagcctaagttgctgcccttggaacttgaaaagacagccatacagaactatactgtaaccgaatttcaacctctttattatgtggccgagtcatttaacgatgccaaagagaaagtgaggaacttcgccgctaccattcccagaccgttctccgtgagatatgatccctacactcagaggattgaggttctagacaatacccagcagcttaagatcctcgccgactcaatcaactcagagatcggcatcttatgtagtgcgttgcagaagataaag

SEQ ID NO: 17885 - DNA, 1356 bp, Artificial Sequence
  Description of Artificial Sequence: Synthetic coding sequence
atgagcactgcagttttagagaatccaggacttggaagaaagttatccgacttcggtcaagagacatcatatatcgaagacaactgtaaccagaatggagctatttcgctgattttttctctcaaagaggaagtgggtgccctagcaaaggtgctccgactgtttgaggagaacgatgttaatctcacacacatagagagccgaccatcaagacttaaaaaagatgaatacgagttctttacgcatctggacaaacgtagtcttccagcgcttacaaatataataaagattcttagacacgatatcggagctacagtacacgagctcagccgagataagaagaaagatactgttccatggtttccgcggacaatccaagaattggaccgatttgcaaaccaaatattgtcttacggggctgaactcgatgctgaccaccctggttttaaggatccagtttaccgggctagacgtaagcaattcgcggatattgcttataattatcgacatggtcaaccgattccacgagttgaatacatggaggaggaaaaaaagacgtgggggacggtgttcaaaaccttaaaatccctttataaaacgcacgcttgctatgaatacaatcatatattcccacttttagaaaaatattgcggattccacgaagacaatattccacaactagaagacgtgtcccagttcctccagacctgcacgggatttagactcagaccagtggccggattgctttcttcgagagacttcctgggtggacttgcttttcgcgtctttcattgcacccaatacataaggcatggttccaaaccaatgtacacccccgaaccggacatttgccatgaacttttagggcatgtgccacttttttctgaccggtcctttgcgcaattttcacaggagatcggacttgcatcattgggagcgcccgatgaatacattgaaaagttggccacaatttattggttcacagtcgaattcgggctttgcaaacaaggagattcaattaaagcatatggagccggccttttgtcgagctttggagagttgcaatattgcctttcagaaaagccgaaattattgcctctggaactagaaaagactgctatccaaaattatactgtgacagaatttcagccattgtattatgtggctgagtcttttaatgatgccaaggaaaaggtgagaaattttgcagctactatcccaaggccattcagcgtccgatacgatccatacactcagcgcattgaggtgttagataacactcaacagctaaaaatccttgctgattccattaacagtgaaatcgggatcctctgctcggcattgcaaaaaattaaa

SEQ ID NO: 17886 - DNA, 1356 bp, Artificial Sequence
  Description of Artificial Sequence: Synthetic coding sequence
atgtccacggctgtgctggagaacccggggttgggaagaaagctctcggacttcgggcaggagacgtcctacatagaggacaattgcaaccaaaacggggccatctcactgatcttctcgctcaaggaagaagtgggagcgctggctaaggtgctccgcctctttgaagaaaacgatgtcaatctgactcacattgagtcgcggccaagccgactcaaaaaggatgagtacgagttcttcacccatcttgacaaaagaagcctcccagcactgactaacatcattaagatcctccggcacgatatcggcgcaactgttcacgaattgtcgcgggacaagaagaaagacactgtgccgtggttcccacgcaccattcaggagctggataggttcgccaaccaaatcctgtcttacggtgccgagctggacgcagaccacccaggattcaaagacccagtctacagagcgcgcaggaaacaattcgcggacatcgcgtacaactacaggcatggacaaccgattccgcgcgtggaatacatggaggaagagaaaaagacttggggtactgtgtttaagactcttaagtcgctgtacaagactcacgcgtgctacgaatacaatcacatctttcctttgctggaaaagtactgcggatttcatgaggacaacatcccgcagttggaagatgtgtcgcaattcctgcagacttgcactgggttccgcctccgcccagtcgcgggcttgctgtcgtcccgggacttcctgggaggtctggctttccgggtttttcattgcacccagtacattcgccatgggtcgaagccgatgtacactcctgaacccgacatctgccacgagttgctgggtcatgtgccactcttctctgatcgctcatttgcacagtttagccaggagatcggactggcgtccctgggcgccccagacgaatacatcgaaaaactggccacgatttactggttcactgtggaattcggactgtgtaagcaaggagacagcatcaaggcctacggagccgggcttctttcctcgttcggtgaactgcagtattgtctgagcgaaaagccgaagctgcttccccttgagctggaaaagaccgcgatccagaattacactgtgacggaatttcagccgctctactacgtggctgagtcgtttaacgacgccaaagaaaaggtgaggaattttgcggctacgatccctcgccccttttcggtccggtatgatccatacactcaaaggatcgaggtgctggacaacactcagcagcttaagatcctcgccgattccatcaactcggagatcggaatcctctgctcggccctgcaaaagatcaag

SEQ ID NO: 17887 - DNA, 1356 bp, Artificial Sequence
  Description of Artificial Sequence: Synthetic coding sequence
atgtctacggctgtgctcgaaaacccagggttgggccgaaaattgtcggattttgggcaagaaacctcatacatcgaggacaattgtaatcagaacggagccatttcgttaatattttcgctgaaggaggaggttggagcgttggccaaggtgcttcggctattcgaagagaacgacgtcaatctgacacatatcgaaagtagaccctcacggctgaagaaagatgaatacgaattcttcactcatctcgataaacgatctttaccagccctgactaacataatcaaaattctgcgacatgacatcggcgccaccgtgcacgaactcagtcgagacaagaaaaaagatacagtcccttggtttccacggacaattcaagagctcgatcgatttgccaaccagatcctgagctacggtgccgagcttgacgctgaccaccctggttttaaggatcccgtctaccgggcgcgccgcaaacaatttgcagatattgcttacaactaccggcacgggcagccaattccaagagtcgagtacatggaagaggaaaagaaaacctggggcacagtctttaaaacattgaaatccctgtataaaacacacgcgtgttatgaatacaatcacatctttccactgctggaaaaatattgcggttttcacgaggacaacattccccagctggaggatgtttctcagtttctgcagacctgcaccgggttccgtctgcggccggtggccggcctactcagttcacgggacttcctcggcgggctcgctttcagggtgttccattgtactcagtatataagacatggatccaagcctatgtatacccccgagcccgatatatgtcacgaactgctgggccatgttccactgttcagcgaccgctcttttgcccagtttagtcaagagataggcctggcctctctgggggccccagacgagtacatcgagaaactcgccaccatatactggttcaccgtagaatttgggttatgcaaacaaggagattcaatcaaggcttatggcgcgggactcctctcttcctttggcgagctgcaatattgtctgtccgaaaagccaaagcttctgcctttagaattggaaaaaacagcaatccaaaactataccgtcaccgagtttcaaccgttatactatgtggcagagagtttcaatgacgctaaggaaaaggtgaggaattttgctgccaccataccacgcccgttctccgtgagatatgacccatacacgcaacgaatcgaggtgttggataacactcagcagctgaaaatcttggccgactccattaatagcgagattggtatcctatgctcggccctgcagaaaattaag

SEQ ID NO: 17888 - DNA, 1356 bp, Artificial Sequence
  Description of Artificial Sequence: Synthetic coding sequence
atgagtacagctgtccttgaaaaccctggtctgggccggaaactgagtgattttgggcaagaaacttcgtacattgaggataattgtaaccagaatggagccatcagcttgattttctccctgaaggaggaggttggggccttggccaaggtgttgcgactgttcgaagagaacgatgtgaacctgacccacattgaatcccgaccttcaagactcaaaaaggacgagtacgagtttttcacccatctggataagcgatctctgcccgcgctgaccaacatcataaagattctacgacacgacatcggggccactgtgcatgagttgtcaagggacaaaaaaaaggatacagtgccatggtttccaagaacgatacaggaactggacagattcgcaaatcagatcctaagttacggggctgagctagatgcagatcacccggggtttaaagaccccgtgtaccgtgcaagaaggaagcagtttgccgatatcgcttataattaccgccatgggcagcctatcccacgggtggaatacatggaggaggagaagaagacttggggaactgtgtttaagacactgaagagcttatacaaaactcacgcctgttacgagtacaatcatatattccccttgctggaaaaatactgtggattccacgaggacaatatacctcagctggaggacgtctcacagttcctacagacctgcacagggttccgattgcgtcccgtggctgggcttctatctagcagagactttctgggtggtctggcattcagagtgttccactgcactcagtacattaggcacggatccaaaccgatgtatacaccagaaccagacatatgtcatgaactgctcggacacgtgcctctgttctccgatcggagcttcgcgcagttctctcaagagattggtctggcatcgctgggtgcccccgacgaatacatcgagaaactcgccacgatctattggtttaccgtggagtttggcctgtgcaagcaaggcgatagtatcaaggcctacggcgccggcctgctctccagtttcggcgaactgcagtactgcctgtctgaaaaacccaagctgctaccactagagcttgaaaagaccgccattcagaactacaccgtgacagagttccagcctctatattatgtggctgaatctttcaatgacgctaaagaaaaggtcagaaactttgccgccaccattccaaggccattcagtgttcggtacgacccctatactcaacgaatagaggttttagataacacacagcaactgaaaatcttagccgatagtataaactccgagattgggatcctgtgttccgctctgcaaaaaataaag

SEQ ID NO: 17889 - DNA, 1356 bp, Artificial Sequence
  Description of Artificial Sequence: Synthetic coding sequence
atgtcgacggcggttctagaaaatccgggtctaggtcgaaaattatcggattttggtcaagaaacgtcgtatatagaagataattgtaatcaaaatggtgcgatatcgctaatattttcgttaaaagaagaagttggtgcgttagcgaaagtactacgattatttgaagaaaatgatgtaaatctaacgcatatagaatcgcgtccgtcgcgattaaaaaaagatgaatatgaattttttacgcatttagataaacgatcgttaccggcgctaacgaatataataaaaatactacgtcatgatataggtgcgacggtacatgaactatcgcgagataaaaaaaaagatacggtaccgtggtttccgcgtacgatacaagaattagatcgttttgcgaatcaaatattatcgtatggtgcggaactagatgcggatcatccgggttttaaagatccggtatatcgtgcgcgtcgaaaacaatttgcggatatagcgtataattatcgtcatggtcaaccgataccgcgtgtagaatatatggaagaagaaaaaaaaacgtggggtacggtatttaaaacgttaaaatcgttatataaaacgcatgcgtgttatgaatataatcatatatttccgctattagaaaaatattgtggttttcatgaagataatataccgcaactagaagatgtatcgcaatttctacaaacgtgtacgggttttcgtttacgaccggttgcgggtttattatcgtcgcgagattttctaggtggtctagcgtttcgtgtatttcattgtacgcaatatatacgtcatggttcgaaaccgatgtatacgccggaaccggatatatgtcatgaattattaggtcatgtaccgttattttcggatcgttcgtttgcgcaattttcgcaagaaataggtttagcgtcgttaggtgcgccggatgaatatatagaaaaactagcgacgatatattggtttacggtagaatttggtttatgtaaacaaggtgattcgataaaagcgtatggtgcgggtctattatcgtcgtttggtgaattacaatattgtttatcggaaaaaccgaaactattaccgttagaactagaaaaaacggcgatacaaaattatacggtaacggaatttcaaccgctatattatgtagcggaatcgtttaatgatgcgaaagaaaaagtacgaaattttgcggcgacgataccgcgtccgttttcggtacgatatgatccgtatacgcaacgtatagaagtattagataatacgcaacaactaaaaatattagcggattcgataaattcggaaataggtatattatgttcggcgctacaaaaaataaaa

SEQ ID NO: 17890 - DNA, 1356 bp, Artificial Sequence
  Description of Artificial Sequence: Synthetic coding sequence
atgtccaccgccgtgctggagaatcctggactgggacggaaactttccgatttcggacaggaaaccagctacatcgaggacaactgcaaccagaacggcgcgatctcgctgatcttctctctcaaggaagaagtcggcgccctcgccaaagtgttgcgcctgtttgaagagaatgatgtgaacctgactcacatcgaatctcgtccttcccgcctgaaaaaggacgaatatgaattcttcacccacctggataagcgctcgctgccggcgctgactaacatcatcaagatcctcagacatgacatcggagcgaccgtgcatgagctctcacgcgacaagaagaaagacacggtgccgtggttcccgagaactatccaagaactggacagattcgccaatcaaatcctgtcctacggggccgaactcgatgcggaccaccctggattcaaggatcccgtctaccgcgcacggcgcaagcagttcgcagacatcgcatacaattaccggcatggccaaccgatcccccgggtcgagtacatggaggaagagaaaaagacctggggtaccgtgtttaagaccttgaagtccctgtacaagacgcatgcgtgctacgagtacaatcacatctttccactgcttgagaagtactgcggatttcacgaagataacatcccacaactggaggacgtgtcccaattccttcagacctgcaccggatttcgacttagacccgtcgctggactgttgtcgagccgcgactttctgggaggactcgccttccgcgtgtttcactgcactcagtacatcagacacggaagcaaacctatgtacacccctgaacctgacatctgccatgaactgctcggtcatgtcccgctgttttctgaccggtcatttgcccagttttcgcaagagatcggactcgctagcctgggtgcccctgacgagtacatagaaaaactcgcgaccatctattggttcactgtcgagttcgggttgtgtaagcagggagacagcatcaaggcctacggagcaggactgctgtcctcgttcggagaactccagtactgcctgtcggagaagcccaagctcctgccgcttgaactggaaaaaaccgctattcagaactacactgtgaccgagttccagcctctctactacgttgccgaatcattcaatgatgcaaaggagaaagtccggaacttcgcggcaactattcctcgcccattctcagtgcggtacgatccatacacgcagaggatcgaagtgttggataatacccagcagctgaaaatcctggcggactcgatcaattccgaaatcggcatcctctgctctgcattgcaaaagatcaag

SEQ ID NO: 17891 - DNA, 1356 bp, Artificial Sequence
  Description of Artificial Sequence: Synthetic coding sequence
atgtcgacggccgtgctggaaaatccgggccttgggagaaaactcagcgacttcggtcaagaaacttcctacatcgaggacaactgcaaccagaatggagcaatttcgctgatcttttctctcaaggaagaagtgggcgcactggcaaaagtgctgcggctttttgaagagaacgacgtcaacctcacccatattgagtcacgcccatccaggctgaagaaagatgaatatgaattctttacgcatctggataaacgaagcctccccgcgcttactaacatcatcaaaatactccgccatgatataggagcaaccgtgcacgaactgagccgggataagaaaaaggatactgtcccgtggttcccaagaaccatccaggagctggatcggtttgcaaatcagatcctttcatacggtgccgaacttgatgcagaccatcctggctttaaggacccggtgtacagggcaagacgcaaacaattcgcagatattgcatacaattatcgacacggtcagccgatacccagagtggaatacatggaagaggagaaaaagacctggggaaccgtgttcaaaacccttaagtcgctctacaagacccacgcctgttatgagtataatcatatctttccacttcttgagaaatactgtggatttcatgaagataacattccccagctcgaagatgtgtcccaatttcttcaaacctgtactggtttccgccttcgaccagtcgcgggtctgctcagctctcgggatttccttgggggtctggcctttagagtgttccactgcactcagtacatcaggcacggatccaagccaatgtacactcctgagccggacatatgccatgaacttctgggtcatgttccattgtttagcgatcgttcttttgcacaattttcgcaggaaattggactcgcctcactcggggccccagatgagtacatcgagaaactggccaccatctactggttcactgtcgagttcgggctttgtaagcagggcgattccattaaggcatacggagcaggtttgttgtccagctttggcgaactgcagtactgcctgtcggaaaagccgaagctgcttcctcttgaactggaaaagacggcgatacagaattacacggtgaccgaatttcaaccactttactacgtggcggaatcctttaacgatgcgaaagagaaggtgcgcaatttcgcagccaccatccctcggccgtttagcgtccgctacgatccatacacgcaaagaatagaagttctcgataacactcagcaacttaagatcctggcagactcaattaactccgaaattggtatcttgtgctccgcactgcaaaagattaaa

SEQ ID NO: 17892 - DNA, 1356 bp, Artificial Sequence
  Description of Artificial Sequence: Synthetic coding sequence
atgtcgaccgccgtgcttgaaaaccccggactgggtcgcaagttgagcgattttggacaagaaacttcgtacatcgaggacaattgtaaccagaatggcgccatctccctcatattcagcctcaaagaggaagtgggggcccttgccaaggtgcttcgcctgttcgaggagaacgatgtgaaccttacccatatcgagtcgcgtccgtcacgacttaagaaggacgaatacgagttctttacgcacctggataagcgttcgctgccagcactcaccaacatcatcaaaattctgcggcatgatataggcgccaccgtccacgaactgtcgcgggataagaaaaaggacactgtgccatggttcccccgcactattcaagagttggaccgctttgcaaaccagatcctgagctatggagccgaacttgacgctgaccaccccgggtttaaagaccctgtgtaccgcgctcggagaaagcaatttgccgacattgcctacaattaccgtcatggacagccaattcctagggtggaatacatggaggaagagaaaaagacgtggggcaccgtgttcaagactttgaaatcgctttacaaaactcacgcatgttatgaatacaaccatatcttccctctcctggagaaatactgtggcttccatgaagataacattcctcaactggaagatgtctcgcagttcttgcagacttgtaccggttttcgtttgaggccagttgcaggcctgcttagctcccgagatttcctgggaggtcttgcatttagagtctttcactgcactcaatacattagacatggatcgaagcccatgtacaccccagaaccagacatctgccatgaacttctggggcatgtgcctcttttctctgatagatcgtttgcacaattctcgcaggaaattggcctggcatctctgggggccccggacgaatacattgaaaaactggctacgatctactggtttaccgtcgaatttgggctttgcaagcaaggcgattccattaaggcatacggggcggggcttctgtccagcttcggagagctccaatactgccttagcgagaaacctaagctccttccactcgaactggaaaagaccgcaattcaaaactacaccgtgacggaatttcagcctctgtactatgttgctgagtcatttaacgatgcaaaggaaaaggtccggaattttgccgcgacgattccaaggcctttttcggtccgttacgatccttacacccaacggatagaagttttggataacacccaacagcttaagatattggccgattccatcaatagcgagattggaattttgtgtagtgcactgcaaaagatcaag

SEQ ID NO: 17893 - DNA, 1356 bp, Artificial Sequence
  Description of Artificial Sequence: Synthetic coding sequence
atgtccaccgctgtgctggagaaccctgggttgggtcggaagctgtcggacttcggccaagaaacctcctacatcgaggacaactgcaatcaaaacggtgcgatttcgctgatcttctccctgaaggaagaagtgggagctctggcgaaggtcctgcggctctttgaggagaacgacgtcaacctcacccacatcgaatcgcgtccatcacgcctgaaaaaagatgagtatgagttctttactcatctggacaaaagatcgctgcctgcgctcaccaacatcatcaaaatcttgaggcacgacatcggtgcgaccgtgcatgaactgtcccgggataagaagaaagatactgtgccctggttccccagaaccatccaggaactggaccgcttcgctaaccaaatcctgtcatacggcgccgaactggatgccgaccacccgggtttcaaggatcctgtgtaccgcgcccgcagaaagcaattcgcggacatcgcatacaactaccgccacgggcaaccgattcccagagttgagtacatggaagaagagaagaaaacctggggcaccgtgtttaagacgctgaagtccctgtacaaaacccatgcctgttacgaatacaaccacattttcccactcctcgagaagtactgtggattccatgaagataacatccctcagctggaagatgtctcacagtttctgcagacttgcactggattccgcctcagaccggtcgccggcctgctctcgtcgcgggacttcctgggaggcctcgcgttcagagtgttccactgcacccaatacatcagacacggatcaaaaccgatgtacaccccagagcctgatatatgccatgaacttctgggacacgtcccgctgttctcagataggtcgtttgctcagttctctcaagagatcgggctggcctcgctgggagctcctgacgagtacatcgaaaagctcgcaactatttactggttcaccgtggagtttggcttgtgcaagcaaggcgattcgatcaaggcctacggcgccggacttctgtcctccttcggcgaactccaatactgtctgtcggagaaaccgaagctgctccctctggaactcgaaaagaccgccatccagaactacactgtgaccgaattccaacccctctattacgtcgcggagtccttcaacgacgcaaaggaaaaggtgcgcaatttcgcggcaaccatccccagaccgttttccgtgcggtacgacccctatactcagcggattgaggtgcttgataacacccagcagctgaagattctggccgactccatcaacagcgagatcggaatcctgtgctctgcactgcagaagatcaag

SEQ ID NO: 17894 - DNA, 1356 bp, Artificial Sequence
  Description of Artificial Sequence: Synthetic coding sequence
atgtcgactgctgtgctggagaatcccggtctgggtcgcaagctcagcgacttcgggcaggaaacctcatacatcgaggacaactgtaatcagaatggagcgatcagccttatcttcagcctcaaggaggaggtgggagccctggcgaaagtgcttaggctgttcgaggaaaatgacgtgaacctcactcacatcgagagccgcccgtcccgcctgaagaaagatgaatacgagtttttcacccacctcgataagcggtcactgccggccctgaccaatatcatcaaaattctgcgccatgacattggcgccaccgtgcacgaactgtcccgtgacaagaagaaggataccgtcccgtggttcccaagaaccatccaggaactggaccggtttgcgaatcaaatcttgtcctacggagccgagctggacgctgaccacccgggttttaaggatccggtataccgcgctagacgcaaacagttcgcggacatcgcatacaactaccgccatgggcagccgatccctcgggtcgagtacatggaagaggaaaagaaaacgtggggaactgtctttaagactttgaagtcactgtacaaaacgcatgcctgctacgaatacaaccatatcttcccgctcttggagaagtactgcggatttcacgaggataacatacctcaactggaggacgtgtcgcaattcctgcagacttgtactggcttccgccttagaccggtggcgggactcctgtcctcgcgggactttctcgggggcctcgcgttccgcgtgttccattgcacgcagtacatcagacatggatccaaaccgatgtacactccagagccggatatctgccatgagttgctgggccatgtgcctctgttcagcgaccgcagctttgcccagttcagccaggaaattggtctggcctccttgggagctcctgatgagtatatcgaaaagctggcaactatctactggttcacggtggagttcggactctgcaagcaaggtgactcgatcaaggcctacggcgcgggactgctctcgtccttcggcgagctgcagtactgcctctcggaaaaacctaaactgcttcccctggaactggaaaagaccgcaatccagaattacacggttacggaatttcagccactctactacgtggcagaatcgttcaacgatgcaaaggaaaaggtgaggaattttgccgccaccatcccgcgtccgttttccgtgcggtacgatccttacacccagcgcatcgaagtgctggacaacacccagcagctgaaaatcttggccgattccatcaacagcgaaatcggcatcctctgcagcgccctgcagaagatcaaa

SEQ ID NO: 17895 - DNA, 1356 bp, Artificial Sequence
  Description of Artificial Sequence: Synthetic coding sequence
atgtccactgcagttctggagaatcccggcctggggcggaagctgtctgacttcggtcaggaaacttcatatatcgaagataattgcaaccagaacggagccataagcctgatcttcagcctgaaggaggaggtcggtgcacttgctaaggttctgcgacttttcgaggagaacgatgttaacttgacccatatagagtctcggccctcccggctgaaaaaggatgaatatgagtttttcacgcacctggataaacgcagtctgcccgctttgacaaacattatcaagattctcaggcatgatatcggggcgacggtgcatgaattgtcccgggataaaaagaaggataccgtcccgtggttccccaggacaattcaggagttggataggtttgctaaccagatcctctcctacggcgcagagcttgacgcagaccaccctgggtttaaggaccctgtttaccgagcacgcagaaagcagttcgccgacatagcttacaactatagacatggacagcctatccctagggttgaatacatggaggaggagaagaaaacatgggggacagtttttaaaacacttaaaagcctctacaaaacgcacgcgtgttacgaatacaatcacatttttccacttctggagaagtattgcggattccatgaagacaatatcccgcagctcgaggacgtctcacagttcctgcaaacctgcacgggattcagactgagacccgtggcaggcctgctatcatcacgggatttcctgggcgggcttgccttccgcgtctttcactgcacacagtacatccgccacggatcaaaacctatgtatacgccagagcctgatatctgccatgagttgctcgggcacgtgcctctgttctcggaccgcagtttcgcccaattctctcaggaaattggcctagcttcacttggggctccggacgaatatattgaaaagctggcaactatatactggttcactgtagagtttgggctttgcaaacaaggcgatagcattaaagcctatggcgctggccttttatctagtttcggggaactccaatactgtctgagtgagaagcccaagctgcttcctttagaactggagaagacagcaatccagaactatacagtcaccgagttccagcctttgtattacgtggcggagtccttcaacgatgctaaggagaaagtgaggaatttcgccgccactattccaaggcccttttcagtccgctacgacccctacactcaaagaattgaggtcctggacaatacccagcagcttaagatattggctgactcaatcaacagcgagatcggaatcctctgctctgccctgcagaagatcaaa

SEQ ID NO: 17896 - DNA, 1356 bp, Artificial Sequence
  Description of Artificial Sequence: Synthetic coding sequence
atgtcgaccgccgtgctggagaaccccggactcggacggaagctgtccgacttcgggcaggagacgagctacattgaggacaactgtaatcagaacggggccatctcccttatcttttcactgaaggaggaggtcggggcactggccaaggtgctgcgtttgttcgaggagaacgatgtgaatcttactcacatcgagtcgcggccgagcaggctcaagaaggatgaatacgagtttttcacccacttggataagagatccctgcccgcgctgaccaatatcatcaaaatcctgcgccatgatatcggagcgactgtgcacgaactgtcgcgggacaagaagaaagataccgtcccgtggttcccacggactatccaggagttggaccgcttcgcgaatcaaattctgtcctacggcgcagagctggacgccgaccatcctggcttcaaggacccagtgtaccgcgcacggcgcaaacagtttgccgacatcgcctacaactatcgccatggacagccgatacccagagtggaatacatggaagaagagaagaaaacgtggggcacggtattcaagaccttgaagtccttgtacaagacccacgcgtgctacgagtacaatcatatctttccgctgctcgagaagtactgcggatttcacgaggacaatattccgcaactggaggacgtgagccaattcctccaaacctgtactggctttcgccttaggccggtggccggcctgctcagctcaagagatttcctgggcggcctggccttccgggttttccactgcactcaatacatcagacatggatccaagccaatgtacaccccggagcccgatatctgccacgaactgctgggacatgtgccgctcttctcagatcgctcattcgcccaattctcccaagaaatcgggttggcctcgctgggtgcacctgatgagtacatcgaaaaactcgctaccatctattggttcacggtggaattcgggctctgcaagcaaggggactcaattaaggcgtacggagccggcttgctgtcgtcctttggcgaactgcagtactgcttgtcggaaaagcctaagctgcttcctctggaactcgaaaagaccgccattcagaattacaccgttacggaattccagccgctgtactacgtcgctgaatcgtttaatgacgccaaggagaaagtgaggaatttcgccgcaacgatcccacggccgttcagcgtgcgatacgatccttatacgcagcgcatcgaagtcctggacaacacccagcagcttaagatcctggcggacagcatcaacagcgagatcggaatcttgtgctccgcactccaaaagatcaaa

SEQ ID NO: 17897 - DNA, 1356 bp, Artificial Sequence
  Description of Artificial Sequence: Synthetic coding sequence
atgagcaccgctgtgttggagaatcctggactggggaggaagctcagcgacttcggtcaagaaacttcgtacatcgaggacaactgtaatcaaaacggagcaatttcgcttatcttctctctgaaggaggaagtcggagccctggcaaaagtgctgagattgttcgaagagaatgatgtcaacttgacgcatatagaatcgcggccttcgagactcaagaaggacgaatacgagttcttcacccatctcgacaagcgctcgcttccggcccttaccaacatcatcaaaatcctccgccatgatatcggagccaccgtgcatgaactgtcacgggacaagaaaaaggacactgtgccctggtttccccgcactattcaggagcttgaccggttcgctaaccagatcctgtcgtacggtgccgaactggatgccgatcacccaggcttcaaagatccagtttatagggcaaggcgcaaacagttcgcagacatagcgtacaattaccgacatggccaaccaatcccaagagtggaatacatggaggaggagaaaaagacttggggaacggtctttaagactttgaaaagcctgtacaagactcatgcttgctacgagtacaaccatatcttccctcttctcgaaaagtactgcgggtttcacgaggataacatcccacaattggaagatgtgtcacagttcctccagacgtgtaccggctttcggctcaggccggtcgcagggcttctgtcctcacgggacttccttggaggactggcgttcagggtgttccactgcacccagtacatccggcacggatccaaaccgatgtacactccggagccggatatctgccacgaactcctggggcacgtgcctcttttcagcgacaggtcattcgcgcaattttcccaagaaatcggactcgcgagcctgggcgcccctgacgaatacatcgaaaaactggccaccatatactggttcaccgtggaattcggcctgtgcaagcaaggagatagcatcaaggcgtatggcgccggactgctgtcgagctttggagagctgcaatactgcctctccgaaaagccgaagctgctgccgctcgaactcgaaaagactgccatccagaactacactgtcaccgaattccaaccgctgtattacgtggcagaatcctttaatgacgcgaaggagaaggtgcggaactttgctgctaccatccctcggccattctccgtccgctacgacccctacactcaacgcattgaagttctcgataacacccagcagctcaagatcctggcggactccatcaactcagagatcggcattctgtgcagcgccctccaaaagattaaa

SEQ ID NO: 17898 - DNA, 1356 bp, Artificial Sequence
  Description of Artificial Sequence: Synthetic coding sequence
atgtctaccgccgtgctggagaaccctggactcggacgaaaactttcggactttggacaggagacttcgtatattgaagataattgtaaccagaacggtgctatttcgctgattttctctctgaaggaggaagtcggggcactggccaaagtccttcggctttttgaagagaacgatgtgaatcttacccatatcgaatcgaggccttccagattgaagaaggatgaatacgaattcttcacgcacttggacaagaggtcccttcctgcgctcactaatatcataaagattcttcgccatgatattggcgctactgttcatgaattgtcgagagataagaaaaaagatactgtgccatggtttccacgtacgatacaagagctcgatcgctttgcaaaccagattctttcctatggcgcggaactcgatgccgaccaccctggatttaaggaccccgtgtaccgagcgagacggaagcaatttgctgacatcgcctacaactaccgacatggtcaaccaatcccgcgggtggagtacatggaagaagaaaagaaaacctggggcaccgtgtttaagactctcaagtctctgtacaaaacgcatgcatgttacgaatacaatcacattttcccacttctcgagaaatactgcgggttccatgaagataacatacctcagctggaagatgtgtcccaatttcttcagacctgcaccggctttagactgaggcctgtggctggactcctctcctcaagagatttcctgggaggcctggcttttcgggtatttcactgcactcaatacattcgccacggcagcaagcccatgtacacgcccgagcctgatatctgccacgagttgctcggccatgtacctctgttttcagatcgctcgttcgcacaattttcgcaagaaatagggctggcgtcactgggagccccagacgagtacattgaaaagctcgcaactatttactggtttactgtggaatttggtctgtgtaagcaaggtgatagcattaaggcatacggagcaggacttttgtccagctttggtgagctgcagtactgtctttcggagaaaccaaaactccttcccttggagcttgagaaaactgcaattcaaaactacaccgttaccgaatttcagcctctgtactacgtcgccgaatccttcaatgatgcaaaggaaaaggtgaggaacttcgccgccactattcctagaccctttagcgtccggtacgacccatacacccagaggatcgaagttcttgacaatacgcaacaactcaagatccttgcagattcaatcaacagcgagatcggaatcctgtgttcagcacttcagaagattaaa

SEQ ID NO: 17899 - DNA, 1356 bp, Artificial Sequence
  Description of Artificial Sequence: Synthetic coding sequence
atgagtacagcagtcctggagaatcccgggctggggcggaaactgtccgactttgggcaggaaactagctacatcgaggacaattgcaatcagaatggagccatctcgttgatcttcagtctcaaggaggaagtcggcgccttggcaaaggtgctgcgcttattcgaggagaacgacgtcaacctcacccatatcgagtcccgcccttccagactcaaaaaggatgagtatgagttttttactcatcttgataagaggagtctgcccgcactgacaaacataatcaaaattctgcggcacgatatcggggccaccgtccacgaactctcacgggacaagaaaaaggataccgtcccatggtttcctcgcacaatccaagaactggacagattcgcaaatcagattctctcatatggggcagagctagacgctgatcatcctgggtttaaagacccagtatatagggcgaggcgcaagcaattcgcagatatagcctataactatcgacacggacagcccatcccccgagtggaatacatggaggaagagaagaagacatggggcacggtttttaaaaccttgaagtcattgtacaagactcacgcatgctacgagtacaatcatatttttccactgctcgaaaagtactgcggcttccacgaggataacatcccacaacttgaggacgtgagtcagttccttcagacctgcacaggattccggctgcgacccgttgccggcctgctctctagccgagattttcttgggggtttagccttccgcgttttccactgtacacagtatatccgtcacggctccaagccaatgtatacgccggaacccgacatctgtcacgagctcttgggccatgtgccattattctctgacaggtcttttgcccagttttcacaggaaatcggactggctagtctcggcgcaccagatgagtatatcgaaaagttggcaaccatctattggtttacagttgagttcggcctttgcaaacagggtgactcgattaaggcctatggagcggggctactgagctcctttggagagctccagtattgcttaagcgaaaagcctaagttgctgcctctggagctcgagaagacagccatccaaaactataccgtgaccgaattccagcctctttattacgtcgcagagtcatttaacgacgcgaaggagaaggtgcgtaactttgccgcaacaatcccccgccccttcagcgtccgctatgatccttatacgcaacggattgaggtgctggataacactcagcaactcaagatactggcagattcaataaactccgaaatcggcatcctctgttccgctttgcaaaagatcaag

SEQ ID NO: 17900 - DNA, 1356 bp, Artificial Sequence
  Description of Artificial Sequence: Synthetic coding sequence
atgagcaccgccgtactcgaaaatccgggcctagggcgcaaattgtccgactttggccaagagaccagttacatagaggataactgcaatcagaacggtgctataagcctgatcttcagtctgaaggaggaagtcggcgcccttgctaaggtgctcagacttttcgaggagaacgacgtgaacctcacacacatagagtcccgtccaagtcgcctgaaaaaagacgagtatgagttttttactcatttggacaagcggtctctgcccgctctgaccaacatcatcaaaattcttcgacatgatatcggcgccactgttcatgaattgtcacgcgacaagaaaaaagacaccgtcccatggtttccccgcactatccaagagctggaccggttcgctaatcagatcctgagttacggcgccgaactagacgcagaccatcctggctttaaagaccccgtgtatagagcgcgcaggaagcaatttgctgacatcgcatacaactatcgccacgggcagcccatcccccgggttgagtatatggaggaggaaaagaagacctggggcacggtattcaagacactcaagtccctgtataaaacacatgcatgttatgagtacaatcacatcttccccctgctggaaaaatattgcggctttcacgaggataacattccccagttggaggacgtttctcagtttttgcagacttgtaccggctttcggttgcgtcctgtggcaggtctgttgtcatcccgggattttcttggagggcttgctttccgggtgtttcattgtacgcagtacattcggcacggcagcaaacctatgtatactcccgagcctgacatctgccacgaattgctgggtcatgtgcccctgttctctgatagaagcttcgcacaattctctcaagagatcgggttagcttccctaggggcaccagacgagtatattgagaagctcgctaccatttattggttcaccgtggagttcggcttgtgtaaacagggggattccattaaagcctacggggccgggctactaagtagcttcggggaactccagtactgtctcagcgagaaaccgaagttactacctctcgagctcgaaaagacggccattcagaattatacagtgactgaatttcagccactgtattatgtggcagagtcatttaatgatgccaaggagaaggttaggaactttgcagctactatcccgcggccgttctcggtgcgctacgatccttacacacagcgcatcgaggttctggacaacacgcagcagctgaagattctggccgattctatcaactcagaaatcgggatcctctgcagtgccctgcagaagattaag

SEQ ID NO: 17901 - DNA, 1356 bp, Artificial Sequence
  Description of Artificial Sequence: Synthetic coding sequence
atgtcgactgctgtgctggagaatccgggactgggaagaaagctgtcggacttcggacaggagacgagctacatcgaagataactgcaatcagaacggtgcgatctcactgattttctccctgaaggaggaagtgggcgctctggctaaggtgctccgcctgttcgaagaaaatgatgtgaatctgactcatatcgagtcgaggccctcacgcctgaagaaggatgaatatgagtttttcactcacctcgacaagcgctccttgccggccctcaccaacatcatcaagattctgcggcacgacatcggcgccactgtgcatgagctgtcacgcgataagaagaaagacacggtgccatggttcccccgcactatccaggaattggaccgtttcgcaaaccaaatcctctcgtacggagctgaactggacgcggaccatcctggattcaaggacccagtctaccgcgccaggagaaagcagttcgcggatattgcctataactaccggcacggacaaccaatccctcgcgtcgagtacatggaagaggagaaaaagacctggggcactgtgttcaagactctcaagtcgctctacaaaactcacgcgtgctatgagtacaatcacatctttccgttgttggaaaagtactgcggcttccatgaagataacatcccccagctggaggacgtgtcacagttcttgcagacctgcactgggttccgcctccgccccgtcgcaggcctgctgtcaagccgggacttcctgggaggactggctttccgcgtgtttcactgtacccagtacatccggcacggatcaaagccgatgtacacgcctgaaccggacatttgccacgagctgctggggcatgtgccgctcttctccgatcgcagcttcgcccaattctcgcaagaaatcggcttggcttccctgggcgccccggacgagtacatcgagaaacttgcgaccatctactggttcaccgtggagttcggcctgtgcaagcagggagattcgatcaaggcctacggggccggactcctgtcgtcgttcggcgaacttcagtactgcttgtcggaaaagccgaaactgctccccctggaactggaaaagacggcgatccagaactacaccgttaccgaattccaaccgttgtactacgtggccgaatcatttaacgatgccaaggaaaaagtgagaaatttcgcggcaaccatccctagacctttctccgtgcgctacgatccatacacccagcggatcgaagtgctggacaacacccagcagctcaaaatcctggcagactcaatcaattccgaaatcggaatcttgtgttccgcgctccaaaagatcaaa

SEQ ID NO: 17902 - DNA, 1356 bp, Artificial Sequence
  Description of Artificial Sequence: Synthetic coding sequence
atgtctacggcagtgcttgaaaatcccggactcggacgcaagctcagcgacttcggccaagaaacctcatacattgaagataactgcaatcaaaacggtgctatttccctcatcttttcacttaaagaggaagtgggagcacttgctaaggtgcttcgtctctttgaggaaaacgacgtgaacctgactcatatcgagtcccgaccgagcaggctcaagaaagatgaatacgagtttttcacccaccttgacaagcgcagcctccctgcccttactaatatcattaagatactgcgccacgacataggtgcaacggtgcacgaactgtctcgggataagaagaaagatacggtcccttggtttccacgtactattcaggaattggataggtttgcgaatcaaattctcagctacggagccgaactggatgcagaccatcctggttttaaggatcctgtctatagagctcggagaaagcagtttgcagatatcgcatacaactacaggcacggacagccaatccctagagtggaatacatggaagaggagaaaaagacctggggcactgtgtttaagaccctgaaatctctgtacaagacgcatgcttgttacgaatacaatcacattttcccactgcttgaaaagtactgtggattccatgaggacaacattcctcaactcgaagatgtttcgcaattccttcagacttgcaccggcttcagacttagacccgtggcaggcctgcttagctcccgcgatttcctgggtggactcgcgtttagagtctttcactgtacccagtacattagacatggatcgaagcctatgtacacccctgaaccggatatctgtcacgaactgctcggacacgttcctttgttctcggataggtcatttgcacaattcagccaggaaattggccttgcctccctcggagcacccgatgagtacatcgagaagctggccaccatttactggtttaccgtcgaattcggcttgtgcaaacaaggtgattcgataaaagcatacggcgccggccttctgtccagcttcggtgaactgcaatactgcctttcggaaaaaccgaagctcctcccactggaactggaaaagaccgcaattcaaaactacaccgtgactgagtttcaacctctttactacgtggcggaatcgtttaacgatgcaaaggagaaagtccggaatttcgcagccactatcccaaggccattttcagtgcggtacgacccctacactcagcgtatcgaggtgctcgacaacacccagcagctcaagatccttgcagactccattaactcggaaataggcattctttgttcggcactccaaaagataaag

SEQ ID NO: 17903 - DNA, 1356 bp, Artificial Sequence
  Description of Artificial Sequence: Synthetic coding sequence
atgtccaccgcggtgctcgaaaacccgggattgggaagaaaactgtcggactttggccaggagactagctacatcgaagataattgtaaccagaatggagccatctccctcattttcagcctcaaagaagaggtgggagctctggctaaggtgctccgcctcttcgaggagaacgacgtaaacctgacccatatcgaaagccgcccttcacgtttgaagaaggatgaatacgaattcttcactcacctcgataaaaggtcgttgcctgcgttgacgaatatcattaagatcctgagacacgacattggggctactgtccacgaactctcgagagacaagaaaaaggataccgtgccatggtttccgcgcactatacaagaactggatcggttcgccaatcagatcctgtcctatggagctgagcttgacgcagaccacccaggctttaaggacccggtgtaccgcgcgaggcgcaagcaattcgccgacatcgcctacaactaccggcatggacagccgatcccccgggtcgaatacatggaagaagagaaaaagacctggggaaccgtattcaagacgctgaagtccttgtacaagacccacgcctgctatgaatacaaccacattttccctctgctggagaagtactgcggctttcatgaggacaacatcccgcagttggaagatgtgagccaattcttgcagacgtgcaccgggttcaggctgcgcccggtcgcgggactccttagctcgcgggacttcctcggaggactggcctttagggtgttccattgtactcagtacatccgccacggttctaagccgatgtacacccctgagcccgatatctgccatgaactgctgggccacgtcccactgttttcggatcgcagcttcgcgcagttctcccaggaaattgggctggcatcactgggtgcacctgacgaatacatcgagaagctggccaccatctattggtttactgtggagttcggcctctgcaaacaaggagattccatcaaggcctacggtgccggccttctgagttcgtttggcgagctgcaatattgtctgtccgagaaacccaagctgctgccactggaactggaaaaaactgcgattcagaactacacggtcaccgagttccagcccctttactacgtggcagagtcgttcaatgacgcaaaggagaaggtgcggaacttcgcggctactatcccgcggcctttcagcgtgcgctacgatccttacactcagagaatcgaagtgctcgacaacactcaacaactgaaaatcctcgctgactcaatcaattcggaaataggaatcctttgcagtgcccttcagaaaatcaag

SEQ ID NO: 17904 - DNA, 1356 bp, Artificial Sequence
  Description of Artificial Sequence: Synthetic coding sequence
atgtcaacagccgtactggagaaccccggcttgggacgtaagttgtctgatttcggccaagagacctcatatattgaggacaattgtaatcagaacggcgctatatccctgatcttttcccttaaggaggaggtaggagccctggctaaggtccttaggctgtttgaagaaaacgacgtcaacctgactcacatcgaaagtcgccccagccgtctcaaaaaggacgagtatgaattcttcacccacctggacaaaagatcacttccagctttgaccaacatcatcaagatcctgagacatgatattggtgctaccgtgcacgagctcagccgtgacaaaaagaaggacaccgtgccttggttcccaaggaccattcaagagttggaccgctttgcaaaccaaattttgtcttacggcgccgagctggacgccgatcaccccggattcaaggatcccgtgtaccgcgctcgccgtaaacaatttgccgacattgcctacaactaccgccacggccagccaatcccacgtgtcgagtacatggaagaggaaaagaagacttggggtaccgtgttcaaaactctgaaatctctgtacaagacccacgcttgctatgagtataaccatatctttcccctgttggagaaatactgcggtttccacgaagacaacataccacagttggaggacgtgagtcagtttcttcaaacctgcactggtttcaggctgcgtcccgtggcaggtttgctctccagtagggacttcctgggcggcctcgcattcagggtgttccattgtacccagtacattcgtcatggctccaagcctatgtatacccccgaaccagatatttgtcacgagttgttgggccacgtgccactcttcagcgacagatcattcgcccagttttctcaagaaataggactggcttctctgggtgctcctgacgaatatattgaaaaactcgctactatctactggttcactgtagaattcggattgtgtaagcagggagacagtatcaaggcttatggtgcaggtctccttagcagcttcggcgagcttcagtattgcttgagcgagaaacctaagttgctgccactggaactggaaaagactgctatccaaaattacactgtcaccgaatttcagcccctctactacgtcgcagagtctttcaacgatgctaaagagaaggtaaggaatttcgctgccactatcccaaggccattctccgtcagatatgacccctacactcaacgtatcgaagtcctggataacacccagcagctgaagattctggccgatagtatcaactctgagattggcatcctgtgtagcgccttgcaaaagataaaa

SEQ ID NO: 17905 - DNA, 1356 bp, Artificial Sequence
  Description of Artificial Sequence: Synthetic coding sequence
atgagcactgccgtgctcgaaaacccgggactgggccggaaactgtcggattttggacaagagacttcgtacatagaagataactgcaaccagaacggcgccatttctctgatcttctcgctgaaggaggaggtcggggcgctcgcgaaggtcctcaggcttttcgaagagaatgatgtcaatcttactcatattgagtcgcgcccttcaaggctgaagaaggacgaatacgagtttttcacccatctggacaaacgctctctcccggccctcactaatatcatcaagatccttcggcacgacatcggagctactgtgcacgaacttagccgcgacaagaaaaaggataccgtgccatggttcccacgcacgattcaggaattggatagattcgcgaaccaaatactgtcctacggagccgaactcgacgccgatcacccaggcttcaaggaccctgtgtaccgcgcccgcagaaagcagttcgcggacatcgcgtacaactacagacacgggcagcctatcccacgggtggagtatatggaggaagagaaaaagacttggggaaccgtgttcaagactctgaagtcgttgtacaagacccacgcatgctacgagtataatcacatctttccgctgctggaaaagtactgcggattccacgaggacaatatccctcaactggaggacgtttctcagttcctgcagacgtgcaccggatttcgtctgcggccagtcgcagggctgctctcttcacgcgatttcctcggtgggttggcatttcgcgtctttcattgcactcagtacatccggcatggttccaagcctatgtacaccccggaaccggacatttgtcacgaattgctcggacatgtgcctttgttttcggatcggtcctttgcccaattctcgcaggaaatcggcctggcgtccttgggagctcccgacgagtacatcgaaaagctcgccaccatctactggttcactgtggaattcgggctgtgcaagcagggagattcgattaaggcctacggcgccggcctgttgtcatcatttggtgagctgcagtattgtctgtcggagaaaccaaagctcctgcctctggagctcgaaaagactgcgatccagaactacaccgtgaccgagttccaaccgctgtactacgtcgctgaatcgtttaacgacgcgaaagaaaaagtccgaaacttcgccgcaaccatcccacggccatttagcgtaagatacgacccgtatactcaacggatcgaagttctggataacactcagcagctgaagatcttggccgactccatcaattcggagatcggaatcctttgtagtgcgctgcagaaaatcaag

SEQ ID NO: 17906 - DNA, 1356 bp, Artificial Sequence
  Description of Artificial Sequence: Synthetic coding sequence
atgtctacagctgtgctggaaaaccccggattgggcagaaagctctccgactttggacaggaaacgagctacattgaagacaattgcaatcagaatggcgcgatttcactgatcttctcactgaaggaggaggtcggcgcccttgccaaggtgctgagactgttcgaggagaacgatgtgaacttgactcatattgagtcgcgaccctctcgactgaagaaggatgaatacgaattcttcacccacctcgataagcggtccctccccgccctgaccaacattataaagatcttgcggcacgatatcggagccactgtccacgaacttagtcgcgataagaaaaaagacaccgttccctggtttccccggaccattcaggagctggatagatttgccaaccagattttgtcttacggggctgagctggatgccgaccacccaggcttcaaggatcccgtctaccgcgctcggcggaaacaatttgcagacatcgcatataattacaggcatggccagcccattccacgggtggaatatatggaagaagagaagaaaacatggggaactgtgtttaagacactgaagagtctctacaaaacccatgcatgctacgagtacaaccatatcttccccctgctggagaagtattgcgggttccacgaggacaatattcctcagctggaagatgttagtcagttccttcagacctgcacagggttcaggctgaggcccgtcgccgggctgctgagttctcgtgatttcctggggggcctcgccttcagagtgttccattgcacacaatacatccggcatgggtccaagcctatgtacacgcccgagcccgacatttgccatgaactgcttggtcacgtgccattgtttagcgataggtcatttgctcagtttagtcaggagattggcttagctagtctgggcgcacctgacgagtatatagagaagctggctactatttactggttcacagtagagttcggattgtgtaagcaaggcgactccattaaggcatatggagccggactcctatctagcttcggagagctccagtactgcctgtctgagaaacccaagttactgcctctagaattggaaaagaccgcaatccagaactacacagtcacagagtttcagcccttgtattatgtggcagaatcattcaatgatgcaaaagagaaagtaagaaactttgccgctacaatcccaaggcccttttccgtccgctatgatccatacacacagcgcattgaggtcttagacaatacgcagcagctgaagatcttagccgattccataaatagcgagatcggaatcttgtgtagcgcgctgcaaaagattaaa

SEQ ID NO: 17907 - DNA, 1356 bp, Artificial Sequence
  Description of Artificial Sequence: Synthetic coding sequence
atgtccactgcagtgctggaaaacccaggtttgggtaggaagctgtcggacttcggacaagagacttcttacatagaggataactgcaaccagaatggagctatctccctgatctttagccttaaggaagaagtgggtgcacttgcaaaggtcctccgcttgttcgaagagaacgatgtgaacctcacgcatatcgaatcccgcccttcgcggctgaagaaggacgaatacgaattcttcacgcatctcgacaagaggagcctgcctgctctgaccaatatcatcaagatcctgagacatgacatcggcgcgaccgtgcacgaactgagtcgggacaagaaaaaagataccgtgccgtggttcccacggacgatccaagaacttgacagatttgcgaatcaaatcttgagctacggcgccgaactggacgctgaccacccgggcttcaaggacccggtctaccgggccagacgcaaacaatttgcagatattgcctacaactatcggcacggccagcccatccctcgggtggagtacatggaggaggagaagaagacttggggaactgtgtttaagactcttaagtccctgtacaaaacccacgcctgttacgagtacaatcacatctttccgctcctcgagaagtactgcggatttcacgaagacaatattcctcaactcgaagatgtgagccagttcctgcaaacttgtactggattccgactccgccccgtcgccggactgctgtcgtcccgagatttcctcggaggacttgcttttagagtgtttcattgtactcagtacatcagacacggaagcaaaccgatgtacaccccagagcctgatatctgccatgagctcctcggacacgtgccgcttttcagcgatcgttcgtttgcgcagttctcgcaggaaattggactcgcctccctgggcgcgccggacgaatacatcgaaaagctggcaaccatttactggttcactgtggaatttggcctgtgcaagcagggcgactcgattaaggcctatggagcgggtctgctctcgtctttcggggagctccagtactgcctctccgagaagcccaagctcctgccgctggagctcgagaagaccgcgatccagaactacacggtgactgaatttcagccgctctattacgtggcagagtcattcaacgacgccaaagaaaaggtgagaaacttcgctgccactatccccaggccattctcagtaagatacgatccctatactcagcgaattgaggtgctggataacacccaacaacttaagatcttggctgattcgattaactcggagataggcatcctctgctccgccctgcagaagatcaaa

SEQ ID NO: 17908 - DNA, 1356 bp, Artificial Sequence
  Description of Artificial Sequence: Synthetic coding sequence
atgtccaccgcagtcctggagaacccaggacttggtaggaagctctcggattttggccaagaaaccagctacattgaagataattgtaatcaaaatggtgccatcagccttatcttttccctcaaggaagaggtgggggcactcgctaaggtcctgagactttttgaggagaatgacgtgaatctgacccacatcgagtcgaggcctagcagacttaagaaggatgaatacgaattcttcactcatcttgataaacggtcgctgccagcacttactaatatcatcaagatcctgagacacgatattggagctaccgtgcatgaactttccagggataagaagaaagacaccgtcccttggtttcctcgcaccattcaagaacttgatcgattcgcaaatcaaatactgtcatacggtgcggaactggacgcggatcatcctgggtttaaggatcccgtgtacagagcccggagaaagcagtttgctgatatcgcgtacaactaccgtcacggccaacctatacctcgagtggaatacatggaggaagagaaaaagacgtggggtactgtgtttaagaccttgaagtcactgtataagacccacgcatgctatgaatacaaccacattttcccgctgctggagaaatactgcggttttcatgaagataacatacctcagctggaggatgtcagccaatttctccaaacctgcacgggttttaggcttcgtccagtggcgggactgctttcatcgagggactttctcggaggccttgcattccgggtgtttcattgtacgcagtacattcgccacggttccaaaccaatgtatacccctgaacctgatatatgtcatgaacttttgggacatgtgcctttgttttcggatcgctcgtttgcacagttttcccaggagattggcctcgcatcccttggagcaccggacgaatacattgaaaagttggctacgatctactggtttaccgtcgaatttggcctttgtaagcaaggggattccattaaggcctacggagcaggtctgctgtcatcgttcggggaactgcagtactgtttgtcggaaaaacctaagttgcttccgctcgaactggagaaaaccgccatacaaaactacacggtgactgagtttcaacctctgtactacgtcgcggaaagttttaacgatgcaaaggagaaggtgcgcaactttgcagcaaccattccacgcccatttagcgtgcggtacgatccctatacccaacggattgaggtgcttgataatactcagcaactcaagattctggcggacagcattaacagcgagataggaatcttgtgctcggcacttcagaagataaaa

SEQ ID NO: 17909 - DNA, 1356 bp, Artificial Sequence
  Description of Artificial Sequence: Synthetic coding sequence
atgagcactgccgtgctggagaaccccggacttggccgcaagctgtcggatttcggacaggaaacttcctacatagaagataattgtaaccagaacggagcgatttcacttatcttttcgctcaaggaggaagtcggtgccctcgcgaaagtgctgagactgtttgaagagaacgatgtcaatcttacccatattgaatccaggccaagcagactcaagaaggacgaatacgagttctttacgcatctggataagcgctcgcttcctgcgttgaccaacatcatcaagatcctccgccatgatattggcgctaccgtgcatgaactgtccagggataagaagaaggatactgtgccttggttcccgagaactatccaggaactggaccgcttcgcaaaccagattctctcgtacggtgcagaacttgacgcagaccatccaggttttaaggatcccgtgtaccgtgcacgtcgtaagcaatttgccgatattgcgtacaactacagacatggtcaaccaattccacgggtggagtatatggaagaggagaaaaagacgtggggcactgtgtttaagaccctcaagagcctgtacaagactcatgcctgttacgaatacaatcacatatttccactcctggaaaagtactgcgggtttcacgaggacaatatcccccagcttgaggatgtgtcccaattcctgcaaacttgtactggatttaggcttaggccagtggcagggctgcttagctccagagattttcttggcgggctcgccttcagagttttccattgcacccaatacatcagacacggttccaagccgatgtacactccagaaccagacatttgtcatgaacttctgggacacgtgcccctgttttccgatcgatcgtttgcccaattttctcaagagataggactggcatcccttggcgcccctgatgagtatatcgagaaactggccaccatatactggtttaccgtcgagtttgggctttgtaaacaaggcgatagcataaaggcttatggtgcgggcttgctctcctcgtttggggagcttcagtactgtctttccgagaagccgaagctcctcccactcgaactggaaaaaaccgcgattcaaaactacactgtgactgagtttcaacctctttactacgtcgccgaatcgttcaacgatgcaaaggaaaaggtgcggaactttgcagcaacgattccccgccctttctcggtgcgttacgacccctacactcaacggatcgaggtccttgataatacgcaacaactcaagatcttggcagattccattaactccgaaatcggcattctgtgttcggccctccagaagataaag

SEQ ID NO: 17910 - DNA, 1356 bp, Artificial Sequence
  Description of Artificial Sequence: Synthetic coding sequence
atgtcgactgcagtgctcgaaaacccaggactgggtcgcaaactttcagactttggacaagagacgtcgtacatcgaggataactgtaatcaaaatggtgcaatcagccttatcttttcccttaaggaagaagtgggagcacttgcaaaggttctgcggctgtttgaggaaaatgatgtcaatcttacccacattgaatccagaccaagcagacttaagaaggatgaatatgagttctttacccacctcgataagcgttcactgcccgcgctgactaatatcataaagatcctccggcacgatattggagcaaccgtgcatgaactctccagggataagaaaaaggataccgttccgtggtttcccaggacgatacaggagctggaccgctttgccaaccagatcttgagctacggggccgaactggatgcagaccaccctggatttaaggatcccgtctaccgtgccagacggaagcaattcgctgacatcgcatacaactacaggcacggtcaacccattcctcgcgtggagtacatggaagaagagaaaaagacttggggtaccgtgttcaagacccttaagagcttgtacaagacgcacgcatgctacgaatacaaccacatttttcctcttcttgagaaatactgtggtttccatgaagataacatacctcagttggaagatgtgtcacaatttctccagacttgtactgggtttcgcctgcggccggtcgcaggcctgctgtcatcgcgcgactttctcggcggactcgccttcagggtgtttcattgcacccagtacattcggcatggaagcaagccaatgtacaccccggaacctgatatctgtcacgaactgcttgggcatgtgccgctgttctcggatagatcgtttgcccaattttcgcaagagattgggctcgcctcacttggagcccctgacgaatacatcgaaaagctggcaacgatttactggtttactgtggagtttggcctgtgcaagcagggagattcgattaaggcctacggagcaggccttttgtcctcgttcggcgaactgcagtactgtctgtcggaaaagccaaaacttctgcccctggagctggaaaagactgccattcagaactacactgtcaccgaattccaacctctttactacgtggcagaatcatttaacgatgcaaaagagaaagtgcgaaacttcgcagccactatacctagacctttttccgtgcgatacgacccatacacccaacggatcgaggtccttgataacacccaacagctgaaaattctcgccgactcaatcaactcggaaataggaatactttgctccgcccttcaaaagatcaag

SEQ ID NO: 17911 - DNA, 1356 bp, Artificial Sequence
  Description of Artificial Sequence: Synthetic coding sequence
atgtctacagcagtccttgaaaatcctggtttaggacgaaaattgtcagattttggacaagaaacatcatatatagaagataactgtaatcaaaatggtgctatctctttaattttttcacttaaagaagaagtcggagcattagcaaaggttttaagactttttgaagagaatgacgttaatttaacacatattgaatctcgaccatctagattaaaaaaagatgaatatgaatttttcactcatttagataaaagatctttgccagctttaacaaatattattaaaattttacgacatgatattggagctactgttcatgaactttctagagataaaaaaaaagacacagttccatggttcccaagaacaattcaagaacttgatagatttgcaaatcaaatattatcatatggagctgaattagatgctgatcatcctggatttaaagatccagtttatagagctagaagaaaacagttcgctgatattgcatataattatagacatggacaaccaattccaagagtagagtatatggaagaagagaaaaaaacatggggaactgtatttaaaacattaaaatctctctataaaactcacgcatgttatgaatataatcatatttttccattacttgaaaaatattgtggttttcatgaagataacataccacaattagaagatgtctcacaattcttacaaacttgtactggatttagattaaggccagtagcaggacttttatctagtagagattttttaggtggtttagctttcagagtatttcattgtacacaatatattagacatggatcaaaacctatgtatacaccagaaccagatatttgccatgaattattaggacatgttccattatttagtgatagatctttcgcacaattctcccaagaaattggactagctagtcttggagctccagatgaatatattgaaaagttagcaacaatctattggtttacagtcgaatttggtctttgtaaacaaggagattcaattaaagcttatggagcaggattgttgagttcctttggagaattacaatattgtttaagtgagaaaccaaagttattgccattagaacttgaaaaaacagctattcaaaattatacagttacagaatttcagccattatattatgtagcagaatctttcaatgatgcaaaggaaaaagttcgaaattttgctgctacaatccctagaccattctcagttagatatgatccatatactcaaagaatcgaagttttagataatacacaacaattgaaaattcttgcagattcaatcaactcagaaattggaattttatgtagtgcacttcaaaagattaaa

SEQ ID NO: 17912 - DNA, 1356 bp, Artificial Sequence
  Description of Artificial Sequence: Synthetic coding sequence
atgtctaccgcagtactggaaaacccaggcctggggagaaagctgagcgattttggacaggagacttcatacattgaggataattgtaatcagaatggcgcgatctcccttatcttctctctgaaggaggaagtgggcgccctggctaaagtcctgagactgtttgaagaaaatgatgtgaacctgacacacatcgagtcacgcccgagtcgactcaagaaagacgaatatgaattcttcacgcacctcgacaagaggagcttgcccgctctcactaacatcatcaagatcctcagacacgacattggggccaccgtccatgaactgagtcgcgacaagaaaaaggacaccgtaccgtggttcccccggacaatccaggagttggaccgcttcgccaaccagatcctctcttacggcgcagaactggatgcggatcatccaggattcaaggatcccgtgtaccgcgcacgaagaaagcagttcgctgatatcgcttacaattacagacacggtcagcctatccctagggtggagtacatggaggaagaaaagaaaacatgggggaccgtgttcaagactctgaaatccctgtacaagacccacgcatgctacgaatacaatcatatatttcccttgctcgagaagtactgcgggtttcacgaggataacataccgcagctggaggacgtgagtcagttcctgcagacttgcaccggttttcggctcagacccgtagccggtttgctctcaagcagggactttttgggaggattggccttcagagttttccactgcacccagtacatcaggcatggaagtaagcccatgtatactcctgaacccgacatctgccacgaactgctgggtcacgttccactgttctctgaccggtcattcgcccagttttcacaggaaatcgggcttgcctctctgggggcacctgacgagtacatcgaaaaactcgctaccatctattggttcaccgtggagtttgggctttgcaagcagggagattccattaaggcttacggggctggactgctgagctcattcggcgagttgcagtattgcttgtccgaaaagccaaaactgctccccctggagctggagaagacagctatacagaattacaccgttactgagtttcagcccctctactatgtggccgaaagctttaacgacgccaaggagaaggtacgcaattttgccgcgactattccccgaccattcagcgtgcgctacgatccatacacgcagcgcatcgaggtgctcgacaacactcagcagctcaagatccttgctgatagcatcaacagcgagatcggcatcctgtgcagtgccctgcagaagatcaag

SEQ ID NO: 17913 - DNA, 1356 bp, Artificial Sequence
  Description of Artificial Sequence: Synthetic coding sequence
atgtcgaccgccgttcttgagaacccagggctgggacgaaagttgtccgattttggacaagaaacctcgtatatcgaagataattgcaatcaaaacggcgcgatatcactcatcttttcccttaaggaggaagtgggggcacttgcgaaggtcctcagactttttgaggaaaacgatgtgaacctgactcatattgagtcacgcccttcgcggctcaagaaggatgaatacgagttctttacccatcttgataaacgctcgctcccagcactcactaacattatcaaaattctgaggcacgacattggcgcgaccgtgcacgagctttcccgggataagaaaaaggatactgtgccttggtttcctagaactatccaagaacttgatcgttttgccaatcagatactgtcgtacggtgcagagcttgacgcagatcacccgggatttaaggatcctgtgtacagggcacgcaggaaacaattcgcagacatcgcctacaattacagacatggtcaaccaatcccccgcgtcgagtacatggaggaggagaaaaagacctggggaaccgtgttcaagactcttaaaagcctttacaaaactcacgcttgttacgaatacaaccacatttttcccctcctggaaaagtactgtggctttcacgaggataacataccacaactggaagatgtgtctcaatttcttcaaacgtgcactggattccggctcagaccagtggcagggcttctttcctcgcgtgattttcttggaggtcttgcatttcgggtgtttcattgtacccaatacattaggcatgggtcgaagcctatgtacacccccgaacctgatatttgtcatgagctcctcgggcacgtgccattgtttagcgatcggtcgttcgcacagttctcgcaggaaatcggactcgcttcgctgggagccccagatgaatacatcgaaaaacttgcaactatatactggttcaccgtggaattcggattgtgtaaacagggcgactcaatcaaggcatacggagcaggtttgctgagctcctttggtgaactccaatactgcctttccgagaagccaaagctcttgccacttgagctggaaaagaccgcaatccagaactacactgtgactgaatttcagcccctttactatgtggcagagtcattcaacgatgcaaaggaaaaggtccgcaattttgcggcaaccatcccaagacccttttcggtccgttacgacccatacactcagcgcatcgaggtgctggataatacgcagcagcttaagatactcgcagactcaatcaactccgaaattgggattttgtgttctgcccttcaaaagatcaag

SEQ ID NO: 17914 - DNA, 1356 bp, Artificial Sequence
  Description of Artificial Sequence: Synthetic coding sequence
atgtccacagccgtgctggaaaaccccggactgggtaggaagttgagcgatttcggccaggagacatcctacattgaggataattgcaaccagaacggggcgatctctttgatattcagtctgaaggaggaagtaggggcactcgctaaagttttgcgacttttcgaggaaaatgatgttaatctgacccacatcgagtcccgcccatcgcggctgaagaaggatgaatacgagttcttcacgcatcttgataagaggagtctgcccgctctcactaatataatcaaaattctccggcacgacatcggggccacagtgcacgaattgagtcgcgacaagaaaaaagacaccgtgccttggttcccgcgcacaatacaggagctcgacaggtttgctaaccaaatactctcatatggggccgaattggatgccgaccatcctggcttcaaagaccctgtgtatcgagctagacgcaaacaatttgcggacatcgcttacaattacaggcatgggcagcctattcctcgcgtggagtacatggaggaggagaaaaaaacatggggaacggtgttcaagacgcttaagagtctctataagacccatgcatgctacgaatacaaccacatcttccccttgctcgaaaaatattgcggattccatgaagataacatcccccaactggaggatgtttcacagttcctgcaaacatgcacaggttttaggcttagaccagtggccggcctgctgtccagtcgcgactttctgggcggcctggcctttcgagtattccattgcacacaatatatcaggcacgggagtaaacccatgtatactcctgagcctgatatttgccatgagctactggggcacgtgcccctcttcagtgacaggtcctttgcccagtttagccaggagatcggcctagcctcccttggggctcccgatgaatatatagagaagctggcgaccatatactggtttacagtcgaattcggtctctgcaaacagggtgactctattaaggcatacggcgccggcctcctttcctcctttggcgaattacaatactgcctgtcagaaaaacctaaactcttgcctttggaactggagaagactgcgattcaaaattacactgtgactgaatttcaaccactatattatgtcgcagaatcatttaatgatgcaaaagagaaagtgcgcaacttcgctgcaaccattccccgccctttttccgtccgctatgatccctacacacaacgcatagaggtgctggataatactcagcagcttaagatcctggccgattccatcaattcagagatagggattctgtgttctgcgctgcagaagattaag

SEQ ID NO: 17915 - DNA, 1356 bp, Artificial Sequence
  Description of Artificial Sequence: Synthetic coding sequence
atgagtacagccgtcctggaaaacccaggcctaggtagaaaactgtccgactttggtcaggagacgagctatatcgaggacaactgtaatcagaatggcgctatctctttaattttcagcctcaaggaggaggtgggtgctctcgctaaggtgcttcggctctttgaggagaacgacgtgaatctcacccacatagagtctaggccctctaggctaaagaaggatgagtacgagttctttacacatttggacaagagatcattaccggcactcacaaacattattaagattctgcgccacgatatcggcgccaccgtgcacgaactgagtcgcgacaagaaaaaagacaccgtcccttggtttccacgcacaatacaggaattggacaggtttgccaatcagattttgagctatggcgcagagctcgacgccgatcaccctggctttaaagatcccgtttatcgagcaagaagaaagcagttcgccgatatcgcctataattaccggcatggtcagccaatacctcgcgtagagtatatggaggaggagaagaagacatgggggactgtttttaaaactctcaagagtttatataaaacacacgcttgttatgaatataaccatattttccctctgctcgaaaaatactgcggttttcacgaagataatataccacagctggaggacgtgtcccaattcctgcagacatgtactggctttcggctgcgccctgtggctggcctgttatcaagccgcgactttctgggaggcctggcctttcgagtgttccactgcacccagtacatcagacacggatccaagcccatgtacacacctgagccagacatttgccatgagctgctggggcatgtgcctctgttttccgaccgaagtttcgcacagttttcccaagaaatcggactggcatccctaggcgccccagacgagtacatagaaaagctggccacgatttattggtttacagtggagtttggcttatgtaagcagggggattcaatcaaggcttacggcgccggtctcctgtcatcctttggagaactgcaatactgcctctcggaaaagcctaagttgcttcccctggagttggagaaaaccgctatccaaaattatacggtgacagagtttcaacccctctactacgtggcggaatcctttaacgacgcgaaagaaaaggtaagaaatttcgccgccacaattccccggcctttcagcgttaggtacgacccctatacccaacgcatcgaggtgttggataatactcagcaactgaagattctcgctgactccatcaatagcgagattgggatcctgtgcagcgctctgcagaaaattaaa

SEQ ID NO: 17916 - DNA, 1356 bp, Artificial Sequence
  Description of Artificial Sequence: Synthetic coding sequence
atgtccaccgccgtgctggaaaaccctggcctgggtcggaagctgtccgattttggtcaagaaacatcctacatcgaggataactgcaatcagaacggtgccataagtctgatttttagtttaaaggaggaagtgggtgcgctggccaaggtactacggctgttcgaggagaacgacgtgaatctaacccatatcgaatcaaggccgtctagactgaagaaggacgagtatgagttctttacccacctcgacaagcgttcacttcctgcgctgacaaatatcatcaagatccttaggcatgacatcggtgccaccgtgcacgaactctcccgggacaaaaaaaaggataccgtcccttggttcccgcgcaccatccaggaactggaccggtttgctaaccagattctgtcctatggagctgagctggacgccgatcaccctggcttcaaggacccagtgtatcgggcccggcggaagcagtttgctgacatcgcttacaactataggcatgggcagccaatacccagggtggagtacatggaagaggaaaaaaagacttggggtaccgtctttaagacactcaagtctctttacaagactcatgcatgctacgagtataaccatatattccctctgctagagaagtattgtggcttccatgaagacaatattccacagcttgaggacgtgagccaatttctgcagacctgcaccgggttccggctccggccagtagccggactgctctcgtctagagactttctcggcggcctggccttcagagttttccactgcacccagtacattagacacggctccaagcctatgtatacacctgagccagatatatgccatgaactcctggggcacgtcccgttgttcagtgacagaagcttcgcacagtttagccaggagatcggactcgcttctctgggagcccccgacgaatatatcgaaaagctcgcaacaatttactggtttactgtcgaatttggcctgtgcaaacagggtgactctataaaggcttacggagccggtctgctaagttccttcggcgagctgcaatattgtctctccgagaagcctaagctacttcctctcgagctggagaaaaccgccattcaaaattatacagtgacagagttccagcctctgtattatgttgccgagagcttcaatgacgccaaggagaaggtccggaactttgccgccactataccacggcctttcagcgtgaggtatgatccctatacccaaagaatagaggttctggataacacacagcaacttaagattctcgccgattcaatcaacagcgagatcggtatcttgtgctccgcactccaaaaaatcaag

SEQ ID NO: 17917 - DNA, 1356 bp, Artificial Sequence
  Description of Artificial Sequence: Synthetic coding sequence
atgagcacagctgttttggaaaatccaggactgggccgcaagctgagtgacttcggccaggaaaccagttacatcgaggacaattgtaatcagaacggtgccatctccctgatcttttccctcaaagaagaggttggagctcttgccaaagttcttaggctctttgaagagaacgacgtgaacctgacccacatcgaaagcaggcccagtaggctgaagaaggatgaatatgagtttttcacccacctcgacaagaggtccctcccagcactgaccaatattatcaaaatccttcgccatgatatcggcgcaacggtgcacgagctgtccagagacaaaaaaaaggacacagttccgtggtttcctaggacgatccaggaactggacagatttgctaatcagattctcagttatggcgctgaactggacgcagaccaccccggctttaaagaccctgtgtacagagctagaagaaaacagttcgccgacattgcttacaattaccgccatggacaacctatcccacgcgtcgagtacatggaggaagagaaaaagacgtggggaaccgtcttcaagaccctgaaatctctttataagacccatgcctgctatgagtacaaccatattttccctctgctcgaaaaatactgtggtttccacgaggacaacatacctcagctcgaagacgtatcccaatttctgcagacatgcacaggatttagactcagacccgtggccggactgctctcttcaagagactttctgggaggccttgcattcagggtctttcattgtacccaatacatcagacacggcagcaaacctatgtacaccccagagcccgatatatgccatgagctccttggccatgtgccgctcttctcagatcgcagcttcgcgcaattcagccaagagattggactggcttctctcggcgctccagacgaatacatcgaaaagctcgctactatctattggtttacagtggaattcggtttgtgcaaacaaggagacagtatcaaggcctatggagcgggactgcttagtagtttcggcgaacttcaatactgcctttcagagaaacccaagcttcttcccctggagctcgaaaagactgcgattcaaaattacactgtcactgagttccaacccctctattacgtcgctgagtcttttaatgacgccaaggaaaaggtgagaaattttgctgccactattccaagaccattttcagtccgctatgacccctacacccagagaatagaagtgttggacaacacccagcagctgaagatactggcagacagtatcaattctgagatcggaatcctgtgcagtgcactgcagaagattaag

SEQ ID NO: 17918 - DNA, 1356 bp, Artificial Sequence
  Description of Artificial Sequence: Synthetic coding sequence
atgagcactgcagtgctggaaaaccctggtctgggcagaaagctgtccgatttcgggcaggaaacctcttatattgaggacaactgtaaccagaacggcgcgatctccctgattttctccctaaaggaagaggttggcgccctggcaaaggtactgagactctttgaagagaatgatgtgaacttgacacatatcgagtcaaggcccagccggcttaaaaaggatgaatacgaattcttcacacatctagacaagcgaagtcttccagctcttaccaatatcatcaagatcctccgacatgacatcggagctacagttcacgaattgtctagagataagaagaaggacacagttccttggtttcctcgaacaattcaggaactggatcgtttcgcaaaccaaatacttagttatggtgccgaacttgatgccgaccatcctggcttcaaggacccagtctaccgagccaggcgaaaacaattcgcagacatcgcttacaattatcgtcacggacagcccatacctagagtggagtatatggaggaagagaagaaaacatggggcaccgtctttaagacgctcaaatcattatacaagacacacgcatgctacgagtacaaccacatcttcccactactcgagaagtactgtgggttccatgaagataacatccctcagctggaagacgtaagccagtttctgcaaacttgcacgggcttcagattgcgccccgttgctgggctgcttagtagccgtgactttctgggagggttggcgttccgagtgttccactgcacgcagtatatcagacacggaagcaagccaatgtatactcccgagccagatatctgccatgaactcttggggcacgtgccacttttttccgaccggtctttcgcccaattcagtcaagagattgggttggccagcctgggcgcccccgacgaatacatcgaaaagctggcgacgatttattggttcactgtagaattcggcctgtgcaagcagggtgactcaatcaaggcctacggtgctgggttgctgagctcatttggtgaactgcagtattgtttgagcgagaaaccaaagcttctgccccttgagctagaaaaaactgccatccaaaactacacggttacagagttccagccgctttactatgtagctgaatcatttaacgacgccaaggaaaaagtgaggaatttcgcagccaccataccaaggcctttctcggtgagatacgatccttacacacagagaatcgaagtgcttgataatactcaacagctcaaaattctggcggactcaattaattccgagattggaatcctatgttctgcgctccagaagattaaa

SEQ ID NO: 17919 - DNA, 1356 bp, Artificial Sequence
  Description of Artificial Sequence: Synthetic coding sequence
atgtccacagccgtgctggagaatccaggtctcggacggaaactctccgattttggccaggaaacctcgtacatcgaggacaattgcaatcagaacggcgccatctccctaatcttttccctgaaagaggaggtaggagccctcgctaaagtacttcggctttttgaggaaaacgacgttaacctgacacacatagaatcaaggccctctcgcctgaagaaggacgaatacgaattcttcactcatctggataagcgaagcctgcctgccctcactaatatcatcaagattctgagacatgacattggagctactgtccacgagttgagcagggataagaaaaaggataccgtgccttggtttccacgcacaatccaggagttagatcgcttcgcgaatcagatattatcttacggcgccgagcttgatgccgatcatcctggcttcaaggaccctgtgtatagggcacgccgtaaacagttcgccgatatcgcgtacaactatcggcacgggcaaccaatcccaagggtggaatatatggaggaagaaaaaaagacttgggggacagtgtttaagaccctgaagtcactgtacaagacccatgcgtgctatgagtataatcacatttttccccttctggagaaatattgtggttttcacgaagataacataccccagctcgaggatgtgagccagttcctgcaaacatgcactgggtttaggctgcgacctgtggcggggcttctgagttcacgtgactttctcggagggctggcttttagagtcttccactgcacgcagtatatacggcatggctctaagccaatgtacaccccagaacccgacatttgccatgagctgctggggcacgtccctctgttttctgaccgcagctttgcacagtttagccaagagatcggcctggcttctctgggagctccagacgaatatatcgaaaaacttgcaaccatttactggttcaccgttgagttcgggttgtgcaagcagggcgacagtattaaagcctacggcgccggactgctttcctctttcggggagctgcagtactgcctaagcgaaaaacctaaactgctccccctagagctagagaagaccgcaatacaaaactatacggtcaccgagtttcaacctctctactacgtggccgagagcttcaacgacgcaaaggaaaaagttagaaacttcgccgccacgataccacggcccttctcagtcaggtatgatccgtatactcagaggatcgaagttctggacaacacacagcaattaaaaatcctggccgactcgatcaattccgaaattggaatcctctgttccgctctccaaaaaattaag

SEQ ID NO: 17920 - DNA, 1356 bp, Artificial Sequence
  Description of Artificial Sequence: Synthetic coding sequence
atgtcgacagctgtcttggagaatcccggattaggacgaaagctctccgacttcggccaggagacctcctatattgaggacaactgtaaccagaatggtgccatatcgttgatctttagcctgaaggaagaggtgggagctctcgcaaaagtcctgagactttttgaagaaaatgatgtgaacctgacccacattgagtcacggccatctcggctgaagaaggatgagtatgaatttttcacccacttggacaaaagatcattgcccgccctgaccaacatcatcaagatcctgcgccacgatatcggcgccacagtccacgagttgagccgcgacaagaaaaaggataccgtgccctggttcccgcgaactattcaggagctcgaccggttcgccaatcaaattttgtcctatggggccgagttagatgctgaccaccctggcttcaaggaccctgtgtacagagcgcggcgcaaacagttcgccgacattgcatacaattatcgccacggacagcctatcccccgggtcgaatatatggaagaggagaagaagacatggggaaccgtgtttaagaccttgaaaagcctctataagacacatgcctgctatgagtacaatcatatctttccactgctcgagaaatactgtgggttccacgaggacaatattccccagctcgaggatgtctcccaattcctccagacttgcaccggattccgattgcggcctgtggccggtttactctccagtcgggatttcttgggtggccttgcattcagggtattccactgtactcaatatataaggcacgggagtaagcccatgtacacccccgagccagacatctgtcacgagctcttgggccacgtgcccctattttccgatcggtcctttgcgcagttcagccaggagataggcctcgcctccctgggcgcacctgacgaatacattgagaaacttgctaccatctactggttcacagtggaattcggactgtgcaaacagggtgatagcatcaaggcctacggcgccggtctgttatctagtttcggagagttgcaatactgcctgtccgagaagcccaaacttcttcctctcgaattagaaaaaaccgctatacagaactatactgtcaccgagtttcagcccctgtactacgtcgcggaatcttttaacgacgctaaggagaaggtacgcaatttcgctgctacaattcctcggcccttttccgtacggtacgacccctacacccagcggatagaagtcttggacaacacgcagcagctgaagattttggcagacagcataaattccgaaatcggcatcctgtgttccgccctgcagaagatcaaa

SEQ ID NO: 17921 - DNA, 1356 bp, Artificial Sequence
  Description of Artificial Sequence: Synthetic coding sequence
atgtccaccgccgtcctggagaacccgggcctcggccgtaagctgagtgattttggccaggaaacttcatatatcgaagataactgcaatcaaaatggggccatcagcctcatcttcagcctgaaggaggaagttggagctcttgctaaagtgctgaggctctttgaagaaaacgatgtaaatctgacccacatcgagagccgaccctctcgcctcaagaaggatgaatatgagttttttacacacctggataaacgaagcctccccgccctcactaacattataaaaatcctacgccacgatataggtgccacagttcacgaactatcccgcgacaagaagaaggatacagtgccttggtttcctcggaccatacaggaactggatcgatttgccaaccagatactgagttacggtgcagagctggacgcagaccaccccgggttcaaggaccccgtatatagagcccggcgtaagcaattcgcagacattgcttacaattaccggcacggacagccaataccgcgagtggaatacatggaagaggagaaaaaaacctgggggaccgtgttcaagacactgaaatcactttataagacacatgcatgttatgaatataaccatattttcccactgctggagaagtattgtggatttcacgaggataatattcctcagctagaggacgtgtctcaatttctccagacctgtaccgggttccggctgagaccagtcgcaggtctcttaagcagtagagattttctcgggggactcgccttcagagtgtttcattgcacccagtacataagacatggttctaaaccaatgtacacccccgagccggatatctgtcatgagctgctgggccacgtgcccctattcagcgataggtctttcgctcaattcagccaggagatcggtcttgcatccctgggggcccccgacgagtacattgagaaacttgcaaccatctactggtttaccgtagagttcggcctctgtaagcagggcgattctatcaaggcatatggagctggtctgctcagcagctttggggagttgcaatactgtctgagcgagaagcccaagttgctgccactggagctagagaaaacggccattcaaaattatacagtgactgagtttcagccattgtactatgtggcagaaagttttaatgacgccaaagagaaagtgagaaattttgcagcaacaatccctaggcccttttctgtgcgttatgatccatatactcagaggatcgaggttcttgataatacccagcagctcaagatcctggccgattccattaactcagagatagggattctgtgctctgcactgcagaagatcaaa

SEQ ID NO: 17922 - DNA, 1356 bp, Artificial Sequence
  Description of Artificial Sequence: Synthetic coding sequence
atgagcaccgcggtcctcgaaaacccgggactgggccgaaaactctcagatttcggacaagaaactagttacattgaggacaactgcaatcaaaatggggctattagcctgattttttccttaaaggaggaggtaggggcactggctaaagtgctcaggctttttgaggagaatgatgtcaacctgacacacatcgagtctcgcccttccaggcttaagaaagatgagtatgagttttttacacacctcgataagaggtcactgcccgcactgacgaatataatcaaaatactccgtcacgatataggtgctacggttcacgagctgtcacgggataaaaagaaggatacagtgccatggtttccacgaacgatccaagagctggatcgatttgccaaccagatcctgtcctacggagccgagctggatgcagaccaccccgggtttaaggatcctgtgtaccgcgcccgacgaaagcagtttgccgacattgcctataactaccgacacgggcagccaattcctagggttgaatatatggaagaagaaaagaagacgtgggggacggtcttcaagacactgaaaagtctgtacaaaacccacgcatgttatgaatataaccacatcttcccactgctagagaagtattgcggattccatgaggataatattccccagctggaagatgtgtcccagtttttacagacatgcaccggattccgactgcgacctgtggccggcctgctcagctcccgagattttttgggtgggctagctttcagggtgttccattgcacacagtacatcagacatgggtccaagccaatgtatacgcctgaaccagatatctgtcatgagctcctcggacacgtgccactctttagtgatcgcagctttgcccaatttagccaagagatcggactcgcctcattgggcgcacccgatgagtacatcgaaaagctggcgacgatttactggttcactgtggagtttggtctgtgcaaacagggggactctatcaaggcttatggggccggcttgttgagttcattcggagaactgcagtattgcttgtccgagaagccaaaactgcttccattggagctagagaaaactgccatccagaactacacagtcaccgagtttcagcccctctactacgtcgctgaatcctttaacgatgctaaagagaaggtgaggaactttgcagcaactattcctcggccattctcagtgaggtatgacccctacacccaacgcatcgaggtccttgataatacgcagcagctgaagatcctagctgattcaattaactctgagatcggaatcctctgtagcgctctccagaagataaaa

SEQ ID NO: 17923 - DNA, 1356 bp, Artificial Sequence
  Description of Artificial Sequence: Synthetic coding sequence
atgtcaactgcggtgttggagaatcccggtctgggcaggaagctgtcggactttgggcaggagacgtcgtatatcgaagataattgcaaccagaacggcgcgatttcgctcattttcagcctcaaagaggaggtgggagccctggcgaaagtgttgaggctgttcgaagaaaatgacgtcaacctcactcatatcgagagcagaccgtcgcgtctcaagaaggatgagtacgagttctttactcatctcgataagcgctcccttccagccctcactaatatcatcaaaatccttcggcatgacattggcgccacggtgcacgaactgtcccgggataagaagaaggataccgtgccatggtttccgcgcactatccaggaactggaccgctttgcgaatcagatcctgtcatacggagcagaattggacgctgatcacccaggatttaaggatccggtctaccgcgcgcgccggaagcaatttgcggacattgcctacaactaccggcacggtcagccaatcccgcgcgtggagtacatggaagaagaaaagaaaacttggggaactgtgttcaagaccctcaaatcgctctacaaaactcacgcctgctacgagtacaatcacatttttccactgctggagaaatactgtgggttccacgaggacaacatcccgcagctcgaggatgtgtcacagttcctgcaaacctgcaccggatttcgcctccggcctgtggcgggtctgctgtcaagccgggacttcctcggaggcctggcgttccgcgttttccactgcacgcaatacattcgccacggatcaaaaccgatgtacaccccagagccagacatctgtcatgaactcttggggcacgtcccgctgttctccgatcgctcattcgcccagttcagccaggagatcggactggctagcctgggagctccggacgaatacatcgagaagttggcgacgatctattggtttaccgtggaatttggactttgcaaacaaggagactcaatcaaggcatacggcgcaggcctcttgtcctccttcggagagctccagtactgcctttcagagaagccgaaactgctgccacttgaattggaaaagactgcgatccaaaactacaccgtcactgagttccagccgttgtactacgtggccgagtcctttaatgacgcgaaggaaaaggtgaggaatttcgctgccaccatcccgcgcccctttagcgttaggtatgatccctacactcaacggattgaagtcctggataatacccagcaacttaagattctggccgattcaatcaatagcgaaatcggaatcctgtgttcggctctgcagaagattaag

SEQ ID NO: 17924 - DNA, 1356 bp, Artificial Sequence
  Description of Artificial Sequence: Synthetic coding sequence
atgagcacggcggtcctcgagaatcctggcctgggacgcaagctgtcggatttcggacaagaaacttcatacattgaagataactgtaaccaaaatggcgcaattagcctgattttcagcttgaaggaagaagtgggagcacttgcgaaggtgcttagattgtttgaagaaaacgatgtgaaccttactcacattgaatcacggccatcgagactgaaaaaggatgagtacgaattctttacccaccttgacaagcgctccctcccagccctgactaacatcattaagattctccgacacgatattggggcaactgtccatgaactttcgagagacaagaaaaaggacaccgtgccttggttcccacgaactattcaagaacttgatcggttcgctaatcagattctttcatacggagctgagcttgatgcagatcatcccggcttcaaggatcctgtgtaccgcgcgaggcgcaaacagttcgcggatatcgcctacaattaccggcacggacagcccatcccccgcgtcgaatacatggaagaagagaagaaaacttggggcaccgttttcaaaacccttaaatcgttgtacaaaacgcatgcctgctacgaatacaaccacatctttcctcttcttgaaaagtactgcggtttccacgaggataacattccccaacttgaggacgtgtcgcagtttttgcaaacttgtaccggatttcggctccgccccgtggcaggtctgctgtcgagccgcgattttctcgggggacttgcattccgagtgtttcattgcacccagtacattaggcatggatccaagccaatgtatacccctgaacccgatatatgccacgagctgttgggtcacgtcccgctcttttcggacagatcgtttgcccaatttagccaggaaattgggctggcaagcctgggtgcacctgacgaatacatcgaaaagttggccaccatttactggttcactgttgagttcggactgtgtaagcaaggagattccattaaggcatacggtgcagggctcctctcatccttcggcgagctccaatactgcctttcagaaaaacccaagctgctgcctctggaactggaaaagacggcaattcagaattacacggtgactgaatttcaaccactctactacgtggccgaatcctttaatgacgccaaggagaaggtgcgcaattttgcagcgaccatccctcgcccatttagcgtgagatacgatccttacacccagcgtattgaagtgctggataacacccaacagttgaaaatacttgccgattccatcaactccgaaatcggaatcctttgtagcgctctgcaaaagattaag

SEQ ID NO: 17925 - DNA, 1356 bp, Artificial Sequence
  Description of Artificial Sequence: Synthetic coding sequence
atgtccactgccgtgctggaaaacccggggctcggcaggaaactttccgatttcggacaagaaaccagctacatagaggacaattgtaaccaaaatggggccatctcgctcatcttttcactgaaggaggaagtgggggcactcgctaaggtgcttagactgttcgaagaaaacgatgtcaacttgacccacattgaatccaggccttcccgcctgaagaaagacgagtatgagttctttacccatctggacaagcggtcccttcctgcgctgactaatatcattaagatcttgcggcacgacattggcgcaaccgtgcacgaactgtcgcgagataagaaaaaggatactgtgccctggttccctaggaccatccaagagctggatagattcgcaaaccagattctgtcctacggagcagaactggacgcagatcatccaggatttaaggaccctgtgtaccgggcacggcggaagcaattcgcagatattgcgtacaattaccgccatggccaacctatccctagagtcgagtacatggaggaagaaaagaaaacctggggtactgttttcaaaactttgaagtccctgtacaaaactcacgcgtgttacgaatacaaccatatctttccactgctcgagaagtattgtgggtttcatgaagataacatccctcaacttgaggatgtgtcgcagtttctgcagacttgcacggggtttagactgaggcccgtcgcaggcctgctgagctctcgggattttcttggaggactggcatttcgagtctttcattgcactcaatacattaggcatggatcaaagcccatgtacacccctgaacctgatatttgtcatgaacttcttggccatgtgcctctgttctcagaccgttccttcgctcaatttagccaggagattggtctggcttcgcttggtgccccagacgaatacattgagaagctcgcgaccatttactggtttaccgttgagtttggcctttgcaagcaaggtgacagcataaaggcatatggagcaggtctgctctccagtttcggtgaacttcagtactgtctttcagagaaacctaagctccttccgctggagctggagaaaactgccatccagaactacaccgtgacggaattccaacctctttactacgtagcagaatcatttaacgatgctaaggaaaaggtcagaaatttcgcagccaccattcctagaccgttctcggtacgctacgatccctacacgcaacgtatcgaagtgcttgacaacactcagcagcttaagatacttgctgacagcatcaactccgaaattggaatcctgtgttccgcacttcagaagataaaa

SEQ ID NO: 17926 - DNA, 1356 bp, Artificial Sequence
  Description of Artificial Sequence: Synthetic coding sequence
atgtcgaccgctgtgctggaaaacccgggcctcgggcgaaagctgagcgacttcggacaagaaacctcctacatcgaggacaattgtaatcagaatggggctatttcactcatattctcgcttaaggaagaagtgggcgcactggcaaaggtgctccgcctgttcgaagaaaatgacgtgaacctgacgcacatcgagtcacggccaagcagactcaaaaaggacgaatacgagttcttcacccacctggacaagcgcagcttgccggccctgactaacattattaaaatcctcagacatgatatcggagcgaccgtccatgaactgagcagagacaagaagaaagataccgtgccttggttccctcggactatccaggagctggaccgtttcgccaaccaaatcctgtcgtacggggccgaactggacgcagaccaccctggctttaaggacccggtgtaccgcgccaggaggaagcagtttgccgacatcgcgtacaattaccgccacggacagcccattccaagggtggaatacatggaggaggagaaaaagacgtggggcactgttttcaagaccctcaagtccctgtacaagactcatgcctgttacgagtataaccatatctttccgctgctggagaaatactgcggcttccacgaggataatattccacaactggaggacgtctcccagttcctccagacttgcactggattccggctgcggccggttgctggtttgttgagtagcagagattttctgggaggcctcgcgttccgggtgttccactgcacccagtacatccgccacgggtccaagccaatgtacaccccggaacccgatatctgccacgagctcctcggacatgtgccgctgttctcggatcgctcatttgcgcaattctcccaggaaatcggactcgcgagcctgggtgccccggatgaatatatcgagaaacttgctactatctactggtttaccgtcgagttcggactgtgcaaacaaggagattcgatcaaagcctacggtgcgggactgctgtcgtccttcggagaactccagtactgtttgtcggaaaagccgaagctgcttccactcgaactggaaaagactgcaatccagaactacaccgtgacggaattccaaccgttgtactatgtggccgaatcctttaacgatgctaaagaaaaggtccgcaacttcgccgcgactatccctagacccttttcagtccggtacgatccatacactcaacgcatcgaggtgcttgacaacacccagcagctgaagatcttggccgactctattaactcagagatcggaatcctctgctcggcacttcagaagatcaag

SEQ ID NO: 17927 - DNA, 1356 bp, Artificial Sequence
  Description of Artificial Sequence: Synthetic coding sequence
atgagcactgcagtccttgagaaccccggcctgggaaggaaactgagtgactttggacaggagacctcttatattgaagataactgtaatcagaacggcgccatttcccttatctttagcctgaaagaggaggtgggggcactggctaaggtgctgcgactgttcgaggaaaacgacgtgaatctcacacatatcgagtctaggccgtcaaggttgaaaaaggatgagtatgagttttttacacatttggacaagagatccttgcccgccttgacaaatatcattaagatcctccggcatgacatcggggccaccgtgcacgagctttcacgcgataagaaaaaggacacagtcccttggtttccccgaacgattcaggagcttgataggtttgccaaccagatcctctcttatggcgctgagctggacgctgatcaccccggatttaaagaccccgtgtacagagctcgcaggaaacagttcgccgacatagcatacaattatcggcacggccaacctatcccaagagttgaatacatggaagaggagaaaaagacttgggggacggttttcaagactttgaagagcctctataaaacccatgcttgctatgagtacaatcatatctttcctctcctggaaaaatactgtgggttccacgaggataatattcctcagctggaagacgtaagccagtttctgcaaacatgtactggctttcgcctgcgacctgtggccgggcttctgtccagcagagatttcctcggaggcctggcatttcgagtgtttcattgtacccagtatatccggcatggcagcaagccaatgtataccccagaacctgacatttgccatgagctccttggccatgtacctctgttctctgaccggtctttcgcgcagttttcacaggagatcggtctggcgagcttgggcgctcccgatgagtacatagaaaaacttgccactatctactggttcacggtggaattcggactgtgcaaacagggcgatagcattaaggcatacggggccggactccttagctctttcggtgagctgcagtactgcctcagtgagaaacctaagttgctcccgctggaactggagaaaaccgccattcaaaactataccgtcacagagttccagccattgtattatgttgccgagagctttaacgacgctaaagagaaggtcaggaacttcgccgctacaatcccgaggccgtttagtgtgagatatgacccatatacacagagaatcgaagtgctggataacacgcagcagctcaagattctggctgattctataaattcagaaattggaattctgtgcagtgcccttcagaaaattaag

SEQ ID NO: 17928 - DNA, 1356 bp, Artificial Sequence
  Description of Artificial Sequence: Synthetic coding sequence
atgtcgaccgccgtcctcgaaaacccgggattgggacgtaagctcagcgacttcggtcaggaaaccagctacattgaagataactgtaatcagaacggagccatctccctcattttctcgctcaaggaagaggtcggtgcactggcgaaggtccttagactgttcgaagagaatgatgtgaatctgactcatatcgaatcaaggccaagccggttgaaaaaggatgaatacgaattcttcacgcatctggacaagcggtcactgccggccctgactaacatcataaagatccttagacatgacatcggggctaccgtgcacgagctgagccgcgataagaagaaggacaccgtgccgtggtttccgcggaccatacaagagttggaccgctttgccaaccaaatcctgagctatggagcggagctggatgcggaccaccccggattcaaggacccggtttaccgggccaggaggaagcagttcgctgacatcgcgtacaattaccggcacggacagccaatcccgagagtggaatacatggaagaggagaaaaagacctggggcactgtgttcaagacccttaaatcgctgtacaagacccatgcgtgctatgaatacaaccacattttcccgttgctcgagaagtactgtggcttccacgaggacaacatcccacagctggaggacgtgagccaattcttgcagacctgtactggattcagactcagaccagtggcaggactcctgtcaagccgggatttccttgggggactggcctttcgcgttttccattgcacccagtacattagacacggatccaagccaatgtacacgccggaacctgatatctgtcacgagctcctggggcacgtcccgctgttctcagaccggtcctttgcacagttctcccaagaaattggcctggcgtctctcggagccccggacgagtacatcgaaaaacttgcaactatctattggttcactgtggaattcgggttgtgcaagcagggagattctatcaaggcctacggagcaggactgctgtcctcctttggcgaactgcaatactgcctcagcgagaagccaaagctgctgccgctcgaactcgaaaagactgccatccaaaactacaccgtgaccgagttccaacctctgtactatgtggccgaatcgtttaatgacgctaaggaaaaggtgcgcaatttcgccgctaccattccaaggcctttttcggtccgctacgacccttacactcagcgcattgaggtgctggataacactcagcagctgaagattttggcggattcaattaactcggagatcggtattctgtgttccgcactccaaaagatcaag

SEQ ID NO: 17929 - DNA, 1356 bp, Artificial Sequence
  Description of Artificial Sequence: Synthetic coding sequence
atgagcaccgccgtactggaaaacccggggctggggcgcaagctgtcggacttcggacaggaaactagctatatcgaggataattgcaaccaaaatggggccatcagcctgattttctcactgaaggaagaggtcggagccctggccaaggtgctcagactgttcgaagagaacgacgtgaacctgacccacatcgaatcccgcccatcacgcctcaaaaaggatgaatacgaattcttcacccacctcgacaaaaggagcctgccggccctcactaacattatcaaaatcctcagacatgacatcggtgcgactgtgcatgaactctcacgggacaagaaaaaggacaccgtgccgtggttccctcgcaccatccaggaactggatcgcttcgcaaatcaaatcctgtcatacggcgcggagctcgatgcggaccaccccggctttaaggacccagtgtaccgagcacggagaaagcaatttgccgacatcgcgtataactaccgccacggtcagccgattcctcgcgtcgagtacatggaagaggaaaagaaaacttggggaactgtgttcaagactctgaagtcgctgtacaagacccacgcatgctacgagtacaatcatatctttccactgctggagaaatactgcggtttccatgaggacaatatcccgcagttggaggatgtgagccaattcctccagacttgtactggtttcagactcagacctgtcgcggggctgctgtcgtccagggattttctcggtggactggcgttccgggtctttcactgcacccagtatatccgccacggctcaaaacctatgtacactccagaacccgacatctgccatgaactcttgggacacgtcccgctcttctccgaccgctcgtttgcacagtttagccaagaaatcggactggcatcgctcggagcacctgacgagtacatcgaaaaactggccactatctactggttcactgtcgagttcgggctgtgtaagcagggagattcgatcaaggcctacggtgctggactcctgtcatcatttggtgagctgcaatactgcttgagcgagaagccaaaacttctgccacttgagctggaaaagactgcaattcagaattacaccgtgaccgaattccagcccctctactacgtggccgagtcctttaacgacgctaaagagaaggtgcgcaattttgccgctaccatcccgcgaccgttctccgttaggtacgatccgtatacgcaacgcatcgaagtcctcgataatacccagcagctgaagatcctcgccgattccatcaatagcgaaatcggaatcctgtgcagtgcccttcaaaagatcaaa

SEQ ID NO: 17930 - DNA, 1356 bp, Artificial Sequence
  Description of Artificial Sequence: Synthetic coding sequence
atgtccacagctgttcttgagaaccctgggcttgggaggaaattgtccgattttgggcaggaaactagttacattgaagataattgtaaccagaatggggccatctcactgatcttcagtctgaaagaagaggtgggggcactggccaaggtgctccgcctgttcgaagaaaatgacgtgaatctaactcacatcgaatcacggccttctcggctcaagaaagatgagtacgaattctttactcatctcgacaaacgctctctccctgctctaacaaatatcatcaaaattttacgccatgacatcggggcaacagtgcacgaactgtctagagataaaaagaaagatacagtgccatggttcccgcggacaatccaggaacttgatcgctttgctaaccagattctgtcatacggggcagagcttgatgccgaccacccagggttcaaagatccagtttatcgggctcgacggaaacagtttgctgatatagcttacaattatcgacatggacaacctatcccacgagtcgaatacatggaagaagaaaaaaaaacatgggggactgtgtttaaaacgctcaaatctctgtacaaaactcacgcctgctacgaatataaccatatattccctcttctggaaaaatattgtggatttcatgaagataacataccccagttagaagatgtgagtcagtttctgcagacgtgcacaggatttcgcttgagacctgtagcaggactactctcctcgagagatttcttgggagggctcgcctttcgcgtgttccactgcacacagtacatacggcatgggtcgaaaccaatgtacacacctgaacccgatatctgccacgaactactggggcacgtgcctcttttttctgatcgaagttttgcacagttctcccaggagataggactggcttcactgggagccccagatgaatatattgaaaaactcgcaacaatctattggtttacagtggaattcgggctctgtaaacagggggatagtatcaaagcatatggagccgggctgctctctagttttggggaacttcagtattgtttatcagaaaaacctaaacttttgcccctcgaactcgagaagacagccatccagaactatacagtgactgaatttcagcccctttattatgtcgctgagtcattcaatgatgcaaaagaaaaagtgaggaacttcgccgctacaatccctcgaccctttagtgtgagatatgatccctatactcagagaatcgaagtgctcgataatacacagcagctgaaaatactagcagacagtattaattctgagataggaatactctgctctgctctgcagaaaatcaaa

SEQ ID NO: 17931 - DNA, 1356 bp, Artificial Sequence
  Description of Artificial Sequence: Synthetic coding sequence
atgtccacagcggtacttgagaatcctggcttgggccgcaaactttctgactttggacaggaaacatcatatatcgaggataactgcaaccagaatggagcgatctctctcatcttttcactgaaggaggaagtgggcgccctcgccaaagtgttacgacttttcgaagaaaacgacgttaacctcacacacatcgaatcccgcccttctagactgaagaaagacgagtacgagttctttacccacctggacaagcgatccctgcctgccctgacgaacataatcaagattctgagacatgatatcggtgccacagtacatgaactgagtcgcgacaaaaagaaggatacagtgccgtggttcccacgtacaattcaggagcttgaccgcttcgcaaaccaaattctgtcttatggagcagagctggacgcagaccatccgggctttaaggacccggtttatagagctcggcgtaagcaattcgcggatattgcatacaactaccggcacgggcaaccaattcccagggtggaatacatggaagaagagaagaagacttgggggaccgtcttcaagacgctgaaatccttgtataaaacgcacgcgtgttacgaatacaaccacattttccccctgctggagaagtattgcgggtttcatgaggacaacatcccacagcttgaggatgtttcgcagtttctgcagacgtgcaccggctttcgactcaggccagtcgcgggtctcctcagttctagggacttcttgggagggctggccttccgggtctttcactgtacgcagtacatacgacacggctcaaaacccatgtatactccagagccagatatctgtcacgagctgttgggacacgtgcccctgtttagcgaccgaagcttcgctcagttttctcaagagattggattggcctcactcggggctcccgacgagtatatcgaaaaattggccactatctactggttcacagtggaattcggcctatgcaagcagggagattccattaaagcctacggggccggcctcttgagctcattcggcgagctccaatactgcctgtccgagaaacccaagttattgccgctggagctagaaaaaacagctatccagaattataccgtaactgaatttcagcccttgtactatgtggcagagtccttcaatgacgccaaggagaaagtccggaactttgccgcaacaatacctaggccatttagtgtgcgctatgatccatatacacagcggatcgaagtcctcgataacactcagcaactgaagattcttgccgattcaatcaattcagagatcgggatcctgtgttcggcgctccagaaaattaag

SEQ ID NO: 17932 - DNA, 1356 bp, Artificial Sequence
  Description of Artificial Sequence: Synthetic coding sequence
atgtctacggccgtcttagagaaccccgggctgggccgtaaactgtctgactttggacaagaaacatcttatatcgaggacaactgtaaccaaaacggcgcaatttcgcttattttttccctgaaggaggaagtgggagccctggcgaaggtcctgaggttgttcgaggaaaatgacgtgaatcttacccacatcgaatctcgcccttcacgcttgaagaaggatgagtatgaatttttcacccatctcgataaacggtctttgcctgccctcacaaatattattaagatcttgagacatgatataggcgccactgtgcatgagctatcacgggacaagaagaaagataccgtcccttggtttccacgaacaattcaagaactggaccggtttgccaatcagattctatcctatggagccgagttagatgccgaccacccgggattcaaggacccggtatatcgcgctcgccgaaaacagttcgccgatatcgcatataattaccgccatggtcaaccaatacccagagtcgagtacatggaggaggagaaaaagacctggggcaccgtgttcaagacacttaagagcttatataagacacatgcttgctatgaatacaatcatatctttcccttgctggagaaatattgcggcttccacgaggataatattccccaactggaagacgtgtcacagttcctgcagacatgcaccggttttagactgagaccagtggccggcctgttgtccagcagggattttctcggaggtctggcattcagagtgtttcactgcacccagtatatacggcatggaagtaagcctatgtacactcctgaacccgatatatgtcacgagctacttgggcacgttccactattctcggacaggtccttcgctcagttcagtcaagaaatcggtctggcatcactaggggcccccgatgagtatattgaaaaacttgccacaatatactggtttacagtcgagtttggtctgtgcaagcagggggactcaatcaaggcctatggagccggacttctgtccagcttcggcgagctgcagtactgccttagtgagaaacccaagttgctccctctggagctcgagaagactgccatccagaactacacagtaaccgaatttcaaccgctctattacgtggctgagtcattcaacgacgcgaaggaaaaagtgaggaactttgcagcgactattccacggcctttttcagtgcgttacgacccttacactcagcggatagaggtgctggacaatacacagcaactcaagattctggctgatagtattaactctgaaattggcatcctgtgtagcgctctgcaaaagatcaaa

SEQ ID NO: 17933 - DNA, 1356 bp, Artificial Sequence
  Description of Artificial Sequence: Synthetic coding sequence
atgtcgactgccgtattggagaatccaggacttggtcgtaagctgtctgattttggccaggagactagctacatcgaagacaactgcaatcagaatggtgcgattagcctgatattttcgctcaaggaagaagtgggtgcactcgcaaaggttttgaggctgttcgaggagaacgacgtgaacctcacccacattgagtcgcgaccatcaagacttaagaaagacgaatacgaattcttcactcatctcgataaacgctcgctaccagccttgacaaatattatcaagatcttgcggcatgacattggtgcgacagtgcatgagctgagccgagacaagaaaaaagataccgtcccttggtttccacgaacgatccaggaactggacaggtttgcgaaccagatcctaagctatggtgctgaacttgacgcggatcatcccggctttaaggacccggtgtaccgcgctcgcagaaagcagtttgccgacattgcatataattaccgccacggtcagcctatcccgcgggtcgagtacatggaagaagagaagaagacgtggggtaccgtcttcaagaccctgaagagtttgtataagacccatgcttgttatgagtataaccatatttttccacttctcgagaagtactgcggcttccacgaggataacattcctcagttggaagatgtttcgcaattccttcagacttgcactggtttcaggcttcgtccagtggccggacttttaagttctcgcgacttcctaggagggttagcttttcgagtcttccactgtacccagtacatacgtcatggctcgaagccgatgtacacaccggagccagacatttgccatgagttgcttggtcacgtcccgctattctccgataggtccttcgcccaattttcccaagagattggtttggcaagtctcggtgccccggacgagtatatcgaaaaactcgcaaccatttactggttcacagttgaattcggtctgtgcaagcaaggagattctataaaggcatacggcgcagggctactgtcttcatttggcgagcttcagtattgcctctcggaaaagcccaaactgttgccattagaactggaaaaaactgctatccagaattacaccgtgacagaattccagccgttgtactatgtggcggagagtttcaacgatgcaaaggagaaagtgcgaaatttcgctgcgactataccccgtcccttttccgtccgctatgacccttacacgcaacgaattgaggtcctggataacacccaacagctaaaaattctggctgatagcatcaactctgagatcggcattctttgctccgctttacagaagataaag

SEQ ID NO: 17934 - DNA, 1356 bp, Artificial Sequence
  Description of Artificial Sequence: Synthetic coding sequence
atgtcaaccgcagtgcttgagaaccccggtcttggccggaaacttagcgactttggtcaggagacttcttacattgaagataattgtaatcaaaacggagcaatttcgctgattttctcgctcaaggaagaagtgggagcgcttgcaaaagtgctgcggctctttgaagaaaacgacgtgaacctgactcacattgagtcgaggccgagccgactcaagaaggatgaatacgagtttttcacgcacctcgataagcgctcccttcctgctctcacgaacattatcaaaatcctcaggcatgatattggagctaccgtgcatgagctgagcagagacaagaagaaggatactgtgccttggtttcctcggaccatacaggaactcgataggttcgccaatcagatcttgtcgtacggcgcagaacttgacgcggatcaccccggctttaaggaccccgtctacagggcacggagaaagcaatttgcagacattgcgtacaactaccgacatggacaaccgattcctcgcgtggaatacatggaggaagaaaagaaaacttggggtactgtgttcaaaactcttaaatccctttacaagactcacgcatgttacgaatacaatcatatcttccctctcctggaaaagtactgtgggttccatgaagataacattcctcaactggaagatgtgtcgcaatttcttcaaacctgcaccgggtttagactgcgccctgtggcgggacttctttcatctcgggattttcttggagggctggcctttcgcgtttttcattgcactcagtacatacgccatggcagcaagcctatgtacacccctgagccggacatctgtcacgagctgctcggacatgtgccattgttttcggaccgctcttttgcacagttctcacaagagatcgggctggcatctctgggcgctcctgacgagtatatcgagaaacttgccaccatttactggtttaccgtggaatttggactgtgtaagcagggagattcgattaaagcatatggtgcgggcctcctctcatcctttggagagctccagtactgcctgagtgaaaagcccaagttgcttcccctggaactcgaaaagacggcaattcaaaactataccgtcaccgaatttcagccactgtactacgtagcggagtcctttaacgatgctaaggagaaggtgcgaaactttgcagcaaccatacctcgacctttctcagtcagatacgatccttatactcaaagaattgaagttcttgataacacccaacaactgaaaatcctggccgactcgatcaattccgagatcgggatcctttgttcagcactgcagaagattaaa

SEQ ID NO: 17935 - DNA, 1356 bp, Artificial Sequence
  Description of Artificial Sequence: Synthetic coding sequence
atgtctactgctgtcctggaaaacccaggcctggggagaaagctgtccgattttggccaggagacgagctatatcgaagacaattgcaatcagaatggtgccattagcctgatcttctcactgaaggaggaagttggcgctttggctaaagttctgcggttgttcgaggagaacgatgtaaatctgactcatattgagagtcgccctagtaggttaaaaaaggacgagtacgaatttttcactcacctcgataagcgtagcctccccgccctcacaaatattatcaaaattttaaggcacgatatcggagcaacagtccacgagctgtcgcgggacaaaaaaaaagacaccgttccttggtttccgcggaccattcaggagttggaccggtttgcaaatcagatccttagctatggcgctgaattggatgctgaccatccaggttttaaagatccggtctacagagcacggcgcaaacagttcgccgacatcgcttataattacaggcatggccagccaattccccgcgtcgaatacatggaggaggaaaaaaaaacgtggggcaccgtgtttaagactctgaagagtctgtacaagacccatgcctgttacgagtacaatcatatatttccactgttagagaaatactgcggtttccacgaggacaatatcccccagctggaggatgtgagtcagttcctgcagacctgtactggctttaggttgcgcccagtcgctggactgctctcctccagagatttcctgggaggactcgctttcagagtatttcactgtactcagtacataaggcacggctcgaagcctatgtatacacccgagcctgacatctgccacgagcttctcggtcacgtgcccctgttctccgacagatctttcgctcagttcagtcaggagattgggctagcctcccttggcgcaccagatgaatacatagaaaagctagccaccatctactggttcactgtcgagttcggtctttgcaagcagggagatagcataaaagcttacggcgctgggctgctgtcctcattcggagaactgcagtactgccttagcgagaagccaaagctgctgcctctggagctggaaaagactgcgattcaaaattacaccgtgactgaatttcagcctctgtactacgttgctgagtcatttaatgatgctaaggaaaaggtccgcaacttcgccgctacaatacccagacctttctccgtgcgatatgacccctacacgcaaaggatcgaagtgctcgataacacccaacagctgaaaattttggcagatagtatcaactcagaaatcgggatactgtgtagtgctctgcaaaagatcaag

SEQ ID NO: 17936 - DNA, 1356 bp, Artificial Sequence
  Description of Artificial Sequence: Synthetic coding sequence
atgagcacggcagtgctggagaacccgggactgggaaggaagctgtccgattttggtcaagagacttcctacatcgaggacaattgcaaccagaacggggcgatctcactcatcttcagcctcaaggaagaagtcggagctctggcgaaggtcctgcggctctttgaagaaaatgacgtgaacctgacgcacatcgagagccggccttcgcgcttgaagaaggacgagtatgaattcttcacccatctcgacaagcggtcgctgccagccctgacgaacattatcaaaatcctgaggcacgacatcggagcaactgtccatgaactgtcgagagataagaagaaggatacggtcccgtggttcccgcgtaccatccaggagcttgataggttcgccaaccagatcctgtcctacggcgcagaactggatgcggatcaccctgggtttaaggatccagtgtaccgcgcccgccgaaagcaattcgctgacatcgcatacaactacagacatggacagccgataccgcgcgtggagtacatggaagaagaaaagaaaacctggggcactgtgtttaagactctgaagagcctgtataagacccacgcatgctacgagtataatcacatcttcccgctgctggaaaagtattgtgggttccacgaagataacatcccacagctggaggatgtgagccagtttctgcagacctgtaccggctttcggctccggcccgttgctggtttgctgagctcgcgggacttcctcggaggcctcgcctttcgggtgttccattgcactcaatacatccggcacggatccaaacctatgtacactccagaaccggatatctgccacgaacttctgggccatgtcccgctcttctcagacagatccttcgcacagttctcccaagagatcggtttggcttcgctgggggctccggatgagtacattgagaaactcgcgaccatctattggttcaccgtggaattcggattgtgcaagcagggggatagcatcaaagcatacggggcaggattgctgtcatcgtttggtgaattgcagtactgcctgtcagaaaaaccaaaattgctcccactggaattggaaaagactgccatccagaattacaccgtcactgaattccaacctctgtactacgtcgctgaatcgtttaacgacgcgaaggagaaagtgcgcaactttgcggccaccatcccacggccgttctccgtgcggtatgatccgtatactcagaggatcgaggttctggacaacacccagcagctgaagatcctggccgacagcatcaatagcgagatcggcatcctctgcagcgctctccagaaaatcaag

SEQ ID NO: 17937 - DNA, 1356 bp, Artificial Sequence
  Description of Artificial Sequence: Synthetic coding sequence
atgagtacagctgtactggagaaccctgggctgggacgcaagttgtcagatttcgggcaggaaaccagctacattgaagacaattgcaatcaaaacggggccatcagtttgattttcagcctgaaagaggaggttggagctcttgcaaaggtgctccggctgtttgaagagaatgacgtgaacctgactcacattgaaagccgcccatcccggctgaagaaagacgagtacgagtttttcacccatctggacaagaggtcactgcctgctttgacgaatattatcaagatcctcaggcatgacatcggtgctaccgtgcatgagctttcccgggacaaaaagaaagacacagtgccctggttccctaggactatacaggagcttgatagattcgcaaaccagatactgtcctacggcgcagagctggacgccgaccatcctggattcaaagaccctgtgtacagagctcggcgaaagcagttcgccgacatcgcatacaattataggcacggccagcctattccccgggttgaatatatggaagaggagaagaaaacatggggcaccgtcttcaagacactgaaatctctgtacaagacacatgcatgctatgagtataatcacatcttccccctgctcgagaaatactgcgggttccacgaagacaatatccctcaactggaggacgtgagccaattcttgcaaacctgcaccggctttagactgcgcccagtcgctgggctgctgtcttctcgagatttcctcggcggtctcgctttccgggtcttccattgcacacagtacattaggcacgggtctaaacccatgtacactcctgaacctgatatttgtcacgagctgctcggacatgtgcccctgttttcagaccgcagtttcgctcaattctcacaggaaatcggactggcctcacttggagcccccgatgagtatattgagaagctggcgacgatctactggtttacagtcgaatttggcctgtgcaaacaaggggattccattaaggcctacggggctggcctgctgagctccttcggagagctgcagtactgtttgagcgagaaacctaagctgctccctcttgaactggaaaagaccgccatccagaactacacagtaaccgagttccagcccctgtattacgtggctgagtcttttaacgatgccaaagagaaggtgcggaatttcgctgccaccattccccggcctttttcagtccggtacgacccgtatacacagcggatcgaagtcctcgacaatacccagcagctcaagattctcgcagactccattaatagtgaaatcgggatactgtgcagcgctctgcagaagatcaag

SEQ ID NO: 17938 - DNA, 1356 bp, Artificial Sequence
  Description of Artificial Sequence: Synthetic coding sequence
atgtcgaccgctgtgctggagaatccaggactgggaagaaaacttagcgattttggtcaggaaacgtcatacatcgaagataactgtaatcagaacggagctatttcgttgatcttctctctgaaggaagaggtgggcgcactggcaaaggtcctgcgactcttcgaggagaacgacgtcaacctgactcatatcgaaagccggcctagcagattgaaaaaagatgaatacgaattctttacccatcttgataaaagatccctgccggcacttactaacataatcaagattttgcggcatgatataggagcaaccgtgcatgaactctcgcgggataagaagaaggataccgtaccgtggtttccacgcacgattcaagagcttgacaggttcgctaaccagatactttcctacggggccgaactggacgccgatcacccaggttttaaggaccccgtctaccgcgcacgcagaaagcaattcgctgacattgcatacaattacagacacggtcaacctataccgcgagtggagtacatggaggaagagaaaaagacttgggggaccgtctttaagactcttaagtcgctttacaagacccacgcgtgctacgagtacaatcacatttttccccttctcgaaaagtactgcggattccatgaggacaacatccctcaactggaagatgtgagccagtttctccaaacttgtacgggtttcagactgcgtcctgtggccggccttctgagctccagggattttcttggcggtctggcttttcgggtttttcattgtacgcagtacattcgtcatggatcaaagccaatgtatactcccgaaccagatatatgccatgagctgctcggccacgtacctctttttagcgatcgctccttcgcccaattttcccaagaaatcgggcttgcatcacttggcgcgcctgatgagtacatcgaaaaacttgcaaccatttactggttcacggtcgaattcggtctttgcaagcaaggcgactccatcaaggcgtacggcgccggattgctgagcagcttcggtgaattgcaatactgtctgtcggaaaagccaaaactgctccctctggagcttgaaaaaactgcaatacaaaactatactgtgaccgagtttcagcctctttactatgtggccgaatcctttaacgacgcgaaggaaaaggtgcgcaattttgcagcaactatcccccgccctttcagcgtgagatacgatccatacacccagcgcatagaagttttggataatacccagcagctgaagattctggccgatagcatcaactccgaaattggaatactctgttcagcacttcaaaagattaaa

SEQ ID NO: 17939 - DNA, 1356 bp, Artificial Sequence
  Description of Artificial Sequence: Synthetic coding sequence
atgagcacagccgtgctagaaaaccctggcctgggacgaaagctatccgactttggccaggagacatcctacatagaagataactgcaaccagaacggggcaatttccctgatattcagcctaaaggaggaggtgggcgctctagctaaagtcctgagactgttcgaggaaaatgatgtgaacttaacccacatcgaaagtcgtccttctaggctcaagaaggacgaatatgaattctttacacacctcgacaaaaggtctcttcctgcattgaccaatatcattaagatactcaggcatgatatcggagccacggtgcacgagctgagcagggataaaaagaaggatactgtgccctggttcccccgtaccattcaggagctggaccgtttcgccaaccagatcctttcttacggcgcagaactggacgccgaccaccctgggtttaaagaccctgtatatcgtgcccgaaggaaacagttcgcagatattgcttacaactaccggcatgggcagcccatcccccgcgtcgagtatatggaggaagagaagaagacctggggcaccgtgtttaaaacacttaaaagcctttacaagacacatgcctgctacgagtataatcatatcttccctctgctggagaaatattgtgggtttcacgaggacaacatcccccagctagaagacgtgagccagttccttcagacatgtaccggatttaggcttcgccctgtggcagggctgctgagcagccgggatttccttgggggtctggcctttagggtattccattgcactcagtatatacgacacggctctaaaccaatgtataccccagagccggacatttgccacgaattacttggccacgtacccttatttagcgaccggtccttcgcccagtttagccaggagatagggctggcctctctaggcgcccctgatgaatacattgaaaaacttgccaccatctattggttcaccgtggaatttgggctctgcaaacagggtgactccatcaaggcttatggggcagggcttttgagctcttttggggaattacagtattgtctctccgagaagcccaagctattacccctagagcttgaaaagactgcaatacagaactatacggtaaccgaattccagcccctgtactatgttgctgagagcttcaatgacgccaaagagaaggttcggaatttcgcagcaacaatccctcggccattcagcgtgaggtacgacccctacacccagagaatagaagtgctggataacacccagcagctgaaaattctggccgacagcattaactccgagataggtatcctttgcagcgcactccaaaagatcaaa

SEQ ID NO: 17940 - DNA, 1356 bp, Artificial Sequence
  Description of Artificial Sequence: Synthetic coding sequence
atgtccaccgcagtgcttgaaaatcccggactgggaagaaagctctcggattttggccaagagacttcctacatcgaagataactgtaatcagaatggagcaatctcgctcatctttagccttaaagaagaggtgggggcactggcaaaagtgttgcgcctgtttgaggaaaatgacgtgaatctcacccatattgaatccagaccatcgcggctgaagaaagatgaatacgagttcttcacccatctcgacaagcgctccttgcctgcgctgaccaacattatcaagatacttcggcacgatattggcgcaaccgtgcatgaattgtccagagacaagaaaaaggatactgtcccctggtttccgcgaaccatccaagaacttgatcgttttgccaaccagatcctttcgtacggtgcagagcttgatgcagaccatccaggatttaaggatcctgtgtatcgggcgaggaggaagcagttcgcagatattgcctacaactaccgacacggtcaacctatccctcgcgtggagtatatggaagaggagaaaaagacctgggggaccgtgttcaagactcttaagtcattgtacaaaacccacgcatgctacgaatacaatcacatctttcctctccttgaaaagtactgtggttttcatgaagataacattccacaactcgaggacgtgagccaattcctccagacgtgtacgggattccgcctcagacctgtggcaggattgctgtcatcaagagattttcttgggggactggcatttcgggtctttcactgcactcaatacattaggcatggttctaagcctatgtacacccccgagcccgatatttgtcatgagcttctcgggcatgtgccccttttctccgatagatcgtttgcacaattttcccaggagattggacttgcgagcctgggagctccagatgaatacattgagaaattggcaactatctactggtttaccgtggagttcggactgtgtaaacaaggagacagcatcaaggcatacggtgcaggcttgctcagctcctttggtgagcttcagtactgtctctcggaaaagccaaaactgcttccccttgaactcgaaaagaccgcaattcaaaactacaccgtcaccgaattccaacctctttactacgtggcagaatcctttaacgacgctaaagaaaaggtgagaaacttcgcagctaccatcccccggccttttagcgtgcgctacgacccatacactcaacgcattgaggtgcttgacaacactcaacaactgaagattttggcggattccattaactcagaaatcggaattctgtgttcggcactgcagaagattaag

SEQ ID NO: 17941 - DNA, 1356 bp, Artificial Sequence
  Description of Artificial Sequence: Synthetic coding sequence
atgtccaccgcagtgctcgagaaccccggattgggacgaaagctcagcgattttggccaagaaacttcctacatcgaggataactgtaaccagaatggagccatttccctcatcttttcgctgaaagaagaagtcggggcgcttgcaaaagtgttgcgactcttcgaggagaacgatgtgaacctgacccatatcgaatccagaccgtcgcggcttaagaaggacgaatacgagtttttcactcatctggataaacggtcgctgccagcactcactaacattatcaagatcctgcggcacgatattggtgccactgtgcatgagctcagccgggacaagaaaaaggacacggtcccgtggtttcctaggactattcaagaactggatcgcttcgccaaccagatccttagctacggcgcagaactggatgcagatcatcctggctttaaggatccagtctaccgggcgagacggaagcaatttgcagacattgcctacaattacagacacggacaacctattcctagagtggaatacatggaagaagaaaagaaaacctggggtactgtgttcaagacgcttaagtccctctataagacccacgcgtgttatgaatacaaccacatatttcctcttctggaaaagtactgcggttttcatgaggacaacatcccacagttggaggatgttagccagtttctccaaacctgtactggattcagactgcgccccgtggctggactcctcagctcacgcgattttcttggagggctggcatttagggttttccattgcacccaatacattcgccacggttcgaaaccaatgtacacccccgaacctgatatctgtcacgagcttctcggacatgtgcccttgttttccgatcgctccttcgcccagtttagccaggaaatcgggcttgcatcccttggagccccagatgaatacatagagaagctggcaaccatttactggtttaccgtggaattcggattgtgcaagcaaggcgactcaattaaggcatacggagccgggctcctgtcgtcgtttggagaacttcagtactgcctgagcgagaaaccaaaactccttccactcgaacttgagaaaactgcgatccagaattacaccgttaccgaattccaaccgctgtactacgtcgcggaatcctttaacgatgccaaggagaaggtgcgcaactttgcggcaaccatcccacgccctttttcggtgaggtacgatccatacacccaacggattgaagtgctggacaacactcaacagctgaagattcttgcagattcaattaacagcgagatcggaattctttgtagcgcactgcaaaagattaag

SEQ ID NO: 17942 - DNA, 1356 bp, Artificial Sequence
  Description of Artificial Sequence: Synthetic coding sequence
atgtcgactgctgtacttgaaaaccccggtctgggtaggaagttgtcagatttcgggcaggagacctcatacattgaagataactgtaatcagaacggagccatctctcttatcttctccctcaaggaagaggtgggggcactcgctaaggtcctcaggcttttcgaggaaaacgatgtcaaccttacccacatcgaaagcagacctagccggctcaaaaaagatgagtatgagttttttacacatctggacaagcgatcccttcctgctctcactaatatcattaaaattcttaggcatgacataggggctaccgttcacgagctctcacgggataaaaagaaagatactgtgccatggtttcctcgtacaattcaagagttggatcgattcgcaaaccaaattcttagttatggtgctgaactcgatgccgatcacccagggtttaaagatccggtgtatagggcaaggcgtaagcaattcgctgatattgcttacaattacaggcatggccaaccaattccacgtgttgaatatatggaggaagaaaagaaaacctggggtacggtatttaaaacactcaagtcactatacaagactcatgcttgctacgagtacaaccatatttttccattgctggaaaagtactgtggatttcatgaagataatatccctcaacttgaggacgtatctcagtttttgcaaacgtgtaccggctttaggcttagaccagtggcaggtttgctgagcagccgtgatttcctgggcggactcgccttcagagttttccattgtactcaatatatccgtcacggttcgaagccaatgtacacccctgaacctgatatctgccatgagcttttagggcatgtccccttattttcagatagatcttttgctcaatttagtcaggagattggtttagccagtttgggcgccccggatgagtacatcgaaaaattggccacaatctattggtttacagtcgagttcggactgtgcaagcagggtgattctattaaggcttatggggctggattgctttcttcctttggagagctccaatattgtctttctgagaaacctaaactgctccctctggagcttgagaaaactgccatccaaaactatacagtcactgagttccagcctctttactatgtggctgaaagtttcaatgatgccaaggaaaaggttagaaattttgcggcaacaattcctcgaccatttagcgtacgttatgatccttatacccaacgtatagaggtgctcgataacacgcaacagttgaagattctcgctgactccataaattctgagatcggcatattgtgttccgctcttcagaaaatcaag

SEQ ID NO: 17943 - DNA, 1356 bp, Artificial Sequence
  Description of Artificial Sequence: Synthetic coding sequence
atgtcgactgccgttctagagaaccctggcctaggtagaaaactaagcgacttcggacaggagacctcatatattgaggacaactgcaaccaaaacggcgcgatttcactgattttctccctgaaggaggaagtgggtgctttggccaaagtccttagactcttcgaggagaacgacgtgaacttgacccacattgaaagtaggccttctcggttgaagaaagacgagtatgagttcttcacccatctggacaagcggtccttacctgctctgactaatataataaagatacttcggcacgacataggtgccacagtccacgagctgagccgggacaagaagaaagacaccgtgccctggttcccgcgcactattcaggaactggaccgcttcgccaaccagattctgagttatggggccgagcttgacgctgaccatccggggttcaaggatccggtgtaccgtgcgcggcgcaagcagtttgcggatatcgcctataattatagacacggccagccgatccctagggtggagtacatggaagaagaaaagaaaacctggggtactgtattcaagaccctgaaatctctgtataaaacccatgcctgctacgaatacaatcacatcttccccttactagaaaagtactgcggtttccatgaagataacataccacagctggaggacgtgtcccaatttttacagacatgcactgggttcagactccgtcctgtggctgggctgctgagcagtagagacttccttggcggtcttgccttccgtgtatttcactgtacccagtacatccggcatggctcaaaacctatgtacacaccggaacctgacatctgtcacgagcttttgggccacgtccccttattctccgaccgcagcttcgcacaattctcacaggaaatcggtctggctagtctgggtgcccctgacgagtatattgaaaagctggctactatctattggttcactgttgagttcgggctctgcaaacagggggactcaatcaaagcttacggcgctggccttctctcctcatttggtgagctgcagtattgcctcagtgaaaagccaaaactactgcctctagaactggagaagaccgccatccagaattatacggtgacagagtttcagcctctgtactacgtggcagaatctttcaatgacgcaaaagagaaggttcgaaactttgccgcgacgattccgcgccctttttctgtaaggtacgacccgtatacccaacggatagaagtgcttgataacactcagcagctcaaaatccttgcagacagcatcaattccgagataggcatcctatgtagcgccctccaaaaaataaaa

SEQ ID NO: 17944 - DNA, 1356 bp, Artificial Sequence; identical to SEQ ID NO: 17900
  Description of Artificial Sequence: Synthetic coding sequence

SEQ ID NO: 17945 - DNA, 1356 bp, Artificial Sequence
  Description of Artificial Sequence: Synthetic coding sequence
atgagcaccgcagttttagagaatcctggtttaggccgtaaactttccgatttcggacaggagacgtcctacatcgaggataactgcaaccagaacggggccatatccctgatcttttctcttaaagaagaggtgggggcgctagccaaggttcttaggctctttgaggaaaatgatgtcaatctcactcacatcgaatccaggccatccagactcaagaaagacgaatacgaatttttcactcatctcgataagagatccctgccagcgttaactaacattatcaagatcctcagacacgatataggggcaaccgtacacgagttgagtagggacaaaaaaaaggacacagtgccttggtttccccgtactattcaagagttggaccgttttgctaaccaaatcctttcttacggtgccgagctcgacgccgaccaccctggatttaaggatcccgtctatagggcaagacgcaagcagttcgccgacatcgcctataattacagacacggccagcctatccctcgagtggagtatatggaagaggagaaaaagacgtggggtacagtgttcaaaaccctgaagtctttgtataagactcacgcctgctatgagtacaaccatatttttccacttctggagaagtactgtgggttccatgaggacaacatcccacagctggaggacgtgtctcagttcttgcagacctgtactgggttcagactgcgccccgttgccggcctactgagcagcagggattttcttggaggacttgcgttcagggtcttccattgtacgcagtatatccggcatggatcaaagccaatgtacacaccagagcctgacatctgccacgagctcctgggacatgtaccgctgttctccgacaggagctttgctcagttttcacaggaaatcgggctggcttctctgggagcgcctgatgagtacattgagaagctcgccaccatctactggttcacggtggagttcggactttgtaaacagggagattccattaaggcatacggtgctgggttgctgagctcctttggtgaactgcaatattgcctcagcgagaagccaaagcttctgcccctggagctggaaaaaactgctattcagaattacaccgtcacagagtttcagcctctgtactacgtcgctgagtctttcaacgatgccaaggagaaggtaaggaatttcgcagcaactatacctcgccccttctctgtccgttatgatccttatacccagagaatcgaggttctcgataacactcagcaactgaagatcctggccgactccatcaatagcgaaattggcattctttgtagcgctctgcagaagataaag

SEQ ID NO: 17946 - DNA, 1356 bp, Artificial Sequence
  Description of Artificial Sequence: Synthetic coding sequence
atgtcaactgcagtgttagaaaatccaggcttaggaaggaagctctcagacttcggacaagagacctcatatattgaggataattgcaatcaaaatggagcgatcagtcttatcttttcgcttaaggaagaagttggggcgctggctaaagtgctccgtctttttgaggaaaacgacgtcaatttaacacatattgaatcacgtccgtcacgactcaaaaaagatgagtacgagtttttcactcatttggacaagagaagcctgccggcgttgaccaacataatcaaaatcttacggcacgatataggagcgacggtgcatgaattgtctcgcgataaaaaaaaggacacagtaccttggtttccccgaaccattcaagagctggatcgatttgcgaatcagattttgtcttatggcgcggaactggacgctgatcatcctggttttaaggatcctgtgtaccgagcacgccggaaacaattcgcggatatcgcgtataattacaggcacggtcagccgattccacgcgtcgaatatatggaagaagaaaaaaaaacgtggggcaccgtctttaagacgttgaaatctctttataagacgcacgcgtgttatgagtacaaccatatctttccattgctggagaaatattgcggttttcacgaagataatattccgcaattagaggatgtatcccagttcttacagacgtgcaccggctttcgcttaagacctgtggccggactgttatcgagccgggactttcttggtggcttggcttttcgtgttttccactgcacacaatatatacggcatggctcaaaacctatgtacaccccggaaccggatatttgtcatgaacttcttggccatgtcccacttttttctgatcggtcttttgcgcagttttctcaagagatcggcctcgcgagccttggcgctccagatgagtatattgagaaactggccacaatctactggttcactgttgaattcggattatgtaaacaaggagattccattaaagcgtatggagcaggcctcctgtcatcttttggggaactacaatattgcttatcagagaagccgaagctgctgccgttagaattagagaaaacagccattcagaattacaccgtgactgaattccaaccgctctactatgtcgcagaatctttcaacgatgctaaagaaaaagtgcggaatttcgcggccacaatcccgcggccgttctcggtacgttacgatccatatactcagcgcatcgaagtgcttgataatacgcagcaattaaaaattctggccgattctatcaactcagaaatcgggattctctgcagcgcattacaaaaaatcaaa

SEQ ID NO: 17947 - DNA, 1356 bp, Artificial Sequence
  Description of Artificial Sequence: Synthetic coding sequence
atgtcgactgcagtgctggaaaaccccgggttgggtcgtaagctcagcgatttcggccaagaaacctcttacattgaagataactgcaatcagaacggcgcaattagcctgatctttagccttaaggaagaggtgggagcccttgcaaaagtgctgcgcctttttgaagagaacgacgtgaaccttactcacattgaatcaaggccatcaaggctgaagaaggatgaatacgagttctttactcatcttgataagaggtccctcccagcactgaccaacataatcaaaatcttgaggcacgatatcggagcaaccgtgcatgaactctcgagagacaagaagaaggacactgtcccttggttcccgagaaccatacaagagctggatcgctttgcaaatcagattctgtcatacggcgcagaacttgatgcagaccatcctggattcaaggatcctgtgtaccgcgcaagacggaaacagtttgccgatatcgcatacaattacagacatggccaaccgattccaagagtggaatacatggaagaggagaaaaagacgtggggtaccgtctttaagactctgaagtccctgtacaaaactcatgcgtgttacgagtacaatcatatctttcctctgctcgaaaagtactgtggatttcatgaagataacattccgcaattggaggatgtgtcacagtttcttcagacttgtaccggcttccgactgcgaccagtggcaggtctgctgtcatcgcgggactttcttgggggactggcattcagggtgtttcattgtactcaatacattcgacatggctccaagcccatgtacacccctgaaccagacatttgccacgaactcctcggacatgtgccactgttctcggataggagctttgcacaattttcccaagagatcggactcgcgtccttgggtgccccagatgagtacattgaaaaactggccacgatttactggttcaccgtcgaatttgggctgtgcaaacagggcgacagcattaaagcctacggggcaggcctgctctcatcattcggagagcttcagtactgtcttagcgaaaagccaaaacttcttccacttgaactggagaaaaccgcaattcagaactacacggtcacggaatttcagcctctctactacgttgcagaatcgtttaatgacgcaaaggagaaggtgcgcaattttgcagcaactatccctaggccgttttcagtcaggtacgatccttacacccagcggatagaggtgctggacaacacccaacaacttaagatacttgcagattcaatcaactccgagattgggattctgtgttcggcgctgcaaaagatcaag

SEQ ID NO: 17948 - DNA, 1356 bp, Artificial Sequence
  Description of Artificial Sequence: Synthetic coding sequence
atgagcaccgctgtgctggaaaatcctggcctgggaagaaaattgagtgactttggacaggagacctcttatatcgaagataactgtaaccaaaacggggcaatctctcttattttctcattgaaagaagaggtgggagctctggctaaggtcctgcggctattcgaggagaacgacgtgaatctgactcacattgagagtagaccaagtcgactcaaaaaagacgaatatgagttcttcacccaccttgacaaacggtctctgccggctctgacaaacataatcaagatcctgaggcacgatataggcgcgacggtccatgaactttctagggacaaaaaaaaagacaccgtgccttggttccctcgaacaatacaggaactcgataggttcgcaaaccagattctgagctacggcgccgagctggacgcagaccatcctgggtttaaagaccctgtctacagagcacgcagaaaacagtttgctgatatagcttacaattacaggcacgggcagccaattccaagggtcgaatacatggaagaggaaaagaaaacttgggggactgttttcaaaaccctcaaaagcttatataaaacccatgcttgctatgaatacaatcacatctttccacttctggaaaaatactgcggatttcatgaggacaacattcctcaacttgaagacgttagccagttccttcagacctgcaccgggtttcggctcagaccagtcgcgggcctactttcctcgagggattttctgggaggcctggcattcagggtcttccactgcacccagtacatcaggcacggtagtaaacccatgtacaccccagagcctgacatctgccatgagctcctgggccacgttccgcttttcagcgatcgttcatttgcccagttttcccaggaaattggactggctagcctgggagctcctgatgaatatatcgagaagttagcgaccatttactggttcacagtcgagtttggcctctgtaagcagggtgatagcataaaggcttacggagctggactgctgtcaagttttggagaacttcagtattgtctcagcgaaaagcctaaactactgcctctggaactggagaagacagctattcagaactacacggtgaccgaatttcagccgctctattacgttgccgagtcttttaatgatgccaaagagaaggtcaggaatttcgccgccacaataccaaggcctttctcagtcagatatgatccatacacccaaagaatcgaagtactggacaacacacaacagcttaagatcctggctgacagcatcaatagtgaaatcgggattctgtgctctgctttacaaaaaatcaag

SEQ ID NO: 17949 - DNA, 1356 bp, Artificial Sequence
  Description of Artificial Sequence: Synthetic coding sequence
atgtcgacggcagttcttgaaaatccgggacttggtagaaagctgagcgactttggacaggagacttcctacatcgaagataattgcaaccagaacggagcaatctccctgatcttttccctgaaagaggaagtgggtgcgcttgcaaaggtgctcagacttttcgaagaaaacgatgtgaatttgacccatattgagtcacgtccgtcgcgcctgaaaaaggatgaatacgaattctttacgcatctggacaaaagaagccttcccgcactgaccaatatcattaagatcctgagacatgatatcggtgccactgtgcatgagctttcaagagacaagaagaaggacactgtcccgtggttcccaaggactatccaggagctggaccgttttgcaaatcaaattctgtcatacggagcagagcttgatgcagaccacccaggcttcaaggatcccgtgtatcgggctcgccgaaagcagtttgccgatatcgcctacaactacagacatgggcaaccaattcctagggtcgagtacatggaagaagagaaaaagacgtggggaaccgttttcaaaactcttaagagcttgtacaagacccacgcttgttacgagtacaaccatatctttccccttcttgagaaatactgtggattccatgaagataacatcccgcaactcgaagatgtgtcgcaatttctgcaaacctgtactggctttagacttagacctgtggccgggctcctctcgagccgagatttccttggaggtctggcatttcgcgtgttccactgtacccagtacattagacatgggagcaagccaatgtacacccccgaacctgatatctgtcatgaactgcttggacacgtcccactgttttcggaccggtcattcgcccaattttcgcaggaaattggacttgcgtccctcggagccccagatgagtacatagaaaaacttgctaccatttactggttcactgtggaattcggactttgcaagcagggcgactcgattaaggcatacggcgcagggctcctctcttccttcggggagcttcaatactgtctgtcggaaaaaccaaagctcctgccccttgaacttgaaaagactgccatccaaaactacaccgtgaccgagtttcagccactctattacgtggccgagtcgtttaacgacgcgaaggagaaagtccgtaatttcgcagcgactattcctcgtccattttccgtgcgctacgacccttacactcagagaattgaagttcttgacaacactcagcagcttaagattctcgccgactccattaactcggaaatcgggattctgtgtagcgctcttcaaaagattaag

SEQ ID NO: 17950 - DNA, 1356 bp, Artificial Sequence
  Description of Artificial Sequence: Synthetic coding sequence
atgagcactgctgtactggaaaacccaggactgggccgcaaattatcagactttggccaggagactagttatattgaggacaattgcaaccagaatggtgccatttccctcattttcagcctcaaagaagaggtcggggctttggcgaaggtgttgcgactgttcgaggaaaatgacgttaacctgactcacatagaatccaggccatccagacttaaaaaagacgagtacgaattttttacccatcttgataagcggtcactccccgcactgaccaacatcatcaagatattaaggcatgacattggagcaacagtgcatgaactgtccagagacaaaaagaaggataccgtgccctggtttcctcgcactatccaggagctcgacagattcgccaaccaaatcctgagttatggtgccgaattggatgctgatcatccaggtttcaaagacccggtgtatagggctcgacgaaagcagttcgctgatatcgcctacaactataggcatggccagccaatcccgcgagtggagtatatggaagaggagaaaaagacatggggtacagtgtttaaaacactgaaaagtctgtacaaaactcatgcttgttacgagtacaaccacatcttccctctattggagaagtattgcggctttcatgaagacaatatcccacaactggaagatgtgtcacaattcctacaaacttgtaccggcttcagactcaggcccgtggcaggcctgctctcaagcagagacttcctaggaggcttagccttccgagtgtttcattgcacacagtacattagacacgggagcaagccaatgtatacgcccgagccagatatctgtcatgaactgttggggcacgtgcccctttttagtgatcgatccttcgcacagttcagtcaggaaattggactcgcctcactcggggctccagacgaatacattgaaaaattggcaaccatttattggtttacagtggagtttggtctctgcaagcaaggggactcaataaaagcgtatggggcgggtctcctttcatcatttggcgaacttcaatactgcctctcagaaaagcccaaactgctacctctggagttggagaagactgcgatccagaattacaccgtgacagaattccagcctctttactatgtggccgaaagctttaacgacgctaaggaaaaagtaaggaactttgctgcaacgattcctcggcctttttccgtcagatacgatccctacacccagaggattgaagtcctagacaatacccaacagctgaagatcctggccgattcaataaactccgagatcggaatattgtgttccgctctccagaaaatcaag

SEQ ID NO: 17951 - DNA, 1356 bp, Artificial Sequence
  Description of Artificial Sequence: Synthetic coding sequence
atgagtactgccgttctagagaatcctggcctgggaagaaagctgagcgattttggccaagaaacgtcttatatcgaggataactgcaatcaaaatggggccatctccctgatcttctccctaaaggaggaggtgggcgcactggccaaggtcctgcggctttttgaggaaaacgacgttaatctcacccatatcgagtctagaccctcccgattgaagaaggacgaatacgagtttttcactcacctggataagagaagtctgccggctctgactaatatcatcaagatcttaaggcacgatattggtgcgaccgtccacgagctgagcagagacaaaaaaaaggacacggtgccttggtttccccgcaccattcaagaattggaccgatttgcgaaccagatactttcctatggtgccgaattggacgcggaccacccggggttcaaggatcctgtgtacagggcaaggcggaagcagttcgcagacatcgcgtacaactatcggcacgggcagccgatccctagagtggaatacatggaggaagagaagaagacttggggcaccgtgttcaagacccttaagtccctctacaagacccacgcttgttacgaatataaccatatctttccattgcttgagaagtattgcggctttcacgaagataacattccccagctggaagacgtttcccagtttctgcagacgtgtaccggatttcggctgagacctgtggcgggcttgctgtcttctagggatttccttggcggtcttgcatttagggtttttcattgcactcagtatattcgccacggttccaagccgatgtacacacctgagcccgatatctgtcatgagctgcttgggcacgtgccacttttttcagatagatccttcgcccagtttagccaggaaatcgggctggcttccctgggggctcccgacgaatatatcgagaagctggccaccatatattggtttacagtggagttcggactttgcaaacaaggcgacagcattaaagcttacggggcgggcttgttatcatctttcggagaactacagtattgtctttcggagaaacccaagctgctccctctcgaactcgaaaagaccgcgatacagaactatacagtaactgagtttcagccactctactatgtagctgagagcttcaatgatgcgaaagagaaggtgagaaacttcgctgctaccatccctcgtcctttttcggtgcgctatgatccatacactcagagaattgaagtgctcgataacacccagcagctgaagatccttgctgacagcatcaactcagagattggaatattgtgcagcgcgctgcagaagatcaaa

SEQ ID NO: 17952 - DNA, 1356 bp, Artificial Sequence
  Description of Artificial Sequence: Synthetic coding sequence
atgtcaacagcagtgttagaaaaccccggcttgggcaggaagttgagcgacttcgggcaggagacatcctatatcgaagataactgcaatcaaaacggtgcaataagcctaatcttcagccttaaagaagaggttggagcattagcaaaggtcttgcgtctgttcgaagagaatgacgttaacttgactcacattgagtcaaggccatcacgactgaaaaaagacgagtacgaattctttacacatctggacaagcggagcctgccagcacttacaaatattatcaaaatcctgagacacgatatcggtgccaccgtgcacgaactgagtagagacaagaaaaaagatacagtgccatggtttccacggacaatacaagagttggacaggtttgctaatcaaatcttgagctacggggccgagctagacgcggatcatcctgggttcaaggacccagtttaccgcgccagaaggaagcaatttgctgatatcgcttataattatcgtcacgggcagccaatcccccgggtcgaatacatggaggaggaaaaaaaaacttggggtacagtgttcaaaacactgaagtcactctacaaaacgcacgcctgctatgagtacaaccacatattccccctgcttgagaaatactgtgggttccacgaagacaacataccacagctggaggacgtttcacagttcctgcagacttgcacgggctttaggctccggcctgtggccggcctcctctccagccgagatttcctggggggtctggccttccgcgtatttcactgcacacagtacattcgacatgggtccaaacccatgtacacacctgaaccagatatctgccacgaactgctaggacatgtgccactgttctcggataggtccttcgctcagttctcgcaggaaatcggccttgcttcgttaggggctcctgatgaatatatcgaaaagctcgctaccatctactggtttacggtcgagttcggcctgtgtaaacagggcgatagtatcaaagcatatggtgctggtttgctgtccagttttggcgaacttcagtactgtctgtcggaaaagcctaagcttctgcctcttgagctagaaaaaacagccatacagaactataccgtgacagagttccaaccactttactacgtagccgaatccttcaacgatgcaaaagagaaagtcagaaatttcgctgcaacaattcctagacctttctctgtgcgatatgatccgtacacacagagaattgaggtgcttgataatactcagcagttgaagatactcgccgattccataaattccgaaatcggaattttgtgcagcgccctgcagaaaataaag

SEQ ID NO: 17953 - DNA, 1356 bp, Artificial Sequence
  Description of Artificial Sequence: Synthetic coding sequence
atgtccacagcggtgttggagaatcctggtcttggacggaagctgtctgacttcggccaggagacttcatacattgaggataactgcaatcagaacggcgcaattagcctcatattttccctgaaagaggaagtcggcgccctggctaaagtactaaggctgtttgaggaaaacgatgtcaacctgacacatatagaaagccgaccatccaggctgaagaaagacgaatacgagttcttcactcacctcgataagcggagtcttccagcactgactaatataattaagatcctgagacacgatattggggccacagtacacgagctaagtcgcgacaaaaagaaggacactgtgccctggtttccccgcacaattcaggaactggatagatttgccaatcaaattctttcctatggggccgaactggacgccgaccatccaggattcaaggacccagtgtaccgcgctcggcgcaaacagttcgccgacattgcctacaactaccgccacggacagcctatacccagagttgaatacatggaagaggagaaaaagacctgggggaccgtattcaagacactaaaaagtctctataaaacgcacgcttgctatgagtataaccatatattccctctcctggagaaatactgcggattccatgaggataatatcccacagctggaggatgtgagtcaattcctgcaaacgtgtaccggctttaggttacgaccagtcgccggcctactgtcttctagggatttcctagggggcctggctttccgggtattccattgcacccagtacatccgacacgggtctaaacccatgtataccccagagcccgacatctgccatgaactgttgggacatgtacctctgtttagcgatcgaagttttgcccagttctcccaggaaatcggactcgcttccctcggtgcccccgatgagtacattgaaaagcttgctaccatctattggtttaccgtcgagttcggcctctgcaaacaaggggattcgataaaggcatatggagccggcttgttgagttcatttggtgaacttcaatattgcctctctgaaaagccaaaactcttgccccttgagctcgagaaaaccgccattcagaactacactgtgacagagttccaacctctgtactatgtggccgaatcattcaacgacgccaaggagaaggttcggaactttgcggccaccatcccccgcccgttctccgtcagatacgacccctacacacaaagaattgaggtcctcgacaatacgcaacagcttaaaatactggcggattccatcaattccgagattggcatcttatgcagcgccctccagaagatcaag

SEQ ID NO: 17954 - DNA, 1356 bp, Artificial Sequence
  Description of Artificial Sequence: Synthetic coding sequence
atgtccactgccgtgctggaaaacccgggcttgggtcgaaagttgtcagatttcggacaggagacttcctacatcgaggacaattgtaatcaaaacggcgccatcagcctgatctttagcctgaaagaggaagtcggagccctggcaaaggtgcttagattgtttgaagaaaacgacgtgaatttgacccatatcgaatcacgcccgagccgcctgaaaaaagatgaatacgagttcttcacccacctggataagaggtcactcccggccctgaccaacatcatcaagattcttaggcatgatatcggagccaccgtgcatgaactttcgagagataagaaaaaggataccgtgccttggttcccacgcacgatccaagagctcgaccgtttcgcaaatcaaatcctttcctacggtgccgaactcgatgcagaccatcccgggttcaaggacccggtgtaccgggcccggcggaagcagttcgcagacatcgcgtataactaccgccacggacagccaatcccgagggtggagtacatggaggaggagaagaaaacgtgggggacggtctttaagaccttgaagagcttgtacaagacccacgcgtgctacgagtacaaccacatttttcccttgttggagaagtactgcgggttccacgaggataacatcccacagctggaagatgtgtcgcaatttctccagacctgcactggattccggctgcgcccagttgcgggcctgctctccagccgggacttcctgggaggtctggcatttagagtgtttcattgcactcaatacatccggcacggatcgaagccgatgtacacgccggaacccgacatttgtcacgagctcctgggacacgtgccgttgttctcggaccgatcgttcgctcaattcagccaagaaatcggactggcatcgctcggagcgccggatgaatacattgaaaaactggccactatctactggtttactgtcgagttcggtttgtgcaaacagggagacagcatcaaggcgtacggcgcgggactgctctcctccttcggggaactgcagtactgtctctcagaaaaaccaaaactgctcccactggagctggaaaagaccgcaatacagaattacactgtcacggaatttcagcccctgtactacgtggccgagagcttcaacgatgcgaaggaaaaagtccggaacttcgcggccaccatcccgcgacccttctcagtgagatacgacccgtacacccagcggatcgaagtccttgacaacacgcagcagcttaagatactcgccgactcaatcaattctgaaatcggaatcctgtgctcggcgttgcagaagatcaaa

SEQ ID NO: 17955 - DNA, 1356 bp, Artificial Sequence
  Description of Artificial Sequence: Synthetic coding sequence
atgagcaccgcagtgctcgaaaatcccggcctgggaaggaagttgagcgacttcggacaggaaaccagctacattgaagacaattgtaaccaaaacggggccattagtttgattttctccttgaaggaggaggttggggctctggctaaggtcctccgacttttcgaagagaatgatgtgaatctcacccatatcgagtctagaccgtcaaggttgaagaaggacgagtatgaattttttacccacctggataaaagaagccttcccgcccttacaaacatcattaagatccttaggcacgacattggagcaactgtgcatgagctgtctcgtgataagaaaaaggacacggttccatggttcccaaggacaatccaagaactcgacagattcgctaatcagatcctctcctacggagcagaactcgatgccgatcaccccggattcaaagaccccgtttatagggctcgccgtaaacagtttgccgatattgcatacaactacagacatggtcagcccatcccacgcgtcgaatatatggaggaggagaaaaagacatggggcaccgtattcaagacgcttaaaagtctctataagacgcacgcatgctacgagtataaccacattttcccgttgttggagaaatactgtggctttcacgaagataatattccacaactagaagacgtgagtcaatttcttcaaacctgcacaggttttagactgagacccgtcgctggcctcctcagctctcgtgacttccttggcggcttggcctttcgcgtgtttcattgcacacagtatatccgtcacgggtccaagccaatgtacacccctgaacctgatatatgccatgagcttctaggtcacgtgcccctgttctctgatcggtctttcgcgcagtttagccaggagatcggactagccagcctcggagctcccgatgaatacatcgagaaactggcaaccatttattggttcactgtggaattcgggctctgcaagcagggcgattccatcaaagcttatggggccggcctgctatcgtccttcggagagctgcagtactgtctgagtgagaagcctaaacttctccctttagagctcgagaaaacagccatccagaactacactgtaacagaattccagcctctctactacgttgctgaaagcttcaacgacgccaaggaaaaggtgcggaattttgccgcaaccattccgcggcccttttcagtgaggtacgacccgtacacacagcgaatcgaagtgttggacaacacacagcagcttaagattcttgctgacagcataaactcagaaatcggcatcctgtgctcagccctccagaaaattaag

SEQ ID NO: 17956 - DNA, 1356 bp, Artificial Sequence
  Description of Artificial Sequence: Synthetic coding sequence
atgtcaacggcagttctggaaaatccgggacttggccgtaaacttagcgactttgggcaggaaaccagctatattgaggacaactgtaatcaaaacggagcaatatcgctgattttcagtctgaaggaagaggtgggggcactggccaaagtcctgcgtctttttgaggagaacgacgtgaatctcacccatatcgaatcaagaccatcgagattgaagaaagatgagtacgaattctttacgcatctcgataagcgctcgctcccggcactcactaacattatcaagattcttcggcacgacattggagcaaccgtgcacgaactttctcgagataagaaaaaggacactgtcccgtggtttccaagaaccattcaggaactggatcgctttgcaaatcaaatactgagctacggcgcagagctggatgcagatcatcccggctttaaggaccccgtgtaccgagctcgccgcaagcaattcgcagacattgcatacaattacagacacgggcaacctatcccgcgcgtcgaatacatggaggaagagaagaaaacctggggtaccgtctttaagacgctcaaatcgctgtacaagactcatgcctgctacgaatacaaccacatcttccccctgctggagaagtactgtggctttcatgaggacaacatcccacaactcgaggacgtgagccagttcctgcaaacctgtactggcttcagactccggcctgtcgcaggattgctgagctcccgagactttcttgggggcttggcttttagggtgttccactgtacccagtacataaggcacggttcaaagcctatgtatactccggaaccggacatctgccatgaactgcttggccacgtcccactgttttcggataggtcgtttgctcagttctcccaggaaattggactggcatcattgggagcgcctgacgaatacattgaaaagttggccaccatatactggtttacggtggaattcggactctgcaaacagggtgactccatcaaggcatacggcgcaggccttctgtcgtcatttggcgagcttcagtactgtctcagcgagaagcccaagctccttcctctcgagctggaaaagactgccatccagaactataccgtgaccgaatttcaaccactttactacgtggcggaatcgttcaacgacgcgaaagagaaggttaggaattttgctgccacgattccccgcccattctcggtgagatatgatccttacactcaacggatcgaagtgttggataacactcaacagctgaagattcttgctgactcgattaactccgaaattgggatcctttgctccgcactgcaaaagataaag

SEQ ID NO: 17957 - DNA, 1356 bp, Artificial Sequence
  Description of Artificial Sequence: Synthetic coding sequence
atgagtaccgctgtgctggaaaaccccggacttggacgtaaattgagcgatttcggacaggaaactagttatatcgaggacaactgtaatcagaacggcgccatctcacttatcttttccctgaaagaggaggtgggggccctcgctaaggtcctgcgcctgtttgaagagaacgacgtgaatctaacacatatagagagtcgcccttcccgtctgaaaaaagacgaatacgagttctttacccacctcgacaagagatctctacctgctctcaccaacatcataaaaatcttgagacacgatataggtgccactgttcatgagctgtcccgcgacaagaaaaaagataccgtgccttggtttccaaggaccatccaagagctggatagattcgccaaccagatactgtcctatggggctgaactggatgccgatcaccccggctttaaagacccagtgtatagggccagacgaaagcagttcgccgacattgcatacaactacagacacgggcagcccataccccgtgtcgagtacatggaggaagaaaagaaaacctgggggaccgtttttaaaactctaaaatctctatacaaaacacatgcttgttacgagtataatcatatattccccctgcttgaaaaatactgtggtttccacgaggataatatcccacagttagaagacgtctcacagttcctgcagacctgcactggcttcaggcttcgcccagtggctggactcctaagctcacgggacttcttaggaggcctggcattcagggtgtttcactgtacccagtacatccggcacggctccaagcctatgtatacacccgaacctgatatctgccacgaactcttagggcatgttccactgttcagtgaccgatcattcgcacagttttcccaggagataggtctggccagcctaggcgctccagacgaatacattgagaagctagccaccatttattggtttaccgtggagttcgggctgtgtaagcagggcgatagcataaaggcctatggcgccggtctgttaagctctttcggcgagctgcaatactgtctaagcgagaaacctaagctgctgcccttagaactagaaaaaaccgcaatacagaattacaccgtgaccgagttccagccactgtactacgtcgccgaaagctttaacgacgccaaggagaaggttcgtaactttgccgcaaccattccaaggcccttctctgtgaggtacgatccatatacacagcgcattgaggtgctggataatacccagcagctgaagattctagccgattctatcaatagcgaaattggcatattatgctccgcccttcagaaaataaag

SEQ ID NO: 17958 - DNA, 1356 bp, Artificial Sequence
  Description of Artificial Sequence: Synthetic coding sequence
atgtcaaccgccgtcctcgagaatccaggactaggtaggaaactgagtgacttcggtcaggagacctcgtacatcgaggacaattgtaaccaaaacggagccatctccctcatattttctctgaaggaggaggtgggggcccttgccaaggtccttaggctgttcgaagagaacgacgtgaatctcacgcacattgagtccaggccatcacggctcaagaaggacgagtacgaattcttcactcacttggataaacgctcattgccagctctcactaacatcattaagattctcagacacgatatcggggctacggtgcacgagctctcaagggataagaagaaggacacggttccttggtttcctaggacgatccaggagctagacagattcgcaaatcagatccttagttacggagcggaactcgacgcagaccaccccggcttcaaagaccccgtgtaccgtgccagaaggaaacagttcgctgacattgcctacaactataggcatggccaaccgatcccccgtgtagagtacatggaggaagaaaagaaaacttggggcactgtctttaaaacattgaagagtctgtataagacccatgcttgttacgaatacaatcacatctttccactgctcgagaaatactgtggcttccatgaggacaacatacctcagttggaagacgtttcacaattcctccagacctgtacaggctttcggctcagaccagtggcgggccttctctcaagccgggacttcctcggcggactcgcgtttcgggtctttcattgcactcagtacatacggcacggttccaaacctatgtacactccagaaccagatatttgccacgaattgttgggacatgttcctctgttttctgacagatccttcgcacagttctcccaggagatcggtctggccagcctgggagcgccagacgagtatatagagaagctggctactatctattggtttaccgtggaattcggcctgtgtaaacagggggactcaatcaaagcttatggagctggcctcctgagttcctttggcgagctgcagtactgcctgtcggaaaagcccaaacttttgcccctcgaactagagaaaacggccatacagaactatacagtaaccgaatttcaacccctgtattacgtggctgaatccttcaacgatgcgaaagagaaagtgagaaatttcgcagctacgattcctaggcctttttcagttaggtacgacccatatacccaaaggatagaagtattggacaacacacagcaactgaagatcctggccgactccatcaattctgaaattggtatcctgtgctccgctctgcagaagattaag

SEQ ID NO: 17959 - DNA, 1218 bp, Artificial Sequence
  Description of Artificial Sequence: Synthetic coding sequence
atgacattagacgtagggcccgaagacgaactgcccgactgggcggccgcaaaagagttctaccagaagtatgatcccaaagatgttatagggcgcggcgtgagctccgtagtgcggcggtgcgtgcaccgtgcgaccgggcacgaattcgccgtgaagatcatggaggtgacagcagaacgtttatctccagaacagctggaggaagttagagaggcgacccggcgagaaactcatattctgcggcaggtggccggtcacccacatattatcacactgatcgatagctacgaatcaagctcattcatgttcctggtgtttgatcttatgcggaagggcgagctgtttgattacctcaccgagaaggtcgccctgagtgagaaagagactcgcagcataatgcgaagcttgctggaggcagtctcctttctacatgccaacaacatcgtgcacagggacctgaagcccgagaacatcctcctggatgataatatgcaaatacgattatcggacttcggttttagttgccatctggaaccgggggagaagcttcgagagctctgtggaacgcccggttacctggcaccagaaatcttgaagtgctctatggacgagacccacccggggtatggcaaagaggtcgacctttgggcctgtggcgtcatcctgttcactctcttggccggaagcccaccattttggcacagaagacagatcctcatgttacgcatgatcatggaagggcagtatcagttctcatcaccggaatgggacgaccgaagtagtacggttaaggatttgatctctcggctcctgcaggtcgatcctgaggcccgactcacagcagagcaggccttgcaacacccgttcttcgagcgttgcgagggcagccagccctggaatttgacgccccggcaacgcttccgtgttgcggtatggaccgtgctcgcggccgggcgcgtggcgctgagcacccaccgggtgcgccccttaactaaaaatgcgctccttagggatccctatgctcttagaagtgtgcggcatttgatcgacaactgtgcgttcaggttgtatggccactgggtgaagaagggggagcagcagaaccgggcggccctgttccagcataggccccctggtccattccccataatgggccccgaagaagagggcgattcagccgcaattaccgaggacgaggctgtgcttgtactgggc

SEQ ID NO: 17960 - DNA, 1218 bp, Artificial Sequence
  Description of Artificial Sequence: Synthetic coding sequence
atgacgctggacgtcgggcccgaggacgagctgcctgactgggctgctgctaaggagttctatcaaaagtacgatcctaaggacgtaattggccggggagtgtcctcagtcgtgcggaggtgcgtgcatagagcaactggtcatgaatttgccgtcaaaatcatggaagtgactgcagagagactttcccctgagcagctggaagaggtgcgcgaagcaacgcgccgcgaaacccatatccttagacaggtggcaggtcaccctcacattatcactcttattgactcgtacgaaagctcatcgtttatgtttcttgtctttgatcttatgagaaagggcgagctctttgattacctgacggaaaaggtggcactttcagagaaggaaaccagatccattatgagatcattgctcgaagcagtgtccttcttgcacgcgaacaatatagtccaccgggacctgaagcccgagaatatacttctggatgacaacatgcaaatccgcctctctgattttggattctcgtgtcacctggaacctggagaaaaacttcgagaactttgtggaacccctggatacctggcaccagaaatccttaagtgttcaatggatgaaactcacccagggtacggaaaggaagtcgacctttgggcctgtggggtgatcttgtttactcttcttgcaggctcgccaccgttctggcatagacgacagattcttatgctgcgaatgattatggaaggacaataccaattctcatccccagaatgggatgacaggtcgagcactgtgaaggaccttattagccgactcctgcaggtggacccagaagcccgtttgaccgcagaacaagccctgcagcatccattctttgaacggtgtgagggctcacaaccttggaacttgactcctaggcagcggttccgcgtggcagtgtggactgtgctggccgccggccgcgtggcactgtccacgcatcgcgtgcgtcctctgactaagaatgccctcctgagggacccatacgccctgaggtccgtgcggcatctgatcgataactgtgcatttcggctctacggccattgggtcaagaagggagaacagcagaaccgcgcagctctctttcaacatagaccacccgggccttttcctatcatgggaccagaagaagaaggtgactccgctgcaattacggaagatgaggcagtgctggtcctggga

SEQ ID NO: 17961 - DNA, 1218 bp, Artificial Sequence
  Description of Artificial Sequence: Synthetic coding sequence
atgacgttagacgttgggcctgaagacgagctacctgactgggcggcggccaaagaattctatcagaaatacgatccaaaagacgtcatcggccgtggagtgtcttccgtagtccgcagatgcgtccatcgcgcaacaggccacgaattcgcagtaaagatcatggaagtgacagccgaacgtctgtctccggaacagctggaagaggttcgcgaagccacaaggagggagacacacatactacgccaagtagctgggcatcctcacattatcactttgattgattcgtatgaatctagctcattcatgtttctggtcttcgatctaatgaggaagggcgaattatttgactatttgacagagaaagtggctctgagcgagaaagaaacccgctcaattatgcgatctctcctggaagctgttagcttcctgcatgccaacaatattgttcaccgcgatctcaaaccagaaaatattctgcttgatgacaacatgcagatccggttgagcgatttcggcttcagctgtcatctcgaacctggagagaaacttcgagaactctgcgggactcctggatatctggctcctgaaatactgaagtgctcaatggacgaaacacatcccgggtatggaaaagaggtagacttgtgggcttgcggagtgatactctttacacttttagccggctcgcctcctttctggcacagaaggcagatcctgatgctcagaatgattatggagggacaatatcagttctccagcccggagtgggatgatcgatcctccacggtcaaagacctgattagtaggctcctgcaggtggatccagaggccagactaactgcggaacaggctctgcaacacccatttttcgagagatgtgagggcagtcagccttggaacctgacaccccgccagcggttccgcgtcgccgtctggactgttctggcggccgggagagtggccctgagcactcacagggtgcgcccattgaccaagaacgcactcctaagggacccttatgcgctgcgttcggttaggcacctgatagacaactgtgcatttcgtctgtacggtcactgggttaaaaagggagagcagcagaaccgagcagctttgttccagcaccgcccccccggaccctttccaatcatggggccagaagaagagggagattctgccgccatcactgaggatgaggcagtgctcgttttggga

SEQ ID NO: 17962 - DNA, 1218 bp, Artificial Sequence
  Description of Artificial Sequence: Synthetic coding sequence
atgactctcgacgtgggtcctgaggatgaattgcctgattgggcagctgcaaaagagttttaccagaagtacgatccaaaggatgtgatcggacgaggtgtttcgagcgtggtgaggcgatgtgtccaccgtgcaaccggtcacgagttcgcagtgaagatcatggaagtgaccgcagaaaggctctcacctgaacagcttgaagaagtgagggaggcaacccgccgggaaactcatattctgcgccaagtggccggacacccacacataatcaccctgatcgatagctatgagtcctcctccttcatgtttctggtgttcgatctgatgcgcaaaggggagctctttgactaccttactgagaaggtcgcactttcagaaaaagaaaccagatccattatgcggagcctgctggaggcagtgtcttttctgcacgcaaacaacattgtccatagagatctgaaaccggagaatattctgcttgatgataacatgcaaattcgactttccgattttggattttcgtgtcatctcgaacctggcgaaaaactgcgggaactctgcgggactccgggttacttggcacctgagatcctgaagtgctcgatggacgaaacccacccaggctacgggaaggaggtggacctttgggcctgtggtgtgattctgtttactctgctggcgggttccccgcctttctggcatcgtcggcagattttgatgcttcggatgattatggagggtcagtaccaattctcgtcgccggaatgggacgaccggagctccaccgtgaaggatcttatctcccgtctgctccaggtggacccggaagcccggctgacggcagaacaggcactgcaacacccctttttcgaacgttgtgaaggaagccagccctggaatctgactccacggcagagattccgggtcgccgtctggacggtgcttgcagcagggcgcgtcgcattgagcactcacagagtaagaccactgactaaaaacgcactcttgagggatccatacgccctcagatcggtcagacacctcatagataattgcgcatttcggctttacggtcattgggtcaagaagggcgagcaacaaaacagggcagcgctttttcaacaccgacctcccgggccatttcctatcatgggtccggaagaagagggggactcggccgctattactgaggatgaagcggtgctggttcttgga

SEQ ID NO: 17963 - DNA, 1218 bp, Artificial Sequence
  Description of Artificial Sequence: Synthetic coding sequence
atgacattagatgtgggaccagaagatgaactgccggattgggctgcggccaaagaattctatcagaagtacgaccctaaagatgtgataggcagaggtgtatcatcggtcgttcgaagatgcgtccatcgtgctacgggacacgagttcgcggttaaaattatggaggttactgctgaaagactaagtccagagcagcttgaagaagttcgtgaagccacccgacgagaaacgcatattttgcgacaagttgctgggcatccacacatcatcacgttgatcgatagttacgagagcagcagtttcatgttcctggttttcgatcttatgcgtaaaggagagcttttcgattatcttacagaaaaagtcgcactgagtgaaaaagagaccagatcgatcatgagatccttgttagaagccgtatcctttcttcatgcaaataatatcgttcacagagatcttaaaccggaaaatattctcttggatgataatatgcagattagattgtcagattttggattctcctgtcatctggaaccaggtgaaaagttaagagagttatgtggaaccccgggatatttggctcctgaaatcctaaagtgctcaatggatgaaacccaccccggatacggaaaagaggttgatctttgggcgtgcggagttatactcttcactctgttggctggaagcccaccgttttggcatcggagacaaatcctcatgctgagaatgatcatggaaggacaatatcaattctcatcgcccgagtgggacgaccgaagctccacggtgaaggatcttatttccagacttctacaagttgatccagaagcgaggctaactgctgagcaagctttgcaacatccatttttcgaaagatgtgaaggatcccaaccatggaacttaactccacggcaacgattcagggttgcagtttggaccgtgctcgcagcaggaagagtggcactaagcactcatcgagttagaccacttacaaaaaacgcacttctccgtgatccatatgcactcagatccgtacgtcacctcattgataactgcgcatttagattgtacggtcattgggtgaagaagggagaacagcaaaacagagcggcgttattccaacaccgtcccccaggacctttcccaattatgggccctgaagaggaaggagactcagcagcaattactgaagacgaagccgttcttgtcctgggg

SEQ ID NO: 17964 - DNA, 1218 bp, Artificial Sequence
  Description of Artificial Sequence: Synthetic coding sequence
atgacacttgatgtagggccggaggacgagcttccggactgggcggcggctaaggagttttatcagaaatatgacccgaaagacgtgataggccgcggagtgagtagtgtggttcggagatgcgtccaccgtgcgacaggacacgagtttgccgtaaaaattatggaagtgacggctgagagactgtccccggagcaacttgaggaagtacgggaggccacgcggagagaaacgcatattcttcgtcaagtggctggacaccctcacattatcaccctgatcgacagctacgaaagctcttcattcatgtttctggtatttgaccttatgcgtaagggagagctgttcgactatcttaccgaaaaagtggccttgtcagaaaaagaaacacgcagcattatgcggtctcttttggaagcagtctcctttttacacgcaaataacattgtgcatagggatctgaaaccagaaaacatactgcttgatgataatatgcagattcggcttagtgactttggcttttcgtgtcatttagaacctggggagaaattacgcgaactgtgtgggacacctggttaccttgcgccggaaattctgaaatgctctatggatgagacacacccaggctatggaaaggaagtggatctgtgggcatgcggtgtgattttatttacattgttagctggatcgccgccgttttggcaccggcggcagatactcatgttacgcatgatcatggaaggacaatatcagtttagctctccggagtgggacgatagatcctcaactgtcaaagatcttatctctcgcctgcttcaggttgaccctgaggctcgccttacagcagaacaagccttacaacatcctttttttgaaagatgcgagggcagccaaccatggaacttaactcctcgccagcggtttcgtgtcgctgtttggacagtgctcgcagcaggacgcgtggcgttgtcgacccacagagtccgcccattgacaaagaatgcattgttacgtgatccgtacgcattgcggtcggtgcgtcatttgatcgataactgtgcatttagactttatggccattgggttaaaaaaggagagcaacagaatcgtgcagcgctttttcagcatcgcccgccgggtcctttccctattatgggacctgaggaggagggtgattcagccgcaattacggaagatgaggcagtcctcgtccttgga

SEQ ID NO: 17965 - DNA, 1218 bp, Artificial Sequence
  Description of Artificial Sequence: Synthetic coding sequence
atgacactggacgttggacctgaagacgagctacccgactgggcagccgcaaaggagttttatcagaagtatgacccgaaagacgtcatcggacggggggtctcatctgtagtccggcggtgcgttcacagggctaccggacacgagtttgcggttaagatcatggaagttaccgcagaacgactgtcacccgaacagctagaggaagtcagagaggctacgaggcgcgagacccacattctacgacaggtggcaggccatcctcatataataacactgatagattcttatgagtcgagcagtttcatgttcctcgtgttcgatctaatgcggaagggagagctattcgactacctgacagagaaggtcgcgctgtccgagaaggagaccaggtcaatcatgcgaagcctcttggaggctgtgtcctttctgcacgccaataacattgtgcaccgtgatctgaaacccgaaaatattctgttggatgataatatgcagattaggctatcagacttcggattctcgtgtcacctcgagccgggtgagaaattgagagagttgtgtggcaccccgggatacctcgccccagagatactcaagtgcagcatggatgagacccatcccggctacggcaaggaggttgatttatgggcctgtggggtgatcctctttaccttactcgcgggttcgcctcctttttggcacaggcgccaaattcttatgctgagaatgatcatggaggggcagtatcagtttagctcgcccgagtgggacgacaggagcagcactgtgaaggatctgataagccgacttctacaggtggaccctgaggcgcgcctgacagcagaacaggccctccagcacccatttttcgaacggtgtgagggcagtcagccttggaatttgactcccaggcagcggttcagggtggctgtgtggaccgttcttgcagccgggcgagtggcccttagtacgcacagggtgaggccgctcacaaaaaacgcattgctgcgagacccttatgctcttcgaagcgttaggcatctcatcgacaactgcgcttttcgcttatacggacactgggtgaagaagggagaacagcagaaccgcgcagccctgttccagcataggcctcctggtccttttcccatcatgggacccgaggaagagggcgactctgccgccattaccgaagacgaggctgttctcgtacttggg

SEQ ID NO: 17966 - DNA, 1218 bp, Artificial Sequence
  Description of Artificial Sequence: Synthetic coding sequence
atgacccttgatgtggggccagaggatgagctgccagactgggctgcagcaaaggaattctaccagaaatacgatcccaaggatgttatcgggaggggggtctcctctgtggtgagaagatgcgtacacagggccacgggtcacgaattcgcggtgaaaatcatggaagtcacagcagagagactctcgcctgagcagctagaagaagtgagggaggccacacgccgtgaaacccatatcctgaggcaggttgccggccacccccacattatcacgttaatcgactcatatgaatcatccagtttcatgttcctggtgtttgatctgatgcggaagggcgaactgttcgactacctgaccgagaaggttgctttgtccgaaaaagaaacacggagcatcatgcggagtttactggaagctgtatcttttctgcacgccaacaatatagtgcatcgggatctgaagccagagaacattctgcttgacgataacatgcagatcaggctgtccgatttcggcttctcgtgtcacctcgaaccaggcgaaaaactgcgcgaactttgcgggacacccggttaccttgcgcccgagatcctcaagtgtagcatggacgaaacgcacccaggttacgggaaggaagtggatctgtgggcgtgcggggttattctctttacactgctggctggaagccctcccttctggcatcgaaggcagattctgatgctacgcatgattatggagggtcagtaccagttctcttcaccagaatgggatgatcggagctcaaccgtcaaagacctgatcagcaggctgctgcaagtcgacccagaggcccgtctgactgcagagcaagcactccagcatccattcttcgagcgctgtgaggggtctcagccttggaatctaaccccgcgccaacgattccgagtggccgtgtggacagtgttggcagcagggagagtcgccttatccactcatagagtgagacctctgaccaagaatgcattgctgcgggacccttacgctctgcgctccgtaagacacctgatagataattgtgcttttcgactgtacggacactgggttaagaaaggcgaacaacaaaatagagctgccctgttccagcatcggccgccagggccgttccccatcatggggcccgaggaagagggagattctgctgctataacggaagatgaagccgttctggtgctcgga

SEQ ID NO: 17967 - DNA, 1218 bp, Artificial Sequence
  Description of Artificial Sequence: Synthetic coding sequence
atgaccctggacgttgggcctgaggatgaactgcccgattgggcagccgctaaggaattttatcaaaagtacgacccaaaggatgtcatcggccgtggcgtctcatctgtcgtccgccgatgcgtccaccgtgcaaccggccacgagtttgcagtcaaaatcatggaggttactgctgagcgacttagtcctgaacagcttgaagaggtcagagaggcgacccggcgtgagacccacatattgagacaggttgctggccatccccatatcattacattgattgattcatacgagagctccagctttatgtttctagtgtttgatctgatgcggaaaggcgagctgttcgactacctcactgagaaagtggcgctatctgagaaggagacgcgctctattatgaggagtctgctggaagcagtgtcttttttgcatgcgaataacatcgttcatcgcgatctaaaacccgagaatattttactggacgacaacatgcaaatacggctgtccgactttggcttttcctgtcatctcgagcctggagagaagttacgtgaattgtgcgggacaccggggtatttggcaccagaaatcttaaagtgctccatggatgagacgcacccgggatatgggaaagaggtggatttgtgggcatgtggggtgattttattcacgctccttgccggaagcccccccttttggcacaggagacagatcctgatgctgcgtatgatcatggagggccagtaccagttctcaagcccagaatgggatgatcggtcaagcaccgtcaaagatctgattagtaggcttctccaggtggaccctgaagctagactcaccgccgagcaggctctgcagcatcctttcttcgagagatgtgaagggagccaaccctggaacctgaccccacggcaacggtttagggtagccgtatggaccgtgcttgccgcaggacgagtagcactttcaacccaccgggtgcgtccccttactaaaaacgccctgctccgagacccctacgcgctccgctccgtgcgccatctgatcgacaattgcgcattcagactctatggacactgggtgaaaaagggtgagcaacagaaccgtgccgctctgttccagcaccgaccccccgggccattccctattatgggtcccgaggaggaaggtgatagcgccgcaataacagaagacgaagctgttctggtccttggt

SEQ ID NO: 17968 - DNA, 1218 bp, Artificial Sequence
  Description of Artificial Sequence: Synthetic coding sequence
atgaccttggacgtaggccctgaggacgagttacccgactgggctgccgccaaagagttctatcagaaatacgaccctaaagatgtgatcggaagaggcgtttccagcgttgtccggaggtgtgtgcatcgcgccacaggacatgagttcgctgtgaaaattatggaggtgacggctgaacggctctcaccagaacagctggaggaagtccgggaagcaacaaggcgggaaacgcatatactcagacaggtggccgggcacccacatataattacactgattgactcctacgaatcctcctcctttatgtttctggtgttcgatctgatgcgcaagggggaactgtttgactaccttaccgagaaagtggccctgagcgagaaagagacccggtcgatcatgagaagtttactggaggcagtgtctttcctgcatgcgaataatatcgtacatcgggatttaaagccggaaaatattttactggacgacaacatgcagattagactgagcgactttgggttcagctgccacctggaacccggtgaaaaactgcgtgagctgtgcggcactcccggctacctggctcctgaaatattgaagtgctcaatggatgagacgcatccaggatatggcaaagaggtggatctgtgggcatgtggcgtcatactgtttacgctgctcgcaggaagcccacccttttggcacaggagacagattctgatgctgcgcatgattatggaggggcagtaccaatttagtagccccgaatgggacgaccggtcctcaaccgtgaaagatctgatatctaggcttttgcaggtggaccccgaggctagattaacggctgagcaggctctgcaacacccgttctttgagaggtgcgagggttcccagccatggaacctaactcctcggcagcgttttcgcgtggctgtgtggaccgtgctggcagcagggagggtggctctctctacacaccgcgtgcgccccctgaccaaaaacgctctccttagagacccttacgccttgcggagtgtgcgacacctcatcgataattgtgcatttcgtctttatggacactgggtgaagaagggtgagcagcagaaccgagcagccctgtttcagcatagacctccaggccctttccccatcatgggaccagaggaagagggcgacagcgccgccattactgaagacgaggctgtactggtgctcgga

SEQ ID NO: 17969 - DNA, 1218 bp, Artificial Sequence
  Description of Artificial Sequence: Synthetic coding sequence
atgactttggacgttggacctgaagacgagctaccagactgggcggcggcaaaggagttttatcagaagtacgaccctaaggatgtgatagggagaggtgtgagcagcgtagtcaggagatgtgtccacagggcaaccggtcatgagtttgcggtgaagatcatggaggtgaccgccgagcgcttgagcccagagcagttggaagaagtcagggaggctacaagacgcgaaacccacatcctgagacaagtcgcaggacaccctcatattatcactctgatcgacagttacgaatcgtcttcctttatgttcttggtgttcgaccttatgcgcaaaggggagctgtttgattacctcaccgagaaagtggctctatcagagaaggagaccaggtcgataatgcggtccctgttggaggcggtctcctttctgcatgccaacaacatcgtccatcgcgatcttaagccagagaacatcctgctggacgataacatgcagatccgcctctccgattttggtttttcatgccacttagaacccggcgaaaagctccgtgagctgtgtggaactccaggctatctagctcccgagatcctgaagtgttctatggacgaaacgcaccctggctatggaaaggaggtagacctctgggcttgcggggtgattctttttaccctcctggcgggcagtcctcctttttggcaccggcggcagatactgatgctccgaatgatcatggaggggcaataccaatttagcagccccgagtgggatgaccgcagttcaacagtgaaggacttaatttctagactattacaggtcgatcccgaggcccggctgaccgcagagcaagctctccagcaccccttcttcgagcgatgtgaggggagccagccctggaatctcaccccgcgtcagcggttcagagtcgcagtgtggaccgttctcgctgctggccgcgtagccctaagcactcaccgcgtccgacccttgaccaagaatgcgttactcagggacccctatgctctgagatcagttagacatcttattgacaactgtgcttttagactgtacggccactgggtcaagaaaggagagcagcagaatagagctgctctattccagcacaggccccctgggccatttccaatcatggggcctgaagaggaaggcgactctgcagccatcacagaggacgaagccgtgcttgtgctagga

SEQ ID NO: 17970 - DNA, 1218 bp, Artificial Sequence
  Description of Artificial Sequence: Synthetic coding sequence
atgacacttgacgtgggcccggaggatgagctgcctgattgggcagctgccaaagagttctaccagaaatatgaccctaaagacgttatcgggcgtggcgtgtccagcgtagttaggagatgtgtgcatcgtgccacaggccacgagttcgcagtgaagatcatggaagttactgcagagaggctctctcccgagcaacttgaggaagtgagggaggccacccgacgcgagacccatattttgaggcaggttgccgggcacccccatatcatcacactgatcgacagttacgagagctcctctttcatgttcttagtgttcgacttgatgcggaagggagagctctttgactatctcaccgagaaggtcgccttgtctgaaaaggagacacgctcaattatgagatcactgctcgaagcagtgtcattcttgcatgcgaacaatatcgtacaccgggacctaaaaccagagaacattctgctggatgataacatgcagatccgactgtctgacttcggtttttcctgccatctggagccgggtgaaaagctccgggaactgtgtgggacacccgggtacctggctcctgagatcttaaagtgcagcatggatgaaactcatcctggatatggcaaggaggtggacctgtgggcatgtggcgtaattctcttcactttactcgccgggtcaccaccgttttggcatagaagacagatcttgatgctgagaatgatcatggaaggccagtatcaattttcctctccagagtgggacgacagatcctcaaccgtcaaagacctgataagccggctgttgcaggttgatcccgaagcccgcctcactgcggaacaagccttgcagcaccctttttttgagaggtgcgaagggagtcaaccctggaacctaaccccacggcagcgcttccgagtggcggtgtggacagtgctggccgcgggtcgggtggccttaagcacacatcgagtgagaccgttgaccaagaatgcactcttacgtgatccgtatgcgctgaggtctgttcggcacctcattgacaactgtgcttttaggctctatggtcactgggtcaagaaaggggagcagcagaacagggcagcgttgttccaacaccgtcctccaggtccatttccaatcatggggcctgaggaggagggggactctgctgcaatcacagaagacgaggcggtgctggtgttggga

SEQ ID NO: 17971 - DNA, 1218 bp, Artificial Sequence
  Description of Artificial Sequence: Synthetic coding sequence
atgacgctcgatgtcggacctgaagatgaattgcccgattgggcagcggctaaggagttctatcagaagtatgacccaaaggacgtgatcggacgcggagtttcctccgtcgtaagacggtgtgttcatcgggccacaggccatgagttcgcggttaaaattatggaagtcacagccgagcggcttagtccggagcaactcgaggaggtccgtgaagcgacccgccgtgaaacacacatccttcgacaggtggctggacatccccatattatcacattaatcgatagctatgagtcatcgagcttcatgtttcttgtgttcgatctgatgcgcaagggtgagttgtttgactacctaacagagaaggtcgccttatcggaaaaagaaactaggagcatcatgcgctccttgctcgaagcagtttcctttcttcatgccaacaacatcgtacaccgcgatttgaagccggagaacatcctattggacgacaacatgcagatacggctttcggattttgggttctcgtgccacctggagccgggtgagaagctccgggagctttgtggaacccccgggtacctcgcacctgagattctgaaatgttccatggacgagacgcatccaggttatggtaaagaagtcgacctgtgggcttgcggggtgattctgtttacccttctggcagggtcaccccccttctggcaccgtcgccagatactgatgctgcgtatgattatggaggggcaataccagttcagttctccggaatgggatgaccgatcctctaccgtcaaagacctgatctctagactgttgcaggtcgatccagaggcccggctgaccgctgagcaggctcttcagcacccattcttcgaacgttgcgaaggttcgcaaccgtggaacttaacaccgcgtcagcgattccgcgtagcagtttggacagttcttgctgctggccgagtggcgctcagtactcaccgcgtacgcccattgactaaaaacgcgctgttgcgcgatccttacgcgctgcgtagcgtccggcacctaatcgataattgcgcgtttaggctgtacgggcactgggtgaagaagggtgagcaacaaaacagagccgcgctctttcagcatcgtcctccaggtccatttccgatcatgggccctgaggaggagggagattccgccgccatcacggaggatgaagcagtgctcgtgctcggc

SEQ ID NO: 17972 - DNA, 1218 bp, Artificial Sequence
  Description of Artificial Sequence: Synthetic coding sequence
atgacgctggatgtgggtcctgaagatgagctgcctgattgggctgcagcaaaggagttctaccaaaagtacgatccgaaggacgtcatcggtcgaggagtgagctcagtagtccgcagatgtgtccatcgcgcgaccggtcatgagttcgccgtgaaaatcatggaggtgaccgccgaaagacttagccctgagcaacttgaagaggtgagagaggcaactagaagagaaacccatattcttaggcaagtcgcagggcatcctcatatcatcactctgattgactcatacgaatcatcgtccttcatgttcctggtgtttgaccttatgcgcaagggagagctgttcgattacctgactgagaaggtcgcactttccgaaaaggaaacccgtagcatcatgcggtccctgctggaagcagtgtccttcctccacgcaaacaacattgtgcaccgtgatcttaagccagagaatatccttcttgatgacaatatgcaaattagactgtcggactttggtttttcgtgtcatctggaaccaggggaaaagttgcgggaactttgcggaaccccgggatacctggcacccgagattctcaagtgttcgatggatgaaactcaccctggctatggaaaagaagtcgatctgtgggcatgcggggtaatcctttttaccctgctggccggctccccaccattttggcacagacggcaaatacttatgctccgcatgatcatggaaggacagtaccagttttcctcgcccgaatgggatgaccgctcaagcacggtgaaagatctgatatcgcgattgctgcaggttgaccctgaagcacggctcactgcggagcaggcactgcagcatccttttttcgaaagatgtgaaggtagccaaccctggaacctcactccccgtcagagatttcgagtggctgtatggactgtgcttgcggcaggaagggtggcactgagcacccatagagtgcgtccactcaccaagaacgcactgctgcgcgatccatacgccctgagatccgtgcgccatcttattgacaattgcgcgtttagactctacggccactgggtgaagaaaggggaacagcaaaaccgggcagcactttttcaacaccgccctcctggtccattccctattatgggccctgaagaagagggagactcggccgcgattaccgaagatgaggctgtcctcgtcctgggt

SEQ ID NO: 17973 - DNA, 1218 bp, Artificial Sequence
  Description of Artificial Sequence: Synthetic coding sequence
atgactttagacgtaggccccgaggatgaacttcccgactgggccgccgcaaaagaattctatcaaaaatacgacccaaaagacgtgatcggacgtggcgttagctcggtcgttcgtcggtgcgtccaccgagccactggacatgaattcgccgtcaagattatggaggtgacagcggagcgactgagcccggagcagctagaggaggtgcgagaagctacccgccgagaaacccacattctgaggcaggttgcgggacatccacatatcatcactcttattgattcctacgagtctagtagttttatgtttctggtgtttgacctcatgagaaagggcgagttgttcgattatctgacagaaaaagttgcgctctcggagaaggaaacacgatccatcatgcgatctttgctcgaagccgtatcattcctgcacgctaacaatattgtgcacagagacttgaaacctgaaaatatactcctggacgacaacatgcagatcagactctccgatttcggcttcagttgccatctcgagcccggggagaagcttagagaactctgtgggacccctggatatctagcccctgagattcttaagtgctctatggacgaaactcacccaggatacggaaaggaagttgatctttgggcatgcggtgtgattcttttcaccctgctcgcgggatccccccccttctggcataggcgccagatccttatgttgcggatgataatggagggccaataccagttcagctcgcctgagtgggatgataggtcgtctaccgtgaaagacctgatttccaggctcctgcaggttgaccctgaggctagactgaccgcagaacaagcactgcagcacccattttttgaaaggtgtgagggatcccagccatggaacctgacacctcgacagcgtttccgagtggccgtctggacagtgttggccgccgggcgagtggcattgtctacacatagggttcggccgctgactaaaaatgcactcctccgagacccgtacgccctacgctcagttcgacacctgatcgataattgtgcgttccgcctttatggtcattgggtaaaaaagggagagcagcagaatagagcggcactcttccagcaccgtcctccgggaccctttcctatcatggggcccgaagaggagggcgatagcgcagcaataaccgaggatgaagccgtgttagtgttgggt

SEQ ID NO: 17974 - DNA, 1218 bp, Artificial Sequence
  Description of Artificial Sequence: Synthetic coding sequence
atgaccctggatgtcgggcctgaggacgagctcccagactgggctgcggcgaaggaattctaccaaaagtacgatccgaaggatgtcatcggacgcggagtctcgagcgtggtccggcggtgcgtgcaccgggcaactggccatgaatttgccgtgaagatcatggaagtgactgcggagcgactctcgccggagcagctggaggaagtgcgcgaggcaacgcgccgggaaactcacattctgcgacaagtggcgggacacccgcatatcatcactctgatcgattcctacgagtcctcctcgttcatgtttctggtgtttgacctgatgcggaagggagaactgtttgattacctcaccgagaaagttgcactgtcggaaaaggaaacccggagcattatgcgctccctccttgaagctgtctccttcctgcacgctaacaatatcgttcatcgggatctcaagccagaaaacatccttcttgacgataacatgcaaatccggctgtctgatttcgggttctcatgccacctggagccgggggaaaagctgcgcgagctttgcggaactcctggctacctggcgcccgaaatcttgaagtgctcaatggacgagactcacccaggttatggaaaagaggtggacctctgggcctgcggcgtgatcctgttcaccctgctcgctggctccccgcctttctggcaccggagacaaatactcatgctgcggatgattatggagggtcaataccagttctcctcgccggaatgggatgaccggtcctctactgtgaaagatctcatctcacggcttctccaggtggaccccgaagcgcgcctgactgccgagcaggcgctgcagcatccgttttttgaacgctgcgagggatcccaaccctggaatctcactccgcgccaacgcttcagagtggcagtgtggactgtgctggccgccggcagagtggcactttccactcaccgggtgaggccactgaccaaaaatgctctcctgcgggatccatacgccctccggtccgtgagacatcttatcgacaattgtgcgttcagactctacggacactgggtgaagaagggcgagcagcaaaaccgcgctgcgctcttccagcatagacctccaggtcctttcccaattatgggaccagaggaagaaggggattcggccgcaatcacggaggacgaagccgtactggtcctggga

SEQ ID NO: 17975 - DNA, 1218 bp, Artificial Sequence
  Description of Artificial Sequence: Synthetic coding sequence
atgacactagacgtgggtcccgaagacgagctgcccgactgggccgccgccaaggaattctaccagaagtatgacccaaaagacgtcatcggacgcggcgtgtcttccgtggtgaggaggtgcgttcatcgagccacaggccacgagttcgccgttaagataatggaagtgacggccgaacgtctttcacccgagcagctggaagaagtgagggaagcaaccagacgggaaactcacattctgagacaggtggcagggcacccacacatcatcacactgatcgattcttacgagtctagctccttcatgttcctggtctttgacctgatgcgaaagggtgaactgtttgattacctcaccgaaaaagtggcattgagtgagaaagagacacgttcaatcatgcgctctttactggaagccgtttcgttcctccacgccaataacatcgtgcatcgtgacctgaagcctgagaatattctcctggacgacaacatgcagatccgcctgagcgacttcggattcagttgtcatttagaaccaggggaaaagttgcgggagctatgtgggactccggggtacctagcccctgaaatcctgaaatgcagcatggatgagactcatcccggctatggcaaggaggtagatctctgggcatgcggtgttatcttatttaccttactcgcaggttccccacccttttggcaccgacgccagattcttatgcttcggatgatcatggaaggccaataccagttttcttcccccgaatgggacgatcggtcctctacagtcaaagatcttatctctcgactgttacaagtcgatccagaggccaggttgaccgccgagcaggccctgcagcatcctttcttcgagcgatgtgaaggatcccagccctggaacctgactccacgccagcgattccgtgttgcggtgtggacagttctggcagcagggcgggtcgcactatcaacccatcgcgtgcgcccactcacgaaaaacgccttactgcgggatccctatgcacttagaagcgtacggcatcttatcgataattgcgcatttagactctacgggcactgggttaagaaaggagaacagcagaatagagcggcgttgtttcaacacaggcctccggggccatttccgataatgggccccgaggaggagggagatagcgcagccattacagaggatgaagccgtgctggttctcggg

SEQ ID NO: 17976 - DNA, 1218 bp, Artificial Sequence
  Description of Artificial Sequence: Synthetic coding sequence
atgacactggatgtggggccagaggatgaactgccagattgggcagcagcgaaggaattctaccagaagtatgatcctaaggacgtgattgggcggggggtgtcttctgtggtcaggagatgcgtacacagggctactggccacgagttcgcggtaaagataatggaggtaaccgccgaacggctgtctccggaacagctggaagaggtccgagaggctacacgacgcgaaactcacattttgcggcaagtcgcaggccacccacatattatcacattgatcgattcttacgagtcatctagcttcatgttcttggttttcgatctgatgcgcaagggagaactcttcgactacctaactgagaaagtcgccctctctgaaaaggaaactcggtctattatgagaagcctgctcgaggcggtgtccttcctccatgcaaacaatatagttcaccgcgacctgaaacctgaaaacatcctgctagacgacaatatgcagatccgcttatccgatttcgggtttagctgtcacctggaacctggagaaaagctccgcgaactatgcggcacccctgggtacctggcacctgagatactcaaatgctccatggacgaaacccaccccggatatgggaaagaagttgatctttgggcatgcggagtgatactgttcaccttgttggccggttccccgcctttttggcatcggcggcaaatcttgatgctgagaatgattatggaggggcagtaccagttctcaagccccgagtgggatgacaggagctcaaccgttaaggatttgatcagtagattactccaggtggacccagaggcgcgcctgactgcagaacaggcactccagcatccctttttcgagcggtgcgagggatcccagccctggaatcttacaccaaggcaacgcttccgggttgctgtgtggaccgtgctggcggccggaagagtggcgctttcaacacatcgcgtcaggccattgaccaagaatgccctactgagagatccctatgcccttcgaagcgtccggcacctgattgacaactgtgcatttagattgtatggccactgggtcaagaaaggtgagcagcagaacagggcagcactgtttcagcatagaccccctggtccattccccataatggggccggaagaggaaggcgattccgctgctattactgaggatgaggccgtactggtactgggg

SEQ ID NO: 17977 - DNA, 1218 bp, Artificial Sequence
  Description of Artificial Sequence: Synthetic coding sequence
atgaccctggacgttggaccggaggacgagctgccggattgggcggctgcaaaggagttctatcaaaagtacgatccaaaagacgtgatcggaaggggagtgtcctcggtcgtgaggcgttgtgtgcatagggcgaccggacacgagttcgccgtcaaaatcatggaggtcaccgcagaacggctgagcccagaacaactggaagaggtgcgggaggcaactagaagggaaacccatattctgcggcaggtggccgggcaccctcatatcattactctgattgactcctacgaaagcagcagcttcatgttcctggtgttcgacttgatgagaaagggggaacttttcgactacctgactgagaaggtcgccctttcagagaaggaaaccagaagcatcatgcggtccctgctcgaggcggtgagctttctgcacgccaacaatatcgtccaccgcgatctcaagccggaaaacatcctcctggacgacaacatgcagattagactttcagacttcgggttttcatgtcaccttgaaccaggagagaaactccgggagctgtgcggcacgccgggatacctcgctcctgaaatcctgaagtgctcaatggacgaaactcacccaggctacgggaaggaagtggacctgtgggcgtgcggcgtcatcctttttactctgctcgcgggaagcccacccttctggcaccgccggcagatcctgatgctccgcatgatcatggaaggacagtaccagttctcgtccccggaatgggacgatcggagctctactgtgaaggatctgatctcacgactgcttcaagtggacccggaagcacgccttaccgccgaacaggcgctgcagcacccgttcttcgagagatgtgaaggttctcagccatggaatctgacgccaagacagcggttccgggtggcggtctggaccgtgctggccgcgggtcgggtggcactgtccactcatagggtccgcccgctcaccaagaacgcactcttgagggatccgtatgctctgcgctcggtgcgccacctgattgacaactgcgccttccgcctgtacggacattgggtgaaaaagggcgaacaacaaaacagagcggcactcttccaacatagacctccaggacctttccccatcatgggaccggaagaggagggggattcggccgccatcaccgaggacgaagcagtcctcgtcctggga

SEQ ID NO: 17978 - DNA, 1218 bp, Artificial Sequence
  Description of Artificial Sequence: Synthetic coding sequence
atgacgctcgatgtgggaccggaagatgagttgcctgactgggcagccgctaaagaattctaccaaaagtacgacccaaaggatgtgatcgggcggggggtgtcatccgtggtgcgccggtgcgtccacagagcgaccggacatgaatttgctgtgaaaatcatggaggtcaccgccgagcggctgtccccggaacaactggaggaagttcgggaggccactagacgcgagactcatatccttcggcaggtcgcagggcacccgcatatcatcaccctcatcgactcctacgagtccagctcattcatgtttcttgtgttcgacctcatgcgtaagggcgagctctttgactacttgacggagaaggtcgctctctctgagaaagagactaggtcgataatgaggtcactgcttgaggccgtgagcttcttgcatgctaacaatatcgtccaccgggacctgaagccggagaatatcctcctggatgacaacatgcagatccgcctgtccgacttcggcttcagttgtcacctggagccaggagagaagctccgcgaactgtgtggaactccgggctacctggctcctgaaattctgaagtgcagcatggacgaaacccacccgggttacggaaaagaagtggatctgtgggcctgcggcgttatccttttcaccctcctggccggaagcccgccattttggcaccgacgccagatcctgatgctgagaatgatcatggaaggacagtaccagttctcgtcccctgaatgggacgaccgctcatcaaccgtgaaggacctcatcagtcggctcctccaggttgatcctgaagctcgcctgactgcagaacaggcgcttcagcatccgtttttcgaacggtgcgaaggatcgcaaccgtggaacttgaccccccgacaacgcttccgtgtggcggtatggactgttctggcggccggtcgcgtggcattgtctactcacagagtgaggccgctgacgaagaacgccctgctgcgcgacccctacgcccttcggtcggtccggcatcttattgacaactgcgcgttccggctgtatgggcactgggtcaaaaagggagaacagcagaatagagcagcccttttccaacaccgcccgcccggcccatttcctataatgggtcctgaggaggaaggggatagcgcggccattaccgaagatgaggcggtgctcgtgctggga

SEQ ID NO: 17979 - DNA, 1218 bp, Artificial Sequence
  Description of Artificial Sequence: Synthetic coding sequence
atgactctggatgtcggtcccgaagacgaactccccgattgggctgccgctaaagagttttaccagaagtacgacccaaaggacgtgatagggaggggtgtgtcgtcggtggttcgtcgctgtgttcatcgtgcgacaggccatgagtttgccgtcaaaattatggaggtaactgccgagcgactgtcacctgaacagctggaggaggtccgagaggccaccaggcgggagacccatattctgcgacaggtagccggacatccccacatcatcaccctgatagacagctacgagtcctccagcttcatgttcctcgtgtttgatttgatgaggaagggcgagctattcgattacctgactgaaaaggttgccctgtcggaaaaagagacaagatctattatgagatctcttttagaagccgtgtcctttctgcatgcaaataacattgttcatagggacctgaagcccgaaaatattttgttggatgataacatgcaaatcaggctgtcggattttggatttagttgccatctcgaacccggagaaaagctgcgcgaactctgtggaaccccggggtaccttgcccctgagatcctgaagtgctctatggacgaaactcacccaggctacgggaaggaggtcgatctgtgggcgtgcggtgtaatcttattcaccttgctggcaggtagcccccccttttggcaccgccggcagatccttatgctgagaatgattatggaagggcagtaccagtttagttctcccgaatgggacgaccgcagctccacagtcaaagaccttataagccggctgttgcaagtcgatcccgaagctcgtctcacagctgaacaggccctgcagcaccccttctttgaacgctgcgagggtagccagccttggaacctcactccacgccagcgttttcgggtggcggtctggaccgttctcgcagccggacgagtcgccctgagcacccatcgagtccgaccactgacaaagaatgccctgctgagggacccctatgcgctgaggtctgtgcgccacttaattgataattgcgctttcaggctctacggccactgggtgaaaaagggcgagcaacagaatcgggctgccctgtttcagcatcggccacccggtccatttccgatcatgggccctgaagaagagggcgattccgcagcgatcaccgaggacgaagccgttctcgtcttaggg

SEQ ID NO: 17980 - DNA, 1218 bp, Artificial Sequence
  Description of Artificial Sequence: Synthetic coding sequence
atgacccttgacgtgggacccgaggatgagctcccagattgggccgcagcaaaggagttttaccagaagtacgacccgaaggacgtcatcggtcgcggggtgtcgagcgtcgtgcgcaggtgcgtgcaccgggcgactggccacgagttcgcggtcaagattatggaagtgaccgctgaacggctgtccccggaacaactggaggaggtcagggaagcaaccagacgcgagactcacatccttcgccaagtcgccggacatccgcacatcatcactctcatcgactcatacgagagctcgtcctttatgttcctcgtgttcgaccttatgcggaaaggggagctgttcgactacctgacggaaaaggtggcgctgagcgaaaaggaaactcgcagcattatgaggtcactcctggaagcggtgtcattcctgcatgcgaataacatcgtgcaccgcgatctcaagccggagaacatcctgctcgacgacaatatgcagatccggctgtccgatttcggtttctcctgccacctggagccaggcgagaagctgcgggagctgtgtggaacgccgggatatttggcgcctgaaatcctgaagtgctcgatggatgaaactcacccaggctacggcaaggaagtggatctgtgggcttgcggcgtgatcctcttcaccctcctggcaggatccccgcccttctggcatcggcgccagatactgatgttgcgaatgatcatggaaggccagtaccagttcagctcaccggaatgggacgaccgctcatcaaccgtgaaggacctgatcagccggctgctgcaggtggacccggaggcccggctgactgcggaacaagccctgcagcatcctttcttcgaacgctgcgaaggctcgcagccgtggaacctcaccccgaggcagcgctttcgggtcgccgtgtggaccgtgctcgcggcgggcagggtggccctctcgacgcacagagtgcgcccgcttaccaagaacgccctcttgcgcgatccgtacgccctccgatctgtcaggcacctgattgacaactgtgcctttcgcctgtacggtcactgggtgaagaagggagaacagcagaatcgtgccgccttgtttcagcatcggccaccggggccgttccctatcatggggccggaagaagagggcgactcagctgctatcaccgaggatgaagcagtgttggtgctggga

SEQ ID NO: 17981 - DNA, 1218 bp, Artificial Sequence
  Description of Artificial Sequence: Synthetic coding sequence
atgacgctggacgtagggccagaagatgagctcccggactgggcagccgccaaagaattctaccaaaagtacgacccaaaggacgtcatcgggcgcggcgtctcttccgtggttaggaggtgcgtgcaccgggccacaggccacgaatttgctgttaagattatggaggtaaccgccgagcgcctgtctccggaacagttggaggaggtgcgcgaggccacacggcgagaaacgcacatcctccggcaggtggctggtcacccccatatcatcaccctgatcgattcttatgaatccagcagctttatgtttcttgtgtttgacctgatgcgcaagggcgagttgtttgattacctcactgagaaagtcgcattgtccgagaaagagacacggagtatcatgagatcgctgctggaggctgtatctttcctccacgccaacaatatcgtacacagggacctaaagccagagaatatacttcttgatgacaacatgcagataagactgagtgatttcggcttctcttgccacctagaacctggggagaaactgcgcgaactgtgtggtacaccaggctacctagcccccgaaatcctcaaatgttccatggacgagacccatcctggttatgggaaagaagtggacctgtgggcatgcggggttattctcttcacattgttggccggctcacctcccttttggcaccgccgtcagatacttatgcttagaatgataatggagggtcaatatcagttctcatccccagagtgggacgaccgttcttctaccgtgaaagacttaatctcccgcttgttacaggtcgacccagaggcccggctgaccgccgagcaggcactgcagcatccgttttttgaacgctgtgagggatctcaaccatggaacctcacaccacgtcagaggtttagggttgccgtttggacggtccttgcagctggccgagtggcactgagcacccatagggtcagaccattgaccaagaatgccctgcttcgggatccttatgccctccggtcggtaagacatctaatcgataattgcgcatttcgcctgtacggacattgggtgaaaaagggcgagcagcagaatcgagctgccttgtttcagcacaggcctcccggtcccttccctatcatgggtcctgaagaggagggagatagcgccgccatcactgaagacgaggcagtactcgtactcggt

SEQ ID NO: 17982 - DNA, 1218 bp, Artificial Sequence
  Description of Artificial Sequence: Synthetic coding sequence
atgaccctggatgtcggacccgaggacgagctgccggattgggccgcagcaaaggagttctaccagaagtacgatccaaaggatgtgatcgggcgcggagtctcgagcgttgttagaagatgtgtgcacagagcaactggccacgaattcgcagtgaagattatggaggtgactgcggagaggctgtccccagaacagctggaagaggtgcgtgaagcaaccagacgagaaactcatatcctgagacaagtcgcaggacatccccacatcattaccctgatagattcctatgagtcgtcatcctttatgttcttggtctttgatttgatgcggaaaggagaacttttcgactacctgaccgaaaaagtggcgctctccgagaaggaaacccgctcgattatgcgttcgctgcttgaagctgtctcctttcttcacgccaataacatcgttcatagagatctgaagccagaaaacattctccttgacgataacatgcaaatccgcctttccgattttggctttagctgtcacctcgagcccggagaaaagctgcgcgaactttgtggtaccccaggatacctggcccctgagattctcaagtgttcgatggacgaaacgcatccaggctacggcaaagaggtggatctttgggcctgtggggtgatcctttttacgctgctcgcgggaagccctccattctggcaccggcggcaaatcctgatgctgcgcatgatcatggagggccagtaccagttttcaagccctgaatgggatgatagatccagcacggtgaaggatctgatttccagactgcttcaggtcgaccctgaggctcgccttaccgcggagcaggcactccaacacccgttttttgaacgatgcgagggatcgcaaccctggaacttgactcctagacaacgcttccgagtggccgtctggaccgtgctcgcagcaggccgggtcgcactgagcacccatcgggtgcggcctctgacgaagaatgcactcctgagagatccttacgccctgaggtccgtgaggcacctcattgataactgtgctttccgcctttatggccactgggtcaagaagggagaacagcaaaatcgcgcggccctgtttcaacatcggcctccaggaccgtttccaatcatgggtcctgaggaagaaggcgattccgcagcaataaccgaggatgaagcagtcttggtcctggga

SEQ ID NO: 17983 - DNA, 1218 bp, Artificial Sequence
  Description of Artificial Sequence: Synthetic coding sequence
atgaccctcgatgtgggccctgaggacgagcttccggattgggccgctgcgaaagagttctaccagaagtacgacccgaaggacgtcatcggaagaggcgtgagctcggtcgtgagacggtgcgtgcacagagcgaccggacatgaattcgctgtcaaaatcatggaagtcactgccgagcggctgagccctgagcagctcgaagaagtgagagaagcgaccagacgcgaaactcacatcctgaggcaagtcgcgggacacccgcacatcattactcttatcgactcgtacgaatcaagctcgttcatgttcctggtgttcgacctgatgcgcaagggagagctgtttgactacttgaccgaaaaagtcgccctgtccgagaaggaaacccgcagtatcatgcgctcactgttggaagccgtgagcttcctccacgcgaataacatcgtgcaccgggacctcaagccggaaaacatcctgctcgatgataatatgcaaattaggctgtccgatttcggattttcctgtcatctcgagccaggagaaaaactccgtgagttgtgcgggactccaggataccttgcccctgagatcttgaaatgctcaatggatgagactcatccaggctacgggaaggaagtggatctgtgggcctgtggtgtcattctgttcaccttgctcgcgggctcaccgccattctggcatcgccgccagatcctgatgctccgaatgataatggaaggccagtaccaattttcgtccccggaatgggacgaccggtcctctactgtgaaggacctgatctcgcgcctgctgcaagtggaccccgaggcacggctgaccgcagaacaggctctgcaacacccgttcttcgaaagatgcgagggaagccaaccgtggaacctgacccctcggcagaggttccgagtggcggtgtggaccgtgctggctgccgggcgcgttgcactgtccactcatcgcgtgaggccgctcacgaagaacgcccttctgcgcgatccctatgcacttagatcggtccgccacctcatcgacaattgcgcctttcggctctacggacattgggtgaagaagggagaacagcagaaccgggccgcactgttccagcaccggcctcccggaccatttccaatcatgggtccggaggaagagggcgactccgccgcaatcacggaggatgaagctgtgctggttctcggt

SEQ ID NO: 17984 - DNA, 1218 bp, Artificial Sequence
  Description of Artificial Sequence: Synthetic coding sequence
atgactctggatgtgggacctgaagatgagctcccggactgggctgccgcaaaggagttttaccaaaagtacgacccaaaggatgtgattggaagaggagtatcctccgtggtgagacggtgtgtgcaccgagccaccggccatgaatttgcagtgaaaatcatggaagtgactgcagaacgactcagcccagaacaactggaagaggtccgtgaggctacccggagagaaacgcatatccttagacaagtcgcagggcatcctcatatcattactctgattgatagctacgagagctcgtcatttatgttcctggtgttcgacctcatgcgcaagggggagctgttcgactatctgactgagaaggtggccctgtcggagaaggaaaccagatcgattatgaggtcgctgctggaagccgtgtcttttcttcatgcaaacaatattgtgcatcgcgatctcaagcctgagaacattctgcttgacgataacatgcaaatccgcctttccgattttggcttttcctgtcacctcgaaccgggagaaaagctgagggagttgtgcggaactcccggctatttggccccagaaattctgaaatgctccatggatgaaactcatcctggctacggtaaggaagttgatctttgggcgtgcggcgtgattctgttcactctgctggcaggcagcccacctttttggcatcggcgacagatcttgatgctgcgcatgataatggaaggccaatatcaattctcaagccctgaatgggacgaccggtcatcgacggtgaaggacctcataagcaggcttctgcaagtggaccctgaagcaaggcttaccgcagaacaggctcttcagcatccttttttcgagcgatgcgaaggaagccagccatggaatcttacgcccagacaacggtttcgcgtggccgtgtggactgtgctcgccgcaggtagggtggcactgtcaacgcatcgggtgcgtcccctcactaagaacgcccttcttcgggatccatacgccctccgtagcgtgagacatcttattgacaactgtgcattcaggctctacggccactgggtgaaaaaaggtgaacagcaaaatagagcagcattgttccagcacagacctccaggcccttttcctatcatgggtcctgaagaggaaggggactcggcagcgatcactgaagatgaagcagtgctggtgttggga

SEQ ID NO: 17985 - DNA, 1218 bp, Artificial Sequence
  Description of Artificial Sequence: Synthetic coding sequence
atgaccctcgatgtgggtccagaagatgaactcccagactgggcggccgcgaaggaattctaccagaaatacgatcctaaggatgttatcggaaggggcgtgtccagtgttgtacgcaggtgcgtccaccgcgccaccggccacgagttcgccgtgaagattatggaagtgaccgctgagaggctgagccccgaacagcttgaggaagttagggaagcaaccaggagagagactcacattttgagacaggtggccggccacccacacattatcaccctgatcgattcttatgaatccagcagcttcatgtttctggttttcgatctgatgcgcaagggagaactgttcgactaccttaccgagaaggttgctttgtccgaaaaagaaacccgctcaattatgaggagcctcctcgaggctgtatccttcttgcatgcaaacaacatcgttcatagggacctgaagcctgaaaacattttgcttgacgataacatgcagattaggctttccgattttggcttctcatgccacctggagccgggagagaaactcagggagctctgtggaacacccggatacttggccccggagatccttaagtgctccatggacgagacccaccccggatacggtaaggaggttgatttgtgggcttgcggtgtgattctgtttactctgcttgccggctctccaccgttctggcaccgccgccagattcttatgctgagaatgatcatggagggccagtatcaattctcttcacctgagtgggatgacagatctagcactgttaaggacttgatctccagactcctccaggtcgaccctgaggccaggctcacagccgagcaagcccttcaacaccccttcttcgagaggtgcgagggctcccagccttggaatctgacccccagacagagatttagggtcgccgtgtggacagtgcttgctgcaggtagagtggccctgagcacacaccgcgtgaggccgttgacaaagaacgccctgctgagagacccttatgctctgagatctgtccgccacctgattgacaactgtgcatttaggctctacggtcattgggttaagaagggcgagcaacagaacagggccgctctgtttcagcacagaccccccggaccatttcccatcatgggccctgaggaagaaggtgacagcgcagctattaccgaggacgaggctgtgttggtgctcggc

SEQ ID NO: 17986 - DNA, 1218 bp, Artificial Sequence
  Description of Artificial Sequence: Synthetic coding sequence
atgacacttgatgtaggtcccgaagacgaactccccgattgggccgccgccaaagaattttatcagaagtatgatcctaaggacgtgatcggaagaggggtgagcagcgttgtgcgtagatgtgttcatagagccacaggacatgagtttgctgtgaaaattatggaggtgaccgccgagagattgagtcctgagcaacttgaggaagtgcgcgaggcaacccgcagagagacccatattctgaggcaggtagcaggtcaccctcacataattaccctgattgatagttacgaatctagctcatttatgttcctggtttttgatctgatgaggaaaggcgagctgtttgactatctaaccgagaaagtggccttaagtgaaaaggaaacccgctctattatgcgctcattgctggaggctgtctccttcttgcatgctaataacattgttcatcgcgatttgaagcctgaaaacatcctcctggatgacaatatgcagattcggctttctgacttcgggttctcttgccacctcgaacctggtgaaaaattacgcgaactatgcgggacaccaggatatcttgcacccgagatactcaagtgttcgatggatgagacccatcctggttatggcaaggaggtggacctctgggcctgtggagtaatcctcttcacactgttggcaggtagtcccccgttttggcaccgcaggcagattctgatgcttagaatgatcatggaaggacagtatcaattctctagtcccgagtgggacgacagatcctccacagtgaaagatctgatctctcggttactgcaggtggatcccgaggctcggctaaccgcagaacaggctttacaacatccctttttcgaaagatgcgagggaagtcagccttggaatttgaccccgaggcagcgattcagggtggcggtctggacagtgctggctgcgggacgagtggcattgagtactcatagagtccgccccctgactaagaacgccctactccgggatccgtatgctctgagatctgtacggcatctgattgacaactgcgcctttaggctatacggccattgggtcaaaaaaggcgagcaacagaatagagctgcactgttccagcatagaccacccggcccatttcccattatgggcccggaggaggaaggcgattccgcagctattaccgaagacgaagcagtcctagttctgggc

SEQ ID NO: 17987 - DNA, 1218 bp, Artificial Sequence
  Description of Artificial Sequence: Synthetic coding sequence
atgacccttgatgtggggcctgaggatgagctgcctgattgggccgcggccaaggaattctaccagaagtacgatccgaaggatgtcatcggaagaggcgtcagctcggtcgtgagacgttgcgtccaccgcgccaccgggcacgaattcgcggtgaagattatggaagtgactgcggagcgtctgtcgccggaacaactcgaggaagtccgggaggcaaccaggagagaaacccatatcctgcggcaggtcgcaggtcacccgcacatcatcactctgatcgattcatacgaatcctcgtcgttcatgttcctcgtctttgatctcatgcgcaagggagagctgttcgactatctgaccgagaaggtcgcgctgtcggagaaggagactcggtcaatcatgcgatcgctcctggaggccgtctccttcctgcacgccaacaacatcgtgcaccgagatctcaaaccggagaatatcctgctggacgacaatatgcagatccgcttgtccgacttcgggtttagctgccaccttgaacctggcgagaagctcagggagctgtgcggtacccctggatacctcgctcctgaaatccttaaatgttcaatggatgagactcacccaggttacggaaaagaagtcgacctgtgggcatgtggagtgatcctgttcactctcttggcagggtcgccgccattttggcaccgcagacagatcctgatgctgcgcatgatcatggaggggcagtaccagttcagctccccagaatgggatgaccggagctcaaccgtcaaggatctgattagcaggctgctgcaggtggatccagaggcacgcctcactgccgagcaagcccttcagcatccgtttttcgaaagatgcgaaggctcgcagccgtggaatctcaccccacggcaaagattccgggtggcggtttggaccgtactggccgccggaagggtcgcattgagcacccatcgggtgcgcccgctgacgaaaaacgctctgttgcgcgatccttacgcgctgagatccgtccgacacctcatcgataattgcgctttccggctgtacgggcactgggtgaaaaagggagaacagcaaaaccgggcggcattgttccaacatcgcccccctggaccgttccctatcatgggtcctgaggaggaaggagacagcgcggccatcactgaggacgaagcagtgctggtgctcgga

SEQ ID NO: 17988 - DNA, 1218 bp, Artificial Sequence
  Description of Artificial Sequence: Synthetic coding sequence
atgacgcttgacgtgggtccagaagatgagcttccagattgggccgccgcgaaggagttttaccagaagtacgatccgaaggatgttatcggtcggggagtgtcctcggtggtgaggagatgcgtccatagagccactggacacgagtttgctgtgaagatcatggaagtgactgccgaacggctctcacccgaacagctcgaagaagtgcgcgaggcaacccgacgggaaactcacattctgcggcaggtcgcaggacacccgcatatcataacccttatcgactcgtacgaatcgtcctccttcatgttcctggtgttcgacttgatgcgcaagggagaactgttcgactacctgaccgaaaaagtggcgctctccgagaaggaaaccaggtcgatcatgcggtcgctcctggaagcggtgtctttcctgcacgccaacaatattgtgcaccgggacctcaagccggagaacattctgctggatgacaacatgcagatccgcttgtcggacttcggattctcatgccacttggagccaggggagaagctcagagaattgtgcggtaccccaggctacctggcaccagaaatcctgaaatgctccatggatgaaacccacccggggtacggcaaggaggtcgacctgtgggcttgtggagtgatcctcttcactctgctggccggaagcccaccattctggcaccggcggcagattctcatgctgcgcatgatcatggagggccagtaccaattttcatccccggagtgggatgatcggtctagcaccgtcaaggacctcatctcgcgattgttgcaagtggaccctgaagcacgtttgacggctgagcaggcgcttcaacacccgttttttgaaaggtgcgaaggaagccagccgtggaatctcactccgcggcaaagatttcgcgtggccgtgtggaccgtgcttgccgcggggcgggtggccctgtctactcaccgcgtgcgccccctgaccaaaaacgcactcctccgcgatccttacgccttgcggagcgtgcgccatctcatagataactgcgctttccgcctctatgggcactgggtgaagaagggagagcagcagaaccgggccgccctgttccagcaccgaccaccaggcccattccctatcatgggacctgaagaagaaggagactccgcggcgatcactgaggatgaggctgtactcgtcctcgga

SEQ ID NO: 17989 - DNA, 1218 bp, Artificial Sequence
  Description of Artificial Sequence: Synthetic coding sequence
atgaccctcgatgtggggccggaggatgaactcccagattgggccgcagctaaggagttctatcagaagtatgaccctaaagacgttatcgggaggggagtgagttcagtggtgagaaggtgcgtgcatagagcaacgggccatgaattcgctgtaaagatcatggaggtgactgctgaacggctgagccctgaacaactcgaagaagtaagagaggccacgcgccgggaaacccatatcctgcgtcaagtggctggacatccccacattatcacattaatcgatagttatgagagctcaagtttcatgtttctggtgtttgatctcatgcgcaaaggagaactgtttgactaccttacagaaaaagtcgctctgtctgagaaggaaacccggagcatcatgagatcattgctggaagcagtgtcatttctgcatgctaataatattgtgcaccgcgatcttaaacctgagaatatcctgttggatgataacatgcaaattcgcctgagtgattttggattcagttgccatttagagcccggcgagaagttgagggagttgtgcggcacccctggctatctggctcctgagatattgaaatgcagcatggatgagacccatccgggctacggtaaagaggtggacttgtgggcctgcggcgtcatccttttcacactgcttgccgggtccccacctttttggcacagaagacagattttaatgttgagaatgatcatggagggacaatatcagtttagtagcccagaatgggacgataggtcttcgaccgtgaaagatctcattagtcggctcttacaggtggatccagaggctcggctgaccgctgaacaggccctgcagcatccgtttttcgagcgctgcgaagggtctcagccgtggaaccttaccccacgccaacgctttagagtcgccgtgtggactgtccttgcagcaggcagagtggcactcagcacccatcgtgtgcgccctcttaccaaaaacgcactgctgcgggacccatacgctcttaggtccgtgaggcatctgatcgataattgcgcttttagactttacggacattgggttaagaagggcgaacaacagaatagggccgccttatttcagcatcgcccgccaggccctttcccaattatggggcctgaggaagagggtgacagcgcggcgatcacagaagacgaagcagtcctcgttctggga

SEQ ID NO: 17990 - DNA, 1218 bp, Artificial Sequence; identical to SEQ ID NO: 17986
  Description of Artificial Sequence: Synthetic coding sequence

SEQ ID NO: 17991 - DNA, 1218 bp, Artificial Sequence
  Description of Artificial Sequence: Synthetic coding sequence
atgaccctggatgtgggacctgaagacgagctacctgactgggctgccgcaaaggagttttatcagaagtatgatcctaaggacgtgatagggaggggtgtgtcaagcgttgtgagaagatgtgtgcacagggccactggccacgaatttgccgtaaagataatggaggtgaccgccgagcgcttgtctccagaacaactagaggaggttagagaagctacccgaagagaaacccatatactgcgacaggtggccgggcatccccatatcatcacactgattgactcctatgagagcagtagtttcatgttcctcgtcttcgatctgatgaggaaaggagagctgtttgactacctgactgagaaagtggccttaagcgaaaaggaaacaaggtcaatcatgcggagcctgctggaagcagtgtctttcctacacgctaacaatatagtgcaccgggatctgaaaccagagaacatcctgctggacgataatatgcagattaggctttctgactttggcttcagctgccatcttgaaccaggagaaaagctgagagaactgtgcggaacccccggatacctggcaccagagatattaaaatgctcaatggacgagacacatcctggctatgggaaggaagtggacctgtgggcttgcggcgtaatactattcaccctcctcgccggctctccacctttttggcaccgaagacagattctgatgctgcgaatgataatggaggggcagtaccagttctcttcccccgagtgggatgaccgcagtagcaccgtcaaagacctgattagtcgtttgcttcaagtggatcccgaagcaagattaacagccgagcaagctctccagcaccctttcttcgagcggtgcgagggcagccaaccatggaatttaaccccccggcaaaggtttagggtggcagtctggaccgttctcgctgctggaagagtagcactaagtacacaccgcgttcgtcctttgaccaagaacgccctgctgcgggatccctatgctctaaggtctgtaaggcacttgattgacaattgcgccttcaggctgtacgggcactgggtgaagaagggagagcagcaaaatagggccgccctgtttcagcacaggccacccggcccctttccaatcatgggccctgaggaggaaggggacagcgcagccatcaccgaggatgaggccgtgctggtgctgggc

SEQ ID NO: 17992 - DNA, 1218 bp, Artificial Sequence
  Description of Artificial Sequence: Synthetic coding sequence
atgaccctcgatgtgggaccggaggatgaactccctgactgggctgccgcgaaggaattctaccagaaatacgacccaaaggacgtgatcggacgcggagtgagctcggtggtccgccgatgcgtccaccgcgcaactggacatgagttcgcagtcaaaatcatggaagtgactgcggagcgcctgtcgcccgagcagctcgaagaggtgcgggaagcaaccaggcgggaaactcacattctgagacaggtggccgggcacccccacatcattaccctgatcgactcctacgaatcgtcctcctttatgttcctggtgttcgacctgatgcgtaagggagagctcttcgactacttgaccgagaaggtggcattgtcagagaaggaaactagatcgatcatgcgctccctgctggaagcagtgtcattcctgcacgcgaataacattgtgcacagggacctgaagccggaaaacatccttcttgacgataacatgcagatcaggctttcagatttcggattttcgtgccatctcgaaccgggcgagaagctgcgcgaactgtgcggtactccgggatacctggctccggagatcctcaagtgttccatggacgagacgcacccgggatacggaaaagaggtggatctctgggcatgcggcgttatactttttactctcctcgccggatcaccaccgttctggcatcggcgccagatccttatgctcagaatgattatggagggccagtatcaattcagttcgcctgaatgggacgacagatcctcgactgttaaggatcttatcagcaggctgctgcaggtggatccggaagctcgccttactgcagaacaggccctgcagcaccccttctttgaacgctgcgaggggagccagccgtggaacctgaccccacggcagagattccgggtggcagtgtggaccgtgctggccgcagggcgggtggcacttagcactcatcgggtgcggccgctgactaaaaacgcgctgctgagggacccatacgcactgaggtcagtaagacatctgatcgacaattgtgcatttcgcttgtacggccactgggtgaagaagggagaacagcaaaatcgagcggcgctcttccagcatagacctcctggaccattccctatcatggggccggaagaagaaggagactccgcagccattaccgaggacgaggcggtgctggtcttgggt

SEQ ID NO: 17993 - DNA, 1218 bp, Artificial Sequence
  Description of Artificial Sequence: Synthetic coding sequence
atgactttggacgttggaccagaagatgaattgcctgactgggctgctgctaaagaattttatcaaaaatatgatccaaaagatgttattggaagaggagtttcatctgtagtaagaagatgtgttcatagagctactggacatgaattcgctgttaaaattatggaagttacagcagaaagattgtctccagagcaattagaagaagttagagaagctacaagaagagaaacacatattcttcgacaagttgctggacatccacatattattactcttattgattcttatgaatcatctagttttatgtttcttgtttttgatttaatgcgtaaaggagaattatttgattatttaacagagaaagttgctttaagtgagaaagaaacaagatcaattatgcgttctttattggaagcagttagtttcctccatgcaaacaatattgtacatagagatttaaaaccagaaaatattttattggatgataatatgcaaattagattatcagatttcggattttcatgtcatcttgaaccaggtgaaaaattacgtgaattatgtggaacaccaggttatttggctcctgaaattcttaaatgtagtatggatgaaacacatccagggtatggaaaagaagttgatttgtgggcatgcggtgttattctttttactctcttagcaggttcgcctccattttggcatcgaagacaaattcttatgcttagaatgattatggaaggacaatatcagttcagttcaccagaatgggacgatagaagttcaactgttaaagatttaatatctaggcttttacaagttgaccctgaggctagattgactgctgaacaagcacttcaacaccctttttttgaaagatgtgaagggtcacaaccatggaatttaactccaagacaaagatttcgtgtagcagtctggactgtattagcagctggaagagttgcattatctacacatagagtaagaccattgactaaaaatgctcttcttagagatccttatgcattaagaagtgttagacatctaattgataattgtgcttttagattatatggtcattgggttaaaaaaggtgaacaacagaatcgtgcagctttatttcaacatcgaccaccaggaccatttcctattatgggaccagaagaagaaggagatagcgctgcaattactgaagatgaagctgtattagtcttgggt

SEQ ID NO: 17994 - DNA, 1218 bp, Artificial Sequence
  Description of Artificial Sequence: Synthetic coding sequence
atgacgctggatgtggggcccgaagatgaactgccagattgggcggctgccaaggagttttaccagaagtacgacccaaaggacgtcattggccgcggagtctcctccgtggtgaggaggtgtgtgcacagggctacgggccatgaatttgcggtcaaaatcatggaagttactgcagagcggctgagcccggagcagctcgaggaagtgagggaagccacccggcgcgaaactcatatcttgcgccaagtcgcgggacacccacatatcatcaccctgatcgactcctacgagtcgtcgtccttcatgttccttgtgttcgacctgatgcgaaaaggtgagctgttcgactatctcactgagaaagtagcattgtcagaaaaggaaacccgaagcatcatgcgctcgttgttggaggccgtctcgttcttgcatgcaaataacattgtgcatcgggatcttaagccggaaaacatcctgctggacgacaatatgcaaattcgtctttcggatttcggcttttcttgccacttggaaccaggggaaaagctcagagagctgtgcgggacgccgggatacctggcgcctgaaatcctgaagtgttctatggatgaaactcacccgggctacggtaaagaagtcgacctctgggcatgcggagtgatactgtttaccctgttggccggaagtccacctttttggcaccgcaggcaaatccttatgctgaggatgatcatggaaggtcagtaccagttctcatccccggagtgggacgatcgctcgtcgaccgttaaagacctgatctcgagactcctgcaagtggatccggaagcccggctcactgccgagcaggccctccagcacccgttcttcgaacgctgcgaggggtcgcagccttggaaccttaccccgagacaacgctttcgggtggcggtctggactgtgctggccgcgggaagggtggccctgtcgacccaccgggtccggcccttgaccaagaacgcactcctccgggacccttacgccctgaggtcggtgcgccacctgatcgataattgcgctttccgcctctacggtcattgggtgaagaagggagaacagcagaaccgggcggctctgttccagcacagaccaccgggaccattcccgatcatggggcccgaggaggagggagatagcgctgccataaccgaggacgaggccgtgctggtgctcggc

SEQ ID NO: 17995 - DNA, 1218 bp, Artificial Sequence
  Description of Artificial Sequence: Synthetic coding sequence
atgacgttggatgtggggcccgaggacgaattgcctgattgggcagcagccaaagaattctaccaaaaatacgacccaaaagatgttatcggtagaggggtctccagcgtagttcgccggtgtgtccatcgtgcaactggccacgagttcgcggtgaagattatggaagtcacagcagaaagactgagcccagagcaactagaagaggtcagggaggcaaccaggagagagacacacattcttaggcaggtcgctggacacccgcatattatcacgctgatagattcttatgagtcgagttccttcatgttcctcgtctttgacttgatgaggaaaggagaactcttcgactaccttactgaaaaggtcgccctttccgaaaaggaaacccgttctattatgaggtctttactggaagctgtgtcattccttcatgcaaacaatattgtgcacagagacttgaagcctgaaaacatattgcttgatgacaacatgcagatcaggctctctgattttggcttctcatgtcatttggaacctggggagaagctacgggaactgtgcggtacaccagggtacctggcccccgaaatcctgaaatgtagtatggacgagactcaccccggatatggaaaggaggtggacctgtgggcttgcggagtgatattatttactttgctggccggctctccgcccttctggcaccgcaggcagattctgatgctgcggatgattatggagggtcagtatcagttctcatctcccgagtgggatgaccgatcgagtaccgtaaaggacctgatcagtcgattactgcaggtggacccggaagcccgattaacagccgaacaggccctgcagcacccttttttcgagagatgcgaggggtcacagccctggaacctcacgccgcgccaacgattccgggtggcggtttggactgtactggcggccggtcgagtggcactgtctacacatcgggtgaggcctctcacaaaaaacgccctgttgagagacccttacgcgttgcgctcagtgcggcatttaatcgataattgtgctttccgcctctacgggcactgggtaaagaagggagagcagcagaaccgggctgcccttttccagcatcgtcctcctggcccttttccaattatgggcccggaggaagagggggactccgcggccataaccgaggatgaggccgtacttgtgctgggc

SEQ ID NO: 17996 - DNA, 1218 bp, Artificial Sequence
  Description of Artificial Sequence: Synthetic coding sequence
atgactcttgatgttggacctgaggacgagcttccagactgggcagcggccaaggaattctaccagaaatacgaccctaaggatgtgatcggacggggggtgtcctccgtggtccgacgatgcgtgcacagggccaccggacatgagttcgccgtgaagattatggaagtgactgcggagcgccttagcccagaacagcttgaggaagtgagggaagcgactagacgcgagactcacatcctcagacaggtcgcaggacacccacatatcattacgctgattgattcgtatgaatcgagctcttttatgttcctggtgtttgacctgatgcgcaaaggggagctcttcgattaccttaccgaaaaggttgctctgtctgagaaagaaaccagatcaatcatgcgatcgctgcttgaggcagtgtcctttctccacgctaataacatcgtccatcgggatctgaagcctgagaatattcttctggatgacaatatgcagattcggctcagcgattttggcttttcctgccacctggagccgggcgaaaagctccgggaactgtgtggtactcccggatacctcgctcctgagattctgaagtgttcaatggacgaaacgcatcccggttacggtaaggaagtggacctgtgggcatgtggcgtgattctcttcactctgttggcaggttcacctccattttggcatcgcagacaaatactcatgcttcgcatgataatggagggtcaataccagttcagcagccctgaatgggacgacaggagctcaaccgtgaaggatctcatctctcgccttctgcaagtggacccagaggcaaggcttacggccgaacaggcgctccagcacccttttttcgagcggtgtgaaggatcgcaaccttggaaccttaccccaagacaaaggtttagagtggcagtgtggaccgtccttgcagccggcagagtagcactgtctacccatcgggtccggccgctcactaagaacgcacttctcagggatccttacgcccttaggtccgtcaggcatttgattgataactgtgcatttcgcctttacggacattgggtcaagaaaggtgaacaacaaaaccgtgcagcactctttcaacatcggccccccggccctttccctattatgggcccggaagaagaaggcgattccgctgcaatcaccgaggatgaggcagtgctggtgctcggg

SEQ ID NO: 17997 - DNA, 1218 bp, Artificial Sequence
  Description of Artificial Sequence: Synthetic coding sequence
atgaccctcgacgtcggcccggaagatgagctgcctgactgggctgcagccaaggaattctatcaaaagtacgacccgaaagatgtcattgggcggggagtgtcatctgtggtccggcggtgcgtgcatcgcgcgaccggacatgaattcgccgtgaagatcatggaggttaccgctgagcgcctgtcaccagagcagctcgaggaagtgcgcgaagctacgagacgggaaacccacatcttgagacaagttgcgggtcatccacatatcattactctgatcgacagctacgagtccagctcgtttatgttcctcgtgttcgatctgatgcgcaagggggaactgttcgactacttgactgagaaagttgcactttcggagaaagagactagatccatcatgaggtcgctgctggaggcggtgtctttcctccacgcgaacaacatcgtgcaccgggacctcaagcctgaaaacatcctgctcgacgacaatatgcaaattcggctgtcggatttcggattttcctgtcacctggagcccggcgaaaagctgcgagagctgtgcggcaccccgggatacttggctccggagatcctgaagtgcagcatggatgaaacgcacccaggctatgggaaagaggtagatctgtgggcttgcggagtcatcctgttcaccctgcttgcaggaagccctcctttctggcaccgtcggcagatactgatgttgagaatgatcatggaaggacaataccagttctcatccccagagtgggacgaccggagctcgactgtgaaggacctcatctcacgccttctgcaggtggatccggaagctcgcttgactgccgaacaggccctgcagcatccgtttttcgaaagatgcgaggggagccagccctggaatctcactccacgccagagatttcgggtggcagtctggacggtgctggcagcaggaagagttgcgttgtcgacgcatagggtcaggccgcttaccaaaaacgccctgctccgggatccgtatgctctgcgctcagtgcgccatctgatcgacaactgtgctttccggctctacggccactgggtcaaaaagggagaacagcaaaacagggctgcgcttttccagcatcggccccccggaccattcccaataatgggaccggaagaggaaggggactcggcagccattaccgaagatgaggccgtgctggtgctggga

SEQ ID NO: 17998 - DNA, 1218 bp, Artificial Sequence
  Description of Artificial Sequence: Synthetic coding sequence
atgacactcgatgtcggccccgaagacgagctgcctgactgggcagcagctaaggagttctaccaaaagtatgatcccaaagacgtcatcggcaggggggtttcctccgtggttagaagatgtgtgcacagagctaccggccacgagtttgcagtaaagattatggaggttaccgccgaacggctgagcccagaacagctggaagaggtaagagaggcaacccgcagggagacccatatcttgaggcaggtggctgggcatccacacataatcacgttaatcgattcatatgagtcaagcagcttcatgttcctggtctttgacctcatgaggaaaggggagctttttgactacctcaccgagaaggtcgccttatcggagaaggagactcggagcattatgagatctctacttgaggctgtgtctttcctgcatgccaataatatagtgcacagggacctaaagccggagaacatcctgctcgacgataacatgcagatccgcctgagtgattttgggttttcctgtcaccttgagcccggagagaagttgcgcgaattgtgcgggacacccggctaccttgcaccagagatcctcaaatgtagcatggatgagacccatcccggttacggcaaggaggtcgacctgtgggcatgtggcgttatcctgttcaccctcctcgcagggtccccgcctttttggcataggcgccagatcctgatgttgaggatgataatggagggccagtatcagttttcctctccggagtgggatgatcgctcctctactgttaaggacctcattagccgccttcttcaggttgatccggaggctaggttaaccgcggagcaagcactgcaacaccccttcttcgaacgctgcgaagggtcacagccatggaacctcacgcctcgtcagagattccgcgtggcagtatggacagtcctggccgccggtcgggtcgccctgtctacccatcgagtgagaccccttacaaagaacgccctactgcgggatccttacgcactgcgaagtgttcgccacctgatcgacaactgcgcatttcggctgtacggacactgggtcaagaaaggcgagcagcagaatcgcgccgcacttttccaacatagacctcctggccctttcccaatcatgggacctgaggaagagggtgactctgcagctattacagaggacgaagcagtcctggtcctgggc

SEQ ID NO: 17999 - DNA, 1218 bp, Artificial Sequence
  Description of Artificial Sequence: Synthetic coding sequence
atgacgttagacgtggggccagaggatgaacttcccgactgggccgccgctaaggagttttaccaaaagtacgatcctaaggatgtgatcggaagaggtgtgtcatccgtagtgagacggtgtgtgcaccgtgctacaggacacgagttcgccgttaagatcatggaggtgacagctgaaagactctctcccgaacagctagaagaagtgcgggaggctactcggcgcgagacccatattctgcgacaagtggccggccacccacacataatcacgctcatcgactcttacgagagctcatccttcatgttcctggttttcgatctgatgaggaagggagaactattcgattacttaactgagaaggtggcgctgagcgagaaagagacaaggtctatcatgcgctccctattggaggcggtgtcctttttgcacgcgaacaacattgtgcaccgggatttgaaacccgagaatatcctgctagacgataatatgcagatccgtctgtcagactttgggttcagctgccacctggagcccggcgagaagctgagggagctatgtgggactcctgggtacttggccccagagatcctgaaatgttccatggacgagacacaccccggttatggtaaagaggtggatctgtgggcttgcggcgtgatcttgttcacactgctggccggatcacctcccttttggcatagacgtcagatcctgatgctgcgcatgatcatggaggggcagtaccaatttagcagtcctgaatgggacgaccgatctagcactgttaaagatttgatctcaagactgcttcaagtcgatccagaggcacggctgacagccgagcaggccctgcagcatccctttttcgagcgatgcgagggaagtcagccttggaacctgacccctagacagaggttcagagtggctgtttggaccgtccttgctgccgggcgagtagctctttccacacaccgtgtgcggcccctaacaaagaacgccctgctgagggacccttatgcactgaggtcagtccggcatctaatagacaactgcgcatttcgactctatgggcactgggtgaagaagggcgaacagcagaatcgggctgcactgttccagcacaggcccccgggaccatttcctataatgggtcccgaggaggagggagattccgccgcaattacagaagacgaagccgtgctcgtcctgggc

SEQ ID NO: 18000 - DNA, 1218 bp, Artificial Sequence
  Description of Artificial Sequence: Synthetic coding sequence
atgaccttagacgtaggtccagaggacgaactcccagactgggcggcagcgaaggagttctaccagaagtacgatccaaaggatgtgatcggccgcggtgtgagcagcgttgttcgccgttgtgtacaccgcgctactggtcatgagtttgctgtgaagattatggaggttaccgcggagcgcttgagccctgaacaactggaggaagtgagggaagcgacccgaagggagacccacatcttgcgacaagtggcaggtcaccctcatatcattaccctgattgattcgtatgaatcttcttccttcatgttcctggtgtttgatttgatgcgtaagggtgagctgtttgattatctgaccgagaaagtcgctcttagcgagaaggagacccgtagcatcatgcgcagtctgttagaagcggttagtttcctacatgccaataacattgtccaccgagatctgaaacctgaaaatatactgcttgacgacaacatgcagattcgactgtccgatttcggttttagctgtcatctggaaccaggtgaaaagctgcgagagttgtgcggcaccccgggctatcttgctccagaaatcctgaagtgttcaatggacgagacacacccaggatatggcaaggaggtggacctgtgggcgtgcggtgtcattctatttaccctgcttgcaggcagcccacccttttggcataggcgccagatcctcatgctgcgcatgatcatggaaggccaatatcagttcagcagcccagagtgggatgatagaagcagcaccgtgaaagatctgatttcccgcctgctccaggttgatccagaggcacgtttgaccgcggagcaagctctccagcacccgttttttgagagatgtgagggcagtcaaccttggaacctgacgccacgccagcgctttcgcgtggcagtttggactgttctggcagccggtcgcgtcgcgctgtcaacccatcgtgtgcgcccgctgactaaaaatgccctgctgcgcgacccctacgcgctgcgcagcgtccgtcacctcatcgacaactgcgccttccgcctgtacggacactgggttaaaaaaggcgagcaacagaatagagcggcattgttccaacatcgcccccctgggccgttccccatcatgggtcctgaggaggagggcgatagcgcagcgataactgaggacgaggcggttttggtgctgggc

SEQ ID NO: 18001 - DNA, 1218 bp, Artificial Sequence
  Description of Artificial Sequence: Synthetic coding sequence
atgaccctggacgtgggacctgaggatgaactgccggattgggctgcagcgaaggagttttaccagaagtacgatccgaaggacgtgattggccggggcgtttcgtccgttgtgagaaggtgcgtgcacagggcaactggtcatgaattcgccgtcaagatcatggaggtcaccgcagagcgcctgtcaccagaacaacttgaagaagtgcgcgaggctacgcggagagaaacccatatcctgagacaagtggccggtcacccgcatatcattactttgatcgattcgtacgagtcgtcgtcatttatgtttctggtgtttgatcttatgcgaaagggggaactgttcgactacttgaccgaaaaggtggccttgagcgaaaaggaaacccgttcaattatgcgttcgcttttggaagcagtcagcttccttcatgcaaataacattgtccaccgagatctgaagcccgaaaacattcttctggatgataacatgcagataagactttcagatttcggattttcgtgccacctcgaaccaggtgaaaagctgagagaactgtgtggcactcctggctacttggcgcccgagattcttaaatgctccatggatgaaactcatccaggatacggtaaggaagtggacctctgggcctgtggtgtgattcttttcactctgcttgcaggatccccgcctttttggcatcgccgccagatcctcatgctccggatgattatggaagggcagtaccaatttagctcgcccgaatgggatgatcgttccagcactgtcaaggaccttatttcccggctcctccaggtggatccagaagcacggcttactgcagaacaggcccttcaacatccgtttttcgagagatgcgaagggagccagccttggaacctcactccacgtcaacggtttcgagtggcagtttggactgtgctcgcagcaggcagagtcgcactgtccacccatcgcgtgcgaccgctcactaagaacgcactgctgcgggacccatacgcacttcggagcgtgcgccatcttattgacaactgtgccttcaggctttacggccactgggtgaagaagggagaacaacaaaatcgggcagcactgttccagcatagaccacccggtccttttccaatcatgggaccagaagaggagggtgatagcgcagcaattaccgaggacgaggcagtcttggttcttggt

SEQ ID NO: 18002 - DNA, 1218 bp, Artificial Sequence
  Description of Artificial Sequence: Synthetic coding sequence
atgactcttgacgtggggcctgaggacgaacttccagactgggcagcagcaaaagaattctaccaaaagtacgatcctaaggacgtcataggtcgaggtgtctcctcagtggtgcggcgatgcgtccacagagctactggacatgaattcgcagtgaagataatggaagtcaccgcagaaagattgtcgccagaacaactggaggaagttagagaggcaacgagaagggaaactcatatcctccggcaggtcgcagggcacccccatatcattaccctgatcgatagttacgagtcgtcgtcatttatgtttctcgtattcgacttgatgcggaagggagaacttttcgattacttgactgaaaaagtggcactttccgagaaggagactcgtagcatcatgcgaagcctgcttgaggcagtgtcctttctccacgccaacaatatcgtgcatagggacctgaagcctgagaatatcctgctggatgacaacatgcaaattcgactgtcagattttggattttcgtgtcatcttgaaccgggcgaaaaacttcgggaactgtgtgggacccctggatacttggctcctgaaattctgaagtgttcgatggatgagactcatcccggatacgggaaggaggtggatctgtgggcctgtggcgtgattctgtttacgctgcttgcgggcagcccaccattctggcatcgccggcagatcctcatgcttagaatgataatggagggtcaatatcaattttcatcccccgaatgggacgataggtcgtccactgtgaaagatctgataagcagactcctgcaggtggaccccgaagcacgactcactgcagaacaggcgctccagcatcctttctttgagcgatgcgaaggaagccagccttggaatctgaccccccgccaaaggtttagagtcgccgtgtggactgtcctggcagccggacgagtcgcactctcgacccaccgagtccgtcctctgacgaagaacgcccttctccgggatccatacgcactcaggtcggtgagacacttgattgataactgtgcgtttcggctctacggccattgggttaagaagggtgaacaacagaacagggcagcattgttccaacacaggccaccaggtccgttccctattatgggcccagaagaggaaggggattcggcagctattaccgaagatgaagctgtactggtgcttggg

SEQ ID NO: 18003 - DNA, 1218 bp, Artificial Sequence
  Description of Artificial Sequence: Synthetic coding sequence
atgaccctcgacgtgggaccggaggacgaactgccggattgggcagctgccaaggagttctaccagaagtacgatccaaaggatgtgatcggccggggagtgtcctcagtcgtccgcagatgcgtccatagagcgacgggacacgagttcgctgtgaaaatcatggaagttactgccgagagactgtccccggaacaacttgaggaggtccgggaagcgactcggagagagactcatattctgagacaggtggccggacatccacacattatcactctcatcgacagctacgaatcctcgtcgttcatgttcctggtgttcgacctgatgcggaagggggagctgttcgattacctgactgaaaaagtcgcactctcggagaaagaaacgagatcgattatgcggtcactccttgaagccgtgagcttcctccacgcgaacaatatcgtccatcgcgaccttaagccagaaaacatcctcctggatgacaatatgcagatccgcctctcagactttggattcagctgccacctcgagccgggagagaagctccgcgagctctgtggcaccccgggatacctggcgccagaaatcctcaagtgttccatggacgaaacccatccgggttatggcaaggaagtggacttgtgggcttgcggagtgatcctgttcactctgctggcgggatcgccaccgttttggcaccgccggcagatcctgatgcttaggatgatcatggaagggcagtaccagtttagctcgccagaatgggatgaccgtagcagtaccgtgaaggatctgatctcccgacttcttcaggtcgacccggaagcgcgcctgaccgctgaacaagccctccagcacccattcttcgagagatgcgaagggagccagccttggaatctgaccccccgccaacggttcagagtggcggtgtggacggtcctcgctgcggggcgggtggcgctgtccacccatcgggtccgcccccttaccaagaatgctctcctccgcgacccatacgccctgcggtcagtcaggcacctcatagataactgcgccttccggctttacggccactgggtgaaaaaaggcgagcagcagaatcgggcggccctctttcagcacagaccgcctggtccattcccgatcatgggaccagaggaagaaggagatagcgccgctattaccgaggatgaagctgtgctggtgctcggg

SEQ ID NO: 18004 - DNA, 1218 bp, Artificial Sequence
  Description of Artificial Sequence: Synthetic coding sequence
atgacactcgatgtcggtcccgaagacgaactcccggattgggctgccgctaaagaattttaccagaagtatgacccgaaagatgtgatcggacgaggcgtgagtagcgttgtgagaaggtgtgtgcatcgggctacggggcacgagtttgcggtgaagattatggaggtcacagccgaacgactgagtcccgagcaactcgaggaagtgagggaggctacaaggagggagactcacatattgcgacaggttgccggtcacccccatatcataactctcatcgattcctacgagtcctcatcattcatgtttctcgtgttcgaccttatgcgaaagggggagctgttcgattatcttactgagaaagtcgcactcagtgaaaaggagacccggtctatcatgaggtccctgctggaagctgtctcttttctccacgccaataatattgtccatcgagatctcaagcctgaaaatattctgcttgatgacaacatgcagataagactcagcgacttcggattctcatgtcacttggagccaggagagaagctgcgggaactgtgtggtacccccggttacctggccccggagattctgaagtgttccatggatgaaacccatccgggctatggtaaggaagtagacctctgggcttgtggtgtcattctctttacactcttggcagggtccccgcctttctggcatcgccgacaaatcctgatgttgaggatgatcatggagggccagtaccagttctctagtcccgagtgggacgaccgcagtagcacggtgaaagacctgatctcacggttgctgcaggtggatcccgaagcccgcctcacagccgagcaggccctccagcacccgttcttcgagcggtgcgagggatcccagccttggaatcttactccccgacagagattccgcgtagccgtttggacagtgcttgccgccggcagggtcgcactttcaacacaccgcgtgcgccccctgactaagaatgccctgttgcgggatccttatgcattgcgcagtgtccggcaccttatagataattgtgctttcaggttgtacggacactgggtcaagaagggtgaacagcagaaccgggctgcactgttccagcataggcccccagggcccttccctatcatgggccctgaggaagaaggcgattccgcggccattactgaggacgaggcggtgctggtcctggga

SEQ ID NO: 18005 - DNA, 1218 bp, Artificial Sequence
  Description of Artificial Sequence: Synthetic coding sequence
atgacgctagatgtaggtccggaagatgaactaccggattgggcggcggcgaaagaattttatcaaaaatatgatccgaaagatgtaataggtcgtggtgtatcgtcggtagtacgacgatgtgttcatcgtgcgacgggtcatgaatttgcggttaaaataatggaagtaacggcggaacgtctatcgccggaacaattagaagaagttcgtgaagcgacgcgtcgtgaaacgcatatattacgacaagttgcgggtcatccgcatataataacgctaatagattcgtatgaatcgtcgtcgtttatgtttttagtatttgatttaatgcgtaaaggtgaattatttgattatctaacggaaaaagtagcgttatcggaaaaagaaacgcgatcgataatgcgttcgttactagaagcggtatcgtttttacatgcgaataatatagtacatcgagatctaaaaccggaaaatatactattagatgataatatgcaaatacgattatcggattttggtttttcgtgtcatctagaaccgggtgaaaaactacgtgaattatgtggtacgccgggttatttagcgccggaaatattaaaatgttcgatggatgaaacgcatccgggttatggtaaagaagtagatttatgggcgtgtggtgtaatattatttacgttattagcgggttcgccgccgttttggcatcgtcgtcaaatactaatgttacgaatgataatggaaggtcaatatcaattttcgtcgccggaatgggatgatcgatcgtcgacggttaaagatctaatatcgcgattattacaagttgatccggaagcgcgtttaacggcggaacaagcgttacaacatccgttttttgaacgatgtgaaggttcgcaaccgtggaatttaacgccgcgtcaacgatttcgagttgcggtttggacggtactagcggcgggtcgagtagcgttatcgacgcatcgagtacgtccgttaacgaaaaatgcgttattacgagatccgtatgcgctacgttcggtacgtcatttaatagataattgtgcgtttcgtttatatggtcattgggttaaaaaaggtgaacaacaaaatcgtgcggcgctatttcaacatcgtccgccgggtccgtttccgataatgggtccggaagaagaaggtgattcggcggcgataacggaagatgaagcggtattagtattaggt

SEQ ID NO: 18006 - DNA, 1218 bp, Artificial Sequence
  Description of Artificial Sequence: Synthetic coding sequence
atgactctggacgtgggacctgaagatgagctccctgactgggcagcagccaaagaattctaccaaaagtatgatccaaaggatgtgattggtcgcggtgtgtcgtccgtggtgcgtcgctgtgtgcacagagcaaccgggcatgagttcgctgttaagattatggaagtcaccgcagagcgcctgtccccagaacagttggaagaggtgcgcgaagctacccgcagagagacgcacatcctccgccaggtggccggacatccccatatcattaccctgatagattcatacgagtcatcatcctttatgttcctggtgttcgatctgatgcggaagggtgagctgtttgattacctgaccgaaaaagtggcgctgtccgaaaaagaaactcgcagcattatgagatcgttgctcgaagcagtgtcgttcttgcatgccaacaatatcgtgcatcgagatttgaagcctgagaacattctgcttgatgacaatatgcaaattcgactttccgatttcggtttctcgtgtcatctcgaaccgggggaaaagctcagggaactctgcggcacccctggataccttgctcctgagattctgaaatgttcgatggacgagactcatccaggctacgggaaagaggtggatctgtgggcctgtggagtgattctttttaccctgcttgcaggaagcccaccattctggcatcggcgccaaatccttatgctcagaatgatcatggaaggtcagtaccagtttagctcgccagagtgggacgatagatcttccactgtgaaggaccttatctcccgccttcttcaagttgatcctgaagcgaggcttactgctgagcaagccctgcaacaccctttctttgagaggtgcgagggatcccaaccctggaacctcaccccacgtcagagatttcgggtggcagtgtggaccgtgctcgcagcaggaagggtggcgctcagcactcatcgggtccgccccctgaccaagaatgcactccttcgggatccatacgctcttagatcagtgcgccacctgatcgataattgtgcctttcgcctgtacggacattgggtaaagaagggagagcagcagaatagggcggcgcttttccaacatagaccaccaggaccatttcctatcatgggccctgaagaggaaggagattccgcagctattaccgaagatgaagcagtgcttgtcctcggg

SEQ ID NO: 18007 - DNA, 1218 bp, Artificial Sequence
  Description of Artificial Sequence: Synthetic coding sequence
atgacactggacgttggcccagaggatgaactgccggactgggccgcagccaaagaattttatcagaagtacgacccgaaagatgttattggccgtggggttagttcggtagtgcgccgctgtgtacatagggctactggacacgaattcgccgttaagatcatggaggtcaccgccgagcggttatcacctgaacagctggaggaggttagagaagccactagaagggagactcacatccttaggcaagtggccggccatccgcatattatcaccctgatcgactcctacgagtcaagctccttcatgttcctggtgtttgatctgatgagaaagggagagcttttcgactacctgactgagaaggtggcactgagtgagaaagagacccgatccattatgcgctcactcctggaggcggtgtctttcctccacgcgaacaatattgtgcacagggacttgaagcctgagaacatcttactggacgacaatatgcagattagactgagcgatttcggcttctcctgccatctggaaccgggagaaaagttacgagagctgtgcggaactcctggatacctcgcccctgaaatccttaagtgtagtatggatgagactcatccaggttacggtaaagaggtggacctgtgggcgtgcggcgtcatccttttcaccttgctcgccgggtcacctcccttttggcatcgccgacagattctgatgctgcggatgatcatggaaggccagtatcagttctcctctccggagtgggatgatcggtctagcacggttaaagacttgatttcaaggctgctgcaggtagatccagaagccagactcactgccgagcaggcactgcagcacccattctttgagcgctgtgaggggtcgcagccctggaacctcactcccagacagcggttccgtgtagccgtctggaccgttctagcggcaggcagagtggcattgtctacgcatagagtgcggcccctcacaaagaacgctctgttgcgggatccctatgctctgcgcagtgtccggcatttaatcgataactgcgcctttcggttgtacggccattgggtgaagaaaggcgaacagcagaaccgggctgcactgttccagcatagacccccaggcccattccctatcatgggcccggaggaggagggagacagcgcagctatcaccgaggatgaggcggttcttgttttggga

SEQ ID NO: 18008 - DNA, 1218 bp, Artificial Sequence
  Description of Artificial Sequence: Synthetic coding sequence
atgactctggacgttggtcctgaggacgaactgccagattgggccgccgctaaggagttctaccagaaatatgaccctaaggacgttattggacgcggcgtgtcttctgttgtccggaggtgcgttcatcgcgccactggtcatgagtttgcagtcaagatcatggaagtaactgccgagaggctgagcccagagcaattggaggaggtcagggaagccaccaggagagagacccacatcctgcgacaagtcgccgggcacccccacattatcactcttatcgactcatacgaatcttcttccttcatgtttctcgtcttcgatcttatgcggaagggcgagctgttcgattacctcaccgagaaagtggctttgtccgagaaagagacaagaagcataatgcgaagtcttctggaggccgtgtctttcttgcacgccaacaacattgtacacagagacctgaaaccagagaatatcctgctcgacgataacatgcagatccgcctgagcgacttcggattttcatgtcatctcgaacctggagagaagctgagagagctttgtggcaccccaggatatctcgcaccagaaatcctgaaatgttctatggatgagacccatcctggctacggcaaagaagtggacctgtgggcctgcggggtgatcctttttaccctcctggccggctctccacctttttggcatcggcgacagatattgatgctccgaatgataatggaagggcaatatcagttctctagccctgaatgggatgatcgctcttctactgtgaaggatctgattagcaggcttcttcaggttgatccagaagctagactgacggcagagcaagccctgcaacacccattcttcgaaaggtgcgagggctcccagccctggaatctgacgcccaggcagagattcagggtggcggtgtggacagtgcttgcagctggccgagtcgctttgagcacgcaccgagtacgccctcttactaagaatgccctgctgagggatccatacgcgctgcgctcagtcaggcatcttatcgacaattgcgccttccgcctgtacggccattgggtgaaaaaaggagagcaacagaacagggccgcactttttcagcatcgcccacctgggccattccctattatggggcctgaagaggaaggcgatagcgcagctatcactgaggacgaggcagtgctggtgttgggc

SEQ ID NO: 18009 - DNA, 1218 bp, Artificial Sequence
  Description of Artificial Sequence: Synthetic coding sequence
atgactctggatgtaggcccagaggacgagctgccagattgggccgcggccaaggaattctatcagaagtatgaccctaaggacgtgatcggacggggagtgagctcagtggtgcgcagatgcgtgcatagagccaccggtcatgaattcgcagtgaagatcatggaggtgactgcggaacgactgtcgccagaacaactcgaagaggtgcgggaagccacccgccgggagacgcatattctgaggcaagtggccggacacccgcacattatcaccctgatcgattcttacgagtcgtcctcgttcatgtttctggtgttcgacctgatgcggaagggcgagttgtttgactacctgacggaaaaggtggctctgtcggaaaaggagactcggtcgatcatgcgctcgctgctcgaagcggtgtcgttcctccacgccaacaacatcgtgcatcgcgacctgaagccagaaaacatcctgctcgacgataacatgcaaatcagactgagcgacttcggcttcagctgtcatctcgaaccgggggagaagctgagggagctctgcggaacccctggatacctggcgccggaaatcttgaaatgctccatggatgagactcacccggggtacggcaaagaggtcgatttgtgggcttgcggagtgatcctctttactctgcttgcgggctcgcctccgttttggcatcgccgccaaatcctgatgctcagaatgatcatggaaggacaataccagttcagctcaccggaatgggacgacaggtcatccaccgtcaaggacctgatctcccggctgctgcaggtggacccggaggcacggctgactgccgaacaggccctccagcatccattcttcgagcggtgtgagggatcccagccatggaatctcactcctcgacagagattccgggtcgccgtgtggacggtgctcgcagcgggacgcgtggccctgtccactcatcgggtgcggccactcaccaagaacgctcttctccgggacccctacgcactccgctccgtgcgccacctcatcgataattgtgcctttcgcctttacggacactgggtgaagaagggcgaacagcagaacagggccgcgctgtttcaacaccggccgccgggaccctttccgatcatgggacctgaagaggagggagatagcgcggccatcactgaagatgaggccgtgctcgtgctggga

SEQ ID NO: 18010 - DNA, 1218 bp, Artificial Sequence
  Description of Artificial Sequence: Synthetic coding sequence
atgacccttgacgtcggaccagaggacgagctgcccgattgggccgctgctaaggagttctaccagaaatacgacccaaaggacgtgatcggccggggagtgtcctctgttgtgcgccggtgcgtccaccgggccaccggacacgagttcgcggtcaagattatggaggtcaccgcagaacgcctgagcccggaacagctggaggaggtccgggaagcgaccaggcgcgagactcacatccttcggcaggtcgcgggacacccacacatcatcactctcatcgactcgtatgaatcatcgtcgttcatgtttctcgtgtttgaccttatgcggaagggtgagcttttcgactacttgactgaaaaggtagccctctcggaaaaggagacgaggtccattatgcgtagcttgctcgaagccgtgtccttcctgcacgcaaataacatcgtgcaccgggacctgaagccggagaacatcctgctggatgacaacatgcagattcgtttgagcgacttcggattctcgtgccatctggagccgggcgaaaagctgcgggaactgtgcggcactcctggatacctggcgccagaaatccttaagtgttcgatggacgagacgcatcccggctacggcaaggaggtggacctgtgggcctgcggtgttattctcttcactcttttggcaggatcgccgccgttttggcataggcgccaaatcctgatgctccggatgatcatggaagggcagtatcaattttcgtcccctgagtgggatgataggtcgtctactgtcaaggatctgatctcgagactgctgcaggttgacccggaagcgcgcctgactgccgagcaagctcttcagcaccctttcttcgaacggtgtgaagggagccagccctggaacctcaccccacgccagagattcagagtcgccgtgtggactgtgctggccgcaggacgcgtggctctctccacccaccgcgtgcggccattgactaagaatgccctgctgcgcgacccttacgccctgcgctccgtccgccatttgatcgacaactgtgcattccgcctgtacggacactgggtgaaaaaaggagaacagcagaatagggccgcactcttccagcatcgccccccaggaccatttccgataatgggcccggaggaggaaggagattcggcggccatcaccgaggacgaggcggtgttggttctcgga

SEQ ID NO: 18011 - DNA, 1218 bp, Artificial Sequence
  Description of Artificial Sequence: Synthetic coding sequence
atgaccttggatgtcggtccagaagacgagctgccagattgggccgccgctaaggagttctatcagaagtatgatcccaaagacgtgatcggacggggggtcagcagtgtcgtaagacgctgtgtgcacagagcgactggacatgagtttgccgtgaagatcatggaggtgaccgccgaaaggctgtctcccgagcagctagaggaagtcagggaagcaacgagaagagagacccacattctaagacaggtcgccgggcacccccacattattacgctgatcgacagttatgaaagctcctcttttatgtttttggtgttcgatttgatgaggaagggcgagctatttgactatctgaccgagaaagtcgccctgagcgaaaaagaaacaaggagcatcatgcgctcattactggaggctgtgagtttcctgcacgccaataatatagtgcatagggatttaaaaccagaaaacattctgctggacgacaacatgcagatccgtctctctgactttgggttcagctgccacctcgaacctggtgaaaagctcagggaactctgcggaacccccggatacctggcccctgagatcctgaaatgctccatggatgagacgcacccgggctacggaaaggaggtcgacctgtgggcttgtggcgttatcctgttcaccctgttggccggctcgccacccttttggcatagacggcagattcttatgctccgaatgatcatggaggggcagtatcaattttcctctccagagtgggacgatcgatcctcgacggtgaaagatctgatcagtcgcctgttacaggtggatcccgaagccagattaacggccgagcaggcgctccagcatccttttttcgagcggtgtgaaggctcccagccttggaatttgacccctcgccagagattccgcgtggccgtgtggaccgtgttggccgccgggagggttgctttgagcacccacagggttagaccgctaaccaagaatgctctgctgagagacccttacgccttgcgttccgtcaggcaccttattgacaattgcgcatttcggctctatggacactgggtgaagaaaggggagcaacagaaccgggctgctctattccagcacaggccaccgggcccgtttcctattatgggacctgaggaggagggcgactccgcagctatcactgaggacgaggccgttctggtgctaggc

SEQ ID NO: 18012 - DNA, 1218 bp, Artificial Sequence
  Description of Artificial Sequence: Synthetic coding sequence
atgacattggacgtgggccccgaggacgagctacctgactgggcagctgccaaggaattttaccagaaatatgatcccaaggacgtgatagggaggggcgtaagttccgtggtcagacgctgtgtacacagagctactgggcacgagttcgccgtgaagatcatggaggtcaccgcagagaggctgtctcccgagcagctagaggaggtgagggaggctacacgaagggaaacacatatcttgaggcaggttgctgggcacccccatattatcactctgatcgatagttatgaatcctcttcattcatgttccttgtgttcgacctaatgcgaaagggagaattgttcgactacctcactgaaaaggtcgcactttctgaaaaggaaactagatccatcatgcgatctctgctggaggccgtgagctttcttcatgccaacaatatcgtccatcgagatctcaagccagagaatatcctgctcgatgacaacatgcaaatcaggttgagcgattttggattctcctgccatctggagcccggtgaaaagctgagggagttgtgtggtaccccgggctatctggcacctgaaatcttgaaatgttctatggatgaaacacatccaggttacggcaaggaagtggacctctgggcttgcggcgttatcctctttaccctgctcgccggctcaccacccttttggcaccggcgacagatcctgatgttgcgaatgatcatggagggtcagtatcagttctcttcccccgaatgggatgacaggtcaagcactgtcaaagacctgatttcccggctcctgcaggtcgaccctgaagcgagactaacagccgagcaagcccttcagcacccattcttcgaaagatgcgagggttctcaaccctggaatctaaccccgcggcaacgttttagagtcgcagtgtggactgtcctcgccgccgggagggtggcactgagtactcacagagtaaggccactgactaagaatgcgctgctgcgagatccctacgccctcaggagcgtccgacatctcatcgataattgtgcgttccggttgtacggccactgggttaagaagggcgaacagcagaatcgagctgccctttttcagcaccgacctccagggccattccctatcatggggccagaagaggagggggactcggcggccatcacggaagacgaggcggtgcttgtcctggga

SEQ ID NO: 18013 - DNA, 1218 bp, Artificial Sequence
  Description of Artificial Sequence: Synthetic coding sequence
atgacactcgatgtcggacccgaggatgaacttcctgattgggcagcggctaaagaattctatcagaagtacgatcctaaagatgtaattggacggggagtcagtagtgttgtaaggaggtgtgtgcaccgggccactggacacgaatttgccgtgaaaatcatggaagtcactgccgaaagactgtcccccgagcagctcgaggaagtacgagaagcaactagaagggaaacacatatactgaggcaggtagccggacatccgcacataataacgcttatagactcctatgaatcctcctcatttatgttccttgtgtttgatcttatgcggaaaggggaactgtttgactatctgacagagaaagtcgcattgtccgaaaaagaaactcgaagtataatgagatctctcctcgaagcagtgagttttcttcacgcaaacaatattgtgcatagggatctcaaaccagaaaacatcctcctggatgataatatgcagattaggctttctgacttcgggttttcttgccacctggaaccaggagaaaaactgcgggaactttgtggaacacctgggtacctcgcgccagaaatcctcaaatgttccatggatgaaacacatcccgggtatggaaaggaagtagacctatgggcctgtggggtaatcctcttcacactgctggccgggtctccaccgttttggcaccgcagacagatcctaatgctgaggatgataatggaagggcagtatcagttttcctccccagaatgggatgatcgctcctcaactgtcaaggaccttatctccaggctcctacaggttgaccccgaagcacggctaacagctgaacaggctttacagcatccattttttgaaagatgtgaagggtcgcagccttggaatcttacaccaaggcagcggttccgggttgccgtttggactgtcctggccgccggaagagtggccctttctacacacagagtaagaccccttactaaaaatgctctcctccgggacccttacgccctgaggtctgttaggcacctcatagacaactgcgcttttaggctctatggacactgggtaaagaaaggagaacagcaaaatagagcagctctatttcagcatagacctcccgggccattcccaatcatgggacccgaagaggaaggagattcggcggccatcacagaagatgaggctgtgttagttcttgga

SEQ ID NO: 18014 - DNA, 1218 bp, Artificial Sequence
  Description of Artificial Sequence: Synthetic coding sequence
atgaccctcgacgtcggacctgaagatgaactgcccgactgggccgctgctaaggagttctatcaaaagtacgatccgaaggatgtgatcggtcgcggagtaagctccgtcgtgcggcgatgcgtgcatcgcgctaccggtcacgagttcgcggtcaagataatggaggtcaccgccgagcgtctctcccccgagcagttggaggaagttcgcgaggctacgcgtcgcgagacccacattctacgccaagtggctgggcacccccacatcattacccttattgatagctacgaaagtagcagcttcatgttcttggtcttcgacctgatgaggaagggcgagctgttcgactacttgaccgagaaggttgcgctctcggaaaaggagacccgctcaatcatgcggtccttgttggaggctgtttcgttcctgcatgctaacaatatagtccatagagacctgaagccggaaaacattcttttagacgacaacatgcaaatccgcctgtccgacttcggattcagttgtcaccttgagcctggagaaaagctccgcgagctttgtggcacgccaggctacctcgctcctgagatccttaagtgctccatggatgaaactcaccccggttacggaaaggaagtcgacctgtgggcctgtggtgtgatcctcttcacccttttagctggctcgcctccgttctggcaccgcagacagattctcatgctgcgtatgatcatggaaggccaataccagttctcgtcaccagagtgggacgaccgcagttccacagtcaaggacctaatttctcgcctgcttcaggtggaccccgaggcgcgtcttacagcggaacaggccctccagcaccctttcttcgagcggtgtgagggatcacagccgtggaatctcacccctcggcagcggttccgagttgctgtttggacggtcctcgcggccggtcgcgtggccttgtcaacccaccgggtccgccccttgactaagaatgctttgcttcgggacccctacgctcttaggagcgtccgccatctcatcgacaactgcgcgtttcgcctgtacggacactgggtgaaaaagggcgagcaacagaaccgtgccgcgttgttccagcaccgtccgcccggtcccttccctatcatgggcccggaagaggagggagactccgccgccattaccgaggacgaggctgttctggtccttggc

SEQ ID NO: 18015 - DNA, 1218 bp, Artificial Sequence
  Description of Artificial Sequence: Synthetic coding sequence
atgaccctggatgtggggcctgaggacgagcttcctgattgggctgcagctaaggaattttaccagaaatacgaccctaaggatgttatagggcggggcgtgtccagcgtagtccggcgctgcgtccacagagctactggccatgagttcgccgttaagatcatggaagtgactgcggagcgcctgagccccgaacagctggaagaggtcagggaagcaacaaggcgcgaaacccatatcttgaggcaggttgcaggacaccctcatatcataaccttgattgactcctacgaatcttcatctttcatgtttcttgtattcgaccttatgcggaaaggagagctgttcgattatttgaccgagaaggtcgccttgtctgagaaagaaacgcgctctataatgcgaagcctgctggaggccgtgtcattcctgcatgctaacaatatcgtgcacagagacctgaaacctgaaaacatccttctggatgataacatgcagatccgattgagtgacttcggattttcttgccacctggagcccggcgaaaagctgagggagctttgcggcactccggggtacctggcgcccgaaatcctcaaatgcagcatggacgaaacacatcctggctacgggaaggaggtggacctttgggcttgtggagttatactgtttaccttgctggccgggtcccctccgttctggcatcgacgccagattctgatgctcagaatgattatggagggccaataccaattcagctcccccgagtgggacgaccgctccagcaccgttaaagaccttataagcagattgctgcaggtagaccccgaagcccgactcacagcagaacaagctctgcagcatccattttttgagaggtgtgagggatcacagccatggaatctgactccaaggcagaggtttcgcgtagctgtgtggactgttctggctgccggaagggtggcactgtctactcatcgcgtgcgcccgctgaccaagaacgccctgctgcgggacccttacgccctgcggagcgtccgacatttgattgataactgcgccttccggctttatggacactgggtgaagaagggggaacagcagaaccgcgcggctttgtttcagcacagaccacctggacctttccctataatggggcccgaggaagagggggactccgcagcaattacggaggacgaggctgtcctggtgctcgga

SEQ ID NO: 18016 - DNA, 1218 bp, Artificial Sequence
  Description of Artificial Sequence: Synthetic coding sequence
atgaccctcgacgtcggtccagaggatgaactgcctgactgggcagctgccaaggaattctatcaaaagtatgacccaaaggatgtgataggaaggggtgtctcttccgttgtgagaaggtgcgtgcatagggctactggccatgaatttgccgtgaagataatggaagtaaccgccgagagattaagtcctgagcagctggaagaggtccgggaggccacaagacgcgaaacccatattctcagacaagtcgcaggccacccacatattatcaccctaatagactcctatgagagctccagcttcatgttccttgttttcgacctgatgagaaagggggagttgttcgattatctcacagagaaagtggcgctgtctgagaaggagacaagatcaattatgaggagcctgctcgaggcagtgtccttcttgcatgctaataacatcgtccatagagacctgaagcccgagaatatcctgttggatgacaacatgcagatcaggctaagtgattttggcttttcatgccatttggagcctggcgagaagctcagagagctatgcggcacacctggttatctggcacccgaaatcctcaagtgctctatggatgaaacccatcccggctatgggaaagaggtcgatttatgggcttgcggggttatcctctttacgctgttggcaggctcacctcccttttggcaccgccggcagatcctcatgctgcgaatgattatggaggggcagtaccagttcagctcccctgaatgggacgacaggagctcaaccgttaaagacctgataagtaggcttcttcaggtggatccagaggccaggttgactgccgagcaggctctgcagcaccctttttttgaaaggtgcgagggttcccagccatggaatttaacaccgcgtcagcgctttagagtggctgtgtggaccgtgcttgccgctggcagggtggcattgagcacccatagagtccgccccctgacaaagaacgctctgttgagggatccctacgccttgagatccgtgcgccaccttattgataattgtgcgttcagactgtacggacattgggtgaagaaaggggagcaacaaaatagagccgcactgtttcagcaccgacccccagggcccttccctatcatggggccagaggaggaaggggatagtgctgcaatcacagaggacgaagctgtccttgtgctgggt

SEQ ID NO: 18017 - DNA, 1218 bp, Artificial Sequence
  Description of Artificial Sequence: Synthetic coding sequence
atgactctcgacgttggcccagaagacgagcttccagattgggccgctgcgaaggaattctatcagaaatacgatccaaaggacgttattggacgtggtgtgtcaagtgtggttcgcaggtgcgtccaccgtgccaccggacatgagtttgcggtcaagataatggaagtgacggccgaacggctgtcccccgaacagctcgaagaagtcagagaagccactaggcgagagacacacatccttcgtcaggtagctggccatccgcatatcatcacactaattgattcatatgaatctagcagtttcatgttcctggtgtttgatctgatgcggaagggtgaactgtttgactatctcaccgagaaggttgcgctctcggaaaaagagacgagatctattatgcgctctctgctggaggccgtttcctttctgcatgccaacaacatagtgcatagggacctcaagcccgaaaatatactcctggatgataacatgcagattagactgagtgattttggcttcagctgccatctggagccgggtgaaaaactgagagagctctgtgggacacccggctatctagcccccgagatactgaagtgttccatggatgaaacacacccaggctatggaaaggaagttgacctgtgggcctgcggtgtgatcctgttcaccttactcgccgggtcccctccattttggcaccgcaggcagattctgatgttgcgtatgataatggaaggtcagtatcaattttccagtcctgagtgggacgacaggtcaagcacggtgaaagatctcatcagccgcttgttgcaagtcgatcctgaagccaggcttaccgccgaacaggctttacagcacccctttttcgagcgctgtgagggatcccagccgtggaatttgacacccaggcagagatttcgtgtggccgtgtggactgtgttagccgccgggagagtagccctatctacgcatagggtgcggcctctgaccaaaaacgccctcttaagggacccgtatgcactccggagtgtacggcaccttatagacaactgcgcttttcggctgtacgggcactgggttaaaaaaggcgagcagcaaaaccgagcagccctgttccagcatcgccctcccggacctttccctatcatgggaccggaggaggaaggcgactccgcggccattactgaagacgaggcggtgctcgtgctgggg

SEQ ID NO: 18018 - DNA, 1218 bp, Artificial Sequence
  Description of Artificial Sequence: Synthetic coding sequence
atgaccctcgacgtcggccctgaagacgagcttccagattgggccgccgccaaggaattttatcagaaatacgacccgaaggacgttatcggacgtggagtttcaagcgtggtccgtagatgcgtccatcgtgccaccggacatgaattcgcagtaaaaatcatggaggtgaccgcagagagactatcacctgaacaattggaagaagtgagggaggccaccaggcgagaaacccatatcctgcgtcaggtcgcaggccaccctcacatcatcacactcatagacagctacgaatcttctagttttatgtttctggtgtttgacttgatgaggaagggtgagttgtttgattatcttaccgagaaagtcgccctgtccgagaaggagacacgctcaatcatgcgctcattgctggaggctgtatcattcctgcacgcaaacaacattgtgcatcgagaccttaaacctgaaaatattctgctggacgataacatgcagatccggctgagcgatttcgggttcagctgtcacctggagccaggagaaaaactgcgcgaactctgcggcacaccaggatacctggctcctgagatccttaaatgcagcatggacgaaacccaccctggctacgggaaggaggtggacctgtgggcatgcggagtgatcctgtttactcttctagcggggagcccccctttttggcacagaaggcagattctgatgctgcgcatgatcatggaaggccaatatcaattcagtagccccgaatgggacgatcggtctagcaccgtgaaggacctgattagcaggttgctgcaagtcgacccggaagctcgactgaccgccgagcaagctttacaacatccatttttcgagcggtgtgagggatcccagccgtggaacttgaccccacgccagagatttagggtcgccgtatggaccgtgctggctgccggccgtgtcgcattatctacccatcgggtcagaccactgacgaaaaacgcactcctgagggatccctacgccttaaggagcgtcagacaccttatcgacaactgtgcctttcgactctacggacattgggtgaagaagggcgaacagcagaaccgggcggctcttttccagcatcgccctccaggcccatttcctatcatgggccccgaagaagaaggagattcagccgctatcacagaagatgaagccgtcctcgtccttggc

SEQ ID NO: 18019 - DNA, 1218 bp, Artificial Sequence
  Description of Artificial Sequence: Synthetic coding sequence
atgactcttgacgttggccccgaggatgagctgcctgactgggcagccgccaaagagttctaccagaagtatgatcccaaggacgtgataggccggggtgtgtcgtcggtggtacgccgatgcgtccatcgagctacgggtcatgagtttgccgtgaagattatggaagtgaccgctgagcgactcagtcctgagcagctggaggaggttcgtgaagcaacgcgacgcgagacccacatcctgcgccaagttgcgggacaccctcacattataaccctgatcgattcttatgagtcgtccagtttcatgttccttgtgtttgaccttatgcgcaaaggtgaactgttcgactatctcaccgaaaaggtcgcccttagtgagaaggagactcggtccatcatgcgttccctgttggaagcggtgagctttctacatgcgaataatatagtgcaccgtgacctgaagcctgagaatattctgcttgatgacaacatgcaaatcagactgagtgactttggcttttcctgccatctcgagcccggcgagaagcttagggagctgtgcggtactccggggtatctggccccagagatcctgaagtgctcgatggatgagactcaccccggatacggaaaagaggtcgatctgtgggcctgtggagtgattctctttaccctgctggcgggatccccaccgttttggcaccggcgacagattctgatgctgaggatgataatggaaggacaatatcagttttcgagccctgagtgggatgatagatcgtccactgtgaaggacctgattagccggcttctacaggtcgacccagaggcccgcctgaccgcagagcaggccctccagcatcccttctttgaacgctgcgagggctctcaaccctggaacctaacgccccgccagcggtttagggtggcggtttggacagtgttggctgccggccgcgtagcgcttagcacccaccgtgtccgaccactgacaaaaaatgccctactacgggatccatatgcgctgcgatcagtgcgtcatctgatcgataactgtgcattccggttgtacggccattgggtgaagaagggggagcagcaaaaccgggcggccctgttccaacataggccccccggcccctttcccattatgggccctgaggaagaaggcgactcagctgccatcaccgaggatgaggcagtgctagtactgggc

SEQ ID NO: 18020 - DNA, 1218 bp, Artificial Sequence
  Description of Artificial Sequence: Synthetic coding sequence
atgacgctggacgtcgggccggaggacgaacttcccgactgggcagccgcgaaggagttttaccagaaatatgatcccaaggacgtgatcgggcgcggtgtgagctcagtcgtgagacgctgcgtgcaccgcgcaaccggacatgaattcgcggtgaagatcatggaagtgaccgcagaacgcctctccccggagcagctcgaggaggttagggaagctacccgcagagaaacccatatcctgaggcaggtggccgggcatccgcacattatcaccctcatagactcgtacgaaagctcctccttcatgttcctggtgttcgatctcatgcgaaagggagaactgttcgactacctcactgaaaaagtggctctctcagaaaaggagactaggtcgattatgagatctctgctcgaagcagtctcgtttttgcacgctaataacatcgtgcacagagacttgaaaccagagaacatcttgctggacgataacatgcaaatccggctgtcagatttcggtttctcatgtcatcttgaaccgggggaaaagctgcgcgagctttgcggcactccgggatacctggcgccggagatcctcaaatgcagcatggacgagacgcatccgggatatggcaaggaagtcgatctgtgggcatgcggagtgatcctcttcaccctgttggctggctcaccgccattctggcatcggcgccaaatcctcatgctgagaatgattatggaaggacaataccaattcagctcaccggaatgggacgaccggtcatcgaccgtgaaggatctgatctccagactgctccaggtggaccctgaggcgagactcactgccgaacaggcgctgcaacacccgttcttcgaaaggtgcgaaggatcacagccgtggaatctgactccaagacagcggtttcgagtggccgtgtggaccgtcctcgcggccggacgggtcgccctctccacccaccgcgtgaggccgttgacgaagaatgcactcttgcgcgatccttacgcgctgagatcagtccgccaccttatcgataactgtgcctttcgactgtacggtcactgggttaagaaaggtgagcagcagaaccgcgccgcgctctttcagcaccggccaccgggtcccttcccaatcatgggaccagaggaggaaggggactcggccgctatcacggaggatgaggcggtgctggtgttggga

SEQ ID NO: 18021 - DNA, 1218 bp, Artificial Sequence
  Description of Artificial Sequence: Synthetic coding sequence
atgactcttgatgtcggtccggaggacgaactcccagattgggctgcagctaaggagttttatcaaaagtacgaccctaaggatgtcatcggccgaggggtgtcctcggtggttcgccggtgtgttcatagagccaccggacacgagtttgcagttaagattatggaggtgacggcagaacgactttcaccagagcagctggaagaagtgcgcgaggcgacccgccgcgagactcatatcctcagacaagtggcggggcatccgcacatcattaccctcattgatagctacgagagctcgtccttcatgtttctcgtgttcgatctgatgagaaagggagaacttttcgactaccttaccgaaaaagtggcactctcggaaaaggaaaccagaagcatcatgcgaagcctccttgaagcggtgtcctttctgcacgcaaacaatatcgtccatagagatcttaagccagaaaacattctgctggacgacaacatgcagattcggctgtcagatttcggtttcagctgtcaccttgaacctggcgagaaactgagagaactttgcggcactcctggatacttggcaccggaaattctgaaatgttcgatggacgaaactcatccaggatatggcaaggaagtcgatctttgggcgtgcggcgtgattcttttcacgcttctggccggctcgcctcctttttggcacagaaggcaaatcctcatgctcagaatgattatggaaggacagtaccagttttcctcgcctgagtgggacgacagatcttcgacggtgaaggaccttatctccaggctgctccaagtcgatccagaggcacgccttaccgcggaacaggcccttcaacacccattctttgagcgctgtgagggctcacagccatggaacctgactccacgacaacgctttagagtggcagtgtggaccgtccttgccgcaggacgtgtggccctgtcgactcatcgggtgcgccccctgaccaaaaacgcgctgcttagagatccatacgcacttagaagtgtgagacatctgattgataattgtgctttccgattgtacggacattgggtgaagaaaggagagcagcaaaacagggcagcactgtttcaacacagaccacctggcccatttccaattatgggaccagaagaagaaggcgactccgcagcaatcacggaagatgaggcggtcctggtgctcggg

SEQ ID NO: 18022 - DNA, 1218 bp, Artificial Sequence
  Description of Artificial Sequence: Synthetic coding sequence
atgacactcgatgttggccctgaagacgagcttcctgactgggctgccgccaaggagttttatcagaagtacgaccctaaggatgtgatcggccgtggagtgtccagcgtagtaagacgctgcgtccaccgcgctacaggccacgagttcgccgttaaaatcatggaggtaaccgccgagaggttgtctccagaacagctcgaggaagttagagaggctacaagacgtgaaactcacattctgcgccaggtggccggtcatcctcacattattactctgatcgacagttacgagagcagtagtttcatgttcctcgttttcgatctcatgagaaaaggcgagctgttcgactacctgaccgaaaaggtagccctgtctgagaaagaaacacgttcaattatgcgctctctgcttgaggcagtgtcctttctgcacgccaacaacattgtgcaccgtgacctgaagcctgagaatattttgctggatgacaatatgcaaatcaggctgagcgatttcggcttctcttgccatctcgaacccggtgaaaagttgcgtgagttgtgcggcaccccaggctacctcgccccagaaatcctgaaatgcagtatggatgagactcatcccggttacggcaaggaggtcgacctgtgggcatgtggtgtgatcttgttcacccttcttgctggttccccccctttctggcacagaagacagatcctcatgctcagaatgattatggaaggtcagtaccaattctcaagtcctgaatgggatgaccgctcatccactgtgaaggacctgatttctcgcctcttgcaggtggatcccgaagcacgcctgaccgccgaacaggccctgcagcacccatttttcgagcgctgcgagggatcccaaccctggaacctgaccccccgccagcgctttagagtcgctgtgtggacagtgctggccgccggaagagtagcactgtccacacaccgtgttcgcccactgactaaaaacgctctgctgagagacccctacgcactccgcagcgtcaggcacctcattgacaattgcgcctttaggctttacggtcattgggtcaagaaaggcgagcagcaaaatcgcgcagctctcttccagcaccgcccaccaggtccttttcccataatgggacccgaggaggaaggtgatagtgctgccatcactgaggacgaagctgtgctggtactgggc

SEQ ID NO: 18023 - DNA, 1218 bp, Artificial Sequence
  Description of Artificial Sequence: Synthetic coding sequence
atgactttggacgtgggcccagaagatgaactgcccgattgggctgcggccaaagaattttatcaaaagtatgatcccaaagatgtgatcggacgcggggtctcaagtgtggtacgcagatgcgtccaccgggcgacagggcacgagttcgctgtgaaaatcatggaggtcacagccgaacgtctgtcccctgagcagctggaggaggtgagggaagctacccgccgggagacccacatcctcaggcaggtggctggacacccccacatcatcacgctgatagatagctacgagtccagttctttcatgtttcttgtgttcgaccttatgagaaagggtgagctgtttgactatctgaccgagaaagttgctctgagtgagaaggagactagaagtatcatgcgctccctgctggaagcggtgtccttcttgcacgcgaataacatcgtccatcgcgacctgaagcccgagaacatccttctcgacgacaatatgcagattcgcctgtccgacttcggtttctcctgtcacctggagccaggggagaagctgcgggagctgtgcgggacgccgggatacctcgcccccgagattctcaagtgctcaatggacgaaacgcaccctggctacggcaaagaggtggacctctgggcttgcggtgttatattatttactttgctggccgggagcccgcccttctggcacaggcgtcagatcctgatgctgcgcatgatcatggagggacagtaccagttctcctcccccgagtgggacgaccgctcaagcacggtcaaagacctgatcagtagactactgcaggtggatcctgaggcccggttgactgcagaacaagccctgcagcaccctttttttgagcgctgcgaagggagtcagccttggaacctgactcctaggcagcggtttcgtgtcgccgtctggacggttctcgccgctggaagagtagccctctctactcatcgcgtgcgcccattaaccaaaaacgcattgttgcgtgacccctacgcgctgcgctccgtccggcaccttattgacaactgtgccttccgcctttatggtcactgggtaaaaaaaggagaacagcagaatcgagcagctctcttccaacaccggccccccggaccctttcccattatggggcccgaagaggagggcgacagtgctgccatcacagaagatgaagctgtgctcgtgctcggg

SEQ ID NO: 18024 - DNA, 1218 bp, Artificial Sequence
  Description of Artificial Sequence: Synthetic coding sequence
atgaccctcgatgttggaccagaggacgagctcccagactgggcggctgccaaggaattctaccagaagtacgatcctaaggatgtgatcggtagaggtgtcagcagcgtggtccggaggtgtgtgcaccgggccactgggcacgaatttgcagtgaagataatggaagtgactgcagaaagattgagccctgaacaactggaagaagtgagagaggcgactcgccgcgagactcatatccttcgccaggtcgcaggccacccacacataatcacccttatcgattcctatgaaagctcgtcgtttatgtttcttgtgtttgatctcatgcggaagggtgaactgtttgattatcttaccgaaaaagtggctctgtccgaaaaggaaactcgctccatcatgcgctcattgctggaagcagtgtccttcctccacgccaataacatcgtgcatagggatctgaagccagagaacattttgctggatgacaacatgcaaattcggctgtcagattttggtttttcgtgccacctggaacctggagagaaacttcgagaactttgtggtactccgggatacctggcacccgaaatcttgaagtgttccatggatgaaacccacccaggctacggtaaggaagtggatctctgggcctgtggagtgatactttttactcttctggcaggatcacctcctttttggcaccgcagacaaattcttatgctcaggatgataatggagggtcaataccaattttcatccccagaatgggatgacagaagctcgaccgtgaaggatctgatatccaggcttcttcaggtggatcctgaggcacgccttaccgcagaacaagcactgcagcatccttttttcgaaagatgtgagggctcgcagccctggaaccttactcctcgacagcgattccgcgtggccgtgtggaccgtgctcgcagcaggtcgggtggctctttctactcatagggtcaggccacttaccaagaacgcactgctgagggatccttacgctcttagatcggtccgacacctgatcgataactgcgcgttcagattgtacggacattgggtcaagaagggagagcagcagaatcgtgccgcactgttccaacacagacccccgggaccattccctattatggggccagaggaggagggtgatagcgcagccataactgaagatgaggcagtcctcgtgctgggt

SEQ ID NO: 18025 - DNA, 1218 bp, Artificial Sequence
  Description of Artificial Sequence: Synthetic coding sequence
atgactctggatgtgggtcctgaggacgaactcccggattgggccgcggctaaagagttctaccagaaatacgaccccaaagatgttattggtcgcggggtgtcatccgtggtgaggcgctgcgttcaccgggcgacggggcatgagttcgctgtcaagatcatggaagtgaccgctgaaagactgtcgccagagcagctcgaagaagtgcgggaggcgactagacgggagactcatatcctgagacaggtggcaggccacccacacatcataaccctcatcgacagctacgagtcatcttcgtttatgttcttggtgttcgatctgatgcgcaaaggcgagctgtttgattacctcactgaaaaagtggccctgtcagaaaaggagactagatccatcatgcgctcgctcctggaagccgtgtccttcctgcacgccaacaatatcgtgcaccgcgacttgaaacctgagaatattctgctggatgacaatatgcaaattcgcctgagcgatttcggattctcatgccatctggagccaggggaaaagctccgcgagttgtgcggcacgccgggataccttgctccggaaatcctcaaatgctccatggatgaaacccatcctggatacggaaaggaagtggacttgtgggcgtgcggagttattctgttcaccctgctcgcaggatccccaccgttttggcaccgccggcaaatcctgatgctgcgcatgataatggaaggccagtaccagttctcctcccccgaatgggatgaccggagctcgactgtgaaggacctcatctcgcggctgctgcaggttgacccggaggcccggctcactgccgagcaggcacttcaacatccgttttttgaacggtgtgaaggcagccagccgtggaatctcaccccaagacaacggttccgcgtggcagtgtggactgttctggcggctggaagggtggcgctgtcgactcaccgggtgcgcccgctgactaagaacgccctgctgcgggacccatacgccctgcgttcagtcagacacctgatcgacaactgtgcgttccgcttgtacggtcattgggtgaaaaagggagaacaacagaatagggcagcgctcttccagcaccgcccacctggaccgttcccgatcatggggccagaagaagaaggagactcagccgccattactgaggacgaagcggtgctcgtgctggga

SEQ ID NO: 18026 - DNA, 1218 bp, Artificial Sequence
  Description of Artificial Sequence: Synthetic coding sequence
atgactttggatgtggggcctgaagacgaattgcccgattgggctgctgccaaggagttctatcagaagtacgatcccaaggatgtaatcggtagaggtgtctcgtctgtggtgagaaggtgcgtccatcgagctacagggcacgagttcgcagttaagataatggaggttacggccgagaggctgtctccagaacagcttgaggaggtgagagaggccactagaagggaaacacatatattaaggcaggtggctggtcatccgcacattattacattgattgactcgtatgaaagctcgtctttcatgtttttggttttcgacttgatgagaaaaggagaactgttcgattacttaaccgaaaaggttgccctttcagagaaggagacccgcagcattatgcgctcccttctagaagcagtgtctttccttcatgctaataatatcgtgcatcgtgatttaaaaccagaaaacattttgttagatgacaacatgcaaatcaggctttcagattttggattctcttgtcatctggagcctggtgaaaaacttcgtgaactttgcggtacacccgggtatcttgcgcctgaaatcttgaagtgctcgatggacgagactcatcctggctacggaaaagaagttgacctgtgggcttgtggagttattctgtttactttgttagctggaagtcctcctttttggcacagaagacagattttaatgttgaggatgattatggaaggtcaatatcaatttagttcaccagagtgggatgaccgttcttccacagtgaaggatttgatctctcgattactccaggttgatcctgaggctaggttgactgctgaacaagcacttcaacatccattcttcgagcgttgcgagggatcacagccttggaacctaacccctcgccagagattcagggttgctgtttggactgtactcgctgctggccgtgttgcactatcgactcatagggtacgacctcttaccaagaacgcactccttcgggatccttacgctttgcgttcagtgcgtcatctgattgataactgcgcttttagactctacggccattgggtgaaaaagggagagcaacaaaatcgggcagctctctttcaacatcgacccccaggaccttttcctattatggggcctgaggaggaaggagattcagctgctattaccgaggatgaagcagtacttgttttggga

SEQ ID NO: 18027 - DNA, 1218 bp, Artificial Sequence
  Description of Artificial Sequence: Synthetic coding sequence
atgaccctggacgttggccccgaggacgaactccctgattgggcggcagcaaaagaattctatcagaaatatgatccaaaggacgtgatcgggagaggcgtgtcctcggttgtacggcggtgcgtgcacagggctaccggtcatgagtttgcggttaaaattatggaggtgacagccgaaagactttcacccgagcagttggaggaggtgcgagaagccactcggagagagacccatatattgcgtcaggtggcggggcatccacacattatcacgctgatcgatagctacgagagctcaagcttcatgttcctcgtgtttgatttgatgcgcaagggagaactgttcgactatctcaccgagaaggtcgctctgagcgaaaaggagactagaagcattatgcgatccctgttggaggcagtgagcttcttgcacgccaataatatcgtgcaccgagacttaaaacctgagaacatcctcctggatgacaacatgcagatacgcttgagcgacttcgggtttagttgccacctggagccaggggagaagttacgggagctgtgcggaacacccggttatttggcgccagagattctgaaatgttccatggatgagactcacccaggttatggcaaagaggtggatctgtgggcctgcggggtaattctgtttaccctgttagcaggaagcccccccttctggcataggagacagatcctgatgttgagaatgatcatggaagggcagtaccagttctcatccccagagtgggacgataggagctccaccgttaaggacctgatcagtcgtctcctccaagtcgatccagaggcccgactaaccgccgagcaggctctgcagcacccttttttcgaacgttgcgaaggctctcaaccttggaatttgactccgcgacaaagattccgggtagcagtgtggacagtcctggccgcaggtagggtcgcactgagcacccaccgcgtgagaccacttacaaagaacgcgctgctacgcgacccatacgcccttaggtcagtgcggcacttgatagacaactgcgcctttagactctacggtcactgggttaagaagggagaacaacaaaaccgtgcagcgttgttccagcaccgcccacccggccccttcccaatcatgggaccggaagaggagggggacagtgctgccatcactgaagatgaagctgtgttagtgttaggt
